United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 20

SEQ ID NO: 756090 - RNA, 21 nt, Leptospira interrogans serovar lai str. 56601
gccgucuauaaaauucaaaaa

SEQ ID NO: 756091 - RNA, 12 nt, Leptospira interrogans serovar lai str. 56601
gcccuccuaugu

SEQ ID NO: 756092 - RNA, 15 nt, Leptospira interrogans serovar lai str. 56601
gcccuccuauguuuc

SEQ ID NO: 756093 - RNA, 19 nt, Leptospira interrogans serovar lai str. 56601
gcccuccuauguuucuugu

SEQ ID NO: 756094 - RNA, 17 nt, Leptospira interrogans serovar lai str. 56601
gcccauucuuuccccaa

SEQ ID NO: 756095 - RNA, 17 nt, Leptospira interrogans serovar lai str. 56601
gccccaaaauuuagaau

SEQ ID NO: 756096 - RNA, 16 nt, Leptospira interrogans serovar lai str. 56601
gccccacccaaaaaua

SEQ ID NO: 756097 - RNA, 17 nt, Leptospira interrogans serovar lai str. 56601
gccccauucuuuuugcc

SEQ ID NO: 756098 - RNA, 22 nt, Leptospira interrogans serovar lai str. 56601
gccaugccaaacacgaauuccu

SEQ ID NO: 756099 - RNA, 19 nt, Leptospira interrogans serovar lai str. 56601
uagaacgugucauguuuua

SEQ ID NO: 756100 - RNA, 17 nt, Leptospira interrogans serovar lai str. 56601
uagaacuuuucuggauu

SEQ ID NO: 756101 - RNA, 17 nt, Leptospira interrogans serovar lai str. 56601
uagaacuguugaaaaaa

SEQ ID NO: 756102 - RNA, 22 nt, Leptospira interrogans serovar lai str. 56601
uagaacuguugaaaaaauccau

SEQ ID NO: 756103 - RNA, 16 nt, Leptospira interrogans serovar lai str. 56601
uagaacuagaaagacc

SEQ ID NO: 756104 - RNA, 22 nt, Leptospira interrogans serovar lai str. 56601
uagaacucacguuaaauagaaa

SEQ ID NO: 756105 - RNA, 14 nt, Leptospira interrogans serovar lai str. 56601
uagaaccuggauuu

SEQ ID NO: 756106 - RNA, 17 nt, Leptospira interrogans serovar lai str. 56601
uagaauaaauuauacaa

SEQ ID NO: 756107 - RNA, 14 nt, Leptospira interrogans serovar lai str. 56601
uagaauaaagagaa

SEQ ID NO: 756108 - RNA, 15 nt, Leptospira interrogans serovar lai str. 56601
uagaagccaaugugc

SEQ ID NO: 756109 - RNA, 19 nt, Leptospira interrogans serovar lai str. 56601
uagaagcaauaaaaucaau

SEQ ID NO: 756110 - RNA, 16 nt, Leptospira interrogans serovar lai str. 56601
uagaauuuuaugauuu

SEQ ID NO: 756111 - RNA, 20 nt, Leptospira interrogans serovar lai str. 56601
uagaauuuuaugauuuucuu

SEQ ID NO: 756112 - RNA, 16 nt, Leptospira interrogans serovar lai str. 56601
uagaauuuguucuuaa

SEQ ID NO: 756113 - RNA, 18 nt, Leptospira interrogans serovar lai str. 56601
uagaauuuguuuguaaaa

SEQ ID NO: 756114 - RNA, 22 nt, Leptospira interrogans serovar lai str. 56601
uagaauuuguuuguaaaauagu

SEQ ID NO: 756115 - RNA, 18 nt, Leptospira interrogans serovar lai str. 56601
uagaauuuguuuuuaaaa

SEQ ID NO: 756116 - RNA, 24 nt, Leptospira interrogans serovar lai str. 56601
uagaauuuucuaaagauucuugau

SEQ ID NO: 756117 - RNA, 14 nt, Leptospira interrogans serovar lai str. 56601
uagaauuuuuauga

SEQ ID NO: 756118 - RNA, 14 nt, Leptospira interrogans serovar lai str. 56601
uagaauuuuucgaa

SEQ ID NO: 756119 - RNA, 21 nt, Leptospira interrogans serovar lai str. 56601
uagaauuuuuguagaauugaa

SEQ ID NO: 756120 - RNA, 23 nt, Leptospira interrogans serovar lai str. 56601
uagaauuuuuguagaauugaaag

SEQ ID NO: 756121 - RNA, 22 nt, Leptospira interrogans serovar lai str. 56601
uagaauuuauucguaaaaucuu

SEQ ID NO: 756122 - RNA, 18 nt, Leptospira interrogans serovar lai str. 56601
uagaauuuauuuguaaaa

SEQ ID NO: 756123 - RNA, 15 nt, Leptospira interrogans serovar lai str. 56601
uagaauuuauuuuca

SEQ ID NO: 756124 - RNA, 17 nt, Leptospira interrogans serovar lai str. 56601
uagaauuuauuuucaua

SEQ ID NO: 756125 - RNA, 22 nt, Leptospira interrogans serovar lai str. 56601
uagaauuguguuaguucccaca

SEQ ID NO: 756126 - RNA, 17 nt, Leptospira interrogans serovar lai str. 56601
uagaauuguugaaaaac

SEQ ID NO: 756127 - RNA, 17 nt, Leptospira interrogans serovar lai str. 56601
uagaauuguugaaaaau

SEQ ID NO: 756128 - RNA, 20 nt, Leptospira interrogans serovar lai str. 56601
uagaauuguugaaaaauuaa

SEQ ID NO: 756129 - RNA, 21 nt, Leptospira interrogans serovar lai str. 56601
uagaauuguugaaaaauuaau

SEQ ID NO: 756130 - RNA, 21 nt, Leptospira interrogans serovar lai str. 56601
uagaauuguugaaaaauuuau

SEQ ID NO: 756131 - RNA, 18 nt, Leptospira interrogans serovar lai str. 56601
uagaaucaaaaugaacuc

SEQ ID NO: 756132 - RNA, 23 nt, Leptospira interrogans serovar lai str. 56601
uagaaucaaaaugaacucaacag

SEQ ID NO: 756133 - RNA, 15 nt, Leptospira interrogans serovar lai str. 56601
uagaauauuaugaaa

SEQ ID NO: 756134 - RNA, 17 nt, Leptospira interrogans serovar lai str. 56601
uagaauauuaugaaaua

SEQ ID NO: 756135 - RNA, 20 nt, Leptospira interrogans serovar lai str. 56601
uagaauauuaugaaauaaag

SEQ ID NO: 756136 - RNA, 15 nt, Leptospira interrogans serovar lai str. 56601
uagaauauuuucuca

SEQ ID NO: 756137 - RNA, 12 nt, Leptospira interrogans serovar lai str. 56601
uagaaucagaau

SEQ ID NO: 756138 - RNA, 19 nt, Leptospira interrogans serovar lai str. 56601
uagaauagagucuuuaaaa

SEQ ID NO: 756139 - RNA, 11 nt, Leptospira interrogans serovar lai str. 56601
uagaauauaca

SEQ ID NO: 756140 - RNA, 22 nt, Leptospira interrogans serovar lai str. 56601
uagaauauacaacuuuuuuaau

SEQ ID NO: 756141 - RNA, 19 nt, Leptospira interrogans serovar lai str. 56601
uagaaucugaacuuuauag

SEQ ID NO: 756142 - RNA, 20 nt, Leptospira interrogans serovar lai str. 56601
uagaaucugaacuuuauaga

SEQ ID NO: 756143 - RNA, 19 nt, Leptospira interrogans serovar lai str. 56601
uagaaucuagacguaauuu

SEQ ID NO: 756144 - RNA, 15 nt, Leptospira interrogans serovar lai str. 56601
uagaaucaucucaaa

SEQ ID NO: 756145 - RNA, 17 nt, Leptospira interrogans serovar lai str. 56601
uagaaucaucucaaaaa

SEQ ID NO: 756146 - RNA, 23 nt, Leptospira interrogans serovar lai str. 56601
uagaauccaaugcgaaauagauu

SEQ ID NO: 756147 - RNA, 20 nt, Leptospira interrogans serovar lai str. 56601
uagaaucuaaacuuacagau

SEQ ID NO: 756148 - RNA, 21 nt, Leptospira interrogans serovar lai str. 56601
uagaaucuaaacuuuacagau

SEQ ID NO: 756149 - RNA, 19 nt, Leptospira interrogans serovar lai str. 56601
uacuacuuuuagaaaaaau

SEQ ID NO: 756150 - RNA, 19 nt, Leptospira interrogans serovar lai str. 56601
uacuacuuuucugaaaaac

SEQ ID NO: 756151 - RNA, 12 nt, Leptospira interrogans serovar lai str. 56601
uacuagaacaau

SEQ ID NO: 756152 - RNA, 20 nt, Leptospira interrogans serovar lai str. 56601
uacuacuuaaacguauaaaa

SEQ ID NO: 756153 - RNA, 13 nt, Leptospira interrogans serovar lai str. 56601
uacuauaaacaua

SEQ ID NO: 756154 - RNA, 14 nt, Leptospira interrogans serovar lai str. 56601
uacuauaaacuucu

SEQ ID NO: 756155 - RNA, 22 nt, Leptospira interrogans serovar lai str. 56601
uacuauaaacuucucuuaaaau

SEQ ID NO: 756156 - RNA, 14 nt, Leptospira interrogans serovar lai str. 56601
uacuauaaauuacu

SEQ ID NO: 756157 - RNA, 17 nt, Leptospira interrogans serovar lai str. 56601
uacuauaacuuuaaaaa

SEQ ID NO: 756158 - RNA, 14 nt, Leptospira interrogans serovar lai str. 56601
uagaaacaaaugga

SEQ ID NO: 756159 - RNA, 15 nt, Leptospira interrogans serovar lai str. 56601
uagaaacaaggcuuu

SEQ ID NO: 756160 - RNA, 13 nt, Leptospira interrogans serovar lai str. 56601
uagaaaauucaaa

SEQ ID NO: 756161 - RNA, 14 nt, Leptospira interrogans serovar lai str. 56601
uagaaaauucaaaa

SEQ ID NO: 756162 - RNA, 22 nt, Leptospira interrogans serovar lai str. 56601
uagaaaccaguaauaguuugua

SEQ ID NO: 756163 - RNA, 22 nt, Leptospira interrogans serovar lai str. 56601
uagaaacuuauacuuuauagaa

SEQ ID NO: 756164 - RNA, 23 nt, Leptospira interrogans serovar lai str. 56601
uagaaacuuauacuuuauagaaa

SEQ ID NO: 756165 - RNA, 20 nt, Leptospira interrogans serovar lai str. 56601
uagaaacggugcauuuaaaa

SEQ ID NO: 756166 - RNA, 22 nt, Leptospira interrogans serovar lai str. 56601
uagaaacggugcauuuaaaaaa

SEQ ID NO: 756167 - RNA, 18 nt, Leptospira interrogans serovar lai str. 56601
uacuaugaaauacaaaaa

SEQ ID NO: 756168 - RNA, 22 nt, Leptospira interrogans serovar lai str. 56601
uacuaugaagacgcuuaaaaau

SEQ ID NO: 756169 - RNA, 15 nt, Leptospira interrogans serovar lai str. 56601
uagaaaguuauuuua

SEQ ID NO: 756170 - RNA, 17 nt, Leptospira interrogans serovar lai str. 56601
uagaaauacuuaaaaug

SEQ ID NO: 756171 - RNA, 20 nt, Leptospira interrogans serovar lai str. 56601
uagaaauacuuaaaaugaga

SEQ ID NO: 756172 - RNA, 16 nt, Leptospira interrogans serovar lai str. 56601
uagaaauacuucucca

SEQ ID NO: 756173 - RNA, 20 nt, Leptospira interrogans serovar lai str. 56601
uagaaauauuuagaauaaaa

SEQ ID NO: 756174 - RNA, 17 nt, Leptospira interrogans serovar lai str. 56601
uagaaauacauaaauga

SEQ ID NO: 756175 - RNA, 22 nt, Leptospira interrogans serovar lai str. 56601
uagaaagaauuuucuaaaagua

SEQ ID NO: 756176 - RNA, 18 nt, Leptospira interrogans serovar lai str. 56601
uagaaauguaggaacuca

SEQ ID NO: 756177 - RNA, 15 nt, Leptospira interrogans serovar lai str. 56601
uagaaauucuauuuu

SEQ ID NO: 756178 - RNA, 21 nt, Leptospira interrogans serovar lai str. 56601
uagaaauuuauaauauucuuu

SEQ ID NO: 756179 - RNA, 13 nt, Leptospira interrogans serovar lai str. 56601
uagaaauuugauu

SEQ ID NO: 756180 - RNA, 17 nt, Leptospira interrogans serovar lai str. 56601
uagaaaucaauggaaaa

SEQ ID NO: 756181 - RNA, 22 nt, Leptospira interrogans serovar lai str. 56601
uagaaaucaauggaaaauuaau

SEQ ID NO: 756182 - RNA, 21 nt, Leptospira interrogans serovar lai str. 56601
uagaaaugauuuuuuaaaaua

SEQ ID NO: 756183 - RNA, 22 nt, Leptospira interrogans serovar lai str. 56601
uagaaaugauuuuuuaaaauaa

SEQ ID NO: 756184 - RNA, 19 nt, Leptospira interrogans serovar lai str. 56601
uagaaaucgauuuguaaaa

SEQ ID NO: 756185 - RNA, 14 nt, Leptospira interrogans serovar lai str. 56601
uagaaauuuuuaau

SEQ ID NO: 756186 - RNA, 18 nt, Leptospira interrogans serovar lai str. 56601
uagaaauuuuuaauaaaa

SEQ ID NO: 756187 - RNA, 19 nt, Leptospira interrogans serovar lai str. 56601
uagaaauuuuuaauaaaau

SEQ ID NO: 756188 - RNA, 21 nt, Leptospira interrogans serovar lai str. 56601
uagaaauuuuuaaucaaaugc

SEQ ID NO: 756189 - RNA, 19 nt, Leptospira interrogans serovar lai str. 56601
uagaaauuuucaaaaaaua

SEQ ID NO: 756190 - RNA, 15 nt, Leptospira interrogans serovar lai str. 56601
uagaacagaaugucu

SEQ ID NO: 756191 - RNA, 15 nt, Leptospira interrogans serovar lai str. 56601
uagaaccaucucaaa

SEQ ID NO: 756192 - RNA, 17 nt, Leptospira interrogans serovar lai str. 56601
uagaaccaucucaaaaa

SEQ ID NO: 756193 - RNA, 18 nt, Leptospira interrogans serovar lai str. 56601
uagaguaccauaaauuuu

SEQ ID NO: 756194 - RNA, 18 nt, Leptospira interrogans serovar lai str. 56601
uagaguaaauuuugaaaa

SEQ ID NO: 756195 - RNA, 21 nt, Leptospira interrogans serovar lai str. 56601
uagaguucugaaaucuuagga

SEQ ID NO: 756196 - RNA, 15 nt, Leptospira interrogans serovar lai str. 56601
uagaguuguugaaaa

SEQ ID NO: 756197 - RNA, 17 nt, Leptospira interrogans serovar lai str. 56601
uagaguuguugaaaaau

SEQ ID NO: 756198 - RNA, 19 nt, Leptospira interrogans serovar lai str. 56601
uagaguuguugaaaaauua

SEQ ID NO: 756199 - RNA, 17 nt, Leptospira interrogans serovar lai str. 56601
uagaguuucuaaaaaaa

SEQ ID NO: 756200 - RNA, 18 nt, Leptospira interrogans serovar lai str. 56601
uagaguuugaguuucuuu

SEQ ID NO: 756201 - RNA, 23 nt, Leptospira interrogans serovar lai str. 56601
uagaguguugacucuuuugagaa

SEQ ID NO: 756202 - RNA, 17 nt, Leptospira interrogans serovar lai str. 56601
uagagugccaaaauuuu

SEQ ID NO: 756203 - RNA, 20 nt, Leptospira interrogans serovar lai str. 56601
uagagugccaaaauuuugcu

SEQ ID NO: 756204 - RNA, 13 nt, Leptospira interrogans serovar lai str. 56601
uagaguuauugaa

SEQ ID NO: 756205 - RNA, 14 nt, Leptospira interrogans serovar lai str. 56601
uagauacaauuaaa

SEQ ID NO: 756206 - RNA, 22 nt, Leptospira interrogans serovar lai str. 56601
uagauaauuuuuacucaaagaa

SEQ ID NO: 756207 - RNA, 23 nt, Leptospira interrogans serovar lai str. 56601
uagauaauuaaacaaagaauaaa

SEQ ID NO: 756208 - RNA, 19 nt, Leptospira interrogans serovar lai str. 56601
uagauaaggcuaaagaaua

SEQ ID NO: 756209 - RNA, 18 nt, Leptospira interrogans serovar lai str. 56601
uagauaagagacaaauau

SEQ ID NO: 756210 - RNA, 20 nt, Leptospira interrogans serovar lai str. 56601
uagauaagagacaaauauuu

SEQ ID NO: 756211 - RNA, 19 nt, Leptospira interrogans serovar lai str. 56601
uagagccaaauuuuuagag

SEQ ID NO: 756212 - RNA, 21 nt, Leptospira interrogans serovar lai str. 56601
uagagccaaauuuuuagagug

SEQ ID NO: 756213 - RNA, 13 nt, Leptospira interrogans serovar lai str. 56601
uagagauugauau

SEQ ID NO: 756214 - RNA, 18 nt, Leptospira interrogans serovar lai str. 56601
uagagauugauauucaaa

SEQ ID NO: 756215 - RNA, 13 nt, Leptospira interrogans serovar lai str. 56601
uagagagugaaaa

SEQ ID NO: 756216 - RNA, 14 nt, Leptospira interrogans serovar lai str. 56601
uagagagugaaaaa

SEQ ID NO: 756217 - RNA, 13 nt, Leptospira interrogans serovar lai str. 56601
uagaggauaaacu

SEQ ID NO: 756218 - RNA, 15 nt, Leptospira interrogans serovar lai str. 56601
uagaggcuuuacauu

SEQ ID NO: 756219 - RNA, 13 nt, Leptospira interrogans serovar lai str. 56601
uagacauuguuuu

SEQ ID NO: 756220 - RNA, 21 nt, Leptospira interrogans serovar lai str. 56601
uagaccaauuuuuuuguaaaa

SEQ ID NO: 756221 - RNA, 21 nt, Leptospira interrogans serovar lai str. 56601
uagaccaggccaccgcaagaa

SEQ ID NO: 756222 - RNA, 12 nt, Leptospira interrogans serovar lai str. 56601
uagacuggcuuc

SEQ ID NO: 756223 - RNA, 18 nt, Leptospira interrogans serovar lai str. 56601
uagacuaacgauuguaaa

SEQ ID NO: 756224 - RNA, 19 nt, Leptospira interrogans serovar lai str. 56601
uagacuaacgauuguaaaa

SEQ ID NO: 756225 - RNA, 19 nt, Leptospira interrogans serovar lai str. 56601
uagacguaggaaaugaaaa

SEQ ID NO: 756226 - RNA, 13 nt, Leptospira interrogans serovar lai str. 56601
uagagaauuugug

SEQ ID NO: 756227 - RNA, 21 nt, Leptospira interrogans serovar lai str. 56601
uagagaauuuguguuguaugu

SEQ ID NO: 756228 - RNA, 20 nt, Leptospira interrogans serovar lai str. 56601
uagagaauuuucuuauugaa

SEQ ID NO: 756229 - RNA, 15 nt, Leptospira interrogans serovar lai str. 56601
uagagaaguuaaaaa

SEQ ID NO: 756230 - RNA, 20 nt, Leptospira interrogans serovar lai str. 56601
uagagacgaauuuuuuagaa

SEQ ID NO: 756231 - RNA, 22 nt, Leptospira interrogans serovar lai str. 56601
uagagaacgaugcuugagcucc

SEQ ID NO: 756232 - RNA, 14 nt, Leptospira interrogans serovar lai str. 56601
uaggcgauuuuucg

SEQ ID NO: 756233 - RNA, 21 nt, Leptospira interrogans serovar lai str. 56601
uagggaaaguuuuuuaaaaaa

SEQ ID NO: 756234 - RNA, 18 nt, Leptospira interrogans serovar lai str. 56601
uagggaucgaucuguaaa

SEQ ID NO: 756235 - RNA, 21 nt, Leptospira interrogans serovar lai str. 56601
uaggaacucauacuucuaaaa

SEQ ID NO: 756236 - RNA, 23 nt, Leptospira interrogans serovar lai str. 56601
uaggaacucuuacuuugagaaaa

SEQ ID NO: 756237 - RNA, 22 nt, Leptospira interrogans serovar lai str. 56601
uaggaacugcuuccaaaaaaag

SEQ ID NO: 756238 - RNA, 23 nt, Leptospira interrogans serovar lai str. 56601
uaggaacugcuuccaaaaaaagu

SEQ ID NO: 756239 - RNA, 14 nt, Leptospira interrogans serovar lai str. 56601
uaggaacuuuuaua

SEQ ID NO: 756240 - RNA, 15 nt, Leptospira interrogans serovar lai str. 56601
uaggaagaaacaaag

SEQ ID NO: 756241 - RNA, 18 nt, Leptospira interrogans serovar lai str. 56601
uaggaacccauacaaaau

SEQ ID NO: 756242 - RNA, 22 nt, Leptospira interrogans serovar lai str. 56601
uaggaacccauacaaaauuuaa

SEQ ID NO: 756243 - RNA, 21 nt, Leptospira interrogans serovar lai str. 56601
uaggaacuaccgcaaaucaag

SEQ ID NO: 756244 - RNA, 22 nt, Leptospira interrogans serovar lai str. 56601
uaggaacuacuacuuuuagaaa

SEQ ID NO: 756245 - RNA, 15 nt, Leptospira interrogans serovar lai str. 56601
uaggaacuacugcau

SEQ ID NO: 756246 - RNA, 17 nt, Leptospira interrogans serovar lai str. 56601
uaggaucaguaguucuc

SEQ ID NO: 756247 - RNA, 18 nt, Leptospira interrogans serovar lai str. 56601
uaggaucguauuuuagaa

SEQ ID NO: 756248 - RNA, 17 nt, Leptospira interrogans serovar lai str. 56601
uagcuaagucuuuaaaa

SEQ ID NO: 756249 - RNA, 15 nt, Leptospira interrogans serovar lai str. 56601
uaggaaauaauuccu

SEQ ID NO: 756250 - RNA, 15 nt, Leptospira interrogans serovar lai str. 56601
uaggaaaugaaaaag

SEQ ID NO: 756251 - RNA, 16 nt, Leptospira interrogans serovar lai str. 56601
uagauauuaguaaaac

SEQ ID NO: 756252 - RNA, 20 nt, Leptospira interrogans serovar lai str. 56601
uagauagguucuuagaacuu

SEQ ID NO: 756253 - RNA, 22 nt, Leptospira interrogans serovar lai str. 56601
uagauagguucuuagaacuuac

SEQ ID NO: 756254 - RNA, 15 nt, Leptospira interrogans serovar lai str. 56601
uagaucugauauuuu

SEQ ID NO: 756255 - RNA, 17 nt, Leptospira interrogans serovar lai str. 56601
uagccaaaaauuagaau

SEQ ID NO: 756256 - RNA, 22 nt, Leptospira interrogans serovar lai str. 56601
uagcaguucuacuuuauuaaaa

SEQ ID NO: 756257 - RNA, 23 nt, Leptospira interrogans serovar lai str. 56601
uagcaguucuacuuuauuaaaaa

SEQ ID NO: 756258 - RNA, 17 nt, Leptospira interrogans serovar lai str. 56601
uagccaguguaaacggu

SEQ ID NO: 756259 - RNA, 15 nt, Leptospira interrogans serovar lai str. 56601
uagccaaguauaaaa

SEQ ID NO: 756260 - RNA, 17 nt, Leptospira interrogans serovar lai str. 56601
uagccaucggaauuccu

SEQ ID NO: 756261 - RNA, 19 nt, Leptospira interrogans serovar lai str. 56601
uagccaucggaauuccucc

SEQ ID NO: 756262 - RNA, 21 nt, Leptospira interrogans serovar lai str. 56601
uaucucuugucagaccuaaaa

SEQ ID NO: 756263 - RNA, 23 nt, Leptospira interrogans serovar lai str. 56601
uaucucuugucagaccuaaaauu

SEQ ID NO: 756264 - RNA, 19 nt, Leptospira interrogans serovar lai str. 56601
uaucuuauuauuuaacgug

SEQ ID NO: 756265 - RNA, 12 nt, Leptospira interrogans serovar lai str. 56601
uaucuuaaugua

SEQ ID NO: 756266 - RNA, 22 nt, Leptospira interrogans serovar lai str. 56601
uaucuuaauguaaaguucuuuu

SEQ ID NO: 756267 - RNA, 15 nt, Leptospira interrogans serovar lai str. 56601
uaucuuaauuaaaaa

SEQ ID NO: 756268 - RNA, 17 nt, Leptospira interrogans serovar lai str. 56601
uaucuuaauuaaaaaau

SEQ ID NO: 756269 - RNA, 16 nt, Leptospira interrogans serovar lai str. 56601
uaucuuagaauuguug

SEQ ID NO: 756270 - RNA, 23 nt, Leptospira interrogans serovar lai str. 56601
uaucuuaauauaauaauuccguu

SEQ ID NO: 756271 - RNA, 13 nt, Leptospira interrogans serovar lai str. 56601
uaucuguaaaauu

SEQ ID NO: 756272 - RNA, 12 nt, Leptospira interrogans serovar lai str. 56601
uaucuauaaaau

SEQ ID NO: 756273 - RNA, 14 nt, Leptospira interrogans serovar lai str. 56601
uaucuaauauuuuu

SEQ ID NO: 756274 - RNA, 15 nt, Leptospira interrogans serovar lai str. 56601
uaucgauuuaaaaac

SEQ ID NO: 756275 - RNA, 15 nt, Leptospira interrogans serovar lai str. 56601
uaucuaaauauugau

SEQ ID NO: 756276 - RNA, 18 nt, Leptospira interrogans serovar lai str. 56601
uaucuaaagcuugauuau

SEQ ID NO: 756277 - RNA, 17 nt, Leptospira interrogans serovar lai str. 56601
uaucauguuuuauauaa

SEQ ID NO: 756278 - RNA, 13 nt, Leptospira interrogans serovar lai str. 56601
uauccgaaaaauu

SEQ ID NO: 756279 - RNA, 22 nt, Leptospira interrogans serovar lai str. 56601
uauccuuacgaugucuuuucaa

SEQ ID NO: 756280 - RNA, 18 nt, Leptospira interrogans serovar lai str. 56601
uauccuuaaaaugaaaau

SEQ ID NO: 756281 - RNA, 19 nt, Leptospira interrogans serovar lai str. 56601
uauccuuaaaaugaaaauu

SEQ ID NO: 756282 - RNA, 14 nt, Leptospira interrogans serovar lai str. 56601
uauccuuaugaaag

SEQ ID NO: 756283 - RNA, 18 nt, Leptospira interrogans serovar lai str. 56601
uauccuugggauaaauau

SEQ ID NO: 756284 - RNA, 21 nt, Leptospira interrogans serovar lai str. 56601
uaucgaauuucuucauaaaau

SEQ ID NO: 756285 - RNA, 22 nt, Leptospira interrogans serovar lai str. 56601
uaucgaauuucuucauaaaauc

SEQ ID NO: 756286 - RNA, 23 nt, Leptospira interrogans serovar lai str. 56601
uaucgaauggaaaucuuuuaaaa

SEQ ID NO: 756287 - RNA, 18 nt, Leptospira interrogans serovar lai str. 56601
uaucgaauggaauuuauu

SEQ ID NO: 756288 - RNA, 13 nt, Leptospira interrogans serovar lai str. 56601
uauauuuauaaaa

SEQ ID NO: 756289 - RNA, 17 nt, Leptospira interrogans serovar lai str. 56601
uauauugguuauaccaa

SEQ ID NO: 756290 - RNA, 22 nt, Leptospira interrogans serovar lai str. 56601
uaucaauccuguaaauucaaaa

SEQ ID NO: 756291 - RNA, 12 nt, Leptospira interrogans serovar lai str. 56601
uaucaauagaaa

SEQ ID NO: 756292 - RNA, 18 nt, Leptospira interrogans serovar lai str. 56601
uaucacaaaaaugaaaaa

SEQ ID NO: 756293 - RNA, 21 nt, Leptospira interrogans serovar lai str. 56601
uaucacaaaaaugaaaaaacu

SEQ ID NO: 756294 - RNA, 21 nt, Leptospira interrogans serovar lai str. 56601
uaucacaaaucacaauuuuaa

SEQ ID NO: 756295 - RNA, 14 nt, Leptospira interrogans serovar lai str. 56601
uaucacaaaucuau

SEQ ID NO: 756296 - RNA, 20 nt, Leptospira interrogans serovar lai str. 56601
uaucaauucacucuuaaaua

SEQ ID NO: 756297 - RNA, 22 nt, Leptospira interrogans serovar lai str. 56601
uaucaauucacucuuaaauacu

SEQ ID NO: 756298 - RNA, 20 nt, Leptospira interrogans serovar lai str. 56601
uaucaggauaaccuaaaauu

SEQ ID NO: 756299 - RNA, 16 nt, Leptospira interrogans serovar lai str. 56601
uaucauaaauuuuuau

SEQ ID NO: 756300 - RNA, 12 nt, Leptospira interrogans serovar lai str. 56601
uaucauagaaua

SEQ ID NO: 756301 - RNA, 22 nt, Leptospira interrogans serovar lai str. 56601
uaucaguuuuguuaaccaaaaa

SEQ ID NO: 756302 - RNA, 12 nt, Leptospira interrogans serovar lai str. 56601
uaucauaaaaau

SEQ ID NO: 756303 - RNA, 13 nt, Leptospira interrogans serovar lai str. 56601
uaucauaaaaaua

SEQ ID NO: 756304 - RNA, 14 nt, Leptospira interrogans serovar lai str. 56601
uaucauaaaaauaa

SEQ ID NO: 756305 - RNA, 19 nt, Leptospira interrogans serovar lai str. 56601
uaucauaaaaauaaagaaa

SEQ ID NO: 756306 - RNA, 20 nt, Leptospira interrogans serovar lai str. 56601
uaucauaaaaauaaagaaac

SEQ ID NO: 756307 - RNA, 13 nt, Leptospira interrogans serovar lai str. 56601
uauagcuguuuua

SEQ ID NO: 756308 - RNA, 17 nt, Leptospira interrogans serovar lai str. 56601
uauaggaucguauuuua

SEQ ID NO: 756309 - RNA, 17 nt, Leptospira interrogans serovar lai str. 56601
uauaucucguauugaau

SEQ ID NO: 756310 - RNA, 18 nt, Leptospira interrogans serovar lai str. 56601
uauaucucguauugaauu

SEQ ID NO: 756311 - RNA, 17 nt, Leptospira interrogans serovar lai str. 56601
uauauauccuuaugaaa

SEQ ID NO: 756312 - RNA, 21 nt, Leptospira interrogans serovar lai str. 56601
uauauauccuuaugaaagcaa

SEQ ID NO: 756313 - RNA, 22 nt, Leptospira interrogans serovar lai str. 56601
uauauaucuuuggauuuuauuu

SEQ ID NO: 756314 - RNA, 16 nt, Leptospira interrogans serovar lai str. 56601
uauaucgaauacauuu

SEQ ID NO: 756315 - RNA, 22 nt, Leptospira interrogans serovar lai str. 56601
uauauaguuuugagcauaaaaa

SEQ ID NO: 756316 - RNA, 23 nt, Leptospira interrogans serovar lai str. 56601
uauauaguuuugagcauaaaaaa

SEQ ID NO: 756317 - RNA, 13 nt, Leptospira interrogans serovar lai str. 56601
uauauauaaauuc

SEQ ID NO: 756318 - RNA, 20 nt, Leptospira interrogans serovar lai str. 56601
uauauaguuaugaauaaaaa

SEQ ID NO: 756319 - RNA, 21 nt, Leptospira interrogans serovar lai str. 56601
uauauaguuaugaauaaaaaa

SEQ ID NO: 756320 - RNA, 18 nt, Leptospira interrogans serovar lai str. 56601
uauauagcucuugaauaa

SEQ ID NO: 756321 - RNA, 20 nt, Leptospira interrogans serovar lai str. 56601
uauauagcucuugaauaaag

SEQ ID NO: 756322 - RNA, 12 nt, Leptospira interrogans serovar lai str. 56601
uauauucuuaua

SEQ ID NO: 756323 - RNA, 23 nt, Leptospira interrogans serovar lai str. 56601
uauauucuuuucugaauaaaaau

SEQ ID NO: 756324 - RNA, 15 nt, Leptospira interrogans serovar lai str. 56601
uauauugaaauauua

SEQ ID NO: 756325 - RNA, 17 nt, Leptospira interrogans serovar lai str. 56601
uauauucaauuucuuua

SEQ ID NO: 756326 - RNA, 17 nt, Leptospira interrogans serovar lai str. 56601
uauauuauaauucucuu

SEQ ID NO: 756327 - RNA, 18 nt, Leptospira interrogans serovar lai str. 56601
uauauuauaauuuuaaau

SEQ ID NO: 756328 - RNA, 18 nt, Leptospira interrogans serovar lai str. 56601
uauauucaaaaaauggaa

SEQ ID NO: 756329 - RNA, 13 nt, Leptospira interrogans serovar lai str. 56601
uauauuagaauau

SEQ ID NO: 756330 - RNA, 20 nt, Leptospira interrogans serovar lai str. 56601
uauauuagaguuucuaaaaa

SEQ ID NO: 756331 - RNA, 21 nt, Leptospira interrogans serovar lai str. 56601
uauauuagaguuucuaaaaaa

SEQ ID NO: 756332 - RNA, 20 nt, Leptospira interrogans serovar lai str. 56601
uauauuagauuuauauguuu

SEQ ID NO: 756333 - RNA, 15 nt, Leptospira interrogans serovar lai str. 56601
uauauuaauauucua

SEQ ID NO: 756334 - RNA, 21 nt, Leptospira interrogans serovar lai str. 56601
uauauuaaucuuuuuuaauaa

SEQ ID NO: 756335 - RNA, 14 nt, Leptospira interrogans serovar lai str. 56601
uauaucuuuggauu

SEQ ID NO: 756336 - RNA, 14 nt, Leptospira interrogans serovar lai str. 56601
uauauuaaaaugua

SEQ ID NO: 756337 - RNA, 12 nt, Leptospira interrogans serovar lai str. 56601
uauaauuuuaua

SEQ ID NO: 756338 - RNA, 12 nt, Leptospira interrogans serovar lai str. 56601
uauaauuucuuu

SEQ ID NO: 756339 - RNA, 17 nt, Leptospira interrogans serovar lai str. 56601
uauaauuucuuuuuaua

SEQ ID NO: 756340 - RNA, 18 nt, Leptospira interrogans serovar lai str. 56601
uauaauuuuaaauaauaa

SEQ ID NO: 756341 - RNA, 21 nt, Leptospira interrogans serovar lai str. 56601
uauaauuuucuuaauaaacuu

SEQ ID NO: 756342 - RNA, 13 nt, Leptospira interrogans serovar lai str. 56601
uauaauuuuuaac

SEQ ID NO: 756343 - RNA, 15 nt, Leptospira interrogans serovar lai str. 56601
uauaauuuuuacuuu

SEQ ID NO: 756344 - RNA, 22 nt, Leptospira interrogans serovar lai str. 56601
uauaauuuaaaaucguaaaaaa

SEQ ID NO: 756345 - RNA, 22 nt, Leptospira interrogans serovar lai str. 56601
uauacaauucuuucuuaaauuu

SEQ ID NO: 756346 - RNA, 20 nt, Leptospira interrogans serovar lai str. 56601
uauacaagacuucuauacuc

SEQ ID NO: 756347 - RNA, 16 nt, Leptospira interrogans serovar lai str. 56601
uauacaggaaacauua

SEQ ID NO: 756348 - RNA, 14 nt, Leptospira interrogans serovar lai str. 56601
uauaauuaauaaaa

SEQ ID NO: 756349 - RNA, 15 nt, Leptospira interrogans serovar lai str. 56601
uauaauuaaaaagau

SEQ ID NO: 756350 - RNA, 14 nt, Leptospira interrogans serovar lai str. 56601
uauaauguuaauuu

SEQ ID NO: 756351 - RNA, 21 nt, Leptospira interrogans serovar lai str. 56601
uauaauguuugaauuuuuaag

SEQ ID NO: 756352 - RNA, 15 nt, Leptospira interrogans serovar lai str. 56601
uauaaucaaauacaa

SEQ ID NO: 756353 - RNA, 14 nt, Leptospira interrogans serovar lai str. 56601
uauaauauuuauuu

SEQ ID NO: 756354 - RNA, 16 nt, Leptospira interrogans serovar lai str. 56601
uauaauuaauaaaacu

SEQ ID NO: 756355 - RNA, 17 nt, Leptospira interrogans serovar lai str. 56601
uauaauucuguaaaaua

SEQ ID NO: 756356 - RNA, 11 nt, Leptospira interrogans serovar lai str. 56601
uauaauucuuu

SEQ ID NO: 756357 - RNA, 17 nt, Leptospira interrogans serovar lai str. 56601
uauaauucuuuaaaauu

SEQ ID NO: 756358 - RNA, 13 nt, Leptospira interrogans serovar lai str. 56601
uauaauugaacau

SEQ ID NO: 756359 - RNA, 19 nt, Leptospira interrogans serovar lai str. 56601
uauaauugaacauuuuuaa

SEQ ID NO: 756360 - RNA, 23 nt, Leptospira interrogans serovar lai str. 56601
uauaauugaacauuuuuaaaaau

SEQ ID NO: 756361 - RNA, 20 nt, Leptospira interrogans serovar lai str. 56601
uauaauucguuuuuuaaaau

SEQ ID NO: 756362 - RNA, 20 nt, Leptospira interrogans serovar lai str. 56601
uauaauucccguuauaaauc

SEQ ID NO: 756363 - RNA, 20 nt, Leptospira interrogans serovar lai str. 56601
uauaauuccgggguuucuuu

SEQ ID NO: 756364 - RNA, 19 nt, Leptospira interrogans serovar lai str. 56601
uauaaauucaucuaaaaaa

SEQ ID NO: 756365 - RNA, 17 nt, Leptospira interrogans serovar lai str. 56601
uauaaauucgcaaaaaa

SEQ ID NO: 756366 - RNA, 21 nt, Leptospira interrogans serovar lai str. 56601
uauaaauugaguaccuaucaa

SEQ ID NO: 756367 - RNA, 19 nt, Leptospira interrogans serovar lai str. 56601
uauaaauugcaucaaagaa

SEQ ID NO: 756368 - RNA, 14 nt, Leptospira interrogans serovar lai str. 56601
uauaaauuuaaaaa

SEQ ID NO: 756369 - RNA, 13 nt, Leptospira interrogans serovar lai str. 56601
uauaauaaaauua

SEQ ID NO: 756370 - RNA, 16 nt, Leptospira interrogans serovar lai str. 56601
uauaauaaaauuauua

SEQ ID NO: 756371 - RNA, 21 nt, Leptospira interrogans serovar lai str. 56601
uauaauaaaauuauuaacuaa

SEQ ID NO: 756372 - RNA, 21 nt, Leptospira interrogans serovar lai str. 56601
uauaauaaaguaccuaauauu

SEQ ID NO: 756373 - RNA, 13 nt, Leptospira interrogans serovar lai str. 56601
uauaauaaauuga

SEQ ID NO: 756374 - RNA, 18 nt, Leptospira interrogans serovar lai str. 56601
uauaauaguuacgacauu

SEQ ID NO: 756375 - RNA, 19 nt, Leptospira interrogans serovar lai str. 56601
uauaauagaguuacagaaa

SEQ ID NO: 756376 - RNA, 21 nt, Leptospira interrogans serovar lai str. 56601
uauaauagaguuacagaaaaa

SEQ ID NO: 756377 - RNA, 23 nt, Leptospira interrogans serovar lai str. 56601
uauaauagaguuacagaaaaaau

SEQ ID NO: 756378 - RNA, 20 nt, Leptospira interrogans serovar lai str. 56601
uauaauauacuuauaaagaa

SEQ ID NO: 756379 - RNA, 21 nt, Leptospira interrogans serovar lai str. 56601
uauaauauacuuauaaagaau

SEQ ID NO: 756380 - RNA, 17 nt, Leptospira interrogans serovar lai str. 56601
uauaauaagauuuguug

SEQ ID NO: 756381 - RNA, 16 nt, Leptospira interrogans serovar lai str. 56601
uauaauaauuguugaa

SEQ ID NO: 756382 - RNA, 21 nt, Leptospira interrogans serovar lai str. 56601
uauaauacaugaauucuaauu

SEQ ID NO: 756383 - RNA, 15 nt, Leptospira interrogans serovar lai str. 56601
uauacuagaacaaua

SEQ ID NO: 756384 - RNA, 19 nt, Leptospira interrogans serovar lai str. 56601
uauacuauaacuuuaaaaa

SEQ ID NO: 756385 - RNA, 20 nt, Leptospira interrogans serovar lai str. 56601
uauacuauaacuuuaaaaaa

SEQ ID NO: 756386 - RNA, 20 nt, Leptospira interrogans serovar lai str. 56601
uauacuuucaaaaaauauaa

SEQ ID NO: 756387 - RNA, 20 nt, Leptospira interrogans serovar lai str. 56601
uauaccaaguucgauuaaaa

SEQ ID NO: 756388 - RNA, 23 nt, Leptospira interrogans serovar lai str. 56601
uauaccaaguucgauuaaaauaa

SEQ ID NO: 756389 - RNA, 15 nt, Leptospira interrogans serovar lai str. 56601
uauacggauuucuau

SEQ ID NO: 756390 - RNA, 18 nt, Leptospira interrogans serovar lai str. 56601
uauagaauuuaaguauua

SEQ ID NO: 756391 - RNA, 14 nt, Leptospira interrogans serovar lai str. 56601
uauacuuuuuugau

SEQ ID NO: 756392 - RNA, 20 nt, Leptospira interrogans serovar lai str. 56601
uauagaggucgucucaaaaa

SEQ ID NO: 756393 - RNA, 22 nt, Leptospira interrogans serovar lai str. 56601
uauagaggucgucucaaaaaua

SEQ ID NO: 756394 - RNA, 17 nt, Leptospira interrogans serovar lai str. 56601
uauagaucgauucuuua

SEQ ID NO: 756395 - RNA, 20 nt, Leptospira interrogans serovar lai str. 56601
uauagccaaguauaaaagug

SEQ ID NO: 756396 - RNA, 15 nt, Leptospira interrogans serovar lai str. 56601
uagugguuuguaaua

SEQ ID NO: 756397 - RNA, 14 nt, Leptospira interrogans serovar lai str. 56601
uaguuaauaaauuu

SEQ ID NO: 756398 - RNA, 18 nt, Leptospira interrogans serovar lai str. 56601
uaguuaacgugaauuugg

SEQ ID NO: 756399 - RNA, 19 nt, Leptospira interrogans serovar lai str. 56601
uaguuagcugaaauuaauu

SEQ ID NO: 756400 - RNA, 13 nt, Leptospira interrogans serovar lai str. 56601
uaguuacaauuua

SEQ ID NO: 756401 - RNA, 15 nt, Leptospira interrogans serovar lai str. 56601
uaguuacuuauuuuu

SEQ ID NO: 756402 - RNA, 17 nt, Leptospira interrogans serovar lai str. 56601
uauaaauaaauuuaaau

SEQ ID NO: 756403 - RNA, 18 nt, Leptospira interrogans serovar lai str. 56601
uauaaauaaauuuaaaug

SEQ ID NO: 756404 - RNA, 20 nt, Leptospira interrogans serovar lai str. 56601
uauaaacagucgcuaaacuc

SEQ ID NO: 756405 - RNA, 17 nt, Leptospira interrogans serovar lai str. 56601
uauaaaauuugaaagua

SEQ ID NO: 756406 - RNA, 20 nt, Leptospira interrogans serovar lai str. 56601
uauaaaccaucucaaaaaca

SEQ ID NO: 756407 - RNA, 15 nt, Leptospira interrogans serovar lai str. 56601
uauaaaaucuaaaaa

SEQ ID NO: 756408 - RNA, 16 nt, Leptospira interrogans serovar lai str. 56601
uauaaaaucuaaaaaa

SEQ ID NO: 756409 - RNA, 19 nt, Leptospira interrogans serovar lai str. 56601
uauaaaaucuaaaaaaaca

SEQ ID NO: 756410 - RNA, 17 nt, Leptospira interrogans serovar lai str. 56601
uauaaaaucuaaaaaga

SEQ ID NO: 756411 - RNA, 16 nt, Leptospira interrogans serovar lai str. 56601
uauaaaaucuaaaaau

SEQ ID NO: 756412 - RNA, 17 nt, Leptospira interrogans serovar lai str. 56601
uauaaaaucuaaaaaua

SEQ ID NO: 756413 - RNA, 17 nt, Leptospira interrogans serovar lai str. 56601
uauaaaauguauuaaag

SEQ ID NO: 756414 - RNA, 21 nt, Leptospira interrogans serovar lai str. 56601
uauaaaauuaagcauuauaag

SEQ ID NO: 756415 - RNA, 15 nt, Leptospira interrogans serovar lai str. 56601
uauaaaauuagauuu

SEQ ID NO: 756416 - RNA, 14 nt, Leptospira interrogans serovar lai str. 56601
uauaaaauucaaaa

SEQ ID NO: 756417 - RNA, 23 nt, Leptospira interrogans serovar lai str. 56601
uauaaaaaauaauauuauaaaua

SEQ ID NO: 756418 - RNA, 11 nt, Leptospira interrogans serovar lai str. 56601
uauaaacaaua

SEQ ID NO: 756419 - RNA, 14 nt, Leptospira interrogans serovar lai str. 56601
uauaaacaauauga

SEQ ID NO: 756420 - RNA, 16 nt, Leptospira interrogans serovar lai str. 56601
uauaaacaauaugaaa

SEQ ID NO: 756421 - RNA, 15 nt, Leptospira interrogans serovar lai str. 56601
uauaaaauugaauau

SEQ ID NO: 756422 - RNA, 17 nt, Leptospira interrogans serovar lai str. 56601
uauaaaauugaauauca

SEQ ID NO: 756423 - RNA, 22 nt, Leptospira interrogans serovar lai str. 56601
uauaaauauuaauuuaaaaaca

SEQ ID NO: 756424 - RNA, 21 nt, Leptospira interrogans serovar lai str. 56601
uauaaaucaaagcaaaguuuc

SEQ ID NO: 756425 - RNA, 20 nt, Leptospira interrogans serovar lai str. 56601
uauaaaugaauuuuaaauuu

SEQ ID NO: 756426 - RNA, 12 nt, Leptospira interrogans serovar lai str. 56601
uaguuuuuccug

SEQ ID NO: 756427 - RNA, 19 nt, Leptospira interrogans serovar lai str. 56601
uaguuuugagcauaaaaaa

SEQ ID NO: 756428 - RNA, 21 nt, Leptospira interrogans serovar lai str. 56601
uaguuaugaauaaaaaauuuc

SEQ ID NO: 756429 - RNA, 18 nt, Leptospira interrogans serovar lai str. 56601
uaguuauauuaauauucu

SEQ ID NO: 756430 - RNA, 16 nt, Leptospira interrogans serovar lai str. 56601
uaguuauguuuuaaaa

SEQ ID NO: 756431 - RNA, 19 nt, Leptospira interrogans serovar lai str. 56601
uaguuucuaaguguaaaau

SEQ ID NO: 756432 - RNA, 14 nt, Leptospira interrogans serovar lai str. 56601
uaguuuauuuuaaa

SEQ ID NO: 756433 - RNA, 15 nt, Leptospira interrogans serovar lai str. 56601
uaguuuauuuuaaaa

SEQ ID NO: 756434 - RNA, 16 nt, Leptospira interrogans serovar lai str. 56601
uaguuuauuuuaaaaa

SEQ ID NO: 756435 - RNA, 18 nt, Leptospira interrogans serovar lai str. 56601
uaguuuauuuuucuuuua

SEQ ID NO: 756436 - RNA, 21 nt, Leptospira interrogans serovar lai str. 56601
uaguuuauuuuucuuuuaaaa

SEQ ID NO: 756437 - RNA, 14 nt, Leptospira interrogans serovar lai str. 56601
uacgacuuuauuca

SEQ ID NO: 756438 - RNA, 22 nt, Leptospira interrogans serovar lai str. 56601
uacgauucgaaagauuuuucau

SEQ ID NO: 756439 - RNA, 17 nt, Leptospira interrogans serovar lai str. 56601
uacgauucuaaauuauu

SEQ ID NO: 756440 - RNA, 17 nt, Leptospira interrogans serovar lai str. 56601
uacgauuaaauuuugaa

SEQ ID NO: 756441 - RNA, 17 nt, Leptospira interrogans serovar lai str. 56601
uaccuguuuuaguucaa

SEQ ID NO: 756442 - RNA, 19 nt, Leptospira interrogans serovar lai str. 56601
uacgacauuuuagagcaga

SEQ ID NO: 756443 - RNA, 22 nt, Leptospira interrogans serovar lai str. 56601
uaccuguucggaguuguauaac

SEQ ID NO: 756444 - RNA, 11 nt, Leptospira interrogans serovar lai str. 56601
uacuacauuug

SEQ ID NO: 756445 - RNA, 14 nt, Leptospira interrogans serovar lai str. 56601
uacuacauuuuauu

SEQ ID NO: 756446 - RNA, 16 nt, Leptospira interrogans serovar lai str. 56601
uacuacauuuuauugu

SEQ ID NO: 756447 - RNA, 15 nt, Leptospira interrogans serovar lai str. 56601
uacuacaauuaaaaa

SEQ ID NO: 756448 - RNA, 13 nt, Leptospira interrogans serovar lai str. 56601
uacuacaaaaauu

SEQ ID NO: 756449 - RNA, 16 nt, Leptospira interrogans serovar lai str. 56601
uacuacaaaaauuuaa

SEQ ID NO: 756450 - RNA, 14 nt, Leptospira interrogans serovar lai str. 56601
uacuaccaaagcuu

SEQ ID NO: 756451 - RNA, 16 nt, Leptospira interrogans serovar lai str. 56601
uacuacgaaaauuuaa

SEQ ID NO: 756452 - RNA, 14 nt, Leptospira interrogans serovar lai str. 56601
uacuaauaguuuua

SEQ ID NO: 756453 - RNA, 16 nt, Leptospira interrogans serovar lai str. 56601
uacuaauucuuuugca

SEQ ID NO: 756454 - RNA, 19 nt, Leptospira interrogans serovar lai str. 56601
uacuaaucucuauaaaagu

SEQ ID NO: 756455 - RNA, 23 nt, Leptospira interrogans serovar lai str. 56601
uacuaaucgagcuuuucuguuca

SEQ ID NO: 756456 - RNA, 17 nt, Leptospira interrogans serovar lai str. 56601
uacguuccuucuacaau

SEQ ID NO: 756457 - RNA, 14 nt, Leptospira interrogans serovar lai str. 56601
uacuaaaucagaau

SEQ ID NO: 756458 - RNA, 11 nt, Leptospira interrogans serovar lai str. 56601
uacuaaaucuc

SEQ ID NO: 756459 - RNA, 20 nt, Leptospira interrogans serovar lai str. 56601
uacuaaauuaaguuuauuca

SEQ ID NO: 756460 - RNA, 23 nt, Leptospira interrogans serovar lai str. 56601
uacuaacacaguuugaauuuuac

SEQ ID NO: 756461 - RNA, 21 nt, Leptospira interrogans serovar lai str. 56601
uacguuauaauucuuuaaaau

SEQ ID NO: 756462 - RNA, 13 nt, Leptospira interrogans serovar lai str. 56601
uacguaaaaauga

SEQ ID NO: 756463 - RNA, 17 nt, Leptospira interrogans serovar lai str. 56601
uacgcugaguuugagag

SEQ ID NO: 756464 - RNA, 18 nt, Leptospira interrogans serovar lai str. 56601
uacgcuucaaucucuuuc

SEQ ID NO: 756465 - RNA, 22 nt, Leptospira interrogans serovar lai str. 56601
uacgcuucaaucucuuucucau

SEQ ID NO: 756466 - RNA, 21 nt, Leptospira interrogans serovar lai str. 56601
uaccacagugaaagauuaaag

SEQ ID NO: 756467 - RNA, 23 nt, Leptospira interrogans serovar lai str. 56601
uaccaccaaaguaugauuuuacc

SEQ ID NO: 756468 - RNA, 16 nt, Leptospira interrogans serovar lai str. 56601
uaccaguuaaauucau

SEQ ID NO: 756469 - RNA, 20 nt, Leptospira interrogans serovar lai str. 56601
uaccaguuaaacuuugaaaa

SEQ ID NO: 756470 - RNA, 16 nt, Leptospira interrogans serovar lai str. 56601
uaccaucaccaacccc

SEQ ID NO: 756471 - RNA, 19 nt, Leptospira interrogans serovar lai str. 56601
uaccauaggcgcggaaaaa

SEQ ID NO: 756472 - RNA, 20 nt, Leptospira interrogans serovar lai str. 56601
uaccauaggcgcggaaaaau

SEQ ID NO: 756473 - RNA, 20 nt, Leptospira interrogans serovar lai str. 56601
uaccguuuuuaaaugugcgg

SEQ ID NO: 756474 - RNA, 17 nt, Leptospira interrogans serovar lai str. 56601
uaccucaauuuuccauu

SEQ ID NO: 756475 - RNA, 17 nt, Leptospira interrogans serovar lai str. 56601
uaccuccuuuuucaaaa

SEQ ID NO: 756476 - RNA, 17 nt, Leptospira interrogans serovar lai str. 56601
uaccucuaaaaaucggc

SEQ ID NO: 756477 - RNA, 14 nt, Leptospira interrogans serovar lai str. 56601
uacaucuuaaaaaa

SEQ ID NO: 756478 - RNA, 15 nt, Leptospira interrogans serovar lai str. 56601
uacaucuuaaaaaau

SEQ ID NO: 756479 - RNA, 16 nt, Leptospira interrogans serovar lai str. 56601
uacaucuuaaaaaaua

SEQ ID NO: 756480 - RNA, 20 nt, Leptospira interrogans serovar lai str. 56601
uacaucuuaaaaaauacaaa

SEQ ID NO: 756481 - RNA, 16 nt, Leptospira interrogans serovar lai str. 56601
uacaugaauucuaauu

SEQ ID NO: 756482 - RNA, 13 nt, Leptospira interrogans serovar lai str. 56601
uacauguaaaacu

SEQ ID NO: 756483 - RNA, 14 nt, Leptospira interrogans serovar lai str. 56601
uacaucgucuucuu

SEQ ID NO: 756484 - RNA, 23 nt, Leptospira interrogans serovar lai str. 56601
uacaucccaaaccucuuuauacg

SEQ ID NO: 756485 - RNA, 14 nt, Leptospira interrogans serovar lai str. 56601
uacaucaaaaacaa

SEQ ID NO: 756486 - RNA, 17 nt, Leptospira interrogans serovar lai str. 56601
uacaggcgguuuaaaag

SEQ ID NO: 756487 - RNA, 20 nt, Leptospira interrogans serovar lai str. 56601
uaccaauaauuucccauaaa

SEQ ID NO: 756488 - RNA, 23 nt, Leptospira interrogans serovar lai str. 56601
uaccaauaauuucccauaaaaag

SEQ ID NO: 756489 - RNA, 21 nt, Leptospira interrogans serovar lai str. 56601
uaccaaggauguggaaguuuu

SEQ ID NO: 756490 - RNA, 13 nt, Leptospira interrogans serovar lai str. 56601
uaccaaguuauua

SEQ ID NO: 756491 - RNA, 15 nt, Leptospira interrogans serovar lai str. 56601
uaccaaguuauuaac

SEQ ID NO: 756492 - RNA, 13 nt, Leptospira interrogans serovar lai str. 56601
uaccaaauucacg

SEQ ID NO: 756493 - RNA, 16 nt, Leptospira interrogans serovar lai str. 56601
uaccaaauuguuuucu

SEQ ID NO: 756494 - RNA, 19 nt, Leptospira interrogans serovar lai str. 56601
uaccaaauuguuuucuaaa

SEQ ID NO: 756495 - RNA, 21 nt, Leptospira interrogans serovar lai str. 56601
uaccaacgucccuauuguauu

SEQ ID NO: 756496 - RNA, 21 nt, Leptospira interrogans serovar lai str. 56601
uaccaaaaaugcaaaaguuuu

SEQ ID NO: 756497 - RNA, 13 nt, Leptospira interrogans serovar lai str. 56601
uaccaaaacccau

SEQ ID NO: 756498 - RNA, 15 nt, Leptospira interrogans serovar lai str. 56601
uacauucguuuuaau

SEQ ID NO: 756499 - RNA, 20 nt, Leptospira interrogans serovar lai str. 56601
uacauucugaaacuuuucaa

SEQ ID NO: 756500 - RNA, 21 nt, Leptospira interrogans serovar lai str. 56601
uacauugaguccuuucgacuu

SEQ ID NO: 756501 - RNA, 22 nt, Leptospira interrogans serovar lai str. 56601
uacauuaugcgcaaucucaagu

SEQ ID NO: 756502 - RNA, 16 nt, Leptospira interrogans serovar lai str. 56601
uacauucaauaauuuu

SEQ ID NO: 756503 - RNA, 20 nt, Leptospira interrogans serovar lai str. 56601
uacauucaauuucuuuaauu

SEQ ID NO: 756504 - RNA, 23 nt, Leptospira interrogans serovar lai str. 56601
uacauuagaauuuuaugauuuuc

SEQ ID NO: 756505 - RNA, 21 nt, Leptospira interrogans serovar lai str. 56601
uacauuagagucguugaaaau

SEQ ID NO: 756506 - RNA, 18 nt, Leptospira interrogans serovar lai str. 56601
uacauuagaguuguugaa

SEQ ID NO: 756507 - RNA, 22 nt, Leptospira interrogans serovar lai str. 56601
uacauuagaguuguugaaaaau

SEQ ID NO: 756508 - RNA, 11 nt, Leptospira interrogans serovar lai str. 56601
uacauuuuuaa

SEQ ID NO: 756509 - RNA, 20 nt, Leptospira interrogans serovar lai str. 56601
uacauuuuuaaauuguucgu

SEQ ID NO: 756510 - RNA, 18 nt, Leptospira interrogans serovar lai str. 56601
uacauuuuuuaaauuuau

SEQ ID NO: 756511 - RNA, 15 nt, Leptospira interrogans serovar lai str. 56601
uacauuuuuuuagaa

SEQ ID NO: 756512 - RNA, 17 nt, Leptospira interrogans serovar lai str. 56601
uacauuugauuaaaaau

SEQ ID NO: 756513 - RNA, 21 nt, Leptospira interrogans serovar lai str. 56601
uacauuggggaaguaauuuuc

SEQ ID NO: 756514 - RNA, 18 nt, Leptospira interrogans serovar lai str. 56601
uacaauuugcuaaaauaa

SEQ ID NO: 756515 - RNA, 19 nt, Leptospira interrogans serovar lai str. 56601
uacaauuugcuaaaauaag

SEQ ID NO: 756516 - RNA, 22 nt, Leptospira interrogans serovar lai str. 56601
uacaauuugcuaaaauaagaau

SEQ ID NO: 756517 - RNA, 15 nt, Leptospira interrogans serovar lai str. 56601
uacaaugaaaaagca

SEQ ID NO: 756518 - RNA, 14 nt, Leptospira interrogans serovar lai str. 56601
uacaauuuuaucuu

SEQ ID NO: 756519 - RNA, 23 nt, Leptospira interrogans serovar lai str. 56601
uacagaacacucaacgaagucuc

SEQ ID NO: 756520 - RNA, 10 nt, Leptospira interrogans serovar lai str. 56601
uacagaaaaa

SEQ ID NO: 756521 - RNA, 13 nt, Leptospira interrogans serovar lai str. 56601
uacagaaacaaaa

SEQ ID NO: 756522 - RNA, 14 nt, Leptospira interrogans serovar lai str. 56601
uacagaaacaaaau

SEQ ID NO: 756523 - RNA, 19 nt, Leptospira interrogans serovar lai str. 56601
uacagaaaaccaaauaaua

SEQ ID NO: 756524 - RNA, 20 nt, Leptospira interrogans serovar lai str. 56601
uacagaaaaccaaauaauaa

SEQ ID NO: 756525 - RNA, 16 nt, Leptospira interrogans serovar lai str. 56601
uacagacguauuuuua

SEQ ID NO: 756526 - RNA, 22 nt, Leptospira interrogans serovar lai str. 56601
uacagaauugauuguugaacuu

SEQ ID NO: 756527 - RNA, 16 nt, Leptospira interrogans serovar lai str. 56601
uacagaagggagaaua

SEQ ID NO: 756528 - RNA, 19 nt, Leptospira interrogans serovar lai str. 56601
uacagaauaaauacauaca

SEQ ID NO: 756529 - RNA, 22 nt, Leptospira interrogans serovar lai str. 56601
uacagaauaaauacauacaaug

SEQ ID NO: 756530 - RNA, 14 nt, Leptospira interrogans serovar lai str. 56601
uacagaauauuaaa

SEQ ID NO: 756531 - RNA, 19 nt, Leptospira interrogans serovar lai str. 56601
uacagaacccaauaaaaac

SEQ ID NO: 756532 - RNA, 18 nt, Leptospira interrogans serovar lai str. 56601
uacagaucaauucuuuaa

SEQ ID NO: 756533 - RNA, 14 nt, Leptospira interrogans serovar lai str. 56601
uacagauaaaaaua

SEQ ID NO: 756534 - RNA, 18 nt, Leptospira interrogans serovar lai str. 56601
uacagauuuauuuuagaa

SEQ ID NO: 756535 - RNA, 18 nt, Leptospira interrogans serovar lai str. 56601
uacagaucgauuccuacu

SEQ ID NO: 756536 - RNA, 21 nt, Leptospira interrogans serovar lai str. 56601
uacagaucgauuccuacuuau

SEQ ID NO: 756537 - RNA, 21 nt, Leptospira interrogans serovar lai str. 56601
uacagauacucaauuugauau

SEQ ID NO: 756538 - RNA, 16 nt, Leptospira interrogans serovar lai str. 56601
uacaauauuucgucuu

SEQ ID NO: 756539 - RNA, 16 nt, Leptospira interrogans serovar lai str. 56601
uacaaucaauaaauug

SEQ ID NO: 756540 - RNA, 21 nt, Leptospira interrogans serovar lai str. 56601
uacaauccucgcuuuuaauaa

SEQ ID NO: 756541 - RNA, 16 nt, Leptospira interrogans serovar lai str. 56601
uacaaucggguaaaaa

SEQ ID NO: 756542 - RNA, 17 nt, Leptospira interrogans serovar lai str. 56601
uacaaucggguaaaaaa

SEQ ID NO: 756543 - RNA, 18 nt, Leptospira interrogans serovar lai str. 56601
uacaaucggguaaaaaau

SEQ ID NO: 756544 - RNA, 21 nt, Leptospira interrogans serovar lai str. 56601
uacaaucggguaaaaaauacu

SEQ ID NO: 756545 - RNA, 12 nt, Leptospira interrogans serovar lai str. 56601
uacaaugaaaaa

SEQ ID NO: 756546 - RNA, 16 nt, Leptospira interrogans serovar lai str. 56601
uacaacgcgauccaua

SEQ ID NO: 756547 - RNA, 21 nt, Leptospira interrogans serovar lai str. 56601
uacaaccgaaaagguuaaaaa

SEQ ID NO: 756548 - RNA, 22 nt, Leptospira interrogans serovar lai str. 56601
uacaaccgaaaagguuaaaaau

SEQ ID NO: 756549 - RNA, 18 nt, Leptospira interrogans serovar lai str. 56601
uacaaccacuggaauaua

SEQ ID NO: 756550 - RNA, 15 nt, Leptospira interrogans serovar lai str. 56601
uacaacauccuucaa

SEQ ID NO: 756551 - RNA, 19 nt, Leptospira interrogans serovar lai str. 56601
uacaacauccuucaaacuu

SEQ ID NO: 756552 - RNA, 22 nt, Leptospira interrogans serovar lai str. 56601
uacaaaugggaugauagauuaa

SEQ ID NO: 756553 - RNA, 18 nt, Leptospira interrogans serovar lai str. 56601
uacaaaucacgauuuuac

SEQ ID NO: 756554 - RNA, 23 nt, Leptospira interrogans serovar lai str. 56601
uacaaaucacgauuuuacaaaca

SEQ ID NO: 756555 - RNA, 16 nt, Leptospira interrogans serovar lai str. 56601
uacaaauucuucuucc

SEQ ID NO: 756556 - RNA, 14 nt, Leptospira interrogans serovar lai str. 56601
uacaaauugauaau

SEQ ID NO: 756557 - RNA, 16 nt, Leptospira interrogans serovar lai str. 56601
uacaaauugauaauuu

SEQ ID NO: 756558 - RNA, 19 nt, Leptospira interrogans serovar lai str. 56601
uacaaauuaguauuuuucu

SEQ ID NO: 756559 - RNA, 18 nt, Leptospira interrogans serovar lai str. 56601
uaauuguugaauaucuaa

SEQ ID NO: 756560 - RNA, 16 nt, Leptospira interrogans serovar lai str. 56601
uacaaaguaaguucaa

SEQ ID NO: 756561 - RNA, 14 nt, Leptospira interrogans serovar lai str. 56601
uacaaaguauucuu

SEQ ID NO: 756562 - RNA, 18 nt, Leptospira interrogans serovar lai str. 56601
uacaaaguauucuuucca

SEQ ID NO: 756563 - RNA, 13 nt, Leptospira interrogans serovar lai str. 56601
uaauaauucaaaa

SEQ ID NO: 756564 - RNA, 15 nt, Leptospira interrogans serovar lai str. 56601
uaauaauuagaaaaa

SEQ ID NO: 756565 - RNA, 17 nt, Leptospira interrogans serovar lai str. 56601
uaauaauuagaaaaaua

SEQ ID NO: 756566 - RNA, 16 nt, Leptospira interrogans serovar lai str. 56601
uaauaaucuuaaauau

SEQ ID NO: 756567 - RNA, 21 nt, Leptospira interrogans serovar lai str. 56601
uaauaaucuuuugaguauuua

SEQ ID NO: 756568 - RNA, 17 nt, Leptospira interrogans serovar lai str. 56601
uaauacaugauuacuca

SEQ ID NO: 756569 - RNA, 13 nt, Leptospira interrogans serovar lai str. 56601
uaauacaaaucuu

SEQ ID NO: 756570 - RNA, 12 nt, Leptospira interrogans serovar lai str. 56601
uaauacaaaaaa

SEQ ID NO: 756571 - RNA, 11 nt, Leptospira interrogans serovar lai str. 56601
uaauacaaaac

SEQ ID NO: 756572 - RNA, 17 nt, Leptospira interrogans serovar lai str. 56601
uaauacucgaaaccaua

SEQ ID NO: 756573 - RNA, 15 nt, Leptospira interrogans serovar lai str. 56601
uaauaccuaauucuc

SEQ ID NO: 756574 - RNA, 16 nt, Leptospira interrogans serovar lai str. 56601
uaauaccuaauucucu

SEQ ID NO: 756575 - RNA, 17 nt, Leptospira interrogans serovar lai str. 56601
uaauacgaugauaaauu

SEQ ID NO: 756576 - RNA, 17 nt, Leptospira interrogans serovar lai str. 56601
uaauaaucuaaacuuga

SEQ ID NO: 756577 - RNA, 12 nt, Leptospira interrogans serovar lai str. 56601
uaauaauaugaa

SEQ ID NO: 756578 - RNA, 18 nt, Leptospira interrogans serovar lai str. 56601
uaauaauaugauguaaau

SEQ ID NO: 756579 - RNA, 20 nt, Leptospira interrogans serovar lai str. 56601
uaauaaaucaaucuacuuga

SEQ ID NO: 756580 - RNA, 22 nt, Leptospira interrogans serovar lai str. 56601
uaauaaaucaaucuacuugaau

SEQ ID NO: 756581 - RNA, 21 nt, Leptospira interrogans serovar lai str. 56601
uaauaaaguaccuaauauuuu

SEQ ID NO: 756582 - RNA, 15 nt, Leptospira interrogans serovar lai str. 56601
uaauaaacuuucaaa

SEQ ID NO: 756583 - RNA, 12 nt, Leptospira interrogans serovar lai str. 56601
uaauaaaauuuu

SEQ ID NO: 756584 - RNA, 19 nt, Leptospira interrogans serovar lai str. 56601
uaauaaaauuuuuaaaaaa

SEQ ID NO: 756585 - RNA, 17 nt, Leptospira interrogans serovar lai str. 56601
uaauaaacaaaauucaa

SEQ ID NO: 756586 - RNA, 13 nt, Leptospira interrogans serovar lai str. 56601
uaauaaaauuauu

SEQ ID NO: 756587 - RNA, 12 nt, Leptospira interrogans serovar lai str. 56601
uaauaaaauuaa

SEQ ID NO: 756588 - RNA, 10 nt, Leptospira interrogans serovar lai str. 56601
uaauaaaaug

SEQ ID NO: 756589 - RNA, 12 nt, Leptospira interrogans serovar lai str. 56601
uaauaaaaugca

SEQ ID NO: 756590 - RNA, 13 nt, Leptospira interrogans serovar lai str. 56601
uaauaaaaugcaa

SEQ ID NO: 756591 - RNA, 11 nt, Leptospira interrogans serovar lai str. 56601
uaauaaaaugu

SEQ ID NO: 756592 - RNA, 22 nt, Leptospira interrogans serovar lai str. 56601
uaauaaaacuuuucuaaauuga

SEQ ID NO: 756593 - RNA, 13 nt, Leptospira interrogans serovar lai str. 56601
uaauaaaaauagc

SEQ ID NO: 756594 - RNA, 14 nt, Leptospira interrogans serovar lai str. 56601
uaauaaaaauuuaa

SEQ ID NO: 756595 - RNA, 22 nt, Leptospira interrogans serovar lai str. 56601
uaauaaaaauuuaaaauacuca

SEQ ID NO: 756596 - RNA, 21 nt, Leptospira interrogans serovar lai str. 56601
uaauaaaaauuuacagauacu

SEQ ID NO: 756597 - RNA, 13 nt, Leptospira interrogans serovar lai str. 56601
uaauaaaaauuug

SEQ ID NO: 756598 - RNA, 14 nt, Leptospira interrogans serovar lai str. 56601
uaauaaaaacaaua

SEQ ID NO: 756599 - RNA, 22 nt, Leptospira interrogans serovar lai str. 56601
uaauaaaaacaauauucuaauu

SEQ ID NO: 756600 - RNA, 20 nt, Leptospira interrogans serovar lai str. 56601
uaaguuuuucuuaaaaaguu

SEQ ID NO: 756601 - RNA, 18 nt, Leptospira interrogans serovar lai str. 56601
uaaguuuuuuaaauuuac

SEQ ID NO: 756602 - RNA, 13 nt, Leptospira interrogans serovar lai str. 56601
uaaguuuuuaaau

SEQ ID NO: 756603 - RNA, 15 nt, Leptospira interrogans serovar lai str. 56601
uaaguuuuuaaauaa

SEQ ID NO: 756604 - RNA, 19 nt, Leptospira interrogans serovar lai str. 56601
uaaguuuuuaaauaagcua

SEQ ID NO: 756605 - RNA, 18 nt, Leptospira interrogans serovar lai str. 56601
uaaguuuuuauuauaaaa

SEQ ID NO: 756606 - RNA, 12 nt, Leptospira interrogans serovar lai str. 56601
uaaguuuuucga

SEQ ID NO: 756607 - RNA, 20 nt, Leptospira interrogans serovar lai str. 56601
uaaguuugugagaguuccca

SEQ ID NO: 756608 - RNA, 21 nt, Leptospira interrogans serovar lai str. 56601
uaaguuugugagaguucccac

SEQ ID NO: 756609 - RNA, 22 nt, Leptospira interrogans serovar lai str. 56601
uaaguuugugagaguucccacg

SEQ ID NO: 756610 - RNA, 10 nt, Leptospira interrogans serovar lai str. 56601
uaaguuuuac

SEQ ID NO: 756611 - RNA, 11 nt, Leptospira interrogans serovar lai str. 56601
uaaguuuucca

SEQ ID NO: 756612 - RNA, 20 nt, Leptospira interrogans serovar lai str. 56601
uaaguugagaauauaagaaa

SEQ ID NO: 756613 - RNA, 20 nt, Leptospira interrogans serovar lai str. 56601
uaaguuguguugaaucuuaa

SEQ ID NO: 756614 - RNA, 22 nt, Leptospira interrogans serovar lai str. 56601
uaaguucgguguaaaaaaucau

SEQ ID NO: 756615 - RNA, 20 nt, Leptospira interrogans serovar lai str. 56601
uaaguucgucugagaaaaac

SEQ ID NO: 756616 - RNA, 15 nt, Leptospira interrogans serovar lai str. 56601
uaaguucaaauuuau

SEQ ID NO: 756617 - RNA, 13 nt, Leptospira interrogans serovar lai str. 56601
uaaguuaaauaua

SEQ ID NO: 756618 - RNA, 15 nt, Leptospira interrogans serovar lai str. 56601
uaaguuauauuagag

SEQ ID NO: 756619 - RNA, 18 nt, Leptospira interrogans serovar lai str. 56601
uaagucguuguauuuuaa

SEQ ID NO: 756620 - RNA, 19 nt, Leptospira interrogans serovar lai str. 56601
uaagucguuguauuuuaaa

SEQ ID NO: 756621 - RNA, 14 nt, Leptospira interrogans serovar lai str. 56601
uaaguccuuuucuu

SEQ ID NO: 756622 - RNA, 17 nt, Leptospira interrogans serovar lai str. 56601
uaaguccuuuucuuaua

SEQ ID NO: 756623 - RNA, 20 nt, Leptospira interrogans serovar lai str. 56601
uaaguauuauaaauuuugag

SEQ ID NO: 756624 - RNA, 21 nt, Leptospira interrogans serovar lai str. 56601
uaaguguaugaaaagucaaaa

SEQ ID NO: 756625 - RNA, 15 nt, Leptospira interrogans serovar lai str. 56601
uaaguagaaauuuaa

SEQ ID NO: 756626 - RNA, 14 nt, Leptospira interrogans serovar lai str. 56601
uaaguaauuuaaaa

SEQ ID NO: 756627 - RNA, 15 nt, Leptospira interrogans serovar lai str. 56601
uaaguaauuuaaaaa

SEQ ID NO: 756628 - RNA, 17 nt, Leptospira interrogans serovar lai str. 56601
uaagguuuuauaaaaug

SEQ ID NO: 756629 - RNA, 17 nt, Leptospira interrogans serovar lai str. 56601
uaaguaaaaaugcaaau

SEQ ID NO: 756630 - RNA, 15 nt, Leptospira interrogans serovar lai str. 56601
uaaggcaaaagacuc

SEQ ID NO: 756631 - RNA, 22 nt, Leptospira interrogans serovar lai str. 56601
uaaggcccacaucgaaaaaaca

SEQ ID NO: 756632 - RNA, 20 nt, Leptospira interrogans serovar lai str. 56601
uaaggauccaauacaaaaca

SEQ ID NO: 756633 - RNA, 15 nt, Leptospira interrogans serovar lai str. 56601
uaaggagcaccuaac

SEQ ID NO: 756634 - RNA, 20 nt, Leptospira interrogans serovar lai str. 56601
uaaggagcucaucauucuga

SEQ ID NO: 756635 - RNA, 23 nt, Leptospira interrogans serovar lai str. 56601
uaagggaaaguuauuucuuucaa

SEQ ID NO: 756636 - RNA, 12 nt, Leptospira interrogans serovar lai str. 56601
uaaucuuuugaa

SEQ ID NO: 756637 - RNA, 14 nt, Leptospira interrogans serovar lai str. 56601
uaaucuuuuuaaaa

SEQ ID NO: 756638 - RNA, 22 nt, Leptospira interrogans serovar lai str. 56601
uaaucuuuuuaaaaguuugauu

SEQ ID NO: 756639 - RNA, 13 nt, Leptospira interrogans serovar lai str. 56601
uaaucuuuguaug

SEQ ID NO: 756640 - RNA, 14 nt, Leptospira interrogans serovar lai str. 56601
uaaugcugauuuuu

SEQ ID NO: 756641 - RNA, 20 nt, Leptospira interrogans serovar lai str. 56601
uaauguaggaacuauuacuu

SEQ ID NO: 756642 - RNA, 17 nt, Leptospira interrogans serovar lai str. 56601
uaauguacaacauccuu

SEQ ID NO: 756643 - RNA, 15 nt, Leptospira interrogans serovar lai str. 56601
uaauuaaaugaagug

SEQ ID NO: 756644 - RNA, 22 nt, Leptospira interrogans serovar lai str. 56601
uaauuaaacuuuuauaaaaucu

SEQ ID NO: 756645 - RNA, 16 nt, Leptospira interrogans serovar lai str. 56601
uaauuagaaaaauauu

SEQ ID NO: 756646 - RNA, 20 nt, Leptospira interrogans serovar lai str. 56601
uaauguuaauuuagaauaaa

SEQ ID NO: 756647 - RNA, 18 nt, Leptospira interrogans serovar lai str. 56601
uaauuccgggguuucuuu

SEQ ID NO: 756648 - RNA, 14 nt, Leptospira interrogans serovar lai str. 56601
uaauuccuccauga

SEQ ID NO: 756649 - RNA, 16 nt, Leptospira interrogans serovar lai str. 56601
uaauucuucuaaugaa

SEQ ID NO: 756650 - RNA, 18 nt, Leptospira interrogans serovar lai str. 56601
uaauucugaauaauugaa

SEQ ID NO: 756651 - RNA, 15 nt, Leptospira interrogans serovar lai str. 56601
uaauucuguaaaaau

SEQ ID NO: 756652 - RNA, 22 nt, Leptospira interrogans serovar lai str. 56601
uaauucuguaaaauaaauuuau

SEQ ID NO: 756653 - RNA, 18 nt, Leptospira interrogans serovar lai str. 56601
uaauucuuaaaaauuuau

SEQ ID NO: 756654 - RNA, 22 nt, Leptospira interrogans serovar lai str. 56601
uaauuccagcuccgcauaaaac

SEQ ID NO: 756655 - RNA, 20 nt, Leptospira interrogans serovar lai str. 56601
uaauuagaggauaaacugua

SEQ ID NO: 756656 - RNA, 17 nt, Leptospira interrogans serovar lai str. 56601
uaauucuucaauaucuu

SEQ ID NO: 756657 - RNA, 12 nt, Leptospira interrogans serovar lai str. 56601
uaauucuuuaga

SEQ ID NO: 756658 - RNA, 20 nt, Leptospira interrogans serovar lai str. 56601
uaauugaacauuuuuaaaaa

SEQ ID NO: 756659 - RNA, 18 nt, Leptospira interrogans serovar lai str. 56601
uaauuggccguaauaucu

SEQ ID NO: 756660 - RNA, 22 nt, Leptospira interrogans serovar lai str. 56601
uaauuggccguaauaucuccaa

SEQ ID NO: 756661 - RNA, 17 nt, Leptospira interrogans serovar lai str. 56601
uaauuguaaaaggagaa

SEQ ID NO: 756662 - RNA, 18 nt, Leptospira interrogans serovar lai str. 56601
uaauuguaaaaggagaau

SEQ ID NO: 756663 - RNA, 20 nt, Leptospira interrogans serovar lai str. 56601
uaauuggaauguacuaaaau

SEQ ID NO: 756664 - RNA, 15 nt, Leptospira interrogans serovar lai str. 56601
uaaucaucaaaauca

SEQ ID NO: 756665 - RNA, 12 nt, Leptospira interrogans serovar lai str. 56601
uaaucaaaugca

SEQ ID NO: 756666 - RNA, 21 nt, Leptospira interrogans serovar lai str. 56601
uaaucaaaugcaguaguuccu

SEQ ID NO: 756667 - RNA, 22 nt, Leptospira interrogans serovar lai str. 56601
uaaucaaauuucugcaugaaau

SEQ ID NO: 756668 - RNA, 15 nt, Leptospira interrogans serovar lai str. 56601
uaaucaaauacaaaa

SEQ ID NO: 756669 - RNA, 18 nt, Leptospira interrogans serovar lai str. 56601
uaaucaaaauuucuuuuu

SEQ ID NO: 756670 - RNA, 17 nt, Leptospira interrogans serovar lai str. 56601
uaaucaaacuaaauuag

SEQ ID NO: 756671 - RNA, 22 nt, Leptospira interrogans serovar lai str. 56601
uaaucaaacuaaauuaguucuu

SEQ ID NO: 756672 - RNA, 13 nt, Leptospira interrogans serovar lai str. 56601
uaauauuuuaaag

SEQ ID NO: 756673 - RNA, 12 nt, Leptospira interrogans serovar lai str. 56601
uaauauuucuuu

SEQ ID NO: 756674 - RNA, 13 nt, Leptospira interrogans serovar lai str. 56601
uaauauuauuaaa

SEQ ID NO: 756675 - RNA, 22 nt, Leptospira interrogans serovar lai str. 56601
uaauauuauuaaauuuuuauac

SEQ ID NO: 756676 - RNA, 22 nt, Leptospira interrogans serovar lai str. 56601
uaauauguuuagaguauuauaa

SEQ ID NO: 756677 - RNA, 23 nt, Leptospira interrogans serovar lai str. 56601
uaauauuagaauuguugaaaaau

SEQ ID NO: 756678 - RNA, 15 nt, Leptospira interrogans serovar lai str. 56601
uaauauuacauucaa

SEQ ID NO: 756679 - RNA, 12 nt, Leptospira interrogans serovar lai str. 56601
uaauauuaaaaa

SEQ ID NO: 756680 - RNA, 16 nt, Leptospira interrogans serovar lai str. 56601
uaauauuaaaaacaca

SEQ ID NO: 756681 - RNA, 17 nt, Leptospira interrogans serovar lai str. 56601
uaauaugaauuuuuaau

SEQ ID NO: 756682 - RNA, 14 nt, Leptospira interrogans serovar lai str. 56601
uaauaugauuaugu

SEQ ID NO: 756683 - RNA, 14 nt, Leptospira interrogans serovar lai str. 56601
uaauagauugauaa

SEQ ID NO: 756684 - RNA, 16 nt, Leptospira interrogans serovar lai str. 56601
uaaucgcuuucgcauu

SEQ ID NO: 756685 - RNA, 18 nt, Leptospira interrogans serovar lai str. 56601
uaauccagcugaaacuaa

SEQ ID NO: 756686 - RNA, 18 nt, Leptospira interrogans serovar lai str. 56601
uaaucgagcuuuucuguu

SEQ ID NO: 756687 - RNA, 21 nt, Leptospira interrogans serovar lai str. 56601
uaaucgcagguugcaauccaa

SEQ ID NO: 756688 - RNA, 16 nt, Leptospira interrogans serovar lai str. 56601
uaaucuaguuuauaug

SEQ ID NO: 756689 - RNA, 14 nt, Leptospira interrogans serovar lai str. 56601
uaaucuaauucgaa

SEQ ID NO: 756690 - RNA, 20 nt, Leptospira interrogans serovar lai str. 56601
uaaucuaagauccaaauuuu

SEQ ID NO: 756691 - RNA, 16 nt, Leptospira interrogans serovar lai str. 56601
uaaucguguuugagau

SEQ ID NO: 756692 - RNA, 17 nt, Leptospira interrogans serovar lai str. 56601
uaaucucguuaaauuuu

SEQ ID NO: 756693 - RNA, 19 nt, Leptospira interrogans serovar lai str. 56601
uaaucucgauuucuaaaau

SEQ ID NO: 756694 - RNA, 16 nt, Leptospira interrogans serovar lai str. 56601
uaaucuguaaaucaac

SEQ ID NO: 756695 - RNA, 22 nt, Leptospira interrogans serovar lai str. 56601
uaaucugugggaacuaccacaa

SEQ ID NO: 756696 - RNA, 21 nt, Leptospira interrogans serovar lai str. 56601
uaaucuuauuuuuuaauauuc

SEQ ID NO: 756697 - RNA, 22 nt, Leptospira interrogans serovar lai str. 56601
uaaucuuauuuuuuaauauuca

SEQ ID NO: 756698 - RNA, 23 nt, Leptospira interrogans serovar lai str. 56601
uaaucuggucggaauuacgacaa

SEQ ID NO: 756699 - RNA, 21 nt, Leptospira interrogans serovar lai str. 56601
uaagcuaagcauaaaauucua

SEQ ID NO: 756700 - RNA, 16 nt, Leptospira interrogans serovar lai str. 56601
uaagcuuuagaaaaua

SEQ ID NO: 756701 - RNA, 19 nt, Leptospira interrogans serovar lai str. 56601
uaaggaaccaucaccaacc

SEQ ID NO: 756702 - RNA, 16 nt, Leptospira interrogans serovar lai str. 56601
uaagcugaaaauuuuc

SEQ ID NO: 756703 - RNA, 18 nt, Leptospira interrogans serovar lai str. 56601
uaagccaaaccaaauaga

SEQ ID NO: 756704 - RNA, 21 nt, Leptospira interrogans serovar lai str. 56601
uaagauugaaugaaaucuaaa

SEQ ID NO: 756705 - RNA, 16 nt, Leptospira interrogans serovar lai str. 56601
uaagauuuguugaaaa

SEQ ID NO: 756706 - RNA, 12 nt, Leptospira interrogans serovar lai str. 56601
uaagcaaaaaua

SEQ ID NO: 756707 - RNA, 15 nt, Leptospira interrogans serovar lai str. 56601
uaagcaaaaauaaag

SEQ ID NO: 756708 - RNA, 14 nt, Leptospira interrogans serovar lai str. 56601
uaagauuuugagac

SEQ ID NO: 756709 - RNA, 14 nt, Leptospira interrogans serovar lai str. 56601
uaagcaaagauuaa

SEQ ID NO: 756710 - RNA, 18 nt, Leptospira interrogans serovar lai str. 56601
uaagauuauauuauauuu

SEQ ID NO: 756711 - RNA, 20 nt, Leptospira interrogans serovar lai str. 56601
uaagaucuuuauaaaucugu

SEQ ID NO: 756712 - RNA, 14 nt, Leptospira interrogans serovar lai str. 56601
uaagaucauuuaaa

SEQ ID NO: 756713 - RNA, 13 nt, Leptospira interrogans serovar lai str. 56601
uaagauaaauuau

SEQ ID NO: 756714 - RNA, 23 nt, Leptospira interrogans serovar lai str. 56601
uaagaguuacuacaauuuuagaa

SEQ ID NO: 756715 - RNA, 20 nt, Leptospira interrogans serovar lai str. 56601
uaagauaaauuuaguaguaa

SEQ ID NO: 756716 - RNA, 14 nt, Leptospira interrogans serovar lai str. 56601
uaagaucaaagaga

SEQ ID NO: 756717 - RNA, 15 nt, Leptospira interrogans serovar lai str. 56601
uaagauccaaauuuu

SEQ ID NO: 756718 - RNA, 16 nt, Leptospira interrogans serovar lai str. 56601
uaagauaugaauuaau

SEQ ID NO: 756719 - RNA, 21 nt, Leptospira interrogans serovar lai str. 56601
uaagagaugugaguuuuaaaa

SEQ ID NO: 756720 - RNA, 19 nt, Leptospira interrogans serovar lai str. 56601
uaagagaauuucuauaaaa

SEQ ID NO: 756721 - RNA, 17 nt, Leptospira interrogans serovar lai str. 56601
uaagagucauuuuuaaa

SEQ ID NO: 756722 - RNA, 18 nt, Leptospira interrogans serovar lai str. 56601
uaagaguagaguaagaaa

SEQ ID NO: 756723 - RNA, 17 nt, Leptospira interrogans serovar lai str. 56601
uaagagcgucuuugaau

SEQ ID NO: 756724 - RNA, 18 nt, Leptospira interrogans serovar lai str. 56601
uaagagcgucuuugaauu

SEQ ID NO: 756725 - RNA, 19 nt, Leptospira interrogans serovar lai str. 56601
uaagaauuuaucauuucuu

SEQ ID NO: 756726 - RNA, 15 nt, Leptospira interrogans serovar lai str. 56601
uaagacccuaaaaaa

SEQ ID NO: 756727 - RNA, 21 nt, Leptospira interrogans serovar lai str. 56601
uaagagaaccucuauaaaauc

SEQ ID NO: 756728 - RNA, 17 nt, Leptospira interrogans serovar lai str. 56601
uaagaauaauuuaaacu

SEQ ID NO: 756729 - RNA, 12 nt, Leptospira interrogans serovar lai str. 56601
uaagaauauuau

SEQ ID NO: 756730 - RNA, 22 nt, Leptospira interrogans serovar lai str. 56601
uaagaauccaugauccauuuuu

SEQ ID NO: 756731 - RNA, 15 nt, Leptospira interrogans serovar lai str. 56601
uaagaaucgaaaaaa

SEQ ID NO: 756732 - RNA, 16 nt, Leptospira interrogans serovar lai str. 56601
uaagaaucgaaaaaau

SEQ ID NO: 756733 - RNA, 17 nt, Leptospira interrogans serovar lai str. 56601
uaagaaucgaaaaaaua

SEQ ID NO: 756734 - RNA, 15 nt, Leptospira interrogans serovar lai str. 56601
uaagaaucaaaucuu

SEQ ID NO: 756735 - RNA, 22 nt, Leptospira interrogans serovar lai str. 56601
uaagaauguuuuccagaaacca

SEQ ID NO: 756736 - RNA, 15 nt, Leptospira interrogans serovar lai str. 56601
uaagaauuuguuugu

SEQ ID NO: 756737 - RNA, 14 nt, Leptospira interrogans serovar lai str. 56601
uaagaauuuuaaaa

SEQ ID NO: 756738 - RNA, 16 nt, Leptospira interrogans serovar lai str. 56601
uaagaauuuuaaaaaa

SEQ ID NO: 756739 - RNA, 17 nt, Leptospira interrogans serovar lai str. 56601
uaagaauuuuaaaaaau

SEQ ID NO: 756740 - RNA, 12 nt, Leptospira interrogans serovar lai str. 56601
uaacuucauuuc

SEQ ID NO: 756741 - RNA, 21 nt, Leptospira interrogans serovar lai str. 56601
uaacuuagucuuuguuuauug

SEQ ID NO: 756742 - RNA, 16 nt, Leptospira interrogans serovar lai str. 56601
uaacuuauaagacauu

SEQ ID NO: 756743 - RNA, 22 nt, Leptospira interrogans serovar lai str. 56601
uaagaacaaacaccacaauuua

SEQ ID NO: 756744 - RNA, 16 nt, Leptospira interrogans serovar lai str. 56601
uaagaacaauuuaaaa

SEQ ID NO: 756745 - RNA, 12 nt, Leptospira interrogans serovar lai str. 56601
uaacuuuuucag

SEQ ID NO: 756746 - RNA, 17 nt, Leptospira interrogans serovar lai str. 56601
uaagaaagacuuuuccu

SEQ ID NO: 756747 - RNA, 14 nt, Leptospira interrogans serovar lai str. 56601
uaagaaaguauuaa

SEQ ID NO: 756748 - RNA, 12 nt, Leptospira interrogans serovar lai str. 56601
uaagaaauagau

SEQ ID NO: 756749 - RNA, 17 nt, Leptospira interrogans serovar lai str. 56601
uaagaaaaaacuuucua

SEQ ID NO: 756750 - RNA, 12 nt, Leptospira interrogans serovar lai str. 56601
uaagaaaaaagc

SEQ ID NO: 756751 - RNA, 15 nt, Leptospira interrogans serovar lai str. 56601
uaagaaaaaauuucu

SEQ ID NO: 756752 - RNA, 17 nt, Leptospira interrogans serovar lai str. 56601
uaagaaaaaauuucucc

SEQ ID NO: 756753 - RNA, 14 nt, Leptospira interrogans serovar lai str. 56601
uaagaaaaacuagg

SEQ ID NO: 756754 - RNA, 15 nt, Leptospira interrogans serovar lai str. 56601
uaacuuugaaaauuu

SEQ ID NO: 756755 - RNA, 11 nt, Leptospira interrogans serovar lai str. 56601
uaagaaaauau

SEQ ID NO: 756756 - RNA, 13 nt, Leptospira interrogans serovar lai str. 56601
uaagaaaauuuaa

SEQ ID NO: 756757 - RNA, 15 nt, Leptospira interrogans serovar lai str. 56601
uaagaaaauuuaaaa

SEQ ID NO: 756758 - RNA, 13 nt, Leptospira interrogans serovar lai str. 56601
uaagaaaaauuga

SEQ ID NO: 756759 - RNA, 12 nt, Leptospira interrogans serovar lai str. 56601
uaagaaaaccau

SEQ ID NO: 756760 - RNA, 21 nt, Leptospira interrogans serovar lai str. 56601
uaacuuuuuuuaaaaaauuca

SEQ ID NO: 756761 - RNA, 12 nt, Leptospira interrogans serovar lai str. 56601
uaagaaaacuca

SEQ ID NO: 756762 - RNA, 23 nt, Leptospira interrogans serovar lai str. 56601
uaacuuucuuuuagaaaauuaua

SEQ ID NO: 756763 - RNA, 12 nt, Leptospira interrogans serovar lai str. 56601
uaacuuuuacug

SEQ ID NO: 756764 - RNA, 16 nt, Leptospira interrogans serovar lai str. 56601
uaacuuuuauucucuu

SEQ ID NO: 756765 - RNA, 20 nt, Leptospira interrogans serovar lai str. 56601
uaacuuugauagaaaaaauc

SEQ ID NO: 756766 - RNA, 13 nt, Leptospira interrogans serovar lai str. 56601
uaacuaacuauga

SEQ ID NO: 756767 - RNA, 15 nt, Leptospira interrogans serovar lai str. 56601
uaacuacacgagagc

SEQ ID NO: 756768 - RNA, 22 nt, Leptospira interrogans serovar lai str. 56601
uaacucguuagagaaaagcauu

SEQ ID NO: 756769 - RNA, 15 nt, Leptospira interrogans serovar lai str. 56601
uaacucuauuaguuu

SEQ ID NO: 756770 - RNA, 16 nt, Leptospira interrogans serovar lai str. 56601
uaacuccuacauuaga

SEQ ID NO: 756771 - RNA, 19 nt, Leptospira interrogans serovar lai str. 56601
uaacuccuacauuagaguu

SEQ ID NO: 756772 - RNA, 22 nt, Leptospira interrogans serovar lai str. 56601
uaacucauauagaaauuauagu

SEQ ID NO: 756773 - RNA, 23 nt, Leptospira interrogans serovar lai str. 56601
uaacucauauagaaauuauagua

SEQ ID NO: 756774 - RNA, 17 nt, Leptospira interrogans serovar lai str. 56601
uaacucaucuaaucgaa

SEQ ID NO: 756775 - RNA, 12 nt, Leptospira interrogans serovar lai str. 56601
uaacugguuuuu

SEQ ID NO: 756776 - RNA, 15 nt, Leptospira interrogans serovar lai str. 56601
uaacugguuuuucuu

SEQ ID NO: 756777 - RNA, 21 nt, Leptospira interrogans serovar lai str. 56601
uaaccccuaagcguucuaagu

SEQ ID NO: 756778 - RNA, 16 nt, Leptospira interrogans serovar lai str. 56601
uaacgggaauuauaaa

SEQ ID NO: 756779 - RNA, 11 nt, Leptospira interrogans serovar lai str. 56601
uaacaacucua

SEQ ID NO: 756780 - RNA, 20 nt, Leptospira interrogans serovar lai str. 56601
uaacacucaacgauaagaau

SEQ ID NO: 756781 - RNA, 20 nt, Leptospira interrogans serovar lai str. 56601
uaacacgauacucaauauuu

SEQ ID NO: 756782 - RNA, 17 nt, Leptospira interrogans serovar lai str. 56601
uaaauuuuuugcaaaaa

SEQ ID NO: 756783 - RNA, 22 nt, Leptospira interrogans serovar lai str. 56601
uaaauuuuuuggaaaucgaaaa

SEQ ID NO: 756784 - RNA, 13 nt, Leptospira interrogans serovar lai str. 56601
uaacaaaaauacu

SEQ ID NO: 756785 - RNA, 14 nt, Leptospira interrogans serovar lai str. 56601
uaacaaaaaucaac

SEQ ID NO: 756786 - RNA, 13 nt, Leptospira interrogans serovar lai str. 56601
uaaauuuuuauua

SEQ ID NO: 756787 - RNA, 20 nt, Leptospira interrogans serovar lai str. 56601
uaaauuuuuuagaaaucaau

SEQ ID NO: 756788 - RNA, 18 nt, Leptospira interrogans serovar lai str. 56601
uaacaaaacugcuucaau

SEQ ID NO: 756789 - RNA, 23 nt, Leptospira interrogans serovar lai str. 56601
uaacaaaacugcuucaauugucc

SEQ ID NO: 756790 - RNA, 15 nt, Leptospira interrogans serovar lai str. 56601
uaacaacauuagaau

SEQ ID NO: 756791 - RNA, 19 nt, Leptospira interrogans serovar lai str. 56601
uaacaaaaaaugcucaaaa

SEQ ID NO: 756792 - RNA, 21 nt, Leptospira interrogans serovar lai str. 56601
uaaaugugggaacuaccacaa

SEQ ID NO: 756793 - RNA, 22 nt, Leptospira interrogans serovar lai str. 56601
uaaaugugggaacuacuacaau

SEQ ID NO: 756794 - RNA, 16 nt, Leptospira interrogans serovar lai str. 56601
uaaauguuauuuugua

SEQ ID NO: 756795 - RNA, 15 nt, Leptospira interrogans serovar lai str. 56601
uaaauguucaaauuc

SEQ ID NO: 756796 - RNA, 14 nt, Leptospira interrogans serovar lai str. 56601
uaaauguuauugau

SEQ ID NO: 756797 - RNA, 22 nt, Leptospira interrogans serovar lai str. 56601
uaaauguauauucguuguuucu

SEQ ID NO: 756798 - RNA, 20 nt, Leptospira interrogans serovar lai str. 56601
uaacauccaaacucuuaauc

SEQ ID NO: 756799 - RNA, 23 nt, Leptospira interrogans serovar lai str. 56601
uaacaucggaaacgcaaugucuc

SEQ ID NO: 756800 - RNA, 17 nt, Leptospira interrogans serovar lai str. 56601
uaacaguucucacagau

SEQ ID NO: 756801 - RNA, 17 nt, Leptospira interrogans serovar lai str. 56601
uaacaguuauuauuuaa

SEQ ID NO: 756802 - RNA, 15 nt, Leptospira interrogans serovar lai str. 56601
uaacagcuacagcug

SEQ ID NO: 756803 - RNA, 21 nt, Leptospira interrogans serovar lai str. 56601
uaaauaagcuaagcauaaaau

SEQ ID NO: 756804 - RNA, 22 nt, Leptospira interrogans serovar lai str. 56601
uaaauaagcuaagcauaaaauu

SEQ ID NO: 756805 - RNA, 15 nt, Leptospira interrogans serovar lai str. 56601
uaaauaauaauauac

SEQ ID NO: 756806 - RNA, 17 nt, Leptospira interrogans serovar lai str. 56601
uaaauacauacaaugaa

SEQ ID NO: 756807 - RNA, 18 nt, Leptospira interrogans serovar lai str. 56601
uaaauacaucucuuuuuu

SEQ ID NO: 756808 - RNA, 20 nt, Leptospira interrogans serovar lai str. 56601
uaaauagggaauauuccauu

SEQ ID NO: 756809 - RNA, 23 nt, Leptospira interrogans serovar lai str. 56601
uaaauaccuguucggaguuguau

SEQ ID NO: 756810 - RNA, 16 nt, Leptospira interrogans serovar lai str. 56601
uaaauaccuaaauauu

SEQ ID NO: 756811 - RNA, 23 nt, Leptospira interrogans serovar lai str. 56601
uaaaguaguuucgccaaucucca

SEQ ID NO: 756812 - RNA, 18 nt, Leptospira interrogans serovar lai str. 56601
uaaaguccaaaucaaaaa

SEQ ID NO: 756813 - RNA, 21 nt, Leptospira interrogans serovar lai str. 56601
uaaaguccaaaucaaaaaagu

SEQ ID NO: 756814 - RNA, 15 nt, Leptospira interrogans serovar lai str. 56601
uaaagucuauuuccc

SEQ ID NO: 756815 - RNA, 17 nt, Leptospira interrogans serovar lai str. 56601
uaaagucuauuucccaa

SEQ ID NO: 756816 - RNA, 19 nt, Leptospira interrogans serovar lai str. 56601
uaaagucuauuucccaaaa

SEQ ID NO: 756817 - RNA, 22 nt, Leptospira interrogans serovar lai str. 56601
uaaagucguuuuuaagcgauuu

SEQ ID NO: 756818 - RNA, 16 nt, Leptospira interrogans serovar lai str. 56601
uaaaguuaauacaaaa

SEQ ID NO: 756819 - RNA, 16 nt, Leptospira interrogans serovar lai str. 56601
uaaaguguaaacuauu

SEQ ID NO: 756820 - RNA, 23 nt, Leptospira interrogans serovar lai str. 56601
uaaagugugcaaacggauaaaau

SEQ ID NO: 756821 - RNA, 15 nt, Leptospira interrogans serovar lai str. 56601
uaaaucaugaucaaa

SEQ ID NO: 756822 - RNA, 16 nt, Leptospira interrogans serovar lai str. 56601
uaaaucaugaucaaau

SEQ ID NO: 756823 - RNA, 19 nt, Leptospira interrogans serovar lai str. 56601
uaaaucaugaucaaauuca

SEQ ID NO: 756824 - RNA, 17 nt, Leptospira interrogans serovar lai str. 56601
uaaaucagaauaaucuc

SEQ ID NO: 756825 - RNA, 15 nt, Leptospira interrogans serovar lai str. 56601
uaaauauuaauuuaa

SEQ ID NO: 756826 - RNA, 17 nt, Leptospira interrogans serovar lai str. 56601
uaaauauuaauuuaaaa

SEQ ID NO: 756827 - RNA, 22 nt, Leptospira interrogans serovar lai str. 56601
uaaauauuaauuuaaaaacaag

SEQ ID NO: 756828 - RNA, 14 nt, Leptospira interrogans serovar lai str. 56601
uaaauauucucuau

SEQ ID NO: 756829 - RNA, 22 nt, Leptospira interrogans serovar lai str. 56601
uaaaugauaauaauuagaaaaa

SEQ ID NO: 756830 - RNA, 21 nt, Leptospira interrogans serovar lai str. 56601
uaaaugauacguucaaacuug

SEQ ID NO: 756831 - RNA, 19 nt, Leptospira interrogans serovar lai str. 56601
uaaaucuaauucuucuaau

SEQ ID NO: 756832 - RNA, 19 nt, Leptospira interrogans serovar lai str. 56601
uaaaugcaccguuucuaua

SEQ ID NO: 756833 - RNA, 15 nt, Leptospira interrogans serovar lai str. 56601
uaaaucccauuuuaa

SEQ ID NO: 756834 - RNA, 16 nt, Leptospira interrogans serovar lai str. 56601
uaaaucccauuuuaac

SEQ ID NO: 756835 - RNA, 19 nt, Leptospira interrogans serovar lai str. 56601
uaaaucccauuuuagcaua

SEQ ID NO: 756836 - RNA, 19 nt, Leptospira interrogans serovar lai str. 56601
uaaauccguauacuuuaaa

SEQ ID NO: 756837 - RNA, 20 nt, Leptospira interrogans serovar lai str. 56601
uaaauccguauacuuuaaaa

SEQ ID NO: 756838 - RNA, 15 nt, Leptospira interrogans serovar lai str. 56601
uaaauccaacuuaaa

SEQ ID NO: 756839 - RNA, 21 nt, Leptospira interrogans serovar lai str. 56601
uaaaucgaaucgaauguauuu

SEQ ID NO: 756840 - RNA, 18 nt, Leptospira interrogans serovar lai str. 56601
uaaagaaccgacaaucgu

SEQ ID NO: 756841 - RNA, 13 nt, Leptospira interrogans serovar lai str. 56601
uaaagaaaaggaa

SEQ ID NO: 756842 - RNA, 19 nt, Leptospira interrogans serovar lai str. 56601
uaaagaaaguaauuuugaa

SEQ ID NO: 756843 - RNA, 11 nt, Leptospira interrogans serovar lai str. 56601
uaaagaaacuc

SEQ ID NO: 756844 - RNA, 21 nt, Leptospira interrogans serovar lai str. 56601
uaaagaaacucauaaaauaac

SEQ ID NO: 756845 - RNA, 13 nt, Leptospira interrogans serovar lai str. 56601
uaaacuuauauug

SEQ ID NO: 756846 - RNA, 19 nt, Leptospira interrogans serovar lai str. 56601
uaaacuuuuuugaauauag

SEQ ID NO: 756847 - RNA, 13 nt, Leptospira interrogans serovar lai str. 56601
uaaacuucaaaaa

SEQ ID NO: 756848 - RNA, 18 nt, Leptospira interrogans serovar lai str. 56601
uaaacuucaaaaaauaua

SEQ ID NO: 756849 - RNA, 14 nt, Leptospira interrogans serovar lai str. 56601
uaaagaagagccuc

SEQ ID NO: 756850 - RNA, 21 nt, Leptospira interrogans serovar lai str. 56601
uaaagcaaauaccaaaccucu

SEQ ID NO: 756851 - RNA, 18 nt, Leptospira interrogans serovar lai str. 56601
uaaagauuuuucuucuuc

SEQ ID NO: 756852 - RNA, 16 nt, Leptospira interrogans serovar lai str. 56601
uaaacccauuuuagaa

SEQ ID NO: 756853 - RNA, 16 nt, Leptospira interrogans serovar lai str. 56601
uaaacccugagaauau

SEQ ID NO: 756854 - RNA, 17 nt, Leptospira interrogans serovar lai str. 56601
uaaacuagauuauugau

SEQ ID NO: 756855 - RNA, 13 nt, Leptospira interrogans serovar lai str. 56601
uaaacuaucuauu

SEQ ID NO: 756856 - RNA, 16 nt, Leptospira interrogans serovar lai str. 56601
uaaacuaucuauuaga

SEQ ID NO: 756857 - RNA, 19 nt, Leptospira interrogans serovar lai str. 56601
uaaacuaucuauuagaaca

SEQ ID NO: 756858 - RNA, 15 nt, Leptospira interrogans serovar lai str. 56601
uaaacuauuacguaa

SEQ ID NO: 756859 - RNA, 16 nt, Leptospira interrogans serovar lai str. 56601
uaaacuguaaacuuga

SEQ ID NO: 756860 - RNA, 18 nt, Leptospira interrogans serovar lai str. 56601
uaaacuguaaacuugauu

SEQ ID NO: 756861 - RNA, 13 nt, Leptospira interrogans serovar lai str. 56601
uaaacucaaagaa

SEQ ID NO: 756862 - RNA, 17 nt, Leptospira interrogans serovar lai str. 56601
uaaacucauucuaguuu

SEQ ID NO: 756863 - RNA, 15 nt, Leptospira interrogans serovar lai str. 56601
uaaaaauacuaaaag

SEQ ID NO: 756864 - RNA, 20 nt, Leptospira interrogans serovar lai str. 56601
uaaaaaugaaaucuacaaaa

SEQ ID NO: 756865 - RNA, 16 nt, Leptospira interrogans serovar lai str. 56601
uaaaaauacuuuauuu

SEQ ID NO: 756866 - RNA, 14 nt, Leptospira interrogans serovar lai str. 56601
uaaaaauaaagaaa

SEQ ID NO: 756867 - RNA, 20 nt, Leptospira interrogans serovar lai str. 56601
uaaaaaguuuuucuaaauuu

SEQ ID NO: 756868 - RNA, 16 nt, Leptospira interrogans serovar lai str. 56601
uaaaaauaaaauguag

SEQ ID NO: 756869 - RNA, 12 nt, Leptospira interrogans serovar lai str. 56601
uaaaaaguaaaa

SEQ ID NO: 756870 - RNA, 23 nt, Leptospira interrogans serovar lai str. 56601
uaaaaagugaauuaaaagaaacu

SEQ ID NO: 756871 - RNA, 11 nt, Leptospira interrogans serovar lai str. 56601
uaaaaagaauc

SEQ ID NO: 756872 - RNA, 17 nt, Leptospira interrogans serovar lai str. 56601
uaaaaagagccauaaau

SEQ ID NO: 756873 - RNA, 17 nt, Leptospira interrogans serovar lai str. 56601
guuugaggucccacaau

SEQ ID NO: 756874 - RNA, 20 nt, Leptospira interrogans serovar lai str. 56601
guuugagugaucauucuuua

SEQ ID NO: 756875 - RNA, 16 nt, Leptospira interrogans serovar lai str. 56601
guuugaguuucuuuuu

SEQ ID NO: 756876 - RNA, 18 nt, Leptospira interrogans serovar lai str. 56601
guuugauaauuugugaac

SEQ ID NO: 756877 - RNA, 13 nt, Leptospira interrogans serovar lai str. 56601
guuugaucuuuuu

SEQ ID NO: 756878 - RNA, 18 nt, Leptospira interrogans serovar lai str. 56601
uaaaaaccccauuaaaaa

SEQ ID NO: 756879 - RNA, 21 nt, Leptospira interrogans serovar lai str. 56601
uaaaaacuuaugcuauuuaau

SEQ ID NO: 756880 - RNA, 14 nt, Leptospira interrogans serovar lai str. 56601
uaaaaacuucacuu

SEQ ID NO: 756881 - RNA, 20 nt, Leptospira interrogans serovar lai str. 56601
uaaaaacucuaccuuuauuu

SEQ ID NO: 756882 - RNA, 10 nt, Leptospira interrogans serovar lai str. 56601
uaaaaagaag

SEQ ID NO: 756883 - RNA, 15 nt, Leptospira interrogans serovar lai str. 56601
uaaaaacuaauaauu

SEQ ID NO: 756884 - RNA, 19 nt, Leptospira interrogans serovar lai str. 56601
uaaaaaccguuuucaauua

SEQ ID NO: 756885 - RNA, 23 nt, Leptospira interrogans serovar lai str. 56601
uaaaaacgguauuuaaaauuaau

SEQ ID NO: 756886 - RNA, 16 nt, Leptospira interrogans serovar lai str. 56601
uaaaaacgucaaaauu

SEQ ID NO: 756887 - RNA, 17 nt, Leptospira interrogans serovar lai str. 56601
uaaaaacgucuaguccu

SEQ ID NO: 756888 - RNA, 19 nt, Leptospira interrogans serovar lai str. 56601
uaaaaaugaguaaacuauu

SEQ ID NO: 756889 - RNA, 16 nt, Leptospira interrogans serovar lai str. 56601
uaaaaaugauacuauu

SEQ ID NO: 756890 - RNA, 20 nt, Leptospira interrogans serovar lai str. 56601
uaaaaauucaacuaaauccu

SEQ ID NO: 756891 - RNA, 12 nt, Leptospira interrogans serovar lai str. 56601
uaaaaauuaauu

SEQ ID NO: 756892 - RNA, 18 nt, Leptospira interrogans serovar lai str. 56601
uaaaaauuagaaaugauu

SEQ ID NO: 756893 - RNA, 17 nt, Leptospira interrogans serovar lai str. 56601
uaaaaauggauacuuau

SEQ ID NO: 756894 - RNA, 12 nt, Leptospira interrogans serovar lai str. 56601
uaaaaauugauc

SEQ ID NO: 756895 - RNA, 12 nt, Leptospira interrogans serovar lai str. 56601
uaaaaauuuaau

SEQ ID NO: 756896 - RNA, 13 nt, Leptospira interrogans serovar lai str. 56601
uaaaaauuuaauu

SEQ ID NO: 756897 - RNA, 14 nt, Leptospira interrogans serovar lai str. 56601
uaaaaauuuaauuu

SEQ ID NO: 756898 - RNA, 15 nt, Leptospira interrogans serovar lai str. 56601
uaaaaauuuauaaag

SEQ ID NO: 756899 - RNA, 12 nt, Leptospira interrogans serovar lai str. 56601
uaaaaauuuaaa

SEQ ID NO: 756900 - RNA, 13 nt, Leptospira interrogans serovar lai str. 56601
uaaaaauuuccuu

SEQ ID NO: 756901 - RNA, 14 nt, Leptospira interrogans serovar lai str. 56601
uaaaaauuuccuuu

SEQ ID NO: 756902 - RNA, 21 nt, Leptospira interrogans serovar lai str. 56601
uaaaaauuucagauuuuauuu

SEQ ID NO: 756903 - RNA, 23 nt, Leptospira interrogans serovar lai str. 56601
uaaaaauuugcgauauucuauua

SEQ ID NO: 756904 - RNA, 16 nt, Leptospira interrogans serovar lai str. 56601
uaaaaauuuuauuaaa

SEQ ID NO: 756905 - RNA, 13 nt, Leptospira interrogans serovar lai str. 56601
uaaaaauuuugaa

SEQ ID NO: 756906 - RNA, 11 nt, Leptospira interrogans serovar lai str. 56601
uaaaacaaaaa

SEQ ID NO: 756907 - RNA, 15 nt, Leptospira interrogans serovar lai str. 56601
uaaaacaaaaaaaca

SEQ ID NO: 756908 - RNA, 16 nt, Leptospira interrogans serovar lai str. 56601
uaaaacaaaaaaacaa

SEQ ID NO: 756909 - RNA, 12 nt, Leptospira interrogans serovar lai str. 56601
uaaaacaaucuu

SEQ ID NO: 756910 - RNA, 20 nt, Leptospira interrogans serovar lai str. 56601
uaaaacaaucuucaaauucu

SEQ ID NO: 756911 - RNA, 13 nt, Leptospira interrogans serovar lai str. 56601
uaaaaccaaaaug

SEQ ID NO: 756912 - RNA, 19 nt, Leptospira interrogans serovar lai str. 56601
uaaaagaagauuuuucuuu

SEQ ID NO: 756913 - RNA, 21 nt, Leptospira interrogans serovar lai str. 56601
uaaaagaauauuucuaaaauu

SEQ ID NO: 756914 - RNA, 22 nt, Leptospira interrogans serovar lai str. 56601
uaaaagaauauuucuaaaauug

SEQ ID NO: 756915 - RNA, 19 nt, Leptospira interrogans serovar lai str. 56601
uaaaagaaucauuaaucag

SEQ ID NO: 756916 - RNA, 22 nt, Leptospira interrogans serovar lai str. 56601
uaaaagcuuuugcuuuuaaagg

SEQ ID NO: 756917 - RNA, 22 nt, Leptospira interrogans serovar lai str. 56601
uaaaagauccgcuacaaauuca

SEQ ID NO: 756918 - RNA, 22 nt, Leptospira interrogans serovar lai str. 56601
uaaaacccaucguaaacaaaag

SEQ ID NO: 756919 - RNA, 17 nt, Leptospira interrogans serovar lai str. 56601
uaaaaccgcugaaaaaa

SEQ ID NO: 756920 - RNA, 16 nt, Leptospira interrogans serovar lai str. 56601
uaaaacucuaaauuca

SEQ ID NO: 756921 - RNA, 20 nt, Leptospira interrogans serovar lai str. 56601
uaaaacugaguaccguuuau

SEQ ID NO: 756922 - RNA, 22 nt, Leptospira interrogans serovar lai str. 56601
uaaaacugaguaccguuuauuu

SEQ ID NO: 756923 - RNA, 11 nt, Leptospira interrogans serovar lai str. 56601
uaaaauucaca

SEQ ID NO: 756924 - RNA, 16 nt, Leptospira interrogans serovar lai str. 56601
uaaaauucagauuuca

SEQ ID NO: 756925 - RNA, 14 nt, Leptospira interrogans serovar lai str. 56601
uaaaauuauuaacu

SEQ ID NO: 756926 - RNA, 13 nt, Leptospira interrogans serovar lai str. 56601
uaaaauucaaaaa

SEQ ID NO: 756927 - RNA, 16 nt, Leptospira interrogans serovar lai str. 56601
uaaaauucaaaaagaa

SEQ ID NO: 756928 - RNA, 18 nt, Leptospira interrogans serovar lai str. 56601
uaaaauuagauuuauuga

SEQ ID NO: 756929 - RNA, 23 nt, Leptospira interrogans serovar lai str. 56601
uaaaauucuccgauuugguuuuc

SEQ ID NO: 756930 - RNA, 19 nt, Leptospira interrogans serovar lai str. 56601
uaaaauucuuagaguaaaa

SEQ ID NO: 756931 - RNA, 20 nt, Leptospira interrogans serovar lai str. 56601
uaaaauuguaggaacuacua

SEQ ID NO: 756932 - RNA, 13 nt, Leptospira interrogans serovar lai str. 56601
uaaaauuuuucuc

SEQ ID NO: 756933 - RNA, 16 nt, Leptospira interrogans serovar lai str. 56601
uaaaauuuuuaaaaaa

SEQ ID NO: 756934 - RNA, 15 nt, Leptospira interrogans serovar lai str. 56601
uaaaauuuuauaaaa

SEQ ID NO: 756935 - RNA, 18 nt, Leptospira interrogans serovar lai str. 56601
uaaaauuuuauaaaaauc

SEQ ID NO: 756936 - RNA, 15 nt, Leptospira interrogans serovar lai str. 56601
uaaaauuugaaaaga

SEQ ID NO: 756937 - RNA, 14 nt, Leptospira interrogans serovar lai str. 56601
uaaaauuugaaagu

SEQ ID NO: 756938 - RNA, 18 nt, Leptospira interrogans serovar lai str. 56601
uaaaauuuguaggaacuc

SEQ ID NO: 756939 - RNA, 12 nt, Leptospira interrogans serovar lai str. 56601
uaaaauuuuaaa

SEQ ID NO: 756940 - RNA, 13 nt, Leptospira interrogans serovar lai str. 56601
uaaaauuucauuu

SEQ ID NO: 756941 - RNA, 12 nt, Leptospira interrogans serovar lai str. 56601
uaaaauuuauua

SEQ ID NO: 756942 - RNA, 22 nt, Leptospira interrogans serovar lai str. 56601
uaaaauuuagaaauagauauaa

SEQ ID NO: 756943 - RNA, 14 nt, Leptospira interrogans serovar lai str. 56601
uaaaauuuaaauuu

SEQ ID NO: 756944 - RNA, 21 nt, Leptospira interrogans serovar lai str. 56601
uaaacaaauccgaaaauguag

SEQ ID NO: 756945 - RNA, 18 nt, Leptospira interrogans serovar lai str. 56601
uaaaauuuuuaauaaaau

SEQ ID NO: 756946 - RNA, 11 nt, Leptospira interrogans serovar lai str. 56601
uaaacaaagac

SEQ ID NO: 756947 - RNA, 15 nt, Leptospira interrogans serovar lai str. 56601
uaaacaaagacaaag

SEQ ID NO: 756948 - RNA, 13 nt, Leptospira interrogans serovar lai str. 56601
uaaacaauaaaau

SEQ ID NO: 756949 - RNA, 16 nt, Leptospira interrogans serovar lai str. 56601
uaaaauaucuuuaauu

SEQ ID NO: 756950 - RNA, 17 nt, Leptospira interrogans serovar lai str. 56601
uaaaauaucuuuaauug

SEQ ID NO: 756951 - RNA, 21 nt, Leptospira interrogans serovar lai str. 56601
uaaaauauagugguuuguaau

SEQ ID NO: 756952 - RNA, 19 nt, Leptospira interrogans serovar lai str. 56601
uaaaaggagaauucaauuu

SEQ ID NO: 756953 - RNA, 22 nt, Leptospira interrogans serovar lai str. 56601
uaaaaggaggaucguucuccuu

SEQ ID NO: 756954 - RNA, 15 nt, Leptospira interrogans serovar lai str. 56601
uaaaauaaauuuaua

SEQ ID NO: 756955 - RNA, 15 nt, Leptospira interrogans serovar lai str. 56601
uaaaagggacguagu

SEQ ID NO: 756956 - RNA, 20 nt, Leptospira interrogans serovar lai str. 56601
uaaaauggacugcaaaauca

SEQ ID NO: 756957 - RNA, 17 nt, Leptospira interrogans serovar lai str. 56601
uaaaauggguuuucauu

SEQ ID NO: 756958 - RNA, 18 nt, Leptospira interrogans serovar lai str. 56601
uaaaauggguuuucauuu

SEQ ID NO: 756959 - RNA, 18 nt, Leptospira interrogans serovar lai str. 56601
uaaaauggguuuuuaauu

SEQ ID NO: 756960 - RNA, 17 nt, Leptospira interrogans serovar lai str. 56601
uaaaauguacaauuaaa

SEQ ID NO: 756961 - RNA, 17 nt, Leptospira interrogans serovar lai str. 56601
uaaaauguggaaacuau

SEQ ID NO: 756962 - RNA, 20 nt, Leptospira interrogans serovar lai str. 56601
uaaaauguggaaacuaucac

SEQ ID NO: 756963 - RNA, 22 nt, Leptospira interrogans serovar lai str. 56601
uaaaauuaaauaccuaaauauu

SEQ ID NO: 756964 - RNA, 12 nt, Leptospira interrogans serovar lai str. 56601
uaaaauuaaaag

SEQ ID NO: 756965 - RNA, 15 nt, Leptospira interrogans serovar lai str. 56601
uaaaauguuuuauuu

SEQ ID NO: 756966 - RNA, 18 nt, Leptospira interrogans serovar lai str. 56601
uaaaauguauuaaaguug

SEQ ID NO: 756967 - RNA, 10 nt, Leptospira interrogans serovar lai str. 56601
uaaaauuaaa

SEQ ID NO: 756968 - RNA, 14 nt, Leptospira interrogans serovar lai str. 56601
uaaaauuaaaaauu

SEQ ID NO: 756969 - RNA, 22 nt, Leptospira interrogans serovar lai str. 56601
uaaaaugcaguaguuccuacaa

SEQ ID NO: 756970 - RNA, 21 nt, Leptospira interrogans serovar lai str. 56601
uaaaaugcaguaguuccuaua

SEQ ID NO: 756971 - RNA, 18 nt, Leptospira interrogans serovar lai str. 56601
uaaaaucggaaaauugaa

SEQ ID NO: 756972 - RNA, 14 nt, Leptospira interrogans serovar lai str. 56601
uaaaaucuaaaaaa

SEQ ID NO: 756973 - RNA, 15 nt, Leptospira interrogans serovar lai str. 56601
uaaaaucuaaaaaaa

SEQ ID NO: 756974 - RNA, 17 nt, Leptospira interrogans serovar lai str. 56601
uaaaaucuaaaaaaaau

SEQ ID NO: 756975 - RNA, 17 nt, Leptospira interrogans serovar lai str. 56601
uaaaaucuaaaaagaau

SEQ ID NO: 756976 - RNA, 18 nt, Leptospira interrogans serovar lai str. 56601
uaaaaucuaaaaagaauc

SEQ ID NO: 756977 - RNA, 15 nt, Leptospira interrogans serovar lai str. 56601
uaaaaucuaaaaaua

SEQ ID NO: 756978 - RNA, 21 nt, Leptospira interrogans serovar lai str. 56601
uaaaauccccaguauuuugca

SEQ ID NO: 756979 - RNA, 18 nt, Leptospira interrogans serovar lai str. 56601
uaaaauccguagccgcuu

SEQ ID NO: 756980 - RNA, 21 nt, Leptospira interrogans serovar lai str. 56601
uaaaaucgaguuucacaaaaa

SEQ ID NO: 756981 - RNA, 23 nt, Leptospira interrogans serovar lai str. 56601
uaaaaucgaguuucacaaaaaug

SEQ ID NO: 756982 - RNA, 19 nt, Leptospira interrogans serovar lai str. 56601
uaaaauccuauucaacuug

SEQ ID NO: 756983 - RNA, 13 nt, Leptospira interrogans serovar lai str. 56601
guuuaaaaacuuu

SEQ ID NO: 756984 - RNA, 15 nt, Leptospira interrogans serovar lai str. 56601
guuuaaauagauuca

SEQ ID NO: 756985 - RNA, 20 nt, Leptospira interrogans serovar lai str. 56601
guuuaaaccuucuuuaagau

SEQ ID NO: 756986 - RNA, 21 nt, Leptospira interrogans serovar lai str. 56601
guuuaaaccuucuuuaagaua

SEQ ID NO: 756987 - RNA, 14 nt, Leptospira interrogans serovar lai str. 56601
guuguugaaagggg

SEQ ID NO: 756988 - RNA, 15 nt, Leptospira interrogans serovar lai str. 56601
guuguuucaguaagu

SEQ ID NO: 756989 - RNA, 21 nt, Leptospira interrogans serovar lai str. 56601
guuguaucagauguuuuaaaa

SEQ ID NO: 756990 - RNA, 17 nt, Leptospira interrogans serovar lai str. 56601
guuguauccccauaaac

SEQ ID NO: 756991 - RNA, 20 nt, Leptospira interrogans serovar lai str. 56601
guuguauccccauaaacaaa

SEQ ID NO: 756992 - RNA, 19 nt, Leptospira interrogans serovar lai str. 56601
guuuagguaaagauuuucu

SEQ ID NO: 756993 - RNA, 18 nt, Leptospira interrogans serovar lai str. 56601
guuuauaugaguucccac

SEQ ID NO: 756994 - RNA, 19 nt, Leptospira interrogans serovar lai str. 56601
guuuauaugaguucccaca

SEQ ID NO: 756995 - RNA, 17 nt, Leptospira interrogans serovar lai str. 56601
guuuaccccgaagagcu

SEQ ID NO: 756996 - RNA, 19 nt, Leptospira interrogans serovar lai str. 56601
guuuacaauggaaaguguu

SEQ ID NO: 756997 - RNA, 19 nt, Leptospira interrogans serovar lai str. 56601
guuuacacaacauuaugaa

SEQ ID NO: 756998 - RNA, 12 nt, Leptospira interrogans serovar lai str. 56601
guuuaauuucuu

SEQ ID NO: 756999 - RNA, 13 nt, Leptospira interrogans serovar lai str. 56601
guuuaauuucuuc

SEQ ID NO: 757000 - RNA, 18 nt, Leptospira interrogans serovar lai str. 56601
guuugaaacucaguaaaa

SEQ ID NO: 757001 - RNA, 14 nt, Leptospira interrogans serovar lai str. 56601
guuucuuuuguaaa

SEQ ID NO: 757002 - RNA, 12 nt, Leptospira interrogans serovar lai str. 56601
guuugaaaaaau

SEQ ID NO: 757003 - RNA, 19 nt, Leptospira interrogans serovar lai str. 56601
guuugaauuuuacuaaaaa

SEQ ID NO: 757004 - RNA, 17 nt, Leptospira interrogans serovar lai str. 56601
guuugacguaaaaaaau

SEQ ID NO: 757005 - RNA, 15 nt, Leptospira interrogans serovar lai str. 56601
guuucuauaaaacaa

SEQ ID NO: 757006 - RNA, 22 nt, Leptospira interrogans serovar lai str. 56601
guuucuauaaaacaaaauagau

SEQ ID NO: 757007 - RNA, 21 nt, Leptospira interrogans serovar lai str. 56601
guuucuccggcgaccuuucua

SEQ ID NO: 757008 - RNA, 18 nt, Leptospira interrogans serovar lai str. 56601
guuucucauuuuauuuuu

SEQ ID NO: 757009 - RNA, 19 nt, Leptospira interrogans serovar lai str. 56601
guuucucauuuuauuuuua

SEQ ID NO: 757010 - RNA, 21 nt, Leptospira interrogans serovar lai str. 56601
guuuauccuaaugaaaaagaa

SEQ ID NO: 757011 - RNA, 17 nt, Leptospira interrogans serovar lai str. 56601
guuuaucuucucuagaa

SEQ ID NO: 757012 - RNA, 14 nt, Leptospira interrogans serovar lai str. 56601
guuuaugugaguuc

SEQ ID NO: 757013 - RNA, 22 nt, Leptospira interrogans serovar lai str. 56601
guuuaugugaguucccauagau

SEQ ID NO: 757014 - RNA, 13 nt, Leptospira interrogans serovar lai str. 56601
guuuccauaaaau

SEQ ID NO: 757015 - RNA, 14 nt, Leptospira interrogans serovar lai str. 56601
guuuccauaaaaua

SEQ ID NO: 757016 - RNA, 15 nt, Leptospira interrogans serovar lai str. 56601
guuuccaugaaauag

SEQ ID NO: 757017 - RNA, 14 nt, Leptospira interrogans serovar lai str. 56601
guuucgaaaauuuu

SEQ ID NO: 757018 - RNA, 15 nt, Leptospira interrogans serovar lai str. 56601
guuggaaucuaaacu

SEQ ID NO: 757019 - RNA, 15 nt, Leptospira interrogans serovar lai str. 56601
guugcuaagaaaaaa

SEQ ID NO: 757020 - RNA, 20 nt, Leptospira interrogans serovar lai str. 56601
guugcuauggaauuuuucaa

SEQ ID NO: 757021 - RNA, 14 nt, Leptospira interrogans serovar lai str. 56601
guugcuauaaaaag

SEQ ID NO: 757022 - RNA, 15 nt, Leptospira interrogans serovar lai str. 56601
guugcguuuaaaaac

SEQ ID NO: 757023 - RNA, 15 nt, Leptospira interrogans serovar lai str. 56601
guugcaaagaagaaa

SEQ ID NO: 757024 - RNA, 12 nt, Leptospira interrogans serovar lai str. 56601
guugauuucuac

SEQ ID NO: 757025 - RNA, 12 nt, Leptospira interrogans serovar lai str. 56601
guugauucugcu

SEQ ID NO: 757026 - RNA, 21 nt, Leptospira interrogans serovar lai str. 56601
guugaucuuauacucuuaaaa

SEQ ID NO: 757027 - RNA, 21 nt, Leptospira interrogans serovar lai str. 56601
guugcaguuccuugaacuuac

SEQ ID NO: 757028 - RNA, 14 nt, Leptospira interrogans serovar lai str. 56601
guugagcaguaaaa

SEQ ID NO: 757029 - RNA, 15 nt, Leptospira interrogans serovar lai str. 56601
guugagcaguaaaau

SEQ ID NO: 757030 - RNA, 18 nt, Leptospira interrogans serovar lai str. 56601
guugagaguuuuucuaua

SEQ ID NO: 757031 - RNA, 21 nt, Leptospira interrogans serovar lai str. 56601
guugagcaaaaauuuucuaaa

SEQ ID NO: 757032 - RNA, 22 nt, Leptospira interrogans serovar lai str. 56601
guugagcacagcaaaaaauuug

SEQ ID NO: 757033 - RNA, 16 nt, Leptospira interrogans serovar lai str. 56601
guugaguucauucuga

SEQ ID NO: 757034 - RNA, 12 nt, Leptospira interrogans serovar lai str. 56601
guugaguuucaa

SEQ ID NO: 757035 - RNA, 21 nt, Leptospira interrogans serovar lai str. 56601
guugaguuuucccuauuuuug

SEQ ID NO: 757036 - RNA, 17 nt, Leptospira interrogans serovar lai str. 56601
guugaguuuuuccuauu

SEQ ID NO: 757037 - RNA, 21 nt, Leptospira interrogans serovar lai str. 56601
guugaguuuuuccuauuuuug

SEQ ID NO: 757038 - RNA, 16 nt, Leptospira interrogans serovar lai str. 56601
guugaguuuuuguauc

SEQ ID NO: 757039 - RNA, 15 nt, Leptospira interrogans serovar lai str. 56601
guugaguaguaaaau

SEQ ID NO: 757040 - RNA, 14 nt, Leptospira interrogans serovar lai str. 56601
guugaaucuuaaau

SEQ ID NO: 757041 - RNA, 12 nt, Leptospira interrogans serovar lai str. 56601
guugaauaagau

SEQ ID NO: 757042 - RNA, 23 nt, Leptospira interrogans serovar lai str. 56601
guugaauaagauuuuagaaucag

SEQ ID NO: 757043 - RNA, 21 nt, Leptospira interrogans serovar lai str. 56601
guugaaguuacgcguuuaaau

SEQ ID NO: 757044 - RNA, 23 nt, Leptospira interrogans serovar lai str. 56601
guugaaaaucggauaguuuaaau

SEQ ID NO: 757045 - RNA, 18 nt, Leptospira interrogans serovar lai str. 56601
guucuuuuugagacaaga

SEQ ID NO: 757046 - RNA, 17 nt, Leptospira interrogans serovar lai str. 56601
guucuuuuuuccuucuu

SEQ ID NO: 757047 - RNA, 15 nt, Leptospira interrogans serovar lai str. 56601
guucuacaaaauuua

SEQ ID NO: 757048 - RNA, 18 nt, Leptospira interrogans serovar lai str. 56601
guucuaaugucguuaaau

SEQ ID NO: 757049 - RNA, 22 nt, Leptospira interrogans serovar lai str. 56601
guucuaauguuguuaaauuuuu

SEQ ID NO: 757050 - RNA, 13 nt, Leptospira interrogans serovar lai str. 56601
guucgugaagaaa

SEQ ID NO: 757051 - RNA, 16 nt, Leptospira interrogans serovar lai str. 56601
guucguggagaaaacg

SEQ ID NO: 757052 - RNA, 13 nt, Leptospira interrogans serovar lai str. 56601
guucuugugggaa

SEQ ID NO: 757053 - RNA, 15 nt, Leptospira interrogans serovar lai str. 56601
guucuugugggaacu

SEQ ID NO: 757054 - RNA, 19 nt, Leptospira interrogans serovar lai str. 56601
guucuugcaaaaauagaau

SEQ ID NO: 757055 - RNA, 19 nt, Leptospira interrogans serovar lai str. 56601
guucuucgucuaacacgga

SEQ ID NO: 757056 - RNA, 16 nt, Leptospira interrogans serovar lai str. 56601
guucagguaguaguug

SEQ ID NO: 757057 - RNA, 15 nt, Leptospira interrogans serovar lai str. 56601
guucagcuagaaaag

SEQ ID NO: 757058 - RNA, 15 nt, Leptospira interrogans serovar lai str. 56601
guucacucaaaauac

SEQ ID NO: 757059 - RNA, 14 nt, Leptospira interrogans serovar lai str. 56601
guuacuuauuuuug

SEQ ID NO: 757060 - RNA, 19 nt, Leptospira interrogans serovar lai str. 56601
guucagauucgaacuuuuu

SEQ ID NO: 757061 - RNA, 15 nt, Leptospira interrogans serovar lai str. 56601
guucgauuaaaauaa

SEQ ID NO: 757062 - RNA, 22 nt, Leptospira interrogans serovar lai str. 56601
guucgccuacacuguguucuuu

SEQ ID NO: 757063 - RNA, 14 nt, Leptospira interrogans serovar lai str. 56601
guucggaaaaagua

SEQ ID NO: 757064 - RNA, 20 nt, Leptospira interrogans serovar lai str. 56601
guucggaagauuuuucaauc

SEQ ID NO: 757065 - RNA, 16 nt, Leptospira interrogans serovar lai str. 56601
guuccuaaaaaauaaa

SEQ ID NO: 757066 - RNA, 22 nt, Leptospira interrogans serovar lai str. 56601
guuccuacaucauuuguagaga

SEQ ID NO: 757067 - RNA, 16 nt, Leptospira interrogans serovar lai str. 56601
guuccuacauuuucag

SEQ ID NO: 757068 - RNA, 15 nt, Leptospira interrogans serovar lai str. 56601
guucccgccucacaa

SEQ ID NO: 757069 - RNA, 19 nt, Leptospira interrogans serovar lai str. 56601
guuccaacguaccaaaacc

SEQ ID NO: 757070 - RNA, 17 nt, Leptospira interrogans serovar lai str. 56601
guuccaaaaccucaaaa

SEQ ID NO: 757071 - RNA, 20 nt, Leptospira interrogans serovar lai str. 56601
guuccaaaaccucaaaaaau

SEQ ID NO: 757072 - RNA, 22 nt, Leptospira interrogans serovar lai str. 56601
guuccaaauuacucuuucuauu

SEQ ID NO: 757073 - RNA, 16 nt, Leptospira interrogans serovar lai str. 56601
guuccaauuaacaaaa

SEQ ID NO: 757074 - RNA, 18 nt, Leptospira interrogans serovar lai str. 56601
guuccaauuaacaaaacu

SEQ ID NO: 757075 - RNA, 18 nt, Leptospira interrogans serovar lai str. 56601
guuccacauuuauuuuua

SEQ ID NO: 757076 - RNA, 23 nt, Leptospira interrogans serovar lai str. 56601
guuccacauuuuaaagguugagc

SEQ ID NO: 757077 - RNA, 18 nt, Leptospira interrogans serovar lai str. 56601
guuaauuuagaauaaaaa

SEQ ID NO: 757078 - RNA, 19 nt, Leptospira interrogans serovar lai str. 56601
guuacaauuuauuauaaaa

SEQ ID NO: 757079 - RNA, 21 nt, Leptospira interrogans serovar lai str. 56601
guuacauaaguuguuauaaac

SEQ ID NO: 757080 - RNA, 22 nt, Leptospira interrogans serovar lai str. 56601
guuaauuguuguuauggaauuu

SEQ ID NO: 757081 - RNA, 16 nt, Leptospira interrogans serovar lai str. 56601
guuaauacaaaacuua

SEQ ID NO: 757082 - RNA, 15 nt, Leptospira interrogans serovar lai str. 56601
guuaauagaguuguu

SEQ ID NO: 757083 - RNA, 16 nt, Leptospira interrogans serovar lai str. 56601
guuaagucguuguauu

SEQ ID NO: 757084 - RNA, 22 nt, Leptospira interrogans serovar lai str. 56601
guuaauaaauugcauaaaagaa

SEQ ID NO: 757085 - RNA, 22 nt, Leptospira interrogans serovar lai str. 56601
guuaaaguuuacaucaaaaaca

SEQ ID NO: 757086 - RNA, 23 nt, Leptospira interrogans serovar lai str. 56601
guuaaaguuuacaucaaaaacaa

SEQ ID NO: 757087 - RNA, 16 nt, Leptospira interrogans serovar lai str. 56601
guguuuauaaaaaccu

SEQ ID NO: 757088 - RNA, 18 nt, Leptospira interrogans serovar lai str. 56601
guguggucuauuacaaaa

SEQ ID NO: 757089 - RNA, 20 nt, Leptospira interrogans serovar lai str. 56601
guguaaucuuauuuuuuaau

SEQ ID NO: 757090 - RNA, 13 nt, Leptospira interrogans serovar lai str. 56601
guguaaacuauua

SEQ ID NO: 757091 - RNA, 15 nt, Leptospira interrogans serovar lai str. 56601
guguaaaaaaauuuu

SEQ ID NO: 757092 - RNA, 20 nt, Leptospira interrogans serovar lai str. 56601
guggucaacaucucaaucaa

SEQ ID NO: 757093 - RNA, 23 nt, Leptospira interrogans serovar lai str. 56601
guggucaacaucucaaucaaaau

SEQ ID NO: 757094 - RNA, 23 nt, Leptospira interrogans serovar lai str. 56601
gugguaacuacuacgaaaauuua

SEQ ID NO: 757095 - RNA, 23 nt, Leptospira interrogans serovar lai str. 56601
gugggaacuacuacgaaaauuua

SEQ ID NO: 757096 - RNA, 14 nt, Leptospira interrogans serovar lai str. 56601
gugcgguauuuuuu

SEQ ID NO: 757097 - RNA, 16 nt, Leptospira interrogans serovar lai str. 56601
gugcuauauucaaaaa

SEQ ID NO: 757098 - RNA, 22 nt, Leptospira interrogans serovar lai str. 56601
gugcuauauucaaaaaaguuua

SEQ ID NO: 757099 - RNA, 16 nt, Leptospira interrogans serovar lai str. 56601
gugaugaagagaaagu

SEQ ID NO: 757100 - RNA, 21 nt, Leptospira interrogans serovar lai str. 56601
gugauuucaugcaaaaauuua

SEQ ID NO: 757101 - RNA, 20 nt, Leptospira interrogans serovar lai str. 56601
gugauuguuuguuuuuucca

SEQ ID NO: 757102 - RNA, 14 nt, Leptospira interrogans serovar lai str. 56601
gugauuuaaaaaua

SEQ ID NO: 757103 - RNA, 16 nt, Leptospira interrogans serovar lai str. 56601
gugauuuaaaaauagu

SEQ ID NO: 757104 - RNA, 18 nt, Leptospira interrogans serovar lai str. 56601
gugauuaaaccgguaaaa

SEQ ID NO: 757105 - RNA, 15 nt, Leptospira interrogans serovar lai str. 56601
gugcauuuaaaaaau

SEQ ID NO: 757106 - RNA, 18 nt, Leptospira interrogans serovar lai str. 56601
gucgcaacauaauguuuc

SEQ ID NO: 757107 - RNA, 20 nt, Leptospira interrogans serovar lai str. 56601
gucgcaacauaauguuucaa

SEQ ID NO: 757108 - RNA, 15 nt, Leptospira interrogans serovar lai str. 56601
gucgauuagcuuaac

SEQ ID NO: 757109 - RNA, 18 nt, Leptospira interrogans serovar lai str. 56601
gucgaucuacuaaaucag

SEQ ID NO: 757110 - RNA, 13 nt, Leptospira interrogans serovar lai str. 56601
gucgauuucuuuc

SEQ ID NO: 757111 - RNA, 18 nt, Leptospira interrogans serovar lai str. 56601
gucauuuugauaauuuca

SEQ ID NO: 757112 - RNA, 14 nt, Leptospira interrogans serovar lai str. 56601
gucauuuacucaaa

SEQ ID NO: 757113 - RNA, 16 nt, Leptospira interrogans serovar lai str. 56601
gucauuuacucaaauu

SEQ ID NO: 757114 - RNA, 17 nt, Leptospira interrogans serovar lai str. 56601
guccuaaaaccucaaaa

SEQ ID NO: 757115 - RNA, 23 nt, Leptospira interrogans serovar lai str. 56601
guccuaaaaccucaaaaaauuuu

SEQ ID NO: 757116 - RNA, 13 nt, Leptospira interrogans serovar lai str. 56601
guccuccagaacc

SEQ ID NO: 757117 - RNA, 14 nt, Leptospira interrogans serovar lai str. 56601
gucagaccuaaaau

SEQ ID NO: 757118 - RNA, 18 nt, Leptospira interrogans serovar lai str. 56601
guauauaaauuuauauuu

SEQ ID NO: 757119 - RNA, 17 nt, Leptospira interrogans serovar lai str. 56601
guauauuaacuuucauu

SEQ ID NO: 757120 - RNA, 19 nt, Leptospira interrogans serovar lai str. 56601
guauauuauaaaauuugcg

SEQ ID NO: 757121 - RNA, 16 nt, Leptospira interrogans serovar lai str. 56601
gucaagauuauuuuug

SEQ ID NO: 757122 - RNA, 15 nt, Leptospira interrogans serovar lai str. 56601
gucaagcagauuugu

SEQ ID NO: 757123 - RNA, 13 nt, Leptospira interrogans serovar lai str. 56601
gucaagcccuccu

SEQ ID NO: 757124 - RNA, 23 nt, Leptospira interrogans serovar lai str. 56601
gucaauuaaauuguaugaaagaa

SEQ ID NO: 757125 - RNA, 22 nt, Leptospira interrogans serovar lai str. 56601
gucaaucuccacuauggaauuu

SEQ ID NO: 757126 - RNA, 21 nt, Leptospira interrogans serovar lai str. 56601
gucaagcgacgauagaagcga

SEQ ID NO: 757127 - RNA, 24 nt, Leptospira interrogans serovar lai str. 56601
guaguagucuuacaauuuuagaau

SEQ ID NO: 757128 - RNA, 22 nt, Leptospira interrogans serovar lai str. 56601
guagucuuacaauuuuagaauu

SEQ ID NO: 757129 - RNA, 17 nt, Leptospira interrogans serovar lai str. 56601
guaguuauauuaauauu

SEQ ID NO: 757130 - RNA, 20 nt, Leptospira interrogans serovar lai str. 56601
guaguuccuacaaauuaaau

SEQ ID NO: 757131 - RNA, 18 nt, Leptospira interrogans serovar lai str. 56601
guaguuccuacauuuuag

SEQ ID NO: 757132 - RNA, 17 nt, Leptospira interrogans serovar lai str. 56601
guaguuccuacauuuuu

SEQ ID NO: 757133 - RNA, 14 nt, Leptospira interrogans serovar lai str. 56601
guaguuuauuuuuc

SEQ ID NO: 757134 - RNA, 18 nt, Leptospira interrogans serovar lai str. 56601
guauaaaagaaacauaau

SEQ ID NO: 757135 - RNA, 13 nt, Leptospira interrogans serovar lai str. 56601
guauaaaauaaaa

SEQ ID NO: 757136 - RNA, 14 nt, Leptospira interrogans serovar lai str. 56601
guauaauauuuauu

SEQ ID NO: 757137 - RNA, 18 nt, Leptospira interrogans serovar lai str. 56601
guagauacaauuaaacga

SEQ ID NO: 757138 - RNA, 12 nt, Leptospira interrogans serovar lai str. 56601
guagaucaaauc

SEQ ID NO: 757139 - RNA, 13 nt, Leptospira interrogans serovar lai str. 56601
guagaucaaaucu

SEQ ID NO: 757140 - RNA, 16 nt, Leptospira interrogans serovar lai str. 56601
guagaucaaaucugaa

SEQ ID NO: 757141 - RNA, 21 nt, Leptospira interrogans serovar lai str. 56601
guagaucaaaucugaaauuca

SEQ ID NO: 757142 - RNA, 15 nt, Leptospira interrogans serovar lai str. 56601
guagaguaagaaaca

SEQ ID NO: 757143 - RNA, 14 nt, Leptospira interrogans serovar lai str. 56601
guacguaaaaauga

SEQ ID NO: 757144 - RNA, 17 nt, Leptospira interrogans serovar lai str. 56601
guacuaauucuuuugca

SEQ ID NO: 757145 - RNA, 18 nt, Leptospira interrogans serovar lai str. 56601
guacuaaaauuuuauaaa

SEQ ID NO: 757146 - RNA, 19 nt, Leptospira interrogans serovar lai str. 56601
guacuaaaauuuuauaaaa

SEQ ID NO: 757147 - RNA, 16 nt, Leptospira interrogans serovar lai str. 56601
guaccguuuauuuuua

SEQ ID NO: 757148 - RNA, 15 nt, Leptospira interrogans serovar lai str. 56601
guaccguaaagaaga

SEQ ID NO: 757149 - RNA, 15 nt, Leptospira interrogans serovar lai str. 56601
guagagaaacuuagc

SEQ ID NO: 757150 - RNA, 19 nt, Leptospira interrogans serovar lai str. 56601
guaaucucgauuucuaaaa

SEQ ID NO: 757151 - RNA, 15 nt, Leptospira interrogans serovar lai str. 56601
guaccauuuugauac

SEQ ID NO: 757152 - RNA, 16 nt, Leptospira interrogans serovar lai str. 56601
guaaauauuuuuuuua

SEQ ID NO: 757153 - RNA, 20 nt, Leptospira interrogans serovar lai str. 56601
guaaauauuuuuuuuaauca

SEQ ID NO: 757154 - RNA, 20 nt, Leptospira interrogans serovar lai str. 56601
guaaaucgcugauaaauuuc

SEQ ID NO: 757155 - RNA, 20 nt, Leptospira interrogans serovar lai str. 56601
guaaauaaaccgcauaaaag

SEQ ID NO: 757156 - RNA, 14 nt, Leptospira interrogans serovar lai str. 56601
guaaaguuuagauu

SEQ ID NO: 757157 - RNA, 16 nt, Leptospira interrogans serovar lai str. 56601
guaaaggaauccauga

SEQ ID NO: 757158 - RNA, 20 nt, Leptospira interrogans serovar lai str. 56601
guaaauggauaaauuuuaga

SEQ ID NO: 757159 - RNA, 12 nt, Leptospira interrogans serovar lai str. 56601
guaaauuaacag

SEQ ID NO: 757160 - RNA, 18 nt, Leptospira interrogans serovar lai str. 56601
guaaaugaauuggaaaga

SEQ ID NO: 757161 - RNA, 13 nt, Leptospira interrogans serovar lai str. 56601
guaaauucaaagc

SEQ ID NO: 757162 - RNA, 14 nt, Leptospira interrogans serovar lai str. 56601
guaaauuuuuauca

SEQ ID NO: 757163 - RNA, 15 nt, Leptospira interrogans serovar lai str. 56601
guaacagaaaaaugu

SEQ ID NO: 757164 - RNA, 21 nt, Leptospira interrogans serovar lai str. 56601
guaaaauuuagauuuguguua

SEQ ID NO: 757165 - RNA, 12 nt, Leptospira interrogans serovar lai str. 56601
guaaaauuuaaa

SEQ ID NO: 757166 - RNA, 13 nt, Leptospira interrogans serovar lai str. 56601
guaaaauuuaaaa

SEQ ID NO: 757167 - RNA, 17 nt, Leptospira interrogans serovar lai str. 56601
guaaaauuuaaaauucu

SEQ ID NO: 757168 - RNA, 23 nt, Leptospira interrogans serovar lai str. 56601
guaaaaucgaguuucacaaaaau

SEQ ID NO: 757169 - RNA, 12 nt, Leptospira interrogans serovar lai str. 56601
guaaaauccaga

SEQ ID NO: 757170 - RNA, 17 nt, Leptospira interrogans serovar lai str. 56601
guaaaauccagaauaau

SEQ ID NO: 757171 - RNA, 16 nt, Leptospira interrogans serovar lai str. 56601
guaaaaucuuuaaguu

SEQ ID NO: 757172 - RNA, 17 nt, Leptospira interrogans serovar lai str. 56601
guaaaauggucuuuuag

SEQ ID NO: 757173 - RNA, 13 nt, Leptospira interrogans serovar lai str. 56601
guaaaauuaaaau

SEQ ID NO: 757174 - RNA, 12 nt, Leptospira interrogans serovar lai str. 56601
guaaaauuaaag

SEQ ID NO: 757175 - RNA, 14 nt, Leptospira interrogans serovar lai str. 56601
guaaaauuaaaucu

SEQ ID NO: 757176 - RNA, 18 nt, Leptospira interrogans serovar lai str. 56601
guaaaauggaaaaaagau

SEQ ID NO: 757177 - RNA, 14 nt, Leptospira interrogans serovar lai str. 56601
guaaagauuagaaa

SEQ ID NO: 757178 - RNA, 15 nt, Leptospira interrogans serovar lai str. 56601
guaaagauuagaaaa

SEQ ID NO: 757179 - RNA, 17 nt, Leptospira interrogans serovar lai str. 56601
guaaagauuagaaaaac

SEQ ID NO: 757180 - RNA, 23 nt, Leptospira interrogans serovar lai str. 56601
guaaagaacgauuuuuuacaaaa

SEQ ID NO: 757181 - RNA, 14 nt, Leptospira interrogans serovar lai str. 56601
guaaacuacuaaau

SEQ ID NO: 757182 - RNA, 14 nt, Leptospira interrogans serovar lai str. 56601
guaaacuugauuaa

SEQ ID NO: 757183 - RNA, 16 nt, Leptospira interrogans serovar lai str. 56601
guaaacgguaaaagga

SEQ ID NO: 757184 - RNA, 22 nt, Leptospira interrogans serovar lai str. 56601
guaagaaccgggcaauaauguc

SEQ ID NO: 757185 - RNA, 22 nt, Leptospira interrogans serovar lai str. 56601
guaagaauccaugauccauuuu

SEQ ID NO: 757186 - RNA, 12 nt, Leptospira interrogans serovar lai str. 56601
guaagaaaauau

SEQ ID NO: 757187 - RNA, 15 nt, Leptospira interrogans serovar lai str. 56601
guaagaaaauuugga

SEQ ID NO: 757188 - RNA, 18 nt, Leptospira interrogans serovar lai str. 56601
guaagaaaauuuggacga

SEQ ID NO: 757189 - RNA, 14 nt, Leptospira interrogans serovar lai str. 56601
guaacuuucuuuua

SEQ ID NO: 757190 - RNA, 15 nt, Leptospira interrogans serovar lai str. 56601
guaagaguuccuaca

SEQ ID NO: 757191 - RNA, 23 nt, Leptospira interrogans serovar lai str. 56601
guaaccuuuguuuccucuugaag

SEQ ID NO: 757192 - RNA, 20 nt, Leptospira interrogans serovar lai str. 56601
guaacgagcaucuuuagaau

SEQ ID NO: 757193 - RNA, 15 nt, Leptospira interrogans serovar lai str. 56601
guaacgauuucuauu

SEQ ID NO: 757194 - RNA, 13 nt, Leptospira interrogans serovar lai str. 56601
guaaguuaaauau

SEQ ID NO: 757195 - RNA, 16 nt, Leptospira interrogans serovar lai str. 56601
guaaguccaaugaaaa

SEQ ID NO: 757196 - RNA, 22 nt, Leptospira interrogans serovar lai str. 56601
guaaguaauuacccuaaagcua

SEQ ID NO: 757197 - RNA, 17 nt, Leptospira interrogans serovar lai str. 56601
guaaguaucuaaaaguu

SEQ ID NO: 757198 - RNA, 11 nt, Leptospira interrogans serovar lai str. 56601
guaauaaaaau

SEQ ID NO: 757199 - RNA, 15 nt, Leptospira interrogans serovar lai str. 56601
guaauaguucccaca

SEQ ID NO: 757200 - RNA, 13 nt, Leptospira interrogans serovar lai str. 56601
guaaguaauauau

SEQ ID NO: 757201 - RNA, 16 nt, Leptospira interrogans serovar lai str. 56601
guaaggcaaacuuuuu

SEQ ID NO: 757202 - RNA, 16 nt, Leptospira interrogans serovar lai str. 56601
guaagcguaaauuaca

SEQ ID NO: 757203 - RNA, 16 nt, Leptospira interrogans serovar lai str. 56601
guaagcuugauuuucg

SEQ ID NO: 757204 - RNA, 16 nt, Leptospira interrogans serovar lai str. 56601
ggugaucuuagaaaac

SEQ ID NO: 757205 - RNA, 18 nt, Leptospira interrogans serovar lai str. 56601
gguaauuguagauucuuu

SEQ ID NO: 757206 - RNA, 21 nt, Leptospira interrogans serovar lai str. 56601
gguacaaucggguaaaaaaua

SEQ ID NO: 757207 - RNA, 11 nt, Leptospira interrogans serovar lai str. 56601
gguacuuuacg

SEQ ID NO: 757208 - RNA, 13 nt, Leptospira interrogans serovar lai str. 56601
gguauaaaauaaa

SEQ ID NO: 757209 - RNA, 22 nt, Leptospira interrogans serovar lai str. 56601
gguaguucccacaaauuccaau

SEQ ID NO: 757210 - RNA, 17 nt, Leptospira interrogans serovar lai str. 56601
gguauuaucuaaagcuu

SEQ ID NO: 757211 - RNA, 21 nt, Leptospira interrogans serovar lai str. 56601
ggguugguuaugguaaggagc

SEQ ID NO: 757212 - RNA, 20 nt, Leptospira interrogans serovar lai str. 56601
gguaacgagcaucuuuagaa

SEQ ID NO: 757213 - RNA, 22 nt, Leptospira interrogans serovar lai str. 56601
gguaaggagcucaucauucuga

SEQ ID NO: 757214 - RNA, 23 nt, Leptospira interrogans serovar lai str. 56601
gguaaauuuuuuagaaaucaauu

SEQ ID NO: 757215 - RNA, 12 nt, Leptospira interrogans serovar lai str. 56601
gguaaaaaauac

SEQ ID NO: 757216 - RNA, 23 nt, Leptospira interrogans serovar lai str. 56601
gguaaaaucuuuaaguuugugag

SEQ ID NO: 757217 - RNA, 22 nt, Leptospira interrogans serovar lai str. 56601
gguaaaaucauucuuuugugac

SEQ ID NO: 757218 - RNA, 16 nt, Leptospira interrogans serovar lai str. 56601
gggauacucauaaaau

SEQ ID NO: 757219 - RNA, 13 nt, Leptospira interrogans serovar lai str. 56601
gggaguuccuaca

SEQ ID NO: 757220 - RNA, 14 nt, Leptospira interrogans serovar lai str. 56601
gggagcgcuugaaa

SEQ ID NO: 757221 - RNA, 17 nt, Leptospira interrogans serovar lai str. 56601
ggcuuuacauuuuuaaa

SEQ ID NO: 757222 - RNA, 18 nt, Leptospira interrogans serovar lai str. 56601
ggcuuuaguuugaaagaa

SEQ ID NO: 757223 - RNA, 19 nt, Leptospira interrogans serovar lai str. 56601
ggcuuguuucaaaagguuu

SEQ ID NO: 757224 - RNA, 20 nt, Leptospira interrogans serovar lai str. 56601
ggcuucgaucguaaaauuuu

SEQ ID NO: 757225 - RNA, 14 nt, Leptospira interrogans serovar lai str. 56601
ggcugcuuuuuuga

SEQ ID NO: 757226 - RNA, 12 nt, Leptospira interrogans serovar lai str. 56601
ggcucaacuuuu

SEQ ID NO: 757227 - RNA, 21 nt, Leptospira interrogans serovar lai str. 56601
ggcucaauauuuaaaaauucu

SEQ ID NO: 757228 - RNA, 12 nt, Leptospira interrogans serovar lai str. 56601
ggcucccacaau

SEQ ID NO: 757229 - RNA, 18 nt, Leptospira interrogans serovar lai str. 56601
ggcugauucccaguaaau

SEQ ID NO: 757230 - RNA, 15 nt, Leptospira interrogans serovar lai str. 56601
ggcgaauaaaaaacu

SEQ ID NO: 757231 - RNA, 18 nt, Leptospira interrogans serovar lai str. 56601
ggcgagacauaaaaaaau

SEQ ID NO: 757232 - RNA, 19 nt, Leptospira interrogans serovar lai str. 56601
ggcgagacauaaaaaaauu

SEQ ID NO: 757233 - RNA, 20 nt, Leptospira interrogans serovar lai str. 56601
ggcggcgugagcggaaggaa

SEQ ID NO: 757234 - RNA, 22 nt, Leptospira interrogans serovar lai str. 56601
ggcaaucgaaguugauuucaga

SEQ ID NO: 757235 - RNA, 23 nt, Leptospira interrogans serovar lai str. 56601
ggauuuugaucuuuuuuucuaga

SEQ ID NO: 757236 - RNA, 18 nt, Leptospira interrogans serovar lai str. 56601
ggauuaucccaguugaga

SEQ ID NO: 757237 - RNA, 20 nt, Leptospira interrogans serovar lai str. 56601
ggauucacauuaaaauagga

SEQ ID NO: 757238 - RNA, 22 nt, Leptospira interrogans serovar lai str. 56601
ggauucacauuaaaauaggauu

SEQ ID NO: 757239 - RNA, 20 nt, Leptospira interrogans serovar lai str. 56601
ggauugccuaaauuccuucc

SEQ ID NO: 757240 - RNA, 17 nt, Leptospira interrogans serovar lai str. 56601
ggauggaaaaugaauuu

SEQ ID NO: 757241 - RNA, 14 nt, Leptospira interrogans serovar lai str. 56601
ggaggauuagaaga

SEQ ID NO: 757242 - RNA, 15 nt, Leptospira interrogans serovar lai str. 56601
ggaggauuagaagaa

SEQ ID NO: 757243 - RNA, 17 nt, Leptospira interrogans serovar lai str. 56601
ggaguucuaaauuauga

SEQ ID NO: 757244 - RNA, 13 nt, Leptospira interrogans serovar lai str. 56601
ggagauaaaaaag

SEQ ID NO: 757245 - RNA, 14 nt, Leptospira interrogans serovar lai str. 56601
ggagauaaaaaagg

SEQ ID NO: 757246 - RNA, 13 nt, Leptospira interrogans serovar lai str. 56601
ggagauuacuuuu

SEQ ID NO: 757247 - RNA, 14 nt, Leptospira interrogans serovar lai str. 56601
ggagaaaauuuaaa

SEQ ID NO: 757248 - RNA, 17 nt, Leptospira interrogans serovar lai str. 56601
ggaauacuuuucuuccc

SEQ ID NO: 757249 - RNA, 22 nt, Leptospira interrogans serovar lai str. 56601
ggacaaaucauaggauacaaaa

SEQ ID NO: 757250 - RNA, 19 nt, Leptospira interrogans serovar lai str. 56601
ggaaucuaaacuuuguaaa

SEQ ID NO: 757251 - RNA, 21 nt, Leptospira interrogans serovar lai str. 56601
ggaauuuuuuaacaacucuaa

SEQ ID NO: 757252 - RNA, 23 nt, Leptospira interrogans serovar lai str. 56601
ggacgaauccugcuaacugauua

SEQ ID NO: 757253 - RNA, 17 nt, Leptospira interrogans serovar lai str. 56601
cugccuuauaaugaaga

SEQ ID NO: 757254 - RNA, 14 nt, Leptospira interrogans serovar lai str. 56601
cugcaguaguuccc

SEQ ID NO: 757255 - RNA, 14 nt, Leptospira interrogans serovar lai str. 56601
cugcauuuuauuaa

SEQ ID NO: 757256 - RNA, 14 nt, Leptospira interrogans serovar lai str. 56601
cugccaaaauccca

SEQ ID NO: 757257 - RNA, 22 nt, Leptospira interrogans serovar lai str. 56601
cugccaaaaucccagaaaggaa

SEQ ID NO: 757258 - RNA, 21 nt, Leptospira interrogans serovar lai str. 56601
cugcauucuuagaauuuuccu

SEQ ID NO: 757259 - RNA, 14 nt, Leptospira interrogans serovar lai str. 56601
cugcuaaguucauc

SEQ ID NO: 757260 - RNA, 15 nt, Leptospira interrogans serovar lai str. 56601
aaacucaaugcugcu

SEQ ID NO: 757261 - RNA, 17 nt, Leptospira interrogans serovar lai str. 56601
aaacucaaaggaaaaug

SEQ ID NO: 757262 - RNA, 14 nt, Leptospira interrogans serovar lai str. 56601
aaacucaaaucuac

SEQ ID NO: 757263 - RNA, 23 nt, Leptospira interrogans serovar lai str. 56601
aaacucacaucucuuuuuuauaa

SEQ ID NO: 757264 - RNA, 13 nt, Leptospira interrogans serovar lai str. 56601
aaacucaaagaau

SEQ ID NO: 757265 - RNA, 14 nt, Leptospira interrogans serovar lai str. 56601
aaacucaacacaac

SEQ ID NO: 757266 - RNA, 15 nt, Leptospira interrogans serovar lai str. 56601
cugcucgaaaguuua

SEQ ID NO: 757267 - RNA, 16 nt, Leptospira interrogans serovar lai str. 56601
cugcucgaauuuuuuu

SEQ ID NO: 757268 - RNA, 16 nt, Leptospira interrogans serovar lai str. 56601
cuggaaaaauuccuaa

SEQ ID NO: 757269 - RNA, 23 nt, Leptospira interrogans serovar lai str. 56601
cuggaaaaauuccuaaaacaccu

SEQ ID NO: 757270 - RNA, 21 nt, Leptospira interrogans serovar lai str. 56601
cuggaaaagaaucguuuuuuu

SEQ ID NO: 757271 - RNA, 12 nt, Leptospira interrogans serovar lai str. 56601
cuggaaacguca

SEQ ID NO: 757272 - RNA, 14 nt, Leptospira interrogans serovar lai str. 56601
cugcuuuuuuaaac

SEQ ID NO: 757273 - RNA, 19 nt, Leptospira interrogans serovar lai str. 56601
cugcuuccaaaaaaagucu

SEQ ID NO: 757274 - RNA, 23 nt, Leptospira interrogans serovar lai str. 56601
cugcuucaauuguccauuuccau

SEQ ID NO: 757275 - RNA, 16 nt, Leptospira interrogans serovar lai str. 56601
cugaguuugagagaga

SEQ ID NO: 757276 - RNA, 17 nt, Leptospira interrogans serovar lai str. 56601
cugauacugaaaccauc

SEQ ID NO: 757277 - RNA, 14 nt, Leptospira interrogans serovar lai str. 56601
cugauccugaucua

SEQ ID NO: 757278 - RNA, 18 nt, Leptospira interrogans serovar lai str. 56601
cugaucgaauaccguucu

SEQ ID NO: 757279 - RNA, 12 nt, Leptospira interrogans serovar lai str. 56601
cugcaaaauaac

SEQ ID NO: 757280 - RNA, 20 nt, Leptospira interrogans serovar lai str. 56601
cugcaaaaucaguuaauaca

SEQ ID NO: 757281 - RNA, 16 nt, Leptospira interrogans serovar lai str. 56601
cugcaaaauuuaaaaa

SEQ ID NO: 757282 - RNA, 15 nt, Leptospira interrogans serovar lai str. 56601
cugcaagaaaccucu

SEQ ID NO: 757283 - RNA, 15 nt, Leptospira interrogans serovar lai str. 56601
cugauucuaaaaucc

SEQ ID NO: 757284 - RNA, 17 nt, Leptospira interrogans serovar lai str. 56601
cugauucuaaaauccua

SEQ ID NO: 757285 - RNA, 16 nt, Leptospira interrogans serovar lai str. 56601
cugauuuaauuauuua

SEQ ID NO: 757286 - RNA, 14 nt, Leptospira interrogans serovar lai str. 56601
cugauuucaaaaau

SEQ ID NO: 757287 - RNA, 24 nt, Leptospira interrogans serovar lai str. 56601
cugaucuuauggacucuauuauga

SEQ ID NO: 757288 - RNA, 15 nt, Leptospira interrogans serovar lai str. 56601
cugacugaaaaaaac

SEQ ID NO: 757289 - RNA, 12 nt, Leptospira interrogans serovar lai str. 56601
cugagaaccauu

SEQ ID NO: 757290 - RNA, 19 nt, Leptospira interrogans serovar lai str. 56601
cugagaaccauuucaaguu

SEQ ID NO: 757291 - RNA, 19 nt, Leptospira interrogans serovar lai str. 56601
cugacauucuaaacauuua

SEQ ID NO: 757292 - RNA, 16 nt, Leptospira interrogans serovar lai str. 56601
cugaaauuguuuuaaa

SEQ ID NO: 757293 - RNA, 20 nt, Leptospira interrogans serovar lai str. 56601
cugaaauuguuuuaaaacuu

SEQ ID NO: 757294 - RNA, 21 nt, Leptospira interrogans serovar lai str. 56601
cugaacaaacucuugaacaga

SEQ ID NO: 757295 - RNA, 17 nt, Leptospira interrogans serovar lai str. 56601
cugaacaagaauuuauu

SEQ ID NO: 757296 - RNA, 17 nt, Leptospira interrogans serovar lai str. 56601
cugaaccugcaaauuuu

SEQ ID NO: 757297 - RNA, 19 nt, Leptospira interrogans serovar lai str. 56601
cugaaccugcaaauuuuuu

SEQ ID NO: 757298 - RNA, 15 nt, Leptospira interrogans serovar lai str. 56601
cugaacuuaaaaucu

SEQ ID NO: 757299 - RNA, 16 nt, Leptospira interrogans serovar lai str. 56601
cugaacuuaaaaucua

SEQ ID NO: 757300 - RNA, 14 nt, Leptospira interrogans serovar lai str. 56601
cugaacuuuauaga

SEQ ID NO: 757301 - RNA, 11 nt, Leptospira interrogans serovar lai str. 56601
cugaaaaaguu

SEQ ID NO: 757302 - RNA, 23 nt, Leptospira interrogans serovar lai str. 56601
cugaaaaaaguuagaaucuaaac

SEQ ID NO: 757303 - RNA, 14 nt, Leptospira interrogans serovar lai str. 56601
cugaaaaaaguugg

SEQ ID NO: 757304 - RNA, 24 nt, Leptospira interrogans serovar lai str. 56601
cugaaaaaaguuggaauuugaauu

SEQ ID NO: 757305 - RNA, 13 nt, Leptospira interrogans serovar lai str. 56601
cugaaaaaaauua

SEQ ID NO: 757306 - RNA, 16 nt, Leptospira interrogans serovar lai str. 56601
cugaaaaguuuaugaa

SEQ ID NO: 757307 - RNA, 18 nt, Leptospira interrogans serovar lai str. 56601
cugaaaagaauugaaauc

SEQ ID NO: 757308 - RNA, 13 nt, Leptospira interrogans serovar lai str. 56601
cugaaaauuuaau

SEQ ID NO: 757309 - RNA, 20 nt, Leptospira interrogans serovar lai str. 56601
cugaaaauuuuccuuuaaau

SEQ ID NO: 757310 - RNA, 23 nt, Leptospira interrogans serovar lai str. 56601
cugaaaaugaccaaaauuuccaa

SEQ ID NO: 757311 - RNA, 14 nt, Leptospira interrogans serovar lai str. 56601
cugaaacuuuucaa

SEQ ID NO: 757312 - RNA, 19 nt, Leptospira interrogans serovar lai str. 56601
cugaaacuuuucaaaaucu

SEQ ID NO: 757313 - RNA, 22 nt, Leptospira interrogans serovar lai str. 56601
cugaaacuugaacuguuuaauu

SEQ ID NO: 757314 - RNA, 13 nt, Leptospira interrogans serovar lai str. 56601
cucuuuauauaaa

SEQ ID NO: 757315 - RNA, 13 nt, Leptospira interrogans serovar lai str. 56601
cucuuuugagagc

SEQ ID NO: 757316 - RNA, 21 nt, Leptospira interrogans serovar lai str. 56601
cucuuuugagagccuuuuuau

SEQ ID NO: 757317 - RNA, 16 nt, Leptospira interrogans serovar lai str. 56601
cucuuuuuagacaaaa

SEQ ID NO: 757318 - RNA, 22 nt, Leptospira interrogans serovar lai str. 56601
cucuuuuuagacaaaaauacua

SEQ ID NO: 757319 - RNA, 15 nt, Leptospira interrogans serovar lai str. 56601
cucuuuuucucuuug

SEQ ID NO: 757320 - RNA, 19 nt, Leptospira interrogans serovar lai str. 56601
cucuuuuugggaauuuuuu

SEQ ID NO: 757321 - RNA, 12 nt, Leptospira interrogans serovar lai str. 56601
cucuuuuuuaaa

SEQ ID NO: 757322 - RNA, 11 nt, Leptospira interrogans serovar lai str. 56601
cucuuuaaaaa

SEQ ID NO: 757323 - RNA, 20 nt, Leptospira interrogans serovar lai str. 56601
cucuuguaguucaauagaau

SEQ ID NO: 757324 - RNA, 18 nt, Leptospira interrogans serovar lai str. 56601
cucuugcuaaaauuuuuu

SEQ ID NO: 757325 - RNA, 23 nt, Leptospira interrogans serovar lai str. 56601
cucuugcuaaaauuuuuuuaaga

SEQ ID NO: 757326 - RNA, 22 nt, Leptospira interrogans serovar lai str. 56601
cucuuccgguggauuuuuuuau

SEQ ID NO: 757327 - RNA, 17 nt, Leptospira interrogans serovar lai str. 56601
cucuucuaauucaguuu

SEQ ID NO: 757328 - RNA, 18 nt, Leptospira interrogans serovar lai str. 56601
cucuucgucucaccaaca

SEQ ID NO: 757329 - RNA, 14 nt, Leptospira interrogans serovar lai str. 56601
cucugggaucggaa

SEQ ID NO: 757330 - RNA, 14 nt, Leptospira interrogans serovar lai str. 56601
cucuguaaauacaa

SEQ ID NO: 757331 - RNA, 13 nt, Leptospira interrogans serovar lai str. 56601
cucuguucagugu

SEQ ID NO: 757332 - RNA, 22 nt, Leptospira interrogans serovar lai str. 56601
cucuguucaguguaagauuaac

SEQ ID NO: 757333 - RNA, 13 nt, Leptospira interrogans serovar lai str. 56601
cucugugaaacuc

SEQ ID NO: 757334 - RNA, 17 nt, Leptospira interrogans serovar lai str. 56601
cucuggucaaguuauug

SEQ ID NO: 757335 - RNA, 13 nt, Leptospira interrogans serovar lai str. 56601
cucuuauaaaauu

SEQ ID NO: 757336 - RNA, 16 nt, Leptospira interrogans serovar lai str. 56601
cucugauaauuuuuua

SEQ ID NO: 757337 - RNA, 20 nt, Leptospira interrogans serovar lai str. 56601
cucugauaauuuuuuaaaaa

SEQ ID NO: 757338 - RNA, 21 nt, Leptospira interrogans serovar lai str. 56601
cucugauaauuuuuuaaaaaa

SEQ ID NO: 757339 - RNA, 17 nt, Leptospira interrogans serovar lai str. 56601
cucucuuguaguucaau

SEQ ID NO: 757340 - RNA, 18 nt, Leptospira interrogans serovar lai str. 56601
cucuccuuuuuuauuuua

SEQ ID NO: 757341 - RNA, 23 nt, Leptospira interrogans serovar lai str. 56601
cucuccuuuuuuauuuuaacaga

SEQ ID NO: 757342 - RNA, 19 nt, Leptospira interrogans serovar lai str. 56601
cucuccuauguuucuugug

SEQ ID NO: 757343 - RNA, 20 nt, Leptospira interrogans serovar lai str. 56601
cucuccuauguuucuugugu

SEQ ID NO: 757344 - RNA, 21 nt, Leptospira interrogans serovar lai str. 56601
cucuauuauauaguuaucagu

SEQ ID NO: 757345 - RNA, 14 nt, Leptospira interrogans serovar lai str. 56601
cucuauuauuauuu

SEQ ID NO: 757346 - RNA, 14 nt, Leptospira interrogans serovar lai str. 56601
cucuauggguuuuc

SEQ ID NO: 757347 - RNA, 20 nt, Leptospira interrogans serovar lai str. 56601
cucuaugaaacuuaguuccu

SEQ ID NO: 757348 - RNA, 16 nt, Leptospira interrogans serovar lai str. 56601
cucucaaauucuucag

SEQ ID NO: 757349 - RNA, 13 nt, Leptospira interrogans serovar lai str. 56601
cucuauuuaagua

SEQ ID NO: 757350 - RNA, 19 nt, Leptospira interrogans serovar lai str. 56601
cucuauagauugauuuaaa

SEQ ID NO: 757351 - RNA, 19 nt, Leptospira interrogans serovar lai str. 56601
cucuauaaaaucuaaaaaa

SEQ ID NO: 757352 - RNA, 20 nt, Leptospira interrogans serovar lai str. 56601
cucuauaaaaucuaaaaaaa

SEQ ID NO: 757353 - RNA, 13 nt, Leptospira interrogans serovar lai str. 56601
cucuauaaaauca

SEQ ID NO: 757354 - RNA, 15 nt, Leptospira interrogans serovar lai str. 56601
cucuauaaaaucaag

SEQ ID NO: 757355 - RNA, 18 nt, Leptospira interrogans serovar lai str. 56601
cucuaguaaagaaacucg

SEQ ID NO: 757356 - RNA, 22 nt, Leptospira interrogans serovar lai str. 56601
cucggaauauuuuuuccaaaaa

SEQ ID NO: 757357 - RNA, 15 nt, Leptospira interrogans serovar lai str. 56601
cucggaguauauaau

SEQ ID NO: 757358 - RNA, 18 nt, Leptospira interrogans serovar lai str. 56601
cucguacuaauucuuuug

SEQ ID NO: 757359 - RNA, 19 nt, Leptospira interrogans serovar lai str. 56601
cucguaauaucuaaaaccu

SEQ ID NO: 757360 - RNA, 14 nt, Leptospira interrogans serovar lai str. 56601
cucgggaaaaaauu

SEQ ID NO: 757361 - RNA, 21 nt, Leptospira interrogans serovar lai str. 56601
cuccuucucucguauaacgaa

SEQ ID NO: 757362 - RNA, 15 nt, Leptospira interrogans serovar lai str. 56601
cuccuuuuuuauuuu

SEQ ID NO: 757363 - RNA, 23 nt, Leptospira interrogans serovar lai str. 56601
cuccuuuagagugaauuuguaau

SEQ ID NO: 757364 - RNA, 17 nt, Leptospira interrogans serovar lai str. 56601
cucgauagaacaaucuc

SEQ ID NO: 757365 - RNA, 20 nt, Leptospira interrogans serovar lai str. 56601
cuccugaaaauuuuccuuua

SEQ ID NO: 757366 - RNA, 12 nt, Leptospira interrogans serovar lai str. 56601
cuccuccuucuc

SEQ ID NO: 757367 - RNA, 17 nt, Leptospira interrogans serovar lai str. 56601
cuccugucaauuuucca

SEQ ID NO: 757368 - RNA, 16 nt, Leptospira interrogans serovar lai str. 56601
cucccacuuuuaaaga

SEQ ID NO: 757369 - RNA, 23 nt, Leptospira interrogans serovar lai str. 56601
cuccaucuauuuuguuuuauaga

SEQ ID NO: 757370 - RNA, 19 nt, Leptospira interrogans serovar lai str. 56601
cuccauauuccagaaguau

SEQ ID NO: 757371 - RNA, 23 nt, Leptospira interrogans serovar lai str. 56601
cuccauauuccagaaguauuuuc

SEQ ID NO: 757372 - RNA, 16 nt, Leptospira interrogans serovar lai str. 56601
cucauacuucuaaaaa

SEQ ID NO: 757373 - RNA, 18 nt, Leptospira interrogans serovar lai str. 56601
cucauacuucuaaaaaau

SEQ ID NO: 757374 - RNA, 20 nt, Leptospira interrogans serovar lai str. 56601
cucauaacgugacaaacuaa

SEQ ID NO: 757375 - RNA, 18 nt, Leptospira interrogans serovar lai str. 56601
cucaguucaaaauauuua

SEQ ID NO: 757376 - RNA, 14 nt, Leptospira interrogans serovar lai str. 56601
cucagucaccucua

SEQ ID NO: 757377 - RNA, 19 nt, Leptospira interrogans serovar lai str. 56601
cucagucaccucuauaaaa

SEQ ID NO: 757378 - RNA, 20 nt, Leptospira interrogans serovar lai str. 56601
cucagucaccucuauaaaau

SEQ ID NO: 757379 - RNA, 23 nt, Leptospira interrogans serovar lai str. 56601
cucagucaccucuauaaaaucua

SEQ ID NO: 757380 - RNA, 20 nt, Leptospira interrogans serovar lai str. 56601
cucagcacaacgcugcuuuc

SEQ ID NO: 757381 - RNA, 21 nt, Leptospira interrogans serovar lai str. 56601
cucaguaaaacgcucucuacc

SEQ ID NO: 757382 - RNA, 15 nt, Leptospira interrogans serovar lai str. 56601
cucaguaaaauggga

SEQ ID NO: 757383 - RNA, 15 nt, Leptospira interrogans serovar lai str. 56601
cucaguaaacucaau

SEQ ID NO: 757384 - RNA, 18 nt, Leptospira interrogans serovar lai str. 56601
cucagauuccaacuuuuu

SEQ ID NO: 757385 - RNA, 21 nt, Leptospira interrogans serovar lai str. 56601
cucagauuuccuuucucugaa

SEQ ID NO: 757386 - RNA, 16 nt, Leptospira interrogans serovar lai str. 56601
cucauaguuauauaau

SEQ ID NO: 757387 - RNA, 13 nt, Leptospira interrogans serovar lai str. 56601
cucaucauucuga

SEQ ID NO: 757388 - RNA, 15 nt, Leptospira interrogans serovar lai str. 56601
cucaucauucugaaa

SEQ ID NO: 757389 - RNA, 14 nt, Leptospira interrogans serovar lai str. 56601
cucaacaacucuaa

SEQ ID NO: 757390 - RNA, 20 nt, Leptospira interrogans serovar lai str. 56601
cucaaauucgucaaaaccaa

SEQ ID NO: 757391 - RNA, 16 nt, Leptospira interrogans serovar lai str. 56601
cuauuacuuuuuaaac

SEQ ID NO: 757392 - RNA, 16 nt, Leptospira interrogans serovar lai str. 56601
cuauuacguaauguga

SEQ ID NO: 757393 - RNA, 11 nt, Leptospira interrogans serovar lai str. 56601
cuauuaagaau

SEQ ID NO: 757394 - RNA, 12 nt, Leptospira interrogans serovar lai str. 56601
cuauuacaaaau

SEQ ID NO: 757395 - RNA, 18 nt, Leptospira interrogans serovar lai str. 56601
cuauuacaaaaucugaau

SEQ ID NO: 757396 - RNA, 19 nt, Leptospira interrogans serovar lai str. 56601
cucaacggguucuucauua

SEQ ID NO: 757397 - RNA, 15 nt, Leptospira interrogans serovar lai str. 56601
cucacaccuucuuuu

SEQ ID NO: 757398 - RNA, 18 nt, Leptospira interrogans serovar lai str. 56601
cucaauccaauauuuaug

SEQ ID NO: 757399 - RNA, 19 nt, Leptospira interrogans serovar lai str. 56601
cucaauauuuaaaaauucu

SEQ ID NO: 757400 - RNA, 14 nt, Leptospira interrogans serovar lai str. 56601
cucacucauuuuua

SEQ ID NO: 757401 - RNA, 18 nt, Leptospira interrogans serovar lai str. 56601
cucacuaccuuauaaaaa

SEQ ID NO: 757402 - RNA, 19 nt, Leptospira interrogans serovar lai str. 56601
cucacguuaaaaguaauau

SEQ ID NO: 757403 - RNA, 15 nt, Leptospira interrogans serovar lai str. 56601
cucacguuauccuua

SEQ ID NO: 757404 - RNA, 14 nt, Leptospira interrogans serovar lai str. 56601
cuauaguuuuuaac

SEQ ID NO: 757405 - RNA, 13 nt, Leptospira interrogans serovar lai str. 56601
cuauauaaagaaa

SEQ ID NO: 757406 - RNA, 17 nt, Leptospira interrogans serovar lai str. 56601
cuauauaacaaaguauu

SEQ ID NO: 757407 - RNA, 22 nt, Leptospira interrogans serovar lai str. 56601
cuauauaacaaaguauuuaauu

SEQ ID NO: 757408 - RNA, 16 nt, Leptospira interrogans serovar lai str. 56601
cuauaucgugaaacuu

SEQ ID NO: 757409 - RNA, 18 nt, Leptospira interrogans serovar lai str. 56601
cuaucaacaagaaugaaa

SEQ ID NO: 757410 - RNA, 21 nt, Leptospira interrogans serovar lai str. 56601
cuauauuuuacaguaaaacuu

SEQ ID NO: 757411 - RNA, 12 nt, Leptospira interrogans serovar lai str. 56601
cuauauuuugau

SEQ ID NO: 757412 - RNA, 14 nt, Leptospira interrogans serovar lai str. 56601
cuauauucaaaaaa

SEQ ID NO: 757413 - RNA, 16 nt, Leptospira interrogans serovar lai str. 56601
cuauauucaaaaaagu

SEQ ID NO: 757414 - RNA, 18 nt, Leptospira interrogans serovar lai str. 56601
cuauauucaaaaaaguuu

SEQ ID NO: 757415 - RNA, 23 nt, Leptospira interrogans serovar lai str. 56601
cuauauucaaaaaaguuuauacu

SEQ ID NO: 757416 - RNA, 17 nt, Leptospira interrogans serovar lai str. 56601
cuauauucaaaaaaugg

SEQ ID NO: 757417 - RNA, 16 nt, Leptospira interrogans serovar lai str. 56601
cuagggaaagaugauu

SEQ ID NO: 757418 - RNA, 23 nt, Leptospira interrogans serovar lai str. 56601
cuagggaaaguuuuuuaaaaaau

SEQ ID NO: 757419 - RNA, 22 nt, Leptospira interrogans serovar lai str. 56601
cuauaauaagauuuguugaaaa

SEQ ID NO: 757420 - RNA, 13 nt, Leptospira interrogans serovar lai str. 56601
cuagguuuaaacu

SEQ ID NO: 757421 - RNA, 17 nt, Leptospira interrogans serovar lai str. 56601
cuauaauuaauaaaacu

SEQ ID NO: 757422 - RNA, 17 nt, Leptospira interrogans serovar lai str. 56601
cuauacuagaacaauaa

SEQ ID NO: 757423 - RNA, 21 nt, Leptospira interrogans serovar lai str. 56601
cuauaguaaagauuagaaaaa

SEQ ID NO: 757424 - RNA, 23 nt, Leptospira interrogans serovar lai str. 56601
cuaugccccauucuuuuugccaa

SEQ ID NO: 757425 - RNA, 19 nt, Leptospira interrogans serovar lai str. 56601
cuaugauucugaaaaaaau

SEQ ID NO: 757426 - RNA, 16 nt, Leptospira interrogans serovar lai str. 56601
cuaucgguuuucguug

SEQ ID NO: 757427 - RNA, 15 nt, Leptospira interrogans serovar lai str. 56601
cuauccaaaaguuua

SEQ ID NO: 757428 - RNA, 18 nt, Leptospira interrogans serovar lai str. 56601
cuauccacuaaaauacuu

SEQ ID NO: 757429 - RNA, 13 nt, Leptospira interrogans serovar lai str. 56601
cuaucgaacgacc

SEQ ID NO: 757430 - RNA, 20 nt, Leptospira interrogans serovar lai str. 56601
cuacuugugagugaacucca

SEQ ID NO: 757431 - RNA, 22 nt, Leptospira interrogans serovar lai str. 56601
cuacuugugagugaacuccauu

SEQ ID NO: 757432 - RNA, 15 nt, Leptospira interrogans serovar lai str. 56601
cuacuuuuagaaaau

SEQ ID NO: 757433 - RNA, 13 nt, Leptospira interrogans serovar lai str. 56601
cuacuuuuauaaa

SEQ ID NO: 757434 - RNA, 12 nt, Leptospira interrogans serovar lai str. 56601
cuagauuuagau

SEQ ID NO: 757435 - RNA, 21 nt, Leptospira interrogans serovar lai str. 56601
cuagauuuagauucuaaaaaa

SEQ ID NO: 757436 - RNA, 21 nt, Leptospira interrogans serovar lai str. 56601
cuagauuauugaucucuauaa

SEQ ID NO: 757437 - RNA, 14 nt, Leptospira interrogans serovar lai str. 56601
cuaggauuuuauau

SEQ ID NO: 757438 - RNA, 23 nt, Leptospira interrogans serovar lai str. 56601
cuagcuauuuucagaaaaaugaa

SEQ ID NO: 757439 - RNA, 19 nt, Leptospira interrogans serovar lai str. 56601
cuaggaucuccuugaauca

SEQ ID NO: 757440 - RNA, 16 nt, Leptospira interrogans serovar lai str. 56601
cuagcgucuaaaaaau

SEQ ID NO: 757441 - RNA, 17 nt, Leptospira interrogans serovar lai str. 56601
cuagcgucuaaaaaauu

SEQ ID NO: 757442 - RNA, 16 nt, Leptospira interrogans serovar lai str. 56601
cuagcaacacauuuuc

SEQ ID NO: 757443 - RNA, 21 nt, Leptospira interrogans serovar lai str. 56601
cuacgaaacuuuuagaauucu

SEQ ID NO: 757444 - RNA, 13 nt, Leptospira interrogans serovar lai str. 56601
cuacuaauuuauc

SEQ ID NO: 757445 - RNA, 21 nt, Leptospira interrogans serovar lai str. 56601
cuacuaauuuaucgauuuaaa

SEQ ID NO: 757446 - RNA, 13 nt, Leptospira interrogans serovar lai str. 56601
cuacuacaaaaau

SEQ ID NO: 757447 - RNA, 13 nt, Leptospira interrogans serovar lai str. 56601
cuacuaaucucua

SEQ ID NO: 757448 - RNA, 14 nt, Leptospira interrogans serovar lai str. 56601
cuaaauuuguaaua

SEQ ID NO: 757449 - RNA, 18 nt, Leptospira interrogans serovar lai str. 56601
cuaaauuuguaauaguuc

SEQ ID NO: 757450 - RNA, 17 nt, Leptospira interrogans serovar lai str. 56601
cuaaauuuuauaaaauu

SEQ ID NO: 757451 - RNA, 21 nt, Leptospira interrogans serovar lai str. 56601
cuaacaaaaaguguuuauaau

SEQ ID NO: 757452 - RNA, 14 nt, Leptospira interrogans serovar lai str. 56601
cuaacaguaaaacu

SEQ ID NO: 757453 - RNA, 15 nt, Leptospira interrogans serovar lai str. 56601
cuacuauaaauuacu

SEQ ID NO: 757454 - RNA, 15 nt, Leptospira interrogans serovar lai str. 56601
cuacuacgaaaacuu

SEQ ID NO: 757455 - RNA, 15 nt, Leptospira interrogans serovar lai str. 56601
cuacuacgaaaauuu

SEQ ID NO: 757456 - RNA, 12 nt, Leptospira interrogans serovar lai str. 56601
cuacuacuuuaa

SEQ ID NO: 757457 - RNA, 22 nt, Leptospira interrogans serovar lai str. 56601
cuacuccagauuuaauuuuucu

SEQ ID NO: 757458 - RNA, 23 nt, Leptospira interrogans serovar lai str. 56601
cuacuccagauuuaauuuuucug

SEQ ID NO: 757459 - RNA, 16 nt, Leptospira interrogans serovar lai str. 56601
cuacuauuaauagcuu

SEQ ID NO: 757460 - RNA, 14 nt, Leptospira interrogans serovar lai str. 56601
cuacuauuauaaua

SEQ ID NO: 757461 - RNA, 15 nt, Leptospira interrogans serovar lai str. 56601
cuacucgaauuuaua

SEQ ID NO: 757462 - RNA, 19 nt, Leptospira interrogans serovar lai str. 56601
cuacuuaaacguauaaaaa

SEQ ID NO: 757463 - RNA, 23 nt, Leptospira interrogans serovar lai str. 56601
cuacugcauuuuauuaaaaauau

SEQ ID NO: 757464 - RNA, 14 nt, Leptospira interrogans serovar lai str. 56601
cuacugaguuucaa

SEQ ID NO: 757465 - RNA, 17 nt, Leptospira interrogans serovar lai str. 56601
cguuugaaacucaguaa

SEQ ID NO: 757466 - RNA, 23 nt, Leptospira interrogans serovar lai str. 56601
cguuugaacucggcucauaaaaa

SEQ ID NO: 757467 - RNA, 13 nt, Leptospira interrogans serovar lai str. 56601
cuaaaaaugaaau

SEQ ID NO: 757468 - RNA, 20 nt, Leptospira interrogans serovar lai str. 56601
cuaaaacacaucuuaaaaac

SEQ ID NO: 757469 - RNA, 19 nt, Leptospira interrogans serovar lai str. 56601
cuaaaacaccuucucuuuu

SEQ ID NO: 757470 - RNA, 11 nt, Leptospira interrogans serovar lai str. 56601
cuaaaaagaaa

SEQ ID NO: 757471 - RNA, 12 nt, Leptospira interrogans serovar lai str. 56601
cuaaaaacucaa

SEQ ID NO: 757472 - RNA, 16 nt, Leptospira interrogans serovar lai str. 56601
cguuugcaaguagaag

SEQ ID NO: 757473 - RNA, 23 nt, Leptospira interrogans serovar lai str. 56601
cguuugccaauaauucuacgaaa

SEQ ID NO: 757474 - RNA, 21 nt, Leptospira interrogans serovar lai str. 56601
cuaaagaucggcauucaggga

SEQ ID NO: 757475 - RNA, 22 nt, Leptospira interrogans serovar lai str. 56601
cuaaagaaugaucgcauaaaau

SEQ ID NO: 757476 - RNA, 23 nt, Leptospira interrogans serovar lai str. 56601
cuaaagaaugaucgcauaaaauu

SEQ ID NO: 757477 - RNA, 16 nt, Leptospira interrogans serovar lai str. 56601
cuaaagaauacauuuu

SEQ ID NO: 757478 - RNA, 20 nt, Leptospira interrogans serovar lai str. 56601
cuaaacuuacagauugauuu

SEQ ID NO: 757479 - RNA, 13 nt, Leptospira interrogans serovar lai str. 56601
cuaaacucauuuu

SEQ ID NO: 757480 - RNA, 17 nt, Leptospira interrogans serovar lai str. 56601
cuaaaauaauuuuuacu

SEQ ID NO: 757481 - RNA, 23 nt, Leptospira interrogans serovar lai str. 56601
cuaaaauacuuuuagaaaauuag

SEQ ID NO: 757482 - RNA, 15 nt, Leptospira interrogans serovar lai str. 56601
cuaaaauaaaguauc

SEQ ID NO: 757483 - RNA, 16 nt, Leptospira interrogans serovar lai str. 56601
cuaaaaucuggauuuu

SEQ ID NO: 757484 - RNA, 21 nt, Leptospira interrogans serovar lai str. 56601
cuaaaaucauacuuuuaaaaa

SEQ ID NO: 757485 - RNA, 15 nt, Leptospira interrogans serovar lai str. 56601
cuaaaaugaaaaaaa

SEQ ID NO: 757486 - RNA, 19 nt, Leptospira interrogans serovar lai str. 56601
cuaaaaugaaaaaaaacaa

SEQ ID NO: 757487 - RNA, 15 nt, Leptospira interrogans serovar lai str. 56601
cuaaaauuauaggaa

SEQ ID NO: 757488 - RNA, 13 nt, Leptospira interrogans serovar lai str. 56601
cuaaauccuucuu

SEQ ID NO: 757489 - RNA, 16 nt, Leptospira interrogans serovar lai str. 56601
cuaaauccuucuuuuc

SEQ ID NO: 757490 - RNA, 18 nt, Leptospira interrogans serovar lai str. 56601
cuaaaucuaauucuucua

SEQ ID NO: 757491 - RNA, 22 nt, Leptospira interrogans serovar lai str. 56601
cuaaaucgaaucgaauguauuu

SEQ ID NO: 757492 - RNA, 13 nt, Leptospira interrogans serovar lai str. 56601
cuaaaugaguuuu

SEQ ID NO: 757493 - RNA, 23 nt, Leptospira interrogans serovar lai str. 56601
cuaaaugaguuuuagaauauuaa

SEQ ID NO: 757494 - RNA, 20 nt, Leptospira interrogans serovar lai str. 56601
cuaaaugacuugcauuuaau

SEQ ID NO: 757495 - RNA, 23 nt, Leptospira interrogans serovar lai str. 56601
cuaaaugacuugcauuuaauaua

SEQ ID NO: 757496 - RNA, 21 nt, Leptospira interrogans serovar lai str. 56601
cuaaauugagaauuuguuuua

SEQ ID NO: 757497 - RNA, 17 nt, Leptospira interrogans serovar lai str. 56601
cuaaauuccuuccaagu

SEQ ID NO: 757498 - RNA, 15 nt, Leptospira interrogans serovar lai str. 56601
cuaaauuauuuucaa

SEQ ID NO: 757499 - RNA, 18 nt, Leptospira interrogans serovar lai str. 56601
cuaaauuaaguuuauuca

SEQ ID NO: 757500 - RNA, 23 nt, Leptospira interrogans serovar lai str. 56601
cuaaauuaauauuuauaaaacaa

SEQ ID NO: 757501 - RNA, 22 nt, Leptospira interrogans serovar lai str. 56601
cuaaagcuauuuucuaggauuu

SEQ ID NO: 757502 - RNA, 16 nt, Leptospira interrogans serovar lai str. 56601
cuaaaguuguaggaac

SEQ ID NO: 757503 - RNA, 19 nt, Leptospira interrogans serovar lai str. 56601
cguuucaacuuuagaaaaa

SEQ ID NO: 757504 - RNA, 14 nt, Leptospira interrogans serovar lai str. 56601
cguuucaauuuuug

SEQ ID NO: 757505 - RNA, 14 nt, Leptospira interrogans serovar lai str. 56601
cguuuaacaaaaau

SEQ ID NO: 757506 - RNA, 21 nt, Leptospira interrogans serovar lai str. 56601
cguuggccucgaaaguuuaca

SEQ ID NO: 757507 - RNA, 13 nt, Leptospira interrogans serovar lai str. 56601
cguuccaaacccu

SEQ ID NO: 757508 - RNA, 14 nt, Leptospira interrogans serovar lai str. 56601
cguuccaaacccug

SEQ ID NO: 757509 - RNA, 17 nt, Leptospira interrogans serovar lai str. 56601
cguuaaguaggaacuac

SEQ ID NO: 757510 - RNA, 23 nt, Leptospira interrogans serovar lai str. 56601
cguuaaauuuucguaauaguucc

SEQ ID NO: 757511 - RNA, 21 nt, Leptospira interrogans serovar lai str. 56601
cguuaaauuuucguaguaguc

SEQ ID NO: 757512 - RNA, 17 nt, Leptospira interrogans serovar lai str. 56601
cguucuuuuuuccuucu

SEQ ID NO: 757513 - RNA, 16 nt, Leptospira interrogans serovar lai str. 56601
cguugaauaagauuuu

SEQ ID NO: 757514 - RNA, 22 nt, Leptospira interrogans serovar lai str. 56601
cgugguaguucccacauuuaaa

SEQ ID NO: 757515 - RNA, 15 nt, Leptospira interrogans serovar lai str. 56601
cgugacaaacuaaau

SEQ ID NO: 757516 - RNA, 21 nt, Leptospira interrogans serovar lai str. 56601
cgugaacucgguguaaaaaaa

SEQ ID NO: 757517 - RNA, 23 nt, Leptospira interrogans serovar lai str. 56601
cgugaacucgguguaaaaaaauu

SEQ ID NO: 757518 - RNA, 15 nt, Leptospira interrogans serovar lai str. 56601
cgucuuaaauucuaa

SEQ ID NO: 757519 - RNA, 15 nt, Leptospira interrogans serovar lai str. 56601
cgugaguucaaugua

SEQ ID NO: 757520 - RNA, 13 nt, Leptospira interrogans serovar lai str. 56601
cgugaguucagac

SEQ ID NO: 757521 - RNA, 12 nt, Leptospira interrogans serovar lai str. 56601
cguaaaaaaaua

SEQ ID NO: 757522 - RNA, 14 nt, Leptospira interrogans serovar lai str. 56601
cguaaaaaaauaag

SEQ ID NO: 757523 - RNA, 12 nt, Leptospira interrogans serovar lai str. 56601
cguaaaaaaauc

SEQ ID NO: 757524 - RNA, 14 nt, Leptospira interrogans serovar lai str. 56601
cguaaagaagaggu

SEQ ID NO: 757525 - RNA, 23 nt, Leptospira interrogans serovar lai str. 56601
cguaaagaauucauuuuucugaa

SEQ ID NO: 757526 - RNA, 18 nt, Leptospira interrogans serovar lai str. 56601
cguaaaauggaaaaaaga

SEQ ID NO: 757527 - RNA, 18 nt, Leptospira interrogans serovar lai str. 56601
cguaaacaaaaguggaag

SEQ ID NO: 757528 - RNA, 14 nt, Leptospira interrogans serovar lai str. 56601
cguaaaaauauugg

SEQ ID NO: 757529 - RNA, 12 nt, Leptospira interrogans serovar lai str. 56601
cguaaauauuuu

SEQ ID NO: 757530 - RNA, 20 nt, Leptospira interrogans serovar lai str. 56601
cgguuauugugaauauuucu

SEQ ID NO: 757531 - RNA, 15 nt, Leptospira interrogans serovar lai str. 56601
cgguguaaaaaaauu

SEQ ID NO: 757532 - RNA, 14 nt, Leptospira interrogans serovar lai str. 56601
cggugcauuuaaaa

SEQ ID NO: 757533 - RNA, 18 nt, Leptospira interrogans serovar lai str. 56601
cggugcauuuaaaaaauu

SEQ ID NO: 757534 - RNA, 13 nt, Leptospira interrogans serovar lai str. 56601
cguaauaguuccc

SEQ ID NO: 757535 - RNA, 17 nt, Leptospira interrogans serovar lai str. 56601
cguaauaucuaaaaccu

SEQ ID NO: 757536 - RNA, 18 nt, Leptospira interrogans serovar lai str. 56601
cguaauaucuaaaaccuc

SEQ ID NO: 757537 - RNA, 21 nt, Leptospira interrogans serovar lai str. 56601
cguaaguuaaauauaaaagau

SEQ ID NO: 757538 - RNA, 13 nt, Leptospira interrogans serovar lai str. 56601
cguauacuuuaaa

SEQ ID NO: 757539 - RNA, 17 nt, Leptospira interrogans serovar lai str. 56601
cguauaacgaaacuuua

SEQ ID NO: 757540 - RNA, 20 nt, Leptospira interrogans serovar lai str. 56601
cgucgaacucacauuauuua

SEQ ID NO: 757541 - RNA, 19 nt, Leptospira interrogans serovar lai str. 56601
cgucauaguucccacaaau

SEQ ID NO: 757542 - RNA, 22 nt, Leptospira interrogans serovar lai str. 56601
cgucccaaaaucuuaaaagaaa

SEQ ID NO: 757543 - RNA, 18 nt, Leptospira interrogans serovar lai str. 56601
cgguaaauuuuuuagaaa

SEQ ID NO: 757544 - RNA, 21 nt, Leptospira interrogans serovar lai str. 56601
cgguaaauuuuuuagaaauca

SEQ ID NO: 757545 - RNA, 22 nt, Leptospira interrogans serovar lai str. 56601
cgguaaauuuuuuagaaaucaa

SEQ ID NO: 757546 - RNA, 18 nt, Leptospira interrogans serovar lai str. 56601
cgguaaaaucuuuaaguu

SEQ ID NO: 757547 - RNA, 17 nt, Leptospira interrogans serovar lai str. 56601
aaacuaggucgcauuua

SEQ ID NO: 757548 - RNA, 21 nt, Leptospira interrogans serovar lai str. 56601
aaacuaggucgcauuuagcaa

SEQ ID NO: 757549 - RNA, 15 nt, Leptospira interrogans serovar lai str. 56601
aaacuauaaaucauu

SEQ ID NO: 757550 - RNA, 14 nt, Leptospira interrogans serovar lai str. 56601
aaacuacuaaaucu

SEQ ID NO: 757551 - RNA, 13 nt, Leptospira interrogans serovar lai str. 56601
aaacuaaauuagu

SEQ ID NO: 757552 - RNA, 17 nt, Leptospira interrogans serovar lai str. 56601
aaacuacuuccgucuuu

SEQ ID NO: 757553 - RNA, 22 nt, Leptospira interrogans serovar lai str. 56601
aaacuacuuccgucuuuuguaa

SEQ ID NO: 757554 - RNA, 13 nt, Leptospira interrogans serovar lai str. 56601
aaacuaauaauua

SEQ ID NO: 757555 - RNA, 20 nt, Leptospira interrogans serovar lai str. 56601
aaacuaaauuuuucggaaau

SEQ ID NO: 757556 - RNA, 15 nt, Leptospira interrogans serovar lai str. 56601
aaacguuuuguugag

SEQ ID NO: 757557 - RNA, 14 nt, Leptospira interrogans serovar lai str. 56601
aaacuaaaaaaaau

SEQ ID NO: 757558 - RNA, 23 nt, Leptospira interrogans serovar lai str. 56601
cgguacaaucggguaaaaaauac

SEQ ID NO: 757559 - RNA, 20 nt, Leptospira interrogans serovar lai str. 56601
cgguaauuucauaaaauucu

SEQ ID NO: 757560 - RNA, 12 nt, Leptospira interrogans serovar lai str. 56601
cgguaauuauaa

SEQ ID NO: 757561 - RNA, 20 nt, Leptospira interrogans serovar lai str. 56601
cgggagcgcuugaaaauucu

SEQ ID NO: 757562 - RNA, 17 nt, Leptospira interrogans serovar lai str. 56601
cgggaauaaaaacuaca

SEQ ID NO: 757563 - RNA, 21 nt, Leptospira interrogans serovar lai str. 56601
cgggaauauucguaagaaaaa

SEQ ID NO: 757564 - RNA, 18 nt, Leptospira interrogans serovar lai str. 56601
cggcuuuuuuuacuucua

SEQ ID NO: 757565 - RNA, 20 nt, Leptospira interrogans serovar lai str. 56601
cggcuuuuuuuacuucuaac

SEQ ID NO: 757566 - RNA, 14 nt, Leptospira interrogans serovar lai str. 56601
cgggaaaaaauucg

SEQ ID NO: 757567 - RNA, 14 nt, Leptospira interrogans serovar lai str. 56601
cgggaaaaucuuuu

SEQ ID NO: 757568 - RNA, 14 nt, Leptospira interrogans serovar lai str. 56601
cggcucauaaaaaa

SEQ ID NO: 757569 - RNA, 17 nt, Leptospira interrogans serovar lai str. 56601
cuuauuuuugaaaagau

SEQ ID NO: 757570 - RNA, 18 nt, Leptospira interrogans serovar lai str. 56601
cuuauuuuuuuauuuuau

SEQ ID NO: 757571 - RNA, 13 nt, Leptospira interrogans serovar lai str. 56601
cuucaaaaaauau

SEQ ID NO: 757572 - RNA, 22 nt, Leptospira interrogans serovar lai str. 56601
cuucaaaacuaggaucuccuug

SEQ ID NO: 757573 - RNA, 19 nt, Leptospira interrogans serovar lai str. 56601
cuucaaaaucguuuuaaaa

SEQ ID NO: 757574 - RNA, 13 nt, Leptospira interrogans serovar lai str. 56601
cuucaaugaggaa

SEQ ID NO: 757575 - RNA, 15 nt, Leptospira interrogans serovar lai str. 56601
cuucauccagauuca

SEQ ID NO: 757576 - RNA, 18 nt, Leptospira interrogans serovar lai str. 56601
cuucagcagucugugauu

SEQ ID NO: 757577 - RNA, 22 nt, Leptospira interrogans serovar lai str. 56601
cuuccgggaggaauuuuuaaaa

SEQ ID NO: 757578 - RNA, 20 nt, Leptospira interrogans serovar lai str. 56601
cuuccaaaucugaaucucuu

SEQ ID NO: 757579 - RNA, 18 nt, Leptospira interrogans serovar lai str. 56601
aaacuucucuuaaaauuu

SEQ ID NO: 757580 - RNA, 22 nt, Leptospira interrogans serovar lai str. 56601
aaacuucuauuuuauaaauugu

SEQ ID NO: 757581 - RNA, 15 nt, Leptospira interrogans serovar lai str. 56601
aaacuucuauuuuga

SEQ ID NO: 757582 - RNA, 19 nt, Leptospira interrogans serovar lai str. 56601
aaacuucuucaucuuacca

SEQ ID NO: 757583 - RNA, 13 nt, Leptospira interrogans serovar lai str. 56601
cuucauuuuggga

SEQ ID NO: 757584 - RNA, 18 nt, Leptospira interrogans serovar lai str. 56601
aaacuucacuucuuuuag

SEQ ID NO: 757585 - RNA, 19 nt, Leptospira interrogans serovar lai str. 56601
cuuaauguaaaguucuuuu

SEQ ID NO: 757586 - RNA, 22 nt, Leptospira interrogans serovar lai str. 56601
cuuaauguaaaguucuuuucuu

SEQ ID NO: 757587 - RNA, 23 nt, Leptospira interrogans serovar lai str. 56601
cuuaauguaaaguucuuuucuua

SEQ ID NO: 757588 - RNA, 16 nt, Leptospira interrogans serovar lai str. 56601
cuuaaucucaugaguc

SEQ ID NO: 757589 - RNA, 13 nt, Leptospira interrogans serovar lai str. 56601
cuuaaucugcuga

SEQ ID NO: 757590 - RNA, 19 nt, Leptospira interrogans serovar lai str. 56601
cuuaaucugcugaauuuac

SEQ ID NO: 757591 - RNA, 21 nt, Leptospira interrogans serovar lai str. 56601
cuuaaugagauuaaaacugcu

SEQ ID NO: 757592 - RNA, 18 nt, Leptospira interrogans serovar lai str. 56601
cuuaaugucccagauucg

SEQ ID NO: 757593 - RNA, 20 nt, Leptospira interrogans serovar lai str. 56601
cuuacaucccaaaccucuuu

SEQ ID NO: 757594 - RNA, 23 nt, Leptospira interrogans serovar lai str. 56601
cuuaccgccuucacccaccaaaa

SEQ ID NO: 757595 - RNA, 22 nt, Leptospira interrogans serovar lai str. 56601
cuuaccaacgucccuauuguau

SEQ ID NO: 757596 - RNA, 15 nt, Leptospira interrogans serovar lai str. 56601
cuuaccacagugaaa

SEQ ID NO: 757597 - RNA, 21 nt, Leptospira interrogans serovar lai str. 56601
cuuagaguaaaacuuuuaaag

SEQ ID NO: 757598 - RNA, 19 nt, Leptospira interrogans serovar lai str. 56601
cuuagauucacuuuugcug

SEQ ID NO: 757599 - RNA, 20 nt, Leptospira interrogans serovar lai str. 56601
cuuacugcauuuuauuaaag

SEQ ID NO: 757600 - RNA, 23 nt, Leptospira interrogans serovar lai str. 56601
cuuagacucaguauguuguucuc

SEQ ID NO: 757601 - RNA, 20 nt, Leptospira interrogans serovar lai str. 56601
cuuacuaugaagucuuaucu

SEQ ID NO: 757602 - RNA, 12 nt, Leptospira interrogans serovar lai str. 56601
cuuauuugcaau

SEQ ID NO: 757603 - RNA, 14 nt, Leptospira interrogans serovar lai str. 56601
cuuauuuauuaaag

SEQ ID NO: 757604 - RNA, 23 nt, Leptospira interrogans serovar lai str. 56601
cuuauguuuuuuauggaaaaaug

SEQ ID NO: 757605 - RNA, 15 nt, Leptospira interrogans serovar lai str. 56601
cuuauguggaugaua

SEQ ID NO: 757606 - RNA, 13 nt, Leptospira interrogans serovar lai str. 56601
cuuaggaacuuuu

SEQ ID NO: 757607 - RNA, 22 nt, Leptospira interrogans serovar lai str. 56601
cuuagguucgaacguauaaaaa

SEQ ID NO: 757608 - RNA, 22 nt, Leptospira interrogans serovar lai str. 56601
cuuagguuuuguaauaguuccc

SEQ ID NO: 757609 - RNA, 17 nt, Leptospira interrogans serovar lai str. 56601
cuuaucacgaaaauuaa

SEQ ID NO: 757610 - RNA, 21 nt, Leptospira interrogans serovar lai str. 56601
cuuaucacgaaaauuaaaaaa

SEQ ID NO: 757611 - RNA, 17 nt, Leptospira interrogans serovar lai str. 56601
cuguuguuauagaugaa

SEQ ID NO: 757612 - RNA, 14 nt, Leptospira interrogans serovar lai str. 56601
cuguuuauuuugaa

SEQ ID NO: 757613 - RNA, 14 nt, Leptospira interrogans serovar lai str. 56601
cuguuuaauaaaga

SEQ ID NO: 757614 - RNA, 15 nt, Leptospira interrogans serovar lai str. 56601
cuguuuaauaaagau

SEQ ID NO: 757615 - RNA, 17 nt, Leptospira interrogans serovar lai str. 56601
cuguuauccgauuuuug

SEQ ID NO: 757616 - RNA, 18 nt, Leptospira interrogans serovar lai str. 56601
cuguuauccgauuuuugu

SEQ ID NO: 757617 - RNA, 21 nt, Leptospira interrogans serovar lai str. 56601
cuguuauccgauuuuuguuuu

SEQ ID NO: 757618 - RNA, 15 nt, Leptospira interrogans serovar lai str. 56601
cuguuacggauucgu

SEQ ID NO: 757619 - RNA, 23 nt, Leptospira interrogans serovar lai str. 56601
cuguuacggauucguaaaaaccg

SEQ ID NO: 757620 - RNA, 16 nt, Leptospira interrogans serovar lai str. 56601
cuuaauagcagauuuu

SEQ ID NO: 757621 - RNA, 16 nt, Leptospira interrogans serovar lai str. 56601
cuuaaauucuaaaaaa

SEQ ID NO: 757622 - RNA, 18 nt, Leptospira interrogans serovar lai str. 56601
cuuaaauucuaaaaaaau

SEQ ID NO: 757623 - RNA, 19 nt, Leptospira interrogans serovar lai str. 56601
cuuaaauucuaaaaaaaua

SEQ ID NO: 757624 - RNA, 15 nt, Leptospira interrogans serovar lai str. 56601
cuuaaauucuaauug

SEQ ID NO: 757625 - RNA, 12 nt, Leptospira interrogans serovar lai str. 56601
cuuaaaucaauc

SEQ ID NO: 757626 - RNA, 20 nt, Leptospira interrogans serovar lai str. 56601
cuuaaaagaagauuuuucuu

SEQ ID NO: 757627 - RNA, 16 nt, Leptospira interrogans serovar lai str. 56601
cuuaaacguauaaaaa

SEQ ID NO: 757628 - RNA, 18 nt, Leptospira interrogans serovar lai str. 56601
cuuaaagcauuaaaaaag

SEQ ID NO: 757629 - RNA, 19 nt, Leptospira interrogans serovar lai str. 56601
cuuaaagcauuaaaaaaga

SEQ ID NO: 757630 - RNA, 22 nt, Leptospira interrogans serovar lai str. 56601
cuuaaaucuuagauucacuuuu

SEQ ID NO: 757631 - RNA, 19 nt, Leptospira interrogans serovar lai str. 56601
cuuaaaucuuuaaaauacu

SEQ ID NO: 757632 - RNA, 14 nt, Leptospira interrogans serovar lai str. 56601
cuuaaauacuuaaa

SEQ ID NO: 757633 - RNA, 14 nt, Leptospira interrogans serovar lai str. 56601
cuuaaauaaaauuu

SEQ ID NO: 757634 - RNA, 20 nt, Leptospira interrogans serovar lai str. 56601
cuguuucuuacucgacaaaa

SEQ ID NO: 757635 - RNA, 17 nt, Leptospira interrogans serovar lai str. 56601
cuguuuuguuuccuucu

SEQ ID NO: 757636 - RNA, 20 nt, Leptospira interrogans serovar lai str. 56601
cuuaaaaacuugaaucgagc

SEQ ID NO: 757637 - RNA, 13 nt, Leptospira interrogans serovar lai str. 56601
cuuaaaaaaauga

SEQ ID NO: 757638 - RNA, 15 nt, Leptospira interrogans serovar lai str. 56601
cuugcuaaaauuuuu

SEQ ID NO: 757639 - RNA, 22 nt, Leptospira interrogans serovar lai str. 56601
cuugcggauuccauucuucaaa

SEQ ID NO: 757640 - RNA, 14 nt, Leptospira interrogans serovar lai str. 56601
cuuggaaauaucua

SEQ ID NO: 757641 - RNA, 23 nt, Leptospira interrogans serovar lai str. 56601
cuugcugucgcaacauaauguuu

SEQ ID NO: 757642 - RNA, 15 nt, Leptospira interrogans serovar lai str. 56601
aaacuuuuaguaacu

SEQ ID NO: 757643 - RNA, 23 nt, Leptospira interrogans serovar lai str. 56601
aaacuuuuaucgaauggaauuua

SEQ ID NO: 757644 - RNA, 12 nt, Leptospira interrogans serovar lai str. 56601
aaacuuuuaaag

SEQ ID NO: 757645 - RNA, 13 nt, Leptospira interrogans serovar lai str. 56601
aaacuuuguaaau

SEQ ID NO: 757646 - RNA, 22 nt, Leptospira interrogans serovar lai str. 56601
aaacuuucuuccaauuguucca

SEQ ID NO: 757647 - RNA, 18 nt, Leptospira interrogans serovar lai str. 56601
aaacuuugagauguggga

SEQ ID NO: 757648 - RNA, 13 nt, Leptospira interrogans serovar lai str. 56601
aaacuuucuuuuu

SEQ ID NO: 757649 - RNA, 16 nt, Leptospira interrogans serovar lai str. 56601
aaacuuugaaaauugu

SEQ ID NO: 757650 - RNA, 22 nt, Leptospira interrogans serovar lai str. 56601
aaacuuuagaauguaaaagcuu

SEQ ID NO: 757651 - RNA, 22 nt, Leptospira interrogans serovar lai str. 56601
aaacuuguuguaccauuuugau

SEQ ID NO: 757652 - RNA, 14 nt, Leptospira interrogans serovar lai str. 56601
aaacuuuaaauacu

SEQ ID NO: 757653 - RNA, 15 nt, Leptospira interrogans serovar lai str. 56601
aaacuugucccaaaa

SEQ ID NO: 757654 - RNA, 19 nt, Leptospira interrogans serovar lai str. 56601
aaacuugauuaaacaggac

SEQ ID NO: 757655 - RNA, 18 nt, Leptospira interrogans serovar lai str. 56601
cuugccauggaaauuuuu

SEQ ID NO: 757656 - RNA, 15 nt, Leptospira interrogans serovar lai str. 56601
cuugcaaaaauagaa

SEQ ID NO: 757657 - RNA, 13 nt, Leptospira interrogans serovar lai str. 56601
cuugauugguugu

SEQ ID NO: 757658 - RNA, 15 nt, Leptospira interrogans serovar lai str. 56601
cuugauuauuauuuu

SEQ ID NO: 757659 - RNA, 19 nt, Leptospira interrogans serovar lai str. 56601
cuugauauuucuguaaaaa

SEQ ID NO: 757660 - RNA, 23 nt, Leptospira interrogans serovar lai str. 56601
cuugauauuucuguaaaaaauaa

SEQ ID NO: 757661 - RNA, 18 nt, Leptospira interrogans serovar lai str. 56601
cuugagggguuuuuccuu

SEQ ID NO: 757662 - RNA, 13 nt, Leptospira interrogans serovar lai str. 56601
cuugaccucauau

SEQ ID NO: 757663 - RNA, 20 nt, Leptospira interrogans serovar lai str. 56601
cuugacuuugguugaguuuu

SEQ ID NO: 757664 - RNA, 20 nt, Leptospira interrogans serovar lai str. 56601
cuugagaagggugaauuuuu

SEQ ID NO: 757665 - RNA, 17 nt, Leptospira interrogans serovar lai str. 56601
cuugagaaaggagaacu

SEQ ID NO: 757666 - RNA, 16 nt, Leptospira interrogans serovar lai str. 56601
cuugagaaaucauuuu

SEQ ID NO: 757667 - RNA, 13 nt, Leptospira interrogans serovar lai str. 56601
cuugacucugcau

SEQ ID NO: 757668 - RNA, 17 nt, Leptospira interrogans serovar lai str. 56601
cuugaaccauuugaaaa

SEQ ID NO: 757669 - RNA, 12 nt, Leptospira interrogans serovar lai str. 56601
cuugaacucaau

SEQ ID NO: 757670 - RNA, 14 nt, Leptospira interrogans serovar lai str. 56601
cuugaaucaaauaa

SEQ ID NO: 757671 - RNA, 16 nt, Leptospira interrogans serovar lai str. 56601
cuugaauagaaccuuu

SEQ ID NO: 757672 - RNA, 16 nt, Leptospira interrogans serovar lai str. 56601
cuugaaauucucuuuu

SEQ ID NO: 757673 - RNA, 18 nt, Leptospira interrogans serovar lai str. 56601
cuugaaacuuuuaauaaa

SEQ ID NO: 757674 - RNA, 19 nt, Leptospira interrogans serovar lai str. 56601
cuugaaacuuuuaauaaaa

SEQ ID NO: 757675 - RNA, 19 nt, Leptospira interrogans serovar lai str. 56601
cuucuuuuguuuuuauaaa

SEQ ID NO: 757676 - RNA, 13 nt, Leptospira interrogans serovar lai str. 56601
cuucuuuuuucua

SEQ ID NO: 757677 - RNA, 19 nt, Leptospira interrogans serovar lai str. 56601
cuucuuuuuucuaaauaau

SEQ ID NO: 757678 - RNA, 13 nt, Leptospira interrogans serovar lai str. 56601
cuugaaaauaaaa

SEQ ID NO: 757679 - RNA, 19 nt, Leptospira interrogans serovar lai str. 56601
cuucuuccauucuaaaauc

SEQ ID NO: 757680 - RNA, 17 nt, Leptospira interrogans serovar lai str. 56601
cuucuucaugauuuuuu

SEQ ID NO: 757681 - RNA, 21 nt, Leptospira interrogans serovar lai str. 56601
cuucuucgguaauuguagauu

SEQ ID NO: 757682 - RNA, 15 nt, Leptospira interrogans serovar lai str. 56601
cuucuugcgcuaucu

SEQ ID NO: 757683 - RNA, 19 nt, Leptospira interrogans serovar lai str. 56601
cuucuucaauguuauaaaa

SEQ ID NO: 757684 - RNA, 23 nt, Leptospira interrogans serovar lai str. 56601
cuucuuaaguagauaaauucuua

SEQ ID NO: 757685 - RNA, 22 nt, Leptospira interrogans serovar lai str. 56601
cuucgguuuaauauacuaaaau

SEQ ID NO: 757686 - RNA, 20 nt, Leptospira interrogans serovar lai str. 56601
cuucgugaaaugguaccaua

SEQ ID NO: 757687 - RNA, 10 nt, Leptospira interrogans serovar lai str. 56601
cuucuaauga

SEQ ID NO: 757688 - RNA, 12 nt, Leptospira interrogans serovar lai str. 56601
cuucuaauuaaa

SEQ ID NO: 757689 - RNA, 18 nt, Leptospira interrogans serovar lai str. 56601
cuucuaauucaguuuuuc

SEQ ID NO: 757690 - RNA, 20 nt, Leptospira interrogans serovar lai str. 56601
cuucuauuuuauaaauugug

SEQ ID NO: 757691 - RNA, 22 nt, Leptospira interrogans serovar lai str. 56601
cuucucgcaacggauuccucca

SEQ ID NO: 757692 - RNA, 23 nt, Leptospira interrogans serovar lai str. 56601
cuucucgcaacggauuccuccag

SEQ ID NO: 757693 - RNA, 14 nt, Leptospira interrogans serovar lai str. 56601
cuucucuuaaaauu

SEQ ID NO: 757694 - RNA, 21 nt, Leptospira interrogans serovar lai str. 56601
cuucugaaaguaguauucuuu

SEQ ID NO: 757695 - RNA, 21 nt, Leptospira interrogans serovar lai str. 56601
cuucugauuguaacauuauag

SEQ ID NO: 757696 - RNA, 16 nt, Leptospira interrogans serovar lai str. 56601
cuucuggaaugacuga

SEQ ID NO: 757697 - RNA, 14 nt, Leptospira interrogans serovar lai str. 56601
cuuucaaaaaauau

SEQ ID NO: 757698 - RNA, 22 nt, Leptospira interrogans serovar lai str. 56601
cuuucaaagcuauaguuuuuaa

SEQ ID NO: 757699 - RNA, 21 nt, Leptospira interrogans serovar lai str. 56601
cuuuauaaaaguauaauauuu

SEQ ID NO: 757700 - RNA, 11 nt, Leptospira interrogans serovar lai str. 56601
cuuuauaaaau

SEQ ID NO: 757701 - RNA, 16 nt, Leptospira interrogans serovar lai str. 56601
cuuuaguuuccaaaaa

SEQ ID NO: 757702 - RNA, 18 nt, Leptospira interrogans serovar lai str. 56601
cuuuauaauugaacauuu

SEQ ID NO: 757703 - RNA, 18 nt, Leptospira interrogans serovar lai str. 56601
cuuuauagagauuuccua

SEQ ID NO: 757704 - RNA, 18 nt, Leptospira interrogans serovar lai str. 56601
cuuuauuuguauucaaga

SEQ ID NO: 757705 - RNA, 17 nt, Leptospira interrogans serovar lai str. 56601
cuuuauggaaauuucau

SEQ ID NO: 757706 - RNA, 17 nt, Leptospira interrogans serovar lai str. 56601
cuuuaucuuuauaaaaa

SEQ ID NO: 757707 - RNA, 20 nt, Leptospira interrogans serovar lai str. 56601
cuuuaauuacaguuaauaaa

SEQ ID NO: 757708 - RNA, 14 nt, Leptospira interrogans serovar lai str. 56601
cuuuaauuucaaua

SEQ ID NO: 757709 - RNA, 15 nt, Leptospira interrogans serovar lai str. 56601
cuuuaagauauugag

SEQ ID NO: 757710 - RNA, 21 nt, Leptospira interrogans serovar lai str. 56601
cuuuaagagccuuucacaucu

SEQ ID NO: 757711 - RNA, 21 nt, Leptospira interrogans serovar lai str. 56601
cuuuacauuuuuaucuugauc

SEQ ID NO: 757712 - RNA, 18 nt, Leptospira interrogans serovar lai str. 56601
cuuuacaucaauuauuuu

SEQ ID NO: 757713 - RNA, 21 nt, Leptospira interrogans serovar lai str. 56601
cuuuacaauuugcuaaaauaa

SEQ ID NO: 757714 - RNA, 20 nt, Leptospira interrogans serovar lai str. 56601
cuuuacacgauaauuuuuag

SEQ ID NO: 757715 - RNA, 21 nt, Leptospira interrogans serovar lai str. 56601
cuuuacagacugauuuuuuaa

SEQ ID NO: 757716 - RNA, 22 nt, Leptospira interrogans serovar lai str. 56601
cuuuacagacugauuuuuuaaa

SEQ ID NO: 757717 - RNA, 22 nt, Leptospira interrogans serovar lai str. 56601
cuuuacagaucaauucuuuaaa

SEQ ID NO: 757718 - RNA, 15 nt, Leptospira interrogans serovar lai str. 56601
cuuuacguauguauu

SEQ ID NO: 757719 - RNA, 16 nt, Leptospira interrogans serovar lai str. 56601
aaagaauaauauuuua

SEQ ID NO: 757720 - RNA, 23 nt, Leptospira interrogans serovar lai str. 56601
aaagaaguuguaucagauguuuu

SEQ ID NO: 757721 - RNA, 14 nt, Leptospira interrogans serovar lai str. 56601
aaagaaucuaauuu

SEQ ID NO: 757722 - RNA, 14 nt, Leptospira interrogans serovar lai str. 56601
aaagaaucauacaa

SEQ ID NO: 757723 - RNA, 21 nt, Leptospira interrogans serovar lai str. 56601
aaagaaucauacaaucaaauu

SEQ ID NO: 757724 - RNA, 20 nt, Leptospira interrogans serovar lai str. 56601
aaagaaucauuaaucagauu

SEQ ID NO: 757725 - RNA, 23 nt, Leptospira interrogans serovar lai str. 56601
aaagaagggaugaaauuuuaaaa

SEQ ID NO: 757726 - RNA, 21 nt, Leptospira interrogans serovar lai str. 56601
aaagaaggcagcuaagaaaaa

SEQ ID NO: 757727 - RNA, 18 nt, Leptospira interrogans serovar lai str. 56601
aaagacaaaguauuuucu

SEQ ID NO: 757728 - RNA, 21 nt, Leptospira interrogans serovar lai str. 56601
aaagacaauauucuugauugg

SEQ ID NO: 757729 - RNA, 21 nt, Leptospira interrogans serovar lai str. 56601
aaagaauuucuaaaaguaaaa

SEQ ID NO: 757730 - RNA, 16 nt, Leptospira interrogans serovar lai str. 56601
aaagaauuucuaaaau

SEQ ID NO: 757731 - RNA, 15 nt, Leptospira interrogans serovar lai str. 56601
aaagaauuuuuaaaa

SEQ ID NO: 757732 - RNA, 15 nt, Leptospira interrogans serovar lai str. 56601
aaagaauuuuuacag

SEQ ID NO: 757733 - RNA, 19 nt, Leptospira interrogans serovar lai str. 56601
aaagaaucguuuuuuuugu

SEQ ID NO: 757734 - RNA, 17 nt, Leptospira interrogans serovar lai str. 56601
aaagaaucuuuuuaaaa

SEQ ID NO: 757735 - RNA, 16 nt, Leptospira interrogans serovar lai str. 56601
aaagaauugaaaucug

SEQ ID NO: 757736 - RNA, 20 nt, Leptospira interrogans serovar lai str. 56601
aaagaauuuaauaaaaaaau

SEQ ID NO: 757737 - RNA, 14 nt, Leptospira interrogans serovar lai str. 56601
cuuuggauuuugau

SEQ ID NO: 757738 - RNA, 20 nt, Leptospira interrogans serovar lai str. 56601
cuuuguaaaucuauucuuaa

SEQ ID NO: 757739 - RNA, 22 nt, Leptospira interrogans serovar lai str. 56601
cuuugguuaucauaaaaauaaa

SEQ ID NO: 757740 - RNA, 23 nt, Leptospira interrogans serovar lai str. 56601
cuuugguuuguaauaguucccac

SEQ ID NO: 757741 - RNA, 15 nt, Leptospira interrogans serovar lai str. 56601
cuuuggaaauuuuua

SEQ ID NO: 757742 - RNA, 12 nt, Leptospira interrogans serovar lai str. 56601
cuuugaaugaaa

SEQ ID NO: 757743 - RNA, 22 nt, Leptospira interrogans serovar lai str. 56601
cuuugaaugaaaagauuucaaa

SEQ ID NO: 757744 - RNA, 19 nt, Leptospira interrogans serovar lai str. 56601
cuuugaaugacacaaaaaa

SEQ ID NO: 757745 - RNA, 21 nt, Leptospira interrogans serovar lai str. 56601
cuuugaaugcaacgaaaucaa

SEQ ID NO: 757746 - RNA, 23 nt, Leptospira interrogans serovar lai str. 56601
cuuugaaugcaacgaaaucaaug

SEQ ID NO: 757747 - RNA, 15 nt, Leptospira interrogans serovar lai str. 56601
cuuucgauuuuaaau

SEQ ID NO: 757748 - RNA, 17 nt, Leptospira interrogans serovar lai str. 56601
cuuucgaccuuaacucu

SEQ ID NO: 757749 - RNA, 19 nt, Leptospira interrogans serovar lai str. 56601
cuuucgcgguuuucuuuuu

SEQ ID NO: 757750 - RNA, 18 nt, Leptospira interrogans serovar lai str. 56601
cuuuccuaaucuuauuca

SEQ ID NO: 757751 - RNA, 14 nt, Leptospira interrogans serovar lai str. 56601
cuuuccuauaaaag

SEQ ID NO: 757752 - RNA, 20 nt, Leptospira interrogans serovar lai str. 56601
cuuuccgggucgauuuugau

SEQ ID NO: 757753 - RNA, 18 nt, Leptospira interrogans serovar lai str. 56601
cuuuccgucuuuuaggua

SEQ ID NO: 757754 - RNA, 19 nt, Leptospira interrogans serovar lai str. 56601
cuuucgcuuggaaauaucu

SEQ ID NO: 757755 - RNA, 16 nt, Leptospira interrogans serovar lai str. 56601
cuuucuuauuaauucu

SEQ ID NO: 757756 - RNA, 14 nt, Leptospira interrogans serovar lai str. 56601
cuuugaaaauugug

SEQ ID NO: 757757 - RNA, 13 nt, Leptospira interrogans serovar lai str. 56601
cuuugaaaauuuu

SEQ ID NO: 757758 - RNA, 14 nt, Leptospira interrogans serovar lai str. 56601
cuuugaaaauuuuu

SEQ ID NO: 757759 - RNA, 21 nt, Leptospira interrogans serovar lai str. 56601
cuuucuuaaauuuuuuuucag

SEQ ID NO: 757760 - RNA, 15 nt, Leptospira interrogans serovar lai str. 56601
cuuugaauaaaaccg

SEQ ID NO: 757761 - RNA, 23 nt, Leptospira interrogans serovar lai str. 56601
cuuugaacuuguccuaaaauuuu

SEQ ID NO: 757762 - RNA, 15 nt, Leptospira interrogans serovar lai str. 56601
cuuugaacuuuuuca

SEQ ID NO: 757763 - RNA, 21 nt, Leptospira interrogans serovar lai str. 56601
cuuucuuccaauuguuccacu

SEQ ID NO: 757764 - RNA, 19 nt, Leptospira interrogans serovar lai str. 56601
cuuugaaccacaguuccua

SEQ ID NO: 757765 - RNA, 13 nt, Leptospira interrogans serovar lai str. 56601
cuugggauaaaua

SEQ ID NO: 757766 - RNA, 15 nt, Leptospira interrogans serovar lai str. 56601
cuugggauaaauauu

SEQ ID NO: 757767 - RNA, 21 nt, Leptospira interrogans serovar lai str. 56601
cuuguaaguuguguuuauuca

SEQ ID NO: 757768 - RNA, 23 nt, Leptospira interrogans serovar lai str. 56601
cuuguagaaacuauuauacuuua

SEQ ID NO: 757769 - RNA, 22 nt, Leptospira interrogans serovar lai str. 56601
cuuguagauugauccagauucc

SEQ ID NO: 757770 - RNA, 12 nt, Leptospira interrogans serovar lai str. 56601
aaacuuuucuaa

SEQ ID NO: 757771 - RNA, 20 nt, Leptospira interrogans serovar lai str. 56601
aaacuuuucuaaaaguauga

SEQ ID NO: 757772 - RNA, 20 nt, Leptospira interrogans serovar lai str. 56601
cuugucccgaaaccucaaaa

SEQ ID NO: 757773 - RNA, 15 nt, Leptospira interrogans serovar lai str. 56601
cuugucacuauuuuu

SEQ ID NO: 757774 - RNA, 20 nt, Leptospira interrogans serovar lai str. 56601
cuuggugauaaucaucaaaa

SEQ ID NO: 757775 - RNA, 12 nt, Leptospira interrogans serovar lai str. 56601
aaagaaaaccuu

SEQ ID NO: 757776 - RNA, 13 nt, Leptospira interrogans serovar lai str. 56601
aaacuuuuuaaaa

SEQ ID NO: 757777 - RNA, 16 nt, Leptospira interrogans serovar lai str. 56601
aaacuuuuuaaaacga

SEQ ID NO: 757778 - RNA, 20 nt, Leptospira interrogans serovar lai str. 56601
aaagaaaaacaggcgaauuu

SEQ ID NO: 757779 - RNA, 17 nt, Leptospira interrogans serovar lai str. 56601
aaagaaacguaauacga

SEQ ID NO: 757780 - RNA, 15 nt, Leptospira interrogans serovar lai str. 56601
aaagaaacucauaaa

SEQ ID NO: 757781 - RNA, 19 nt, Leptospira interrogans serovar lai str. 56601
aaagaaacuguuuaauaaa

SEQ ID NO: 757782 - RNA, 22 nt, Leptospira interrogans serovar lai str. 56601
aaagaaacuguuuaauaaagau

SEQ ID NO: 757783 - RNA, 19 nt, Leptospira interrogans serovar lai str. 56601
aaagaaaccgaucuuaaaa

SEQ ID NO: 757784 - RNA, 16 nt, Leptospira interrogans serovar lai str. 56601
aaagaaaguugcaaag

SEQ ID NO: 757785 - RNA, 18 nt, Leptospira interrogans serovar lai str. 56601
aaagaaaguugcaaagaa

SEQ ID NO: 757786 - RNA, 18 nt, Leptospira interrogans serovar lai str. 56601
aaagaaagcagcaaagaa

SEQ ID NO: 757787 - RNA, 19 nt, Leptospira interrogans serovar lai str. 56601
aaagaaagcagcaaagaag

SEQ ID NO: 757788 - RNA, 15 nt, Leptospira interrogans serovar lai str. 56601
cuugucguaaaaaaa

SEQ ID NO: 757789 - RNA, 20 nt, Leptospira interrogans serovar lai str. 56601
cuugucguaaaaaaauaaga

SEQ ID NO: 757790 - RNA, 20 nt, Leptospira interrogans serovar lai str. 56601
cuugucggaacacuugaaaa

SEQ ID NO: 757791 - RNA, 19 nt, Leptospira interrogans serovar lai str. 56601
cuugugcaauaauuuuuug

SEQ ID NO: 757792 - RNA, 16 nt, Leptospira interrogans serovar lai str. 56601
cuuguuaaaauaaaaa

SEQ ID NO: 757793 - RNA, 21 nt, Leptospira interrogans serovar lai str. 56601
cuuguuaaaauaaaaaaauug

SEQ ID NO: 757794 - RNA, 17 nt, Leptospira interrogans serovar lai str. 56601
cuugugucaagcccucc

SEQ ID NO: 757795 - RNA, 18 nt, Leptospira interrogans serovar lai str. 56601
cuugugucaagcccuccc

SEQ ID NO: 757796 - RNA, 18 nt, Leptospira interrogans serovar lai str. 56601
cuugugucaagcccuccu

SEQ ID NO: 757797 - RNA, 16 nt, Leptospira interrogans serovar lai str. 56601
cuuguuauuaaaaucu

SEQ ID NO: 757798 - RNA, 19 nt, Leptospira interrogans serovar lai str. 56601
cuuuaaaguugguuuuguu

SEQ ID NO: 757799 - RNA, 13 nt, Leptospira interrogans serovar lai str. 56601
cuuuaaauacuuu

SEQ ID NO: 757800 - RNA, 15 nt, Leptospira interrogans serovar lai str. 56601
cuuuaaaauacuuua

SEQ ID NO: 757801 - RNA, 12 nt, Leptospira interrogans serovar lai str. 56601
cuuuaaaauugu

SEQ ID NO: 757802 - RNA, 24 nt, Leptospira interrogans serovar lai str. 56601
cuuuaaaauuugugauaucucauu

SEQ ID NO: 757803 - RNA, 15 nt, Leptospira interrogans serovar lai str. 56601
cuuuaaaauuuuuaa

SEQ ID NO: 757804 - RNA, 13 nt, Leptospira interrogans serovar lai str. 56601
cuuuaaaagagcg

SEQ ID NO: 757805 - RNA, 17 nt, Leptospira interrogans serovar lai str. 56601
cuuuaaaaauaggaauu

SEQ ID NO: 757806 - RNA, 15 nt, Leptospira interrogans serovar lai str. 56601
cuuuaaaaaauaaga

SEQ ID NO: 757807 - RNA, 13 nt, Leptospira interrogans serovar lai str. 56601
cuuuaaaaaauaa

SEQ ID NO: 757808 - RNA, 12 nt, Leptospira interrogans serovar lai str. 56601
aaagaacugccu

SEQ ID NO: 757809 - RNA, 18 nt, Leptospira interrogans serovar lai str. 56601
aaagaaccgguucagcua

SEQ ID NO: 757810 - RNA, 12 nt, Leptospira interrogans serovar lai str. 56601
aaagaagaaaua

SEQ ID NO: 757811 - RNA, 17 nt, Leptospira interrogans serovar lai str. 56601
aaagaacguuuugcuaa

SEQ ID NO: 757812 - RNA, 19 nt, Leptospira interrogans serovar lai str. 56601
aaagaagaugcuuucucuu

SEQ ID NO: 757813 - RNA, 18 nt, Leptospira interrogans serovar lai str. 56601
aaagaacaagauuaacaa

SEQ ID NO: 757814 - RNA, 15 nt, Leptospira interrogans serovar lai str. 56601
aaagaaauauuaaaa

SEQ ID NO: 757815 - RNA, 19 nt, Leptospira interrogans serovar lai str. 56601
aaagaaauauuaaaaaaau

SEQ ID NO: 757816 - RNA, 11 nt, Leptospira interrogans serovar lai str. 56601
aaagaaauuuu

SEQ ID NO: 757817 - RNA, 20 nt, Leptospira interrogans serovar lai str. 56601
cuuuuuaaguaauauuucuc

SEQ ID NO: 757818 - RNA, 15 nt, Leptospira interrogans serovar lai str. 56601
cuuuuguaauaaaaa

SEQ ID NO: 757819 - RNA, 17 nt, Leptospira interrogans serovar lai str. 56601
cuuuuuauaaaaagcug

SEQ ID NO: 757820 - RNA, 21 nt, Leptospira interrogans serovar lai str. 56601
cuuuuuagacuggcuucgagu

SEQ ID NO: 757821 - RNA, 19 nt, Leptospira interrogans serovar lai str. 56601
cuuuuaucgaauggaauuu

SEQ ID NO: 757822 - RNA, 19 nt, Leptospira interrogans serovar lai str. 56601
cuuuugaccaaaagagguc

SEQ ID NO: 757823 - RNA, 18 nt, Leptospira interrogans serovar lai str. 56601
cuuuugcuucuuuuaaac

SEQ ID NO: 757824 - RNA, 14 nt, Leptospira interrogans serovar lai str. 56601
cuuuugcuuuuaaa

SEQ ID NO: 757825 - RNA, 15 nt, Leptospira interrogans serovar lai str. 56601
cuuuugcuuuuaaag

SEQ ID NO: 757826 - RNA, 16 nt, Leptospira interrogans serovar lai str. 56601
cuuuugaucuuuaaaa

SEQ ID NO: 757827 - RNA, 18 nt, Leptospira interrogans serovar lai str. 56601
cuuuuaguuguacaaaaa

SEQ ID NO: 757828 - RNA, 19 nt, Leptospira interrogans serovar lai str. 56601
cuuuuaguuguacaaaaau

SEQ ID NO: 757829 - RNA, 14 nt, Leptospira interrogans serovar lai str. 56601
cuuuuauaaaaucu

SEQ ID NO: 757830 - RNA, 23 nt, Leptospira interrogans serovar lai str. 56601
cuuuuauaauucaagacuuuaua

SEQ ID NO: 757831 - RNA, 15 nt, Leptospira interrogans serovar lai str. 56601
cuuuuagauaauuau

SEQ ID NO: 757832 - RNA, 11 nt, Leptospira interrogans serovar lai str. 56601
gaaaaagaaac

SEQ ID NO: 757833 - RNA, 17 nt, Leptospira interrogans serovar lai str. 56601
gaaaaacuuuucuaaaa

SEQ ID NO: 757834 - RNA, 12 nt, Leptospira interrogans serovar lai str. 56601
gaaaaaauguaa

SEQ ID NO: 757835 - RNA, 18 nt, Leptospira interrogans serovar lai str. 56601
gaaaaaauuuuucuuaau

SEQ ID NO: 757836 - RNA, 12 nt, Leptospira interrogans serovar lai str. 56601
cuuuuuuuacuu

SEQ ID NO: 757837 - RNA, 12 nt, Leptospira interrogans serovar lai str. 56601
cuuuuuuuaaac

SEQ ID NO: 757838 - RNA, 15 nt, Leptospira interrogans serovar lai str. 56601
cuuuuuuguaaguuu

SEQ ID NO: 757839 - RNA, 14 nt, Leptospira interrogans serovar lai str. 56601
cuuuuuuucauuug

SEQ ID NO: 757840 - RNA, 19 nt, Leptospira interrogans serovar lai str. 56601
gaaaaaagcugaacuuaaa

SEQ ID NO: 757841 - RNA, 16 nt, Leptospira interrogans serovar lai str. 56601
gaaaaaaguuagaauc

SEQ ID NO: 757842 - RNA, 12 nt, Leptospira interrogans serovar lai str. 56601
gaaaaaaguugc

SEQ ID NO: 757843 - RNA, 16 nt, Leptospira interrogans serovar lai str. 56601
gaaaaaaguugcuaag

SEQ ID NO: 757844 - RNA, 21 nt, Leptospira interrogans serovar lai str. 56601
gaaaaaaguuggaauuugaau

SEQ ID NO: 757845 - RNA, 14 nt, Leptospira interrogans serovar lai str. 56601
gaaaaaaguuggga

SEQ ID NO: 757846 - RNA, 14 nt, Leptospira interrogans serovar lai str. 56601
cuuuuuuccuucuu

SEQ ID NO: 757847 - RNA, 18 nt, Leptospira interrogans serovar lai str. 56601
cuuuuugcgauuuugaaa

SEQ ID NO: 757848 - RNA, 18 nt, Leptospira interrogans serovar lai str. 56601
gaaaccuuuauagaauuc

SEQ ID NO: 757849 - RNA, 20 nt, Leptospira interrogans serovar lai str. 56601
gaaaccucggaguauauaau

SEQ ID NO: 757850 - RNA, 17 nt, Leptospira interrogans serovar lai str. 56601
gaaaccuugacaauuua

SEQ ID NO: 757851 - RNA, 14 nt, Leptospira interrogans serovar lai str. 56601
gaaacccaaaaaug

SEQ ID NO: 757852 - RNA, 15 nt, Leptospira interrogans serovar lai str. 56601
gaaacaauucuuccu

SEQ ID NO: 757853 - RNA, 20 nt, Leptospira interrogans serovar lai str. 56601
gaaacaaguuccaaauuacu

SEQ ID NO: 757854 - RNA, 16 nt, Leptospira interrogans serovar lai str. 56601
gaaacaaauggagaau

SEQ ID NO: 757855 - RNA, 17 nt, Leptospira interrogans serovar lai str. 56601
gaaacaucacuuccauu

SEQ ID NO: 757856 - RNA, 22 nt, Leptospira interrogans serovar lai str. 56601
gaaacaucacuuccauuuuuug

SEQ ID NO: 757857 - RNA, 22 nt, Leptospira interrogans serovar lai str. 56601
gaaaagucagguuuuaucaaau

SEQ ID NO: 757858 - RNA, 16 nt, Leptospira interrogans serovar lai str. 56601
gaaaagucgaaagaau

SEQ ID NO: 757859 - RNA, 16 nt, Leptospira interrogans serovar lai str. 56601
gaaaagguuaaaaauu

SEQ ID NO: 757860 - RNA, 15 nt, Leptospira interrogans serovar lai str. 56601
gaaaaaugaaaggua

SEQ ID NO: 757861 - RNA, 20 nt, Leptospira interrogans serovar lai str. 56601
gaaaaauguuaaaaaacuau

SEQ ID NO: 757862 - RNA, 13 nt, Leptospira interrogans serovar lai str. 56601
gaaaaauuccacu

SEQ ID NO: 757863 - RNA, 20 nt, Leptospira interrogans serovar lai str. 56601
gaaaaauuaaaauucuagaa

SEQ ID NO: 757864 - RNA, 15 nt, Leptospira interrogans serovar lai str. 56601
gaaaaauuaauuccu

SEQ ID NO: 757865 - RNA, 21 nt, Leptospira interrogans serovar lai str. 56601
gaaaaaucagguuuuauaaag

SEQ ID NO: 757866 - RNA, 18 nt, Leptospira interrogans serovar lai str. 56601
gaaaaaugaaucaugaau

SEQ ID NO: 757867 - RNA, 14 nt, Leptospira interrogans serovar lai str. 56601
gaaaaaugaauucc

SEQ ID NO: 757868 - RNA, 11 nt, Leptospira interrogans serovar lai str. 56601
gaaaaaugaau

SEQ ID NO: 757869 - RNA, 12 nt, Leptospira interrogans serovar lai str. 56601
gaaaauugaauu

SEQ ID NO: 757870 - RNA, 13 nt, Leptospira interrogans serovar lai str. 56601
gaaaauucaaagg

SEQ ID NO: 757871 - RNA, 13 nt, Leptospira interrogans serovar lai str. 56601
gaaaauuuaaauu

SEQ ID NO: 757872 - RNA, 16 nt, Leptospira interrogans serovar lai str. 56601
gaaaauuuaacaacau

SEQ ID NO: 757873 - RNA, 13 nt, Leptospira interrogans serovar lai str. 56601
gaaaauuugaaaa

SEQ ID NO: 757874 - RNA, 15 nt, Leptospira interrogans serovar lai str. 56601
gaaaauuuuaaguuc

SEQ ID NO: 757875 - RNA, 12 nt, Leptospira interrogans serovar lai str. 56601
gaaaauuuuccc

SEQ ID NO: 757876 - RNA, 14 nt, Leptospira interrogans serovar lai str. 56601
gaaaauuuuccuuu

SEQ ID NO: 757877 - RNA, 15 nt, Leptospira interrogans serovar lai str. 56601
gaaaauuuuccuuua

SEQ ID NO: 757878 - RNA, 15 nt, Leptospira interrogans serovar lai str. 56601
gaaaauuuuuuauuu

SEQ ID NO: 757879 - RNA, 10 nt, Leptospira interrogans serovar lai str. 56601
gaaaauuaga

SEQ ID NO: 757880 - RNA, 21 nt, Leptospira interrogans serovar lai str. 56601
gaaaauuccgaaggaauugca

SEQ ID NO: 757881 - RNA, 14 nt, Leptospira interrogans serovar lai str. 56601
gaaaauaaaaauca

SEQ ID NO: 757882 - RNA, 14 nt, Leptospira interrogans serovar lai str. 56601
gaaagacuuuucau

SEQ ID NO: 757883 - RNA, 18 nt, Leptospira interrogans serovar lai str. 56601
gaaagacuuuucaucauu

SEQ ID NO: 757884 - RNA, 22 nt, Leptospira interrogans serovar lai str. 56601
gaaagaaucuuuuuaaaaguau

SEQ ID NO: 757885 - RNA, 17 nt, Leptospira interrogans serovar lai str. 56601
gaaagaauuuucuaaaa

SEQ ID NO: 757886 - RNA, 13 nt, Leptospira interrogans serovar lai str. 56601
gaaagaauuuuug

SEQ ID NO: 757887 - RNA, 23 nt, Leptospira interrogans serovar lai str. 56601
gaaagaauuuuuggaacgaagaa

SEQ ID NO: 757888 - RNA, 22 nt, Leptospira interrogans serovar lai str. 56601
gaaagaauuuaauaaaaaaaug

SEQ ID NO: 757889 - RNA, 16 nt, Leptospira interrogans serovar lai str. 56601
gaaagaacguuuugcu

SEQ ID NO: 757890 - RNA, 18 nt, Leptospira interrogans serovar lai str. 56601
gaaacggugcauuuaaaa

SEQ ID NO: 757891 - RNA, 18 nt, Leptospira interrogans serovar lai str. 56601
gaaacggccgauugaagc

SEQ ID NO: 757892 - RNA, 14 nt, Leptospira interrogans serovar lai str. 56601
gaaagaaaaagaga

SEQ ID NO: 757893 - RNA, 16 nt, Leptospira interrogans serovar lai str. 56601
gaaagaaaaagagaug

SEQ ID NO: 757894 - RNA, 16 nt, Leptospira interrogans serovar lai str. 56601
gaaacuuuuaauaaaa

SEQ ID NO: 757895 - RNA, 20 nt, Leptospira interrogans serovar lai str. 56601
gaaacguauuuuuacccgau

SEQ ID NO: 757896 - RNA, 20 nt, Leptospira interrogans serovar lai str. 56601
gaaacgaguguuucaugucc

SEQ ID NO: 757897 - RNA, 13 nt, Leptospira interrogans serovar lai str. 56601
gaaacgauacaaa

SEQ ID NO: 757898 - RNA, 20 nt, Leptospira interrogans serovar lai str. 56601
gaaagcgcagacucuucucc

SEQ ID NO: 757899 - RNA, 19 nt, Leptospira interrogans serovar lai str. 56601
gaaaggcggagaaauuaau

SEQ ID NO: 757900 - RNA, 11 nt, Leptospira interrogans serovar lai str. 56601
gaaagugaaag

SEQ ID NO: 757901 - RNA, 18 nt, Leptospira interrogans serovar lai str. 56601
gaaaguucacaaauugca

SEQ ID NO: 757902 - RNA, 20 nt, Leptospira interrogans serovar lai str. 56601
gaaaguucacaaauugcaaa

SEQ ID NO: 757903 - RNA, 15 nt, Leptospira interrogans serovar lai str. 56601
gaaaguguuaguucc

SEQ ID NO: 757904 - RNA, 15 nt, Leptospira interrogans serovar lai str. 56601
gaaaguugcaaagaa

SEQ ID NO: 757905 - RNA, 16 nt, Leptospira interrogans serovar lai str. 56601
gaaaguugcaaagaag

SEQ ID NO: 757906 - RNA, 20 nt, Leptospira interrogans serovar lai str. 56601
gaaaguucuauaaacucaaa

SEQ ID NO: 757907 - RNA, 18 nt, Leptospira interrogans serovar lai str. 56601
gaaagugauccaacaaau

SEQ ID NO: 757908 - RNA, 21 nt, Leptospira interrogans serovar lai str. 56601
gaaagugauccaacaaauuga

SEQ ID NO: 757909 - RNA, 16 nt, Leptospira interrogans serovar lai str. 56601
gaaauaaaaauauaca

SEQ ID NO: 757910 - RNA, 19 nt, Leptospira interrogans serovar lai str. 56601
gaaaguuuauaaagcaaaa

SEQ ID NO: 757911 - RNA, 14 nt, Leptospira interrogans serovar lai str. 56601
gaaaguuuauaaau

SEQ ID NO: 757912 - RNA, 18 nt, Leptospira interrogans serovar lai str. 56601
gaaaguuuuuuaaaaaau

SEQ ID NO: 757913 - RNA, 18 nt, Leptospira interrogans serovar lai str. 56601
gaaaguuuuuuuauaaaa

SEQ ID NO: 757914 - RNA, 10 nt, Leptospira interrogans serovar lai str. 56601
gaaauaaaaa

SEQ ID NO: 757915 - RNA, 22 nt, Leptospira interrogans serovar lai str. 56601
gaaaguuuacacaacauuauga

SEQ ID NO: 757916 - RNA, 12 nt, Leptospira interrogans serovar lai str. 56601
gaaauauauucu

SEQ ID NO: 757917 - RNA, 21 nt, Leptospira interrogans serovar lai str. 56601
gaaauauauucuuuucugaau

SEQ ID NO: 757918 - RNA, 19 nt, Leptospira interrogans serovar lai str. 56601
gaaaucauauggauuaucc

SEQ ID NO: 757919 - RNA, 17 nt, Leptospira interrogans serovar lai str. 56601
gaacacaugauucugaa

SEQ ID NO: 757920 - RNA, 13 nt, Leptospira interrogans serovar lai str. 56601
gaacacaaauucu

SEQ ID NO: 757921 - RNA, 18 nt, Leptospira interrogans serovar lai str. 56601
gaacaaauccuggacuga

SEQ ID NO: 757922 - RNA, 14 nt, Leptospira interrogans serovar lai str. 56601
gaacaaauucuaaa

SEQ ID NO: 757923 - RNA, 16 nt, Leptospira interrogans serovar lai str. 56601
gaacaaauucuaaacu

SEQ ID NO: 757924 - RNA, 21 nt, Leptospira interrogans serovar lai str. 56601
gaaauuuccacuucaaaaaga

SEQ ID NO: 757925 - RNA, 19 nt, Leptospira interrogans serovar lai str. 56601
gaaauuucuaauaaaauau

SEQ ID NO: 757926 - RNA, 23 nt, Leptospira interrogans serovar lai str. 56601
gaaauugugggaacuauuacaaa

SEQ ID NO: 757927 - RNA, 16 nt, Leptospira interrogans serovar lai str. 56601
gaaauuuaaguuuuuc

SEQ ID NO: 757928 - RNA, 12 nt, Leptospira interrogans serovar lai str. 56601
gaaauuauagua

SEQ ID NO: 757929 - RNA, 19 nt, Leptospira interrogans serovar lai str. 56601
aaagagcguuguguugagu

SEQ ID NO: 757930 - RNA, 18 nt, Leptospira interrogans serovar lai str. 56601
gaaauggauggaaaauga

SEQ ID NO: 757931 - RNA, 16 nt, Leptospira interrogans serovar lai str. 56601
gaaauguaggaacuca

SEQ ID NO: 757932 - RNA, 19 nt, Leptospira interrogans serovar lai str. 56601
gaaauggggcaauugaagc

SEQ ID NO: 757933 - RNA, 15 nt, Leptospira interrogans serovar lai str. 56601
gaaaucuaaauuugu

SEQ ID NO: 757934 - RNA, 24 nt, Leptospira interrogans serovar lai str. 56601
gaaauauuaaaaaaauaauauauu

SEQ ID NO: 757935 - RNA, 11 nt, Leptospira interrogans serovar lai str. 56601
gaaaucugaac

SEQ ID NO: 757936 - RNA, 10 nt, Leptospira interrogans serovar lai str. 56601
gaaaucugac

SEQ ID NO: 757937 - RNA, 13 nt, Leptospira interrogans serovar lai str. 56601
gaaaucugaccuc

SEQ ID NO: 757938 - RNA, 15 nt, Leptospira interrogans serovar lai str. 56601
gaaaucucuaacaaa

SEQ ID NO: 757939 - RNA, 23 nt, Leptospira interrogans serovar lai str. 56601
gaaaucuguuuuaucuuagauca

SEQ ID NO: 757940 - RNA, 19 nt, Leptospira interrogans serovar lai str. 56601
gauauucuauuauauacau

SEQ ID NO: 757941 - RNA, 17 nt, Leptospira interrogans serovar lai str. 56601
gaucaauucugaaaaug

SEQ ID NO: 757942 - RNA, 18 nt, Leptospira interrogans serovar lai str. 56601
gaucaauucugaaaaugu

SEQ ID NO: 757943 - RNA, 22 nt, Leptospira interrogans serovar lai str. 56601
gaucaauucugaaaauguaaaa

SEQ ID NO: 757944 - RNA, 17 nt, Leptospira interrogans serovar lai str. 56601
gaucaauucuuaaaaug

SEQ ID NO: 757945 - RNA, 21 nt, Leptospira interrogans serovar lai str. 56601
gaucaacaaaauuacuucaau

SEQ ID NO: 757946 - RNA, 18 nt, Leptospira interrogans serovar lai str. 56601
gaucaaaucugaaauuca

SEQ ID NO: 757947 - RNA, 12 nt, Leptospira interrogans serovar lai str. 56601
gaucaaaaccau

SEQ ID NO: 757948 - RNA, 17 nt, Leptospira interrogans serovar lai str. 56601
gaucaaaaccauuuuug

SEQ ID NO: 757949 - RNA, 12 nt, Leptospira interrogans serovar lai str. 56601
gauauuuuccuu

SEQ ID NO: 757950 - RNA, 18 nt, Leptospira interrogans serovar lai str. 56601
gauauuuucucauucuac

SEQ ID NO: 757951 - RNA, 17 nt, Leptospira interrogans serovar lai str. 56601
gauauuuauaaugaauu

SEQ ID NO: 757952 - RNA, 20 nt, Leptospira interrogans serovar lai str. 56601
gauauuucuguaaaaaauaa

SEQ ID NO: 757953 - RNA, 17 nt, Leptospira interrogans serovar lai str. 56601
gauauaccaguuaaauu

SEQ ID NO: 757954 - RNA, 16 nt, Leptospira interrogans serovar lai str. 56601
gauaucacaaauuuua

SEQ ID NO: 757955 - RNA, 15 nt, Leptospira interrogans serovar lai str. 56601
gauaccgaaaaagcg

SEQ ID NO: 757956 - RNA, 16 nt, Leptospira interrogans serovar lai str. 56601
gauaccgaaaaagcgu

SEQ ID NO: 757957 - RNA, 23 nt, Leptospira interrogans serovar lai str. 56601
aaagcauaaugucggaucauaau

SEQ ID NO: 757958 - RNA, 20 nt, Leptospira interrogans serovar lai str. 56601
gauaauuuuuacucaaagaa

SEQ ID NO: 757959 - RNA, 21 nt, Leptospira interrogans serovar lai str. 56601
gauaauuuuuacucaaagaau

SEQ ID NO: 757960 - RNA, 23 nt, Leptospira interrogans serovar lai str. 56601
gauaauuuuuguuuguaaaauuu

SEQ ID NO: 757961 - RNA, 13 nt, Leptospira interrogans serovar lai str. 56601
gauaauuuuuuaa

SEQ ID NO: 757962 - RNA, 14 nt, Leptospira interrogans serovar lai str. 56601
gauaauuuucuuua

SEQ ID NO: 757963 - RNA, 21 nt, Leptospira interrogans serovar lai str. 56601
gauaauuucauuauuagaguu

SEQ ID NO: 757964 - RNA, 13 nt, Leptospira interrogans serovar lai str. 56601
gauaauuucuagu

SEQ ID NO: 757965 - RNA, 15 nt, Leptospira interrogans serovar lai str. 56601
gauaauucuuuagaa

SEQ ID NO: 757966 - RNA, 16 nt, Leptospira interrogans serovar lai str. 56601
gauaaggcuaaagaau

SEQ ID NO: 757967 - RNA, 20 nt, Leptospira interrogans serovar lai str. 56601
gauaauaauuagaaaaauau

SEQ ID NO: 757968 - RNA, 13 nt, Leptospira interrogans serovar lai str. 56601
gauaaguuuucua

SEQ ID NO: 757969 - RNA, 19 nt, Leptospira interrogans serovar lai str. 56601
gauaaguuuucuaguaaaa

SEQ ID NO: 757970 - RNA, 21 nt, Leptospira interrogans serovar lai str. 56601
gauaaguuuucuaguaaaaau

SEQ ID NO: 757971 - RNA, 13 nt, Leptospira interrogans serovar lai str. 56601
gaguuuuuccuau

SEQ ID NO: 757972 - RNA, 15 nt, Leptospira interrogans serovar lai str. 56601
gaguuuuuuaaaauu

SEQ ID NO: 757973 - RNA, 18 nt, Leptospira interrogans serovar lai str. 56601
gauaaaaaagaaagcaaa

SEQ ID NO: 757974 - RNA, 23 nt, Leptospira interrogans serovar lai str. 56601
gauaaaaagucugucuuaaaauu

SEQ ID NO: 757975 - RNA, 14 nt, Leptospira interrogans serovar lai str. 56601
gauaaaaauaguau

SEQ ID NO: 757976 - RNA, 17 nt, Leptospira interrogans serovar lai str. 56601
gauaaaucgcaaauaca

SEQ ID NO: 757977 - RNA, 13 nt, Leptospira interrogans serovar lai str. 56601
gauaaauuagaaa

SEQ ID NO: 757978 - RNA, 17 nt, Leptospira interrogans serovar lai str. 56601
gauaaagguaaaagaga

SEQ ID NO: 757979 - RNA, 16 nt, Leptospira interrogans serovar lai str. 56601
gaguuauugaaaaauu

SEQ ID NO: 757980 - RNA, 18 nt, Leptospira interrogans serovar lai str. 56601
gaguuauugaaaaauuuc

SEQ ID NO: 757981 - RNA, 16 nt, Leptospira interrogans serovar lai str. 56601
gaguucacuucuugaa

SEQ ID NO: 757982 - RNA, 23 nt, Leptospira interrogans serovar lai str. 56601
gaguuacuacaauuuuagaauuu

SEQ ID NO: 757983 - RNA, 21 nt, Leptospira interrogans serovar lai str. 56601
gaguuauaguaaaagaaaauu

SEQ ID NO: 757984 - RNA, 22 nt, Leptospira interrogans serovar lai str. 56601
gaguuauaguaaaagaaaauua

SEQ ID NO: 757985 - RNA, 12 nt, Leptospira interrogans serovar lai str. 56601
gaguucauucug

SEQ ID NO: 757986 - RNA, 16 nt, Leptospira interrogans serovar lai str. 56601
gaguuccgaaaauuug

SEQ ID NO: 757987 - RNA, 15 nt, Leptospira interrogans serovar lai str. 56601
gaguucccacauuua

SEQ ID NO: 757988 - RNA, 15 nt, Leptospira interrogans serovar lai str. 56601
gaguaguagaaaaug

SEQ ID NO: 757989 - RNA, 16 nt, Leptospira interrogans serovar lai str. 56601
gaguaguagaaaaugu

SEQ ID NO: 757990 - RNA, 16 nt, Leptospira interrogans serovar lai str. 56601
gagugccaaaauuuug

SEQ ID NO: 757991 - RNA, 17 nt, Leptospira interrogans serovar lai str. 56601
gagucugucccaaaauc

SEQ ID NO: 757992 - RNA, 13 nt, Leptospira interrogans serovar lai str. 56601
gagucuagaauuc

SEQ ID NO: 757993 - RNA, 14 nt, Leptospira interrogans serovar lai str. 56601
gagucuauaaaaua

SEQ ID NO: 757994 - RNA, 21 nt, Leptospira interrogans serovar lai str. 56601
gagucauuuuuaaauacuuuu

SEQ ID NO: 757995 - RNA, 22 nt, Leptospira interrogans serovar lai str. 56601
gagcuuuacaauaaaaauuaga

SEQ ID NO: 757996 - RNA, 22 nt, Leptospira interrogans serovar lai str. 56601
gagcuugucccaaaaacucaaa

SEQ ID NO: 757997 - RNA, 17 nt, Leptospira interrogans serovar lai str. 56601
gagccuuuuuauuucua

SEQ ID NO: 757998 - RNA, 14 nt, Leptospira interrogans serovar lai str. 56601
gaggaauagucaau

SEQ ID NO: 757999 - RNA, 15 nt, Leptospira interrogans serovar lai str. 56601
gaggaauuuuuaaaa

SEQ ID NO: 758000 - RNA, 12 nt, Leptospira interrogans serovar lai str. 56601
gagcauaaaaaa

SEQ ID NO: 758001 - RNA, 21 nt, Leptospira interrogans serovar lai str. 56601
gagccaucuuuuuuugccuuu

SEQ ID NO: 758002 - RNA, 18 nt, Leptospira interrogans serovar lai str. 56601
gagccuuucacaucucca

SEQ ID NO: 758003 - RNA, 13 nt, Leptospira interrogans serovar lai str. 56601
gagcaguaaaaaa

SEQ ID NO: 758004 - RNA, 14 nt, Leptospira interrogans serovar lai str. 56601
aaagcagcaaagaa

SEQ ID NO: 758005 - RNA, 15 nt, Leptospira interrogans serovar lai str. 56601
gagcacagcaaaaaa

SEQ ID NO: 758006 - RNA, 14 nt, Leptospira interrogans serovar lai str. 56601
gagauaaaaaagga

SEQ ID NO: 758007 - RNA, 18 nt, Leptospira interrogans serovar lai str. 56601
gagauagaaccuauaucu

SEQ ID NO: 758008 - RNA, 21 nt, Leptospira interrogans serovar lai str. 56601
gagauagguuuuguaagaauu

SEQ ID NO: 758009 - RNA, 18 nt, Leptospira interrogans serovar lai str. 56601
gagauaucacaaauuuua

SEQ ID NO: 758010 - RNA, 18 nt, Leptospira interrogans serovar lai str. 56601
gagacucuaguaaagaaa

SEQ ID NO: 758011 - RNA, 20 nt, Leptospira interrogans serovar lai str. 56601
gagacucuaguaaagaaacu

SEQ ID NO: 758012 - RNA, 21 nt, Leptospira interrogans serovar lai str. 56601
gagagaagccuauauuuugau

SEQ ID NO: 758013 - RNA, 15 nt, Leptospira interrogans serovar lai str. 56601
gagaaguuaaaaaau

SEQ ID NO: 758014 - RNA, 22 nt, Leptospira interrogans serovar lai str. 56601
gagaccgguagcgguaaaagaa

SEQ ID NO: 758015 - RNA, 18 nt, Leptospira interrogans serovar lai str. 56601
gagacauugaagaaaaaa

SEQ ID NO: 758016 - RNA, 15 nt, Leptospira interrogans serovar lai str. 56601
gagacaguauuuucc

SEQ ID NO: 758017 - RNA, 18 nt, Leptospira interrogans serovar lai str. 56601
gagacaagaagaaaagaa

SEQ ID NO: 758018 - RNA, 16 nt, Leptospira interrogans serovar lai str. 56601
gagaauuaauuuuuua

SEQ ID NO: 758019 - RNA, 17 nt, Leptospira interrogans serovar lai str. 56601
gagaauucauuuuucua

SEQ ID NO: 758020 - RNA, 16 nt, Leptospira interrogans serovar lai str. 56601
aaagcaaacuuuuuau

SEQ ID NO: 758021 - RNA, 13 nt, Leptospira interrogans serovar lai str. 56601
aaagcaagaaaau

SEQ ID NO: 758022 - RNA, 19 nt, Leptospira interrogans serovar lai str. 56601
gagaaagcgcagacucuuc

SEQ ID NO: 758023 - RNA, 18 nt, Leptospira interrogans serovar lai str. 56601
gagaaaggcggagaaauu

SEQ ID NO: 758024 - RNA, 15 nt, Leptospira interrogans serovar lai str. 56601
gagaaagaaaaagag

SEQ ID NO: 758025 - RNA, 15 nt, Leptospira interrogans serovar lai str. 56601
aaagauuuguuuuau

SEQ ID NO: 758026 - RNA, 12 nt, Leptospira interrogans serovar lai str. 56601
aaagauuuuaaa

SEQ ID NO: 758027 - RNA, 15 nt, Leptospira interrogans serovar lai str. 56601
aaagauuuuaaaaau

SEQ ID NO: 758028 - RNA, 19 nt, Leptospira interrogans serovar lai str. 56601
gagaaaucuguuuuaucuu

SEQ ID NO: 758029 - RNA, 18 nt, Leptospira interrogans serovar lai str. 56601
aaagauuuccuaauaacu

SEQ ID NO: 758030 - RNA, 16 nt, Leptospira interrogans serovar lai str. 56601
gacuuaagaaauagau

SEQ ID NO: 758031 - RNA, 13 nt, Leptospira interrogans serovar lai str. 56601
gacuguuuuaauu

SEQ ID NO: 758032 - RNA, 17 nt, Leptospira interrogans serovar lai str. 56601
gacuuggaguucuuacu

SEQ ID NO: 758033 - RNA, 19 nt, Leptospira interrogans serovar lai str. 56601
gacuugaaaaagcggucuu

SEQ ID NO: 758034 - RNA, 20 nt, Leptospira interrogans serovar lai str. 56601
gacuucuuaaguagauaaau

SEQ ID NO: 758035 - RNA, 12 nt, Leptospira interrogans serovar lai str. 56601
gacuuuaaauga

SEQ ID NO: 758036 - RNA, 21 nt, Leptospira interrogans serovar lai str. 56601
gacuuuaauuuuaguaaaaau

SEQ ID NO: 758037 - RNA, 23 nt, Leptospira interrogans serovar lai str. 56601
gacuuuaauuuuaguaaaaauca

SEQ ID NO: 758038 - RNA, 19 nt, Leptospira interrogans serovar lai str. 56601
gacuuuauucaaaauagaa

SEQ ID NO: 758039 - RNA, 20 nt, Leptospira interrogans serovar lai str. 56601
gacuuuauucaaaauagaau

SEQ ID NO: 758040 - RNA, 20 nt, Leptospira interrogans serovar lai str. 56601
gacuuugaaacaucacuucc

SEQ ID NO: 758041 - RNA, 24 nt, Leptospira interrogans serovar lai str. 56601
gacuggcuucgagucgcgugccuu

SEQ ID NO: 758042 - RNA, 17 nt, Leptospira interrogans serovar lai str. 56601
gacugcccguuucaauu

SEQ ID NO: 758043 - RNA, 16 nt, Leptospira interrogans serovar lai str. 56601
gacugauucuuuaaau

SEQ ID NO: 758044 - RNA, 23 nt, Leptospira interrogans serovar lai str. 56601
gacguuucuucggauucacaaac

SEQ ID NO: 758045 - RNA, 13 nt, Leptospira interrogans serovar lai str. 56601
gacguuugaaaau

SEQ ID NO: 758046 - RNA, 20 nt, Leptospira interrogans serovar lai str. 56601
gacucuaguaaagaaacucg

SEQ ID NO: 758047 - RNA, 13 nt, Leptospira interrogans serovar lai str. 56601
gacguaaaaauau

SEQ ID NO: 758048 - RNA, 18 nt, Leptospira interrogans serovar lai str. 56601
gacguaaaggaauccaug

SEQ ID NO: 758049 - RNA, 21 nt, Leptospira interrogans serovar lai str. 56601
gacguaaaggaauccaugauu

SEQ ID NO: 758050 - RNA, 14 nt, Leptospira interrogans serovar lai str. 56601
gacgauuuucuccu

SEQ ID NO: 758051 - RNA, 19 nt, Leptospira interrogans serovar lai str. 56601
gaccucuauaauuaauaaa

SEQ ID NO: 758052 - RNA, 21 nt, Leptospira interrogans serovar lai str. 56601
gaccucuauccacuaaaauac

SEQ ID NO: 758053 - RNA, 13 nt, Leptospira interrogans serovar lai str. 56601
gaccucaaauaac

SEQ ID NO: 758054 - RNA, 15 nt, Leptospira interrogans serovar lai str. 56601
gacccaagauuuuuc

SEQ ID NO: 758055 - RNA, 14 nt, Leptospira interrogans serovar lai str. 56601
gaccauuuuccuuc

SEQ ID NO: 758056 - RNA, 15 nt, Leptospira interrogans serovar lai str. 56601
gacccuuagaaagug

SEQ ID NO: 758057 - RNA, 10 nt, Leptospira interrogans serovar lai str. 56601
gaccagagcu

SEQ ID NO: 758058 - RNA, 19 nt, Leptospira interrogans serovar lai str. 56601
gacauaaaaaaauuaaaaa

SEQ ID NO: 758059 - RNA, 23 nt, Leptospira interrogans serovar lai str. 56601
gacauaaaaaaauuaaaaaagag

SEQ ID NO: 758060 - RNA, 23 nt, Leptospira interrogans serovar lai str. 56601
gacaccguugcuauaaaaaggau

SEQ ID NO: 758061 - RNA, 17 nt, Leptospira interrogans serovar lai str. 56601
gacacucuaauguacaa

SEQ ID NO: 758062 - RNA, 22 nt, Leptospira interrogans serovar lai str. 56601
gacacugaaaacauuuugccuu

SEQ ID NO: 758063 - RNA, 20 nt, Leptospira interrogans serovar lai str. 56601
gaauggaaaucuuuuaaaaa

SEQ ID NO: 758064 - RNA, 23 nt, Leptospira interrogans serovar lai str. 56601
gaauuccgacccagaaaaaaccu

SEQ ID NO: 758065 - RNA, 21 nt, Leptospira interrogans serovar lai str. 56601
gaauucauuuaccuaaaauuc

SEQ ID NO: 758066 - RNA, 22 nt, Leptospira interrogans serovar lai str. 56601
gaauucauacuuuuaaaaaguu

SEQ ID NO: 758067 - RNA, 17 nt, Leptospira interrogans serovar lai str. 56601
gaauucacguuaaaaua

SEQ ID NO: 758068 - RNA, 14 nt, Leptospira interrogans serovar lai str. 56601
gaauucagaaaaaa

SEQ ID NO: 758069 - RNA, 16 nt, Leptospira interrogans serovar lai str. 56601
gaauucaauuuauaaa

SEQ ID NO: 758070 - RNA, 19 nt, Leptospira interrogans serovar lai str. 56601
gaauucaauuuauaaacgg

SEQ ID NO: 758071 - RNA, 21 nt, Leptospira interrogans serovar lai str. 56601
gaauuuguguuguauguggua

SEQ ID NO: 758072 - RNA, 18 nt, Leptospira interrogans serovar lai str. 56601
gaauuuguucuuaaaauu

SEQ ID NO: 758073 - RNA, 20 nt, Leptospira interrogans serovar lai str. 56601
gaauuuuaguucucucgaaa

SEQ ID NO: 758074 - RNA, 18 nt, Leptospira interrogans serovar lai str. 56601
gaauuuguaauucuucaa

SEQ ID NO: 758075 - RNA, 11 nt, Leptospira interrogans serovar lai str. 56601
gaauuuuauag

SEQ ID NO: 758076 - RNA, 16 nt, Leptospira interrogans serovar lai str. 56601
gaauuuguuuguaaaa

SEQ ID NO: 758077 - RNA, 18 nt, Leptospira interrogans serovar lai str. 56601
gaauuuguuuguaaaaua

SEQ ID NO: 758078 - RNA, 20 nt, Leptospira interrogans serovar lai str. 56601
gaauuuguuugucuuuuucu

SEQ ID NO: 758079 - RNA, 14 nt, Leptospira interrogans serovar lai str. 56601
gaauuuguuuuucu

SEQ ID NO: 758080 - RNA, 12 nt, Leptospira interrogans serovar lai str. 56601
gaauuuuaaaaa

SEQ ID NO: 758081 - RNA, 13 nt, Leptospira interrogans serovar lai str. 56601
gaauuuuaaauau

SEQ ID NO: 758082 - RNA, 15 nt, Leptospira interrogans serovar lai str. 56601
gaauuuuaagaucua

SEQ ID NO: 758083 - RNA, 19 nt, Leptospira interrogans serovar lai str. 56601
gaauuuggcgguuaaaauc

SEQ ID NO: 758084 - RNA, 15 nt, Leptospira interrogans serovar lai str. 56601
gaauuugcaguaaaa

SEQ ID NO: 758085 - RNA, 17 nt, Leptospira interrogans serovar lai str. 56601
gaauuugcaguaaaagg

SEQ ID NO: 758086 - RNA, 9 nt, Leptospira interrogans serovar lai str. 56601
gaauuucua

SEQ ID NO: 758087 - RNA, 13 nt, Leptospira interrogans serovar lai str. 56601
gaauucuaaaauu

SEQ ID NO: 758088 - RNA, 20 nt, Leptospira interrogans serovar lai str. 56601
gaauucucuaucuuguuucu

SEQ ID NO: 758089 - RNA, 11 nt, Leptospira interrogans serovar lai str. 56601
gaauucuuccu

SEQ ID NO: 758090 - RNA, 19 nt, Leptospira interrogans serovar lai str. 56601
gaauucuuccuucuugaaa

SEQ ID NO: 758091 - RNA, 14 nt, Leptospira interrogans serovar lai str. 56601
gaauuuccauuucu

SEQ ID NO: 758092 - RNA, 16 nt, Leptospira interrogans serovar lai str. 56601
gaauuuccaaacucaa

SEQ ID NO: 758093 - RNA, 17 nt, Leptospira interrogans serovar lai str. 56601
gaauuuccaaacucaau

SEQ ID NO: 758094 - RNA, 22 nt, Leptospira interrogans serovar lai str. 56601
gaauuccaucguuuauuuuucu

SEQ ID NO: 758095 - RNA, 19 nt, Leptospira interrogans serovar lai str. 56601
gaauucuccaauagaauug

SEQ ID NO: 758096 - RNA, 24 nt, Leptospira interrogans serovar lai str. 56601
gacaacagaacaaaauuuacgaaa

SEQ ID NO: 758097 - RNA, 11 nt, Leptospira interrogans serovar lai str. 56601
gaauuuucauc

SEQ ID NO: 758098 - RNA, 22 nt, Leptospira interrogans serovar lai str. 56601
gaauuuugaacauuuucauaua

SEQ ID NO: 758099 - RNA, 20 nt, Leptospira interrogans serovar lai str. 56601
gaauuuucgcuacaaucgcu

SEQ ID NO: 758100 - RNA, 14 nt, Leptospira interrogans serovar lai str. 56601
gacaagaagaaaag

SEQ ID NO: 758101 - RNA, 15 nt, Leptospira interrogans serovar lai str. 56601
gacaacuuauaauuu

SEQ ID NO: 758102 - RNA, 17 nt, Leptospira interrogans serovar lai str. 56601
gacaacuuauaauuuuc

SEQ ID NO: 758103 - RNA, 21 nt, Leptospira interrogans serovar lai str. 56601
gacaaucguaggcacguggaa

SEQ ID NO: 758104 - RNA, 16 nt, Leptospira interrogans serovar lai str. 56601
gaauccgaaaaaccuu

SEQ ID NO: 758105 - RNA, 15 nt, Leptospira interrogans serovar lai str. 56601
gaaucagaaugaacu

SEQ ID NO: 758106 - RNA, 21 nt, Leptospira interrogans serovar lai str. 56601
gaauccuauaauaaaauuaac

SEQ ID NO: 758107 - RNA, 17 nt, Leptospira interrogans serovar lai str. 56601
gaaucucuuuuucucuu

SEQ ID NO: 758108 - RNA, 19 nt, Leptospira interrogans serovar lai str. 56601
gaaucucuuuuucucuuug

SEQ ID NO: 758109 - RNA, 14 nt, Leptospira interrogans serovar lai str. 56601
gaaucugaaccugc

SEQ ID NO: 758110 - RNA, 19 nt, Leptospira interrogans serovar lai str. 56601
gaaucuauuuuugauuuua

SEQ ID NO: 758111 - RNA, 14 nt, Leptospira interrogans serovar lai str. 56601
gaauaggaucagaa

SEQ ID NO: 758112 - RNA, 23 nt, Leptospira interrogans serovar lai str. 56601
gaauaggauuuuagaaucaaaau

SEQ ID NO: 758113 - RNA, 16 nt, Leptospira interrogans serovar lai str. 56601
aaagaucugaguuuac

SEQ ID NO: 758114 - RNA, 20 nt, Leptospira interrogans serovar lai str. 56601
gaauagucaaugguugcaaa

SEQ ID NO: 758115 - RNA, 19 nt, Leptospira interrogans serovar lai str. 56601
gaauauagcacaaaugaca

SEQ ID NO: 758116 - RNA, 17 nt, Leptospira interrogans serovar lai str. 56601
gaauauaauaaaauuau

SEQ ID NO: 758117 - RNA, 17 nt, Leptospira interrogans serovar lai str. 56601
gaauauaacuuuuucag

SEQ ID NO: 758118 - RNA, 21 nt, Leptospira interrogans serovar lai str. 56601
gaauauaagaaaguauuaauu

SEQ ID NO: 758119 - RNA, 15 nt, Leptospira interrogans serovar lai str. 56601
gaauauaagauuaug

SEQ ID NO: 758120 - RNA, 13 nt, Leptospira interrogans serovar lai str. 56601
gaauaguuuacau

SEQ ID NO: 758121 - RNA, 16 nt, Leptospira interrogans serovar lai str. 56601
gaauaguuuacauauc

SEQ ID NO: 758122 - RNA, 19 nt, Leptospira interrogans serovar lai str. 56601
gaauaguuuacauaucaau

SEQ ID NO: 758123 - RNA, 14 nt, Leptospira interrogans serovar lai str. 56601
gaauauaaaauuuu

SEQ ID NO: 758124 - RNA, 19 nt, Leptospira interrogans serovar lai str. 56601
gaauaucauaacaaauaaa

SEQ ID NO: 758125 - RNA, 18 nt, Leptospira interrogans serovar lai str. 56601
gaauauugagcuaauucu

SEQ ID NO: 758126 - RNA, 23 nt, Leptospira interrogans serovar lai str. 56601
gaauauuauuauauuuaaauguu

SEQ ID NO: 758127 - RNA, 13 nt, Leptospira interrogans serovar lai str. 56601
gaauauuccauuu

SEQ ID NO: 758128 - RNA, 19 nt, Leptospira interrogans serovar lai str. 56601
gaauauucguaagaaaaaa

SEQ ID NO: 758129 - RNA, 23 nt, Leptospira interrogans serovar lai str. 56601
gaauauuaaguuuuuuaaauuua

SEQ ID NO: 758130 - RNA, 20 nt, Leptospira interrogans serovar lai str. 56601
gaaguggguuguuaugcaaa

SEQ ID NO: 758131 - RNA, 15 nt, Leptospira interrogans serovar lai str. 56601
gaaguaguuccuaca

SEQ ID NO: 758132 - RNA, 11 nt, Leptospira interrogans serovar lai str. 56601
gaagguugagc

SEQ ID NO: 758133 - RNA, 15 nt, Leptospira interrogans serovar lai str. 56601
gaagguugagcagua

SEQ ID NO: 758134 - RNA, 14 nt, Leptospira interrogans serovar lai str. 56601
gaauacgauuuaau

SEQ ID NO: 758135 - RNA, 15 nt, Leptospira interrogans serovar lai str. 56601
gaauacgauagauuc

SEQ ID NO: 758136 - RNA, 18 nt, Leptospira interrogans serovar lai str. 56601
gaauaaauaaugaaaacu

SEQ ID NO: 758137 - RNA, 22 nt, Leptospira interrogans serovar lai str. 56601
gaauaaauacauacaaugaaaa

SEQ ID NO: 758138 - RNA, 20 nt, Leptospira interrogans serovar lai str. 56601
aaagauagaaguuuauaaua

SEQ ID NO: 758139 - RNA, 17 nt, Leptospira interrogans serovar lai str. 56601
gaaguuaagaagauaaa

SEQ ID NO: 758140 - RNA, 17 nt, Leptospira interrogans serovar lai str. 56601
gaaguguuugcugaguu

SEQ ID NO: 758141 - RNA, 23 nt, Leptospira interrogans serovar lai str. 56601
gaaguuguauccccauaaacaaa

SEQ ID NO: 758142 - RNA, 13 nt, Leptospira interrogans serovar lai str. 56601
gaagauuuuucuu

SEQ ID NO: 758143 - RNA, 13 nt, Leptospira interrogans serovar lai str. 56601
gaagcaguuuugc

SEQ ID NO: 758144 - RNA, 18 nt, Leptospira interrogans serovar lai str. 56601
gaagccaaugugccuucg

SEQ ID NO: 758145 - RNA, 22 nt, Leptospira interrogans serovar lai str. 56601
gaagccaaugugccuucguuua

SEQ ID NO: 758146 - RNA, 15 nt, Leptospira interrogans serovar lai str. 56601
gaagcuaaaauugaa

SEQ ID NO: 758147 - RNA, 14 nt, Leptospira interrogans serovar lai str. 56601
gaagcgagagacgc

SEQ ID NO: 758148 - RNA, 20 nt, Leptospira interrogans serovar lai str. 56601
gaagcgagagacgcugaguu

SEQ ID NO: 758149 - RNA, 12 nt, Leptospira interrogans serovar lai str. 56601
gaagccuauauu

SEQ ID NO: 758150 - RNA, 14 nt, Leptospira interrogans serovar lai str. 56601
gaagaauuguauuu

SEQ ID NO: 758151 - RNA, 15 nt, Leptospira interrogans serovar lai str. 56601
gaagaugagcaaaau

SEQ ID NO: 758152 - RNA, 18 nt, Leptospira interrogans serovar lai str. 56601
ggcuauuuuacugauuua

SEQ ID NO: 758153 - RNA, 17 nt, Leptospira interrogans serovar lai str. 56601
ggcgugagcggaaggaa

SEQ ID NO: 758154 - RNA, 17 nt, Leptospira interrogans serovar lai str. 56601
aaauacacggagauaaa

SEQ ID NO: 758155 - RNA, 21 nt, Leptospira interrogans serovar lai str. 56601
aaauacacggagauaaaaaag

SEQ ID NO: 758156 - RNA, 14 nt, Leptospira interrogans serovar lai str. 56601
aaauacuaaauuaa

SEQ ID NO: 758157 - RNA, 15 nt, Leptospira interrogans serovar lai str. 56601
aaauacuaaauuaag

SEQ ID NO: 758158 - RNA, 12 nt, Leptospira interrogans serovar lai str. 56601
aaauacuuaaaa

SEQ ID NO: 758159 - RNA, 15 nt, Leptospira interrogans serovar lai str. 56601
aaauacuuaaaaacc

SEQ ID NO: 758160 - RNA, 18 nt, Leptospira interrogans serovar lai str. 56601
aaauacuuagaauuuuuu

SEQ ID NO: 758161 - RNA, 23 nt, Leptospira interrogans serovar lai str. 56601
aaauacuucuccacgauugauuu

SEQ ID NO: 758162 - RNA, 18 nt, Leptospira interrogans serovar lai str. 56601
aaauacuguuaauuuuua

SEQ ID NO: 758163 - RNA, 16 nt, Leptospira interrogans serovar lai str. 56601
aaauacucaauccgaa

SEQ ID NO: 758164 - RNA, 13 nt, Leptospira interrogans serovar lai str. 56601
aaauaaaacuucu

SEQ ID NO: 758165 - RNA, 15 nt, Leptospira interrogans serovar lai str. 56601
aaauaaaauguaaaa

SEQ ID NO: 758166 - RNA, 21 nt, Leptospira interrogans serovar lai str. 56601
aaauaaaauguaaaaacuacc

SEQ ID NO: 758167 - RNA, 15 nt, Leptospira interrogans serovar lai str. 56601
aaauaaaauuuuaua

SEQ ID NO: 758168 - RNA, 17 nt, Leptospira interrogans serovar lai str. 56601
aaauaaauuccccaaaa

SEQ ID NO: 758169 - RNA, 19 nt, Leptospira interrogans serovar lai str. 56601
aaauaaauuccccaaaaug

SEQ ID NO: 758170 - RNA, 13 nt, Leptospira interrogans serovar lai str. 56601
aaauaaaguuuua

SEQ ID NO: 758171 - RNA, 18 nt, Leptospira interrogans serovar lai str. 56601
aaauaaaucaugaucaaa

SEQ ID NO: 758172 - RNA, 20 nt, Leptospira interrogans serovar lai str. 56601
aaauaaaucaugaucaaauu

SEQ ID NO: 758173 - RNA, 15 nt, Leptospira interrogans serovar lai str. 56601
aaauaaagaaaagga

SEQ ID NO: 758174 - RNA, 13 nt, Leptospira interrogans serovar lai str. 56601
aaauaaagaaacu

SEQ ID NO: 758175 - RNA, 12 nt, Leptospira interrogans serovar lai str. 56601
aaauaaagguuu

SEQ ID NO: 758176 - RNA, 13 nt, Leptospira interrogans serovar lai str. 56601
aaauaaagguuuu

SEQ ID NO: 758177 - RNA, 17 nt, Leptospira interrogans serovar lai str. 56601
aaaguuuguaguaacuc

SEQ ID NO: 758178 - RNA, 20 nt, Leptospira interrogans serovar lai str. 56601
aaaguuugggauauucugaa

SEQ ID NO: 758179 - RNA, 23 nt, Leptospira interrogans serovar lai str. 56601
aaaguuugggauauucugaaagu

SEQ ID NO: 758180 - RNA, 21 nt, Leptospira interrogans serovar lai str. 56601
aaaguuugggcgaauaaaaaa

SEQ ID NO: 758181 - RNA, 22 nt, Leptospira interrogans serovar lai str. 56601
aaaguuugggcgaauaaaaaac

SEQ ID NO: 758182 - RNA, 23 nt, Leptospira interrogans serovar lai str. 56601
aaaguuugggcgaauaaaaaacu

SEQ ID NO: 758183 - RNA, 12 nt, Leptospira interrogans serovar lai str. 56601
aaaguuuucuuu

SEQ ID NO: 758184 - RNA, 17 nt, Leptospira interrogans serovar lai str. 56601
aaaguuuuucaacaacu

SEQ ID NO: 758185 - RNA, 19 nt, Leptospira interrogans serovar lai str. 56601
aaaguuuugcuguaaaauu

SEQ ID NO: 758186 - RNA, 14 nt, Leptospira interrogans serovar lai str. 56601
aaaguuuuuaaaaa

SEQ ID NO: 758187 - RNA, 20 nt, Leptospira interrogans serovar lai str. 56601
aaaguuuuuauauucuagaa

SEQ ID NO: 758188 - RNA, 17 nt, Leptospira interrogans serovar lai str. 56601
aaaguuuguuuguaaag

SEQ ID NO: 758189 - RNA, 13 nt, Leptospira interrogans serovar lai str. 56601
aaaguuuucacaa

SEQ ID NO: 758190 - RNA, 18 nt, Leptospira interrogans serovar lai str. 56601
aaaguuuucacaaaaaaa

SEQ ID NO: 758191 - RNA, 14 nt, Leptospira interrogans serovar lai str. 56601
aaaguuuuuuaaaa

SEQ ID NO: 758192 - RNA, 16 nt, Leptospira interrogans serovar lai str. 56601
aaaguuuuuuaaaaaa

SEQ ID NO: 758193 - RNA, 17 nt, Leptospira interrogans serovar lai str. 56601
aaaguuuuuuaaaaaau

SEQ ID NO: 758194 - RNA, 15 nt, Leptospira interrogans serovar lai str. 56601
aaaguuuuuuuauaa

SEQ ID NO: 758195 - RNA, 18 nt, Leptospira interrogans serovar lai str. 56601
aaaguuuuuuuauaaaau

SEQ ID NO: 758196 - RNA, 20 nt, Leptospira interrogans serovar lai str. 56601
aaaguuuuuuuauaaaauua

SEQ ID NO: 758197 - RNA, 13 nt, Leptospira interrogans serovar lai str. 56601
aaauaaaaaacaa

SEQ ID NO: 758198 - RNA, 14 nt, Leptospira interrogans serovar lai str. 56601
aaauaaaaaacaaa

SEQ ID NO: 758199 - RNA, 13 nt, Leptospira interrogans serovar lai str. 56601
aaaguugcuaaga

SEQ ID NO: 758200 - RNA, 14 nt, Leptospira interrogans serovar lai str. 56601
aaaguuggaaucug

SEQ ID NO: 758201 - RNA, 15 nt, Leptospira interrogans serovar lai str. 56601
aaaguuuacacaaca

SEQ ID NO: 758202 - RNA, 15 nt, Leptospira interrogans serovar lai str. 56601
aaaguuuauaaacuu

SEQ ID NO: 758203 - RNA, 23 nt, Leptospira interrogans serovar lai str. 56601
aaaguugucucgaaacccaaaaa

SEQ ID NO: 758204 - RNA, 21 nt, Leptospira interrogans serovar lai str. 56601
aaaguucuuuucuuaaaaaaa

SEQ ID NO: 758205 - RNA, 22 nt, Leptospira interrogans serovar lai str. 56601
aaaguucuuuucuuaaaaaaau

SEQ ID NO: 758206 - RNA, 13 nt, Leptospira interrogans serovar lai str. 56601
aaaguugaaaucu

SEQ ID NO: 758207 - RNA, 20 nt, Leptospira interrogans serovar lai str. 56601
aaaguugagugccuaaauuu

SEQ ID NO: 758208 - RNA, 15 nt, Leptospira interrogans serovar lai str. 56601
aaaguugcaaagaag

SEQ ID NO: 758209 - RNA, 22 nt, Leptospira interrogans serovar lai str. 56601
aaaguugcaaagaagaaauaag

SEQ ID NO: 758210 - RNA, 15 nt, Leptospira interrogans serovar lai str. 56601
aaaguucguaaacua

SEQ ID NO: 758211 - RNA, 19 nt, Leptospira interrogans serovar lai str. 56601
aaaguucagauucgaacuu

SEQ ID NO: 758212 - RNA, 14 nt, Leptospira interrogans serovar lai str. 56601
aaaguuauuucuuu

SEQ ID NO: 758213 - RNA, 21 nt, Leptospira interrogans serovar lai str. 56601
aaaguuagaaucugaacuuua

SEQ ID NO: 758214 - RNA, 13 nt, Leptospira interrogans serovar lai str. 56601
aaaguguuuauaa

SEQ ID NO: 758215 - RNA, 15 nt, Leptospira interrogans serovar lai str. 56601
aaaguguuuuuguaa

SEQ ID NO: 758216 - RNA, 13 nt, Leptospira interrogans serovar lai str. 56601
aaaguguaaacua

SEQ ID NO: 758217 - RNA, 20 nt, Leptospira interrogans serovar lai str. 56601
ggcauuaauauaaaaaauaa

SEQ ID NO: 758218 - RNA, 20 nt, Leptospira interrogans serovar lai str. 56601
ggccaaauuugcgaaaaaaa

SEQ ID NO: 758219 - RNA, 21 nt, Leptospira interrogans serovar lai str. 56601
ggccaaauuugcgaaaaaaau

SEQ ID NO: 758220 - RNA, 22 nt, Leptospira interrogans serovar lai str. 56601
ggccaaauuugcgaaaaaaaua

SEQ ID NO: 758221 - RNA, 17 nt, Leptospira interrogans serovar lai str. 56601
ggcagcuaagaaaaaag

SEQ ID NO: 758222 - RNA, 18 nt, Leptospira interrogans serovar lai str. 56601
ggcauaggaaauaauucc

SEQ ID NO: 758223 - RNA, 16 nt, Leptospira interrogans serovar lai str. 56601
ggcauaagcaaaaaua

SEQ ID NO: 758224 - RNA, 17 nt, Leptospira interrogans serovar lai str. 56601
ggcauaagcaaaaauaa

SEQ ID NO: 758225 - RNA, 18 nt, Leptospira interrogans serovar lai str. 56601
ggcagccaauuccaaacg

SEQ ID NO: 758226 - RNA, 23 nt, Leptospira interrogans serovar lai str. 56601
aaaguauguuuuucugauaaaga

SEQ ID NO: 758227 - RNA, 17 nt, Leptospira interrogans serovar lai str. 56601
ggauugccuaaauuccu

SEQ ID NO: 758228 - RNA, 20 nt, Leptospira interrogans serovar lai str. 56601
ggcaaaauccgaaacguuuu

SEQ ID NO: 758229 - RNA, 23 nt, Leptospira interrogans serovar lai str. 56601
ggauagguuccaauuccauuucu

SEQ ID NO: 758230 - RNA, 16 nt, Leptospira interrogans serovar lai str. 56601
ggaguagauuccuaca

SEQ ID NO: 758231 - RNA, 15 nt, Leptospira interrogans serovar lai str. 56601
ggaguauuuuuuccu

SEQ ID NO: 758232 - RNA, 15 nt, Leptospira interrogans serovar lai str. 56601
ggaggauaaauuaga

SEQ ID NO: 758233 - RNA, 14 nt, Leptospira interrogans serovar lai str. 56601
ggagaguuaugagu

SEQ ID NO: 758234 - RNA, 21 nt, Leptospira interrogans serovar lai str. 56601
ggagcgcuugaaaauucuaag

SEQ ID NO: 758235 - RNA, 12 nt, Leptospira interrogans serovar lai str. 56601
aaaguaaaaaag

SEQ ID NO: 758236 - RNA, 13 nt, Leptospira interrogans serovar lai str. 56601
aaaguaaaauuaa

SEQ ID NO: 758237 - RNA, 12 nt, Leptospira interrogans serovar lai str. 56601
aaaguaaaugga

SEQ ID NO: 758238 - RNA, 15 nt, Leptospira interrogans serovar lai str. 56601
ggagaacuuuacaga

SEQ ID NO: 758239 - RNA, 12 nt, Leptospira interrogans serovar lai str. 56601
ggagaauguuug

SEQ ID NO: 758240 - RNA, 19 nt, Leptospira interrogans serovar lai str. 56601
ggagaauuaauuuuucaau

SEQ ID NO: 758241 - RNA, 21 nt, Leptospira interrogans serovar lai str. 56601
aaagguuggaaucuaaacucu

SEQ ID NO: 758242 - RNA, 14 nt, Leptospira interrogans serovar lai str. 56601
ggacucuauuauga

SEQ ID NO: 758243 - RNA, 23 nt, Leptospira interrogans serovar lai str. 56601
ggacuauuaggaaauacaaaaag

SEQ ID NO: 758244 - RNA, 16 nt, Leptospira interrogans serovar lai str. 56601
aaaggggaucaacaaa

SEQ ID NO: 758245 - RNA, 20 nt, Leptospira interrogans serovar lai str. 56601
aaaggggaucaacaaaauua

SEQ ID NO: 758246 - RNA, 15 nt, Leptospira interrogans serovar lai str. 56601
ggacauuguuucucg

SEQ ID NO: 758247 - RNA, 17 nt, Leptospira interrogans serovar lai str. 56601
ggaaucccaaauucuuu

SEQ ID NO: 758248 - RNA, 16 nt, Leptospira interrogans serovar lai str. 56601
ggaaucgaucuguaaa

SEQ ID NO: 758249 - RNA, 20 nt, Leptospira interrogans serovar lai str. 56601
ggaaucugcaucuuuucuaa

SEQ ID NO: 758250 - RNA, 15 nt, Leptospira interrogans serovar lai str. 56601
ggaaucguuuguaaa

SEQ ID NO: 758251 - RNA, 19 nt, Leptospira interrogans serovar lai str. 56601
ggaauauucguaagaaaaa

SEQ ID NO: 758252 - RNA, 13 nt, Leptospira interrogans serovar lai str. 56601
ggaagccaaaacc

SEQ ID NO: 758253 - RNA, 22 nt, Leptospira interrogans serovar lai str. 56601
ggaagccaaaaccaauuuuuca

SEQ ID NO: 758254 - RNA, 13 nt, Leptospira interrogans serovar lai str. 56601
ggaagauuuuuca

SEQ ID NO: 758255 - RNA, 16 nt, Leptospira interrogans serovar lai str. 56601
ggaacuuuuauaauuc

SEQ ID NO: 758256 - RNA, 11 nt, Leptospira interrogans serovar lai str. 56601
ggaagaacaac

SEQ ID NO: 758257 - RNA, 21 nt, Leptospira interrogans serovar lai str. 56601
ggaaaaguuuucuuuaucaga

SEQ ID NO: 758258 - RNA, 13 nt, Leptospira interrogans serovar lai str. 56601
ggaaacauuauau

SEQ ID NO: 758259 - RNA, 13 nt, Leptospira interrogans serovar lai str. 56601
ggaaaaugaaaac

SEQ ID NO: 758260 - RNA, 22 nt, Leptospira interrogans serovar lai str. 56601
ggaaaauugaauauucacuuuu

SEQ ID NO: 758261 - RNA, 18 nt, Leptospira interrogans serovar lai str. 56601
ggaaagaauacgauuuaa

SEQ ID NO: 758262 - RNA, 14 nt, Leptospira interrogans serovar lai str. 56601
ggaaagaaaaggug

SEQ ID NO: 758263 - RNA, 21 nt, Leptospira interrogans serovar lai str. 56601
ggaaaguuuuuuaaaaaauag

SEQ ID NO: 758264 - RNA, 22 nt, Leptospira interrogans serovar lai str. 56601
ggaaaucuuuuaaaaaagguau

SEQ ID NO: 758265 - RNA, 12 nt, Leptospira interrogans serovar lai str. 56601
gcuuuuaaauug

SEQ ID NO: 758266 - RNA, 14 nt, Leptospira interrogans serovar lai str. 56601
gcuuuguaauaaaa

SEQ ID NO: 758267 - RNA, 19 nt, Leptospira interrogans serovar lai str. 56601
gcuuuguagaauaggaucg

SEQ ID NO: 758268 - RNA, 19 nt, Leptospira interrogans serovar lai str. 56601
gcuuugauuggauucuuuc

SEQ ID NO: 758269 - RNA, 13 nt, Leptospira interrogans serovar lai str. 56601
ggaaaaaauauga

SEQ ID NO: 758270 - RNA, 19 nt, Leptospira interrogans serovar lai str. 56601
ggaaaaaauaugauuuaaa

SEQ ID NO: 758271 - RNA, 15 nt, Leptospira interrogans serovar lai str. 56601
ggaaaaaauccccuu

SEQ ID NO: 758272 - RNA, 20 nt, Leptospira interrogans serovar lai str. 56601
ggaaaaaauccccuuucuaa

SEQ ID NO: 758273 - RNA, 13 nt, Leptospira interrogans serovar lai str. 56601
gcuguaaaauuua

SEQ ID NO: 758274 - RNA, 22 nt, Leptospira interrogans serovar lai str. 56601
gcugaugcauccaaucaugaau

SEQ ID NO: 758275 - RNA, 20 nt, Leptospira interrogans serovar lai str. 56601
gcugaggaguuuuuauaaaa

SEQ ID NO: 758276 - RNA, 13 nt, Leptospira interrogans serovar lai str. 56601
gcugaguuugaaa

SEQ ID NO: 758277 - RNA, 18 nt, Leptospira interrogans serovar lai str. 56601
gcucuuuugcuucuuuua

SEQ ID NO: 758278 - RNA, 12 nt, Leptospira interrogans serovar lai str. 56601
gcugaaaaaaaa

SEQ ID NO: 758279 - RNA, 20 nt, Leptospira interrogans serovar lai str. 56601
gcugaaaaugguuuucuauu

SEQ ID NO: 758280 - RNA, 13 nt, Leptospira interrogans serovar lai str. 56601
gcucugaaguauc

SEQ ID NO: 758281 - RNA, 13 nt, Leptospira interrogans serovar lai str. 56601
gcucuauuuccac

SEQ ID NO: 758282 - RNA, 18 nt, Leptospira interrogans serovar lai str. 56601
gcucuauguaagaaaauc

SEQ ID NO: 758283 - RNA, 13 nt, Leptospira interrogans serovar lai str. 56601
gcucuugaauaaa

SEQ ID NO: 758284 - RNA, 15 nt, Leptospira interrogans serovar lai str. 56601
gcucugugaaacuca

SEQ ID NO: 758285 - RNA, 18 nt, Leptospira interrogans serovar lai str. 56601
gcucuaaaauaauuuuua

SEQ ID NO: 758286 - RNA, 15 nt, Leptospira interrogans serovar lai str. 56601
gcucaauauuuaaaa

SEQ ID NO: 758287 - RNA, 20 nt, Leptospira interrogans serovar lai str. 56601
gcucacuuaugauuuaguaa

SEQ ID NO: 758288 - RNA, 21 nt, Leptospira interrogans serovar lai str. 56601
gcucacuuaugauuuaguaaa

SEQ ID NO: 758289 - RNA, 15 nt, Leptospira interrogans serovar lai str. 56601
gcuccagucaaguua

SEQ ID NO: 758290 - RNA, 17 nt, Leptospira interrogans serovar lai str. 56601
gcuccagcuuuuuuaaa

SEQ ID NO: 758291 - RNA, 23 nt, Leptospira interrogans serovar lai str. 56601
gcucaaaaaggcacauuuuucaa

SEQ ID NO: 758292 - RNA, 15 nt, Leptospira interrogans serovar lai str. 56601
gcuauggaauuuuuc

SEQ ID NO: 758293 - RNA, 19 nt, Leptospira interrogans serovar lai str. 56601
gcuaucuucauuaauuuuu

SEQ ID NO: 758294 - RNA, 22 nt, Leptospira interrogans serovar lai str. 56601
gcuauugaauccuuccuccaaa

SEQ ID NO: 758295 - RNA, 16 nt, Leptospira interrogans serovar lai str. 56601
gcuacuugugagugaa

SEQ ID NO: 758296 - RNA, 20 nt, Leptospira interrogans serovar lai str. 56601
gcuacucgaaaguuuauaaa

SEQ ID NO: 758297 - RNA, 16 nt, Leptospira interrogans serovar lai str. 56601
gcuauaaaaaggaucu

SEQ ID NO: 758298 - RNA, 17 nt, Leptospira interrogans serovar lai str. 56601
gcguucuacaaaauuua

SEQ ID NO: 758299 - RNA, 13 nt, Leptospira interrogans serovar lai str. 56601
gcuaaaaagaaag

SEQ ID NO: 758300 - RNA, 23 nt, Leptospira interrogans serovar lai str. 56601
gcuaaaaagaaaguugcaaagaa

SEQ ID NO: 758301 - RNA, 22 nt, Leptospira interrogans serovar lai str. 56601
gcguuucguucuuuuuuccuuc

SEQ ID NO: 758302 - RNA, 20 nt, Leptospira interrogans serovar lai str. 56601
gcuaauucuuaaaaauuuau

SEQ ID NO: 758303 - RNA, 23 nt, Leptospira interrogans serovar lai str. 56601
gcuaauucuuaaaaauuuauaaa

SEQ ID NO: 758304 - RNA, 19 nt, Leptospira interrogans serovar lai str. 56601
gcuacaaucaauaaauugc

SEQ ID NO: 758305 - RNA, 21 nt, Leptospira interrogans serovar lai str. 56601
gcuaaaauuuuuuuaagaauu

SEQ ID NO: 758306 - RNA, 18 nt, Leptospira interrogans serovar lai str. 56601
gcuaaaauaaaguaucca

SEQ ID NO: 758307 - RNA, 17 nt, Leptospira interrogans serovar lai str. 56601
gcuaaacucauuuuaaa

SEQ ID NO: 758308 - RNA, 22 nt, Leptospira interrogans serovar lai str. 56601
gcuaagucuuuaaaaauaggaa

SEQ ID NO: 758309 - RNA, 15 nt, Leptospira interrogans serovar lai str. 56601
gcuaauacaaaagag

SEQ ID NO: 758310 - RNA, 12 nt, Leptospira interrogans serovar lai str. 56601
gcgucuuugaau

SEQ ID NO: 758311 - RNA, 23 nt, Leptospira interrogans serovar lai str. 56601
gcgucucauuucuugaacucaau

SEQ ID NO: 758312 - RNA, 18 nt, Leptospira interrogans serovar lai str. 56601
gcggaugagcgacucaga

SEQ ID NO: 758313 - RNA, 20 nt, Leptospira interrogans serovar lai str. 56601
gcgcugaguaguaaguuuuu

SEQ ID NO: 758314 - RNA, 21 nt, Leptospira interrogans serovar lai str. 56601
gcgcugaguaguaaguuuuuc

SEQ ID NO: 758315 - RNA, 20 nt, Leptospira interrogans serovar lai str. 56601
gcggcgagacauaaaaaaau

SEQ ID NO: 758316 - RNA, 16 nt, Leptospira interrogans serovar lai str. 56601
gccuucuggaaaaauu

SEQ ID NO: 758317 - RNA, 23 nt, Leptospira interrogans serovar lai str. 56601
gccuucucucgacaaucaaaacu

SEQ ID NO: 758318 - RNA, 16 nt, Leptospira interrogans serovar lai str. 56601
gccugccaaaagaacu

SEQ ID NO: 758319 - RNA, 13 nt, Leptospira interrogans serovar lai str. 56601
gcgacaaaaggau

SEQ ID NO: 758320 - RNA, 21 nt, Leptospira interrogans serovar lai str. 56601
gcgaaucgcucgcgaauuuca

SEQ ID NO: 758321 - RNA, 22 nt, Leptospira interrogans serovar lai str. 56601
gcgaaucgcucgcgaauuucau

SEQ ID NO: 758322 - RNA, 16 nt, Leptospira interrogans serovar lai str. 56601
gcgaccgcgcuugaac

SEQ ID NO: 758323 - RNA, 17 nt, Leptospira interrogans serovar lai str. 56601
gcgaccuuucuaaaaau

SEQ ID NO: 758324 - RNA, 20 nt, Leptospira interrogans serovar lai str. 56601
gcgauaaguuuucuaguaaa

SEQ ID NO: 758325 - RNA, 21 nt, Leptospira interrogans serovar lai str. 56601
gccguucugggcucaaaaagg

SEQ ID NO: 758326 - RNA, 22 nt, Leptospira interrogans serovar lai str. 56601
gccguucugggcucaaaaaggc

SEQ ID NO: 758327 - RNA, 20 nt, Leptospira interrogans serovar lai str. 56601
gccguaaaaaauccaugauu

SEQ ID NO: 758328 - RNA, 23 nt, Leptospira interrogans serovar lai str. 56601
gccgauucuaacugguuuuucuu

SEQ ID NO: 758329 - RNA, 17 nt, Leptospira interrogans serovar lai str. 56601
gccgauuggcugauucc

SEQ ID NO: 758330 - RNA, 19 nt, Leptospira interrogans serovar lai str. 56601
aaagcgggaauuccgggaa

SEQ ID NO: 758331 - RNA, 23 nt, Leptospira interrogans serovar lai str. 56601
aaagcgugacuaaaauugacaaa

SEQ ID NO: 758332 - RNA, 19 nt, Leptospira interrogans serovar lai str. 56601
aaagcgucaacugaaacuc

SEQ ID NO: 758333 - RNA, 19 nt, Leptospira interrogans serovar lai str. 56601
aaagcguuucguucuuuuu

SEQ ID NO: 758334 - RNA, 20 nt, Leptospira interrogans serovar lai str. 56601
aaagcguuucguucuuuuuu

SEQ ID NO: 758335 - RNA, 21 nt, Leptospira interrogans serovar lai str. 56601
gcccucugggaucggaaccaa

SEQ ID NO: 758336 - RNA, 16 nt, Leptospira interrogans serovar lai str. 56601
gcccucagcuauaaaa

SEQ ID NO: 758337 - RNA, 23 nt, Leptospira interrogans serovar lai str. 56601
gcccucccguuauuuuuuuuaca

SEQ ID NO: 758338 - RNA, 18 nt, Leptospira interrogans serovar lai str. 56601
gcccuccuauguuucuug

SEQ ID NO: 758339 - RNA, 17 nt, Leptospira interrogans serovar lai str. 56601
gcccguuucaauuuuug

SEQ ID NO: 758340 - RNA, 20 nt, Leptospira interrogans serovar lai str. 56601
gccccaccuaaaaugaaaaa

SEQ ID NO: 758341 - RNA, 21 nt, Leptospira interrogans serovar lai str. 56601
gccaguuuuuugagaaacaac

SEQ ID NO: 758342 - RNA, 12 nt, Leptospira interrogans serovar lai str. 56601
gccauuuuucuu

SEQ ID NO: 758343 - RNA, 14 nt, Leptospira interrogans serovar lai str. 56601
gccaugccaaacac

SEQ ID NO: 758344 - RNA, 15 nt, Leptospira interrogans serovar lai str. 56601
gccaugguaagaaga

SEQ ID NO: 758345 - RNA, 17 nt, Leptospira interrogans serovar lai str. 56601
gccaaucuccauuauag

SEQ ID NO: 758346 - RNA, 19 nt, Leptospira interrogans serovar lai str. 56601
gccaaaaucccagaaagga

SEQ ID NO: 758347 - RNA, 15 nt, Leptospira interrogans serovar lai str. 56601
gcaguaguucccaca

SEQ ID NO: 758348 - RNA, 15 nt, Leptospira interrogans serovar lai str. 56601
gccaaaaauuagaau

SEQ ID NO: 758349 - RNA, 17 nt, Leptospira interrogans serovar lai str. 56601
gcauuguuuaaauagau

SEQ ID NO: 758350 - RNA, 15 nt, Leptospira interrogans serovar lai str. 56601
gcauuuuuuaaaugc

SEQ ID NO: 758351 - RNA, 17 nt, Leptospira interrogans serovar lai str. 56601
gcauuuuuaagauuaca

SEQ ID NO: 758352 - RNA, 18 nt, Leptospira interrogans serovar lai str. 56601
gcauuuuuaagauuacau

SEQ ID NO: 758353 - RNA, 14 nt, Leptospira interrogans serovar lai str. 56601
gcauugaaaucaga

SEQ ID NO: 758354 - RNA, 15 nt, Leptospira interrogans serovar lai str. 56601
gcauugaaaucagag

SEQ ID NO: 758355 - RNA, 21 nt, Leptospira interrogans serovar lai str. 56601
gcauucaaaaaguuuuauaaa

SEQ ID NO: 758356 - RNA, 17 nt, Leptospira interrogans serovar lai str. 56601
gcaugaaaauaauacua

SEQ ID NO: 758357 - RNA, 20 nt, Leptospira interrogans serovar lai str. 56601
gcagcauugaguuuaagaaa

SEQ ID NO: 758358 - RNA, 21 nt, Leptospira interrogans serovar lai str. 56601
gcagcauugaguuuaagaaac

SEQ ID NO: 758359 - RNA, 21 nt, Leptospira interrogans serovar lai str. 56601
gcagauuugauguaaagaaaa

SEQ ID NO: 758360 - RNA, 12 nt, Leptospira interrogans serovar lai str. 56601
gcagcaaagaag

SEQ ID NO: 758361 - RNA, 13 nt, Leptospira interrogans serovar lai str. 56601
gcagcaaagaagg

SEQ ID NO: 758362 - RNA, 22 nt, Leptospira interrogans serovar lai str. 56601
gcagaauguuuucuacaaauaa

SEQ ID NO: 758363 - RNA, 17 nt, Leptospira interrogans serovar lai str. 56601
gcagaagcuuuauuaaa

SEQ ID NO: 758364 - RNA, 18 nt, Leptospira interrogans serovar lai str. 56601
gcagacugauucuuuaaa

SEQ ID NO: 758365 - RNA, 15 nt, Leptospira interrogans serovar lai str. 56601
gcagauucagucuca

SEQ ID NO: 758366 - RNA, 12 nt, Leptospira interrogans serovar lai str. 56601
gcacguggaaaa

SEQ ID NO: 758367 - RNA, 11 nt, Leptospira interrogans serovar lai str. 56601
gcaccaaauug

SEQ ID NO: 758368 - RNA, 14 nt, Leptospira interrogans serovar lai str. 56601
gcacaauauauuca

SEQ ID NO: 758369 - RNA, 17 nt, Leptospira interrogans serovar lai str. 56601
gcacauccgcauucuca

SEQ ID NO: 758370 - RNA, 15 nt, Leptospira interrogans serovar lai str. 56601
gcacauuuuucaagu

SEQ ID NO: 758371 - RNA, 13 nt, Leptospira interrogans serovar lai str. 56601
gcacagcaaaaaa

SEQ ID NO: 758372 - RNA, 21 nt, Leptospira interrogans serovar lai str. 56601
gcacaaaacgaucauuugcau

SEQ ID NO: 758373 - RNA, 21 nt, Leptospira interrogans serovar lai str. 56601
gcacaaaauauucguguucua

SEQ ID NO: 758374 - RNA, 15 nt, Leptospira interrogans serovar lai str. 56601
gcaauuguuggcuuu

SEQ ID NO: 758375 - RNA, 17 nt, Leptospira interrogans serovar lai str. 56601
gcaauuuagaauaaaga

SEQ ID NO: 758376 - RNA, 21 nt, Leptospira interrogans serovar lai str. 56601
gcaauuuagaauaaagagaag

SEQ ID NO: 758377 - RNA, 22 nt, Leptospira interrogans serovar lai str. 56601
gcaauucuaagaccuaaacccu

SEQ ID NO: 758378 - RNA, 16 nt, Leptospira interrogans serovar lai str. 56601
gcaaugucuccaaagu

SEQ ID NO: 758379 - RNA, 23 nt, Leptospira interrogans serovar lai str. 56601
gcaaugugcaaaggaguauuuuu

SEQ ID NO: 758380 - RNA, 11 nt, Leptospira interrogans serovar lai str. 56601
gcaaucuguug

SEQ ID NO: 758381 - RNA, 20 nt, Leptospira interrogans serovar lai str. 56601
gcaauauuauuuuaacuuga

SEQ ID NO: 758382 - RNA, 21 nt, Leptospira interrogans serovar lai str. 56601
gcaauauuauuuuaacuugag

SEQ ID NO: 758383 - RNA, 20 nt, Leptospira interrogans serovar lai str. 56601
gcaaguucuggguaaaaaaa

SEQ ID NO: 758384 - RNA, 13 nt, Leptospira interrogans serovar lai str. 56601
gcaaguaauacuu

SEQ ID NO: 758385 - RNA, 13 nt, Leptospira interrogans serovar lai str. 56601
gcaaguaaaaaga

SEQ ID NO: 758386 - RNA, 21 nt, Leptospira interrogans serovar lai str. 56601
aaagcgcucuuugaaauucag

SEQ ID NO: 758387 - RNA, 20 nt, Leptospira interrogans serovar lai str. 56601
gcaacggauuccuccagugc

SEQ ID NO: 758388 - RNA, 21 nt, Leptospira interrogans serovar lai str. 56601
gaucacaauuuuuuuagaauc

SEQ ID NO: 758389 - RNA, 14 nt, Leptospira interrogans serovar lai str. 56601
gcaacgaaaucaau

SEQ ID NO: 758390 - RNA, 19 nt, Leptospira interrogans serovar lai str. 56601
guaaauuuuuaucauaaaa

SEQ ID NO: 758391 - RNA, 21 nt, Leptospira interrogans serovar lai str. 56601
guaaauuuuuaucauaaaaca

SEQ ID NO: 758392 - RNA, 22 nt, Leptospira interrogans serovar lai str. 56601
guaacagaaaaauguuaaaaaa

SEQ ID NO: 758393 - RNA, 13 nt, Leptospira interrogans serovar lai str. 56601
guaacaguaagaa

SEQ ID NO: 758394 - RNA, 15 nt, Leptospira interrogans serovar lai str. 56601
guaacaguucucaca

SEQ ID NO: 758395 - RNA, 15 nt, Leptospira interrogans serovar lai str. 56601
guaaauccguauacu

SEQ ID NO: 758396 - RNA, 18 nt, Leptospira interrogans serovar lai str. 56601
guaaauccguauacuuua

SEQ ID NO: 758397 - RNA, 22 nt, Leptospira interrogans serovar lai str. 56601
guaaauccguauacuuuaaaaa

SEQ ID NO: 758398 - RNA, 15 nt, Leptospira interrogans serovar lai str. 56601
guaaauaaaaaacga

SEQ ID NO: 758399 - RNA, 17 nt, Leptospira interrogans serovar lai str. 56601
guaaaguucuuuucuua

SEQ ID NO: 758400 - RNA, 21 nt, Leptospira interrogans serovar lai str. 56601
guaaaguucuuuucuuaaaaa

SEQ ID NO: 758401 - RNA, 12 nt, Leptospira interrogans serovar lai str. 56601
guaaaguuuaga

SEQ ID NO: 758402 - RNA, 23 nt, Leptospira interrogans serovar lai str. 56601
guaaauaucaaaugugagaguuc

SEQ ID NO: 758403 - RNA, 21 nt, Leptospira interrogans serovar lai str. 56601
guaaauucacuguuaaaagau

SEQ ID NO: 758404 - RNA, 16 nt, Leptospira interrogans serovar lai str. 56601
guaaauucaaagcaag

SEQ ID NO: 758405 - RNA, 20 nt, Leptospira interrogans serovar lai str. 56601
guaaauuauggacuauuuua

SEQ ID NO: 758406 - RNA, 19 nt, Leptospira interrogans serovar lai str. 56601
guaaauggugguuccuaua

SEQ ID NO: 758407 - RNA, 22 nt, Leptospira interrogans serovar lai str. 56601
guaaaugaauuggaaagaagga

SEQ ID NO: 758408 - RNA, 18 nt, Leptospira interrogans serovar lai str. 56601
guaaaugaauuuagaaaa

SEQ ID NO: 758409 - RNA, 19 nt, Leptospira interrogans serovar lai str. 56601
guaaaugaauuuagaaaau

SEQ ID NO: 758410 - RNA, 18 nt, Leptospira interrogans serovar lai str. 56601
guaaaucgcugauaaauu

SEQ ID NO: 758411 - RNA, 20 nt, Leptospira interrogans serovar lai str. 56601
guaaagacgauccuuuuuug

SEQ ID NO: 758412 - RNA, 13 nt, Leptospira interrogans serovar lai str. 56601
guaaacuacuaaa

SEQ ID NO: 758413 - RNA, 16 nt, Leptospira interrogans serovar lai str. 56601
guaaacuacuaaaucu

SEQ ID NO: 758414 - RNA, 18 nt, Leptospira interrogans serovar lai str. 56601
guaaaggaauccaugauu

SEQ ID NO: 758415 - RNA, 13 nt, Leptospira interrogans serovar lai str. 56601
guaaagaaaacca

SEQ ID NO: 758416 - RNA, 13 nt, Leptospira interrogans serovar lai str. 56601
guaaaaucuuaau

SEQ ID NO: 758417 - RNA, 20 nt, Leptospira interrogans serovar lai str. 56601
guaaaauguggaaacuauca

SEQ ID NO: 758418 - RNA, 17 nt, Leptospira interrogans serovar lai str. 56601
guaaaauggaaaaaaga

SEQ ID NO: 758419 - RNA, 13 nt, Leptospira interrogans serovar lai str. 56601
guaaaaggagaau

SEQ ID NO: 758420 - RNA, 12 nt, Leptospira interrogans serovar lai str. 56601
guaaaagaaaaa

SEQ ID NO: 758421 - RNA, 13 nt, Leptospira interrogans serovar lai str. 56601
guaaaauuuaaag

SEQ ID NO: 758422 - RNA, 14 nt, Leptospira interrogans serovar lai str. 56601
guaaaauuuagauu

SEQ ID NO: 758423 - RNA, 19 nt, Leptospira interrogans serovar lai str. 56601
guaacuacuauguuuuugg

SEQ ID NO: 758424 - RNA, 23 nt, Leptospira interrogans serovar lai str. 56601
guaacuacugcauucuuagaauu

SEQ ID NO: 758425 - RNA, 18 nt, Leptospira interrogans serovar lai str. 56601
guaacucaaaauuucgga

SEQ ID NO: 758426 - RNA, 15 nt, Leptospira interrogans serovar lai str. 56601
guaacgaguagaauu

SEQ ID NO: 758427 - RNA, 10 nt, Leptospira interrogans serovar lai str. 56601
guaaccuuug

SEQ ID NO: 758428 - RNA, 19 nt, Leptospira interrogans serovar lai str. 56601
guaaccuuuguuuccucuu

SEQ ID NO: 758429 - RNA, 23 nt, Leptospira interrogans serovar lai str. 56601
guaagagcuccuacauuuuauuu

SEQ ID NO: 758430 - RNA, 16 nt, Leptospira interrogans serovar lai str. 56601
guaagauaugaauuaa

SEQ ID NO: 758431 - RNA, 23 nt, Leptospira interrogans serovar lai str. 56601
guaacuuucuuuuagaaaauuau

SEQ ID NO: 758432 - RNA, 13 nt, Leptospira interrogans serovar lai str. 56601
guaagaaauaugg

SEQ ID NO: 758433 - RNA, 14 nt, Leptospira interrogans serovar lai str. 56601
guaagaaaaacuag

SEQ ID NO: 758434 - RNA, 15 nt, Leptospira interrogans serovar lai str. 56601
guaagaaaaccauga

SEQ ID NO: 758435 - RNA, 11 nt, Leptospira interrogans serovar lai str. 56601
guaagaaaaaa

SEQ ID NO: 758436 - RNA, 21 nt, Leptospira interrogans serovar lai str. 56601
guaacugacauuccagcuucu

SEQ ID NO: 758437 - RNA, 13 nt, Leptospira interrogans serovar lai str. 56601
guaacuccuagau

SEQ ID NO: 758438 - RNA, 15 nt, Leptospira interrogans serovar lai str. 56601
guaagcguaaauuac

SEQ ID NO: 758439 - RNA, 20 nt, Leptospira interrogans serovar lai str. 56601
guaaguugagaauauaagaa

SEQ ID NO: 758440 - RNA, 20 nt, Leptospira interrogans serovar lai str. 56601
guaaguuaaauauaaaagau

SEQ ID NO: 758441 - RNA, 23 nt, Leptospira interrogans serovar lai str. 56601
guaaguuuuucgauaaaguaaaa

SEQ ID NO: 758442 - RNA, 13 nt, Leptospira interrogans serovar lai str. 56601
guaauauaucagu

SEQ ID NO: 758443 - RNA, 13 nt, Leptospira interrogans serovar lai str. 56601
guaauauauucaa

SEQ ID NO: 758444 - RNA, 16 nt, Leptospira interrogans serovar lai str. 56601
guaauaucuaaaaccu

SEQ ID NO: 758445 - RNA, 17 nt, Leptospira interrogans serovar lai str. 56601
guaauuucguuuuuuua

SEQ ID NO: 758446 - RNA, 11 nt, Leptospira interrogans serovar lai str. 56601
guaauuuugaa

SEQ ID NO: 758447 - RNA, 23 nt, Leptospira interrogans serovar lai str. 56601
guacaacauccuucaaacuuuuc

SEQ ID NO: 758448 - RNA, 20 nt, Leptospira interrogans serovar lai str. 56601
guacaaauugguuuuuauua

SEQ ID NO: 758449 - RNA, 19 nt, Leptospira interrogans serovar lai str. 56601
guacaaaaaugugggaacu

SEQ ID NO: 758450 - RNA, 21 nt, Leptospira interrogans serovar lai str. 56601
guacaaucggguaaaaaauac

SEQ ID NO: 758451 - RNA, 14 nt, Leptospira interrogans serovar lai str. 56601
guaauuaaauuuuc

SEQ ID NO: 758452 - RNA, 15 nt, Leptospira interrogans serovar lai str. 56601
guaauuaaaauuuac

SEQ ID NO: 758453 - RNA, 22 nt, Leptospira interrogans serovar lai str. 56601
guaauuccagaggcaguacaau

SEQ ID NO: 758454 - RNA, 19 nt, Leptospira interrogans serovar lai str. 56601
guaauuguagauucuuuua

SEQ ID NO: 758455 - RNA, 21 nt, Leptospira interrogans serovar lai str. 56601
guaauuucauaaaauucuuag

SEQ ID NO: 758456 - RNA, 15 nt, Leptospira interrogans serovar lai str. 56601
guaauuuaaaaaaau

SEQ ID NO: 758457 - RNA, 15 nt, Leptospira interrogans serovar lai str. 56601
guaaugaaaucuagu

SEQ ID NO: 758458 - RNA, 23 nt, Leptospira interrogans serovar lai str. 56601
aaauagaguaccauaaauuuuua

SEQ ID NO: 758459 - RNA, 23 nt, Leptospira interrogans serovar lai str. 56601
aaauagagcuuuguaauaaaaau

SEQ ID NO: 758460 - RNA, 20 nt, Leptospira interrogans serovar lai str. 56601
aaauagauggagaauuaauu

SEQ ID NO: 758461 - RNA, 22 nt, Leptospira interrogans serovar lai str. 56601
aaauagauggagaauucauuuu

SEQ ID NO: 758462 - RNA, 17 nt, Leptospira interrogans serovar lai str. 56601
aaauagauuaguuuaaa

SEQ ID NO: 758463 - RNA, 14 nt, Leptospira interrogans serovar lai str. 56601
aaauagauucaaaa

SEQ ID NO: 758464 - RNA, 13 nt, Leptospira interrogans serovar lai str. 56601
aaauagauucuaa

SEQ ID NO: 758465 - RNA, 19 nt, Leptospira interrogans serovar lai str. 56601
aaauagauucuaauuuuuc

SEQ ID NO: 758466 - RNA, 19 nt, Leptospira interrogans serovar lai str. 56601
aaauagaucugauauuuua

SEQ ID NO: 758467 - RNA, 22 nt, Leptospira interrogans serovar lai str. 56601
aaauagaucugauauuuuaaau

SEQ ID NO: 758468 - RNA, 23 nt, Leptospira interrogans serovar lai str. 56601
aaauagaucugauauuuuaaauu

SEQ ID NO: 758469 - RNA, 16 nt, Leptospira interrogans serovar lai str. 56601
aaauagaauaaauuau

SEQ ID NO: 758470 - RNA, 22 nt, Leptospira interrogans serovar lai str. 56601
aaauagaauccuauaauaaaau

SEQ ID NO: 758471 - RNA, 16 nt, Leptospira interrogans serovar lai str. 56601
aaauagaauuguugaa

SEQ ID NO: 758472 - RNA, 15 nt, Leptospira interrogans serovar lai str. 56601
aaauagaauuuugca

SEQ ID NO: 758473 - RNA, 18 nt, Leptospira interrogans serovar lai str. 56601
aaauagaauuuugcaaaa

SEQ ID NO: 758474 - RNA, 21 nt, Leptospira interrogans serovar lai str. 56601
aaauagaauuuugcaaaaaaa

SEQ ID NO: 758475 - RNA, 23 nt, Leptospira interrogans serovar lai str. 56601
aaauagaauuuugcaaaaaaaau

SEQ ID NO: 758476 - RNA, 14 nt, Leptospira interrogans serovar lai str. 56601
aaauagaauuuuug

SEQ ID NO: 758477 - RNA, 16 nt, Leptospira interrogans serovar lai str. 56601
aaauagaauuuuugua

SEQ ID NO: 758478 - RNA, 17 nt, Leptospira interrogans serovar lai str. 56601
guaauauauucaauuuc

SEQ ID NO: 758479 - RNA, 16 nt, Leptospira interrogans serovar lai str. 56601
guacaucuuaaaaaau

SEQ ID NO: 758480 - RNA, 22 nt, Leptospira interrogans serovar lai str. 56601
guaccauaggcgcggaaaaauu

SEQ ID NO: 758481 - RNA, 14 nt, Leptospira interrogans serovar lai str. 56601
guacccuuaaaauc

SEQ ID NO: 758482 - RNA, 17 nt, Leptospira interrogans serovar lai str. 56601
gguucuugcaaaaauag

SEQ ID NO: 758483 - RNA, 13 nt, Leptospira interrogans serovar lai str. 56601
gguucuauaaaag

SEQ ID NO: 758484 - RNA, 18 nt, Leptospira interrogans serovar lai str. 56601
gguugagcaguaaaaucu

SEQ ID NO: 758485 - RNA, 18 nt, Leptospira interrogans serovar lai str. 56601
gguugaguaguaaaaucu

SEQ ID NO: 758486 - RNA, 13 nt, Leptospira interrogans serovar lai str. 56601
gguugaguucuuu

SEQ ID NO: 758487 - RNA, 15 nt, Leptospira interrogans serovar lai str. 56601
gguuggauuccuuuc

SEQ ID NO: 758488 - RNA, 14 nt, Leptospira interrogans serovar lai str. 56601
gguuguuaugcaaa

SEQ ID NO: 758489 - RNA, 19 nt, Leptospira interrogans serovar lai str. 56601
gguuguaacucaaaauuuc

SEQ ID NO: 758490 - RNA, 21 nt, Leptospira interrogans serovar lai str. 56601
gguuuuacuaaaaaacauaaa

SEQ ID NO: 758491 - RNA, 16 nt, Leptospira interrogans serovar lai str. 56601
gguuuuauuucugcug

SEQ ID NO: 758492 - RNA, 14 nt, Leptospira interrogans serovar lai str. 56601
gguuucauagaagg

SEQ ID NO: 758493 - RNA, 18 nt, Leptospira interrogans serovar lai str. 56601
gguuucacaaauuuuaua

SEQ ID NO: 758494 - RNA, 14 nt, Leptospira interrogans serovar lai str. 56601
guaaaaaauccaug

SEQ ID NO: 758495 - RNA, 18 nt, Leptospira interrogans serovar lai str. 56601
guaaaaaaacaugaagaa

SEQ ID NO: 758496 - RNA, 12 nt, Leptospira interrogans serovar lai str. 56601
guaaaaauaaua

SEQ ID NO: 758497 - RNA, 13 nt, Leptospira interrogans serovar lai str. 56601
guaaaaaaauaga

SEQ ID NO: 758498 - RNA, 20 nt, Leptospira interrogans serovar lai str. 56601
guaaaaauauuggguauuua

SEQ ID NO: 758499 - RNA, 21 nt, Leptospira interrogans serovar lai str. 56601
guaaaaauaucaguuucuccg

SEQ ID NO: 758500 - RNA, 17 nt, Leptospira interrogans serovar lai str. 56601
guaaaacccaauaccaa

SEQ ID NO: 758501 - RNA, 20 nt, Leptospira interrogans serovar lai str. 56601
guaaaacccaucguaaacaa

SEQ ID NO: 758502 - RNA, 13 nt, Leptospira interrogans serovar lai str. 56601
gguuaaaaauuua

SEQ ID NO: 758503 - RNA, 17 nt, Leptospira interrogans serovar lai str. 56601
gguucaaaaaaauuaaa

SEQ ID NO: 758504 - RNA, 13 nt, Leptospira interrogans serovar lai str. 56601
gguuaauuaaaug

SEQ ID NO: 758505 - RNA, 16 nt, Leptospira interrogans serovar lai str. 56601
gucuacgauuucucca

SEQ ID NO: 758506 - RNA, 21 nt, Leptospira interrogans serovar lai str. 56601
gucgcuaaacucauuuuaaac

SEQ ID NO: 758507 - RNA, 18 nt, Leptospira interrogans serovar lai str. 56601
gucgcucugugaaacuca

SEQ ID NO: 758508 - RNA, 23 nt, Leptospira interrogans serovar lai str. 56601
gucggaucauaauccuaugaaaa

SEQ ID NO: 758509 - RNA, 21 nt, Leptospira interrogans serovar lai str. 56601
gucgacuuugacuugaaaaag

SEQ ID NO: 758510 - RNA, 14 nt, Leptospira interrogans serovar lai str. 56601
gucgcauuuagcaa

SEQ ID NO: 758511 - RNA, 21 nt, Leptospira interrogans serovar lai str. 56601
gucgaacucacguuacuacuc

SEQ ID NO: 758512 - RNA, 14 nt, Leptospira interrogans serovar lai str. 56601
guccucuaugaaac

SEQ ID NO: 758513 - RNA, 15 nt, Leptospira interrogans serovar lai str. 56601
gucccguauaaaagu

SEQ ID NO: 758514 - RNA, 14 nt, Leptospira interrogans serovar lai str. 56601
gucccaaaaacuca

SEQ ID NO: 758515 - RNA, 14 nt, Leptospira interrogans serovar lai str. 56601
gucccaaaauuucu

SEQ ID NO: 758516 - RNA, 15 nt, Leptospira interrogans serovar lai str. 56601
gucccacauuuuugu

SEQ ID NO: 758517 - RNA, 19 nt, Leptospira interrogans serovar lai str. 56601
gucauugaaggguaacuca

SEQ ID NO: 758518 - RNA, 16 nt, Leptospira interrogans serovar lai str. 56601
gucaaguuauuguaaa

SEQ ID NO: 758519 - RNA, 20 nt, Leptospira interrogans serovar lai str. 56601
guauuuucggcauuuuauua

SEQ ID NO: 758520 - RNA, 15 nt, Leptospira interrogans serovar lai str. 56601
guauuuugcacugaa

SEQ ID NO: 758521 - RNA, 17 nt, Leptospira interrogans serovar lai str. 56601
guauuuuuaagauaaau

SEQ ID NO: 758522 - RNA, 17 nt, Leptospira interrogans serovar lai str. 56601
gucaaaugcgacuuaau

SEQ ID NO: 758523 - RNA, 12 nt, Leptospira interrogans serovar lai str. 56601
gucaaaauuuug

SEQ ID NO: 758524 - RNA, 15 nt, Leptospira interrogans serovar lai str. 56601
gucaaaauuuuguuu

SEQ ID NO: 758525 - RNA, 19 nt, Leptospira interrogans serovar lai str. 56601
gucaaacacucuaaaucuu

SEQ ID NO: 758526 - RNA, 22 nt, Leptospira interrogans serovar lai str. 56601
guauuuaguuuuuugaguccac

SEQ ID NO: 758527 - RNA, 14 nt, Leptospira interrogans serovar lai str. 56601
guauuuauuauaua

SEQ ID NO: 758528 - RNA, 15 nt, Leptospira interrogans serovar lai str. 56601
guauuuauuauauaa

SEQ ID NO: 758529 - RNA, 19 nt, Leptospira interrogans serovar lai str. 56601
guauuuuagagaaacuuua

SEQ ID NO: 758530 - RNA, 16 nt, Leptospira interrogans serovar lai str. 56601
guauuuuacgauucaa

SEQ ID NO: 758531 - RNA, 14 nt, Leptospira interrogans serovar lai str. 56601
guauuuuagaaaua

SEQ ID NO: 758532 - RNA, 16 nt, Leptospira interrogans serovar lai str. 56601
guauuuuagaaauauu

SEQ ID NO: 758533 - RNA, 14 nt, Leptospira interrogans serovar lai str. 56601
guauuuuaaacaaa

SEQ ID NO: 758534 - RNA, 15 nt, Leptospira interrogans serovar lai str. 56601
guauuguuaagauaa

SEQ ID NO: 758535 - RNA, 17 nt, Leptospira interrogans serovar lai str. 56601
guauuguuaagauaaau

SEQ ID NO: 758536 - RNA, 13 nt, Leptospira interrogans serovar lai str. 56601
guauuuaaaauua

SEQ ID NO: 758537 - RNA, 21 nt, Leptospira interrogans serovar lai str. 56601
guauuuagcgcuuauugcaaa

SEQ ID NO: 758538 - RNA, 14 nt, Leptospira interrogans serovar lai str. 56601
guauucuuuccaac

SEQ ID NO: 758539 - RNA, 15 nt, Leptospira interrogans serovar lai str. 56601
guauucuuaauagaa

SEQ ID NO: 758540 - RNA, 15 nt, Leptospira interrogans serovar lai str. 56601
guauucuagaauaua

SEQ ID NO: 758541 - RNA, 16 nt, Leptospira interrogans serovar lai str. 56601
guauucuagaauauaa

SEQ ID NO: 758542 - RNA, 19 nt, Leptospira interrogans serovar lai str. 56601
guauucucccccaacugaa

SEQ ID NO: 758543 - RNA, 20 nt, Leptospira interrogans serovar lai str. 56601
guauuccaagggaagguuuu

SEQ ID NO: 758544 - RNA, 20 nt, Leptospira interrogans serovar lai str. 56601
guauuccaugguuuuuucaa

SEQ ID NO: 758545 - RNA, 14 nt, Leptospira interrogans serovar lai str. 56601
guauuauaaacagu

SEQ ID NO: 758546 - RNA, 16 nt, Leptospira interrogans serovar lai str. 56601
guauuauuuuccuuua

SEQ ID NO: 758547 - RNA, 13 nt, Leptospira interrogans serovar lai str. 56601
guaugaguuccua

SEQ ID NO: 758548 - RNA, 15 nt, Leptospira interrogans serovar lai str. 56601
guaugaguuccuaca

SEQ ID NO: 758549 - RNA, 22 nt, Leptospira interrogans serovar lai str. 56601
guauguuuacuugaaaauaaaa

SEQ ID NO: 758550 - RNA, 18 nt, Leptospira interrogans serovar lai str. 56601
guaugugguaguucccac

SEQ ID NO: 758551 - RNA, 21 nt, Leptospira interrogans serovar lai str. 56601
guaucauaaguuuugauagaa

SEQ ID NO: 758552 - RNA, 20 nt, Leptospira interrogans serovar lai str. 56601
guauccaucguaucuuucaa

SEQ ID NO: 758553 - RNA, 12 nt, Leptospira interrogans serovar lai str. 56601
guauccauuucg

SEQ ID NO: 758554 - RNA, 17 nt, Leptospira interrogans serovar lai str. 56601
guauccgaaaaauucca

SEQ ID NO: 758555 - RNA, 11 nt, Leptospira interrogans serovar lai str. 56601
guaugaaaacg

SEQ ID NO: 758556 - RNA, 19 nt, Leptospira interrogans serovar lai str. 56601
guaucuugcguuaaaacgg

SEQ ID NO: 758557 - RNA, 21 nt, Leptospira interrogans serovar lai str. 56601
guaucgaauggaaaucuuuua

SEQ ID NO: 758558 - RNA, 21 nt, Leptospira interrogans serovar lai str. 56601
guauauaaacgaguaguucuu

SEQ ID NO: 758559 - RNA, 13 nt, Leptospira interrogans serovar lai str. 56601
guauauuauaaaa

SEQ ID NO: 758560 - RNA, 13 nt, Leptospira interrogans serovar lai str. 56601
guaucaaaccuuu

SEQ ID NO: 758561 - RNA, 13 nt, Leptospira interrogans serovar lai str. 56601
guauacuuuaaaa

SEQ ID NO: 758562 - RNA, 20 nt, Leptospira interrogans serovar lai str. 56601
guaguuucgccaaucuccau

SEQ ID NO: 758563 - RNA, 23 nt, Leptospira interrogans serovar lai str. 56601
guaguuuucacuaauugugucgu

SEQ ID NO: 758564 - RNA, 13 nt, Leptospira interrogans serovar lai str. 56601
guauaaaaacggu

SEQ ID NO: 758565 - RNA, 21 nt, Leptospira interrogans serovar lai str. 56601
guaguucucacagaaauauau

SEQ ID NO: 758566 - RNA, 22 nt, Leptospira interrogans serovar lai str. 56601
guaguuccuacgguuuuaguca

SEQ ID NO: 758567 - RNA, 20 nt, Leptospira interrogans serovar lai str. 56601
guauaauucuguaaaaauag

SEQ ID NO: 758568 - RNA, 20 nt, Leptospira interrogans serovar lai str. 56601
guauaagucgaucuacuaaa

SEQ ID NO: 758569 - RNA, 20 nt, Leptospira interrogans serovar lai str. 56601
guaggaacuacagcaaauca

SEQ ID NO: 758570 - RNA, 21 nt, Leptospira interrogans serovar lai str. 56601
guaggaacuaccgcaaaucaa

SEQ ID NO: 758571 - RNA, 12 nt, Leptospira interrogans serovar lai str. 56601
guaggaacuauu

SEQ ID NO: 758572 - RNA, 18 nt, Leptospira interrogans serovar lai str. 56601
guaguaugcgaaauuccu

SEQ ID NO: 758573 - RNA, 14 nt, Leptospira interrogans serovar lai str. 56601
guaguaguucccac

SEQ ID NO: 758574 - RNA, 17 nt, Leptospira interrogans serovar lai str. 56601
guaguuaauaaauuuuu

SEQ ID NO: 758575 - RNA, 13 nt, Leptospira interrogans serovar lai str. 56601
guaguaaauaaaa

SEQ ID NO: 758576 - RNA, 17 nt, Leptospira interrogans serovar lai str. 56601
guagauugauuuuucua

SEQ ID NO: 758577 - RNA, 18 nt, Leptospira interrogans serovar lai str. 56601
guagauugcuuuuuaaaa

SEQ ID NO: 758578 - RNA, 21 nt, Leptospira interrogans serovar lai str. 56601
guagauugcuuuuuaaaagau

SEQ ID NO: 758579 - RNA, 14 nt, Leptospira interrogans serovar lai str. 56601
guagauguaauacg

SEQ ID NO: 758580 - RNA, 15 nt, Leptospira interrogans serovar lai str. 56601
guagauaauuaaaca

SEQ ID NO: 758581 - RNA, 17 nt, Leptospira interrogans serovar lai str. 56601
guagauaauuaaacaaa

SEQ ID NO: 758582 - RNA, 19 nt, Leptospira interrogans serovar lai str. 56601
guagagauugauauucaaa

SEQ ID NO: 758583 - RNA, 23 nt, Leptospira interrogans serovar lai str. 56601
guacuauauuuuugugaaacuca

SEQ ID NO: 758584 - RNA, 14 nt, Leptospira interrogans serovar lai str. 56601
guacuuaaauuuua

SEQ ID NO: 758585 - RNA, 22 nt, Leptospira interrogans serovar lai str. 56601
guagaaauuuaauuugaucauc

SEQ ID NO: 758586 - RNA, 20 nt, Leptospira interrogans serovar lai str. 56601
uaaaaucggaaaauugaaua

SEQ ID NO: 758587 - RNA, 16 nt, Leptospira interrogans serovar lai str. 56601
uaaaaucgauuacucu

SEQ ID NO: 758588 - RNA, 19 nt, Leptospira interrogans serovar lai str. 56601
uaaaaucuaaauuuguaau

SEQ ID NO: 758589 - RNA, 19 nt, Leptospira interrogans serovar lai str. 56601
uaaaaucuaucucaaaaau

SEQ ID NO: 758590 - RNA, 21 nt, Leptospira interrogans serovar lai str. 56601
uaaaaucauacuuuuaaaaaa

SEQ ID NO: 758591 - RNA, 20 nt, Leptospira interrogans serovar lai str. 56601
uaaaaucauauuuucaaaaa

SEQ ID NO: 758592 - RNA, 20 nt, Leptospira interrogans serovar lai str. 56601
uaaaauccaugauuuguaau

SEQ ID NO: 758593 - RNA, 15 nt, Leptospira interrogans serovar lai str. 56601
uaaaauaucuuuaau

SEQ ID NO: 758594 - RNA, 14 nt, Leptospira interrogans serovar lai str. 56601
uaaaaucacaaaaa

SEQ ID NO: 758595 - RNA, 21 nt, Leptospira interrogans serovar lai str. 56601
uaaaaucagggccggagaaaa

SEQ ID NO: 758596 - RNA, 22 nt, Leptospira interrogans serovar lai str. 56601
uaaaaucagggccggagaaaau

SEQ ID NO: 758597 - RNA, 13 nt, Leptospira interrogans serovar lai str. 56601
uaaaaugaaaaaa

SEQ ID NO: 758598 - RNA, 17 nt, Leptospira interrogans serovar lai str. 56601
uaaaaugaaaaaaaaca

SEQ ID NO: 758599 - RNA, 15 nt, Leptospira interrogans serovar lai str. 56601
uaaaaugaaaauuau

SEQ ID NO: 758600 - RNA, 16 nt, Leptospira interrogans serovar lai str. 56601
uaaaaugaaaauuaua

SEQ ID NO: 758601 - RNA, 18 nt, Leptospira interrogans serovar lai str. 56601
uaaaaugaaaauuauaag

SEQ ID NO: 758602 - RNA, 21 nt, Leptospira interrogans serovar lai str. 56601
uaaaaucuucaaguuugugag

SEQ ID NO: 758603 - RNA, 19 nt, Leptospira interrogans serovar lai str. 56601
uaaaaucuuaaauuagaua

SEQ ID NO: 758604 - RNA, 14 nt, Leptospira interrogans serovar lai str. 56601
uaaaaucuuaauuu

SEQ ID NO: 758605 - RNA, 14 nt, Leptospira interrogans serovar lai str. 56601
uaaaaucuuuaagu

SEQ ID NO: 758606 - RNA, 15 nt, Leptospira interrogans serovar lai str. 56601
uaaaaucuuuaaguu

SEQ ID NO: 758607 - RNA, 15 nt, Leptospira interrogans serovar lai str. 56601
uaaaaugaaucucuu

SEQ ID NO: 758608 - RNA, 23 nt, Leptospira interrogans serovar lai str. 56601
uaaaaugagaguucgugaagaaa

SEQ ID NO: 758609 - RNA, 12 nt, Leptospira interrogans serovar lai str. 56601
uaaaaugcaaua

SEQ ID NO: 758610 - RNA, 14 nt, Leptospira interrogans serovar lai str. 56601
uaaaauguaaaaac

SEQ ID NO: 758611 - RNA, 16 nt, Leptospira interrogans serovar lai str. 56601
uaaaauguaaaaacua

SEQ ID NO: 758612 - RNA, 16 nt, Leptospira interrogans serovar lai str. 56601
uaaaauggguuuucau

SEQ ID NO: 758613 - RNA, 19 nt, Leptospira interrogans serovar lai str. 56601
uaaaauggguuuuuaauuu

SEQ ID NO: 758614 - RNA, 14 nt, Leptospira interrogans serovar lai str. 56601
uaaaauggaaaaaa

SEQ ID NO: 758615 - RNA, 15 nt, Leptospira interrogans serovar lai str. 56601
uaaaauggaaaaaag

SEQ ID NO: 758616 - RNA, 23 nt, Leptospira interrogans serovar lai str. 56601
uaaaauggaaaaaagaucuuaua

SEQ ID NO: 758617 - RNA, 18 nt, Leptospira interrogans serovar lai str. 56601
uaaaauguggaaacuauc

SEQ ID NO: 758618 - RNA, 10 nt, Leptospira interrogans serovar lai str. 56601
uaaaauuaag

SEQ ID NO: 758619 - RNA, 23 nt, Leptospira interrogans serovar lai str. 56601
uaaaauuaaaauccucaacagau

SEQ ID NO: 758620 - RNA, 22 nt, Leptospira interrogans serovar lai str. 56601
uaaaauuaacaguauucaauuu

SEQ ID NO: 758621 - RNA, 22 nt, Leptospira interrogans serovar lai str. 56601
uaaaaugggaaguuuaccccga

SEQ ID NO: 758622 - RNA, 16 nt, Leptospira interrogans serovar lai str. 56601
uaaaauguaguaacua

SEQ ID NO: 758623 - RNA, 18 nt, Leptospira interrogans serovar lai str. 56601
uaaaauauaguuaaauuu

SEQ ID NO: 758624 - RNA, 13 nt, Leptospira interrogans serovar lai str. 56601
uaaaauauaggaa

SEQ ID NO: 758625 - RNA, 20 nt, Leptospira interrogans serovar lai str. 56601
uaaaauagugguuuguagua

SEQ ID NO: 758626 - RNA, 15 nt, Leptospira interrogans serovar lai str. 56601
uaaaauaggauuuaa

SEQ ID NO: 758627 - RNA, 16 nt, Leptospira interrogans serovar lai str. 56601
uaaaauaggauuuaaa

SEQ ID NO: 758628 - RNA, 21 nt, Leptospira interrogans serovar lai str. 56601
uaaaauaggauuuaaauuuug

SEQ ID NO: 758629 - RNA, 16 nt, Leptospira interrogans serovar lai str. 56601
uaaaauacucaauccg

SEQ ID NO: 758630 - RNA, 15 nt, Leptospira interrogans serovar lai str. 56601
uaaaauagaauuguu

SEQ ID NO: 758631 - RNA, 16 nt, Leptospira interrogans serovar lai str. 56601
uaaaauacuuuuagaa

SEQ ID NO: 758632 - RNA, 17 nt, Leptospira interrogans serovar lai str. 56601
uaaaauacuuuuagaaa

SEQ ID NO: 758633 - RNA, 21 nt, Leptospira interrogans serovar lai str. 56601
uaaaauacuuuugaaauagau

SEQ ID NO: 758634 - RNA, 22 nt, Leptospira interrogans serovar lai str. 56601
uaaaauacuuuugaaauagauu

SEQ ID NO: 758635 - RNA, 18 nt, Leptospira interrogans serovar lai str. 56601
uaaaauagaaacaaaugg

SEQ ID NO: 758636 - RNA, 19 nt, Leptospira interrogans serovar lai str. 56601
uaaaauagaaacagaugga

SEQ ID NO: 758637 - RNA, 12 nt, Leptospira interrogans serovar lai str. 56601
uaaaauaagaau

SEQ ID NO: 758638 - RNA, 22 nt, Leptospira interrogans serovar lai str. 56601
uaaaauaaaaauuucagauuuu

SEQ ID NO: 758639 - RNA, 14 nt, Leptospira interrogans serovar lai str. 56601
uaaaauaaauuuau

SEQ ID NO: 758640 - RNA, 21 nt, Leptospira interrogans serovar lai str. 56601
uaaaauaaauuuauaauucaa

SEQ ID NO: 758641 - RNA, 13 nt, Leptospira interrogans serovar lai str. 56601
uaaaauaccauaa

SEQ ID NO: 758642 - RNA, 17 nt, Leptospira interrogans serovar lai str. 56601
uaaaauaccauaaauuu

SEQ ID NO: 758643 - RNA, 19 nt, Leptospira interrogans serovar lai str. 56601
uaaaauaaugauagaaaua

SEQ ID NO: 758644 - RNA, 20 nt, Leptospira interrogans serovar lai str. 56601
uaaaaggagaauucaauuua

SEQ ID NO: 758645 - RNA, 13 nt, Leptospira interrogans serovar lai str. 56601
uaaaaggagccaa

SEQ ID NO: 758646 - RNA, 19 nt, Leptospira interrogans serovar lai str. 56601
uaaaaggaguaauucuaaa

SEQ ID NO: 758647 - RNA, 22 nt, Leptospira interrogans serovar lai str. 56601
uaaaagcuuauacuuuaagaaa

SEQ ID NO: 758648 - RNA, 16 nt, Leptospira interrogans serovar lai str. 56601
uaaaagcuuuugcuuu

SEQ ID NO: 758649 - RNA, 20 nt, Leptospira interrogans serovar lai str. 56601
uaaaagcuuuugcuuuuaaa

SEQ ID NO: 758650 - RNA, 17 nt, Leptospira interrogans serovar lai str. 56601
uaaaaggacgggaaaau

SEQ ID NO: 758651 - RNA, 21 nt, Leptospira interrogans serovar lai str. 56601
uaaaaguacgggcucauacau

SEQ ID NO: 758652 - RNA, 22 nt, Leptospira interrogans serovar lai str. 56601
uaaaaggcugcuuuuuugagau

SEQ ID NO: 758653 - RNA, 19 nt, Leptospira interrogans serovar lai str. 56601
uaaaagggacguaguucuu

SEQ ID NO: 758654 - RNA, 15 nt, Leptospira interrogans serovar lai str. 56601
uaaaauaaaauuccu

SEQ ID NO: 758655 - RNA, 19 nt, Leptospira interrogans serovar lai str. 56601
uaaaaguuuuugaaaugca

SEQ ID NO: 758656 - RNA, 22 nt, Leptospira interrogans serovar lai str. 56601
uaaaaguaguagucuuacaauu

SEQ ID NO: 758657 - RNA, 18 nt, Leptospira interrogans serovar lai str. 56601
uaaaaguauaauauuuau

SEQ ID NO: 758658 - RNA, 23 nt, Leptospira interrogans serovar lai str. 56601
uaaaaguagaaucaucucaaaaa

SEQ ID NO: 758659 - RNA, 18 nt, Leptospira interrogans serovar lai str. 56601
uaaaaaugauacuauuaa

SEQ ID NO: 758660 - RNA, 19 nt, Leptospira interrogans serovar lai str. 56601
uaaaaaugauacuauuaau

SEQ ID NO: 758661 - RNA, 16 nt, Leptospira interrogans serovar lai str. 56601
uaaaaaugaugcaaau

SEQ ID NO: 758662 - RNA, 11 nt, Leptospira interrogans serovar lai str. 56601
uaaaaaugagu

SEQ ID NO: 758663 - RNA, 16 nt, Leptospira interrogans serovar lai str. 56601
uaaaaauuaaacagua

SEQ ID NO: 758664 - RNA, 17 nt, Leptospira interrogans serovar lai str. 56601
uaaaaauuaauuuuaua

SEQ ID NO: 758665 - RNA, 14 nt, Leptospira interrogans serovar lai str. 56601
uaaaaauucuuaau

SEQ ID NO: 758666 - RNA, 21 nt, Leptospira interrogans serovar lai str. 56601
uaaaaauucgaguaguuaaua

SEQ ID NO: 758667 - RNA, 21 nt, Leptospira interrogans serovar lai str. 56601
uaaaaauuuuauuaaauaaag

SEQ ID NO: 758668 - RNA, 15 nt, Leptospira interrogans serovar lai str. 56601
uaaaaauauggaagc

SEQ ID NO: 758669 - RNA, 22 nt, Leptospira interrogans serovar lai str. 56601
uaaaaauauggaagcuaacaca

SEQ ID NO: 758670 - RNA, 20 nt, Leptospira interrogans serovar lai str. 56601
uaaaaauaguauccaaaauu

SEQ ID NO: 758671 - RNA, 19 nt, Leptospira interrogans serovar lai str. 56601
uaaaaauagccuucaauua

SEQ ID NO: 758672 - RNA, 11 nt, Leptospira interrogans serovar lai str. 56601
uaaaaauauac

SEQ ID NO: 758673 - RNA, 16 nt, Leptospira interrogans serovar lai str. 56601
uaaaaaucucuuuuac

SEQ ID NO: 758674 - RNA, 13 nt, Leptospira interrogans serovar lai str. 56601
uaaaacaaaauag

SEQ ID NO: 758675 - RNA, 15 nt, Leptospira interrogans serovar lai str. 56601
uaaaacaaaauagau

SEQ ID NO: 758676 - RNA, 16 nt, Leptospira interrogans serovar lai str. 56601
uaaaaauuuccggaaa

SEQ ID NO: 758677 - RNA, 19 nt, Leptospira interrogans serovar lai str. 56601
uaaaaauuucuaaagaauu

SEQ ID NO: 758678 - RNA, 16 nt, Leptospira interrogans serovar lai str. 56601
uaaaaauuuuuaauau

SEQ ID NO: 758679 - RNA, 21 nt, Leptospira interrogans serovar lai str. 56601
uaaaacacuuuacauuuuuau

SEQ ID NO: 758680 - RNA, 12 nt, Leptospira interrogans serovar lai str. 56601
uaaaaccaaaau

SEQ ID NO: 758681 - RNA, 10 nt, Leptospira interrogans serovar lai str. 56601
uaaaaccaaa

SEQ ID NO: 758682 - RNA, 20 nt, Leptospira interrogans serovar lai str. 56601
uaaaacccaucguaaacaaa

SEQ ID NO: 758683 - RNA, 21 nt, Leptospira interrogans serovar lai str. 56601
uaaaaccgcugaaaaaaaaau

SEQ ID NO: 758684 - RNA, 15 nt, Leptospira interrogans serovar lai str. 56601
uaaaacuugucccaa

SEQ ID NO: 758685 - RNA, 19 nt, Leptospira interrogans serovar lai str. 56601
uaaaacuuugguuuguaau

SEQ ID NO: 758686 - RNA, 22 nt, Leptospira interrogans serovar lai str. 56601
uaaaacuuuucuaaauugagaa

SEQ ID NO: 758687 - RNA, 14 nt, Leptospira interrogans serovar lai str. 56601
uaaaagaauauuau

SEQ ID NO: 758688 - RNA, 14 nt, Leptospira interrogans serovar lai str. 56601
uaaaagagacauug

SEQ ID NO: 758689 - RNA, 22 nt, Leptospira interrogans serovar lai str. 56601
uaaaagagacauugaagaaaaa

SEQ ID NO: 758690 - RNA, 23 nt, Leptospira interrogans serovar lai str. 56601
uaaaagagacauugaagaaaaaa

SEQ ID NO: 758691 - RNA, 18 nt, Leptospira interrogans serovar lai str. 56601
uaaaagaagauuuuucuu

SEQ ID NO: 758692 - RNA, 14 nt, Leptospira interrogans serovar lai str. 56601
uaaaagaaaauuau

SEQ ID NO: 758693 - RNA, 12 nt, Leptospira interrogans serovar lai str. 56601
uaaaagaucuga

SEQ ID NO: 758694 - RNA, 21 nt, Leptospira interrogans serovar lai str. 56601
uaaaagauuuguuuuauaaaa

SEQ ID NO: 758695 - RNA, 22 nt, Leptospira interrogans serovar lai str. 56601
uaaaagauucguuuuauaaaaa

SEQ ID NO: 758696 - RNA, 16 nt, Leptospira interrogans serovar lai str. 56601
uaaaagauucuauuuu

SEQ ID NO: 758697 - RNA, 20 nt, Leptospira interrogans serovar lai str. 56601
uaaaagagagggucuuucga

SEQ ID NO: 758698 - RNA, 23 nt, Leptospira interrogans serovar lai str. 56601
uaaaagccauuucaaaaauauau

SEQ ID NO: 758699 - RNA, 20 nt, Leptospira interrogans serovar lai str. 56601
uaaaagccgcgaucuaaccg

SEQ ID NO: 758700 - RNA, 19 nt, Leptospira interrogans serovar lai str. 56601
uaaaaccuccggaaaaaac

SEQ ID NO: 758701 - RNA, 12 nt, Leptospira interrogans serovar lai str. 56601
uaaaaccucaaa

SEQ ID NO: 758702 - RNA, 14 nt, Leptospira interrogans serovar lai str. 56601
uaaaaccucaaaaa

SEQ ID NO: 758703 - RNA, 16 nt, Leptospira interrogans serovar lai str. 56601
uaaaaccucaaaaaau

SEQ ID NO: 758704 - RNA, 20 nt, Leptospira interrogans serovar lai str. 56601
uaaaaccguuccauaaauuu

SEQ ID NO: 758705 - RNA, 22 nt, Leptospira interrogans serovar lai str. 56601
uaaaaccguuccauaaauuuug

SEQ ID NO: 758706 - RNA, 20 nt, Leptospira interrogans serovar lai str. 56601
uaaaaccguuuuauaaauau

SEQ ID NO: 758707 - RNA, 21 nt, Leptospira interrogans serovar lai str. 56601
uaaaaccuuuauuuaauaaaa

SEQ ID NO: 758708 - RNA, 15 nt, Leptospira interrogans serovar lai str. 56601
uaaaaccugauuuuu

SEQ ID NO: 758709 - RNA, 24 nt, Leptospira interrogans serovar lai str. 56601
uaaaaccugauuuuucuguaaaaa

SEQ ID NO: 758710 - RNA, 16 nt, Leptospira interrogans serovar lai str. 56601
uaaaacgaauugauaa

SEQ ID NO: 758711 - RNA, 15 nt, Leptospira interrogans serovar lai str. 56601
uaaaacgcucucuac

SEQ ID NO: 758712 - RNA, 16 nt, Leptospira interrogans serovar lai str. 56601
uaaaacggaauuuugu

SEQ ID NO: 758713 - RNA, 20 nt, Leptospira interrogans serovar lai str. 56601
uaaaacuacccagucuccau

SEQ ID NO: 758714 - RNA, 23 nt, Leptospira interrogans serovar lai str. 56601
uaaaacuacuuuccguagaucuu

SEQ ID NO: 758715 - RNA, 14 nt, Leptospira interrogans serovar lai str. 56601
uaaaacucaaagga

SEQ ID NO: 758716 - RNA, 17 nt, Leptospira interrogans serovar lai str. 56601
uaaaacucaaaggaaaa

SEQ ID NO: 758717 - RNA, 21 nt, Leptospira interrogans serovar lai str. 56601
uaaaacucaaaggaaaaugaa

SEQ ID NO: 758718 - RNA, 19 nt, Leptospira interrogans serovar lai str. 56601
uaaaacuguaaauuagauu

SEQ ID NO: 758719 - RNA, 18 nt, Leptospira interrogans serovar lai str. 56601
uaaaacuguacaauagag

SEQ ID NO: 758720 - RNA, 19 nt, Leptospira interrogans serovar lai str. 56601
uaaaacugcgguaauaccu

SEQ ID NO: 758721 - RNA, 20 nt, Leptospira interrogans serovar lai str. 56601
guuuuaaacgauuuaaaaga

SEQ ID NO: 758722 - RNA, 13 nt, Leptospira interrogans serovar lai str. 56601
guuuguaauaguu

SEQ ID NO: 758723 - RNA, 18 nt, Leptospira interrogans serovar lai str. 56601
guuuuaaaacggaauuuu

SEQ ID NO: 758724 - RNA, 17 nt, Leptospira interrogans serovar lai str. 56601
aaaucagggccggagaa

SEQ ID NO: 758725 - RNA, 20 nt, Leptospira interrogans serovar lai str. 56601
aaaucagggccggagaaaau

SEQ ID NO: 758726 - RNA, 19 nt, Leptospira interrogans serovar lai str. 56601
guuugaaacucaguaaaac

SEQ ID NO: 758727 - RNA, 16 nt, Leptospira interrogans serovar lai str. 56601
guuugaaaguucccaa

SEQ ID NO: 758728 - RNA, 20 nt, Leptospira interrogans serovar lai str. 56601
guuugaaaaaauguaacuaa

SEQ ID NO: 758729 - RNA, 18 nt, Leptospira interrogans serovar lai str. 56601
guuuauuuuucuaaaaaa

SEQ ID NO: 758730 - RNA, 17 nt, Leptospira interrogans serovar lai str. 56601
guuuauuuuucuuuuaa

SEQ ID NO: 758731 - RNA, 19 nt, Leptospira interrogans serovar lai str. 56601
guuuauuuuucuuuuaaaa

SEQ ID NO: 758732 - RNA, 14 nt, Leptospira interrogans serovar lai str. 56601
guuuauuuuugaau

SEQ ID NO: 758733 - RNA, 13 nt, Leptospira interrogans serovar lai str. 56601
guuuauuuuaaaa

SEQ ID NO: 758734 - RNA, 17 nt, Leptospira interrogans serovar lai str. 56601
guuuauuuuaaaaaaau

SEQ ID NO: 758735 - RNA, 20 nt, Leptospira interrogans serovar lai str. 56601
guuuauuuuaaaaaaauuuu

SEQ ID NO: 758736 - RNA, 11 nt, Leptospira interrogans serovar lai str. 56601
guuucuugugu

SEQ ID NO: 758737 - RNA, 18 nt, Leptospira interrogans serovar lai str. 56601
guuucuugugucaagccc

SEQ ID NO: 758738 - RNA, 18 nt, Leptospira interrogans serovar lai str. 56601
guuugaauuuuacuaaaa

SEQ ID NO: 758739 - RNA, 13 nt, Leptospira interrogans serovar lai str. 56601
guuugaauuuuua

SEQ ID NO: 758740 - RNA, 22 nt, Leptospira interrogans serovar lai str. 56601
guuugauuugugcaaaaauuuu

SEQ ID NO: 758741 - RNA, 17 nt, Leptospira interrogans serovar lai str. 56601
guuugcaucccagaaca

SEQ ID NO: 758742 - RNA, 19 nt, Leptospira interrogans serovar lai str. 56601
guuugcaucccagaacaaa

SEQ ID NO: 758743 - RNA, 17 nt, Leptospira interrogans serovar lai str. 56601
guuuuaucuaaaauuuc

SEQ ID NO: 758744 - RNA, 22 nt, Leptospira interrogans serovar lai str. 56601
guuuuauagucuucaaaauuga

SEQ ID NO: 758745 - RNA, 10 nt, Leptospira interrogans serovar lai str. 56601
guuuuauucu

SEQ ID NO: 758746 - RNA, 19 nt, Leptospira interrogans serovar lai str. 56601
aaaucagguuuuauaaagu

SEQ ID NO: 758747 - RNA, 20 nt, Leptospira interrogans serovar lai str. 56601
aaaucaguuaauacaaaacu

SEQ ID NO: 758748 - RNA, 17 nt, Leptospira interrogans serovar lai str. 56601
aaaucaugaucaaauuc

SEQ ID NO: 758749 - RNA, 18 nt, Leptospira interrogans serovar lai str. 56601
aaaucaugaucaaauuca

SEQ ID NO: 758750 - RNA, 23 nt, Leptospira interrogans serovar lai str. 56601
aaaucaugauucauuuuucugaa

SEQ ID NO: 758751 - RNA, 21 nt, Leptospira interrogans serovar lai str. 56601
aaaucauggauuuacaguuaa

SEQ ID NO: 758752 - RNA, 13 nt, Leptospira interrogans serovar lai str. 56601
guuuuuaaauuaa

SEQ ID NO: 758753 - RNA, 19 nt, Leptospira interrogans serovar lai str. 56601
guuuuuaaauuaauauuua

SEQ ID NO: 758754 - RNA, 14 nt, Leptospira interrogans serovar lai str. 56601
guuuuguuuccuuc

SEQ ID NO: 758755 - RNA, 15 nt, Leptospira interrogans serovar lai str. 56601
guuuuguuuccuucu

SEQ ID NO: 758756 - RNA, 16 nt, Leptospira interrogans serovar lai str. 56601
guuuuguuuccuucuu

SEQ ID NO: 758757 - RNA, 12 nt, Leptospira interrogans serovar lai str. 56601
guuuuuaaaauc

SEQ ID NO: 758758 - RNA, 17 nt, Leptospira interrogans serovar lai str. 56601
guuuuuaaaaucuucug

SEQ ID NO: 758759 - RNA, 20 nt, Leptospira interrogans serovar lai str. 56601
guuuucuuuaucagaaaaac

SEQ ID NO: 758760 - RNA, 14 nt, Leptospira interrogans serovar lai str. 56601
guuuucuacaaaua

SEQ ID NO: 758761 - RNA, 15 nt, Leptospira interrogans serovar lai str. 56601
guuuucuacaaauaa

SEQ ID NO: 758762 - RNA, 17 nt, Leptospira interrogans serovar lai str. 56601
guuuucuacaaauaaaa

SEQ ID NO: 758763 - RNA, 17 nt, Leptospira interrogans serovar lai str. 56601
guuuucucaaaaucuua

SEQ ID NO: 758764 - RNA, 15 nt, Leptospira interrogans serovar lai str. 56601
guuuuccagaaacca

SEQ ID NO: 758765 - RNA, 17 nt, Leptospira interrogans serovar lai str. 56601
guuuuuuagaaaauuca

SEQ ID NO: 758766 - RNA, 20 nt, Leptospira interrogans serovar lai str. 56601
guuuuuuagaaacuaaaaaa

SEQ ID NO: 758767 - RNA, 21 nt, Leptospira interrogans serovar lai str. 56601
guuuuuuaaucggagaauuua

SEQ ID NO: 758768 - RNA, 13 nt, Leptospira interrogans serovar lai str. 56601
guuuuuuaaaaaa

SEQ ID NO: 758769 - RNA, 15 nt, Leptospira interrogans serovar lai str. 56601
guuuuuuaaaaugua

SEQ ID NO: 758770 - RNA, 17 nt, Leptospira interrogans serovar lai str. 56601
guuuuuuaaaauguagg

SEQ ID NO: 758771 - RNA, 11 nt, Leptospira interrogans serovar lai str. 56601
guuuuuuaaau

SEQ ID NO: 758772 - RNA, 17 nt, Leptospira interrogans serovar lai str. 56601
guuuuuucuuuaaaauc

SEQ ID NO: 758773 - RNA, 16 nt, Leptospira interrogans serovar lai str. 56601
guuuuuucguaaaaaa

SEQ ID NO: 758774 - RNA, 19 nt, Leptospira interrogans serovar lai str. 56601
guuuuuuauggaaaaauga

SEQ ID NO: 758775 - RNA, 20 nt, Leptospira interrogans serovar lai str. 56601
guuuuuuccagcccauucuu

SEQ ID NO: 758776 - RNA, 23 nt, Leptospira interrogans serovar lai str. 56601
guuuuucugauaaagaaaaccuu

SEQ ID NO: 758777 - RNA, 13 nt, Leptospira interrogans serovar lai str. 56601
guuuuuaauuucg

SEQ ID NO: 758778 - RNA, 22 nt, Leptospira interrogans serovar lai str. 56601
uaaaaaaccgucccaaaaucuu

SEQ ID NO: 758779 - RNA, 19 nt, Leptospira interrogans serovar lai str. 56601
uaaaaaaauuuuuaugacu

SEQ ID NO: 758780 - RNA, 12 nt, Leptospira interrogans serovar lai str. 56601
uaaaaaacauaa

SEQ ID NO: 758781 - RNA, 17 nt, Leptospira interrogans serovar lai str. 56601
uaaaaaacauaaaaauu

SEQ ID NO: 758782 - RNA, 13 nt, Leptospira interrogans serovar lai str. 56601
uaaaaaacucaau

SEQ ID NO: 758783 - RNA, 15 nt, Leptospira interrogans serovar lai str. 56601
uaaaaaagauaaaaa

SEQ ID NO: 758784 - RNA, 16 nt, Leptospira interrogans serovar lai str. 56601
uaaaaaagauaaaaag

SEQ ID NO: 758785 - RNA, 15 nt, Leptospira interrogans serovar lai str. 56601
uaaaaaaauauuaaa

SEQ ID NO: 758786 - RNA, 16 nt, Leptospira interrogans serovar lai str. 56601
uaaaaaaauauuaaaa

SEQ ID NO: 758787 - RNA, 12 nt, Leptospira interrogans serovar lai str. 56601
uaaaaaaauaag

SEQ ID NO: 758788 - RNA, 13 nt, Leptospira interrogans serovar lai str. 56601
uaaaaaaauaaua

SEQ ID NO: 758789 - RNA, 14 nt, Leptospira interrogans serovar lai str. 56601
uaaaaaaauaauaa

SEQ ID NO: 758790 - RNA, 13 nt, Leptospira interrogans serovar lai str. 56601
uaaaaaaauguuu

SEQ ID NO: 758791 - RNA, 13 nt, Leptospira interrogans serovar lai str. 56601
uaaaaaaauuaaa

SEQ ID NO: 758792 - RNA, 12 nt, Leptospira interrogans serovar lai str. 56601
uaaaaaaauaga

SEQ ID NO: 758793 - RNA, 13 nt, Leptospira interrogans serovar lai str. 56601
uaaaaaaauagau

SEQ ID NO: 758794 - RNA, 19 nt, Leptospira interrogans serovar lai str. 56601
uaaaaaaauuaaaaaagag

SEQ ID NO: 758795 - RNA, 12 nt, Leptospira interrogans serovar lai str. 56601
guuuuuuuucaa

SEQ ID NO: 758796 - RNA, 16 nt, Leptospira interrogans serovar lai str. 56601
uaaaaaaaaauguaaa

SEQ ID NO: 758797 - RNA, 12 nt, Leptospira interrogans serovar lai str. 56601
uaaaaaauuacc

SEQ ID NO: 758798 - RNA, 18 nt, Leptospira interrogans serovar lai str. 56601
uaaaaaaacaugaagaag

SEQ ID NO: 758799 - RNA, 15 nt, Leptospira interrogans serovar lai str. 56601
uaaaaaauucaauuc

SEQ ID NO: 758800 - RNA, 13 nt, Leptospira interrogans serovar lai str. 56601
uaaaaaauucuuu

SEQ ID NO: 758801 - RNA, 18 nt, Leptospira interrogans serovar lai str. 56601
uaaaaacaacucagcaca

SEQ ID NO: 758802 - RNA, 19 nt, Leptospira interrogans serovar lai str. 56601
uaaaaacaaaaucaaagau

SEQ ID NO: 758803 - RNA, 18 nt, Leptospira interrogans serovar lai str. 56601
uaaaaaauuucuucaauu

SEQ ID NO: 758804 - RNA, 15 nt, Leptospira interrogans serovar lai str. 56601
uaaaaaaucccggau

SEQ ID NO: 758805 - RNA, 22 nt, Leptospira interrogans serovar lai str. 56601
uaaaaaaucauauccaauuuca

SEQ ID NO: 758806 - RNA, 21 nt, Leptospira interrogans serovar lai str. 56601
uaaaaaaugaauguuuaaaau

SEQ ID NO: 758807 - RNA, 12 nt, Leptospira interrogans serovar lai str. 56601
uaaaaaauacaa

SEQ ID NO: 758808 - RNA, 11 nt, Leptospira interrogans serovar lai str. 56601
uaaaaaauagg

SEQ ID NO: 758809 - RNA, 13 nt, Leptospira interrogans serovar lai str. 56601
uaaaaaaugaaug

SEQ ID NO: 758810 - RNA, 18 nt, Leptospira interrogans serovar lai str. 56601
uaaaaacucuaccuuuau

SEQ ID NO: 758811 - RNA, 21 nt, Leptospira interrogans serovar lai str. 56601
uaaaaaccguuuucaauuauu

SEQ ID NO: 758812 - RNA, 21 nt, Leptospira interrogans serovar lai str. 56601
uaaaaacgagacgcugaauua

SEQ ID NO: 758813 - RNA, 17 nt, Leptospira interrogans serovar lai str. 56601
uaaaaaccccauuaaaa

SEQ ID NO: 758814 - RNA, 18 nt, Leptospira interrogans serovar lai str. 56601
uaaaaaccacaaaaacaa

SEQ ID NO: 758815 - RNA, 20 nt, Leptospira interrogans serovar lai str. 56601
uaaaaauaauacaauucuga

SEQ ID NO: 758816 - RNA, 20 nt, Leptospira interrogans serovar lai str. 56601
uaaaaaguacauggcaucca

SEQ ID NO: 758817 - RNA, 21 nt, Leptospira interrogans serovar lai str. 56601
uaaaaagucugucuuaaaauu

SEQ ID NO: 758818 - RNA, 18 nt, Leptospira interrogans serovar lai str. 56601
uaaaaagugaauuaaaag

SEQ ID NO: 758819 - RNA, 21 nt, Leptospira interrogans serovar lai str. 56601
uaaaaaguuuuucuaaauuuu

SEQ ID NO: 758820 - RNA, 18 nt, Leptospira interrogans serovar lai str. 56601
uaaaaagagacguaaucu

SEQ ID NO: 758821 - RNA, 21 nt, Leptospira interrogans serovar lai str. 56601
uaaaaacuucacuucuuuuag

SEQ ID NO: 758822 - RNA, 23 nt, Leptospira interrogans serovar lai str. 56601
uaaaaacuugauauuucuguaaa

SEQ ID NO: 758823 - RNA, 14 nt, Leptospira interrogans serovar lai str. 56601
uaaaaagaguauua

SEQ ID NO: 758824 - RNA, 22 nt, Leptospira interrogans serovar lai str. 56601
uaaaaagauuaucuucuaauua

SEQ ID NO: 758825 - RNA, 16 nt, Leptospira interrogans serovar lai str. 56601
uaaaaagcguuucauu

SEQ ID NO: 758826 - RNA, 16 nt, Leptospira interrogans serovar lai str. 56601
uaaccaaccccacaag

SEQ ID NO: 758827 - RNA, 17 nt, Leptospira interrogans serovar lai str. 56601
uaacccauucaacauca

SEQ ID NO: 758828 - RNA, 15 nt, Leptospira interrogans serovar lai str. 56601
uaaccgcaaaaucau

SEQ ID NO: 758829 - RNA, 23 nt, Leptospira interrogans serovar lai str. 56601
uaaccugcaacaccaauucgguu

SEQ ID NO: 758830 - RNA, 14 nt, Leptospira interrogans serovar lai str. 56601
uaaccuuuguuucc

SEQ ID NO: 758831 - RNA, 16 nt, Leptospira interrogans serovar lai str. 56601
uaacaguaagaagaaa

SEQ ID NO: 758832 - RNA, 19 nt, Leptospira interrogans serovar lai str. 56601
uaacaguaagaagaaaagg

SEQ ID NO: 758833 - RNA, 16 nt, Leptospira interrogans serovar lai str. 56601
uaacaaucaauugaaa

SEQ ID NO: 758834 - RNA, 17 nt, Leptospira interrogans serovar lai str. 56601
uaacaaucaauugaaag

SEQ ID NO: 758835 - RNA, 14 nt, Leptospira interrogans serovar lai str. 56601
uaacauuuuauuau

SEQ ID NO: 758836 - RNA, 16 nt, Leptospira interrogans serovar lai str. 56601
uaacauuuuauuauaa

SEQ ID NO: 758837 - RNA, 22 nt, Leptospira interrogans serovar lai str. 56601
uaacauuuuauuauaaauuuau

SEQ ID NO: 758838 - RNA, 19 nt, Leptospira interrogans serovar lai str. 56601
uaacauuuguuuuuuauaa

SEQ ID NO: 758839 - RNA, 14 nt, Leptospira interrogans serovar lai str. 56601
uaacauuuuuucau

SEQ ID NO: 758840 - RNA, 15 nt, Leptospira interrogans serovar lai str. 56601
uaacaucaaagaauc

SEQ ID NO: 758841 - RNA, 16 nt, Leptospira interrogans serovar lai str. 56601
uaaaugaguuuuagaa

SEQ ID NO: 758842 - RNA, 19 nt, Leptospira interrogans serovar lai str. 56601
uaaaugaguuuuagaauau

SEQ ID NO: 758843 - RNA, 23 nt, Leptospira interrogans serovar lai str. 56601
uaaaugaguuuuagaauauuaag

SEQ ID NO: 758844 - RNA, 18 nt, Leptospira interrogans serovar lai str. 56601
uaaaugacuugcauuuaa

SEQ ID NO: 758845 - RNA, 20 nt, Leptospira interrogans serovar lai str. 56601
uaaaugacuugcauuuaaua

SEQ ID NO: 758846 - RNA, 21 nt, Leptospira interrogans serovar lai str. 56601
uaaaugacuugcauuuaauau

SEQ ID NO: 758847 - RNA, 23 nt, Leptospira interrogans serovar lai str. 56601
uaaaugacuugcauuuaauauau

SEQ ID NO: 758848 - RNA, 16 nt, Leptospira interrogans serovar lai str. 56601
uaaaugaauuuagaaa

SEQ ID NO: 758849 - RNA, 15 nt, Leptospira interrogans serovar lai str. 56601
uaaaugaauuuuaaa

SEQ ID NO: 758850 - RNA, 19 nt, Leptospira interrogans serovar lai str. 56601
uaaaugauacuuuguaaaa

SEQ ID NO: 758851 - RNA, 15 nt, Leptospira interrogans serovar lai str. 56601
uaaauguauguuuac

SEQ ID NO: 758852 - RNA, 16 nt, Leptospira interrogans serovar lai str. 56601
uaaaugggauuuugua

SEQ ID NO: 758853 - RNA, 18 nt, Leptospira interrogans serovar lai str. 56601
uaaauauuuuuuuuaauc

SEQ ID NO: 758854 - RNA, 16 nt, Leptospira interrogans serovar lai str. 56601
uaaaucaccuuuuacu

SEQ ID NO: 758855 - RNA, 20 nt, Leptospira interrogans serovar lai str. 56601
uaaaucaccuuuuacuucau

SEQ ID NO: 758856 - RNA, 15 nt, Leptospira interrogans serovar lai str. 56601
uaaaucuaauucuuc

SEQ ID NO: 758857 - RNA, 21 nt, Leptospira interrogans serovar lai str. 56601
uaaaucaauccucuuugaaau

SEQ ID NO: 758858 - RNA, 13 nt, Leptospira interrogans serovar lai str. 56601
uaaaucaaucuac

SEQ ID NO: 758859 - RNA, 18 nt, Leptospira interrogans serovar lai str. 56601
uaaaucaaucuacuugaa

SEQ ID NO: 758860 - RNA, 20 nt, Leptospira interrogans serovar lai str. 56601
uaaaucaaucuacuugaauu

SEQ ID NO: 758861 - RNA, 13 nt, Leptospira interrogans serovar lai str. 56601
uaaaucuuagauu

SEQ ID NO: 758862 - RNA, 21 nt, Leptospira interrogans serovar lai str. 56601
uaaaucuuaggaacuuuuaua

SEQ ID NO: 758863 - RNA, 14 nt, Leptospira interrogans serovar lai str. 56601
uaaaucuauucuua

SEQ ID NO: 758864 - RNA, 16 nt, Leptospira interrogans serovar lai str. 56601
uaaaucuauucuuaaa

SEQ ID NO: 758865 - RNA, 21 nt, Leptospira interrogans serovar lai str. 56601
uaaaucuauucuuaaaaugua

SEQ ID NO: 758866 - RNA, 17 nt, Leptospira interrogans serovar lai str. 56601
uaaauuagcuuaagaau

SEQ ID NO: 758867 - RNA, 18 nt, Leptospira interrogans serovar lai str. 56601
uaaauuagcuuaagaauu

SEQ ID NO: 758868 - RNA, 19 nt, Leptospira interrogans serovar lai str. 56601
uaaauuagaaaauuauaaa

SEQ ID NO: 758869 - RNA, 15 nt, Leptospira interrogans serovar lai str. 56601
uaaauuagauuauuu

SEQ ID NO: 758870 - RNA, 20 nt, Leptospira interrogans serovar lai str. 56601
uaaauuacugauuucaaaaa

SEQ ID NO: 758871 - RNA, 17 nt, Leptospira interrogans serovar lai str. 56601
uaaauugcacaaaagaa

SEQ ID NO: 758872 - RNA, 18 nt, Leptospira interrogans serovar lai str. 56601
uaaauugcauaaaagaaa

SEQ ID NO: 758873 - RNA, 15 nt, Leptospira interrogans serovar lai str. 56601
uaaauuauauacagg

SEQ ID NO: 758874 - RNA, 18 nt, Leptospira interrogans serovar lai str. 56601
uaaauuuacuauuuugau

SEQ ID NO: 758875 - RNA, 20 nt, Leptospira interrogans serovar lai str. 56601
uaaauuguucguuucuuaau

SEQ ID NO: 758876 - RNA, 19 nt, Leptospira interrogans serovar lai str. 56601
uaaauuguuucauaaaauu

SEQ ID NO: 758877 - RNA, 15 nt, Leptospira interrogans serovar lai str. 56601
uaaauuguaugcagu

SEQ ID NO: 758878 - RNA, 20 nt, Leptospira interrogans serovar lai str. 56601
uaaauuguauaaaagaaaca

SEQ ID NO: 758879 - RNA, 23 nt, Leptospira interrogans serovar lai str. 56601
uaaauuguauaaaagaaacauaa

SEQ ID NO: 758880 - RNA, 21 nt, Leptospira interrogans serovar lai str. 56601
uaaauuggguaucuaaauauu

SEQ ID NO: 758881 - RNA, 19 nt, Leptospira interrogans serovar lai str. 56601
uaaauuucauaucuaaaau

SEQ ID NO: 758882 - RNA, 22 nt, Leptospira interrogans serovar lai str. 56601
uaaauuucauaucuaaaaugga

SEQ ID NO: 758883 - RNA, 16 nt, Leptospira interrogans serovar lai str. 56601
uaaauuuauaaaugua

SEQ ID NO: 758884 - RNA, 16 nt, Leptospira interrogans serovar lai str. 56601
uaaauuuauaauucaa

SEQ ID NO: 758885 - RNA, 17 nt, Leptospira interrogans serovar lai str. 56601
uaaauuuaucuauaaaa

SEQ ID NO: 758886 - RNA, 18 nt, Leptospira interrogans serovar lai str. 56601
uaaauuuaucuauaaaau

SEQ ID NO: 758887 - RNA, 20 nt, Leptospira interrogans serovar lai str. 56601
uaaauuuuacaauuaaacuu

SEQ ID NO: 758888 - RNA, 20 nt, Leptospira interrogans serovar lai str. 56601
uaaauuugugguaguuccua

SEQ ID NO: 758889 - RNA, 19 nt, Leptospira interrogans serovar lai str. 56601
uaaauuuguugcaauacau

SEQ ID NO: 758890 - RNA, 20 nt, Leptospira interrogans serovar lai str. 56601
uaaauuuguaauaguuccca

SEQ ID NO: 758891 - RNA, 13 nt, Leptospira interrogans serovar lai str. 56601
uaaauuuuauaaa

SEQ ID NO: 758892 - RNA, 15 nt, Leptospira interrogans serovar lai str. 56601
uaacaaauuuaaaau

SEQ ID NO: 758893 - RNA, 18 nt, Leptospira interrogans serovar lai str. 56601
uaacaaaguauuuaauuu

SEQ ID NO: 758894 - RNA, 21 nt, Leptospira interrogans serovar lai str. 56601
uaacaauagcuuaaaagugau

SEQ ID NO: 758895 - RNA, 22 nt, Leptospira interrogans serovar lai str. 56601
uaacaauagcuuaaaagugauu

SEQ ID NO: 758896 - RNA, 21 nt, Leptospira interrogans serovar lai str. 56601
uaacaaccaccuuuacauaau

SEQ ID NO: 758897 - RNA, 17 nt, Leptospira interrogans serovar lai str. 56601
uaaauaaagguuuuaua

SEQ ID NO: 758898 - RNA, 16 nt, Leptospira interrogans serovar lai str. 56601
uaaauacaaaaauucu

SEQ ID NO: 758899 - RNA, 20 nt, Leptospira interrogans serovar lai str. 56601
uaaauacaaaaauucuaaua

SEQ ID NO: 758900 - RNA, 13 nt, Leptospira interrogans serovar lai str. 56601
uaaauacaaaaau

SEQ ID NO: 758901 - RNA, 19 nt, Leptospira interrogans serovar lai str. 56601
uaaauacauacaaugaaaa

SEQ ID NO: 758902 - RNA, 17 nt, Leptospira interrogans serovar lai str. 56601
uaaauauuuccaaauug

SEQ ID NO: 758903 - RNA, 23 nt, Leptospira interrogans serovar lai str. 56601
uaaauagggcucgguaaaaagau

SEQ ID NO: 758904 - RNA, 18 nt, Leptospira interrogans serovar lai str. 56601
uaaauagauucaaaaguc

SEQ ID NO: 758905 - RNA, 19 nt, Leptospira interrogans serovar lai str. 56601
uaaauaccuaaauauuuau

SEQ ID NO: 758906 - RNA, 13 nt, Leptospira interrogans serovar lai str. 56601
uaaauaccuguuc

SEQ ID NO: 758907 - RNA, 18 nt, Leptospira interrogans serovar lai str. 56601
uaaauacuuuauaauuga

SEQ ID NO: 758908 - RNA, 21 nt, Leptospira interrogans serovar lai str. 56601
uaaauacuuuauaauugaaca

SEQ ID NO: 758909 - RNA, 11 nt, Leptospira interrogans serovar lai str. 56601
uaaagguugag

SEQ ID NO: 758910 - RNA, 22 nt, Leptospira interrogans serovar lai str. 56601
uaaagguugagcaguaaaaucu

SEQ ID NO: 758911 - RNA, 22 nt, Leptospira interrogans serovar lai str. 56601
uaaagguugaguaguaaaaucu

SEQ ID NO: 758912 - RNA, 16 nt, Leptospira interrogans serovar lai str. 56601
uaaaggugcaugaaaa

SEQ ID NO: 758913 - RNA, 22 nt, Leptospira interrogans serovar lai str. 56601
uaaaggugcaugaaaauaauau

SEQ ID NO: 758914 - RNA, 15 nt, Leptospira interrogans serovar lai str. 56601
uaaaggaauccauga

SEQ ID NO: 758915 - RNA, 17 nt, Leptospira interrogans serovar lai str. 56601
uaaagcgggauuuugau

SEQ ID NO: 758916 - RNA, 14 nt, Leptospira interrogans serovar lai str. 56601
uaaagauuuccuaa

SEQ ID NO: 758917 - RNA, 16 nt, Leptospira interrogans serovar lai str. 56601
uaaagauuuucuaaga

SEQ ID NO: 758918 - RNA, 17 nt, Leptospira interrogans serovar lai str. 56601
uaaagcaaauaccaaac

SEQ ID NO: 758919 - RNA, 20 nt, Leptospira interrogans serovar lai str. 56601
uaaagcaaauaccaaaccuc

SEQ ID NO: 758920 - RNA, 16 nt, Leptospira interrogans serovar lai str. 56601
uaaagaagaguugaau

SEQ ID NO: 758921 - RNA, 18 nt, Leptospira interrogans serovar lai str. 56601
uaaagaagaguugaauau

SEQ ID NO: 758922 - RNA, 16 nt, Leptospira interrogans serovar lai str. 56601
uaaagaagggaugaaa

SEQ ID NO: 758923 - RNA, 18 nt, Leptospira interrogans serovar lai str. 56601
uaaagaagggaugaaauu

SEQ ID NO: 758924 - RNA, 21 nt, Leptospira interrogans serovar lai str. 56601
uaaagacgauuccuaaaaauu

SEQ ID NO: 758925 - RNA, 19 nt, Leptospira interrogans serovar lai str. 56601
uaaagacgauugauucuaa

SEQ ID NO: 758926 - RNA, 16 nt, Leptospira interrogans serovar lai str. 56601
uaaagacuuuaaauga

SEQ ID NO: 758927 - RNA, 18 nt, Leptospira interrogans serovar lai str. 56601
uaaagagaaaacaauuca

SEQ ID NO: 758928 - RNA, 13 nt, Leptospira interrogans serovar lai str. 56601
uaaaauuugaaaa

SEQ ID NO: 758929 - RNA, 18 nt, Leptospira interrogans serovar lai str. 56601
uaaaauuugaaaguaaaa

SEQ ID NO: 758930 - RNA, 19 nt, Leptospira interrogans serovar lai str. 56601
uaaaauuugaaaguaaaaa

SEQ ID NO: 758931 - RNA, 22 nt, Leptospira interrogans serovar lai str. 56601
uaaaauuugaaaguaaaaaaga

SEQ ID NO: 758932 - RNA, 12 nt, Leptospira interrogans serovar lai str. 56601
uaaaauuucauu

SEQ ID NO: 758933 - RNA, 15 nt, Leptospira interrogans serovar lai str. 56601
uaaaauuucauuucu

SEQ ID NO: 758934 - RNA, 17 nt, Leptospira interrogans serovar lai str. 56601
uaaaauuucauuuuacu

SEQ ID NO: 758935 - RNA, 22 nt, Leptospira interrogans serovar lai str. 56601
uaaaauuuacggaacuuaauuu

SEQ ID NO: 758936 - RNA, 16 nt, Leptospira interrogans serovar lai str. 56601
uaaaauuuagaaauag

SEQ ID NO: 758937 - RNA, 14 nt, Leptospira interrogans serovar lai str. 56601
uaaaauuuagauuu

SEQ ID NO: 758938 - RNA, 22 nt, Leptospira interrogans serovar lai str. 56601
uaaaauugaguaccauaaauuu

SEQ ID NO: 758939 - RNA, 19 nt, Leptospira interrogans serovar lai str. 56601
uaaaauugaauacguuauu

SEQ ID NO: 758940 - RNA, 13 nt, Leptospira interrogans serovar lai str. 56601
uaaaauugaauau

SEQ ID NO: 758941 - RNA, 17 nt, Leptospira interrogans serovar lai str. 56601
uaaaauugaauaucaua

SEQ ID NO: 758942 - RNA, 19 nt, Leptospira interrogans serovar lai str. 56601
uaaaauugaauauugagcu

SEQ ID NO: 758943 - RNA, 16 nt, Leptospira interrogans serovar lai str. 56601
uaaaauuuaaaauucu

SEQ ID NO: 758944 - RNA, 13 nt, Leptospira interrogans serovar lai str. 56601
uaaaauuuaaaga

SEQ ID NO: 758945 - RNA, 12 nt, Leptospira interrogans serovar lai str. 56601
uaaaauuuaaau

SEQ ID NO: 758946 - RNA, 19 nt, Leptospira interrogans serovar lai str. 56601
uaaaauuccgaauucuaaa

SEQ ID NO: 758947 - RNA, 19 nt, Leptospira interrogans serovar lai str. 56601
uaaaauucuagaaagaauu

SEQ ID NO: 758948 - RNA, 20 nt, Leptospira interrogans serovar lai str. 56601
uaaaauucuuagaguaaaac

SEQ ID NO: 758949 - RNA, 23 nt, Leptospira interrogans serovar lai str. 56601
uaaaauuagauuuguguuauuca

SEQ ID NO: 758950 - RNA, 14 nt, Leptospira interrogans serovar lai str. 56601
uaaaauuauaggaa

SEQ ID NO: 758951 - RNA, 16 nt, Leptospira interrogans serovar lai str. 56601
uaaaauuauuaacuaa

SEQ ID NO: 758952 - RNA, 15 nt, Leptospira interrogans serovar lai str. 56601
uaaaauucaaaaaga

SEQ ID NO: 758953 - RNA, 18 nt, Leptospira interrogans serovar lai str. 56601
uaaaauuuuucucccuua

SEQ ID NO: 758954 - RNA, 11 nt, Leptospira interrogans serovar lai str. 56601
uaaaauuuuuu

SEQ ID NO: 758955 - RNA, 19 nt, Leptospira interrogans serovar lai str. 56601
uaaaauuuuuugagguuuu

SEQ ID NO: 758956 - RNA, 18 nt, Leptospira interrogans serovar lai str. 56601
uaaaauuuuuuuaagaau

SEQ ID NO: 758957 - RNA, 19 nt, Leptospira interrogans serovar lai str. 56601
uaaaauuuuuuuaagaauu

SEQ ID NO: 758958 - RNA, 17 nt, Leptospira interrogans serovar lai str. 56601
uaaaauuuuuaaaaaau

SEQ ID NO: 758959 - RNA, 19 nt, Leptospira interrogans serovar lai str. 56601
uaaaauuuuuaauaaaaug

SEQ ID NO: 758960 - RNA, 14 nt, Leptospira interrogans serovar lai str. 56601
uaaaauuuguagga

SEQ ID NO: 758961 - RNA, 23 nt, Leptospira interrogans serovar lai str. 56601
uaaaauuuuauacuuuaauaaua

SEQ ID NO: 758962 - RNA, 22 nt, Leptospira interrogans serovar lai str. 56601
uaaaauuuucaucuuuuccauu

SEQ ID NO: 758963 - RNA, 23 nt, Leptospira interrogans serovar lai str. 56601
uaaaauuuucaucuuuuccauug

SEQ ID NO: 758964 - RNA, 14 nt, Leptospira interrogans serovar lai str. 56601
uaaaauuuucauuu

SEQ ID NO: 758965 - RNA, 20 nt, Leptospira interrogans serovar lai str. 56601
uaaacaaaauucaaaugucu

SEQ ID NO: 758966 - RNA, 19 nt, Leptospira interrogans serovar lai str. 56601
uaaacagucgcuaaacuca

SEQ ID NO: 758967 - RNA, 17 nt, Leptospira interrogans serovar lai str. 56601
uaaacaauaugaaagga

SEQ ID NO: 758968 - RNA, 22 nt, Leptospira interrogans serovar lai str. 56601
uaaacacaaucgucaucucgaa

SEQ ID NO: 758969 - RNA, 13 nt, Leptospira interrogans serovar lai str. 56601
uaaacaauuuuau

SEQ ID NO: 758970 - RNA, 16 nt, Leptospira interrogans serovar lai str. 56601
uaaacuucuauuuuga

SEQ ID NO: 758971 - RNA, 21 nt, Leptospira interrogans serovar lai str. 56601
uaaacuucuauuuuuuaauug

SEQ ID NO: 758972 - RNA, 17 nt, Leptospira interrogans serovar lai str. 56601
uaaacuucucuuaaaau

SEQ ID NO: 758973 - RNA, 15 nt, Leptospira interrogans serovar lai str. 56601
uaaacuugauuaaac

SEQ ID NO: 758974 - RNA, 19 nt, Leptospira interrogans serovar lai str. 56601
uaaacuuuaaucauuuuca

SEQ ID NO: 758975 - RNA, 17 nt, Leptospira interrogans serovar lai str. 56601
uaaacuuucaaagaaua

SEQ ID NO: 758976 - RNA, 12 nt, Leptospira interrogans serovar lai str. 56601
uaaacuaaaaaa

SEQ ID NO: 758977 - RNA, 18 nt, Leptospira interrogans serovar lai str. 56601
uaaacuaaaaaaaauagg

SEQ ID NO: 758978 - RNA, 13 nt, Leptospira interrogans serovar lai str. 56601
uaaacguauaaaa

SEQ ID NO: 758979 - RNA, 14 nt, Leptospira interrogans serovar lai str. 56601
uaaacguauaaaaa

SEQ ID NO: 758980 - RNA, 18 nt, Leptospira interrogans serovar lai str. 56601
uaaacuuuguaaaucuau

SEQ ID NO: 758981 - RNA, 14 nt, Leptospira interrogans serovar lai str. 56601
uaaacuuuuauaaa

SEQ ID NO: 758982 - RNA, 17 nt, Leptospira interrogans serovar lai str. 56601
uaaacuuuuauaaaauc

SEQ ID NO: 758983 - RNA, 19 nt, Leptospira interrogans serovar lai str. 56601
uaaacuuuuauaaaaucua

SEQ ID NO: 758984 - RNA, 12 nt, Leptospira interrogans serovar lai str. 56601
uaaacuuugaaa

SEQ ID NO: 758985 - RNA, 16 nt, Leptospira interrogans serovar lai str. 56601
uaaaccaucucaaaaa

SEQ ID NO: 758986 - RNA, 20 nt, Leptospira interrogans serovar lai str. 56601
uaaacauccaauuauaaaau

SEQ ID NO: 758987 - RNA, 16 nt, Leptospira interrogans serovar lai str. 56601
uaaacauuagaguugu

SEQ ID NO: 758988 - RNA, 17 nt, Leptospira interrogans serovar lai str. 56601
uaaacgaucagaaaaac

SEQ ID NO: 758989 - RNA, 20 nt, Leptospira interrogans serovar lai str. 56601
uaaacgauuauuuuuuaaaa

SEQ ID NO: 758990 - RNA, 23 nt, Leptospira interrogans serovar lai str. 56601
uaaacgauuauuuuuuaaaaauc

SEQ ID NO: 758991 - RNA, 14 nt, Leptospira interrogans serovar lai str. 56601
uaaacgauuuaaaa

SEQ ID NO: 758992 - RNA, 17 nt, Leptospira interrogans serovar lai str. 56601
uaaacgauuuuauacau

SEQ ID NO: 758993 - RNA, 18 nt, Leptospira interrogans serovar lai str. 56601
uaaacgauuuuauacauu

SEQ ID NO: 758994 - RNA, 13 nt, Leptospira interrogans serovar lai str. 56601
uaaaccuucuuua

SEQ ID NO: 758995 - RNA, 15 nt, Leptospira interrogans serovar lai str. 56601
guuggauuccuuucu

SEQ ID NO: 758996 - RNA, 20 nt, Leptospira interrogans serovar lai str. 56601
guuguacaaaaaugugggaa

SEQ ID NO: 758997 - RNA, 19 nt, Leptospira interrogans serovar lai str. 56601
guuguaaguaucuaaaagu

SEQ ID NO: 758998 - RNA, 20 nt, Leptospira interrogans serovar lai str. 56601
guuguacucugcaaaauuua

SEQ ID NO: 758999 - RNA, 23 nt, Leptospira interrogans serovar lai str. 56601
guuguagaucaaaucugaaauuc

SEQ ID NO: 759000 - RNA, 18 nt, Leptospira interrogans serovar lai str. 56601
guugggaucuaaacuuug

SEQ ID NO: 759001 - RNA, 22 nt, Leptospira interrogans serovar lai str. 56601
guuuauacuuuaauaauaugaa

SEQ ID NO: 759002 - RNA, 22 nt, Leptospira interrogans serovar lai str. 56601
guuuauucacuuguuauuaaaa

SEQ ID NO: 759003 - RNA, 23 nt, Leptospira interrogans serovar lai str. 56601
guuuacgaucugcuuuuuuaaac

SEQ ID NO: 759004 - RNA, 21 nt, Leptospira interrogans serovar lai str. 56601
guuuacaucaacucuguaaau

SEQ ID NO: 759005 - RNA, 14 nt, Leptospira interrogans serovar lai str. 56601
guuuacaaacuuac

SEQ ID NO: 759006 - RNA, 18 nt, Leptospira interrogans serovar lai str. 56601
guuuacccgauauuaaaa

SEQ ID NO: 759007 - RNA, 17 nt, Leptospira interrogans serovar lai str. 56601
guuuacauaucaauccu

SEQ ID NO: 759008 - RNA, 17 nt, Leptospira interrogans serovar lai str. 56601
guuuaauuguuauaaac

SEQ ID NO: 759009 - RNA, 15 nt, Leptospira interrogans serovar lai str. 56601
guuuaaaaacagaau

SEQ ID NO: 759010 - RNA, 21 nt, Leptospira interrogans serovar lai str. 56601
guuuaauuucuucauaucaaa

SEQ ID NO: 759011 - RNA, 15 nt, Leptospira interrogans serovar lai str. 56601
guuguuaaauuuuug

SEQ ID NO: 759012 - RNA, 16 nt, Leptospira interrogans serovar lai str. 56601
guuguuauggaauuuu

SEQ ID NO: 759013 - RNA, 19 nt, Leptospira interrogans serovar lai str. 56601
guuguuauggaauuuuuca

SEQ ID NO: 759014 - RNA, 17 nt, Leptospira interrogans serovar lai str. 56601
guuguugaaaaauuaau

SEQ ID NO: 759015 - RNA, 14 nt, Leptospira interrogans serovar lai str. 56601
guuuaaaugaaaug

SEQ ID NO: 759016 - RNA, 16 nt, Leptospira interrogans serovar lai str. 56601
guuuaaagaauuuuua

SEQ ID NO: 759017 - RNA, 22 nt, Leptospira interrogans serovar lai str. 56601
guuuaaaagccagaauuuugaa

SEQ ID NO: 759018 - RNA, 21 nt, Leptospira interrogans serovar lai str. 56601
guuguuuacccgauauuaaaa

SEQ ID NO: 759019 - RNA, 14 nt, Leptospira interrogans serovar lai str. 56601
guugcaaaaaagaa

SEQ ID NO: 759020 - RNA, 16 nt, Leptospira interrogans serovar lai str. 56601
guugcaaaaaagaaag

SEQ ID NO: 759021 - RNA, 20 nt, Leptospira interrogans serovar lai str. 56601
guugcaaaaaagaaagcagc

SEQ ID NO: 759022 - RNA, 16 nt, Leptospira interrogans serovar lai str. 56601
guugcaaagaagaaau

SEQ ID NO: 759023 - RNA, 22 nt, Leptospira interrogans serovar lai str. 56601
guugaaucuuaaaucuuuaaaa

SEQ ID NO: 759024 - RNA, 16 nt, Leptospira interrogans serovar lai str. 56601
guugaauauuuucauc

SEQ ID NO: 759025 - RNA, 20 nt, Leptospira interrogans serovar lai str. 56601
guugaauaggauuuuagaau

SEQ ID NO: 759026 - RNA, 20 nt, Leptospira interrogans serovar lai str. 56601
guugaauaagauuuuagaau

SEQ ID NO: 759027 - RNA, 22 nt, Leptospira interrogans serovar lai str. 56601
guugaagcggaguuccuacauu

SEQ ID NO: 759028 - RNA, 14 nt, Leptospira interrogans serovar lai str. 56601
guucuaaaaacuca

SEQ ID NO: 759029 - RNA, 19 nt, Leptospira interrogans serovar lai str. 56601
guucugggcucaaaaaggc

SEQ ID NO: 759030 - RNA, 15 nt, Leptospira interrogans serovar lai str. 56601
guucuuaaaauugug

SEQ ID NO: 759031 - RNA, 14 nt, Leptospira interrogans serovar lai str. 56601
guucuuaaauaaaa

SEQ ID NO: 759032 - RNA, 13 nt, Leptospira interrogans serovar lai str. 56601
guucuuacaauaa

SEQ ID NO: 759033 - RNA, 17 nt, Leptospira interrogans serovar lai str. 56601
guucuuacaauaaaaac

SEQ ID NO: 759034 - RNA, 19 nt, Leptospira interrogans serovar lai str. 56601
guucuguugaguucauucu

SEQ ID NO: 759035 - RNA, 16 nt, Leptospira interrogans serovar lai str. 56601
guucuuagacucagua

SEQ ID NO: 759036 - RNA, 13 nt, Leptospira interrogans serovar lai str. 56601
guucuuagccuuu

SEQ ID NO: 759037 - RNA, 19 nt, Leptospira interrogans serovar lai str. 56601
guucagguaguaguugcac

SEQ ID NO: 759038 - RNA, 13 nt, Leptospira interrogans serovar lai str. 56601
guuccaaagccaa

SEQ ID NO: 759039 - RNA, 21 nt, Leptospira interrogans serovar lai str. 56601
guuccaaaguuauugaauaga

SEQ ID NO: 759040 - RNA, 16 nt, Leptospira interrogans serovar lai str. 56601
guuccaaaaccucaaa

SEQ ID NO: 759041 - RNA, 23 nt, Leptospira interrogans serovar lai str. 56601
guuccaaaaccucaaaaaauuua

SEQ ID NO: 759042 - RNA, 13 nt, Leptospira interrogans serovar lai str. 56601
guuccaaaacuaa

SEQ ID NO: 759043 - RNA, 13 nt, Leptospira interrogans serovar lai str. 56601
guuccaaacccug

SEQ ID NO: 759044 - RNA, 14 nt, Leptospira interrogans serovar lai str. 56601
guucgauuaaaaua

SEQ ID NO: 759045 - RNA, 16 nt, Leptospira interrogans serovar lai str. 56601
guucgcguuaauauaa

SEQ ID NO: 759046 - RNA, 12 nt, Leptospira interrogans serovar lai str. 56601
guucguaugagu

SEQ ID NO: 759047 - RNA, 14 nt, Leptospira interrogans serovar lai str. 56601
guucguaugaguuc

SEQ ID NO: 759048 - RNA, 18 nt, Leptospira interrogans serovar lai str. 56601
guucguaugaguucccac

SEQ ID NO: 759049 - RNA, 11 nt, Leptospira interrogans serovar lai str. 56601
guucccacaaa

SEQ ID NO: 759050 - RNA, 15 nt, Leptospira interrogans serovar lai str. 56601
guucccauuggacgg

SEQ ID NO: 759051 - RNA, 9 nt, Leptospira interrogans serovar lai str. 56601
guuccuaca

SEQ ID NO: 759052 - RNA, 12 nt, Leptospira interrogans serovar lai str. 56601
guuccuacaaau

SEQ ID NO: 759053 - RNA, 14 nt, Leptospira interrogans serovar lai str. 56601
guuccuacaauuca

SEQ ID NO: 759054 - RNA, 13 nt, Leptospira interrogans serovar lai str. 56601
guuccuacauuuu

SEQ ID NO: 759055 - RNA, 21 nt, Leptospira interrogans serovar lai str. 56601
guuccuauaaauucauaaccu

SEQ ID NO: 759056 - RNA, 21 nt, Leptospira interrogans serovar lai str. 56601
guuccuaacuuugaaaauuuu

SEQ ID NO: 759057 - RNA, 19 nt, Leptospira interrogans serovar lai str. 56601
guuccgaaaggaaaagaaa

SEQ ID NO: 759058 - RNA, 15 nt, Leptospira interrogans serovar lai str. 56601
guucccguuuagaaa

SEQ ID NO: 759059 - RNA, 20 nt, Leptospira interrogans serovar lai str. 56601
guuacuacaauuuuagaauu

SEQ ID NO: 759060 - RNA, 14 nt, Leptospira interrogans serovar lai str. 56601
guuauaaaauguau

SEQ ID NO: 759061 - RNA, 12 nt, Leptospira interrogans serovar lai str. 56601
guuauaaaccaa

SEQ ID NO: 759062 - RNA, 20 nt, Leptospira interrogans serovar lai str. 56601
guuauuauuuaacaugaguu

SEQ ID NO: 759063 - RNA, 21 nt, Leptospira interrogans serovar lai str. 56601
guuauuauuuuuguuaaacaa

SEQ ID NO: 759064 - RNA, 17 nt, Leptospira interrogans serovar lai str. 56601
guuauuaauuauauucu

SEQ ID NO: 759065 - RNA, 14 nt, Leptospira interrogans serovar lai str. 56601
guucaaaaaaagga

SEQ ID NO: 759066 - RNA, 13 nt, Leptospira interrogans serovar lai str. 56601
guucaaacaacaa

SEQ ID NO: 759067 - RNA, 21 nt, Leptospira interrogans serovar lai str. 56601
guucaaacaacaaaaaauaua

SEQ ID NO: 759068 - RNA, 18 nt, Leptospira interrogans serovar lai str. 56601
guuaucggcacuuuuguu

SEQ ID NO: 759069 - RNA, 18 nt, Leptospira interrogans serovar lai str. 56601
guuauccgauuuuuguuu

SEQ ID NO: 759070 - RNA, 17 nt, Leptospira interrogans serovar lai str. 56601
guuauaauucuuuaaaa

SEQ ID NO: 759071 - RNA, 13 nt, Leptospira interrogans serovar lai str. 56601
guuauaauuucuu

SEQ ID NO: 759072 - RNA, 17 nt, Leptospira interrogans serovar lai str. 56601
guuauacaauauuucgu

SEQ ID NO: 759073 - RNA, 14 nt, Leptospira interrogans serovar lai str. 56601
guuaucaguaguua

SEQ ID NO: 759074 - RNA, 14 nt, Leptospira interrogans serovar lai str. 56601
guuaucauaaaaau

SEQ ID NO: 759075 - RNA, 19 nt, Leptospira interrogans serovar lai str. 56601
guguuuugugauaaaauua

SEQ ID NO: 759076 - RNA, 16 nt, Leptospira interrogans serovar lai str. 56601
guuacauaaguuguua

SEQ ID NO: 759077 - RNA, 16 nt, Leptospira interrogans serovar lai str. 56601
guuacauuaugaauuu

SEQ ID NO: 759078 - RNA, 23 nt, Leptospira interrogans serovar lai str. 56601
guuaauuuuuauuggaaaaaguc

SEQ ID NO: 759079 - RNA, 17 nt, Leptospira interrogans serovar lai str. 56601
guuaaucagagcaucau

SEQ ID NO: 759080 - RNA, 18 nt, Leptospira interrogans serovar lai str. 56601
guuaauacaaaaaacuga

SEQ ID NO: 759081 - RNA, 21 nt, Leptospira interrogans serovar lai str. 56601
guuaauaaauugcauaaaaga

SEQ ID NO: 759082 - RNA, 18 nt, Leptospira interrogans serovar lai str. 56601
guuaauaaauuuuugacu

SEQ ID NO: 759083 - RNA, 11 nt, Leptospira interrogans serovar lai str. 56601
guuaaauuuuu

SEQ ID NO: 759084 - RNA, 21 nt, Leptospira interrogans serovar lai str. 56601
guuaaauuuuuugcaaaaaaa

SEQ ID NO: 759085 - RNA, 16 nt, Leptospira interrogans serovar lai str. 56601
guggucaacaucucaa

SEQ ID NO: 759086 - RNA, 14 nt, Leptospira interrogans serovar lai str. 56601
gugguaguucccac

SEQ ID NO: 759087 - RNA, 13 nt, Leptospira interrogans serovar lai str. 56601
gugguaguuccua

SEQ ID NO: 759088 - RNA, 11 nt, Leptospira interrogans serovar lai str. 56601
gugucaagccc

SEQ ID NO: 759089 - RNA, 13 nt, Leptospira interrogans serovar lai str. 56601
gugucaagcccuc

SEQ ID NO: 759090 - RNA, 13 nt, Leptospira interrogans serovar lai str. 56601
guguaauaugaau

SEQ ID NO: 759091 - RNA, 16 nt, Leptospira interrogans serovar lai str. 56601
guguaaucuuauuuuu

SEQ ID NO: 759092 - RNA, 14 nt, Leptospira interrogans serovar lai str. 56601
guguaaaauuaaaa

SEQ ID NO: 759093 - RNA, 12 nt, Leptospira interrogans serovar lai str. 56601
guguaaaauuuu

SEQ ID NO: 759094 - RNA, 14 nt, Leptospira interrogans serovar lai str. 56601
guguaaaacccauc

SEQ ID NO: 759095 - RNA, 17 nt, Leptospira interrogans serovar lai str. 56601
gugggaacuauuacaaa

SEQ ID NO: 759096 - RNA, 22 nt, Leptospira interrogans serovar lai str. 56601
gugcuuuguucaaagaaaugug

SEQ ID NO: 759097 - RNA, 12 nt, Leptospira interrogans serovar lai str. 56601
gugcuacugcaa

SEQ ID NO: 759098 - RNA, 17 nt, Leptospira interrogans serovar lai str. 56601
gucuaucuuuuuuaaaa

SEQ ID NO: 759099 - RNA, 16 nt, Leptospira interrogans serovar lai str. 56601
gucuaugacgaauugc

SEQ ID NO: 759100 - RNA, 17 nt, Leptospira interrogans serovar lai str. 56601
gucuauaaaauucaaaa

SEQ ID NO: 759101 - RNA, 21 nt, Leptospira interrogans serovar lai str. 56601
gucuauaaaauucaaaaagaa

SEQ ID NO: 759102 - RNA, 22 nt, Leptospira interrogans serovar lai str. 56601
gucuauaaaauucaaaaagaau

SEQ ID NO: 759103 - RNA, 22 nt, Leptospira interrogans serovar lai str. 56601
gucuauaaauucaucuaaaaaa

SEQ ID NO: 759104 - RNA, 17 nt, Leptospira interrogans serovar lai str. 56601
gucuaucagcuuucuuc

SEQ ID NO: 759105 - RNA, 14 nt, Leptospira interrogans serovar lai str. 56601
gucuacuuuuaaaa

SEQ ID NO: 759106 - RNA, 20 nt, Leptospira interrogans serovar lai str. 56601
gucucaaaauuaagaaucaa

SEQ ID NO: 759107 - RNA, 22 nt, Leptospira interrogans serovar lai str. 56601
gucucaaaauuaagaaucaaua

SEQ ID NO: 759108 - RNA, 17 nt, Leptospira interrogans serovar lai str. 56601
gucuauuacaaaacuua

SEQ ID NO: 759109 - RNA, 21 nt, Leptospira interrogans serovar lai str. 56601
gucuauuucccaaaauuucag

SEQ ID NO: 759110 - RNA, 22 nt, Leptospira interrogans serovar lai str. 56601
gucucaaaaccuguaaaugaau

SEQ ID NO: 759111 - RNA, 16 nt, Leptospira interrogans serovar lai str. 56601
gugauaauucuuuaga

SEQ ID NO: 759112 - RNA, 18 nt, Leptospira interrogans serovar lai str. 56601
gugcauuuaaaaaauuca

SEQ ID NO: 759113 - RNA, 22 nt, Leptospira interrogans serovar lai str. 56601
gugcauuuaaaaaauucaauuc

SEQ ID NO: 759114 - RNA, 19 nt, Leptospira interrogans serovar lai str. 56601
gugcgacuacgauuucauc

SEQ ID NO: 759115 - RNA, 15 nt, Leptospira interrogans serovar lai str. 56601
uacacucuuucaaug

SEQ ID NO: 759116 - RNA, 16 nt, Leptospira interrogans serovar lai str. 56601
uacacggagauaaaaa

SEQ ID NO: 759117 - RNA, 14 nt, Leptospira interrogans serovar lai str. 56601
uacacguaauucuu

SEQ ID NO: 759118 - RNA, 17 nt, Leptospira interrogans serovar lai str. 56601
uacacguaauucuuugg

SEQ ID NO: 759119 - RNA, 15 nt, Leptospira interrogans serovar lai str. 56601
uacacgucaauaaug

SEQ ID NO: 759120 - RNA, 14 nt, Leptospira interrogans serovar lai str. 56601
uacaccaaacucac

SEQ ID NO: 759121 - RNA, 21 nt, Leptospira interrogans serovar lai str. 56601
uacacccuuaacgguuuugau

SEQ ID NO: 759122 - RNA, 22 nt, Leptospira interrogans serovar lai str. 56601
uacagaacccaauaaaaacuaa

SEQ ID NO: 759123 - RNA, 16 nt, Leptospira interrogans serovar lai str. 56601
uacagaaaaaauccau

SEQ ID NO: 759124 - RNA, 11 nt, Leptospira interrogans serovar lai str. 56601
uacagaaaaau

SEQ ID NO: 759125 - RNA, 13 nt, Leptospira interrogans serovar lai str. 56601
uacagaaaaauca

SEQ ID NO: 759126 - RNA, 12 nt, Leptospira interrogans serovar lai str. 56601
uacagauaaacg

SEQ ID NO: 759127 - RNA, 17 nt, Leptospira interrogans serovar lai str. 56601
uacagaauuuuuuaaca

SEQ ID NO: 759128 - RNA, 18 nt, Leptospira interrogans serovar lai str. 56601
uacagacguauuuuuaaa

SEQ ID NO: 759129 - RNA, 19 nt, Leptospira interrogans serovar lai str. 56601
uacagacugauuuuuuaaa

SEQ ID NO: 759130 - RNA, 20 nt, Leptospira interrogans serovar lai str. 56601
uacagacugauuuuuuaaau

SEQ ID NO: 759131 - RNA, 17 nt, Leptospira interrogans serovar lai str. 56601
uacagagauauagaaau

SEQ ID NO: 759132 - RNA, 23 nt, Leptospira interrogans serovar lai str. 56601
uacagagauauagaaauuuucaa

SEQ ID NO: 759133 - RNA, 13 nt, Leptospira interrogans serovar lai str. 56601
uaauuuuaauuaa

SEQ ID NO: 759134 - RNA, 17 nt, Leptospira interrogans serovar lai str. 56601
uaauuuuaguaaaaauc

SEQ ID NO: 759135 - RNA, 15 nt, Leptospira interrogans serovar lai str. 56601
uaauuuuagaauauu

SEQ ID NO: 759136 - RNA, 11 nt, Leptospira interrogans serovar lai str. 56601
uaauuuuagag

SEQ ID NO: 759137 - RNA, 15 nt, Leptospira interrogans serovar lai str. 56601
uaauuuuacuauaaa

SEQ ID NO: 759138 - RNA, 13 nt, Leptospira interrogans serovar lai str. 56601
uaauuuuaaagaa

SEQ ID NO: 759139 - RNA, 13 nt, Leptospira interrogans serovar lai str. 56601
uacaaccaaacag

SEQ ID NO: 759140 - RNA, 15 nt, Leptospira interrogans serovar lai str. 56601
uacaacccaacuuuc

SEQ ID NO: 759141 - RNA, 18 nt, Leptospira interrogans serovar lai str. 56601
uaauuuuaucuuuuucua

SEQ ID NO: 759142 - RNA, 15 nt, Leptospira interrogans serovar lai str. 56601
uaauuuuauccauaa

SEQ ID NO: 759143 - RNA, 18 nt, Leptospira interrogans serovar lai str. 56601
uaauuuuauaauauucua

SEQ ID NO: 759144 - RNA, 14 nt, Leptospira interrogans serovar lai str. 56601
uaauuuuauuucuu

SEQ ID NO: 759145 - RNA, 14 nt, Leptospira interrogans serovar lai str. 56601
uacaacgauucagu

SEQ ID NO: 759146 - RNA, 19 nt, Leptospira interrogans serovar lai str. 56601
uacaacgcgauccauagag

SEQ ID NO: 759147 - RNA, 14 nt, Leptospira interrogans serovar lai str. 56601
uacaacgaaaacag

SEQ ID NO: 759148 - RNA, 22 nt, Leptospira interrogans serovar lai str. 56601
uacaauaaaggaaaguucuaua

SEQ ID NO: 759149 - RNA, 18 nt, Leptospira interrogans serovar lai str. 56601
uacaauaaaucaaaagga

SEQ ID NO: 759150 - RNA, 19 nt, Leptospira interrogans serovar lai str. 56601
uacaauaaaucaaaaggaa

SEQ ID NO: 759151 - RNA, 21 nt, Leptospira interrogans serovar lai str. 56601
uacaauaaaucaaaaggaaua

SEQ ID NO: 759152 - RNA, 14 nt, Leptospira interrogans serovar lai str. 56601
uacaauuaaaaaga

SEQ ID NO: 759153 - RNA, 17 nt, Leptospira interrogans serovar lai str. 56601
uacaauuaaaaagauag

SEQ ID NO: 759154 - RNA, 23 nt, Leptospira interrogans serovar lai str. 56601
uacaauuaaacuucaaaaaauau

SEQ ID NO: 759155 - RNA, 13 nt, Leptospira interrogans serovar lai str. 56601
uacaaugaaaaag

SEQ ID NO: 759156 - RNA, 15 nt, Leptospira interrogans serovar lai str. 56601
uacaaucgcuuucgc

SEQ ID NO: 759157 - RNA, 20 nt, Leptospira interrogans serovar lai str. 56601
uacaaucggguaaaaaauac

SEQ ID NO: 759158 - RNA, 22 nt, Leptospira interrogans serovar lai str. 56601
uacaauauuuugucuuuaauuu

SEQ ID NO: 759159 - RNA, 13 nt, Leptospira interrogans serovar lai str. 56601
uacaguuucgauu

SEQ ID NO: 759160 - RNA, 17 nt, Leptospira interrogans serovar lai str. 56601
uacauaaaaaaauaaua

SEQ ID NO: 759161 - RNA, 17 nt, Leptospira interrogans serovar lai str. 56601
uacauauauaauuuauu

SEQ ID NO: 759162 - RNA, 14 nt, Leptospira interrogans serovar lai str. 56601
uacaugagacuaua

SEQ ID NO: 759163 - RNA, 14 nt, Leptospira interrogans serovar lai str. 56601
uacauguucaaaau

SEQ ID NO: 759164 - RNA, 16 nt, Leptospira interrogans serovar lai str. 56601
uacauuuaaacuuuuc

SEQ ID NO: 759165 - RNA, 18 nt, Leptospira interrogans serovar lai str. 56601
uacauuggggaaguaauu

SEQ ID NO: 759166 - RNA, 20 nt, Leptospira interrogans serovar lai str. 56601
uacauuggggaaguaauuuu

SEQ ID NO: 759167 - RNA, 14 nt, Leptospira interrogans serovar lai str. 56601
uacauuuuucuaaa

SEQ ID NO: 759168 - RNA, 15 nt, Leptospira interrogans serovar lai str. 56601
uacauuuuucuaaau

SEQ ID NO: 759169 - RNA, 18 nt, Leptospira interrogans serovar lai str. 56601
uacauuuuucuaaauuaa

SEQ ID NO: 759170 - RNA, 19 nt, Leptospira interrogans serovar lai str. 56601
uacauuuuucuaaauuaau

SEQ ID NO: 759171 - RNA, 20 nt, Leptospira interrogans serovar lai str. 56601
uacauuuugaguagccaauu

SEQ ID NO: 759172 - RNA, 23 nt, Leptospira interrogans serovar lai str. 56601
uacauuuugaguagccaauugaa

SEQ ID NO: 759173 - RNA, 12 nt, Leptospira interrogans serovar lai str. 56601
uacauuuuaaaa

SEQ ID NO: 759174 - RNA, 13 nt, Leptospira interrogans serovar lai str. 56601
uacauuuuaaaaa

SEQ ID NO: 759175 - RNA, 14 nt, Leptospira interrogans serovar lai str. 56601
uacauuuuaaaaau

SEQ ID NO: 759176 - RNA, 13 nt, Leptospira interrogans serovar lai str. 56601
uacauuuuuagaa

SEQ ID NO: 759177 - RNA, 15 nt, Leptospira interrogans serovar lai str. 56601
uacauuuuugugaaa

SEQ ID NO: 759178 - RNA, 14 nt, Leptospira interrogans serovar lai str. 56601
uacauuuuuuaaau

SEQ ID NO: 759179 - RNA, 22 nt, Leptospira interrogans serovar lai str. 56601
uacauuuuuuaucaauuacgaa

SEQ ID NO: 759180 - RNA, 12 nt, Leptospira interrogans serovar lai str. 56601
uaccaaaaaagu

SEQ ID NO: 759181 - RNA, 13 nt, Leptospira interrogans serovar lai str. 56601
uaccaaaaaagua

SEQ ID NO: 759182 - RNA, 12 nt, Leptospira interrogans serovar lai str. 56601
uaccaaguuauu

SEQ ID NO: 759183 - RNA, 14 nt, Leptospira interrogans serovar lai str. 56601
uaccaaguuauuaa

SEQ ID NO: 759184 - RNA, 18 nt, Leptospira interrogans serovar lai str. 56601
uacaggcgguuuaaaagc

SEQ ID NO: 759185 - RNA, 13 nt, Leptospira interrogans serovar lai str. 56601
uacaguuuuagaa

SEQ ID NO: 759186 - RNA, 14 nt, Leptospira interrogans serovar lai str. 56601
uacaguuuuagaau

SEQ ID NO: 759187 - RNA, 21 nt, Leptospira interrogans serovar lai str. 56601
uacaguucugaguaagauauu

SEQ ID NO: 759188 - RNA, 14 nt, Leptospira interrogans serovar lai str. 56601
uacagauugauucu

SEQ ID NO: 759189 - RNA, 15 nt, Leptospira interrogans serovar lai str. 56601
uacagccaucccacu

SEQ ID NO: 759190 - RNA, 13 nt, Leptospira interrogans serovar lai str. 56601
uaauuaaaugaag

SEQ ID NO: 759191 - RNA, 14 nt, Leptospira interrogans serovar lai str. 56601
uaauuaauucagca

SEQ ID NO: 759192 - RNA, 13 nt, Leptospira interrogans serovar lai str. 56601
uaauucguuugaa

SEQ ID NO: 759193 - RNA, 18 nt, Leptospira interrogans serovar lai str. 56601
uaauucgugaacuuuaga

SEQ ID NO: 759194 - RNA, 19 nt, Leptospira interrogans serovar lai str. 56601
uaauucguuccaaauacaa

SEQ ID NO: 759195 - RNA, 14 nt, Leptospira interrogans serovar lai str. 56601
uaauucauuuggau

SEQ ID NO: 759196 - RNA, 21 nt, Leptospira interrogans serovar lai str. 56601
uaauucguuuuuuaaaaugua

SEQ ID NO: 759197 - RNA, 11 nt, Leptospira interrogans serovar lai str. 56601
uaauucuaaag

SEQ ID NO: 759198 - RNA, 21 nt, Leptospira interrogans serovar lai str. 56601
uaauucuacgaaacuuuuaga

SEQ ID NO: 759199 - RNA, 22 nt, Leptospira interrogans serovar lai str. 56601
uaauucuacgaaacuuuuagaa

SEQ ID NO: 759200 - RNA, 18 nt, Leptospira interrogans serovar lai str. 56601
uaauucugaaaaaguuag

SEQ ID NO: 759201 - RNA, 16 nt, Leptospira interrogans serovar lai str. 56601
uaauucuccauuuguu

SEQ ID NO: 759202 - RNA, 16 nt, Leptospira interrogans serovar lai str. 56601
uaauuauccuuaaaau

SEQ ID NO: 759203 - RNA, 19 nt, Leptospira interrogans serovar lai str. 56601
uaauucagcaucgaauauc

SEQ ID NO: 759204 - RNA, 22 nt, Leptospira interrogans serovar lai str. 56601
uaauucagcaucgaauauccuu

SEQ ID NO: 759205 - RNA, 15 nt, Leptospira interrogans serovar lai str. 56601
uaauucuuaaaaauu

SEQ ID NO: 759206 - RNA, 12 nt, Leptospira interrogans serovar lai str. 56601
uaauucuuaauu

SEQ ID NO: 759207 - RNA, 18 nt, Leptospira interrogans serovar lai str. 56601
uaauucuguaaaaauaga

SEQ ID NO: 759208 - RNA, 16 nt, Leptospira interrogans serovar lai str. 56601
uaauucuuuaaaauuu

SEQ ID NO: 759209 - RNA, 21 nt, Leptospira interrogans serovar lai str. 56601
uaauucuuuaaaauuuuuaau

SEQ ID NO: 759210 - RNA, 16 nt, Leptospira interrogans serovar lai str. 56601
uaauuguugaauaucu

SEQ ID NO: 759211 - RNA, 14 nt, Leptospira interrogans serovar lai str. 56601
uaauuguugcuaug

SEQ ID NO: 759212 - RNA, 13 nt, Leptospira interrogans serovar lai str. 56601
uaauuuaaaaucg

SEQ ID NO: 759213 - RNA, 19 nt, Leptospira interrogans serovar lai str. 56601
uaauuuaaaaaagaagaau

SEQ ID NO: 759214 - RNA, 14 nt, Leptospira interrogans serovar lai str. 56601
uaauuuagaauaaa

SEQ ID NO: 759215 - RNA, 13 nt, Leptospira interrogans serovar lai str. 56601
uaauuuacuacau

SEQ ID NO: 759216 - RNA, 22 nt, Leptospira interrogans serovar lai str. 56601
uaauuuacuacaucuaaugauu

SEQ ID NO: 759217 - RNA, 19 nt, Leptospira interrogans serovar lai str. 56601
uaauuuaauauauuaaaau

SEQ ID NO: 759218 - RNA, 16 nt, Leptospira interrogans serovar lai str. 56601
uaauuucuucauauca

SEQ ID NO: 759219 - RNA, 23 nt, Leptospira interrogans serovar lai str. 56601
uaauuucuucauaucaaauucau

SEQ ID NO: 759220 - RNA, 21 nt, Leptospira interrogans serovar lai str. 56601
uaauuucguuuuuuuaauauu

SEQ ID NO: 759221 - RNA, 22 nt, Leptospira interrogans serovar lai str. 56601
uaauuucguuuuuuuaauauua

SEQ ID NO: 759222 - RNA, 23 nt, Leptospira interrogans serovar lai str. 56601
uaauuucguuuuuuuaauauuac

SEQ ID NO: 759223 - RNA, 18 nt, Leptospira interrogans serovar lai str. 56601
uaauuucucuuauuagaa

SEQ ID NO: 759224 - RNA, 21 nt, Leptospira interrogans serovar lai str. 56601
uaauuucucuuauuagaacuc

SEQ ID NO: 759225 - RNA, 14 nt, Leptospira interrogans serovar lai str. 56601
uaauuuauaaacuu

SEQ ID NO: 759226 - RNA, 16 nt, Leptospira interrogans serovar lai str. 56601
uaauuucccauaaaaa

SEQ ID NO: 759227 - RNA, 21 nt, Leptospira interrogans serovar lai str. 56601
uaaucuuuauagguuucuucg

SEQ ID NO: 759228 - RNA, 12 nt, Leptospira interrogans serovar lai str. 56601
uaaucuuccgca

SEQ ID NO: 759229 - RNA, 17 nt, Leptospira interrogans serovar lai str. 56601
uaaucuuaauauuucuc

SEQ ID NO: 759230 - RNA, 23 nt, Leptospira interrogans serovar lai str. 56601
uaaucugugggaacuaccacaaa

SEQ ID NO: 759231 - RNA, 21 nt, Leptospira interrogans serovar lai str. 56601
uaaucugugggaacuaucaca

SEQ ID NO: 759232 - RNA, 11 nt, Leptospira interrogans serovar lai str. 56601
uaaucuggaaa

SEQ ID NO: 759233 - RNA, 21 nt, Leptospira interrogans serovar lai str. 56601
uaaugaaaacuuguuuuagaa

SEQ ID NO: 759234 - RNA, 21 nt, Leptospira interrogans serovar lai str. 56601
uaaucuuuuuaaaaguuugau

SEQ ID NO: 759235 - RNA, 22 nt, Leptospira interrogans serovar lai str. 56601
uaaucuuuguaugaguucccac

SEQ ID NO: 759236 - RNA, 20 nt, Leptospira interrogans serovar lai str. 56601
uaaugaauaacuuuacaaaa

SEQ ID NO: 759237 - RNA, 20 nt, Leptospira interrogans serovar lai str. 56601
uaaugaaucguaaaaaaaua

SEQ ID NO: 759238 - RNA, 19 nt, Leptospira interrogans serovar lai str. 56601
uaaugaauuucuaauagau

SEQ ID NO: 759239 - RNA, 14 nt, Leptospira interrogans serovar lai str. 56601
uaacgauuguaaaa

SEQ ID NO: 759240 - RNA, 22 nt, Leptospira interrogans serovar lai str. 56601
uaacgauuguaaaaaaacauga

SEQ ID NO: 759241 - RNA, 21 nt, Leptospira interrogans serovar lai str. 56601
uaacgaguagaauucucagga

SEQ ID NO: 759242 - RNA, 21 nt, Leptospira interrogans serovar lai str. 56601
uaacgauacuuaaaaauaccg

SEQ ID NO: 759243 - RNA, 22 nt, Leptospira interrogans serovar lai str. 56601
uaaucgcucugaaguaucucuu

SEQ ID NO: 759244 - RNA, 15 nt, Leptospira interrogans serovar lai str. 56601
uaauccuaugaaaau

SEQ ID NO: 759245 - RNA, 17 nt, Leptospira interrogans serovar lai str. 56601
uaauccuaugaaaauuu

SEQ ID NO: 759246 - RNA, 22 nt, Leptospira interrogans serovar lai str. 56601
uaaucuaagacgaaaagaagaa

SEQ ID NO: 759247 - RNA, 23 nt, Leptospira interrogans serovar lai str. 56601
uaaucguguuugagauuaaaaag

SEQ ID NO: 759248 - RNA, 22 nt, Leptospira interrogans serovar lai str. 56601
uaaucuaguuuauaugaguucc

SEQ ID NO: 759249 - RNA, 16 nt, Leptospira interrogans serovar lai str. 56601
uaaucucgauuucuaa

SEQ ID NO: 759250 - RNA, 22 nt, Leptospira interrogans serovar lai str. 56601
uacuucuauaauguuaauuuag

SEQ ID NO: 759251 - RNA, 18 nt, Leptospira interrogans serovar lai str. 56601
uacuucguuauaauuuuc

SEQ ID NO: 759252 - RNA, 20 nt, Leptospira interrogans serovar lai str. 56601
uacuucguuauaauuuucau

SEQ ID NO: 759253 - RNA, 14 nt, Leptospira interrogans serovar lai str. 56601
uacuucuaaaaaau

SEQ ID NO: 759254 - RNA, 22 nt, Leptospira interrogans serovar lai str. 56601
uacuucccagacguaucaaaau

SEQ ID NO: 759255 - RNA, 14 nt, Leptospira interrogans serovar lai str. 56601
uacuugucuuuaga

SEQ ID NO: 759256 - RNA, 16 nt, Leptospira interrogans serovar lai str. 56601
uacuugucuuuagaac

SEQ ID NO: 759257 - RNA, 13 nt, Leptospira interrogans serovar lai str. 56601
uacuuuaaaaaau

SEQ ID NO: 759258 - RNA, 19 nt, Leptospira interrogans serovar lai str. 56601
uacuuuaaaaaauaucuua

SEQ ID NO: 759259 - RNA, 14 nt, Leptospira interrogans serovar lai str. 56601
uacuuuaauaauau

SEQ ID NO: 759260 - RNA, 13 nt, Leptospira interrogans serovar lai str. 56601
uacuuuaaaauuu

SEQ ID NO: 759261 - RNA, 20 nt, Leptospira interrogans serovar lai str. 56601
uacuuuaagaaaauuuaaaa

SEQ ID NO: 759262 - RNA, 22 nt, Leptospira interrogans serovar lai str. 56601
uacuuuccguagaucuuuuaua

SEQ ID NO: 759263 - RNA, 19 nt, Leptospira interrogans serovar lai str. 56601
uacuuuccgucuuuuaggu

SEQ ID NO: 759264 - RNA, 16 nt, Leptospira interrogans serovar lai str. 56601
uacuuacauagaacuc

SEQ ID NO: 759265 - RNA, 18 nt, Leptospira interrogans serovar lai str. 56601
uacuuaccucuauaaaau

SEQ ID NO: 759266 - RNA, 14 nt, Leptospira interrogans serovar lai str. 56601
uacuuagaugaacu

SEQ ID NO: 759267 - RNA, 19 nt, Leptospira interrogans serovar lai str. 56601
uacuuaaacguauaaaaac

SEQ ID NO: 759268 - RNA, 20 nt, Leptospira interrogans serovar lai str. 56601
uacuuaaacguauaaaaaca

SEQ ID NO: 759269 - RNA, 17 nt, Leptospira interrogans serovar lai str. 56601
uacuuaagcucuaauau

SEQ ID NO: 759270 - RNA, 14 nt, Leptospira interrogans serovar lai str. 56601
uacuccggcuaaaa

SEQ ID NO: 759271 - RNA, 22 nt, Leptospira interrogans serovar lai str. 56601
uacucgaaacuguauuauaaag

SEQ ID NO: 759272 - RNA, 17 nt, Leptospira interrogans serovar lai str. 56601
uacuguaaaauuuaaau

SEQ ID NO: 759273 - RNA, 20 nt, Leptospira interrogans serovar lai str. 56601
uacugguuuuggagaccaaa

SEQ ID NO: 759274 - RNA, 23 nt, Leptospira interrogans serovar lai str. 56601
uacugguuuuggagaccaaaaau

SEQ ID NO: 759275 - RNA, 19 nt, Leptospira interrogans serovar lai str. 56601
uagaaauauuuagaauaaa

SEQ ID NO: 759276 - RNA, 21 nt, Leptospira interrogans serovar lai str. 56601
uagaaaucgauuuguaaaauu

SEQ ID NO: 759277 - RNA, 17 nt, Leptospira interrogans serovar lai str. 56601
uagaaauguaggaacuc

SEQ ID NO: 759278 - RNA, 17 nt, Leptospira interrogans serovar lai str. 56601
uagaaauaugaauuacu

SEQ ID NO: 759279 - RNA, 18 nt, Leptospira interrogans serovar lai str. 56601
uagaaauagaaaccuuuc

SEQ ID NO: 759280 - RNA, 15 nt, Leptospira interrogans serovar lai str. 56601
uagaaagguauagaa

SEQ ID NO: 759281 - RNA, 21 nt, Leptospira interrogans serovar lai str. 56601
uagaaagguuauccucugaac

SEQ ID NO: 759282 - RNA, 20 nt, Leptospira interrogans serovar lai str. 56601
uagaaagaaucuuuuuaaaa

SEQ ID NO: 759283 - RNA, 23 nt, Leptospira interrogans serovar lai str. 56601
uagaaagaaucuuuuuaaaagua

SEQ ID NO: 759284 - RNA, 11 nt, Leptospira interrogans serovar lai str. 56601
uagaaagaauu

SEQ ID NO: 759285 - RNA, 16 nt, Leptospira interrogans serovar lai str. 56601
uagaaagaccuuuuag

SEQ ID NO: 759286 - RNA, 23 nt, Leptospira interrogans serovar lai str. 56601
uagaaagacuuuucaucauuccc

SEQ ID NO: 759287 - RNA, 19 nt, Leptospira interrogans serovar lai str. 56601
uagaaagaggccuuuauuu

SEQ ID NO: 759288 - RNA, 19 nt, Leptospira interrogans serovar lai str. 56601
uagaaacgauguauugagu

SEQ ID NO: 759289 - RNA, 15 nt, Leptospira interrogans serovar lai str. 56601
uagaaaauuuuuucu

SEQ ID NO: 759290 - RNA, 19 nt, Leptospira interrogans serovar lai str. 56601
uagaaaauuagaaagaauc

SEQ ID NO: 759291 - RNA, 21 nt, Leptospira interrogans serovar lai str. 56601
uagaaaauuagaaagaaucuu

SEQ ID NO: 759292 - RNA, 12 nt, Leptospira interrogans serovar lai str. 56601
uacuuuucuucc

SEQ ID NO: 759293 - RNA, 22 nt, Leptospira interrogans serovar lai str. 56601
uacuuuugaaauagauucuaau

SEQ ID NO: 759294 - RNA, 11 nt, Leptospira interrogans serovar lai str. 56601
uacuuuuucug

SEQ ID NO: 759295 - RNA, 16 nt, Leptospira interrogans serovar lai str. 56601
uacuuuuagaaaauuu

SEQ ID NO: 759296 - RNA, 22 nt, Leptospira interrogans serovar lai str. 56601
uacuuuuagaaaauuuuuacuc

SEQ ID NO: 759297 - RNA, 12 nt, Leptospira interrogans serovar lai str. 56601
uacuuuuaaaaa

SEQ ID NO: 759298 - RNA, 16 nt, Leptospira interrogans serovar lai str. 56601
uacuuuguaauuaaaa

SEQ ID NO: 759299 - RNA, 17 nt, Leptospira interrogans serovar lai str. 56601
uacuuuguaauuaaaau

SEQ ID NO: 759300 - RNA, 16 nt, Leptospira interrogans serovar lai str. 56601
uacuuugagaaaauuu

SEQ ID NO: 759301 - RNA, 15 nt, Leptospira interrogans serovar lai str. 56601
uacuuugauuauaac

SEQ ID NO: 759302 - RNA, 15 nt, Leptospira interrogans serovar lai str. 56601
uacuuugaacuuguc

SEQ ID NO: 759303 - RNA, 19 nt, Leptospira interrogans serovar lai str. 56601
uacuuugaacuuguccuaa

SEQ ID NO: 759304 - RNA, 13 nt, Leptospira interrogans serovar lai str. 56601
uacuuugaaugaa

SEQ ID NO: 759305 - RNA, 15 nt, Leptospira interrogans serovar lai str. 56601
uacuuugaaugaaaa

SEQ ID NO: 759306 - RNA, 14 nt, Leptospira interrogans serovar lai str. 56601
uagaaaaaauacau

SEQ ID NO: 759307 - RNA, 14 nt, Leptospira interrogans serovar lai str. 56601
uagaaaaauauuau

SEQ ID NO: 759308 - RNA, 15 nt, Leptospira interrogans serovar lai str. 56601
uagaaaauaauaaua

SEQ ID NO: 759309 - RNA, 18 nt, Leptospira interrogans serovar lai str. 56601
uagaauuuuagacaaaaa

SEQ ID NO: 759310 - RNA, 14 nt, Leptospira interrogans serovar lai str. 56601
uagaauuuucuaaa

SEQ ID NO: 759311 - RNA, 18 nt, Leptospira interrogans serovar lai str. 56601
uagaauuuugcaaaaaaa

SEQ ID NO: 759312 - RNA, 19 nt, Leptospira interrogans serovar lai str. 56601
uagaauuuuguuucuaaaa

SEQ ID NO: 759313 - RNA, 13 nt, Leptospira interrogans serovar lai str. 56601
uagacaaaaaauu

SEQ ID NO: 759314 - RNA, 20 nt, Leptospira interrogans serovar lai str. 56601
uagaauuuguucgugaaauu

SEQ ID NO: 759315 - RNA, 19 nt, Leptospira interrogans serovar lai str. 56601
uagaauuuguucuuaaaau

SEQ ID NO: 759316 - RNA, 15 nt, Leptospira interrogans serovar lai str. 56601
uagaauuuguuugua

SEQ ID NO: 759317 - RNA, 20 nt, Leptospira interrogans serovar lai str. 56601
uagaauuuguuuuuaaaauu

SEQ ID NO: 759318 - RNA, 21 nt, Leptospira interrogans serovar lai str. 56601
uagaauuggggagaaacacuc

SEQ ID NO: 759319 - RNA, 18 nt, Leptospira interrogans serovar lai str. 56601
uagaauuguguuaguucc

SEQ ID NO: 759320 - RNA, 22 nt, Leptospira interrogans serovar lai str. 56601
uagaauuguugaaaaauuaauu

SEQ ID NO: 759321 - RNA, 18 nt, Leptospira interrogans serovar lai str. 56601
uagaauuuaaguauuaua

SEQ ID NO: 759322 - RNA, 12 nt, Leptospira interrogans serovar lai str. 56601
uagacaacuaaa

SEQ ID NO: 759323 - RNA, 14 nt, Leptospira interrogans serovar lai str. 56601
uagacauuguuuua

SEQ ID NO: 759324 - RNA, 21 nt, Leptospira interrogans serovar lai str. 56601
uagacauuguuuuacucuuau

SEQ ID NO: 759325 - RNA, 14 nt, Leptospira interrogans serovar lai str. 56601
uagagaaaagcauu

SEQ ID NO: 759326 - RNA, 19 nt, Leptospira interrogans serovar lai str. 56601
uagacuucucuuuucgaaa

SEQ ID NO: 759327 - RNA, 21 nt, Leptospira interrogans serovar lai str. 56601
uagagaaugaucaauagaauu

SEQ ID NO: 759328 - RNA, 20 nt, Leptospira interrogans serovar lai str. 56601
uagagaaguuaaaaaaugaa

SEQ ID NO: 759329 - RNA, 19 nt, Leptospira interrogans serovar lai str. 56601
uagagaauuaauuuuucaa

SEQ ID NO: 759330 - RNA, 14 nt, Leptospira interrogans serovar lai str. 56601
uagaaucugaacuu

SEQ ID NO: 759331 - RNA, 21 nt, Leptospira interrogans serovar lai str. 56601
uagaaucugaacuuuauagau

SEQ ID NO: 759332 - RNA, 16 nt, Leptospira interrogans serovar lai str. 56601
uagaaucgaaaaguuu

SEQ ID NO: 759333 - RNA, 17 nt, Leptospira interrogans serovar lai str. 56601
uagaaucaacuuuucca

SEQ ID NO: 759334 - RNA, 23 nt, Leptospira interrogans serovar lai str. 56601
uagaaucagaaugaacucaacag

SEQ ID NO: 759335 - RNA, 13 nt, Leptospira interrogans serovar lai str. 56601
uagaaucccauuu

SEQ ID NO: 759336 - RNA, 21 nt, Leptospira interrogans serovar lai str. 56601
uagaaucuucgggcuuauuuu

SEQ ID NO: 759337 - RNA, 14 nt, Leptospira interrogans serovar lai str. 56601
uagaauguaaaagc

SEQ ID NO: 759338 - RNA, 22 nt, Leptospira interrogans serovar lai str. 56601
uagaauguaaaugaauuggaaa

SEQ ID NO: 759339 - RNA, 19 nt, Leptospira interrogans serovar lai str. 56601
uagaauucuccacaaaacc

SEQ ID NO: 759340 - RNA, 14 nt, Leptospira interrogans serovar lai str. 56601
uagaauauaaccgu

SEQ ID NO: 759341 - RNA, 20 nt, Leptospira interrogans serovar lai str. 56601
uagaauaggaucguuucauu

SEQ ID NO: 759342 - RNA, 20 nt, Leptospira interrogans serovar lai str. 56601
uagaauagagucuuuaaaaa

SEQ ID NO: 759343 - RNA, 20 nt, Leptospira interrogans serovar lai str. 56601
uagaaguaguaguucccaca

SEQ ID NO: 759344 - RNA, 18 nt, Leptospira interrogans serovar lai str. 56601
uagaaauuucuaauaaaa

SEQ ID NO: 759345 - RNA, 20 nt, Leptospira interrogans serovar lai str. 56601
uagaaauuuuuaauaaaaug

SEQ ID NO: 759346 - RNA, 19 nt, Leptospira interrogans serovar lai str. 56601
uagaaauuuuuaaucaaau

SEQ ID NO: 759347 - RNA, 16 nt, Leptospira interrogans serovar lai str. 56601
uagaaauuuucaaaaa

SEQ ID NO: 759348 - RNA, 23 nt, Leptospira interrogans serovar lai str. 56601
uagaacaaucucggacagauaua

SEQ ID NO: 759349 - RNA, 13 nt, Leptospira interrogans serovar lai str. 56601
uagaacaucaauu

SEQ ID NO: 759350 - RNA, 19 nt, Leptospira interrogans serovar lai str. 56601
uagaacaucaauuuuauuu

SEQ ID NO: 759351 - RNA, 14 nt, Leptospira interrogans serovar lai str. 56601
uagaacuacucaca

SEQ ID NO: 759352 - RNA, 22 nt, Leptospira interrogans serovar lai str. 56601
uagaacuacucacaaauuguca

SEQ ID NO: 759353 - RNA, 15 nt, Leptospira interrogans serovar lai str. 56601
uagaagaauuguauu

SEQ ID NO: 759354 - RNA, 16 nt, Leptospira interrogans serovar lai str. 56601
uagaacuugucucaga

SEQ ID NO: 759355 - RNA, 20 nt, Leptospira interrogans serovar lai str. 56601
uagaagccugaguuugagag

SEQ ID NO: 759356 - RNA, 20 nt, Leptospira interrogans serovar lai str. 56601
uagaagcgagacgaaaaacu

SEQ ID NO: 759357 - RNA, 17 nt, Leptospira interrogans serovar lai str. 56601
uacucagaguuauauaa

SEQ ID NO: 759358 - RNA, 18 nt, Leptospira interrogans serovar lai str. 56601
uacucagaguuauauaag

SEQ ID NO: 759359 - RNA, 23 nt, Leptospira interrogans serovar lai str. 56601
uacucaauuugauaugaaucagc

SEQ ID NO: 759360 - RNA, 13 nt, Leptospira interrogans serovar lai str. 56601
uacuaugaaauac

SEQ ID NO: 759361 - RNA, 21 nt, Leptospira interrogans serovar lai str. 56601
uacuauuaauuuacuuaucug

SEQ ID NO: 759362 - RNA, 21 nt, Leptospira interrogans serovar lai str. 56601
uacuauuauaauagauugaua

SEQ ID NO: 759363 - RNA, 19 nt, Leptospira interrogans serovar lai str. 56601
uacuauuuugaugaaugaa

SEQ ID NO: 759364 - RNA, 11 nt, Leptospira interrogans serovar lai str. 56601
uacucaaagaa

SEQ ID NO: 759365 - RNA, 13 nt, Leptospira interrogans serovar lai str. 56601
uacucauuuccau

SEQ ID NO: 759366 - RNA, 13 nt, Leptospira interrogans serovar lai str. 56601
uacuaaaaaacau

SEQ ID NO: 759367 - RNA, 14 nt, Leptospira interrogans serovar lai str. 56601
uacuaaaaaacaua

SEQ ID NO: 759368 - RNA, 19 nt, Leptospira interrogans serovar lai str. 56601
uacuaaaaaacauaaaaau

SEQ ID NO: 759369 - RNA, 23 nt, Leptospira interrogans serovar lai str. 56601
uacuauauuuuugugaaacucaa

SEQ ID NO: 759370 - RNA, 15 nt, Leptospira interrogans serovar lai str. 56601
uacuaaaaauucaua

SEQ ID NO: 759371 - RNA, 16 nt, Leptospira interrogans serovar lai str. 56601
uacuaaaaauucauau

SEQ ID NO: 759372 - RNA, 18 nt, Leptospira interrogans serovar lai str. 56601
uacuauaacuuuaaaaaa

SEQ ID NO: 759373 - RNA, 21 nt, Leptospira interrogans serovar lai str. 56601
uacguuuuauuauauaauuuu

SEQ ID NO: 759374 - RNA, 15 nt, Leptospira interrogans serovar lai str. 56601
uacuauaaacauauu

SEQ ID NO: 759375 - RNA, 17 nt, Leptospira interrogans serovar lai str. 56601
uacuauaaacauauuau

SEQ ID NO: 759376 - RNA, 21 nt, Leptospira interrogans serovar lai str. 56601
uacuauaaacauauuauuuuc

SEQ ID NO: 759377 - RNA, 16 nt, Leptospira interrogans serovar lai str. 56601
uacggaugugaauucu

SEQ ID NO: 759378 - RNA, 18 nt, Leptospira interrogans serovar lai str. 56601
uacggaugugaauucucu

SEQ ID NO: 759379 - RNA, 22 nt, Leptospira interrogans serovar lai str. 56601
uacggauucucgcauuuuccuu

SEQ ID NO: 759380 - RNA, 20 nt, Leptospira interrogans serovar lai str. 56601
uacggauugccuaaauuccu

SEQ ID NO: 759381 - RNA, 18 nt, Leptospira interrogans serovar lai str. 56601
uacggauuucuauaaaau

SEQ ID NO: 759382 - RNA, 15 nt, Leptospira interrogans serovar lai str. 56601
uacggggaauuuuua

SEQ ID NO: 759383 - RNA, 20 nt, Leptospira interrogans serovar lai str. 56601
uacggaucaauucugaaaau

SEQ ID NO: 759384 - RNA, 16 nt, Leptospira interrogans serovar lai str. 56601
uacgaucuaaaaggac

SEQ ID NO: 759385 - RNA, 13 nt, Leptospira interrogans serovar lai str. 56601
uacgaauuucaga

SEQ ID NO: 759386 - RNA, 21 nt, Leptospira interrogans serovar lai str. 56601
uacgacaaaucuucuguaaaa

SEQ ID NO: 759387 - RNA, 18 nt, Leptospira interrogans serovar lai str. 56601
uaccucuauaaaauuaaa

SEQ ID NO: 759388 - RNA, 14 nt, Leptospira interrogans serovar lai str. 56601
uaccuuauaaaaau

SEQ ID NO: 759389 - RNA, 22 nt, Leptospira interrogans serovar lai str. 56601
uaccuguuuuaguucaaaaaca

SEQ ID NO: 759390 - RNA, 23 nt, Leptospira interrogans serovar lai str. 56601
uaccuguuuuaguucaaaaacau

SEQ ID NO: 759391 - RNA, 18 nt, Leptospira interrogans serovar lai str. 56601
uacgaaaacuuaaugaga

SEQ ID NO: 759392 - RNA, 19 nt, Leptospira interrogans serovar lai str. 56601
uacgaacaaauucuaaaau

SEQ ID NO: 759393 - RNA, 19 nt, Leptospira interrogans serovar lai str. 56601
uacgaacacauucuaaaau

SEQ ID NO: 759394 - RNA, 20 nt, Leptospira interrogans serovar lai str. 56601
uacgaacgaauucuaaaauu

SEQ ID NO: 759395 - RNA, 19 nt, Leptospira interrogans serovar lai str. 56601
uaccuugaaacuuuuaaua

SEQ ID NO: 759396 - RNA, 16 nt, Leptospira interrogans serovar lai str. 56601
uaccacgaauuaaaua

SEQ ID NO: 759397 - RNA, 16 nt, Leptospira interrogans serovar lai str. 56601
uaccacuuauuucuau

SEQ ID NO: 759398 - RNA, 18 nt, Leptospira interrogans serovar lai str. 56601
uaccuaauucucuucguu

SEQ ID NO: 759399 - RNA, 20 nt, Leptospira interrogans serovar lai str. 56601
uaccuauacaauucuuucuu

SEQ ID NO: 759400 - RNA, 14 nt, Leptospira interrogans serovar lai str. 56601
uaccguuuuuaaau

SEQ ID NO: 759401 - RNA, 21 nt, Leptospira interrogans serovar lai str. 56601
uaccuaaaauggauuuauaau

SEQ ID NO: 759402 - RNA, 15 nt, Leptospira interrogans serovar lai str. 56601
uaccgggauuuuaaa

SEQ ID NO: 759403 - RNA, 18 nt, Leptospira interrogans serovar lai str. 56601
uaccgggauuuuaaaaau

SEQ ID NO: 759404 - RNA, 17 nt, Leptospira interrogans serovar lai str. 56601
uagauucaaaagucuau

SEQ ID NO: 759405 - RNA, 15 nt, Leptospira interrogans serovar lai str. 56601
uagauucuuaauguc

SEQ ID NO: 759406 - RNA, 18 nt, Leptospira interrogans serovar lai str. 56601
uagauucuuaauguccca

SEQ ID NO: 759407 - RNA, 13 nt, Leptospira interrogans serovar lai str. 56601
uagauugcuuuuu

SEQ ID NO: 759408 - RNA, 20 nt, Leptospira interrogans serovar lai str. 56601
uagauugcuuuuuaaaagau

SEQ ID NO: 759409 - RNA, 16 nt, Leptospira interrogans serovar lai str. 56601
uagauucacuuuugcu

SEQ ID NO: 759410 - RNA, 19 nt, Leptospira interrogans serovar lai str. 56601
uagauuccuacauuauuuu

SEQ ID NO: 759411 - RNA, 19 nt, Leptospira interrogans serovar lai str. 56601
uagaugaacuuuuuuauau

SEQ ID NO: 759412 - RNA, 21 nt, Leptospira interrogans serovar lai str. 56601
uagaugaacuuuuuuauauag

SEQ ID NO: 759413 - RNA, 22 nt, Leptospira interrogans serovar lai str. 56601
uagauggagaauucauuuuucu

SEQ ID NO: 759414 - RNA, 23 nt, Leptospira interrogans serovar lai str. 56601
uagauggagaauucauuuuucua

SEQ ID NO: 759415 - RNA, 16 nt, Leptospira interrogans serovar lai str. 56601
uagauagagaauuaau

SEQ ID NO: 759416 - RNA, 17 nt, Leptospira interrogans serovar lai str. 56601
uagauagguucuuagaa

SEQ ID NO: 759417 - RNA, 14 nt, Leptospira interrogans serovar lai str. 56601
uagauauuucaaga

SEQ ID NO: 759418 - RNA, 17 nt, Leptospira interrogans serovar lai str. 56601
uagauccuagcuauuuu

SEQ ID NO: 759419 - RNA, 22 nt, Leptospira interrogans serovar lai str. 56601
uagaucuaagggaugguuguua

SEQ ID NO: 759420 - RNA, 17 nt, Leptospira interrogans serovar lai str. 56601
uagaucuaaauuuucuu

SEQ ID NO: 759421 - RNA, 19 nt, Leptospira interrogans serovar lai str. 56601
uagaucugauauuuuaaau

SEQ ID NO: 759422 - RNA, 23 nt, Leptospira interrogans serovar lai str. 56601
uagaucugauauuuuaaauugaa

SEQ ID NO: 759423 - RNA, 21 nt, Leptospira interrogans serovar lai str. 56601
uagaggagccaugccaaacac

SEQ ID NO: 759424 - RNA, 14 nt, Leptospira interrogans serovar lai str. 56601
uagagccaaauuuu

SEQ ID NO: 759425 - RNA, 15 nt, Leptospira interrogans serovar lai str. 56601
uagaguuuguuccaa

SEQ ID NO: 759426 - RNA, 12 nt, Leptospira interrogans serovar lai str. 56601
uagauaaauaca

SEQ ID NO: 759427 - RNA, 15 nt, Leptospira interrogans serovar lai str. 56601
uagauaaauacaucu

SEQ ID NO: 759428 - RNA, 22 nt, Leptospira interrogans serovar lai str. 56601
uagaguuguugaaaaauuucau

SEQ ID NO: 759429 - RNA, 16 nt, Leptospira interrogans serovar lai str. 56601
uagagugaauuuguaa

SEQ ID NO: 759430 - RNA, 12 nt, Leptospira interrogans serovar lai str. 56601
uagaguuucuuu

SEQ ID NO: 759431 - RNA, 17 nt, Leptospira interrogans serovar lai str. 56601
uagaguuuuugaaaaau

SEQ ID NO: 759432 - RNA, 22 nt, Leptospira interrogans serovar lai str. 56601
uagaguuauugaaaaauuucau

SEQ ID NO: 759433 - RNA, 13 nt, Leptospira interrogans serovar lai str. 56601
uagaguguugacu

SEQ ID NO: 759434 - RNA, 23 nt, Leptospira interrogans serovar lai str. 56601
uagaguguuguguugaguuucaa

SEQ ID NO: 759435 - RNA, 21 nt, Leptospira interrogans serovar lai str. 56601
uagaguguuguuuagaacaga

SEQ ID NO: 759436 - RNA, 18 nt, Leptospira interrogans serovar lai str. 56601
uagagugccgcaccuuuu

SEQ ID NO: 759437 - RNA, 21 nt, Leptospira interrogans serovar lai str. 56601
uagagucguugaaaauucuau

SEQ ID NO: 759438 - RNA, 15 nt, Leptospira interrogans serovar lai str. 56601
uagauaauuaaacaa

SEQ ID NO: 759439 - RNA, 16 nt, Leptospira interrogans serovar lai str. 56601
uagauaauuaaacaaa

SEQ ID NO: 759440 - RNA, 21 nt, Leptospira interrogans serovar lai str. 56601
uagauaauuaaacaaagaaua

SEQ ID NO: 759441 - RNA, 13 nt, Leptospira interrogans serovar lai str. 56601
uagauacauaaac

SEQ ID NO: 759442 - RNA, 20 nt, Leptospira interrogans serovar lai str. 56601
uagauaaggcuaaagaauac

SEQ ID NO: 759443 - RNA, 13 nt, Leptospira interrogans serovar lai str. 56601
uagcauuuuuaag

SEQ ID NO: 759444 - RNA, 15 nt, Leptospira interrogans serovar lai str. 56601
uagcauuuuuaagau

SEQ ID NO: 759445 - RNA, 18 nt, Leptospira interrogans serovar lai str. 56601
uagcauuuuuaagauuac

SEQ ID NO: 759446 - RNA, 17 nt, Leptospira interrogans serovar lai str. 56601
uagccaaguauaaaagu

SEQ ID NO: 759447 - RNA, 18 nt, Leptospira interrogans serovar lai str. 56601
uagccaaaucugaaaaag

SEQ ID NO: 759448 - RNA, 16 nt, Leptospira interrogans serovar lai str. 56601
uagcaugaaauuuucu

SEQ ID NO: 759449 - RNA, 23 nt, Leptospira interrogans serovar lai str. 56601
uagcaugaaauuuucuuagaaaa

SEQ ID NO: 759450 - RNA, 21 nt, Leptospira interrogans serovar lai str. 56601
uagcaguucuacuuuauuaaa

SEQ ID NO: 759451 - RNA, 19 nt, Leptospira interrogans serovar lai str. 56601
uagcagaacgcucucucaa

SEQ ID NO: 759452 - RNA, 23 nt, Leptospira interrogans serovar lai str. 56601
uagcagaugagcauuuuuuuaau

SEQ ID NO: 759453 - RNA, 21 nt, Leptospira interrogans serovar lai str. 56601
uagcagauuuucucaaaaaaa

SEQ ID NO: 759454 - RNA, 20 nt, Leptospira interrogans serovar lai str. 56601
uagcaaauuuacuucaauua

SEQ ID NO: 759455 - RNA, 13 nt, Leptospira interrogans serovar lai str. 56601
uagauugauuuaa

SEQ ID NO: 759456 - RNA, 14 nt, Leptospira interrogans serovar lai str. 56601
uagauugauuuaaa

SEQ ID NO: 759457 - RNA, 15 nt, Leptospira interrogans serovar lai str. 56601
uagcaauuugugaac

SEQ ID NO: 759458 - RNA, 20 nt, Leptospira interrogans serovar lai str. 56601
uagcacaaaugacauuuugu

SEQ ID NO: 759459 - RNA, 16 nt, Leptospira interrogans serovar lai str. 56601
uagcaccuuuuuuaag

SEQ ID NO: 759460 - RNA, 13 nt, Leptospira interrogans serovar lai str. 56601
uaggaacuuuuau

SEQ ID NO: 759461 - RNA, 20 nt, Leptospira interrogans serovar lai str. 56601
uaggaauuuccgauaaagaa

SEQ ID NO: 759462 - RNA, 18 nt, Leptospira interrogans serovar lai str. 56601
uaggaaaugaaaaagaau

SEQ ID NO: 759463 - RNA, 11 nt, Leptospira interrogans serovar lai str. 56601
uaggaaaggga

SEQ ID NO: 759464 - RNA, 13 nt, Leptospira interrogans serovar lai str. 56601
uaggaaauucuuu

SEQ ID NO: 759465 - RNA, 15 nt, Leptospira interrogans serovar lai str. 56601
uaggaaauucuuuuc

SEQ ID NO: 759466 - RNA, 17 nt, Leptospira interrogans serovar lai str. 56601
uaggaaauucuuuucca

SEQ ID NO: 759467 - RNA, 23 nt, Leptospira interrogans serovar lai str. 56601
uaggaacccauacaaaauuuaaa

SEQ ID NO: 759468 - RNA, 15 nt, Leptospira interrogans serovar lai str. 56601
uaggaacugcuucca

SEQ ID NO: 759469 - RNA, 21 nt, Leptospira interrogans serovar lai str. 56601
uaggaacuacuacuuuuagaa

SEQ ID NO: 759470 - RNA, 23 nt, Leptospira interrogans serovar lai str. 56601
uaggaacuacuacuuuuagaaaa

SEQ ID NO: 759471 - RNA, 15 nt, Leptospira interrogans serovar lai str. 56601
uaggaacucauacuu

SEQ ID NO: 759472 - RNA, 21 nt, Leptospira interrogans serovar lai str. 56601
uaggaacucauacuuuuagaa

SEQ ID NO: 759473 - RNA, 23 nt, Leptospira interrogans serovar lai str. 56601
uaggaacucauauuuuuagaaaa

SEQ ID NO: 759474 - RNA, 18 nt, Leptospira interrogans serovar lai str. 56601
uaggaacuccuugguuca

SEQ ID NO: 759475 - RNA, 21 nt, Leptospira interrogans serovar lai str. 56601
uagcuuuugagcaguaaaaaa

SEQ ID NO: 759476 - RNA, 22 nt, Leptospira interrogans serovar lai str. 56601
uagcuuuugagcaguaaaaaag

SEQ ID NO: 759477 - RNA, 16 nt, Leptospira interrogans serovar lai str. 56601
uagcuucuuuaaaaac

SEQ ID NO: 759478 - RNA, 14 nt, Leptospira interrogans serovar lai str. 56601
uaggaucuaugucc

SEQ ID NO: 759479 - RNA, 19 nt, Leptospira interrogans serovar lai str. 56601
uaggaguuccuacauuuau

SEQ ID NO: 759480 - RNA, 18 nt, Leptospira interrogans serovar lai str. 56601
uaggaucagaauuucuuu

SEQ ID NO: 759481 - RNA, 19 nt, Leptospira interrogans serovar lai str. 56601
uaggaucagaauuucuuuc

SEQ ID NO: 759482 - RNA, 18 nt, Leptospira interrogans serovar lai str. 56601
uaggauauuugauauaau

SEQ ID NO: 759483 - RNA, 12 nt, Leptospira interrogans serovar lai str. 56601
uaggauuuaaau

SEQ ID NO: 759484 - RNA, 14 nt, Leptospira interrogans serovar lai str. 56601
uaggauuuuagaau

SEQ ID NO: 759485 - RNA, 18 nt, Leptospira interrogans serovar lai str. 56601
uaggauuuuagaaucaga

SEQ ID NO: 759486 - RNA, 22 nt, Leptospira interrogans serovar lai str. 56601
uaggauuuuuggaauaaaauca

SEQ ID NO: 759487 - RNA, 15 nt, Leptospira interrogans serovar lai str. 56601
uaggauaauacaaau

SEQ ID NO: 759488 - RNA, 17 nt, Leptospira interrogans serovar lai str. 56601
uaggacggauuuuagau

SEQ ID NO: 759489 - RNA, 19 nt, Leptospira interrogans serovar lai str. 56601
uagcuaagucuuuaaaaau

SEQ ID NO: 759490 - RNA, 16 nt, Leptospira interrogans serovar lai str. 56601
uagcgucuaaaaaauu

SEQ ID NO: 759491 - RNA, 15 nt, Leptospira interrogans serovar lai str. 56601
uagcucuugaauaaa

SEQ ID NO: 759492 - RNA, 17 nt, Leptospira interrogans serovar lai str. 56601
uagcgauacuuaaaaau

SEQ ID NO: 759493 - RNA, 16 nt, Leptospira interrogans serovar lai str. 56601
uagcgguaaaagaaua

SEQ ID NO: 759494 - RNA, 17 nt, Leptospira interrogans serovar lai str. 56601
uagccguagggaugaac

SEQ ID NO: 759495 - RNA, 13 nt, Leptospira interrogans serovar lai str. 56601
uagccuaauuuac

SEQ ID NO: 759496 - RNA, 22 nt, Leptospira interrogans serovar lai str. 56601
uagccuaauuuacuacaucuaa

SEQ ID NO: 759497 - RNA, 15 nt, Leptospira interrogans serovar lai str. 56601
uagccauaucauauu

SEQ ID NO: 759498 - RNA, 18 nt, Leptospira interrogans serovar lai str. 56601
uagccaugguaagaagaa

SEQ ID NO: 759499 - RNA, 18 nt, Leptospira interrogans serovar lai str. 56601
uauccaaaaguuuauaaa

SEQ ID NO: 759500 - RNA, 10 nt, Leptospira interrogans serovar lai str. 56601
uauccaaaau

SEQ ID NO: 759501 - RNA, 14 nt, Leptospira interrogans serovar lai str. 56601
uauccaaaacaauc

SEQ ID NO: 759502 - RNA, 20 nt, Leptospira interrogans serovar lai str. 56601
uaucauucuuuccuauaaaa

SEQ ID NO: 759503 - RNA, 14 nt, Leptospira interrogans serovar lai str. 56601
uauccacuaaaaua

SEQ ID NO: 759504 - RNA, 19 nt, Leptospira interrogans serovar lai str. 56601
uauccauauacguaaaaau

SEQ ID NO: 759505 - RNA, 12 nt, Leptospira interrogans serovar lai str. 56601
uauccauaaauu

SEQ ID NO: 759506 - RNA, 13 nt, Leptospira interrogans serovar lai str. 56601
uaucagaaaaaca

SEQ ID NO: 759507 - RNA, 18 nt, Leptospira interrogans serovar lai str. 56601
uaucagaaaaacauacuu

SEQ ID NO: 759508 - RNA, 21 nt, Leptospira interrogans serovar lai str. 56601
uaucagaaaaacauacuuuuu

SEQ ID NO: 759509 - RNA, 18 nt, Leptospira interrogans serovar lai str. 56601
uaucagaaccuuuaguuu

SEQ ID NO: 759510 - RNA, 20 nt, Leptospira interrogans serovar lai str. 56601
uaucauaaauuuuuauugca

SEQ ID NO: 759511 - RNA, 14 nt, Leptospira interrogans serovar lai str. 56601
uauauuuuuaaaaa

SEQ ID NO: 759512 - RNA, 15 nt, Leptospira interrogans serovar lai str. 56601
uauauuuuuaaaaag

SEQ ID NO: 759513 - RNA, 17 nt, Leptospira interrogans serovar lai str. 56601
uauauuuuuaaaaagua

SEQ ID NO: 759514 - RNA, 20 nt, Leptospira interrogans serovar lai str. 56601
uauauuggcgaaagagggaa

SEQ ID NO: 759515 - RNA, 14 nt, Leptospira interrogans serovar lai str. 56601
uauauugucuugaa

SEQ ID NO: 759516 - RNA, 22 nt, Leptospira interrogans serovar lai str. 56601
uauauugucuugaauuacaauu

SEQ ID NO: 759517 - RNA, 18 nt, Leptospira interrogans serovar lai str. 56601
uauauuuugauaaagaau

SEQ ID NO: 759518 - RNA, 13 nt, Leptospira interrogans serovar lai str. 56601
uauauuuuuugaa

SEQ ID NO: 759519 - RNA, 15 nt, Leptospira interrogans serovar lai str. 56601
uauauuuuugugaaa

SEQ ID NO: 759520 - RNA, 14 nt, Leptospira interrogans serovar lai str. 56601
uauauuuuuuuaau

SEQ ID NO: 759521 - RNA, 18 nt, Leptospira interrogans serovar lai str. 56601
uauauucaguauucauuu

SEQ ID NO: 759522 - RNA, 19 nt, Leptospira interrogans serovar lai str. 56601
uauauugagaucaaauacu

SEQ ID NO: 759523 - RNA, 21 nt, Leptospira interrogans serovar lai str. 56601
uauauucuuuucugaauaaaa

SEQ ID NO: 759524 - RNA, 20 nt, Leptospira interrogans serovar lai str. 56601
uauauucgcuccguuuugaa

SEQ ID NO: 759525 - RNA, 15 nt, Leptospira interrogans serovar lai str. 56601
uauauucuuauauau

SEQ ID NO: 759526 - RNA, 17 nt, Leptospira interrogans serovar lai str. 56601
uauauucuuauauaucu

SEQ ID NO: 759527 - RNA, 19 nt, Leptospira interrogans serovar lai str. 56601
uaucacgaaaauuaaaaaa

SEQ ID NO: 759528 - RNA, 13 nt, Leptospira interrogans serovar lai str. 56601
uaucaauagaaau

SEQ ID NO: 759529 - RNA, 14 nt, Leptospira interrogans serovar lai str. 56601
uaucaauagaaaua

SEQ ID NO: 759530 - RNA, 17 nt, Leptospira interrogans serovar lai str. 56601
uaucaauagaaauacca

SEQ ID NO: 759531 - RNA, 16 nt, Leptospira interrogans serovar lai str. 56601
uaucaaaccuuucuuu

SEQ ID NO: 759532 - RNA, 19 nt, Leptospira interrogans serovar lai str. 56601
uaucaaaccuuucuuucug

SEQ ID NO: 759533 - RNA, 22 nt, Leptospira interrogans serovar lai str. 56601
uaucaaacgaaguuuauuucua

SEQ ID NO: 759534 - RNA, 13 nt, Leptospira interrogans serovar lai str. 56601
uauaacuuuaaaa

SEQ ID NO: 759535 - RNA, 15 nt, Leptospira interrogans serovar lai str. 56601
uauaacguuauaaaa

SEQ ID NO: 759536 - RNA, 13 nt, Leptospira interrogans serovar lai str. 56601
uauacaguuugau

SEQ ID NO: 759537 - RNA, 15 nt, Leptospira interrogans serovar lai str. 56601
uauaacuuuaaaaaa

SEQ ID NO: 759538 - RNA, 17 nt, Leptospira interrogans serovar lai str. 56601
uauaacuuuaaaaaaua

SEQ ID NO: 759539 - RNA, 18 nt, Leptospira interrogans serovar lai str. 56601
uauaacuuuaaaaaauaa

SEQ ID NO: 759540 - RNA, 16 nt, Leptospira interrogans serovar lai str. 56601
uauaccaguuaaauuc

SEQ ID NO: 759541 - RNA, 16 nt, Leptospira interrogans serovar lai str. 56601
uauacuuucaaaaaau

SEQ ID NO: 759542 - RNA, 19 nt, Leptospira interrogans serovar lai str. 56601
uauacuuucaaaaaauaua

SEQ ID NO: 759543 - RNA, 13 nt, Leptospira interrogans serovar lai str. 56601
uauacuuuaaaaa

SEQ ID NO: 759544 - RNA, 14 nt, Leptospira interrogans serovar lai str. 56601
uauacuuuaaaaaa

SEQ ID NO: 759545 - RNA, 16 nt, Leptospira interrogans serovar lai str. 56601
uauacuuuaaaaaaua

SEQ ID NO: 759546 - RNA, 21 nt, Leptospira interrogans serovar lai str. 56601
uauacuuuaaaaaauaucuua

SEQ ID NO: 759547 - RNA, 17 nt, Leptospira interrogans serovar lai str. 56601
uauacuuauaaagaauu

SEQ ID NO: 759548 - RNA, 16 nt, Leptospira interrogans serovar lai str. 56601
uauagaaccaucucaa

SEQ ID NO: 759549 - RNA, 21 nt, Leptospira interrogans serovar lai str. 56601
uauagaaccaucucaaaaaua

SEQ ID NO: 759550 - RNA, 21 nt, Leptospira interrogans serovar lai str. 56601
uauagaaaccgauuuuaaucu

SEQ ID NO: 759551 - RNA, 20 nt, Leptospira interrogans serovar lai str. 56601
uauagaaauacuuaaaauga

SEQ ID NO: 759552 - RNA, 14 nt, Leptospira interrogans serovar lai str. 56601
uauacucuuaaaau

SEQ ID NO: 759553 - RNA, 20 nt, Leptospira interrogans serovar lai str. 56601
uauacggauuucuauaaaau

SEQ ID NO: 759554 - RNA, 16 nt, Leptospira interrogans serovar lai str. 56601
uauacuaaaauuauuc

SEQ ID NO: 759555 - RNA, 18 nt, Leptospira interrogans serovar lai str. 56601
uauagauaauuuuuacuc

SEQ ID NO: 759556 - RNA, 18 nt, Leptospira interrogans serovar lai str. 56601
uauagagagcguuuuguu

SEQ ID NO: 759557 - RNA, 16 nt, Leptospira interrogans serovar lai str. 56601
uauagagauuuccuaa

SEQ ID NO: 759558 - RNA, 18 nt, Leptospira interrogans serovar lai str. 56601
uauagauugauucuuuaa

SEQ ID NO: 759559 - RNA, 20 nt, Leptospira interrogans serovar lai str. 56601
uauagacaacguuacuuuua

SEQ ID NO: 759560 - RNA, 13 nt, Leptospira interrogans serovar lai str. 56601
uauagagaaaucc

SEQ ID NO: 759561 - RNA, 18 nt, Leptospira interrogans serovar lai str. 56601
uauagucuucaaaauuga

SEQ ID NO: 759562 - RNA, 13 nt, Leptospira interrogans serovar lai str. 56601
uauauauuuuuaa

SEQ ID NO: 759563 - RNA, 16 nt, Leptospira interrogans serovar lai str. 56601
uauauauuuuuaauuu

SEQ ID NO: 759564 - RNA, 17 nt, Leptospira interrogans serovar lai str. 56601
uauauauugaaauauua

SEQ ID NO: 759565 - RNA, 18 nt, Leptospira interrogans serovar lai str. 56601
uauauauugaaauauuau

SEQ ID NO: 759566 - RNA, 15 nt, Leptospira interrogans serovar lai str. 56601
uauauagaacuuuuc

SEQ ID NO: 759567 - RNA, 17 nt, Leptospira interrogans serovar lai str. 56601
uaguuucuuuuuuagau

SEQ ID NO: 759568 - RNA, 16 nt, Leptospira interrogans serovar lai str. 56601
uaguuucaauuuaaaa

SEQ ID NO: 759569 - RNA, 20 nt, Leptospira interrogans serovar lai str. 56601
uaguuucuaaguguaaaauu

SEQ ID NO: 759570 - RNA, 16 nt, Leptospira interrogans serovar lai str. 56601
uaguuuccaaaaaaga

SEQ ID NO: 759571 - RNA, 19 nt, Leptospira interrogans serovar lai str. 56601
uaguuuccaaaaaagacuu

SEQ ID NO: 759572 - RNA, 22 nt, Leptospira interrogans serovar lai str. 56601
uaguuuucauuacaaaacacug

SEQ ID NO: 759573 - RNA, 17 nt, Leptospira interrogans serovar lai str. 56601
uaguuuuccuucuagau

SEQ ID NO: 759574 - RNA, 22 nt, Leptospira interrogans serovar lai str. 56601
uaguuuuccuucuagauaaggu

SEQ ID NO: 759575 - RNA, 14 nt, Leptospira interrogans serovar lai str. 56601
uaguuuuauguggg

SEQ ID NO: 759576 - RNA, 14 nt, Leptospira interrogans serovar lai str. 56601
uaguuuuauuagaa

SEQ ID NO: 759577 - RNA, 16 nt, Leptospira interrogans serovar lai str. 56601
uaguuuuuucaaaaau

SEQ ID NO: 759578 - RNA, 23 nt, Leptospira interrogans serovar lai str. 56601
uaguuuuuugauuccuuuuucua

SEQ ID NO: 759579 - RNA, 15 nt, Leptospira interrogans serovar lai str. 56601
uaguuuuuauuugau

SEQ ID NO: 759580 - RNA, 22 nt, Leptospira interrogans serovar lai str. 56601
uaguuuuuauuugauuagaaaa

SEQ ID NO: 759581 - RNA, 20 nt, Leptospira interrogans serovar lai str. 56601
uaguuuugagauuacaaaaa

SEQ ID NO: 759582 - RNA, 16 nt, Leptospira interrogans serovar lai str. 56601
uaguuuugauguuuuu

SEQ ID NO: 759583 - RNA, 22 nt, Leptospira interrogans serovar lai str. 56601
uaguuuuguaccguaaagaaga

SEQ ID NO: 759584 - RNA, 13 nt, Leptospira interrogans serovar lai str. 56601
uauaaaaaauaau

SEQ ID NO: 759585 - RNA, 21 nt, Leptospira interrogans serovar lai str. 56601
uauaaaaaauaauauuauaaa

SEQ ID NO: 759586 - RNA, 14 nt, Leptospira interrogans serovar lai str. 56601
uauaaaaacagcac

SEQ ID NO: 759587 - RNA, 19 nt, Leptospira interrogans serovar lai str. 56601
uauaaaaacaguaucgaaa

SEQ ID NO: 759588 - RNA, 23 nt, Leptospira interrogans serovar lai str. 56601
uauaaaaacgguauuuaaaauua

SEQ ID NO: 759589 - RNA, 16 nt, Leptospira interrogans serovar lai str. 56601
uauaaaaacuugauau

SEQ ID NO: 759590 - RNA, 15 nt, Leptospira interrogans serovar lai str. 56601
uauaaaccaucucaa

SEQ ID NO: 759591 - RNA, 18 nt, Leptospira interrogans serovar lai str. 56601
uauaaaccaucucaaaaa

SEQ ID NO: 759592 - RNA, 22 nt, Leptospira interrogans serovar lai str. 56601
uauaaaccaucucaaaaacacu

SEQ ID NO: 759593 - RNA, 18 nt, Leptospira interrogans serovar lai str. 56601
uauaaaagaaacauaaua

SEQ ID NO: 759594 - RNA, 16 nt, Leptospira interrogans serovar lai str. 56601
uauaaacauauuauuu

SEQ ID NO: 759595 - RNA, 16 nt, Leptospira interrogans serovar lai str. 56601
uauaaaaccuuuauuu

SEQ ID NO: 759596 - RNA, 21 nt, Leptospira interrogans serovar lai str. 56601
uauaaaaccuuuauuuaauaa

SEQ ID NO: 759597 - RNA, 22 nt, Leptospira interrogans serovar lai str. 56601
uauaaaacgaaauuauacaaaa

SEQ ID NO: 759598 - RNA, 21 nt, Leptospira interrogans serovar lai str. 56601
uauaaaaaugauacuauuaau

SEQ ID NO: 759599 - RNA, 16 nt, Leptospira interrogans serovar lai str. 56601
uauaaaaauuaaacag

SEQ ID NO: 759600 - RNA, 13 nt, Leptospira interrogans serovar lai str. 56601
uauaaagaaaaac

SEQ ID NO: 759601 - RNA, 14 nt, Leptospira interrogans serovar lai str. 56601
uauaaagaaaaaca

SEQ ID NO: 759602 - RNA, 14 nt, Leptospira interrogans serovar lai str. 56601
uauaacaauucucg

SEQ ID NO: 759603 - RNA, 23 nt, Leptospira interrogans serovar lai str. 56601
uauaacaauucucgauagaacaa

SEQ ID NO: 759604 - RNA, 19 nt, Leptospira interrogans serovar lai str. 56601
uauaacgaaacuuuaauuu

SEQ ID NO: 759605 - RNA, 18 nt, Leptospira interrogans serovar lai str. 56601
uauaacaaaguauuuaau

SEQ ID NO: 759606 - RNA, 20 nt, Leptospira interrogans serovar lai str. 56601
uauaaauucgcaaaaaaaau

SEQ ID NO: 759607 - RNA, 20 nt, Leptospira interrogans serovar lai str. 56601
uauaaauucgccguaaaaaa

SEQ ID NO: 759608 - RNA, 15 nt, Leptospira interrogans serovar lai str. 56601
uauaaauuuaaaaaa

SEQ ID NO: 759609 - RNA, 12 nt, Leptospira interrogans serovar lai str. 56601
uauaaauuauuu

SEQ ID NO: 759610 - RNA, 22 nt, Leptospira interrogans serovar lai str. 56601
uauaaauucaucuaaaaaaaac

SEQ ID NO: 759611 - RNA, 22 nt, Leptospira interrogans serovar lai str. 56601
uagugcacugcuauaauuuaac

SEQ ID NO: 759612 - RNA, 20 nt, Leptospira interrogans serovar lai str. 56601
uaguccguccacaaauugaa

SEQ ID NO: 759613 - RNA, 22 nt, Leptospira interrogans serovar lai str. 56601
uagucauuuugauaauuucauu

SEQ ID NO: 759614 - RNA, 17 nt, Leptospira interrogans serovar lai str. 56601
uagucaaguuaauagag

SEQ ID NO: 759615 - RNA, 12 nt, Leptospira interrogans serovar lai str. 56601
uaguucaauuaa

SEQ ID NO: 759616 - RNA, 13 nt, Leptospira interrogans serovar lai str. 56601
uaguucaaaaaca

SEQ ID NO: 759617 - RNA, 17 nt, Leptospira interrogans serovar lai str. 56601
uaguguuuaauuuuaaa

SEQ ID NO: 759618 - RNA, 16 nt, Leptospira interrogans serovar lai str. 56601
uaguuuacguuuuaau

SEQ ID NO: 759619 - RNA, 14 nt, Leptospira interrogans serovar lai str. 56601
uaguucccacaaau

SEQ ID NO: 759620 - RNA, 12 nt, Leptospira interrogans serovar lai str. 56601
uaguucccacau

SEQ ID NO: 759621 - RNA, 15 nt, Leptospira interrogans serovar lai str. 56601
uaguucccacauuuu

SEQ ID NO: 759622 - RNA, 17 nt, Leptospira interrogans serovar lai str. 56601
uaguucccacauuuugu

SEQ ID NO: 759623 - RNA, 21 nt, Leptospira interrogans serovar lai str. 56601
uaguucccaccuuuuuuuaug

SEQ ID NO: 759624 - RNA, 18 nt, Leptospira interrogans serovar lai str. 56601
uaguuccuacaaauuaag

SEQ ID NO: 759625 - RNA, 22 nt, Leptospira interrogans serovar lai str. 56601
uaguuccuacauuuuaaaaauu

SEQ ID NO: 759626 - RNA, 20 nt, Leptospira interrogans serovar lai str. 56601
uaguuccuacgguuuuaguc

SEQ ID NO: 759627 - RNA, 20 nt, Leptospira interrogans serovar lai str. 56601
uaguuccaauuaacaaaacu

SEQ ID NO: 759628 - RNA, 16 nt, Leptospira interrogans serovar lai str. 56601
uaguaaauuaacagcu

SEQ ID NO: 759629 - RNA, 19 nt, Leptospira interrogans serovar lai str. 56601
uaguaaagauuagaaaaac

SEQ ID NO: 759630 - RNA, 16 nt, Leptospira interrogans serovar lai str. 56601
uaguaaacuacuaaau

SEQ ID NO: 759631 - RNA, 13 nt, Leptospira interrogans serovar lai str. 56601
uaguaaaauuuaa

SEQ ID NO: 759632 - RNA, 16 nt, Leptospira interrogans serovar lai str. 56601
uaguaaaauuuaaaau

SEQ ID NO: 759633 - RNA, 15 nt, Leptospira interrogans serovar lai str. 56601
uaguaaaauuuaaau

SEQ ID NO: 759634 - RNA, 23 nt, Leptospira interrogans serovar lai str. 56601
uagguuuuguaauaguucccaca

SEQ ID NO: 759635 - RNA, 19 nt, Leptospira interrogans serovar lai str. 56601
uagguuuguacguaaaaau

SEQ ID NO: 759636 - RNA, 12 nt, Leptospira interrogans serovar lai str. 56601
uaguaaaagaaa

SEQ ID NO: 759637 - RNA, 19 nt, Leptospira interrogans serovar lai str. 56601
uaguagguccuacauguaa

SEQ ID NO: 759638 - RNA, 19 nt, Leptospira interrogans serovar lai str. 56601
uaguaucauaaguuuugau

SEQ ID NO: 759639 - RNA, 14 nt, Leptospira interrogans serovar lai str. 56601
uaguaguucccacc

SEQ ID NO: 759640 - RNA, 18 nt, Leptospira interrogans serovar lai str. 56601
uaguaguucucacauuua

SEQ ID NO: 759641 - RNA, 16 nt, Leptospira interrogans serovar lai str. 56601
uaguauauaauggcuc

SEQ ID NO: 759642 - RNA, 16 nt, Leptospira interrogans serovar lai str. 56601
uaguaugcgaaauucc

SEQ ID NO: 759643 - RNA, 17 nt, Leptospira interrogans serovar lai str. 56601
uaguaugcgaaauuccu

SEQ ID NO: 759644 - RNA, 20 nt, Leptospira interrogans serovar lai str. 56601
uaguauuuaagaaucaucuu

SEQ ID NO: 759645 - RNA, 18 nt, Leptospira interrogans serovar lai str. 56601
uaguauguuauuuuagcu

SEQ ID NO: 759646 - RNA, 18 nt, Leptospira interrogans serovar lai str. 56601
uagguaaagauuuucuaa

SEQ ID NO: 759647 - RNA, 13 nt, Leptospira interrogans serovar lai str. 56601
uagguaauagaaa

SEQ ID NO: 759648 - RNA, 15 nt, Leptospira interrogans serovar lai str. 56601
uagguagauguaaua

SEQ ID NO: 759649 - RNA, 17 nt, Leptospira interrogans serovar lai str. 56601
uagguaauuuaggaaua

SEQ ID NO: 759650 - RNA, 15 nt, Leptospira interrogans serovar lai str. 56601
uaggcuaaucaaauu

SEQ ID NO: 759651 - RNA, 15 nt, Leptospira interrogans serovar lai str. 56601
uaggcuauuuuacug

SEQ ID NO: 759652 - RNA, 11 nt, Leptospira interrogans serovar lai str. 56601
uagggaaaacu

SEQ ID NO: 759653 - RNA, 14 nt, Leptospira interrogans serovar lai str. 56601
uagggaaaacucaa

SEQ ID NO: 759654 - RNA, 18 nt, Leptospira interrogans serovar lai str. 56601
uagggaaaacucaucaca

SEQ ID NO: 759655 - RNA, 17 nt, Leptospira interrogans serovar lai str. 56601
uagggaguuccuacacu

SEQ ID NO: 759656 - RNA, 15 nt, Leptospira interrogans serovar lai str. 56601
uaggcaucauucuuu

SEQ ID NO: 759657 - RNA, 15 nt, Leptospira interrogans serovar lai str. 56601
uaggcgcggaaaaau

SEQ ID NO: 759658 - RNA, 17 nt, Leptospira interrogans serovar lai str. 56601
uaggcccgaauuuuaaa

SEQ ID NO: 759659 - RNA, 23 nt, Leptospira interrogans serovar lai str. 56601
ucagccgcgcuuuccuuauuaaa

SEQ ID NO: 759660 - RNA, 13 nt, Leptospira interrogans serovar lai str. 56601
ucacugaaaauuu

SEQ ID NO: 759661 - RNA, 15 nt, Leptospira interrogans serovar lai str. 56601
ucacugaaaauuuaa

SEQ ID NO: 759662 - RNA, 13 nt, Leptospira interrogans serovar lai str. 56601
ucagcuacaauca

SEQ ID NO: 759663 - RNA, 14 nt, Leptospira interrogans serovar lai str. 56601
ucagcuacaaucaa

SEQ ID NO: 759664 - RNA, 19 nt, Leptospira interrogans serovar lai str. 56601
ucagcuacaaucaauaaau

SEQ ID NO: 759665 - RNA, 20 nt, Leptospira interrogans serovar lai str. 56601
ucagcuucagucaaguuauu

SEQ ID NO: 759666 - RNA, 19 nt, Leptospira interrogans serovar lai str. 56601
ucaguaaaacgcucucuac

SEQ ID NO: 759667 - RNA, 22 nt, Leptospira interrogans serovar lai str. 56601
ucagguuuuaucaaauaaaguu

SEQ ID NO: 759668 - RNA, 17 nt, Leptospira interrogans serovar lai str. 56601
ucagggcucaaagucau

SEQ ID NO: 759669 - RNA, 16 nt, Leptospira interrogans serovar lai str. 56601
ucagggccggagaaaa

SEQ ID NO: 759670 - RNA, 13 nt, Leptospira interrogans serovar lai str. 56601
ucaggauuacuaa

SEQ ID NO: 759671 - RNA, 17 nt, Leptospira interrogans serovar lai str. 56601
ucaggauuacuaaugca

SEQ ID NO: 759672 - RNA, 14 nt, Leptospira interrogans serovar lai str. 56601
ucagggaaaaauaa

SEQ ID NO: 759673 - RNA, 18 nt, Leptospira interrogans serovar lai str. 56601
ucagucaccucuauaaaa

SEQ ID NO: 759674 - RNA, 14 nt, Leptospira interrogans serovar lai str. 56601
ucaguuaauacaaa

SEQ ID NO: 759675 - RNA, 20 nt, Leptospira interrogans serovar lai str. 56601
ucaguuccgguuugacuuuc

SEQ ID NO: 759676 - RNA, 19 nt, Leptospira interrogans serovar lai str. 56601
ucauaaaaauaaagaaacu

SEQ ID NO: 759677 - RNA, 13 nt, Leptospira interrogans serovar lai str. 56601
ucaguucaaaaua

SEQ ID NO: 759678 - RNA, 17 nt, Leptospira interrogans serovar lai str. 56601
ucaguucaaaauauuua

SEQ ID NO: 759679 - RNA, 16 nt, Leptospira interrogans serovar lai str. 56601
ucauaaguguaugaaa

SEQ ID NO: 759680 - RNA, 14 nt, Leptospira interrogans serovar lai str. 56601
ucauaauaaaacua

SEQ ID NO: 759681 - RNA, 16 nt, Leptospira interrogans serovar lai str. 56601
ucauaacgugacaaac

SEQ ID NO: 759682 - RNA, 13 nt, Leptospira interrogans serovar lai str. 56601
ucauaacuuggcc

SEQ ID NO: 759683 - RNA, 18 nt, Leptospira interrogans serovar lai str. 56601
ucauaacaaauaaaagga

SEQ ID NO: 759684 - RNA, 23 nt, Leptospira interrogans serovar lai str. 56601
ucauaaaggugcaugaaaauaau

SEQ ID NO: 759685 - RNA, 19 nt, Leptospira interrogans serovar lai str. 56601
ucaucgaacagcccaaaaa

SEQ ID NO: 759686 - RNA, 14 nt, Leptospira interrogans serovar lai str. 56601
ucaucauucugaaa

SEQ ID NO: 759687 - RNA, 17 nt, Leptospira interrogans serovar lai str. 56601
ucaucauucugaaaaaa

SEQ ID NO: 759688 - RNA, 19 nt, Leptospira interrogans serovar lai str. 56601
ucaucauucugaaaaaagu

SEQ ID NO: 759689 - RNA, 19 nt, Leptospira interrogans serovar lai str. 56601
ucaucaggaccaaaucuuu

SEQ ID NO: 759690 - RNA, 12 nt, Leptospira interrogans serovar lai str. 56601
ucauacauuuug

SEQ ID NO: 759691 - RNA, 13 nt, Leptospira interrogans serovar lai str. 56601
ucauacaguaaaa

SEQ ID NO: 759692 - RNA, 17 nt, Leptospira interrogans serovar lai str. 56601
ucauaauccuaugaaaa

SEQ ID NO: 759693 - RNA, 14 nt, Leptospira interrogans serovar lai str. 56601
ucauaguuucuaag

SEQ ID NO: 759694 - RNA, 14 nt, Leptospira interrogans serovar lai str. 56601
ucauauauaguuuu

SEQ ID NO: 759695 - RNA, 16 nt, Leptospira interrogans serovar lai str. 56601
ucauauaauaaaaaua

SEQ ID NO: 759696 - RNA, 12 nt, Leptospira interrogans serovar lai str. 56601
ucauaguuccca

SEQ ID NO: 759697 - RNA, 16 nt, Leptospira interrogans serovar lai str. 56601
ucauacuuuagaaauu

SEQ ID NO: 759698 - RNA, 19 nt, Leptospira interrogans serovar lai str. 56601
ucauacuuuagaaauuucu

SEQ ID NO: 759699 - RNA, 23 nt, Leptospira interrogans serovar lai str. 56601
ucauacuuuagaaauuucuaaua

SEQ ID NO: 759700 - RNA, 15 nt, Leptospira interrogans serovar lai str. 56601
ucauacuuuuaaaaa

SEQ ID NO: 759701 - RNA, 14 nt, Leptospira interrogans serovar lai str. 56601
ucauacuucuaaaa

SEQ ID NO: 759702 - RNA, 15 nt, Leptospira interrogans serovar lai str. 56601
ucauacuucuaaaaa

SEQ ID NO: 759703 - RNA, 16 nt, Leptospira interrogans serovar lai str. 56601
ucauacuucuaaaaaa

SEQ ID NO: 759704 - RNA, 21 nt, Leptospira interrogans serovar lai str. 56601
ucauagaggcuuuacauuuuu

SEQ ID NO: 759705 - RNA, 15 nt, Leptospira interrogans serovar lai str. 56601
ucauagaguuucuuu

SEQ ID NO: 759706 - RNA, 16 nt, Leptospira interrogans serovar lai str. 56601
ucauauugaaaucuga

SEQ ID NO: 759707 - RNA, 15 nt, Leptospira interrogans serovar lai str. 56601
ucauaucaaauucau

SEQ ID NO: 759708 - RNA, 16 nt, Leptospira interrogans serovar lai str. 56601
ucauaucccaauaagg

SEQ ID NO: 759709 - RNA, 20 nt, Leptospira interrogans serovar lai str. 56601
ucauauccgaaagauaaauc

SEQ ID NO: 759710 - RNA, 12 nt, Leptospira interrogans serovar lai str. 56601
ucaucaaaacuu

SEQ ID NO: 759711 - RNA, 17 nt, Leptospira interrogans serovar lai str. 56601
ucaucaauuuuggaaag

SEQ ID NO: 759712 - RNA, 14 nt, Leptospira interrogans serovar lai str. 56601
ucaucuuuuccauu

SEQ ID NO: 759713 - RNA, 15 nt, Leptospira interrogans serovar lai str. 56601
ucaucuuuuccauug

SEQ ID NO: 759714 - RNA, 14 nt, Leptospira interrogans serovar lai str. 56601
ucaucuuacacacu

SEQ ID NO: 759715 - RNA, 20 nt, Leptospira interrogans serovar lai str. 56601
ucaucuaaucgaaacuauaa

SEQ ID NO: 759716 - RNA, 20 nt, Leptospira interrogans serovar lai str. 56601
ucaucuacauaaaaaaggaa

SEQ ID NO: 759717 - RNA, 19 nt, Leptospira interrogans serovar lai str. 56601
ucaucuacguuucaauuac

SEQ ID NO: 759718 - RNA, 16 nt, Leptospira interrogans serovar lai str. 56601
ucaucucuauaaauug

SEQ ID NO: 759719 - RNA, 16 nt, Leptospira interrogans serovar lai str. 56601
ucaugaucaaauucac

SEQ ID NO: 759720 - RNA, 21 nt, Leptospira interrogans serovar lai str. 56601
ucaugaucaaauucacauaaa

SEQ ID NO: 759721 - RNA, 23 nt, Leptospira interrogans serovar lai str. 56601
ucaugaucccgauacagaauaaa

SEQ ID NO: 759722 - RNA, 13 nt, Leptospira interrogans serovar lai str. 56601
ucaugauucugaa

SEQ ID NO: 759723 - RNA, 18 nt, Leptospira interrogans serovar lai str. 56601
ucaugagaaacaaaguag

SEQ ID NO: 759724 - RNA, 15 nt, Leptospira interrogans serovar lai str. 56601
ucauggagaauaaaa

SEQ ID NO: 759725 - RNA, 17 nt, Leptospira interrogans serovar lai str. 56601
ucauucugauucuaaaa

SEQ ID NO: 759726 - RNA, 19 nt, Leptospira interrogans serovar lai str. 56601
ucauucugauucuaaaauc

SEQ ID NO: 759727 - RNA, 17 nt, Leptospira interrogans serovar lai str. 56601
ucauucuugucggaaca

SEQ ID NO: 759728 - RNA, 14 nt, Leptospira interrogans serovar lai str. 56601
ucauucuuuaaaau

SEQ ID NO: 759729 - RNA, 15 nt, Leptospira interrogans serovar lai str. 56601
ucauucuuuaaaaua

SEQ ID NO: 759730 - RNA, 22 nt, Leptospira interrogans serovar lai str. 56601
ucauuggaguuuuuuaaaauua

SEQ ID NO: 759731 - RNA, 22 nt, Leptospira interrogans serovar lai str. 56601
ucauuucgaaaacgauuuuuca

SEQ ID NO: 759732 - RNA, 19 nt, Leptospira interrogans serovar lai str. 56601
ucauuuaccuaaaauucag

SEQ ID NO: 759733 - RNA, 12 nt, Leptospira interrogans serovar lai str. 56601
ucauuuacucaa

SEQ ID NO: 759734 - RNA, 17 nt, Leptospira interrogans serovar lai str. 56601
ucauuuuucugaaaaaa

SEQ ID NO: 759735 - RNA, 19 nt, Leptospira interrogans serovar lai str. 56601
ucauuuuuccauaaaaaac

SEQ ID NO: 759736 - RNA, 13 nt, Leptospira interrogans serovar lai str. 56601
ucauuuuucaaau

SEQ ID NO: 759737 - RNA, 14 nt, Leptospira interrogans serovar lai str. 56601
ucauuuuacagaau

SEQ ID NO: 759738 - RNA, 20 nt, Leptospira interrogans serovar lai str. 56601
ucauuuuacagaauauuaaa

SEQ ID NO: 759739 - RNA, 23 nt, Leptospira interrogans serovar lai str. 56601
ucauuuuacagaauauuaaauuu

SEQ ID NO: 759740 - RNA, 19 nt, Leptospira interrogans serovar lai str. 56601
ucauuuuagucaucauaaa

SEQ ID NO: 759741 - RNA, 21 nt, Leptospira interrogans serovar lai str. 56601
ucauuuuuuucgaauugaguu

SEQ ID NO: 759742 - RNA, 20 nt, Leptospira interrogans serovar lai str. 56601
uccaaaaaaagucucaaaac

SEQ ID NO: 759743 - RNA, 18 nt, Leptospira interrogans serovar lai str. 56601
uccaaaaaaauaaaucau

SEQ ID NO: 759744 - RNA, 12 nt, Leptospira interrogans serovar lai str. 56601
uccaaaaacgua

SEQ ID NO: 759745 - RNA, 12 nt, Leptospira interrogans serovar lai str. 56601
uccaaaacucua

SEQ ID NO: 759746 - RNA, 19 nt, Leptospira interrogans serovar lai str. 56601
uccaaaaccucaaaaaauu

SEQ ID NO: 759747 - RNA, 18 nt, Leptospira interrogans serovar lai str. 56601
uccaaaaauuuaaaaauu

SEQ ID NO: 759748 - RNA, 22 nt, Leptospira interrogans serovar lai str. 56601
uccaaaaucauuuaaagcaaau

SEQ ID NO: 759749 - RNA, 23 nt, Leptospira interrogans serovar lai str. 56601
uccaaaaucauuuaaagcaaaua

SEQ ID NO: 759750 - RNA, 18 nt, Leptospira interrogans serovar lai str. 56601
ucauuacguaaagaacuu

SEQ ID NO: 759751 - RNA, 22 nt, Leptospira interrogans serovar lai str. 56601
ucauuauuagaguuguugaaaa

SEQ ID NO: 759752 - RNA, 14 nt, Leptospira interrogans serovar lai str. 56601
ucauuauuugaaaa

SEQ ID NO: 759753 - RNA, 24 nt, Leptospira interrogans serovar lai str. 56601
ucauucuacuuugaaugaaaagau

SEQ ID NO: 759754 - RNA, 22 nt, Leptospira interrogans serovar lai str. 56601
ucauguaaaauuuuuugaaguu

SEQ ID NO: 759755 - RNA, 17 nt, Leptospira interrogans serovar lai str. 56601
ucauggccuucuggaaa

SEQ ID NO: 759756 - RNA, 16 nt, Leptospira interrogans serovar lai str. 56601
ucauuaaucagauuuu

SEQ ID NO: 759757 - RNA, 16 nt, Leptospira interrogans serovar lai str. 56601
ucauuaaacaauuuuu

SEQ ID NO: 759758 - RNA, 11 nt, Leptospira interrogans serovar lai str. 56601
uccacauuuua

SEQ ID NO: 759759 - RNA, 22 nt, Leptospira interrogans serovar lai str. 56601
uccacauuuuagggaucaaucu

SEQ ID NO: 759760 - RNA, 14 nt, Leptospira interrogans serovar lai str. 56601
uccacaucuuuuuu

SEQ ID NO: 759761 - RNA, 17 nt, Leptospira interrogans serovar lai str. 56601
uccacaucuuuuuucgu

SEQ ID NO: 759762 - RNA, 20 nt, Leptospira interrogans serovar lai str. 56601
uccaaacaauuuuuugaaaa

SEQ ID NO: 759763 - RNA, 22 nt, Leptospira interrogans serovar lai str. 56601
uccaaacaauuuuuugaaaaag

SEQ ID NO: 759764 - RNA, 15 nt, Leptospira interrogans serovar lai str. 56601
uccaaaucaaaaaag

SEQ ID NO: 759765 - RNA, 16 nt, Leptospira interrogans serovar lai str. 56601
uccaaaucaaaaaagu

SEQ ID NO: 759766 - RNA, 17 nt, Leptospira interrogans serovar lai str. 56601
uccaaaucaaaaaaguc

SEQ ID NO: 759767 - RNA, 15 nt, Leptospira interrogans serovar lai str. 56601
uccaauuuccuaaaa

SEQ ID NO: 759768 - RNA, 14 nt, Leptospira interrogans serovar lai str. 56601
uccaauuuuaaaac

SEQ ID NO: 759769 - RNA, 18 nt, Leptospira interrogans serovar lai str. 56601
uccaauuuugcuucuaaa

SEQ ID NO: 759770 - RNA, 16 nt, Leptospira interrogans serovar lai str. 56601
uccaauuuuucugaaa

SEQ ID NO: 759771 - RNA, 16 nt, Leptospira interrogans serovar lai str. 56601
uccaauugaauauaaa

SEQ ID NO: 759772 - RNA, 23 nt, Leptospira interrogans serovar lai str. 56601
uccaauuguuccgaauuaaaaau

SEQ ID NO: 759773 - RNA, 21 nt, Leptospira interrogans serovar lai str. 56601
uccacuauggaauuuuuuaac

SEQ ID NO: 759774 - RNA, 13 nt, Leptospira interrogans serovar lai str. 56601
uccacucagacca

SEQ ID NO: 759775 - RNA, 22 nt, Leptospira interrogans serovar lai str. 56601
uccaccuuggaaagaaaaggug

SEQ ID NO: 759776 - RNA, 20 nt, Leptospira interrogans serovar lai str. 56601
uccagaauuagauuaaauuu

SEQ ID NO: 759777 - RNA, 21 nt, Leptospira interrogans serovar lai str. 56601
uccagaggcaguacaauucaa

SEQ ID NO: 759778 - RNA, 22 nt, Leptospira interrogans serovar lai str. 56601
uccagaggcaguacaauucaaa

SEQ ID NO: 759779 - RNA, 18 nt, Leptospira interrogans serovar lai str. 56601
uccagacgguauaaaaag

SEQ ID NO: 759780 - RNA, 15 nt, Leptospira interrogans serovar lai str. 56601
uccaguaggauaaua

SEQ ID NO: 759781 - RNA, 22 nt, Leptospira interrogans serovar lai str. 56601
uccaguauuuuacgcuuaaaua

SEQ ID NO: 759782 - RNA, 14 nt, Leptospira interrogans serovar lai str. 56601
uccauaaaaaacau

SEQ ID NO: 759783 - RNA, 16 nt, Leptospira interrogans serovar lai str. 56601
uccauaaaaaaugaau

SEQ ID NO: 759784 - RNA, 21 nt, Leptospira interrogans serovar lai str. 56601
uccauaaaauagaaacaaaug

SEQ ID NO: 759785 - RNA, 23 nt, Leptospira interrogans serovar lai str. 56601
uccauaaaauagaaacaaaugga

SEQ ID NO: 759786 - RNA, 16 nt, Leptospira interrogans serovar lai str. 56601
uccauaaauucuacaa

SEQ ID NO: 759787 - RNA, 16 nt, Leptospira interrogans serovar lai str. 56601
uccagcuuuuuuaaau

SEQ ID NO: 759788 - RNA, 18 nt, Leptospira interrogans serovar lai str. 56601
uccagcccauucuuuccc

SEQ ID NO: 759789 - RNA, 17 nt, Leptospira interrogans serovar lai str. 56601
uccagcaccuucugaaa

SEQ ID NO: 759790 - RNA, 21 nt, Leptospira interrogans serovar lai str. 56601
uccagcaccuucugaaaguag

SEQ ID NO: 759791 - RNA, 16 nt, Leptospira interrogans serovar lai str. 56601
ucacucauuuuuagau

SEQ ID NO: 759792 - RNA, 22 nt, Leptospira interrogans serovar lai str. 56601
ucacuaaggcccacaucgaaaa

SEQ ID NO: 759793 - RNA, 17 nt, Leptospira interrogans serovar lai str. 56601
ucacgauuuuacgaaca

SEQ ID NO: 759794 - RNA, 13 nt, Leptospira interrogans serovar lai str. 56601
ucacgcuaaaaua

SEQ ID NO: 759795 - RNA, 17 nt, Leptospira interrogans serovar lai str. 56601
ucacgaaaauuaaaaaa

SEQ ID NO: 759796 - RNA, 16 nt, Leptospira interrogans serovar lai str. 56601
ucaccucuauaaaauc

SEQ ID NO: 759797 - RNA, 22 nt, Leptospira interrogans serovar lai str. 56601
ucaccgcacaaaugauagaaac

SEQ ID NO: 759798 - RNA, 19 nt, Leptospira interrogans serovar lai str. 56601
ucaccagaauuuagauaac

SEQ ID NO: 759799 - RNA, 20 nt, Leptospira interrogans serovar lai str. 56601
ucaccagaauuuagauaacg

SEQ ID NO: 759800 - RNA, 14 nt, Leptospira interrogans serovar lai str. 56601
ucaccaaccccaca

SEQ ID NO: 759801 - RNA, 16 nt, Leptospira interrogans serovar lai str. 56601
ucaccaaccccacaag

SEQ ID NO: 759802 - RNA, 16 nt, Leptospira interrogans serovar lai str. 56601
ucaauguuuuucgcuu

SEQ ID NO: 759803 - RNA, 13 nt, Leptospira interrogans serovar lai str. 56601
ucaauuaaauugu

SEQ ID NO: 759804 - RNA, 16 nt, Leptospira interrogans serovar lai str. 56601
ucaauuaaauuguaug

SEQ ID NO: 759805 - RNA, 15 nt, Leptospira interrogans serovar lai str. 56601
ucaauuucuuuaauu

SEQ ID NO: 759806 - RNA, 13 nt, Leptospira interrogans serovar lai str. 56601
ucacaaaucacau

SEQ ID NO: 759807 - RNA, 15 nt, Leptospira interrogans serovar lai str. 56601
ucaauuuuaccaaaa

SEQ ID NO: 759808 - RNA, 15 nt, Leptospira interrogans serovar lai str. 56601
ucaauuuuauuucua

SEQ ID NO: 759809 - RNA, 17 nt, Leptospira interrogans serovar lai str. 56601
ucaauuuuauuucuaag

SEQ ID NO: 759810 - RNA, 17 nt, Leptospira interrogans serovar lai str. 56601
ucaauuuuaguaaacua

SEQ ID NO: 759811 - RNA, 21 nt, Leptospira interrogans serovar lai str. 56601
ucaauuuuaguaaacuacuaa

SEQ ID NO: 759812 - RNA, 21 nt, Leptospira interrogans serovar lai str. 56601
ucaauuuugaagacuauaaaa

SEQ ID NO: 759813 - RNA, 15 nt, Leptospira interrogans serovar lai str. 56601
ucaauuuuuauaaac

SEQ ID NO: 759814 - RNA, 18 nt, Leptospira interrogans serovar lai str. 56601
ucaauuuuuauaaacuuc

SEQ ID NO: 759815 - RNA, 14 nt, Leptospira interrogans serovar lai str. 56601
ucacaaguuaaauu

SEQ ID NO: 759816 - RNA, 21 nt, Leptospira interrogans serovar lai str. 56601
ucacaauuuuuuuagaaucau

SEQ ID NO: 759817 - RNA, 19 nt, Leptospira interrogans serovar lai str. 56601
ucacaauuuuaagaacaau

SEQ ID NO: 759818 - RNA, 18 nt, Leptospira interrogans serovar lai str. 56601
ucaaucugcaaagcucag

SEQ ID NO: 759819 - RNA, 22 nt, Leptospira interrogans serovar lai str. 56601
ucaaucuaacccauucaacauc

SEQ ID NO: 759820 - RNA, 23 nt, Leptospira interrogans serovar lai str. 56601
ucaaucuaacccauucaacauca

SEQ ID NO: 759821 - RNA, 18 nt, Leptospira interrogans serovar lai str. 56601
ucaauggaaaauuaauuu

SEQ ID NO: 759822 - RNA, 23 nt, Leptospira interrogans serovar lai str. 56601
ucaauggaaaauuaauuuuucaa

SEQ ID NO: 759823 - RNA, 20 nt, Leptospira interrogans serovar lai str. 56601
ucaagugauucauucuaaga

SEQ ID NO: 759824 - RNA, 22 nt, Leptospira interrogans serovar lai str. 56601
ucaaguggguuacuuugaacuu

SEQ ID NO: 759825 - RNA, 23 nt, Leptospira interrogans serovar lai str. 56601
ucaaguguuccgacaagaaugag

SEQ ID NO: 759826 - RNA, 23 nt, Leptospira interrogans serovar lai str. 56601
ucaaucgaccguuuccauaaaau

SEQ ID NO: 759827 - RNA, 14 nt, Leptospira interrogans serovar lai str. 56601
ucaauauuuaaaaa

SEQ ID NO: 759828 - RNA, 14 nt, Leptospira interrogans serovar lai str. 56601
ucaaucaauugacu

SEQ ID NO: 759829 - RNA, 20 nt, Leptospira interrogans serovar lai str. 56601
ucaagaugggacuuuuuucg

SEQ ID NO: 759830 - RNA, 12 nt, Leptospira interrogans serovar lai str. 56601
ucaagauugucu

SEQ ID NO: 759831 - RNA, 17 nt, Leptospira interrogans serovar lai str. 56601
ucaagauugucuuuauu

SEQ ID NO: 759832 - RNA, 17 nt, Leptospira interrogans serovar lai str. 56601
ucaagauuuaauuuaga

SEQ ID NO: 759833 - RNA, 21 nt, Leptospira interrogans serovar lai str. 56601
ucaaguaccauaaauuuugau

SEQ ID NO: 759834 - RNA, 22 nt, Leptospira interrogans serovar lai str. 56601
ucaagguuucacuuuuuuaaag

SEQ ID NO: 759835 - RNA, 23 nt, Leptospira interrogans serovar lai str. 56601
ucaagguuucacuuuuuuaaagu

SEQ ID NO: 759836 - RNA, 17 nt, Leptospira interrogans serovar lai str. 56601
ucaaggaagugaaauug

SEQ ID NO: 759837 - RNA, 22 nt, Leptospira interrogans serovar lai str. 56601
ucaaaucuucgguuuaauauac

SEQ ID NO: 759838 - RNA, 23 nt, Leptospira interrogans serovar lai str. 56601
ucaaaucaucuaucuuuucaaaa

SEQ ID NO: 759839 - RNA, 18 nt, Leptospira interrogans serovar lai str. 56601
ucaacguucaaacaacaa

SEQ ID NO: 759840 - RNA, 22 nt, Leptospira interrogans serovar lai str. 56601
ucaacguucaaacaacaaaaaa

SEQ ID NO: 759841 - RNA, 22 nt, Leptospira interrogans serovar lai str. 56601
ucaacucuauucauaaaugaua

SEQ ID NO: 759842 - RNA, 19 nt, Leptospira interrogans serovar lai str. 56601
ucaacucuguaaauucaaa

SEQ ID NO: 759843 - RNA, 19 nt, Leptospira interrogans serovar lai str. 56601
ucaagacuuuauagucaaa

SEQ ID NO: 759844 - RNA, 21 nt, Leptospira interrogans serovar lai str. 56601
ucaagacuuuauagucaaauu

SEQ ID NO: 759845 - RNA, 22 nt, Leptospira interrogans serovar lai str. 56601
ucaagacuuuauagucaaauuu

SEQ ID NO: 759846 - RNA, 20 nt, Leptospira interrogans serovar lai str. 56601
ucaagagccaaguugaaucu

SEQ ID NO: 759847 - RNA, 23 nt, Leptospira interrogans serovar lai str. 56601
ucaagagugguuuucaaauauuu

SEQ ID NO: 759848 - RNA, 20 nt, Leptospira interrogans serovar lai str. 56601
ucaagaauuuuagaauauaa

SEQ ID NO: 759849 - RNA, 12 nt, Leptospira interrogans serovar lai str. 56601
uauuuugaauaa

SEQ ID NO: 759850 - RNA, 16 nt, Leptospira interrogans serovar lai str. 56601
uauuuugaauaaguuu

SEQ ID NO: 759851 - RNA, 17 nt, Leptospira interrogans serovar lai str. 56601
uauuuugagaaaaucca

SEQ ID NO: 759852 - RNA, 21 nt, Leptospira interrogans serovar lai str. 56601
uauuuugagaaaauccaguca

SEQ ID NO: 759853 - RNA, 17 nt, Leptospira interrogans serovar lai str. 56601
uauuuugauaaagaauc

SEQ ID NO: 759854 - RNA, 15 nt, Leptospira interrogans serovar lai str. 56601
uauuuucuauuuuaa

SEQ ID NO: 759855 - RNA, 15 nt, Leptospira interrogans serovar lai str. 56601
uauuuucuuugaaaa

SEQ ID NO: 759856 - RNA, 18 nt, Leptospira interrogans serovar lai str. 56601
uauuuucuaggauuuuau

SEQ ID NO: 759857 - RNA, 16 nt, Leptospira interrogans serovar lai str. 56601
uauuuucgcacauucu

SEQ ID NO: 759858 - RNA, 12 nt, Leptospira interrogans serovar lai str. 56601
uauuuucagauu

SEQ ID NO: 759859 - RNA, 15 nt, Leptospira interrogans serovar lai str. 56601
uauuuuguauaaagu

SEQ ID NO: 759860 - RNA, 14 nt, Leptospira interrogans serovar lai str. 56601
uauuuuguuuugaa

SEQ ID NO: 759861 - RNA, 22 nt, Leptospira interrogans serovar lai str. 56601
uauuuuguuuuuaguuacaauu

SEQ ID NO: 759862 - RNA, 16 nt, Leptospira interrogans serovar lai str. 56601
uauuuuuagaaaauuu

SEQ ID NO: 759863 - RNA, 21 nt, Leptospira interrogans serovar lai str. 56601
uauuuuuauaaagauaaaucg

SEQ ID NO: 759864 - RNA, 18 nt, Leptospira interrogans serovar lai str. 56601
uauuuuuacagaaaaauc

SEQ ID NO: 759865 - RNA, 14 nt, Leptospira interrogans serovar lai str. 56601
uauuuuuaaaugua

SEQ ID NO: 759866 - RNA, 10 nt, Leptospira interrogans serovar lai str. 56601
uauuuuuaag

SEQ ID NO: 759867 - RNA, 21 nt, Leptospira interrogans serovar lai str. 56601
uauuuugcacugaaauagaau

SEQ ID NO: 759868 - RNA, 22 nt, Leptospira interrogans serovar lai str. 56601
uauuuuggcccuccucuaaaau

SEQ ID NO: 759869 - RNA, 23 nt, Leptospira interrogans serovar lai str. 56601
uauuuugugacuaauuuugugaa

SEQ ID NO: 759870 - RNA, 21 nt, Leptospira interrogans serovar lai str. 56601
uauuuugauccguuuuaaaau

SEQ ID NO: 759871 - RNA, 12 nt, Leptospira interrogans serovar lai str. 56601
uauuuugaugaa

SEQ ID NO: 759872 - RNA, 21 nt, Leptospira interrogans serovar lai str. 56601
uauuuugauuccaaagauaaa

SEQ ID NO: 759873 - RNA, 12 nt, Leptospira interrogans serovar lai str. 56601
uauuuuauuuuu

SEQ ID NO: 759874 - RNA, 16 nt, Leptospira interrogans serovar lai str. 56601
uauuuuauguaaaucg

SEQ ID NO: 759875 - RNA, 15 nt, Leptospira interrogans serovar lai str. 56601
uauuuuauuauauaa

SEQ ID NO: 759876 - RNA, 18 nt, Leptospira interrogans serovar lai str. 56601
uauuuucaaaaaauaaaa

SEQ ID NO: 759877 - RNA, 20 nt, Leptospira interrogans serovar lai str. 56601
uauuuucaaaaaauaaaauu

SEQ ID NO: 759878 - RNA, 16 nt, Leptospira interrogans serovar lai str. 56601
uauuuucaaguaaauc

SEQ ID NO: 759879 - RNA, 17 nt, Leptospira interrogans serovar lai str. 56601
uauuuuauaaauugugg

SEQ ID NO: 759880 - RNA, 12 nt, Leptospira interrogans serovar lai str. 56601
uauuuuaaaaaa

SEQ ID NO: 759881 - RNA, 19 nt, Leptospira interrogans serovar lai str. 56601
uauuuguauucaagagcaa

SEQ ID NO: 759882 - RNA, 12 nt, Leptospira interrogans serovar lai str. 56601
uauuuuaaacaa

SEQ ID NO: 759883 - RNA, 18 nt, Leptospira interrogans serovar lai str. 56601
uauuuuaaacaaaacgug

SEQ ID NO: 759884 - RNA, 14 nt, Leptospira interrogans serovar lai str. 56601
uauuuuagaaugug

SEQ ID NO: 759885 - RNA, 22 nt, Leptospira interrogans serovar lai str. 56601
uauuuuagagaaacuuuaaaua

SEQ ID NO: 759886 - RNA, 13 nt, Leptospira interrogans serovar lai str. 56601
uauuuuacaguaa

SEQ ID NO: 759887 - RNA, 14 nt, Leptospira interrogans serovar lai str. 56601
uauuuuaauauauu

SEQ ID NO: 759888 - RNA, 13 nt, Leptospira interrogans serovar lai str. 56601
uauuugauauaau

SEQ ID NO: 759889 - RNA, 14 nt, Leptospira interrogans serovar lai str. 56601
uauuugauuagaaa

SEQ ID NO: 759890 - RNA, 16 nt, Leptospira interrogans serovar lai str. 56601
uauuucuuucaaaaau

SEQ ID NO: 759891 - RNA, 23 nt, Leptospira interrogans serovar lai str. 56601
uauuucuuucaaaaauuuaaguc

SEQ ID NO: 759892 - RNA, 19 nt, Leptospira interrogans serovar lai str. 56601
uauuucuuuugauacaauu

SEQ ID NO: 759893 - RNA, 18 nt, Leptospira interrogans serovar lai str. 56601
uauuugguuuucauuuua

SEQ ID NO: 759894 - RNA, 15 nt, Leptospira interrogans serovar lai str. 56601
uauuuguaaaaauga

SEQ ID NO: 759895 - RNA, 13 nt, Leptospira interrogans serovar lai str. 56601
uauuuguaaaauu

SEQ ID NO: 759896 - RNA, 18 nt, Leptospira interrogans serovar lai str. 56601
uauuugcggaaucaauuu

SEQ ID NO: 759897 - RNA, 19 nt, Leptospira interrogans serovar lai str. 56601
uauuuggauuuuauaaagu

SEQ ID NO: 759898 - RNA, 18 nt, Leptospira interrogans serovar lai str. 56601
uauuuccguuauauuaaa

SEQ ID NO: 759899 - RNA, 19 nt, Leptospira interrogans serovar lai str. 56601
uauuuccguuauauuaaaa

SEQ ID NO: 759900 - RNA, 23 nt, Leptospira interrogans serovar lai str. 56601
uauuucgucuuugguuucaauuu

SEQ ID NO: 759901 - RNA, 13 nt, Leptospira interrogans serovar lai str. 56601
uauuucuaaaaga

SEQ ID NO: 759902 - RNA, 15 nt, Leptospira interrogans serovar lai str. 56601
uauuucuaaaagaag

SEQ ID NO: 759903 - RNA, 21 nt, Leptospira interrogans serovar lai str. 56601
uauuucuaaacgaucuacuuu

SEQ ID NO: 759904 - RNA, 13 nt, Leptospira interrogans serovar lai str. 56601
uauuucccaaaau

SEQ ID NO: 759905 - RNA, 19 nt, Leptospira interrogans serovar lai str. 56601
uauuucccaaaauuucaga

SEQ ID NO: 759906 - RNA, 19 nt, Leptospira interrogans serovar lai str. 56601
uauuuccaaauuguaugaa

SEQ ID NO: 759907 - RNA, 10 nt, Leptospira interrogans serovar lai str. 56601
uauuucuaau

SEQ ID NO: 759908 - RNA, 14 nt, Leptospira interrogans serovar lai str. 56601
uauuucuaauaguu

SEQ ID NO: 759909 - RNA, 14 nt, Leptospira interrogans serovar lai str. 56601
uauuucuauaaaau

SEQ ID NO: 759910 - RNA, 15 nt, Leptospira interrogans serovar lai str. 56601
uauuucuauaaaauu

SEQ ID NO: 759911 - RNA, 14 nt, Leptospira interrogans serovar lai str. 56601
uauuucucucaaau

SEQ ID NO: 759912 - RNA, 20 nt, Leptospira interrogans serovar lai str. 56601
uauuucuucguuauuuuuau

SEQ ID NO: 759913 - RNA, 21 nt, Leptospira interrogans serovar lai str. 56601
uauuucuuaaauucuaaaaaa

SEQ ID NO: 759914 - RNA, 17 nt, Leptospira interrogans serovar lai str. 56601
uauuucuguuuuauaga

SEQ ID NO: 759915 - RNA, 18 nt, Leptospira interrogans serovar lai str. 56601
uauuuuuuuaaaaaauuu

SEQ ID NO: 759916 - RNA, 19 nt, Leptospira interrogans serovar lai str. 56601
uauuuuuuuauuuuauuca

SEQ ID NO: 759917 - RNA, 13 nt, Leptospira interrogans serovar lai str. 56601
uauuuuuuuuaau

SEQ ID NO: 759918 - RNA, 18 nt, Leptospira interrogans serovar lai str. 56601
ucaaaaaaaguaauuacu

SEQ ID NO: 759919 - RNA, 14 nt, Leptospira interrogans serovar lai str. 56601
uauuuuucuaaaaa

SEQ ID NO: 759920 - RNA, 16 nt, Leptospira interrogans serovar lai str. 56601
uauuuuucuaaaaaaa

SEQ ID NO: 759921 - RNA, 12 nt, Leptospira interrogans serovar lai str. 56601
uauuuuuccagc

SEQ ID NO: 759922 - RNA, 15 nt, Leptospira interrogans serovar lai str. 56601
uauuuuuuaugaaaa

SEQ ID NO: 759923 - RNA, 19 nt, Leptospira interrogans serovar lai str. 56601
uauuuuuuaugaaaaacuc

SEQ ID NO: 759924 - RNA, 20 nt, Leptospira interrogans serovar lai str. 56601
uauuuuuuacgaaaaaauug

SEQ ID NO: 759925 - RNA, 15 nt, Leptospira interrogans serovar lai str. 56601
uauuuuuuaauauuc

SEQ ID NO: 759926 - RNA, 13 nt, Leptospira interrogans serovar lai str. 56601
ucaaaaacucuau

SEQ ID NO: 759927 - RNA, 14 nt, Leptospira interrogans serovar lai str. 56601
ucaaaaagaaucgu

SEQ ID NO: 759928 - RNA, 18 nt, Leptospira interrogans serovar lai str. 56601
ucaaaaagacuauauucu

SEQ ID NO: 759929 - RNA, 12 nt, Leptospira interrogans serovar lai str. 56601
ucaaaaagagaa

SEQ ID NO: 759930 - RNA, 19 nt, Leptospira interrogans serovar lai str. 56601
ucaaaaauacuuugaacuu

SEQ ID NO: 759931 - RNA, 17 nt, Leptospira interrogans serovar lai str. 56601
ucaaaaacaaauuaagu

SEQ ID NO: 759932 - RNA, 13 nt, Leptospira interrogans serovar lai str. 56601
ucaaaaaauugca

SEQ ID NO: 759933 - RNA, 12 nt, Leptospira interrogans serovar lai str. 56601
ucaaaaaauuuu

SEQ ID NO: 759934 - RNA, 22 nt, Leptospira interrogans serovar lai str. 56601
ucaaaaaauauaggaacucuua

SEQ ID NO: 759935 - RNA, 18 nt, Leptospira interrogans serovar lai str. 56601
ucaaaaaguuuuauaaac

SEQ ID NO: 759936 - RNA, 15 nt, Leptospira interrogans serovar lai str. 56601
ucaaaaauuuaaguc

SEQ ID NO: 759937 - RNA, 19 nt, Leptospira interrogans serovar lai str. 56601
ucaaaaauuuucuguuuau

SEQ ID NO: 759938 - RNA, 21 nt, Leptospira interrogans serovar lai str. 56601
ucaaaaauuuucuguuuauuu

SEQ ID NO: 759939 - RNA, 14 nt, Leptospira interrogans serovar lai str. 56601
ucaaaacaaaacgu

SEQ ID NO: 759940 - RNA, 15 nt, Leptospira interrogans serovar lai str. 56601
ucaaaacaaaacgua

SEQ ID NO: 759941 - RNA, 13 nt, Leptospira interrogans serovar lai str. 56601
ucaaaaccaaaac

SEQ ID NO: 759942 - RNA, 15 nt, Leptospira interrogans serovar lai str. 56601
ucaaaaccauuuuug

SEQ ID NO: 759943 - RNA, 20 nt, Leptospira interrogans serovar lai str. 56601
ucaaaaccuaauaaacaaaa

SEQ ID NO: 759944 - RNA, 19 nt, Leptospira interrogans serovar lai str. 56601
ucaaaaccuguaaaugaau

SEQ ID NO: 759945 - RNA, 18 nt, Leptospira interrogans serovar lai str. 56601
ucaaaagguauaaaauaa

SEQ ID NO: 759946 - RNA, 18 nt, Leptospira interrogans serovar lai str. 56601
ucaaaauacuuuuaauuu

SEQ ID NO: 759947 - RNA, 15 nt, Leptospira interrogans serovar lai str. 56601
ucaaaauagaauaaa

SEQ ID NO: 759948 - RNA, 23 nt, Leptospira interrogans serovar lai str. 56601
ucaaaauagaauaaauuauacaa

SEQ ID NO: 759949 - RNA, 16 nt, Leptospira interrogans serovar lai str. 56601
ucaaaauaagaaaaua

SEQ ID NO: 759950 - RNA, 21 nt, Leptospira interrogans serovar lai str. 56601
ucaaaauaagaaaauaaaggc

SEQ ID NO: 759951 - RNA, 13 nt, Leptospira interrogans serovar lai str. 56601
ucaaaauaagaau

SEQ ID NO: 759952 - RNA, 16 nt, Leptospira interrogans serovar lai str. 56601
ucaaaagucuauuucu

SEQ ID NO: 759953 - RNA, 17 nt, Leptospira interrogans serovar lai str. 56601
ucaaaauauuuaguauu

SEQ ID NO: 759954 - RNA, 11 nt, Leptospira interrogans serovar lai str. 56601
ucaaagaaaug

SEQ ID NO: 759955 - RNA, 13 nt, Leptospira interrogans serovar lai str. 56601
ucaaagaaauuuu

SEQ ID NO: 759956 - RNA, 16 nt, Leptospira interrogans serovar lai str. 56601
ucaaaccuuucuuucu

SEQ ID NO: 759957 - RNA, 19 nt, Leptospira interrogans serovar lai str. 56601
ucaaaccuuucuuucugau

SEQ ID NO: 759958 - RNA, 17 nt, Leptospira interrogans serovar lai str. 56601
ucaaacgaaguuuauuu

SEQ ID NO: 759959 - RNA, 22 nt, Leptospira interrogans serovar lai str. 56601
ucaaacgaaguuuauuucuaaa

SEQ ID NO: 759960 - RNA, 15 nt, Leptospira interrogans serovar lai str. 56601
ucaaacggucuuucu

SEQ ID NO: 759961 - RNA, 20 nt, Leptospira interrogans serovar lai str. 56601
ucaaacggucuuucuucugu

SEQ ID NO: 759962 - RNA, 23 nt, Leptospira interrogans serovar lai str. 56601
ucaaauaagcgcggauuuauuuu

SEQ ID NO: 759963 - RNA, 20 nt, Leptospira interrogans serovar lai str. 56601
ucaaaguuuugcuguaaaau

SEQ ID NO: 759964 - RNA, 18 nt, Leptospira interrogans serovar lai str. 56601
ucaaaguugauucuuccu

SEQ ID NO: 759965 - RNA, 14 nt, Leptospira interrogans serovar lai str. 56601
ucaaaguuuucaca

SEQ ID NO: 759966 - RNA, 13 nt, Leptospira interrogans serovar lai str. 56601
ucaaagauaaaau

SEQ ID NO: 759967 - RNA, 14 nt, Leptospira interrogans serovar lai str. 56601
ucaaagauaaaaua

SEQ ID NO: 759968 - RNA, 21 nt, Leptospira interrogans serovar lai str. 56601
ucaaaggccgcuucuuuauuu

SEQ ID NO: 759969 - RNA, 23 nt, Leptospira interrogans serovar lai str. 56601
uauccauucuagaaccuggaaaa

SEQ ID NO: 759970 - RNA, 15 nt, Leptospira interrogans serovar lai str. 56601
uauccgauuuuuguu

SEQ ID NO: 759971 - RNA, 21 nt, Leptospira interrogans serovar lai str. 56601
uauuacucggauguauaaaaa

SEQ ID NO: 759972 - RNA, 23 nt, Leptospira interrogans serovar lai str. 56601
uauuauccauuucuauaaauuga

SEQ ID NO: 759973 - RNA, 20 nt, Leptospira interrogans serovar lai str. 56601
uauuauauggaguucuaaau

SEQ ID NO: 759974 - RNA, 17 nt, Leptospira interrogans serovar lai str. 56601
uauuaucaaaauuuaaa

SEQ ID NO: 759975 - RNA, 21 nt, Leptospira interrogans serovar lai str. 56601
uauuauauagcucuugaauaa

SEQ ID NO: 759976 - RNA, 15 nt, Leptospira interrogans serovar lai str. 56601
uauuaggaaauacaa

SEQ ID NO: 759977 - RNA, 16 nt, Leptospira interrogans serovar lai str. 56601
uauuauaauuuuaaau

SEQ ID NO: 759978 - RNA, 22 nt, Leptospira interrogans serovar lai str. 56601
uauuauaauuuuaaauaauaau

SEQ ID NO: 759979 - RNA, 14 nt, Leptospira interrogans serovar lai str. 56601
uauuagaauauaca

SEQ ID NO: 759980 - RNA, 15 nt, Leptospira interrogans serovar lai str. 56601
uauuacuuuuuaaac

SEQ ID NO: 759981 - RNA, 22 nt, Leptospira interrogans serovar lai str. 56601
uauuagaaaaauugaauuucuu

SEQ ID NO: 759982 - RNA, 16 nt, Leptospira interrogans serovar lai str. 56601
uauucaauaaaauacc

SEQ ID NO: 759983 - RNA, 14 nt, Leptospira interrogans serovar lai str. 56601
uauucaauuucaga

SEQ ID NO: 759984 - RNA, 13 nt, Leptospira interrogans serovar lai str. 56601
uauucaauuucuu

SEQ ID NO: 759985 - RNA, 14 nt, Leptospira interrogans serovar lai str. 56601
uauucaauuucuuu

SEQ ID NO: 759986 - RNA, 16 nt, Leptospira interrogans serovar lai str. 56601
uauucacugaaaauuu

SEQ ID NO: 759987 - RNA, 14 nt, Leptospira interrogans serovar lai str. 56601
uauucauaaaugau

SEQ ID NO: 759988 - RNA, 21 nt, Leptospira interrogans serovar lai str. 56601
uauucauaaaugauaauaauu

SEQ ID NO: 759989 - RNA, 15 nt, Leptospira interrogans serovar lai str. 56601
uauucauaacuauau

SEQ ID NO: 759990 - RNA, 15 nt, Leptospira interrogans serovar lai str. 56601
uauucucguuucuaa

SEQ ID NO: 759991 - RNA, 21 nt, Leptospira interrogans serovar lai str. 56601
uauucucuaucgguuuucguu

SEQ ID NO: 759992 - RNA, 23 nt, Leptospira interrogans serovar lai str. 56601
uauucuauucguauuuuauagaa

SEQ ID NO: 759993 - RNA, 19 nt, Leptospira interrogans serovar lai str. 56601
uauuuauucaaaauaucuu

SEQ ID NO: 759994 - RNA, 13 nt, Leptospira interrogans serovar lai str. 56601
uauuuauauuucu

SEQ ID NO: 759995 - RNA, 17 nt, Leptospira interrogans serovar lai str. 56601
uauuuauuuuuuuuaau

SEQ ID NO: 759996 - RNA, 14 nt, Leptospira interrogans serovar lai str. 56601
uauuucaaaaauuu

SEQ ID NO: 759997 - RNA, 20 nt, Leptospira interrogans serovar lai str. 56601
uauuucaaaaauuuaaaugu

SEQ ID NO: 759998 - RNA, 12 nt, Leptospira interrogans serovar lai str. 56601
uauuucaaaauu

SEQ ID NO: 759999 - RNA, 13 nt, Leptospira interrogans serovar lai str. 56601
uauuucaaaauuu

SEQ ID NO: 760000 - RNA, 15 nt, Leptospira interrogans serovar lai str. 56601
uauuuauauauauuc

SEQ ID NO: 760001 - RNA, 19 nt, Leptospira interrogans serovar lai str. 56601
uauuuauauauauucacaa

SEQ ID NO: 760002 - RNA, 14 nt, Leptospira interrogans serovar lai str. 56601
uauuuauaaaacga

SEQ ID NO: 760003 - RNA, 16 nt, Leptospira interrogans serovar lai str. 56601
uauuuauaauauucuu

SEQ ID NO: 760004 - RNA, 18 nt, Leptospira interrogans serovar lai str. 56601
uauuuagaucaaauaagc

SEQ ID NO: 760005 - RNA, 19 nt, Leptospira interrogans serovar lai str. 56601
uauuuaguuucaauuuaaa

SEQ ID NO: 760006 - RNA, 18 nt, Leptospira interrogans serovar lai str. 56601
uauuuagaauaaaauuug

SEQ ID NO: 760007 - RNA, 16 nt, Leptospira interrogans serovar lai str. 56601
uauuuacuuuuuccaa

SEQ ID NO: 760008 - RNA, 19 nt, Leptospira interrogans serovar lai str. 56601
uauugaucucuauaaaauc

SEQ ID NO: 760009 - RNA, 15 nt, Leptospira interrogans serovar lai str. 56601
uauugauaaaaaaau

SEQ ID NO: 760010 - RNA, 16 nt, Leptospira interrogans serovar lai str. 56601
uauugaugauugaaac

SEQ ID NO: 760011 - RNA, 15 nt, Leptospira interrogans serovar lai str. 56601
uauugaauccuuccu

SEQ ID NO: 760012 - RNA, 16 nt, Leptospira interrogans serovar lai str. 56601
aaauccuucuuuucuu

SEQ ID NO: 760013 - RNA, 18 nt, Leptospira interrogans serovar lai str. 56601
aaauccuucuuuucuucu

SEQ ID NO: 760014 - RNA, 20 nt, Leptospira interrogans serovar lai str. 56601
aaauccuucuuuucuucuuc

SEQ ID NO: 760015 - RNA, 14 nt, Leptospira interrogans serovar lai str. 56601
aaaucgaaaaccag

SEQ ID NO: 760016 - RNA, 20 nt, Leptospira interrogans serovar lai str. 56601
aaaucgaaauuaaaauaaag

SEQ ID NO: 760017 - RNA, 15 nt, Leptospira interrogans serovar lai str. 56601
uauuuaaaauuaaug

SEQ ID NO: 760018 - RNA, 12 nt, Leptospira interrogans serovar lai str. 56601
uauuuaaaauuu

SEQ ID NO: 760019 - RNA, 13 nt, Leptospira interrogans serovar lai str. 56601
uauuuaaaauuug

SEQ ID NO: 760020 - RNA, 19 nt, Leptospira interrogans serovar lai str. 56601
uauuuaaacaaacuauacu

SEQ ID NO: 760021 - RNA, 13 nt, Leptospira interrogans serovar lai str. 56601
uauugugggaacu

SEQ ID NO: 760022 - RNA, 14 nt, Leptospira interrogans serovar lai str. 56601
uauugugaauauuu

SEQ ID NO: 760023 - RNA, 14 nt, Leptospira interrogans serovar lai str. 56601
uauugucucaaaau

SEQ ID NO: 760024 - RNA, 18 nt, Leptospira interrogans serovar lai str. 56601
ucuaaugucguuaaauuu

SEQ ID NO: 760025 - RNA, 20 nt, Leptospira interrogans serovar lai str. 56601
ucuaauucuaaaaauuuuuu

SEQ ID NO: 760026 - RNA, 18 nt, Leptospira interrogans serovar lai str. 56601
ucuaauugcaacuaaguu

SEQ ID NO: 760027 - RNA, 21 nt, Leptospira interrogans serovar lai str. 56601
ucuaauuuaaaaaagaagaau

SEQ ID NO: 760028 - RNA, 14 nt, Leptospira interrogans serovar lai str. 56601
ucuaauuuauaaac

SEQ ID NO: 760029 - RNA, 17 nt, Leptospira interrogans serovar lai str. 56601
ucuaauuucagcuagaa

SEQ ID NO: 760030 - RNA, 22 nt, Leptospira interrogans serovar lai str. 56601
ucuaaucccgccaaaaaugccg

SEQ ID NO: 760031 - RNA, 18 nt, Leptospira interrogans serovar lai str. 56601
ucuaauguuguuaaauuu

SEQ ID NO: 760032 - RNA, 19 nt, Leptospira interrogans serovar lai str. 56601
ucuaauguacaacauccuu

SEQ ID NO: 760033 - RNA, 17 nt, Leptospira interrogans serovar lai str. 56601
ucuaauagagaaaaauu

SEQ ID NO: 760034 - RNA, 14 nt, Leptospira interrogans serovar lai str. 56601
ucuaauauuaaaaa

SEQ ID NO: 760035 - RNA, 17 nt, Leptospira interrogans serovar lai str. 56601
ucuaaucgaaacuauaa

SEQ ID NO: 760036 - RNA, 19 nt, Leptospira interrogans serovar lai str. 56601
ucuacaaauaaaacuucuc

SEQ ID NO: 760037 - RNA, 22 nt, Leptospira interrogans serovar lai str. 56601
ucuacaauuguaggaauucaua

SEQ ID NO: 760038 - RNA, 23 nt, Leptospira interrogans serovar lai str. 56601
ucuacagaacccaauaaaaacua

SEQ ID NO: 760039 - RNA, 16 nt, Leptospira interrogans serovar lai str. 56601
ucuacaccuucuaaau

SEQ ID NO: 760040 - RNA, 23 nt, Leptospira interrogans serovar lai str. 56601
ucuacagauaaacgcggauaaac

SEQ ID NO: 760041 - RNA, 15 nt, Leptospira interrogans serovar lai str. 56601
ucuaauuuuucaaaa

SEQ ID NO: 760042 - RNA, 20 nt, Leptospira interrogans serovar lai str. 56601
ucuaauuuuucaaaaacucu

SEQ ID NO: 760043 - RNA, 18 nt, Leptospira interrogans serovar lai str. 56601
ucuacaaaagauuuuuau

SEQ ID NO: 760044 - RNA, 12 nt, Leptospira interrogans serovar lai str. 56601
ucuacaaaauuu

SEQ ID NO: 760045 - RNA, 15 nt, Leptospira interrogans serovar lai str. 56601
ucuacaaauucuucu

SEQ ID NO: 760046 - RNA, 16 nt, Leptospira interrogans serovar lai str. 56601
ucuacaugauucauuu

SEQ ID NO: 760047 - RNA, 23 nt, Leptospira interrogans serovar lai str. 56601
ucuacaugauucauuuaaaaauu

SEQ ID NO: 760048 - RNA, 21 nt, Leptospira interrogans serovar lai str. 56601
ucuacauuugauauauuagaa

SEQ ID NO: 760049 - RNA, 22 nt, Leptospira interrogans serovar lai str. 56601
ucuacauucaauuucuuuaauu

SEQ ID NO: 760050 - RNA, 19 nt, Leptospira interrogans serovar lai str. 56601
ucuacauucugaaacuuuu

SEQ ID NO: 760051 - RNA, 20 nt, Leptospira interrogans serovar lai str. 56601
ucuacauucugaaacuuuuc

SEQ ID NO: 760052 - RNA, 18 nt, Leptospira interrogans serovar lai str. 56601
aaaugaauuuagaaaauu

SEQ ID NO: 760053 - RNA, 23 nt, Leptospira interrogans serovar lai str. 56601
aaaugaauuuagaaaauuagaaa

SEQ ID NO: 760054 - RNA, 23 nt, Leptospira interrogans serovar lai str. 56601
aaaugaauuuagcauuuuuaaga

SEQ ID NO: 760055 - RNA, 14 nt, Leptospira interrogans serovar lai str. 56601
aaaugaauuuuaaa

SEQ ID NO: 760056 - RNA, 22 nt, Leptospira interrogans serovar lai str. 56601
ucuacauuuuugugaaacucaa

SEQ ID NO: 760057 - RNA, 14 nt, Leptospira interrogans serovar lai str. 56601
aaaugaauuguaaa

SEQ ID NO: 760058 - RNA, 15 nt, Leptospira interrogans serovar lai str. 56601
aaaugaccaaaauuu

SEQ ID NO: 760059 - RNA, 20 nt, Leptospira interrogans serovar lai str. 56601
aaaugacuugcauuuaauau

SEQ ID NO: 760060 - RNA, 15 nt, Leptospira interrogans serovar lai str. 56601
ucuacugaguuucaa

SEQ ID NO: 760061 - RNA, 19 nt, Leptospira interrogans serovar lai str. 56601
ucuacuuugaaugaaaaga

SEQ ID NO: 760062 - RNA, 22 nt, Leptospira interrogans serovar lai str. 56601
ucuacuuuauuaaaaaguuuuc

SEQ ID NO: 760063 - RNA, 21 nt, Leptospira interrogans serovar lai str. 56601
aaaugaguuauaguaaaagaa

SEQ ID NO: 760064 - RNA, 15 nt, Leptospira interrogans serovar lai str. 56601
aaaugaguuuuagaa

SEQ ID NO: 760065 - RNA, 20 nt, Leptospira interrogans serovar lai str. 56601
aaaugaguuuuagaauauua

SEQ ID NO: 760066 - RNA, 16 nt, Leptospira interrogans serovar lai str. 56601
aaaugaguaaacuauu

SEQ ID NO: 760067 - RNA, 16 nt, Leptospira interrogans serovar lai str. 56601
ucuacgacuaacaaaa

SEQ ID NO: 760068 - RNA, 15 nt, Leptospira interrogans serovar lai str. 56601
ucuacgaauuucaga

SEQ ID NO: 760069 - RNA, 20 nt, Leptospira interrogans serovar lai str. 56601
ucuacgaaaauucugaaaga

SEQ ID NO: 760070 - RNA, 22 nt, Leptospira interrogans serovar lai str. 56601
ucuacuauaaacuucucuuaaa

SEQ ID NO: 760071 - RNA, 12 nt, Leptospira interrogans serovar lai str. 56601
ucuaaacucuau

SEQ ID NO: 760072 - RNA, 14 nt, Leptospira interrogans serovar lai str. 56601
ucuaaacuaaaaaa

SEQ ID NO: 760073 - RNA, 19 nt, Leptospira interrogans serovar lai str. 56601
ucuaaacuuuacagaucaa

SEQ ID NO: 760074 - RNA, 19 nt, Leptospira interrogans serovar lai str. 56601
ucuaaacuuugcaaaucga

SEQ ID NO: 760075 - RNA, 13 nt, Leptospira interrogans serovar lai str. 56601
ucuaacauuuuau

SEQ ID NO: 760076 - RNA, 19 nt, Leptospira interrogans serovar lai str. 56601
ucuaacccauucaacauca

SEQ ID NO: 760077 - RNA, 18 nt, Leptospira interrogans serovar lai str. 56601
ucuaaccggaauuuccaa

SEQ ID NO: 760078 - RNA, 22 nt, Leptospira interrogans serovar lai str. 56601
ucuaaaugacuugcauuuaaua

SEQ ID NO: 760079 - RNA, 23 nt, Leptospira interrogans serovar lai str. 56601
ucuaaaugacuugcauuuaauau

SEQ ID NO: 760080 - RNA, 14 nt, Leptospira interrogans serovar lai str. 56601
ucuaaauucagaaa

SEQ ID NO: 760081 - RNA, 16 nt, Leptospira interrogans serovar lai str. 56601
ucuaaauucagaaaaa

SEQ ID NO: 760082 - RNA, 20 nt, Leptospira interrogans serovar lai str. 56601
ucuaaauuagaauuuuauug

SEQ ID NO: 760083 - RNA, 21 nt, Leptospira interrogans serovar lai str. 56601
ucuaaauuaauauuuauaaaa

SEQ ID NO: 760084 - RNA, 16 nt, Leptospira interrogans serovar lai str. 56601
ucuaaaaguaaaagua

SEQ ID NO: 760085 - RNA, 20 nt, Leptospira interrogans serovar lai str. 56601
ucuaaaaguaugaacucuua

SEQ ID NO: 760086 - RNA, 10 nt, Leptospira interrogans serovar lai str. 56601
ucuaaaaauu

SEQ ID NO: 760087 - RNA, 22 nt, Leptospira interrogans serovar lai str. 56601
ucuaaaaauuuccggaaaacga

SEQ ID NO: 760088 - RNA, 18 nt, Leptospira interrogans serovar lai str. 56601
ucuaaaaauuuuuuuaaa

SEQ ID NO: 760089 - RNA, 12 nt, Leptospira interrogans serovar lai str. 56601
ucuaaaaucaua

SEQ ID NO: 760090 - RNA, 17 nt, Leptospira interrogans serovar lai str. 56601
ucuaaaagaagaugcuu

SEQ ID NO: 760091 - RNA, 22 nt, Leptospira interrogans serovar lai str. 56601
ucuaaaagaagaugcuuucucu

SEQ ID NO: 760092 - RNA, 23 nt, Leptospira interrogans serovar lai str. 56601
ucuaaaauuguagaaacuuauac

SEQ ID NO: 760093 - RNA, 13 nt, Leptospira interrogans serovar lai str. 56601
ucuaaaauuugua

SEQ ID NO: 760094 - RNA, 13 nt, Leptospira interrogans serovar lai str. 56601
ucguuuuaaaaac

SEQ ID NO: 760095 - RNA, 21 nt, Leptospira interrogans serovar lai str. 56601
ucguuugcuuuucuaucaaaa

SEQ ID NO: 760096 - RNA, 11 nt, Leptospira interrogans serovar lai str. 56601
ucguuuuacuu

SEQ ID NO: 760097 - RNA, 13 nt, Leptospira interrogans serovar lai str. 56601
ucguuuuuuucau

SEQ ID NO: 760098 - RNA, 18 nt, Leptospira interrogans serovar lai str. 56601
ucguuuuuuucaugaaaa

SEQ ID NO: 760099 - RNA, 12 nt, Leptospira interrogans serovar lai str. 56601
ucguuuuuuaaa

SEQ ID NO: 760100 - RNA, 14 nt, Leptospira interrogans serovar lai str. 56601
ucguuuuuuaaaau

SEQ ID NO: 760101 - RNA, 20 nt, Leptospira interrogans serovar lai str. 56601
ucguuuuuuaaaauguagga

SEQ ID NO: 760102 - RNA, 17 nt, Leptospira interrogans serovar lai str. 56601
ucguuuuuuuaauauua

SEQ ID NO: 760103 - RNA, 17 nt, Leptospira interrogans serovar lai str. 56601
ucuaaaaacaacucagc

SEQ ID NO: 760104 - RNA, 12 nt, Leptospira interrogans serovar lai str. 56601
aaaugaaaaauu

SEQ ID NO: 760105 - RNA, 22 nt, Leptospira interrogans serovar lai str. 56601
aaaugaaaaagaauuuuuaaaa

SEQ ID NO: 760106 - RNA, 13 nt, Leptospira interrogans serovar lai str. 56601
aaaugaaaauuau

SEQ ID NO: 760107 - RNA, 14 nt, Leptospira interrogans serovar lai str. 56601
aaaugaaaauuaua

SEQ ID NO: 760108 - RNA, 15 nt, Leptospira interrogans serovar lai str. 56601
aaaugaaaauuauaa

SEQ ID NO: 760109 - RNA, 18 nt, Leptospira interrogans serovar lai str. 56601
aaaugaaaauuauaagua

SEQ ID NO: 760110 - RNA, 17 nt, Leptospira interrogans serovar lai str. 56601
aaaugaaaaaaaacaaa

SEQ ID NO: 760111 - RNA, 20 nt, Leptospira interrogans serovar lai str. 56601
aaaugaaaaaaaacaaagag

SEQ ID NO: 760112 - RNA, 13 nt, Leptospira interrogans serovar lai str. 56601
aaaugaaaaaacu

SEQ ID NO: 760113 - RNA, 15 nt, Leptospira interrogans serovar lai str. 56601
aaaucuuuuaaaaaa

SEQ ID NO: 760114 - RNA, 16 nt, Leptospira interrogans serovar lai str. 56601
aaaucuuuuaaaaaag

SEQ ID NO: 760115 - RNA, 18 nt, Leptospira interrogans serovar lai str. 56601
aaaucuuuagaauuuuuc

SEQ ID NO: 760116 - RNA, 14 nt, Leptospira interrogans serovar lai str. 56601
ucuaauacaaaaaa

SEQ ID NO: 760117 - RNA, 22 nt, Leptospira interrogans serovar lai str. 56601
ucuaauaauauacuaaauuauu

SEQ ID NO: 760118 - RNA, 17 nt, Leptospira interrogans serovar lai str. 56601
ucuaaguuuuuaaauaa

SEQ ID NO: 760119 - RNA, 12 nt, Leptospira interrogans serovar lai str. 56601
ucuaauaaaaua

SEQ ID NO: 760120 - RNA, 15 nt, Leptospira interrogans serovar lai str. 56601
ucuaauaaaauauga

SEQ ID NO: 760121 - RNA, 16 nt, Leptospira interrogans serovar lai str. 56601
ucuaaguccacccaaa

SEQ ID NO: 760122 - RNA, 13 nt, Leptospira interrogans serovar lai str. 56601
ucuaaguccuuuu

SEQ ID NO: 760123 - RNA, 15 nt, Leptospira interrogans serovar lai str. 56601
ucuaaguccuuuucu

SEQ ID NO: 760124 - RNA, 16 nt, Leptospira interrogans serovar lai str. 56601
ucuaaguaauuuaaaa

SEQ ID NO: 760125 - RNA, 15 nt, Leptospira interrogans serovar lai str. 56601
ucuaaguguaaaauu

SEQ ID NO: 760126 - RNA, 17 nt, Leptospira interrogans serovar lai str. 56601
aaaugaagaaacacuuu

SEQ ID NO: 760127 - RNA, 20 nt, Leptospira interrogans serovar lai str. 56601
aaaugaacaaugaauuuuua

SEQ ID NO: 760128 - RNA, 23 nt, Leptospira interrogans serovar lai str. 56601
aaaugaacaaugaauuuuuauaa

SEQ ID NO: 760129 - RNA, 13 nt, Leptospira interrogans serovar lai str. 56601
aaaugaacucaac

SEQ ID NO: 760130 - RNA, 18 nt, Leptospira interrogans serovar lai str. 56601
aaaugaacucaacagaac

SEQ ID NO: 760131 - RNA, 15 nt, Leptospira interrogans serovar lai str. 56601
aaaugaaauguggga

SEQ ID NO: 760132 - RNA, 19 nt, Leptospira interrogans serovar lai str. 56601
aaaugaaagguaauuuuga

SEQ ID NO: 760133 - RNA, 19 nt, Leptospira interrogans serovar lai str. 56601
ucuaagauugaaugaaauc

SEQ ID NO: 760134 - RNA, 22 nt, Leptospira interrogans serovar lai str. 56601
ucuaagauugaaugaaaucuaa

SEQ ID NO: 760135 - RNA, 16 nt, Leptospira interrogans serovar lai str. 56601
ucuaagaucaacacaa

SEQ ID NO: 760136 - RNA, 17 nt, Leptospira interrogans serovar lai str. 56601
ucuaagauccaaauuuu

SEQ ID NO: 760137 - RNA, 20 nt, Leptospira interrogans serovar lai str. 56601
ucuaacugguuuuucuuuaa

SEQ ID NO: 760138 - RNA, 18 nt, Leptospira interrogans serovar lai str. 56601
aaaucuucaguucuuaua

SEQ ID NO: 760139 - RNA, 22 nt, Leptospira interrogans serovar lai str. 56601
aaaucuucaguucuuauagaaa

SEQ ID NO: 760140 - RNA, 21 nt, Leptospira interrogans serovar lai str. 56601
aaaucuuaggaacuuuuauaa

SEQ ID NO: 760141 - RNA, 15 nt, Leptospira interrogans serovar lai str. 56601
aaaucuuaauuugua

SEQ ID NO: 760142 - RNA, 18 nt, Leptospira interrogans serovar lai str. 56601
ucuaagcuuuagaaaaua

SEQ ID NO: 760143 - RNA, 23 nt, Leptospira interrogans serovar lai str. 56601
ucucacagaaauauauucuuuuc

SEQ ID NO: 760144 - RNA, 22 nt, Leptospira interrogans serovar lai str. 56601
ucucagcucuggucaaguuauu

SEQ ID NO: 760145 - RNA, 22 nt, Leptospira interrogans serovar lai str. 56601
ucucagcucugguuaauaaauu

SEQ ID NO: 760146 - RNA, 23 nt, Leptospira interrogans serovar lai str. 56601
ucucagcuucagucaaguuauug

SEQ ID NO: 760147 - RNA, 17 nt, Leptospira interrogans serovar lai str. 56601
ucucagccaaaaguuuu

SEQ ID NO: 760148 - RNA, 16 nt, Leptospira interrogans serovar lai str. 56601
ucucagcaagucuauu

SEQ ID NO: 760149 - RNA, 15 nt, Leptospira interrogans serovar lai str. 56601
ucucaucaaaaaaau

SEQ ID NO: 760150 - RNA, 21 nt, Leptospira interrogans serovar lai str. 56601
ucucagucaccucuauaaaau

SEQ ID NO: 760151 - RNA, 15 nt, Leptospira interrogans serovar lai str. 56601
ucucaguucaaaaua

SEQ ID NO: 760152 - RNA, 17 nt, Leptospira interrogans serovar lai str. 56601
ucuauuggguuugauuu

SEQ ID NO: 760153 - RNA, 22 nt, Leptospira interrogans serovar lai str. 56601
ucuauugguucuauauauuaga

SEQ ID NO: 760154 - RNA, 18 nt, Leptospira interrogans serovar lai str. 56601
ucuauuuaaguacuuaau

SEQ ID NO: 760155 - RNA, 20 nt, Leptospira interrogans serovar lai str. 56601
ucuauuuucuuugaaaaaau

SEQ ID NO: 760156 - RNA, 21 nt, Leptospira interrogans serovar lai str. 56601
ucuauuuugagaaaauccagu

SEQ ID NO: 760157 - RNA, 21 nt, Leptospira interrogans serovar lai str. 56601
ucuauuuuguuuuauagaaac

SEQ ID NO: 760158 - RNA, 13 nt, Leptospira interrogans serovar lai str. 56601
ucuauuucuaaac

SEQ ID NO: 760159 - RNA, 16 nt, Leptospira interrogans serovar lai str. 56601
ucuauuucccaaaauu

SEQ ID NO: 760160 - RNA, 20 nt, Leptospira interrogans serovar lai str. 56601
ucuaugugcgguuacguguu

SEQ ID NO: 760161 - RNA, 14 nt, Leptospira interrogans serovar lai str. 56601
ucuauuauauaguu

SEQ ID NO: 760162 - RNA, 23 nt, Leptospira interrogans serovar lai str. 56601
ucuauuagaauaguaguuuucac

SEQ ID NO: 760163 - RNA, 13 nt, Leptospira interrogans serovar lai str. 56601
ucuauuaugauuc

SEQ ID NO: 760164 - RNA, 15 nt, Leptospira interrogans serovar lai str. 56601
ucuauuaugauucua

SEQ ID NO: 760165 - RNA, 21 nt, Leptospira interrogans serovar lai str. 56601
ucuauucauaaaugauaauaa

SEQ ID NO: 760166 - RNA, 12 nt, Leptospira interrogans serovar lai str. 56601
ucuauucauaac

SEQ ID NO: 760167 - RNA, 13 nt, Leptospira interrogans serovar lai str. 56601
ucuauuccuaaaa

SEQ ID NO: 760168 - RNA, 15 nt, Leptospira interrogans serovar lai str. 56601
ucuauuccuaaaaug

SEQ ID NO: 760169 - RNA, 22 nt, Leptospira interrogans serovar lai str. 56601
ucuauugaguuauaaacauuaa

SEQ ID NO: 760170 - RNA, 21 nt, Leptospira interrogans serovar lai str. 56601
ucuauugaaacaaaaaugaga

SEQ ID NO: 760171 - RNA, 11 nt, Leptospira interrogans serovar lai str. 56601
ucucaaaaaua

SEQ ID NO: 760172 - RNA, 12 nt, Leptospira interrogans serovar lai str. 56601
ucucaaaaauag

SEQ ID NO: 760173 - RNA, 21 nt, Leptospira interrogans serovar lai str. 56601
ucucaaaaacacuuuaucuuu

SEQ ID NO: 760174 - RNA, 19 nt, Leptospira interrogans serovar lai str. 56601
ucucaaaaauaucuuagaa

SEQ ID NO: 760175 - RNA, 15 nt, Leptospira interrogans serovar lai str. 56601
ucuauuuuuuaauug

SEQ ID NO: 760176 - RNA, 14 nt, Leptospira interrogans serovar lai str. 56601
ucuauuuuugauuu

SEQ ID NO: 760177 - RNA, 14 nt, Leptospira interrogans serovar lai str. 56601
ucucaaauucuuca

SEQ ID NO: 760178 - RNA, 21 nt, Leptospira interrogans serovar lai str. 56601
ucucaaaauuaagaaucaaua

SEQ ID NO: 760179 - RNA, 14 nt, Leptospira interrogans serovar lai str. 56601
ucucaaaauuuaag

SEQ ID NO: 760180 - RNA, 16 nt, Leptospira interrogans serovar lai str. 56601
ucucaaaacuuaaaaa

SEQ ID NO: 760181 - RNA, 18 nt, Leptospira interrogans serovar lai str. 56601
ucucaaaacuuaaaaaug

SEQ ID NO: 760182 - RNA, 20 nt, Leptospira interrogans serovar lai str. 56601
ucucaagauuuaauuuagaa

SEQ ID NO: 760183 - RNA, 20 nt, Leptospira interrogans serovar lai str. 56601
ucuauagccaaguauaaaag

SEQ ID NO: 760184 - RNA, 21 nt, Leptospira interrogans serovar lai str. 56601
ucuauagccaaguauaaaagu

SEQ ID NO: 760185 - RNA, 13 nt, Leptospira interrogans serovar lai str. 56601
ucuauauauugaa

SEQ ID NO: 760186 - RNA, 16 nt, Leptospira interrogans serovar lai str. 56601
ucuauaucgugaaacu

SEQ ID NO: 760187 - RNA, 23 nt, Leptospira interrogans serovar lai str. 56601
ucuauauucaaaaaauggaacau

SEQ ID NO: 760188 - RNA, 18 nt, Leptospira interrogans serovar lai str. 56601
ucuauaauguuaauuuag

SEQ ID NO: 760189 - RNA, 19 nt, Leptospira interrogans serovar lai str. 56601
ucuauaauguuaauuuaga

SEQ ID NO: 760190 - RNA, 13 nt, Leptospira interrogans serovar lai str. 56601
ucuauaauuaaua

SEQ ID NO: 760191 - RNA, 20 nt, Leptospira interrogans serovar lai str. 56601
ucuauaauuaauaaaacuga

SEQ ID NO: 760192 - RNA, 20 nt, Leptospira interrogans serovar lai str. 56601
ucuauaaauugcaucaaaga

SEQ ID NO: 760193 - RNA, 12 nt, Leptospira interrogans serovar lai str. 56601
ucuauaaauugg

SEQ ID NO: 760194 - RNA, 13 nt, Leptospira interrogans serovar lai str. 56601
ucuauaaaugaau

SEQ ID NO: 760195 - RNA, 12 nt, Leptospira interrogans serovar lai str. 56601
ucuaguuuuccu

SEQ ID NO: 760196 - RNA, 13 nt, Leptospira interrogans serovar lai str. 56601
ucuauaaaauauc

SEQ ID NO: 760197 - RNA, 15 nt, Leptospira interrogans serovar lai str. 56601
ucuauaaaauaucuu

SEQ ID NO: 760198 - RNA, 13 nt, Leptospira interrogans serovar lai str. 56601
ucuauaaaaucua

SEQ ID NO: 760199 - RNA, 14 nt, Leptospira interrogans serovar lai str. 56601
ucuauaaaaucuaa

SEQ ID NO: 760200 - RNA, 17 nt, Leptospira interrogans serovar lai str. 56601
ucuauaaaaucuaaaaa

SEQ ID NO: 760201 - RNA, 21 nt, Leptospira interrogans serovar lai str. 56601
ucuauaaaaucuaaaaaaaau

SEQ ID NO: 760202 - RNA, 22 nt, Leptospira interrogans serovar lai str. 56601
ucuauaaaaucuaaaaaaacaa

SEQ ID NO: 760203 - RNA, 19 nt, Leptospira interrogans serovar lai str. 56601
ucuauaaaauuaaauaccu

SEQ ID NO: 760204 - RNA, 16 nt, Leptospira interrogans serovar lai str. 56601
ucuauaaaauucaaaa

SEQ ID NO: 760205 - RNA, 20 nt, Leptospira interrogans serovar lai str. 56601
ucuauaaaauucaaaaagaa

SEQ ID NO: 760206 - RNA, 21 nt, Leptospira interrogans serovar lai str. 56601
ucuauaaaauucaaaaagaau

SEQ ID NO: 760207 - RNA, 16 nt, Leptospira interrogans serovar lai str. 56601
ucuauaaaauugaaua

SEQ ID NO: 760208 - RNA, 21 nt, Leptospira interrogans serovar lai str. 56601
ucuauaaaauuugaaaguaaa

SEQ ID NO: 760209 - RNA, 13 nt, Leptospira interrogans serovar lai str. 56601
ucuauaaacucaa

SEQ ID NO: 760210 - RNA, 15 nt, Leptospira interrogans serovar lai str. 56601
ucuauaaaguugaau

SEQ ID NO: 760211 - RNA, 16 nt, Leptospira interrogans serovar lai str. 56601
ucuaucagaaaaacau

SEQ ID NO: 760212 - RNA, 15 nt, Leptospira interrogans serovar lai str. 56601
ucuaugauucugaaa

SEQ ID NO: 760213 - RNA, 13 nt, Leptospira interrogans serovar lai str. 56601
ucuauggaauuuu

SEQ ID NO: 760214 - RNA, 14 nt, Leptospira interrogans serovar lai str. 56601
ucuauggaauuuuu

SEQ ID NO: 760215 - RNA, 17 nt, Leptospira interrogans serovar lai str. 56601
ucuauguuauagacaac

SEQ ID NO: 760216 - RNA, 14 nt, Leptospira interrogans serovar lai str. 56601
ucuauguaagaaaa

SEQ ID NO: 760217 - RNA, 20 nt, Leptospira interrogans serovar lai str. 56601
ucuagcaacacauuuucauu

SEQ ID NO: 760218 - RNA, 22 nt, Leptospira interrogans serovar lai str. 56601
ucuagcaacacauuuucauucu

SEQ ID NO: 760219 - RNA, 21 nt, Leptospira interrogans serovar lai str. 56601
ucuagauuuuacgauuaaauu

SEQ ID NO: 760220 - RNA, 20 nt, Leptospira interrogans serovar lai str. 56601
ucuagaaccuggaaaagaau

SEQ ID NO: 760221 - RNA, 19 nt, Leptospira interrogans serovar lai str. 56601
aaaugagaaagaauuucua

SEQ ID NO: 760222 - RNA, 23 nt, Leptospira interrogans serovar lai str. 56601
aaaugauaauaauuagaaaaaua

SEQ ID NO: 760223 - RNA, 13 nt, Leptospira interrogans serovar lai str. 56601
ucuaguaguuccc

SEQ ID NO: 760224 - RNA, 22 nt, Leptospira interrogans serovar lai str. 56601
ucuaguaguucccacauuuugu

SEQ ID NO: 760225 - RNA, 15 nt, Leptospira interrogans serovar lai str. 56601
ucuagucaaguuaau

SEQ ID NO: 760226 - RNA, 23 nt, Leptospira interrogans serovar lai str. 56601
ucuagucaauuaaauuguaugaa

SEQ ID NO: 760227 - RNA, 16 nt, Leptospira interrogans serovar lai str. 56601
ucuaggcgauuuuucg

SEQ ID NO: 760228 - RNA, 16 nt, Leptospira interrogans serovar lai str. 56601
aaaugcagcaaaaccu

SEQ ID NO: 760229 - RNA, 23 nt, Leptospira interrogans serovar lai str. 56601
aaaugcaaaaguuuucaaaaaug

SEQ ID NO: 760230 - RNA, 14 nt, Leptospira interrogans serovar lai str. 56601
ucuggaaaaguuuu

SEQ ID NO: 760231 - RNA, 18 nt, Leptospira interrogans serovar lai str. 56601
ucuggaaaaguuuuuaaa

SEQ ID NO: 760232 - RNA, 21 nt, Leptospira interrogans serovar lai str. 56601
ucugcauauacggauuucuau

SEQ ID NO: 760233 - RNA, 23 nt, Leptospira interrogans serovar lai str. 56601
ucugcauauacggauuucuauaa

SEQ ID NO: 760234 - RNA, 13 nt, Leptospira interrogans serovar lai str. 56601
ucugcaucgaucc

SEQ ID NO: 760235 - RNA, 18 nt, Leptospira interrogans serovar lai str. 56601
ucugcaucuuuucuaagg

SEQ ID NO: 760236 - RNA, 15 nt, Leptospira interrogans serovar lai str. 56601
ucuguaaaaaauaaa

SEQ ID NO: 760237 - RNA, 16 nt, Leptospira interrogans serovar lai str. 56601
ucuguaaaagaaaaau

SEQ ID NO: 760238 - RNA, 14 nt, Leptospira interrogans serovar lai str. 56601
ucuguaaaauaaau

SEQ ID NO: 760239 - RNA, 20 nt, Leptospira interrogans serovar lai str. 56601
ucuguaaaauaaauuuauaa

SEQ ID NO: 760240 - RNA, 15 nt, Leptospira interrogans serovar lai str. 56601
ucuguaaauacaaaa

SEQ ID NO: 760241 - RNA, 20 nt, Leptospira interrogans serovar lai str. 56601
ucuguaaauucaaagcaaga

SEQ ID NO: 760242 - RNA, 12 nt, Leptospira interrogans serovar lai str. 56601
ucuguaaaguuu

SEQ ID NO: 760243 - RNA, 19 nt, Leptospira interrogans serovar lai str. 56601
ucugguuccauaaagacca

SEQ ID NO: 760244 - RNA, 12 nt, Leptospira interrogans serovar lai str. 56601
ucuguaguaucc

SEQ ID NO: 760245 - RNA, 15 nt, Leptospira interrogans serovar lai str. 56601
ucuguagaaauucua

SEQ ID NO: 760246 - RNA, 17 nt, Leptospira interrogans serovar lai str. 56601
ucuguagaaauucuauu

SEQ ID NO: 760247 - RNA, 12 nt, Leptospira interrogans serovar lai str. 56601
ucuguaauugga

SEQ ID NO: 760248 - RNA, 15 nt, Leptospira interrogans serovar lai str. 56601
ucuguaauuggaaug

SEQ ID NO: 760249 - RNA, 23 nt, Leptospira interrogans serovar lai str. 56601
ucuguaauuggaauguacuaaaa

SEQ ID NO: 760250 - RNA, 16 nt, Leptospira interrogans serovar lai str. 56601
ucugugggaacucuca

SEQ ID NO: 760251 - RNA, 14 nt, Leptospira interrogans serovar lai str. 56601
ucugugaaacucag

SEQ ID NO: 760252 - RNA, 20 nt, Leptospira interrogans serovar lai str. 56601
ucugucuuaaaauuugaaaa

SEQ ID NO: 760253 - RNA, 21 nt, Leptospira interrogans serovar lai str. 56601
ucugucucuuuauauaaaauu

SEQ ID NO: 760254 - RNA, 13 nt, Leptospira interrogans serovar lai str. 56601
ucuuccaauuguu

SEQ ID NO: 760255 - RNA, 22 nt, Leptospira interrogans serovar lai str. 56601
ucuucaauguuauaaaauguau

SEQ ID NO: 760256 - RNA, 16 nt, Leptospira interrogans serovar lai str. 56601
ucuuccguuuuuaauc

SEQ ID NO: 760257 - RNA, 14 nt, Leptospira interrogans serovar lai str. 56601
ucuuccuuuuucau

SEQ ID NO: 760258 - RNA, 15 nt, Leptospira interrogans serovar lai str. 56601
ucuuccuuuuucauu

SEQ ID NO: 760259 - RNA, 23 nt, Leptospira interrogans serovar lai str. 56601
ucuguucauucuuuaaaauagaa

SEQ ID NO: 760260 - RNA, 23 nt, Leptospira interrogans serovar lai str. 56601
ucuguuccgcuguaguaucucuu

SEQ ID NO: 760261 - RNA, 19 nt, Leptospira interrogans serovar lai str. 56601
ucuguuuagaauauuuucu

SEQ ID NO: 760262 - RNA, 14 nt, Leptospira interrogans serovar lai str. 56601
ucuuacaacuuuug

SEQ ID NO: 760263 - RNA, 14 nt, Leptospira interrogans serovar lai str. 56601
ucuuagucuaaaaa

SEQ ID NO: 760264 - RNA, 16 nt, Leptospira interrogans serovar lai str. 56601
ucuuagucuaaaaaca

SEQ ID NO: 760265 - RNA, 21 nt, Leptospira interrogans serovar lai str. 56601
ucuucaauaucuuuauuuaau

SEQ ID NO: 760266 - RNA, 18 nt, Leptospira interrogans serovar lai str. 56601
ucuuauaagaaucgauuc

SEQ ID NO: 760267 - RNA, 13 nt, Leptospira interrogans serovar lai str. 56601
ucuuauaucaaac

SEQ ID NO: 760268 - RNA, 17 nt, Leptospira interrogans serovar lai str. 56601
aaauggagaacuuuaca

SEQ ID NO: 760269 - RNA, 20 nt, Leptospira interrogans serovar lai str. 56601
aaauggagaauuaauuuuuc

SEQ ID NO: 760270 - RNA, 12 nt, Leptospira interrogans serovar lai str. 56601
aaauggaaaauu

SEQ ID NO: 760271 - RNA, 16 nt, Leptospira interrogans serovar lai str. 56601
aaauggauaaauuuua

SEQ ID NO: 760272 - RNA, 17 nt, Leptospira interrogans serovar lai str. 56601
ucucuucgucucaccaa

SEQ ID NO: 760273 - RNA, 15 nt, Leptospira interrogans serovar lai str. 56601
ucucugauaauuuuu

SEQ ID NO: 760274 - RNA, 15 nt, Leptospira interrogans serovar lai str. 56601
ucucuaucagaaaaa

SEQ ID NO: 760275 - RNA, 21 nt, Leptospira interrogans serovar lai str. 56601
ucucuaaaucuuuaagagccu

SEQ ID NO: 760276 - RNA, 14 nt, Leptospira interrogans serovar lai str. 56601
ucucggaauauuuu

SEQ ID NO: 760277 - RNA, 14 nt, Leptospira interrogans serovar lai str. 56601
ucucggacagauau

SEQ ID NO: 760278 - RNA, 21 nt, Leptospira interrogans serovar lai str. 56601
ucucguucaacuuuccuuuuc

SEQ ID NO: 760279 - RNA, 13 nt, Leptospira interrogans serovar lai str. 56601
ucucguuuucuua

SEQ ID NO: 760280 - RNA, 20 nt, Leptospira interrogans serovar lai str. 56601
ucucguuuuuaggauuaauu

SEQ ID NO: 760281 - RNA, 21 nt, Leptospira interrogans serovar lai str. 56601
ucugaaacuuuucaaaaucua

SEQ ID NO: 760282 - RNA, 16 nt, Leptospira interrogans serovar lai str. 56601
ucugaaaauguaaaag

SEQ ID NO: 760283 - RNA, 17 nt, Leptospira interrogans serovar lai str. 56601
ucucuuuauauaaaauu

SEQ ID NO: 760284 - RNA, 19 nt, Leptospira interrogans serovar lai str. 56601
ucugauaaagaaaaccacc

SEQ ID NO: 760285 - RNA, 19 nt, Leptospira interrogans serovar lai str. 56601
ucugauaacuauauaacaa

SEQ ID NO: 760286 - RNA, 18 nt, Leptospira interrogans serovar lai str. 56601
ucugauaauuuuuuaaaa

SEQ ID NO: 760287 - RNA, 22 nt, Leptospira interrogans serovar lai str. 56601
ucugauaauuuuuuaaaaaaau

SEQ ID NO: 760288 - RNA, 17 nt, Leptospira interrogans serovar lai str. 56601
ucugauacuaauaguuu

SEQ ID NO: 760289 - RNA, 15 nt, Leptospira interrogans serovar lai str. 56601
ucuccuuuuuuacug

SEQ ID NO: 760290 - RNA, 23 nt, Leptospira interrogans serovar lai str. 56601
ucucgaaaaucucagaaaauuuu

SEQ ID NO: 760291 - RNA, 15 nt, Leptospira interrogans serovar lai str. 56601
ucucgauuucuaaaa

SEQ ID NO: 760292 - RNA, 15 nt, Leptospira interrogans serovar lai str. 56601
ucucgauuccuaaaa

SEQ ID NO: 760293 - RNA, 18 nt, Leptospira interrogans serovar lai str. 56601
ucucgaacuacccaaaac

SEQ ID NO: 760294 - RNA, 17 nt, Leptospira interrogans serovar lai str. 56601
ucuccugcauccacaaa

SEQ ID NO: 760295 - RNA, 22 nt, Leptospira interrogans serovar lai str. 56601
ucuccucuucaccaagcuccuc

SEQ ID NO: 760296 - RNA, 15 nt, Leptospira interrogans serovar lai str. 56601
ucuccuccugaaaau

SEQ ID NO: 760297 - RNA, 21 nt, Leptospira interrogans serovar lai str. 56601
ucuccggcgaccuuucuaaaa

SEQ ID NO: 760298 - RNA, 16 nt, Leptospira interrogans serovar lai str. 56601
ucuccuaaaauaaaau

SEQ ID NO: 760299 - RNA, 17 nt, Leptospira interrogans serovar lai str. 56601
ucuccuauguuucuugu

SEQ ID NO: 760300 - RNA, 23 nt, Leptospira interrogans serovar lai str. 56601
ucucccuuaccuccuuuuucaaa

SEQ ID NO: 760301 - RNA, 17 nt, Leptospira interrogans serovar lai str. 56601
ucuccauuuguuucuau

SEQ ID NO: 760302 - RNA, 22 nt, Leptospira interrogans serovar lai str. 56601
ucuccauuauaguuuuuucaaa

SEQ ID NO: 760303 - RNA, 17 nt, Leptospira interrogans serovar lai str. 56601
ucuccaucuguuucuau

SEQ ID NO: 760304 - RNA, 15 nt, Leptospira interrogans serovar lai str. 56601
ucuccaucuauuucc

SEQ ID NO: 760305 - RNA, 22 nt, Leptospira interrogans serovar lai str. 56601
ucuccaagaacguuuccagaaa

SEQ ID NO: 760306 - RNA, 14 nt, Leptospira interrogans serovar lai str. 56601
ucuccacuuaaaaa

SEQ ID NO: 760307 - RNA, 23 nt, Leptospira interrogans serovar lai str. 56601
ucuccacuugaauagaaccuuuu

SEQ ID NO: 760308 - RNA, 21 nt, Leptospira interrogans serovar lai str. 56601
ucuccaauagaauuguguuag

SEQ ID NO: 760309 - RNA, 16 nt, Leptospira interrogans serovar lai str. 56601
ucuccagcauuuagaa

SEQ ID NO: 760310 - RNA, 12 nt, Leptospira interrogans serovar lai str. 56601
ucucauuucaaa

SEQ ID NO: 760311 - RNA, 23 nt, Leptospira interrogans serovar lai str. 56601
ucucauuucaaauuuauaguuuu

SEQ ID NO: 760312 - RNA, 16 nt, Leptospira interrogans serovar lai str. 56601
ucucauuggauucuau

SEQ ID NO: 760313 - RNA, 23 nt, Leptospira interrogans serovar lai str. 56601
ucuccaaaauuuuuguguaaaau

SEQ ID NO: 760314 - RNA, 21 nt, Leptospira interrogans serovar lai str. 56601
ucucauuaccaauugauaauu

SEQ ID NO: 760315 - RNA, 11 nt, Leptospira interrogans serovar lai str. 56601
ucguucccaca

SEQ ID NO: 760316 - RNA, 12 nt, Leptospira interrogans serovar lai str. 56601
ucguucccacaa

SEQ ID NO: 760317 - RNA, 15 nt, Leptospira interrogans serovar lai str. 56601
ucguucggaaaaaau

SEQ ID NO: 760318 - RNA, 17 nt, Leptospira interrogans serovar lai str. 56601
ucguuauuuuuauaaag

SEQ ID NO: 760319 - RNA, 18 nt, Leptospira interrogans serovar lai str. 56601
ucguuauaaacaauauga

SEQ ID NO: 760320 - RNA, 13 nt, Leptospira interrogans serovar lai str. 56601
ucguuaaguuauc

SEQ ID NO: 760321 - RNA, 12 nt, Leptospira interrogans serovar lai str. 56601
ucguuaaauuuu

SEQ ID NO: 760322 - RNA, 21 nt, Leptospira interrogans serovar lai str. 56601
ucguugaaaaauuaaugucuu

SEQ ID NO: 760323 - RNA, 14 nt, Leptospira interrogans serovar lai str. 56601
ucguuggaaaguuu

SEQ ID NO: 760324 - RNA, 21 nt, Leptospira interrogans serovar lai str. 56601
ucguuucccauauaauuuuau

SEQ ID NO: 760325 - RNA, 14 nt, Leptospira interrogans serovar lai str. 56601
ucguuuagaggaag

SEQ ID NO: 760326 - RNA, 19 nt, Leptospira interrogans serovar lai str. 56601
ucguuuauuuuucuaaaaa

SEQ ID NO: 760327 - RNA, 20 nt, Leptospira interrogans serovar lai str. 56601
ucguuuauuuuucuaaaaaa

SEQ ID NO: 760328 - RNA, 19 nt, Leptospira interrogans serovar lai str. 56601
ucguuucaacuuuagaaaa

SEQ ID NO: 760329 - RNA, 17 nt, Leptospira interrogans serovar lai str. 56601
ucguuucguacauaaau

SEQ ID NO: 760330 - RNA, 16 nt, Leptospira interrogans serovar lai str. 56601
ucguuucugaggaauu

SEQ ID NO: 760331 - RNA, 21 nt, Leptospira interrogans serovar lai str. 56601
ucguuucguucccguuuagaa

SEQ ID NO: 760332 - RNA, 23 nt, Leptospira interrogans serovar lai str. 56601
ucgugauuugugggaguuuucac

SEQ ID NO: 760333 - RNA, 12 nt, Leptospira interrogans serovar lai str. 56601
ucgucuucuuuu

SEQ ID NO: 760334 - RNA, 13 nt, Leptospira interrogans serovar lai str. 56601
ucgucuucuuuuu

SEQ ID NO: 760335 - RNA, 16 nt, Leptospira interrogans serovar lai str. 56601
ucgucuauaaauucau

SEQ ID NO: 760336 - RNA, 19 nt, Leptospira interrogans serovar lai str. 56601
ucgucuaucuuuuuuaaaa

SEQ ID NO: 760337 - RNA, 14 nt, Leptospira interrogans serovar lai str. 56601
ucgucucaaaaaua

SEQ ID NO: 760338 - RNA, 16 nt, Leptospira interrogans serovar lai str. 56601
ucguaauaucuaaaac

SEQ ID NO: 760339 - RNA, 19 nt, Leptospira interrogans serovar lai str. 56601
ucguacgaaucagauccuu

SEQ ID NO: 760340 - RNA, 23 nt, Leptospira interrogans serovar lai str. 56601
ucguacggauugccuaaauuccu

SEQ ID NO: 760341 - RNA, 16 nt, Leptospira interrogans serovar lai str. 56601
ucguauugaauuuuuu

SEQ ID NO: 760342 - RNA, 17 nt, Leptospira interrogans serovar lai str. 56601
ucguaucuaaagacuaa

SEQ ID NO: 760343 - RNA, 19 nt, Leptospira interrogans serovar lai str. 56601
ucguauuuuagaaauauug

SEQ ID NO: 760344 - RNA, 15 nt, Leptospira interrogans serovar lai str. 56601
ucgucaaaaccaaaa

SEQ ID NO: 760345 - RNA, 15 nt, Leptospira interrogans serovar lai str. 56601
ucggcuuaagaaaau

SEQ ID NO: 760346 - RNA, 15 nt, Leptospira interrogans serovar lai str. 56601
ucgggacaaaucaua

SEQ ID NO: 760347 - RNA, 20 nt, Leptospira interrogans serovar lai str. 56601
ucggccucguuuacaagauu

SEQ ID NO: 760348 - RNA, 18 nt, Leptospira interrogans serovar lai str. 56601
ucgguucacguuaauuga

SEQ ID NO: 760349 - RNA, 19 nt, Leptospira interrogans serovar lai str. 56601
ucgguugagcaaaaauuuu

SEQ ID NO: 760350 - RNA, 22 nt, Leptospira interrogans serovar lai str. 56601
ucgguucgcguuaauauaauaa

SEQ ID NO: 760351 - RNA, 17 nt, Leptospira interrogans serovar lai str. 56601
ucguaaaaaaauauuuc

SEQ ID NO: 760352 - RNA, 12 nt, Leptospira interrogans serovar lai str. 56601
ucguaaaaaaga

SEQ ID NO: 760353 - RNA, 19 nt, Leptospira interrogans serovar lai str. 56601
ucgguggaaacucaguaaa

SEQ ID NO: 760354 - RNA, 12 nt, Leptospira interrogans serovar lai str. 56601
ucgguaaaaaga

SEQ ID NO: 760355 - RNA, 16 nt, Leptospira interrogans serovar lai str. 56601
ucgguauaaucuaauu

SEQ ID NO: 760356 - RNA, 15 nt, Leptospira interrogans serovar lai str. 56601
ucggauuucugaaaa

SEQ ID NO: 760357 - RNA, 18 nt, Leptospira interrogans serovar lai str. 56601
ucggaagauuuuucaauc

SEQ ID NO: 760358 - RNA, 17 nt, Leptospira interrogans serovar lai str. 56601
ucggaaaauugaauauu

SEQ ID NO: 760359 - RNA, 12 nt, Leptospira interrogans serovar lai str. 56601
ucggaaauuuau

SEQ ID NO: 760360 - RNA, 17 nt, Leptospira interrogans serovar lai str. 56601
ucggaaucgaggaaauu

SEQ ID NO: 760361 - RNA, 21 nt, Leptospira interrogans serovar lai str. 56601
ucggaaucgaggaaauucuau

SEQ ID NO: 760362 - RNA, 15 nt, Leptospira interrogans serovar lai str. 56601
ucggaauaacuuucu

SEQ ID NO: 760363 - RNA, 23 nt, Leptospira interrogans serovar lai str. 56601
ucggaauuuuaauuguaaaagga

SEQ ID NO: 760364 - RNA, 21 nt, Leptospira interrogans serovar lai str. 56601
ucggaauauuuuuuccaaaaa

SEQ ID NO: 760365 - RNA, 17 nt, Leptospira interrogans serovar lai str. 56601
ucggaauuucugcuaca

SEQ ID NO: 760366 - RNA, 20 nt, Leptospira interrogans serovar lai str. 56601
ucggagucauacauuuugua

SEQ ID NO: 760367 - RNA, 23 nt, Leptospira interrogans serovar lai str. 56601
ucgcugguuuuauuucugcugcu

SEQ ID NO: 760368 - RNA, 14 nt, Leptospira interrogans serovar lai str. 56601
ucgcugauaaauuu

SEQ ID NO: 760369 - RNA, 24 nt, Leptospira interrogans serovar lai str. 56601
ucgcugauaaauuucauaucuaaa

SEQ ID NO: 760370 - RNA, 19 nt, Leptospira interrogans serovar lai str. 56601
ucgcguuuuauaauaaauu

SEQ ID NO: 760371 - RNA, 18 nt, Leptospira interrogans serovar lai str. 56601
ucgccuauuuuuuuaaaa

SEQ ID NO: 760372 - RNA, 22 nt, Leptospira interrogans serovar lai str. 56601
ucgccuauuuuuuuaaaaaauu

SEQ ID NO: 760373 - RNA, 22 nt, Leptospira interrogans serovar lai str. 56601
ucgccuacacuguguucuuuuu

SEQ ID NO: 760374 - RNA, 22 nt, Leptospira interrogans serovar lai str. 56601
ucgccguucugggcuccaaaag

SEQ ID NO: 760375 - RNA, 14 nt, Leptospira interrogans serovar lai str. 56601
ucgccguaaaaaau

SEQ ID NO: 760376 - RNA, 18 nt, Leptospira interrogans serovar lai str. 56601
ugaaguuuccgaaagacu

SEQ ID NO: 760377 - RNA, 22 nt, Leptospira interrogans serovar lai str. 56601
ugaauaagauuuuagaaucaga

SEQ ID NO: 760378 - RNA, 22 nt, Leptospira interrogans serovar lai str. 56601
ugaagguugagcaguaaaaucu

SEQ ID NO: 760379 - RNA, 13 nt, Leptospira interrogans serovar lai str. 56601
ugaaguguaaaac

SEQ ID NO: 760380 - RNA, 21 nt, Leptospira interrogans serovar lai str. 56601
ugaaguuacgcguuuaaauac

SEQ ID NO: 760381 - RNA, 21 nt, Leptospira interrogans serovar lai str. 56601
ugaauacgacagguuuaauug

SEQ ID NO: 760382 - RNA, 20 nt, Leptospira interrogans serovar lai str. 56601
ugaauacgauagauucaauu

SEQ ID NO: 760383 - RNA, 13 nt, Leptospira interrogans serovar lai str. 56601
ugaauauaaaauu

SEQ ID NO: 760384 - RNA, 17 nt, Leptospira interrogans serovar lai str. 56601
ugaauaggauuuuagaa

SEQ ID NO: 760385 - RNA, 20 nt, Leptospira interrogans serovar lai str. 56601
ugaauaggauuuuagaauca

SEQ ID NO: 760386 - RNA, 23 nt, Leptospira interrogans serovar lai str. 56601
ugaauaggcgauuuuacaaagac

SEQ ID NO: 760387 - RNA, 21 nt, Leptospira interrogans serovar lai str. 56601
ugaauauccuucgcauaacaa

SEQ ID NO: 760388 - RNA, 14 nt, Leptospira interrogans serovar lai str. 56601
ugaauauuauucuu

SEQ ID NO: 760389 - RNA, 18 nt, Leptospira interrogans serovar lai str. 56601
ugaauauucacuuuucca

SEQ ID NO: 760390 - RNA, 16 nt, Leptospira interrogans serovar lai str. 56601
ugaagauauuuuccuu

SEQ ID NO: 760391 - RNA, 23 nt, Leptospira interrogans serovar lai str. 56601
ugaagauuagacacuacauguug

SEQ ID NO: 760392 - RNA, 19 nt, Leptospira interrogans serovar lai str. 56601
ugaagccuuccaucaaaua

SEQ ID NO: 760393 - RNA, 20 nt, Leptospira interrogans serovar lai str. 56601
ugaagcgcuugaguugcuuu

SEQ ID NO: 760394 - RNA, 17 nt, Leptospira interrogans serovar lai str. 56601
ugaagcuaugaagaggu

SEQ ID NO: 760395 - RNA, 15 nt, Leptospira interrogans serovar lai str. 56601
ugaaggguaacucag

SEQ ID NO: 760396 - RNA, 14 nt, Leptospira interrogans serovar lai str. 56601
ugaagaaaguuuau

SEQ ID NO: 760397 - RNA, 18 nt, Leptospira interrogans serovar lai str. 56601
ugaacuuugcagacugau

SEQ ID NO: 760398 - RNA, 14 nt, Leptospira interrogans serovar lai str. 56601
ugaacuuuuuuaua

SEQ ID NO: 760399 - RNA, 19 nt, Leptospira interrogans serovar lai str. 56601
ugaacuuuuuuauauagaa

SEQ ID NO: 760400 - RNA, 16 nt, Leptospira interrogans serovar lai str. 56601
ugaacuugucccaaaa

SEQ ID NO: 760401 - RNA, 19 nt, Leptospira interrogans serovar lai str. 56601
ugaacuuguuccaaaacua

SEQ ID NO: 760402 - RNA, 12 nt, Leptospira interrogans serovar lai str. 56601
ugaacuucuuuc

SEQ ID NO: 760403 - RNA, 15 nt, Leptospira interrogans serovar lai str. 56601
ugaaauucaucaaau

SEQ ID NO: 760404 - RNA, 23 nt, Leptospira interrogans serovar lai str. 56601
ugaaauucucuuuugaccaaaag

SEQ ID NO: 760405 - RNA, 12 nt, Leptospira interrogans serovar lai str. 56601
ugaaauuuccac

SEQ ID NO: 760406 - RNA, 16 nt, Leptospira interrogans serovar lai str. 56601
ugaaauuguuuuaaaa

SEQ ID NO: 760407 - RNA, 15 nt, Leptospira interrogans serovar lai str. 56601
ugaaauuuucuuaga

SEQ ID NO: 760408 - RNA, 17 nt, Leptospira interrogans serovar lai str. 56601
ugaaauggaaaauugaa

SEQ ID NO: 760409 - RNA, 17 nt, Leptospira interrogans serovar lai str. 56601
ugaaauauuauaaauuu

SEQ ID NO: 760410 - RNA, 19 nt, Leptospira interrogans serovar lai str. 56601
ugaaauauuauaaauuuaa

SEQ ID NO: 760411 - RNA, 22 nt, Leptospira interrogans serovar lai str. 56601
ugaaauauuauaaauuuaaaaa

SEQ ID NO: 760412 - RNA, 19 nt, Leptospira interrogans serovar lai str. 56601
ugaaauuuuuguacaaaac

SEQ ID NO: 760413 - RNA, 17 nt, Leptospira interrogans serovar lai str. 56601
ugaaauuuuaaaacccg

SEQ ID NO: 760414 - RNA, 20 nt, Leptospira interrogans serovar lai str. 56601
ugaacauuccauaaugaaga

SEQ ID NO: 760415 - RNA, 12 nt, Leptospira interrogans serovar lai str. 56601
ugaacauuuuca

SEQ ID NO: 760416 - RNA, 16 nt, Leptospira interrogans serovar lai str. 56601
ugaacauuuucauaua

SEQ ID NO: 760417 - RNA, 18 nt, Leptospira interrogans serovar lai str. 56601
ugaacauuuuuaaaaauu

SEQ ID NO: 760418 - RNA, 21 nt, Leptospira interrogans serovar lai str. 56601
ugaaauaguauauuaacuuuc

SEQ ID NO: 760419 - RNA, 12 nt, Leptospira interrogans serovar lai str. 56601
ugaaauagaaaa

SEQ ID NO: 760420 - RNA, 19 nt, Leptospira interrogans serovar lai str. 56601
ugaaagucgcgaguaaauc

SEQ ID NO: 760421 - RNA, 22 nt, Leptospira interrogans serovar lai str. 56601
ugaaagucuaacaguaaaacuu

SEQ ID NO: 760422 - RNA, 13 nt, Leptospira interrogans serovar lai str. 56601
ugaaaguaaucuu

SEQ ID NO: 760423 - RNA, 14 nt, Leptospira interrogans serovar lai str. 56601
ugaaaguaaucuuu

SEQ ID NO: 760424 - RNA, 20 nt, Leptospira interrogans serovar lai str. 56601
ugaaaguaaucuuuuuaaaa

SEQ ID NO: 760425 - RNA, 15 nt, Leptospira interrogans serovar lai str. 56601
ugaaaguaaaaaaga

SEQ ID NO: 760426 - RNA, 19 nt, Leptospira interrogans serovar lai str. 56601
ugaaagaagauagauuuau

SEQ ID NO: 760427 - RNA, 15 nt, Leptospira interrogans serovar lai str. 56601
ugaaacuuuccacuu

SEQ ID NO: 760428 - RNA, 18 nt, Leptospira interrogans serovar lai str. 56601
ugaaacuuuccacuuuuc

SEQ ID NO: 760429 - RNA, 17 nt, Leptospira interrogans serovar lai str. 56601
ugaaacuuuuaauaaaa

SEQ ID NO: 760430 - RNA, 18 nt, Leptospira interrogans serovar lai str. 56601
ugaaacuuuuaauaaaac

SEQ ID NO: 760431 - RNA, 16 nt, Leptospira interrogans serovar lai str. 56601
ugaaacuuuucaaaau

SEQ ID NO: 760432 - RNA, 13 nt, Leptospira interrogans serovar lai str. 56601
ucuucgucuaaca

SEQ ID NO: 760433 - RNA, 15 nt, Leptospira interrogans serovar lai str. 56601
ucuucgucucaccaa

SEQ ID NO: 760434 - RNA, 19 nt, Leptospira interrogans serovar lai str. 56601
ucuucgggcuuauuuuuuu

SEQ ID NO: 760435 - RNA, 21 nt, Leptospira interrogans serovar lai str. 56601
ucuucgguaauuguagauucu

SEQ ID NO: 760436 - RNA, 16 nt, Leptospira interrogans serovar lai str. 56601
ucuucggcguugaguu

SEQ ID NO: 760437 - RNA, 16 nt, Leptospira interrogans serovar lai str. 56601
ugaaaccagauuuccg

SEQ ID NO: 760438 - RNA, 24 nt, Leptospira interrogans serovar lai str. 56601
ugaccucuauaauuaauaaaacug

SEQ ID NO: 760439 - RNA, 21 nt, Leptospira interrogans serovar lai str. 56601
ugaccugccuuucuuauuaau

SEQ ID NO: 760440 - RNA, 21 nt, Leptospira interrogans serovar lai str. 56601
ugacacucuaauguacaacau

SEQ ID NO: 760441 - RNA, 20 nt, Leptospira interrogans serovar lai str. 56601
ugacaaagaguuguuuaucu

SEQ ID NO: 760442 - RNA, 20 nt, Leptospira interrogans serovar lai str. 56601
ugacaauaaucuaagacgaa

SEQ ID NO: 760443 - RNA, 15 nt, Leptospira interrogans serovar lai str. 56601
ugacaauuugugaac

SEQ ID NO: 760444 - RNA, 20 nt, Leptospira interrogans serovar lai str. 56601
ugacaauuugugaacuuuua

SEQ ID NO: 760445 - RNA, 21 nt, Leptospira interrogans serovar lai str. 56601
ugaaucuauuguaauaaaucg

SEQ ID NO: 760446 - RNA, 16 nt, Leptospira interrogans serovar lai str. 56601
ugaauccgaauacaaa

SEQ ID NO: 760447 - RNA, 22 nt, Leptospira interrogans serovar lai str. 56601
ugaaucgagcgaaagccgccuu

SEQ ID NO: 760448 - RNA, 17 nt, Leptospira interrogans serovar lai str. 56601
ugaaucgaaucuuuugc

SEQ ID NO: 760449 - RNA, 17 nt, Leptospira interrogans serovar lai str. 56601
ugaauauuuuccaaaaa

SEQ ID NO: 760450 - RNA, 20 nt, Leptospira interrogans serovar lai str. 56601
ugaauauuuuuaaacucauu

SEQ ID NO: 760451 - RNA, 21 nt, Leptospira interrogans serovar lai str. 56601
ugaauauuuuuaaacucauuc

SEQ ID NO: 760452 - RNA, 20 nt, Leptospira interrogans serovar lai str. 56601
ugaauauugagcuaauucuu

SEQ ID NO: 760453 - RNA, 22 nt, Leptospira interrogans serovar lai str. 56601
ugaauauugagcuaauucuuaa

SEQ ID NO: 760454 - RNA, 23 nt, Leptospira interrogans serovar lai str. 56601
ugaaucaaauaaaaggcugcuuu

SEQ ID NO: 760455 - RNA, 16 nt, Leptospira interrogans serovar lai str. 56601
ugaaucagccauuaaa

SEQ ID NO: 760456 - RNA, 15 nt, Leptospira interrogans serovar lai str. 56601
ugaaugccucucuaa

SEQ ID NO: 760457 - RNA, 22 nt, Leptospira interrogans serovar lai str. 56601
ugaaugauaggcuaaucaaauu

SEQ ID NO: 760458 - RNA, 17 nt, Leptospira interrogans serovar lai str. 56601
ugaaucucuuaaucgaa

SEQ ID NO: 760459 - RNA, 14 nt, Leptospira interrogans serovar lai str. 56601
ugaaucucuuacga

SEQ ID NO: 760460 - RNA, 12 nt, Leptospira interrogans serovar lai str. 56601
ugaaucuuaaau

SEQ ID NO: 760461 - RNA, 15 nt, Leptospira interrogans serovar lai str. 56601
ugaaucuuaaaucuu

SEQ ID NO: 760462 - RNA, 12 nt, Leptospira interrogans serovar lai str. 56601
ugaauuucuucg

SEQ ID NO: 760463 - RNA, 16 nt, Leptospira interrogans serovar lai str. 56601
ugaauuugaggagaau

SEQ ID NO: 760464 - RNA, 19 nt, Leptospira interrogans serovar lai str. 56601
ugaauuuguaauucuucaa

SEQ ID NO: 760465 - RNA, 14 nt, Leptospira interrogans serovar lai str. 56601
ugaauuuguuuuuc

SEQ ID NO: 760466 - RNA, 18 nt, Leptospira interrogans serovar lai str. 56601
ugaauuuuaaauuuacua

SEQ ID NO: 760467 - RNA, 22 nt, Leptospira interrogans serovar lai str. 56601
ugaauuuuaagaucuauuccua

SEQ ID NO: 760468 - RNA, 23 nt, Leptospira interrogans serovar lai str. 56601
ugaauuuuauagauugauucuuu

SEQ ID NO: 760469 - RNA, 16 nt, Leptospira interrogans serovar lai str. 56601
ugaauuuuuaaacauu

SEQ ID NO: 760470 - RNA, 14 nt, Leptospira interrogans serovar lai str. 56601
ugaauuuuuauaaa

SEQ ID NO: 760471 - RNA, 15 nt, Leptospira interrogans serovar lai str. 56601
ugaauuuuuauaaaa

SEQ ID NO: 760472 - RNA, 14 nt, Leptospira interrogans serovar lai str. 56601
ugaauuuuuuauua

SEQ ID NO: 760473 - RNA, 13 nt, Leptospira interrogans serovar lai str. 56601
ugaauuuuuuccc

SEQ ID NO: 760474 - RNA, 22 nt, Leptospira interrogans serovar lai str. 56601
ugaauuuuuucugccauuuuua

SEQ ID NO: 760475 - RNA, 23 nt, Leptospira interrogans serovar lai str. 56601
ugaauuuuuucugccauuuuuag

SEQ ID NO: 760476 - RNA, 18 nt, Leptospira interrogans serovar lai str. 56601
ugaauuuauagauauaac

SEQ ID NO: 760477 - RNA, 22 nt, Leptospira interrogans serovar lai str. 56601
ugaauuucagcgcauuuagaag

SEQ ID NO: 760478 - RNA, 13 nt, Leptospira interrogans serovar lai str. 56601
ugaauuuccauua

SEQ ID NO: 760479 - RNA, 20 nt, Leptospira interrogans serovar lai str. 56601
ugaauuuagcauuuuuaaga

SEQ ID NO: 760480 - RNA, 21 nt, Leptospira interrogans serovar lai str. 56601
ugaauuuaggaaauuuucaau

SEQ ID NO: 760481 - RNA, 22 nt, Leptospira interrogans serovar lai str. 56601
ugaauuuaggaaauuuucaaua

SEQ ID NO: 760482 - RNA, 15 nt, Leptospira interrogans serovar lai str. 56601
ugaauugcucaaaga

SEQ ID NO: 760483 - RNA, 17 nt, Leptospira interrogans serovar lai str. 56601
ugaauuguagaauuuau

SEQ ID NO: 760484 - RNA, 14 nt, Leptospira interrogans serovar lai str. 56601
ugaauuuaaaacuu

SEQ ID NO: 760485 - RNA, 21 nt, Leptospira interrogans serovar lai str. 56601
ugaauuuaaaacuugucccaa

SEQ ID NO: 760486 - RNA, 16 nt, Leptospira interrogans serovar lai str. 56601
ugaauuguaaaaaacc

SEQ ID NO: 760487 - RNA, 20 nt, Leptospira interrogans serovar lai str. 56601
ugaauugaaauggaaaauug

SEQ ID NO: 760488 - RNA, 13 nt, Leptospira interrogans serovar lai str. 56601
ugaauuccuuaua

SEQ ID NO: 760489 - RNA, 20 nt, Leptospira interrogans serovar lai str. 56601
ugaauucucuagaaauuuau

SEQ ID NO: 760490 - RNA, 22 nt, Leptospira interrogans serovar lai str. 56601
ugaauucucuagaaauuuauaa

SEQ ID NO: 760491 - RNA, 21 nt, Leptospira interrogans serovar lai str. 56601
ugaauucucuaucuuguuucu

SEQ ID NO: 760492 - RNA, 16 nt, Leptospira interrogans serovar lai str. 56601
ugaauuaauuuguaau

SEQ ID NO: 760493 - RNA, 14 nt, Leptospira interrogans serovar lai str. 56601
ugaauuacaauuga

SEQ ID NO: 760494 - RNA, 15 nt, Leptospira interrogans serovar lai str. 56601
ugaauucagaaaaaa

SEQ ID NO: 760495 - RNA, 13 nt, Leptospira interrogans serovar lai str. 56601
ugaauuaaaagaa

SEQ ID NO: 760496 - RNA, 22 nt, Leptospira interrogans serovar lai str. 56601
ugaauuaaaaaacuuuuuaaaa

SEQ ID NO: 760497 - RNA, 23 nt, Leptospira interrogans serovar lai str. 56601
ugaauuaaaaaacuuuuuaaaac

SEQ ID NO: 760498 - RNA, 14 nt, Leptospira interrogans serovar lai str. 56601
ugaauuaaagaaga

SEQ ID NO: 760499 - RNA, 23 nt, Leptospira interrogans serovar lai str. 56601
ugaauuaagcagaagcuuuauua

SEQ ID NO: 760500 - RNA, 23 nt, Leptospira interrogans serovar lai str. 56601
ugaaugugacggcaaugugcaaa

SEQ ID NO: 760501 - RNA, 15 nt, Leptospira interrogans serovar lai str. 56601
ugaauguuuaaaauu

SEQ ID NO: 760502 - RNA, 20 nt, Leptospira interrogans serovar lai str. 56601
ugaauguuuaaaauuuauua

SEQ ID NO: 760503 - RNA, 12 nt, Leptospira interrogans serovar lai str. 56601
ugaauuaaaaaa

SEQ ID NO: 760504 - RNA, 21 nt, Leptospira interrogans serovar lai str. 56601
ugauguaggaacuacagcaaa

SEQ ID NO: 760505 - RNA, 20 nt, Leptospira interrogans serovar lai str. 56601
ugaugucacagacuucuuuu

SEQ ID NO: 760506 - RNA, 23 nt, Leptospira interrogans serovar lai str. 56601
ugaugucacagacuucuuuuggc

SEQ ID NO: 760507 - RNA, 18 nt, Leptospira interrogans serovar lai str. 56601
ugauuaaaccgguaaaaa

SEQ ID NO: 760508 - RNA, 14 nt, Leptospira interrogans serovar lai str. 56601
ugauuacaaagcac

SEQ ID NO: 760509 - RNA, 18 nt, Leptospira interrogans serovar lai str. 56601
ugauuagaguuaaauuga

SEQ ID NO: 760510 - RNA, 13 nt, Leptospira interrogans serovar lai str. 56601
ugauuagaaaaaa

SEQ ID NO: 760511 - RNA, 23 nt, Leptospira interrogans serovar lai str. 56601
ugauuagaaaaaaaguauauauu

SEQ ID NO: 760512 - RNA, 19 nt, Leptospira interrogans serovar lai str. 56601
ugauucuaacuuuugcaau

SEQ ID NO: 760513 - RNA, 23 nt, Leptospira interrogans serovar lai str. 56601
ugauucuauauauugaaauauua

SEQ ID NO: 760514 - RNA, 11 nt, Leptospira interrogans serovar lai str. 56601
ugauucaaaaa

SEQ ID NO: 760515 - RNA, 16 nt, Leptospira interrogans serovar lai str. 56601
ugauuauuauuuugau

SEQ ID NO: 760516 - RNA, 15 nt, Leptospira interrogans serovar lai str. 56601
ugauuucaugcaaaa

SEQ ID NO: 760517 - RNA, 17 nt, Leptospira interrogans serovar lai str. 56601
ugauuucacgaacacaa

SEQ ID NO: 760518 - RNA, 16 nt, Leptospira interrogans serovar lai str. 56601
ugauuuaguaaaauuu

SEQ ID NO: 760519 - RNA, 22 nt, Leptospira interrogans serovar lai str. 56601
ugauucuuuaaauguagaaacu

SEQ ID NO: 760520 - RNA, 16 nt, Leptospira interrogans serovar lai str. 56601
ugauucuuuaaaugug

SEQ ID NO: 760521 - RNA, 18 nt, Leptospira interrogans serovar lai str. 56601
ugauucuuuaaauguggg

SEQ ID NO: 760522 - RNA, 12 nt, Leptospira interrogans serovar lai str. 56601
ugauucugaaaa

SEQ ID NO: 760523 - RNA, 14 nt, Leptospira interrogans serovar lai str. 56601
ugauucugaaaaaa

SEQ ID NO: 760524 - RNA, 16 nt, Leptospira interrogans serovar lai str. 56601
ugauucugaaaaaagu

SEQ ID NO: 760525 - RNA, 17 nt, Leptospira interrogans serovar lai str. 56601
ugauucugaaaaaaguu

SEQ ID NO: 760526 - RNA, 14 nt, Leptospira interrogans serovar lai str. 56601
ugauucugcauaua

SEQ ID NO: 760527 - RNA, 15 nt, Leptospira interrogans serovar lai str. 56601
ugauugcuuuuugag

SEQ ID NO: 760528 - RNA, 16 nt, Leptospira interrogans serovar lai str. 56601
ugaucucgggaaaaaa

SEQ ID NO: 760529 - RNA, 16 nt, Leptospira interrogans serovar lai str. 56601
ugaucucuauaaaauc

SEQ ID NO: 760530 - RNA, 18 nt, Leptospira interrogans serovar lai str. 56601
ugaucucuauaaaaucaa

SEQ ID NO: 760531 - RNA, 14 nt, Leptospira interrogans serovar lai str. 56601
ugaucuuguauaag

SEQ ID NO: 760532 - RNA, 16 nt, Leptospira interrogans serovar lai str. 56601
ugaucuuuaaaagagc

SEQ ID NO: 760533 - RNA, 20 nt, Leptospira interrogans serovar lai str. 56601
ugaucuuuuugauaaaauau

SEQ ID NO: 760534 - RNA, 13 nt, Leptospira interrogans serovar lai str. 56601
ugaugaagagaaa

SEQ ID NO: 760535 - RNA, 12 nt, Leptospira interrogans serovar lai str. 56601
ugauauucaaau

SEQ ID NO: 760536 - RNA, 23 nt, Leptospira interrogans serovar lai str. 56601
ugauauucaaauuuacucuuaua

SEQ ID NO: 760537 - RNA, 16 nt, Leptospira interrogans serovar lai str. 56601
ugauauuucauucuua

SEQ ID NO: 760538 - RNA, 16 nt, Leptospira interrogans serovar lai str. 56601
ugauauuuuaaauuga

SEQ ID NO: 760539 - RNA, 19 nt, Leptospira interrogans serovar lai str. 56601
ugauauuucuuaaauucua

SEQ ID NO: 760540 - RNA, 18 nt, Leptospira interrogans serovar lai str. 56601
ugauauugcugucauaaa

SEQ ID NO: 760541 - RNA, 23 nt, Leptospira interrogans serovar lai str. 56601
ugauauugcugucauaaaccgau

SEQ ID NO: 760542 - RNA, 13 nt, Leptospira interrogans serovar lai str. 56601
ugauauuuggauc

SEQ ID NO: 760543 - RNA, 17 nt, Leptospira interrogans serovar lai str. 56601
ugaucucaauauaaacu

SEQ ID NO: 760544 - RNA, 20 nt, Leptospira interrogans serovar lai str. 56601
ugaucgucaaucaauugacu

SEQ ID NO: 760545 - RNA, 13 nt, Leptospira interrogans serovar lai str. 56601
ugaucguaacuuu

SEQ ID NO: 760546 - RNA, 16 nt, Leptospira interrogans serovar lai str. 56601
ugaucgguuuaaaacu

SEQ ID NO: 760547 - RNA, 16 nt, Leptospira interrogans serovar lai str. 56601
ugaucagacugauauu

SEQ ID NO: 760548 - RNA, 14 nt, Leptospira interrogans serovar lai str. 56601
ugauccaacaaauu

SEQ ID NO: 760549 - RNA, 17 nt, Leptospira interrogans serovar lai str. 56601
ugauccaacaaauugaa

SEQ ID NO: 760550 - RNA, 19 nt, Leptospira interrogans serovar lai str. 56601
ugaguuucuccacuuaaaa

SEQ ID NO: 760551 - RNA, 12 nt, Leptospira interrogans serovar lai str. 56601
ugaguuucaaac

SEQ ID NO: 760552 - RNA, 19 nt, Leptospira interrogans serovar lai str. 56601
ugaguuucacaaaaugcug

SEQ ID NO: 760553 - RNA, 12 nt, Leptospira interrogans serovar lai str. 56601
ugaguucuuuua

SEQ ID NO: 760554 - RNA, 17 nt, Leptospira interrogans serovar lai str. 56601
ugaguugcuuugaauga

SEQ ID NO: 760555 - RNA, 11 nt, Leptospira interrogans serovar lai str. 56601
ugaguuugaga

SEQ ID NO: 760556 - RNA, 16 nt, Leptospira interrogans serovar lai str. 56601
ugaguuuuaaaacuca

SEQ ID NO: 760557 - RNA, 17 nt, Leptospira interrogans serovar lai str. 56601
ugaguuuuaaaacucac

SEQ ID NO: 760558 - RNA, 18 nt, Leptospira interrogans serovar lai str. 56601
ugaguuuuaaaacucaca

SEQ ID NO: 760559 - RNA, 17 nt, Leptospira interrogans serovar lai str. 56601
ugagucaacaaauauuc

SEQ ID NO: 760560 - RNA, 14 nt, Leptospira interrogans serovar lai str. 56601
ugagucaagauuau

SEQ ID NO: 760561 - RNA, 21 nt, Leptospira interrogans serovar lai str. 56601
ugauaauuauccuuaaaauga

SEQ ID NO: 760562 - RNA, 13 nt, Leptospira interrogans serovar lai str. 56601
ugauaauucuuua

SEQ ID NO: 760563 - RNA, 20 nt, Leptospira interrogans serovar lai str. 56601
ugauaauuugugaacuuuug

SEQ ID NO: 760564 - RNA, 19 nt, Leptospira interrogans serovar lai str. 56601
ugauaauuuguuuguuaua

SEQ ID NO: 760565 - RNA, 22 nt, Leptospira interrogans serovar lai str. 56601
ugauacaauguuccuguggaaa

SEQ ID NO: 760566 - RNA, 20 nt, Leptospira interrogans serovar lai str. 56601
ugauaauuucauuauuagag

SEQ ID NO: 760567 - RNA, 17 nt, Leptospira interrogans serovar lai str. 56601
ugauaacuauauaacaa

SEQ ID NO: 760568 - RNA, 19 nt, Leptospira interrogans serovar lai str. 56601
ugagcuuuuuuagaaaaag

SEQ ID NO: 760569 - RNA, 15 nt, Leptospira interrogans serovar lai str. 56601
ugaguagaaaguuau

SEQ ID NO: 760570 - RNA, 12 nt, Leptospira interrogans serovar lai str. 56601
ugaguagaagcc

SEQ ID NO: 760571 - RNA, 21 nt, Leptospira interrogans serovar lai str. 56601
ugaguaacgaaagaagacuau

SEQ ID NO: 760572 - RNA, 13 nt, Leptospira interrogans serovar lai str. 56601
ugagcauuuuuuu

SEQ ID NO: 760573 - RNA, 17 nt, Leptospira interrogans serovar lai str. 56601
ugagcauuuuuuuaaua

SEQ ID NO: 760574 - RNA, 21 nt, Leptospira interrogans serovar lai str. 56601
ugagcaguaaaaucuuuaagu

SEQ ID NO: 760575 - RNA, 15 nt, Leptospira interrogans serovar lai str. 56601
ugagccaucuuuuuu

SEQ ID NO: 760576 - RNA, 18 nt, Leptospira interrogans serovar lai str. 56601
ugagcacagcaaaaaauu

SEQ ID NO: 760577 - RNA, 15 nt, Leptospira interrogans serovar lai str. 56601
ugagauuaaaaagaa

SEQ ID NO: 760578 - RNA, 15 nt, Leptospira interrogans serovar lai str. 56601
ugagauuaaaacugc

SEQ ID NO: 760579 - RNA, 15 nt, Leptospira interrogans serovar lai str. 56601
ugagcagauucuaaa

SEQ ID NO: 760580 - RNA, 15 nt, Leptospira interrogans serovar lai str. 56601
ugagaauuucugcaa

SEQ ID NO: 760581 - RNA, 23 nt, Leptospira interrogans serovar lai str. 56601
ugagaauuuguuuuaaaauuuau

SEQ ID NO: 760582 - RNA, 21 nt, Leptospira interrogans serovar lai str. 56601
ugagaauauaagaaaguauua

SEQ ID NO: 760583 - RNA, 23 nt, Leptospira interrogans serovar lai str. 56601
ugagaaagaacaagauuaacaau

SEQ ID NO: 760584 - RNA, 16 nt, Leptospira interrogans serovar lai str. 56601
ugagaauauuuguaau

SEQ ID NO: 760585 - RNA, 17 nt, Leptospira interrogans serovar lai str. 56601
ugacuuucccacuuaua

SEQ ID NO: 760586 - RNA, 12 nt, Leptospira interrogans serovar lai str. 56601
ugagaaaaucca

SEQ ID NO: 760587 - RNA, 17 nt, Leptospira interrogans serovar lai str. 56601
ugacuuuaauuuuagua

SEQ ID NO: 760588 - RNA, 20 nt, Leptospira interrogans serovar lai str. 56601
ugacuugcauuuaauauauu

SEQ ID NO: 760589 - RNA, 19 nt, Leptospira interrogans serovar lai str. 56601
aaauggauggaaaaugaau

SEQ ID NO: 760590 - RNA, 18 nt, Leptospira interrogans serovar lai str. 56601
ugcgauuauuaucaaaau

SEQ ID NO: 760591 - RNA, 16 nt, Leptospira interrogans serovar lai str. 56601
ugccuacaaaucaaau

SEQ ID NO: 760592 - RNA, 18 nt, Leptospira interrogans serovar lai str. 56601
ugccuacaaaucaaaucg

SEQ ID NO: 760593 - RNA, 13 nt, Leptospira interrogans serovar lai str. 56601
ugccguugauagu

SEQ ID NO: 760594 - RNA, 15 nt, Leptospira interrogans serovar lai str. 56601
ugccguuuuucuaau

SEQ ID NO: 760595 - RNA, 21 nt, Leptospira interrogans serovar lai str. 56601
ugccgcaacucgaauuguauc

SEQ ID NO: 760596 - RNA, 17 nt, Leptospira interrogans serovar lai str. 56601
ugccccuccguuuacaa

SEQ ID NO: 760597 - RNA, 18 nt, Leptospira interrogans serovar lai str. 56601
ugccccuccguuuacaaa

SEQ ID NO: 760598 - RNA, 15 nt, Leptospira interrogans serovar lai str. 56601
ugccccaaaauuuag

SEQ ID NO: 760599 - RNA, 17 nt, Leptospira interrogans serovar lai str. 56601
ugccauuuuucuucuuu

SEQ ID NO: 760600 - RNA, 22 nt, Leptospira interrogans serovar lai str. 56601
ugccaaaacuaccucaauuuuc

SEQ ID NO: 760601 - RNA, 20 nt, Leptospira interrogans serovar lai str. 56601
ugccaaaagaacuuugagau

SEQ ID NO: 760602 - RNA, 22 nt, Leptospira interrogans serovar lai str. 56601
ugcaucaaagaaacguuauaca

SEQ ID NO: 760603 - RNA, 16 nt, Leptospira interrogans serovar lai str. 56601
ugcaucuuuucuaagg

SEQ ID NO: 760604 - RNA, 20 nt, Leptospira interrogans serovar lai str. 56601
ugcaugaauuuguuuuucuu

SEQ ID NO: 760605 - RNA, 24 nt, Leptospira interrogans serovar lai str. 56601
ugcauccgucucagcaagucuauu

SEQ ID NO: 760606 - RNA, 19 nt, Leptospira interrogans serovar lai str. 56601
ugcaucccagaacaaaacg

SEQ ID NO: 760607 - RNA, 18 nt, Leptospira interrogans serovar lai str. 56601
ugcagaaguauuccauau

SEQ ID NO: 760608 - RNA, 18 nt, Leptospira interrogans serovar lai str. 56601
ugcagcuucuuccaaagu

SEQ ID NO: 760609 - RNA, 14 nt, Leptospira interrogans serovar lai str. 56601
ugcaggaaacauaa

SEQ ID NO: 760610 - RNA, 19 nt, Leptospira interrogans serovar lai str. 56601
ugauuugagaaucuucauu

SEQ ID NO: 760611 - RNA, 22 nt, Leptospira interrogans serovar lai str. 56601
ugauuucuugaucgacuguaau

SEQ ID NO: 760612 - RNA, 13 nt, Leptospira interrogans serovar lai str. 56601
ugauuuguuucuu

SEQ ID NO: 760613 - RNA, 14 nt, Leptospira interrogans serovar lai str. 56601
ugauuuguuucuuu

SEQ ID NO: 760614 - RNA, 17 nt, Leptospira interrogans serovar lai str. 56601
ugauuuguuucuuuauc

SEQ ID NO: 760615 - RNA, 22 nt, Leptospira interrogans serovar lai str. 56601
ugauuugugcaaaaauuuuuua

SEQ ID NO: 760616 - RNA, 19 nt, Leptospira interrogans serovar lai str. 56601
ugauuuguaauaguuccca

SEQ ID NO: 760617 - RNA, 23 nt, Leptospira interrogans serovar lai str. 56601
ugauuuguaauaguucccacagu

SEQ ID NO: 760618 - RNA, 19 nt, Leptospira interrogans serovar lai str. 56601
uguuggugaguccuuccgu

SEQ ID NO: 760619 - RNA, 17 nt, Leptospira interrogans serovar lai str. 56601
uguuguaccauuuugau

SEQ ID NO: 760620 - RNA, 16 nt, Leptospira interrogans serovar lai str. 56601
uguuuaccuuuugaau

SEQ ID NO: 760621 - RNA, 17 nt, Leptospira interrogans serovar lai str. 56601
uguuuacuugaaaauaa

SEQ ID NO: 760622 - RNA, 22 nt, Leptospira interrogans serovar lai str. 56601
uguuuacuugaaaauaaaaauc

SEQ ID NO: 760623 - RNA, 16 nt, Leptospira interrogans serovar lai str. 56601
uguuuaagguugaggu

SEQ ID NO: 760624 - RNA, 21 nt, Leptospira interrogans serovar lai str. 56601
uguuuagaacagaaugucuua

SEQ ID NO: 760625 - RNA, 15 nt, Leptospira interrogans serovar lai str. 56601
uguuuagaauauuuu

SEQ ID NO: 760626 - RNA, 18 nt, Leptospira interrogans serovar lai str. 56601
uguuuagaguauuauaaa

SEQ ID NO: 760627 - RNA, 17 nt, Leptospira interrogans serovar lai str. 56601
uguuuaggaauuuuuua

SEQ ID NO: 760628 - RNA, 20 nt, Leptospira interrogans serovar lai str. 56601
uguuuaggaauuuuuuaaac

SEQ ID NO: 760629 - RNA, 12 nt, Leptospira interrogans serovar lai str. 56601
uguuuauaaaaa

SEQ ID NO: 760630 - RNA, 14 nt, Leptospira interrogans serovar lai str. 56601
uguuuauaaaacug

SEQ ID NO: 760631 - RNA, 16 nt, Leptospira interrogans serovar lai str. 56601
uguuuaauaaagauuc

SEQ ID NO: 760632 - RNA, 21 nt, Leptospira interrogans serovar lai str. 56601
uguugaacauuccauaaugaa

SEQ ID NO: 760633 - RNA, 20 nt, Leptospira interrogans serovar lai str. 56601
uguugagcgacccuagaagc

SEQ ID NO: 760634 - RNA, 14 nt, Leptospira interrogans serovar lai str. 56601
uguugaguuucuuu

SEQ ID NO: 760635 - RNA, 16 nt, Leptospira interrogans serovar lai str. 56601
uguugaaaaauuucau

SEQ ID NO: 760636 - RNA, 14 nt, Leptospira interrogans serovar lai str. 56601
uguucuuaaaauug

SEQ ID NO: 760637 - RNA, 23 nt, Leptospira interrogans serovar lai str. 56601
uguucguauccuugggauaaaua

SEQ ID NO: 760638 - RNA, 22 nt, Leptospira interrogans serovar lai str. 56601
uguucuacggcuuguauuuuau

SEQ ID NO: 760639 - RNA, 20 nt, Leptospira interrogans serovar lai str. 56601
uguucgucguuuagaggaag

SEQ ID NO: 760640 - RNA, 16 nt, Leptospira interrogans serovar lai str. 56601
uguucuaaaaacucaa

SEQ ID NO: 760641 - RNA, 18 nt, Leptospira interrogans serovar lai str. 56601
uguucuaaaaacucaaaa

SEQ ID NO: 760642 - RNA, 20 nt, Leptospira interrogans serovar lai str. 56601
uguuccgaaaggaaaagaaa

SEQ ID NO: 760643 - RNA, 18 nt, Leptospira interrogans serovar lai str. 56601
uguuccgaauuaaaaauu

SEQ ID NO: 760644 - RNA, 20 nt, Leptospira interrogans serovar lai str. 56601
uguuccgacaagaaugaguc

SEQ ID NO: 760645 - RNA, 15 nt, Leptospira interrogans serovar lai str. 56601
uguuccaaaaacuca

SEQ ID NO: 760646 - RNA, 18 nt, Leptospira interrogans serovar lai str. 56601
uguuccaaaaccucaaaa

SEQ ID NO: 760647 - RNA, 23 nt, Leptospira interrogans serovar lai str. 56601
uguuccaaaaccucaaaaaauuu

SEQ ID NO: 760648 - RNA, 17 nt, Leptospira interrogans serovar lai str. 56601
uguucauucuuuaaaau

SEQ ID NO: 760649 - RNA, 18 nt, Leptospira interrogans serovar lai str. 56601
uguuccaaaguuauugaa

SEQ ID NO: 760650 - RNA, 22 nt, Leptospira interrogans serovar lai str. 56601
uguuccaagaccucaaauaacu

SEQ ID NO: 760651 - RNA, 17 nt, Leptospira interrogans serovar lai str. 56601
uguuauggaauuuuuca

SEQ ID NO: 760652 - RNA, 19 nt, Leptospira interrogans serovar lai str. 56601
uguuaucgcuaauacaaaa

SEQ ID NO: 760653 - RNA, 17 nt, Leptospira interrogans serovar lai str. 56601
uguuauauauuuuuaau

SEQ ID NO: 760654 - RNA, 15 nt, Leptospira interrogans serovar lai str. 56601
uguuauaucgaauuc

SEQ ID NO: 760655 - RNA, 21 nt, Leptospira interrogans serovar lai str. 56601
uguuauucagagcuauaacac

SEQ ID NO: 760656 - RNA, 20 nt, Leptospira interrogans serovar lai str. 56601
uguuagauucuauuuucuuu

SEQ ID NO: 760657 - RNA, 23 nt, Leptospira interrogans serovar lai str. 56601
uguuaggcaauauuauuuuaacu

SEQ ID NO: 760658 - RNA, 15 nt, Leptospira interrogans serovar lai str. 56601
uguuauaaacuucua

SEQ ID NO: 760659 - RNA, 14 nt, Leptospira interrogans serovar lai str. 56601
uguuauagaugaaa

SEQ ID NO: 760660 - RNA, 12 nt, Leptospira interrogans serovar lai str. 56601
uguucaaagaaa

SEQ ID NO: 760661 - RNA, 14 nt, Leptospira interrogans serovar lai str. 56601
uguucaaagaaaug

SEQ ID NO: 760662 - RNA, 16 nt, Leptospira interrogans serovar lai str. 56601
uguuauuuuugcacaa

SEQ ID NO: 760663 - RNA, 12 nt, Leptospira interrogans serovar lai str. 56601
uguucauaaaaa

SEQ ID NO: 760664 - RNA, 14 nt, Leptospira interrogans serovar lai str. 56601
uuaaaaccaaaaug

SEQ ID NO: 760665 - RNA, 15 nt, Leptospira interrogans serovar lai str. 56601
uuaaaaauuuauaaa

SEQ ID NO: 760666 - RNA, 16 nt, Leptospira interrogans serovar lai str. 56601
uuaaaaauuuccuuuu

SEQ ID NO: 760667 - RNA, 18 nt, Leptospira interrogans serovar lai str. 56601
uuaaaaauuuuauuaaau

SEQ ID NO: 760668 - RNA, 21 nt, Leptospira interrogans serovar lai str. 56601
uuaaaacucaacguuaguaac

SEQ ID NO: 760669 - RNA, 19 nt, Leptospira interrogans serovar lai str. 56601
uuaaaacgaauugauaaaa

SEQ ID NO: 760670 - RNA, 19 nt, Leptospira interrogans serovar lai str. 56601
uuaaaacuuuuaauuuaga

SEQ ID NO: 760671 - RNA, 21 nt, Leptospira interrogans serovar lai str. 56601
uuaaaaguagaaucaucucaa

SEQ ID NO: 760672 - RNA, 16 nt, Leptospira interrogans serovar lai str. 56601
uuaaaagccagaauuu

SEQ ID NO: 760673 - RNA, 22 nt, Leptospira interrogans serovar lai str. 56601
uuaaaagccauuucaaaaauau

SEQ ID NO: 760674 - RNA, 18 nt, Leptospira interrogans serovar lai str. 56601
uuaaaagugauuuaaguu

SEQ ID NO: 760675 - RNA, 17 nt, Leptospira interrogans serovar lai str. 56601
uuaaaauccucaacaga

SEQ ID NO: 760676 - RNA, 15 nt, Leptospira interrogans serovar lai str. 56601
uuaaaaucacaaaaa

SEQ ID NO: 760677 - RNA, 16 nt, Leptospira interrogans serovar lai str. 56601
uuaaaaucacaaaaaa

SEQ ID NO: 760678 - RNA, 23 nt, Leptospira interrogans serovar lai str. 56601
uuaaaaaauuaauucuccaucua

SEQ ID NO: 760679 - RNA, 17 nt, Leptospira interrogans serovar lai str. 56601
uuaaaaaauuucuuaaa

SEQ ID NO: 760680 - RNA, 10 nt, Leptospira interrogans serovar lai str. 56601
uuaaaaacaa

SEQ ID NO: 760681 - RNA, 17 nt, Leptospira interrogans serovar lai str. 56601
uuaaaaaagagaaagaa

SEQ ID NO: 760682 - RNA, 15 nt, Leptospira interrogans serovar lai str. 56601
uuaaaaaacuauaaa

SEQ ID NO: 760683 - RNA, 21 nt, Leptospira interrogans serovar lai str. 56601
uuaaaaaauucaauucaucug

SEQ ID NO: 760684 - RNA, 19 nt, Leptospira interrogans serovar lai str. 56601
uuaaaaaguuuuucuaaau

SEQ ID NO: 760685 - RNA, 11 nt, Leptospira interrogans serovar lai str. 56601
uuaaaaaguag

SEQ ID NO: 760686 - RNA, 17 nt, Leptospira interrogans serovar lai str. 56601
uuaaaaauauaaaucaa

SEQ ID NO: 760687 - RNA, 17 nt, Leptospira interrogans serovar lai str. 56601
uguuuuuucuuuaaaau

SEQ ID NO: 760688 - RNA, 22 nt, Leptospira interrogans serovar lai str. 56601
uguuuuuuugcagaaguauucc

SEQ ID NO: 760689 - RNA, 12 nt, Leptospira interrogans serovar lai str. 56601
uuaaaaaaauaa

SEQ ID NO: 760690 - RNA, 12 nt, Leptospira interrogans serovar lai str. 56601
uuaaaaaacuuu

SEQ ID NO: 760691 - RNA, 16 nt, Leptospira interrogans serovar lai str. 56601
uuaaaaaacuuuuuaa

SEQ ID NO: 760692 - RNA, 18 nt, Leptospira interrogans serovar lai str. 56601
uuaaacgaucagaaaaac

SEQ ID NO: 760693 - RNA, 18 nt, Leptospira interrogans serovar lai str. 56601
uuaaaccgguaaaaagua

SEQ ID NO: 760694 - RNA, 19 nt, Leptospira interrogans serovar lai str. 56601
uuaaaccgguaaaaaguaa

SEQ ID NO: 760695 - RNA, 22 nt, Leptospira interrogans serovar lai str. 56601
uuaaaccgguaaaaaguaaaac

SEQ ID NO: 760696 - RNA, 14 nt, Leptospira interrogans serovar lai str. 56601
uuaaaccaguuugu

SEQ ID NO: 760697 - RNA, 20 nt, Leptospira interrogans serovar lai str. 56601
uuaaaauuuacggaacuuaa

SEQ ID NO: 760698 - RNA, 16 nt, Leptospira interrogans serovar lai str. 56601
uuaaacaaagaauaaa

SEQ ID NO: 760699 - RNA, 13 nt, Leptospira interrogans serovar lai str. 56601
uuaaacaaagaca

SEQ ID NO: 760700 - RNA, 19 nt, Leptospira interrogans serovar lai str. 56601
uuaaacaacaguacaagaa

SEQ ID NO: 760701 - RNA, 18 nt, Leptospira interrogans serovar lai str. 56601
uuaaaauucuagaaagaa

SEQ ID NO: 760702 - RNA, 15 nt, Leptospira interrogans serovar lai str. 56601
uuaaaauugcagaau

SEQ ID NO: 760703 - RNA, 14 nt, Leptospira interrogans serovar lai str. 56601
uuaaaauuugaaaa

SEQ ID NO: 760704 - RNA, 21 nt, Leptospira interrogans serovar lai str. 56601
uuaaaauuugugauaucucau

SEQ ID NO: 760705 - RNA, 16 nt, Leptospira interrogans serovar lai str. 56601
uuaaaauuuuuaauaa

SEQ ID NO: 760706 - RNA, 21 nt, Leptospira interrogans serovar lai str. 56601
uuaaaauuaaugaggagaaaa

SEQ ID NO: 760707 - RNA, 23 nt, Leptospira interrogans serovar lai str. 56601
uuaaaauuaaugaggagaaaaaa

SEQ ID NO: 760708 - RNA, 18 nt, Leptospira interrogans serovar lai str. 56601
uuaaaaugaaaauuauaa

SEQ ID NO: 760709 - RNA, 21 nt, Leptospira interrogans serovar lai str. 56601
uuaaaauguacaauuaaagua

SEQ ID NO: 760710 - RNA, 14 nt, Leptospira interrogans serovar lai str. 56601
uuaaaauguaggaa

SEQ ID NO: 760711 - RNA, 22 nt, Leptospira interrogans serovar lai str. 56601
uuaaaaucagggccggagaaaa

SEQ ID NO: 760712 - RNA, 19 nt, Leptospira interrogans serovar lai str. 56601
uuaaacguuuauuucaaaa

SEQ ID NO: 760713 - RNA, 15 nt, Leptospira interrogans serovar lai str. 56601
uuaaacguauaaaaa

SEQ ID NO: 760714 - RNA, 17 nt, Leptospira interrogans serovar lai str. 56601
uuaaacguauaaaaaca

SEQ ID NO: 760715 - RNA, 14 nt, Leptospira interrogans serovar lai str. 56601
uuaaacuauagaga

SEQ ID NO: 760716 - RNA, 22 nt, Leptospira interrogans serovar lai str. 56601
uuaaacuauagagaaauccaau

SEQ ID NO: 760717 - RNA, 22 nt, Leptospira interrogans serovar lai str. 56601
uuaaacuuagauucgaguccuu

SEQ ID NO: 760718 - RNA, 16 nt, Leptospira interrogans serovar lai str. 56601
uuaaacuuauauugau

SEQ ID NO: 760719 - RNA, 15 nt, Leptospira interrogans serovar lai str. 56601
uuaaacuucaaaaaa

SEQ ID NO: 760720 - RNA, 17 nt, Leptospira interrogans serovar lai str. 56601
uuaaacuucaaaaaaua

SEQ ID NO: 760721 - RNA, 20 nt, Leptospira interrogans serovar lai str. 56601
uuaaacuucaaaaaauauag

SEQ ID NO: 760722 - RNA, 20 nt, Leptospira interrogans serovar lai str. 56601
uuaaagaagagccucaagua

SEQ ID NO: 760723 - RNA, 22 nt, Leptospira interrogans serovar lai str. 56601
uuaaagaaugaucaacuacuaa

SEQ ID NO: 760724 - RNA, 16 nt, Leptospira interrogans serovar lai str. 56601
uuaaacuuuuauaaaa

SEQ ID NO: 760725 - RNA, 12 nt, Leptospira interrogans serovar lai str. 56601
uuaaagaaacuc

SEQ ID NO: 760726 - RNA, 16 nt, Leptospira interrogans serovar lai str. 56601
uuaaagaaacucauaa

SEQ ID NO: 760727 - RNA, 14 nt, Leptospira interrogans serovar lai str. 56601
uguuucuauuuuau

SEQ ID NO: 760728 - RNA, 13 nt, Leptospira interrogans serovar lai str. 56601
uguuucuuguguc

SEQ ID NO: 760729 - RNA, 16 nt, Leptospira interrogans serovar lai str. 56601
uguuugaaaaaaugua

SEQ ID NO: 760730 - RNA, 18 nt, Leptospira interrogans serovar lai str. 56601
uguuugaaaguucccaaa

SEQ ID NO: 760731 - RNA, 19 nt, Leptospira interrogans serovar lai str. 56601
uguuucuuuuguaaaacga

SEQ ID NO: 760732 - RNA, 15 nt, Leptospira interrogans serovar lai str. 56601
uguuugaauccaaaa

SEQ ID NO: 760733 - RNA, 17 nt, Leptospira interrogans serovar lai str. 56601
uguuugaauuuuuaaga

SEQ ID NO: 760734 - RNA, 19 nt, Leptospira interrogans serovar lai str. 56601
uguuugagguuuuaaaagu

SEQ ID NO: 760735 - RNA, 20 nt, Leptospira interrogans serovar lai str. 56601
uguuugagguuuuaaaagug

SEQ ID NO: 760736 - RNA, 20 nt, Leptospira interrogans serovar lai str. 56601
uguuugauaauuugugaacu

SEQ ID NO: 760737 - RNA, 13 nt, Leptospira interrogans serovar lai str. 56601
uguuuauuuugaa

SEQ ID NO: 760738 - RNA, 14 nt, Leptospira interrogans serovar lai str. 56601
uguuucaaaaguua

SEQ ID NO: 760739 - RNA, 14 nt, Leptospira interrogans serovar lai str. 56601
uguuuccucuugaa

SEQ ID NO: 760740 - RNA, 14 nt, Leptospira interrogans serovar lai str. 56601
uguuucauaaaauu

SEQ ID NO: 760741 - RNA, 22 nt, Leptospira interrogans serovar lai str. 56601
uguuucauguccggguuagaau

SEQ ID NO: 760742 - RNA, 12 nt, Leptospira interrogans serovar lai str. 56601
uguuuuuuauuu

SEQ ID NO: 760743 - RNA, 23 nt, Leptospira interrogans serovar lai str. 56601
uguuuuugaaacauuucuaaaau

SEQ ID NO: 760744 - RNA, 14 nt, Leptospira interrogans serovar lai str. 56601
uguuuuucuugcua

SEQ ID NO: 760745 - RNA, 12 nt, Leptospira interrogans serovar lai str. 56601
uguuuuucgaau

SEQ ID NO: 760746 - RNA, 21 nt, Leptospira interrogans serovar lai str. 56601
uguuuuucgaaucggguuugu

SEQ ID NO: 760747 - RNA, 13 nt, Leptospira interrogans serovar lai str. 56601
uguuuuuaaaauu

SEQ ID NO: 760748 - RNA, 14 nt, Leptospira interrogans serovar lai str. 56601
uguuuuuaaaauug

SEQ ID NO: 760749 - RNA, 13 nt, Leptospira interrogans serovar lai str. 56601
uguuuuuauaaau

SEQ ID NO: 760750 - RNA, 21 nt, Leptospira interrogans serovar lai str. 56601
uguuuuuauaucuuaauuaaa

SEQ ID NO: 760751 - RNA, 22 nt, Leptospira interrogans serovar lai str. 56601
uguuuugcgauuauuaucaaaa

SEQ ID NO: 760752 - RNA, 16 nt, Leptospira interrogans serovar lai str. 56601
uguuuucuuuucuucu

SEQ ID NO: 760753 - RNA, 21 nt, Leptospira interrogans serovar lai str. 56601
uguuuuggcucuugcuaaaau

SEQ ID NO: 760754 - RNA, 21 nt, Leptospira interrogans serovar lai str. 56601
uguuuucuacaaauaaaacuu

SEQ ID NO: 760755 - RNA, 17 nt, Leptospira interrogans serovar lai str. 56601
uguuuguuauaagaauu

SEQ ID NO: 760756 - RNA, 21 nt, Leptospira interrogans serovar lai str. 56601
uguuuuaaaacuuaaaaugug

SEQ ID NO: 760757 - RNA, 14 nt, Leptospira interrogans serovar lai str. 56601
uguuugucuuuuuc

SEQ ID NO: 760758 - RNA, 16 nt, Leptospira interrogans serovar lai str. 56601
uguuuguccuagaucu

SEQ ID NO: 760759 - RNA, 16 nt, Leptospira interrogans serovar lai str. 56601
uguuuguggauuauga

SEQ ID NO: 760760 - RNA, 13 nt, Leptospira interrogans serovar lai str. 56601
uuaacgcaaaaua

SEQ ID NO: 760761 - RNA, 16 nt, Leptospira interrogans serovar lai str. 56601
uuaacgacauuagaac

SEQ ID NO: 760762 - RNA, 23 nt, Leptospira interrogans serovar lai str. 56601
uuaacauuuguuuuuuauaauuu

SEQ ID NO: 760763 - RNA, 15 nt, Leptospira interrogans serovar lai str. 56601
uuaaccaaaaauuca

SEQ ID NO: 760764 - RNA, 16 nt, Leptospira interrogans serovar lai str. 56601
uuaacuuuuuuuaaaa

SEQ ID NO: 760765 - RNA, 18 nt, Leptospira interrogans serovar lai str. 56601
uuaacuuuuuuuaaaaaa

SEQ ID NO: 760766 - RNA, 17 nt, Leptospira interrogans serovar lai str. 56601
uuaagaucauuuaaaac

SEQ ID NO: 760767 - RNA, 23 nt, Leptospira interrogans serovar lai str. 56601
uuaagaacuuucucgaaaaucuc

SEQ ID NO: 760768 - RNA, 15 nt, Leptospira interrogans serovar lai str. 56601
uuaagauuauauuau

SEQ ID NO: 760769 - RNA, 13 nt, Leptospira interrogans serovar lai str. 56601
uuaacuuuuauuc

SEQ ID NO: 760770 - RNA, 20 nt, Leptospira interrogans serovar lai str. 56601
uuaauaaaucaaucuacuug

SEQ ID NO: 760771 - RNA, 17 nt, Leptospira interrogans serovar lai str. 56601
uuaauaaauuguauaca

SEQ ID NO: 760772 - RNA, 22 nt, Leptospira interrogans serovar lai str. 56601
uuaauaaauuguauacaggaaa

SEQ ID NO: 760773 - RNA, 19 nt, Leptospira interrogans serovar lai str. 56601
uuaauaaaauuuuuaaaaa

SEQ ID NO: 760774 - RNA, 20 nt, Leptospira interrogans serovar lai str. 56601
uuaauaaaauuuuuaaaaaa

SEQ ID NO: 760775 - RNA, 21 nt, Leptospira interrogans serovar lai str. 56601
uuaauaaaauuuuuaaaaaau

SEQ ID NO: 760776 - RNA, 16 nt, Leptospira interrogans serovar lai str. 56601
uuaauaaaaugcagua

SEQ ID NO: 760777 - RNA, 19 nt, Leptospira interrogans serovar lai str. 56601
uuaauaaaaugcaguaguu

SEQ ID NO: 760778 - RNA, 13 nt, Leptospira interrogans serovar lai str. 56601
uuaauaaaaaaau

SEQ ID NO: 760779 - RNA, 21 nt, Leptospira interrogans serovar lai str. 56601
uuaaguaauauuucucucaaa

SEQ ID NO: 760780 - RNA, 18 nt, Leptospira interrogans serovar lai str. 56601
uuaagcaaagauuaagua

SEQ ID NO: 760781 - RNA, 13 nt, Leptospira interrogans serovar lai str. 56601
uuaaucauguuug

SEQ ID NO: 760782 - RNA, 19 nt, Leptospira interrogans serovar lai str. 56601
uuaaucauccaauaauuua

SEQ ID NO: 760783 - RNA, 22 nt, Leptospira interrogans serovar lai str. 56601
uuaauauacaaaacauuccaau

SEQ ID NO: 760784 - RNA, 18 nt, Leptospira interrogans serovar lai str. 56601
uuaaucagauuuuugcac

SEQ ID NO: 760785 - RNA, 14 nt, Leptospira interrogans serovar lai str. 56601
uuaauauacuaaaa

SEQ ID NO: 760786 - RNA, 17 nt, Leptospira interrogans serovar lai str. 56601
uuaauauauuaaaaugu

SEQ ID NO: 760787 - RNA, 14 nt, Leptospira interrogans serovar lai str. 56601
uuaauaauucaaaa

SEQ ID NO: 760788 - RNA, 15 nt, Leptospira interrogans serovar lai str. 56601
uuaauacaaaaaacu

SEQ ID NO: 760789 - RNA, 17 nt, Leptospira interrogans serovar lai str. 56601
uuaauacaaaaaacuga

SEQ ID NO: 760790 - RNA, 23 nt, Leptospira interrogans serovar lai str. 56601
uuaaaugaaguguaaaacccauc

SEQ ID NO: 760791 - RNA, 20 nt, Leptospira interrogans serovar lai str. 56601
uuaaaucuuaugguuuuuua

SEQ ID NO: 760792 - RNA, 23 nt, Leptospira interrogans serovar lai str. 56601
uuaaauguauguuuacuugaaaa

SEQ ID NO: 760793 - RNA, 22 nt, Leptospira interrogans serovar lai str. 56601
uuaaaugugcgggaacucuuuc

SEQ ID NO: 760794 - RNA, 13 nt, Leptospira interrogans serovar lai str. 56601
uuaaauguucaaa

SEQ ID NO: 760795 - RNA, 14 nt, Leptospira interrogans serovar lai str. 56601
uuaaauucaucaau

SEQ ID NO: 760796 - RNA, 13 nt, Leptospira interrogans serovar lai str. 56601
uuaaauuauauuu

SEQ ID NO: 760797 - RNA, 15 nt, Leptospira interrogans serovar lai str. 56601
uuaaauuguaugaaa

SEQ ID NO: 760798 - RNA, 22 nt, Leptospira interrogans serovar lai str. 56601
uuaaauuguucguuucuuaauu

SEQ ID NO: 760799 - RNA, 21 nt, Leptospira interrogans serovar lai str. 56601
uuaaauucccucaauaaucca

SEQ ID NO: 760800 - RNA, 14 nt, Leptospira interrogans serovar lai str. 56601
uuaaauucuaaaaa

SEQ ID NO: 760801 - RNA, 15 nt, Leptospira interrogans serovar lai str. 56601
uuaaauucuaaaaaa

SEQ ID NO: 760802 - RNA, 21 nt, Leptospira interrogans serovar lai str. 56601
uuaaauucuaaaaaaauacga

SEQ ID NO: 760803 - RNA, 18 nt, Leptospira interrogans serovar lai str. 56601
uuaaauuuuauuuauaua

SEQ ID NO: 760804 - RNA, 13 nt, Leptospira interrogans serovar lai str. 56601
uuaaauuuuuaua

SEQ ID NO: 760805 - RNA, 15 nt, Leptospira interrogans serovar lai str. 56601
uuaaauuuuuugcaa

SEQ ID NO: 760806 - RNA, 21 nt, Leptospira interrogans serovar lai str. 56601
uuaaauuuuuugcaaaaaaau

SEQ ID NO: 760807 - RNA, 22 nt, Leptospira interrogans serovar lai str. 56601
uuaaauuuuuugcaaaaaaaua

SEQ ID NO: 760808 - RNA, 23 nt, Leptospira interrogans serovar lai str. 56601
uuaaauuuuuugcaaaaaaauaa

SEQ ID NO: 760809 - RNA, 17 nt, Leptospira interrogans serovar lai str. 56601
uuaacaaucguacgaau

SEQ ID NO: 760810 - RNA, 13 nt, Leptospira interrogans serovar lai str. 56601
uuaacaaucaauu

SEQ ID NO: 760811 - RNA, 13 nt, Leptospira interrogans serovar lai str. 56601
uuaacaacucuaa

SEQ ID NO: 760812 - RNA, 12 nt, Leptospira interrogans serovar lai str. 56601
uuaaauauuaau

SEQ ID NO: 760813 - RNA, 22 nt, Leptospira interrogans serovar lai str. 56601
uuaaauaucgaauuucuucaua

SEQ ID NO: 760814 - RNA, 20 nt, Leptospira interrogans serovar lai str. 56601
uuaaauagaaaccaguaaua

SEQ ID NO: 760815 - RNA, 22 nt, Leptospira interrogans serovar lai str. 56601
uuaaauaccuaaauauuuauua

SEQ ID NO: 760816 - RNA, 20 nt, Leptospira interrogans serovar lai str. 56601
uuaaauagagcuuuguaaua

SEQ ID NO: 760817 - RNA, 15 nt, Leptospira interrogans serovar lai str. 56601
uuaaauacacucuuu

SEQ ID NO: 760818 - RNA, 12 nt, Leptospira interrogans serovar lai str. 56601
uuaaauaaaaag

SEQ ID NO: 760819 - RNA, 21 nt, Leptospira interrogans serovar lai str. 56601
uuaaaguuuacaucaaaaaca

SEQ ID NO: 760820 - RNA, 18 nt, Leptospira interrogans serovar lai str. 56601
uuaaauaaagguuuuaua

SEQ ID NO: 760821 - RNA, 16 nt, Leptospira interrogans serovar lai str. 56601
uuaaauaaaauuuucc

SEQ ID NO: 760822 - RNA, 16 nt, Leptospira interrogans serovar lai str. 56601
uuaaaguuguugaaaa

SEQ ID NO: 760823 - RNA, 21 nt, Leptospira interrogans serovar lai str. 56601
uuaaaguuguugaaaaauuaa

SEQ ID NO: 760824 - RNA, 20 nt, Leptospira interrogans serovar lai str. 56601
uuaaagcauuaaaaaagaua

SEQ ID NO: 760825 - RNA, 15 nt, Leptospira interrogans serovar lai str. 56601
uuaaaguaaaauuaa

SEQ ID NO: 760826 - RNA, 19 nt, Leptospira interrogans serovar lai str. 56601
uuaaaguauuaauuuaauc

SEQ ID NO: 760827 - RNA, 15 nt, Leptospira interrogans serovar lai str. 56601
uuacgucgaacucac

SEQ ID NO: 760828 - RNA, 19 nt, Leptospira interrogans serovar lai str. 56601
uuacuacagacaauccuau

SEQ ID NO: 760829 - RNA, 22 nt, Leptospira interrogans serovar lai str. 56601
uuacuacaucuaaugauuucuu

SEQ ID NO: 760830 - RNA, 22 nt, Leptospira interrogans serovar lai str. 56601
uuacuacauuugauuaaaaauu

SEQ ID NO: 760831 - RNA, 22 nt, Leptospira interrogans serovar lai str. 56601
uuacuacccgacguauaaaaac

SEQ ID NO: 760832 - RNA, 17 nt, Leptospira interrogans serovar lai str. 56601
uuacuacgucuucuaaa

SEQ ID NO: 760833 - RNA, 16 nt, Leptospira interrogans serovar lai str. 56601
uuacggaucaaaauuc

SEQ ID NO: 760834 - RNA, 22 nt, Leptospira interrogans serovar lai str. 56601
uuacuuaccucuauaaaauuaa

SEQ ID NO: 760835 - RNA, 20 nt, Leptospira interrogans serovar lai str. 56601
uuacuuagaugaacuuuuuu

SEQ ID NO: 760836 - RNA, 13 nt, Leptospira interrogans serovar lai str. 56601
uuacuuauacaac

SEQ ID NO: 760837 - RNA, 15 nt, Leptospira interrogans serovar lai str. 56601
uuacucuuauuuaua

SEQ ID NO: 760838 - RNA, 23 nt, Leptospira interrogans serovar lai str. 56601
uuacucuuauuuauauuucuaaa

SEQ ID NO: 760839 - RNA, 15 nt, Leptospira interrogans serovar lai str. 56601
uuacucuauccauau

SEQ ID NO: 760840 - RNA, 20 nt, Leptospira interrogans serovar lai str. 56601
uuacucguuucgaacucacg

SEQ ID NO: 760841 - RNA, 17 nt, Leptospira interrogans serovar lai str. 56601
uuacucgacaaaacacu

SEQ ID NO: 760842 - RNA, 19 nt, Leptospira interrogans serovar lai str. 56601
uuacuauggaauauaaaag

SEQ ID NO: 760843 - RNA, 20 nt, Leptospira interrogans serovar lai str. 56601
uuacuauggaauauaaaaga

SEQ ID NO: 760844 - RNA, 21 nt, Leptospira interrogans serovar lai str. 56601
uuacuuuuucugguuccauaa

SEQ ID NO: 760845 - RNA, 12 nt, Leptospira interrogans serovar lai str. 56601
uuagaaaaauau

SEQ ID NO: 760846 - RNA, 12 nt, Leptospira interrogans serovar lai str. 56601
uuagaaauauug

SEQ ID NO: 760847 - RNA, 22 nt, Leptospira interrogans serovar lai str. 56601
uuagaaauauugaauccaucug

SEQ ID NO: 760848 - RNA, 19 nt, Leptospira interrogans serovar lai str. 56601
uuagaaaugauuuuuuaaa

SEQ ID NO: 760849 - RNA, 18 nt, Leptospira interrogans serovar lai str. 56601
uuagaaauuaaaguaucc

SEQ ID NO: 760850 - RNA, 15 nt, Leptospira interrogans serovar lai str. 56601
uuagaaucccauuua

SEQ ID NO: 760851 - RNA, 13 nt, Leptospira interrogans serovar lai str. 56601
uuagaaucaaaau

SEQ ID NO: 760852 - RNA, 15 nt, Leptospira interrogans serovar lai str. 56601
uuagaaaauuagaaa

SEQ ID NO: 760853 - RNA, 20 nt, Leptospira interrogans serovar lai str. 56601
uuagaauuuuaugauuuucu

SEQ ID NO: 760854 - RNA, 16 nt, Leptospira interrogans serovar lai str. 56601
uuagaauuuucuaaag

SEQ ID NO: 760855 - RNA, 20 nt, Leptospira interrogans serovar lai str. 56601
uuagaauuuucuaaagauuc

SEQ ID NO: 760856 - RNA, 14 nt, Leptospira interrogans serovar lai str. 56601
uuagaaucuaaacu

SEQ ID NO: 760857 - RNA, 17 nt, Leptospira interrogans serovar lai str. 56601
uuagacaaaaauacuaa

SEQ ID NO: 760858 - RNA, 13 nt, Leptospira interrogans serovar lai str. 56601
uuagacaaaaaau

SEQ ID NO: 760859 - RNA, 14 nt, Leptospira interrogans serovar lai str. 56601
uuagaauauuuucu

SEQ ID NO: 760860 - RNA, 19 nt, Leptospira interrogans serovar lai str. 56601
uuagaauuuguuuuuaaaa

SEQ ID NO: 760861 - RNA, 13 nt, Leptospira interrogans serovar lai str. 56601
uuagauaaauaca

SEQ ID NO: 760862 - RNA, 20 nt, Leptospira interrogans serovar lai str. 56601
uuagauaaauacaucucuuu

SEQ ID NO: 760863 - RNA, 21 nt, Leptospira interrogans serovar lai str. 56601
uuagauaagagacaaauauuu

SEQ ID NO: 760864 - RNA, 13 nt, Leptospira interrogans serovar lai str. 56601
uuagauucuaaaa

SEQ ID NO: 760865 - RNA, 17 nt, Leptospira interrogans serovar lai str. 56601
uuagauuuuaacuuuuu

SEQ ID NO: 760866 - RNA, 13 nt, Leptospira interrogans serovar lai str. 56601
uuagauauuuaua

SEQ ID NO: 760867 - RNA, 13 nt, Leptospira interrogans serovar lai str. 56601
uuagaucuaaauu

SEQ ID NO: 760868 - RNA, 15 nt, Leptospira interrogans serovar lai str. 56601
uuagaugaacuuuuu

SEQ ID NO: 760869 - RNA, 17 nt, Leptospira interrogans serovar lai str. 56601
uuacacgauaauuuucu

SEQ ID NO: 760870 - RNA, 20 nt, Leptospira interrogans serovar lai str. 56601
uuacacgauaauuuucuuua

SEQ ID NO: 760871 - RNA, 15 nt, Leptospira interrogans serovar lai str. 56601
uuacaccaaacucac

SEQ ID NO: 760872 - RNA, 18 nt, Leptospira interrogans serovar lai str. 56601
uuacacggccaacaucgu

SEQ ID NO: 760873 - RNA, 22 nt, Leptospira interrogans serovar lai str. 56601
uuacaaauagguuuugaacuac

SEQ ID NO: 760874 - RNA, 14 nt, Leptospira interrogans serovar lai str. 56601
uuacaaaaugauuu

SEQ ID NO: 760875 - RNA, 13 nt, Leptospira interrogans serovar lai str. 56601
uuacaaagauugg

SEQ ID NO: 760876 - RNA, 18 nt, Leptospira interrogans serovar lai str. 56601
uuacaaagugaugaagag

SEQ ID NO: 760877 - RNA, 21 nt, Leptospira interrogans serovar lai str. 56601
uuacaaagugaugaagagaaa

SEQ ID NO: 760878 - RNA, 11 nt, Leptospira interrogans serovar lai str. 56601
uuaauuuuuua

SEQ ID NO: 760879 - RNA, 13 nt, Leptospira interrogans serovar lai str. 56601
uuaauuuuuuaaa

SEQ ID NO: 760880 - RNA, 23 nt, Leptospira interrogans serovar lai str. 56601
uuaauuuuuuaaaaauuuuauua

SEQ ID NO: 760881 - RNA, 12 nt, Leptospira interrogans serovar lai str. 56601
uuaauuuuuaua

SEQ ID NO: 760882 - RNA, 12 nt, Leptospira interrogans serovar lai str. 56601
uuaauuuuucaa

SEQ ID NO: 760883 - RNA, 14 nt, Leptospira interrogans serovar lai str. 56601
uuaauuuuucaaua

SEQ ID NO: 760884 - RNA, 13 nt, Leptospira interrogans serovar lai str. 56601
uuacaaaaaauga

SEQ ID NO: 760885 - RNA, 22 nt, Leptospira interrogans serovar lai str. 56601
uuaaugaauccuauaaacuaac

SEQ ID NO: 760886 - RNA, 16 nt, Leptospira interrogans serovar lai str. 56601
uuaaucuguaaaucaa

SEQ ID NO: 760887 - RNA, 19 nt, Leptospira interrogans serovar lai str. 56601
uuaaucugcugaauuuacc

SEQ ID NO: 760888 - RNA, 16 nt, Leptospira interrogans serovar lai str. 56601
uuaauuuaaucaaaau

SEQ ID NO: 760889 - RNA, 11 nt, Leptospira interrogans serovar lai str. 56601
uuaauuuagaa

SEQ ID NO: 760890 - RNA, 12 nt, Leptospira interrogans serovar lai str. 56601
uuaauuuaaaaa

SEQ ID NO: 760891 - RNA, 21 nt, Leptospira interrogans serovar lai str. 56601
uuaauuuuguaggaauuagua

SEQ ID NO: 760892 - RNA, 23 nt, Leptospira interrogans serovar lai str. 56601
uuaauuuuguaggaauuaguaau

SEQ ID NO: 760893 - RNA, 14 nt, Leptospira interrogans serovar lai str. 56601
uuaccguuuuuaaa

SEQ ID NO: 760894 - RNA, 13 nt, Leptospira interrogans serovar lai str. 56601
uuaccuccuccuu

SEQ ID NO: 760895 - RNA, 14 nt, Leptospira interrogans serovar lai str. 56601
uuaccuccuccuuc

SEQ ID NO: 760896 - RNA, 15 nt, Leptospira interrogans serovar lai str. 56601
uuaccuccuccuucu

SEQ ID NO: 760897 - RNA, 14 nt, Leptospira interrogans serovar lai str. 56601
uuaccuccuuuuuc

SEQ ID NO: 760898 - RNA, 15 nt, Leptospira interrogans serovar lai str. 56601
uuaccgucaauuuuu

SEQ ID NO: 760899 - RNA, 23 nt, Leptospira interrogans serovar lai str. 56601
uuacgaaaauuuuuuauuuuaug

SEQ ID NO: 760900 - RNA, 15 nt, Leptospira interrogans serovar lai str. 56601
uuacgaauuuuuaaa

SEQ ID NO: 760901 - RNA, 17 nt, Leptospira interrogans serovar lai str. 56601
uuacgacaaguccucua

SEQ ID NO: 760902 - RNA, 22 nt, Leptospira interrogans serovar lai str. 56601
uuacgacauuuuaauaaucuuu

SEQ ID NO: 760903 - RNA, 16 nt, Leptospira interrogans serovar lai str. 56601
uuacgacgcgauucau

SEQ ID NO: 760904 - RNA, 13 nt, Leptospira interrogans serovar lai str. 56601
uuacgaugucuuu

SEQ ID NO: 760905 - RNA, 17 nt, Leptospira interrogans serovar lai str. 56601
uuacgaucuaaaaggac

SEQ ID NO: 760906 - RNA, 19 nt, Leptospira interrogans serovar lai str. 56601
uuacauaucaauccuguaa

SEQ ID NO: 760907 - RNA, 13 nt, Leptospira interrogans serovar lai str. 56601
uuacauauauaau

SEQ ID NO: 760908 - RNA, 19 nt, Leptospira interrogans serovar lai str. 56601
uuacauaacuaauaaaaac

SEQ ID NO: 760909 - RNA, 21 nt, Leptospira interrogans serovar lai str. 56601
uuacauaacuaauaaaaacaa

SEQ ID NO: 760910 - RNA, 20 nt, Leptospira interrogans serovar lai str. 56601
uuacaguuuuuaaucgcucu

SEQ ID NO: 760911 - RNA, 17 nt, Leptospira interrogans serovar lai str. 56601
uuacauaagaccauauu

SEQ ID NO: 760912 - RNA, 15 nt, Leptospira interrogans serovar lai str. 56601
uuacaucauguaaua

SEQ ID NO: 760913 - RNA, 14 nt, Leptospira interrogans serovar lai str. 56601
uuaccauaaauuuu

SEQ ID NO: 760914 - RNA, 15 nt, Leptospira interrogans serovar lai str. 56601
uuaccauaaauuuuu

SEQ ID NO: 760915 - RNA, 14 nt, Leptospira interrogans serovar lai str. 56601
uuaccaggaugaau

SEQ ID NO: 760916 - RNA, 13 nt, Leptospira interrogans serovar lai str. 56601
uguguuuuuucuu

SEQ ID NO: 760917 - RNA, 19 nt, Leptospira interrogans serovar lai str. 56601
uguguuuuuucuuuaaaau

SEQ ID NO: 760918 - RNA, 18 nt, Leptospira interrogans serovar lai str. 56601
uguuaaaaaacuauaaau

SEQ ID NO: 760919 - RNA, 14 nt, Leptospira interrogans serovar lai str. 56601
uguuaaaaaauuaa

SEQ ID NO: 760920 - RNA, 20 nt, Leptospira interrogans serovar lai str. 56601
uguuaaaagccauuucaaaa

SEQ ID NO: 760921 - RNA, 23 nt, Leptospira interrogans serovar lai str. 56601
uguguuucagacugacugaaaaa

SEQ ID NO: 760922 - RNA, 17 nt, Leptospira interrogans serovar lai str. 56601
uguguugaguuuuuccu

SEQ ID NO: 760923 - RNA, 18 nt, Leptospira interrogans serovar lai str. 56601
uguguuugauaauuugug

SEQ ID NO: 760924 - RNA, 12 nt, Leptospira interrogans serovar lai str. 56601
ugugucccaaaa

SEQ ID NO: 760925 - RNA, 15 nt, Leptospira interrogans serovar lai str. 56601
uguuaaccaaaaauu

SEQ ID NO: 760926 - RNA, 14 nt, Leptospira interrogans serovar lai str. 56601
uguuaagauaaauu

SEQ ID NO: 760927 - RNA, 15 nt, Leptospira interrogans serovar lai str. 56601
uguuaagauaaauuu

SEQ ID NO: 760928 - RNA, 22 nt, Leptospira interrogans serovar lai str. 56601
uguuacucgucuuuauaaaguu

SEQ ID NO: 760929 - RNA, 19 nt, Leptospira interrogans serovar lai str. 56601
uguuacggaguaaagucga

SEQ ID NO: 760930 - RNA, 20 nt, Leptospira interrogans serovar lai str. 56601
uguuacgguaauauauucaa

SEQ ID NO: 760931 - RNA, 17 nt, Leptospira interrogans serovar lai str. 56601
ugugcuauauucaaaaa

SEQ ID NO: 760932 - RNA, 18 nt, Leptospira interrogans serovar lai str. 56601
ugugggaacuaccacaaa

SEQ ID NO: 760933 - RNA, 15 nt, Leptospira interrogans serovar lai str. 56601
ugugggaacuaucac

SEQ ID NO: 760934 - RNA, 20 nt, Leptospira interrogans serovar lai str. 56601
ugugggaacucacacaaaau

SEQ ID NO: 760935 - RNA, 20 nt, Leptospira interrogans serovar lai str. 56601
ugugggaacucucacaaauc

SEQ ID NO: 760936 - RNA, 17 nt, Leptospira interrogans serovar lai str. 56601
uguguaaugauuucaga

SEQ ID NO: 760937 - RNA, 15 nt, Leptospira interrogans serovar lai str. 56601
ugugucaagcccucc

SEQ ID NO: 760938 - RNA, 22 nt, Leptospira interrogans serovar lai str. 56601
uguggguggggacuaaguuuua

SEQ ID NO: 760939 - RNA, 16 nt, Leptospira interrogans serovar lai str. 56601
uguggucaacaucuca

SEQ ID NO: 760940 - RNA, 14 nt, Leptospira interrogans serovar lai str. 56601
ugugaguuuuaaaa

SEQ ID NO: 760941 - RNA, 21 nt, Leptospira interrogans serovar lai str. 56601
ugugaguucgacguaaagaau

SEQ ID NO: 760942 - RNA, 19 nt, Leptospira interrogans serovar lai str. 56601
ugugccuucguuuaaaaaa

SEQ ID NO: 760943 - RNA, 22 nt, Leptospira interrogans serovar lai str. 56601
ugugacuuaaucugugggaacu

SEQ ID NO: 760944 - RNA, 20 nt, Leptospira interrogans serovar lai str. 56601
ugugacuuccugauuuggaa

SEQ ID NO: 760945 - RNA, 13 nt, Leptospira interrogans serovar lai str. 56601
ugugagaguuccc

SEQ ID NO: 760946 - RNA, 16 nt, Leptospira interrogans serovar lai str. 56601
ugucuguaaaaugaug

SEQ ID NO: 760947 - RNA, 22 nt, Leptospira interrogans serovar lai str. 56601
ugucuguaaaaugaugugggaa

SEQ ID NO: 760948 - RNA, 22 nt, Leptospira interrogans serovar lai str. 56601
ugugaaucaaaagguauaaaau

SEQ ID NO: 760949 - RNA, 16 nt, Leptospira interrogans serovar lai str. 56601
ugugaauucagaaaaa

SEQ ID NO: 760950 - RNA, 15 nt, Leptospira interrogans serovar lai str. 56601
ugucauguuuuaaug

SEQ ID NO: 760951 - RNA, 13 nt, Leptospira interrogans serovar lai str. 56601
ugucuauuuuaau

SEQ ID NO: 760952 - RNA, 15 nt, Leptospira interrogans serovar lai str. 56601
ugucucaaaauuaag

SEQ ID NO: 760953 - RNA, 14 nt, Leptospira interrogans serovar lai str. 56601
ugucucaaaauuua

SEQ ID NO: 760954 - RNA, 23 nt, Leptospira interrogans serovar lai str. 56601
ugucuauagaugcugaaaauggu

SEQ ID NO: 760955 - RNA, 15 nt, Leptospira interrogans serovar lai str. 56601
ugucguacuaaaauu

SEQ ID NO: 760956 - RNA, 21 nt, Leptospira interrogans serovar lai str. 56601
ugucguacuaaaauuaaaaau

SEQ ID NO: 760957 - RNA, 19 nt, Leptospira interrogans serovar lai str. 56601
ugucuacuugucuuuagaa

SEQ ID NO: 760958 - RNA, 15 nt, Leptospira interrogans serovar lai str. 56601
ugucguaaaaaguuu

SEQ ID NO: 760959 - RNA, 22 nt, Leptospira interrogans serovar lai str. 56601
ugucacuauuuuuaugcgugca

SEQ ID NO: 760960 - RNA, 16 nt, Leptospira interrogans serovar lai str. 56601
ugucaagcccuccuau

SEQ ID NO: 760961 - RNA, 18 nt, Leptospira interrogans serovar lai str. 56601
ugucaagcccuccuaugu

SEQ ID NO: 760962 - RNA, 14 nt, Leptospira interrogans serovar lai str. 56601
uguauuaaaaaauc

SEQ ID NO: 760963 - RNA, 15 nt, Leptospira interrogans serovar lai str. 56601
uguauuacucagagu

SEQ ID NO: 760964 - RNA, 22 nt, Leptospira interrogans serovar lai str. 56601
uguauuacucagaguuauauaa

SEQ ID NO: 760965 - RNA, 16 nt, Leptospira interrogans serovar lai str. 56601
uguauauuuuuuuaau

SEQ ID NO: 760966 - RNA, 16 nt, Leptospira interrogans serovar lai str. 56601
uguauggcucauuuuu

SEQ ID NO: 760967 - RNA, 19 nt, Leptospira interrogans serovar lai str. 56601
uguauggcucauuuuucuu

SEQ ID NO: 760968 - RNA, 19 nt, Leptospira interrogans serovar lai str. 56601
uguauaaaagaaacauaau

SEQ ID NO: 760969 - RNA, 18 nt, Leptospira interrogans serovar lai str. 56601
uguauaaaaauaauacaa

SEQ ID NO: 760970 - RNA, 20 nt, Leptospira interrogans serovar lai str. 56601
uguaguucuacauucaauuu

SEQ ID NO: 760971 - RNA, 16 nt, Leptospira interrogans serovar lai str. 56601
uguauauuauaaaauu

SEQ ID NO: 760972 - RNA, 13 nt, Leptospira interrogans serovar lai str. 56601
uguauauaaauuu

SEQ ID NO: 760973 - RNA, 16 nt, Leptospira interrogans serovar lai str. 56601
uguauaccaauaauuu

SEQ ID NO: 760974 - RNA, 21 nt, Leptospira interrogans serovar lai str. 56601
uguauagaaaccgauuuuaau

SEQ ID NO: 760975 - RNA, 22 nt, Leptospira interrogans serovar lai str. 56601
uguaggaacuacagcaaaucac

SEQ ID NO: 760976 - RNA, 20 nt, Leptospira interrogans serovar lai str. 56601
uguaggaacucauacuuuua

SEQ ID NO: 760977 - RNA, 14 nt, Leptospira interrogans serovar lai str. 56601
uguaggaauuagua

SEQ ID NO: 760978 - RNA, 23 nt, Leptospira interrogans serovar lai str. 56601
uguaggaauucauacuuuuaaaa

SEQ ID NO: 760979 - RNA, 22 nt, Leptospira interrogans serovar lai str. 56601
uguaagaaaaaacuuucuaaaa

SEQ ID NO: 760980 - RNA, 14 nt, Leptospira interrogans serovar lai str. 56601
uguaagaaaauauu

SEQ ID NO: 760981 - RNA, 19 nt, Leptospira interrogans serovar lai str. 56601
uguaacuacugcauucuua

SEQ ID NO: 760982 - RNA, 21 nt, Leptospira interrogans serovar lai str. 56601
uguaacuacugcauucuuaga

SEQ ID NO: 760983 - RNA, 20 nt, Leptospira interrogans serovar lai str. 56601
uguaaucucgauuucuaaaa

SEQ ID NO: 760984 - RNA, 16 nt, Leptospira interrogans serovar lai str. 56601
uguaaugacgauuuuc

SEQ ID NO: 760985 - RNA, 14 nt, Leptospira interrogans serovar lai str. 56601
uguacaaaaaugug

SEQ ID NO: 760986 - RNA, 11 nt, Leptospira interrogans serovar lai str. 56601
uguacaaaacc

SEQ ID NO: 760987 - RNA, 22 nt, Leptospira interrogans serovar lai str. 56601
uguacuuacuaaacgauuuuau

SEQ ID NO: 760988 - RNA, 14 nt, Leptospira interrogans serovar lai str. 56601
uguacgauuccaga

SEQ ID NO: 760989 - RNA, 16 nt, Leptospira interrogans serovar lai str. 56601
uguacuuuuaagaauu

SEQ ID NO: 760990 - RNA, 18 nt, Leptospira interrogans serovar lai str. 56601
uguagaaauucuauuuua

SEQ ID NO: 760991 - RNA, 21 nt, Leptospira interrogans serovar lai str. 56601
uguagaaauucuauuuuauug

SEQ ID NO: 760992 - RNA, 16 nt, Leptospira interrogans serovar lai str. 56601
uguagaauugaaagaa

SEQ ID NO: 760993 - RNA, 14 nt, Leptospira interrogans serovar lai str. 56601
uguagacaaaucau

SEQ ID NO: 760994 - RNA, 14 nt, Leptospira interrogans serovar lai str. 56601
uguacaacauccuu

SEQ ID NO: 760995 - RNA, 22 nt, Leptospira interrogans serovar lai str. 56601
uguacaacauccuucaaacuuu

SEQ ID NO: 760996 - RNA, 19 nt, Leptospira interrogans serovar lai str. 56601
ugguuuccgcuguaugaaa

SEQ ID NO: 760997 - RNA, 12 nt, Leptospira interrogans serovar lai str. 56601
ugguuuuuauua

SEQ ID NO: 760998 - RNA, 12 nt, Leptospira interrogans serovar lai str. 56601
ugguuucaauuu

SEQ ID NO: 760999 - RNA, 20 nt, Leptospira interrogans serovar lai str. 56601
ugguuuagacguaggaaaug

SEQ ID NO: 761000 - RNA, 18 nt, Leptospira interrogans serovar lai str. 56601
uggugaacuauuuauaaa

SEQ ID NO: 761001 - RNA, 13 nt, Leptospira interrogans serovar lai str. 56601
uguaaaaaaucau

SEQ ID NO: 761002 - RNA, 12 nt, Leptospira interrogans serovar lai str. 56601
uguaaaaacuac

SEQ ID NO: 761003 - RNA, 18 nt, Leptospira interrogans serovar lai str. 56601
uguaaaaaaacaugaaga

SEQ ID NO: 761004 - RNA, 21 nt, Leptospira interrogans serovar lai str. 56601
uguaaaaaaccgucccaaaau

SEQ ID NO: 761005 - RNA, 12 nt, Leptospira interrogans serovar lai str. 56601
uguaaaagaaaa

SEQ ID NO: 761006 - RNA, 16 nt, Leptospira interrogans serovar lai str. 56601
uguaaaagaaaaauua

SEQ ID NO: 761007 - RNA, 14 nt, Leptospira interrogans serovar lai str. 56601
uguaaaaaugagua

SEQ ID NO: 761008 - RNA, 16 nt, Leptospira interrogans serovar lai str. 56601
uguaaauuugcuuuaa

SEQ ID NO: 761009 - RNA, 18 nt, Leptospira interrogans serovar lai str. 56601
uguaaauucaaagcaaga

SEQ ID NO: 761010 - RNA, 19 nt, Leptospira interrogans serovar lai str. 56601
uguaaauucaaagcaagaa

SEQ ID NO: 761011 - RNA, 18 nt, Leptospira interrogans serovar lai str. 56601
uguaaaagcuuauacuuu

SEQ ID NO: 761012 - RNA, 20 nt, Leptospira interrogans serovar lai str. 56601
uguaaaauuuuuugaaguuu

SEQ ID NO: 761013 - RNA, 20 nt, Leptospira interrogans serovar lai str. 56601
uguaaaaugauguaggaacu

SEQ ID NO: 761014 - RNA, 18 nt, Leptospira interrogans serovar lai str. 56601
uguaaaauggucuuuuag

SEQ ID NO: 761015 - RNA, 13 nt, Leptospira interrogans serovar lai str. 56601
uguaaaauucaga

SEQ ID NO: 761016 - RNA, 12 nt, Leptospira interrogans serovar lai str. 56601
uguaaaauuuaa

SEQ ID NO: 761017 - RNA, 15 nt, Leptospira interrogans serovar lai str. 56601
uguaaaauuuagauu

SEQ ID NO: 761018 - RNA, 22 nt, Leptospira interrogans serovar lai str. 56601
uggauugccacgguuaaaugga

SEQ ID NO: 761019 - RNA, 21 nt, Leptospira interrogans serovar lai str. 56601
uggauuuauguucguucccac

SEQ ID NO: 761020 - RNA, 20 nt, Leptospira interrogans serovar lai str. 56601
uggauuuguaauaguuccca

SEQ ID NO: 761021 - RNA, 17 nt, Leptospira interrogans serovar lai str. 56601
uggauucuaucgaacuu

SEQ ID NO: 761022 - RNA, 18 nt, Leptospira interrogans serovar lai str. 56601
uggauucugcucuucuaa

SEQ ID NO: 761023 - RNA, 23 nt, Leptospira interrogans serovar lai str. 56601
uggauucugcucuucuaauugca

SEQ ID NO: 761024 - RNA, 14 nt, Leptospira interrogans serovar lai str. 56601
uggauucuuucgac

SEQ ID NO: 761025 - RNA, 20 nt, Leptospira interrogans serovar lai str. 56601
uggauucuuucgacuucuuu

SEQ ID NO: 761026 - RNA, 22 nt, Leptospira interrogans serovar lai str. 56601
uggauucuuucgacuucuuuuu

SEQ ID NO: 761027 - RNA, 16 nt, Leptospira interrogans serovar lai str. 56601
ugguacgaccaaaaca

SEQ ID NO: 761028 - RNA, 21 nt, Leptospira interrogans serovar lai str. 56601
ugguaguucccacauuuaaau

SEQ ID NO: 761029 - RNA, 13 nt, Leptospira interrogans serovar lai str. 56601
ugguauuuaaaau

SEQ ID NO: 761030 - RNA, 14 nt, Leptospira interrogans serovar lai str. 56601
ugguauuuaaaauu

SEQ ID NO: 761031 - RNA, 12 nt, Leptospira interrogans serovar lai str. 56601
ugguaauuugug

SEQ ID NO: 761032 - RNA, 21 nt, Leptospira interrogans serovar lai str. 56601
ugguaaaaauaucaguuucuc

SEQ ID NO: 761033 - RNA, 16 nt, Leptospira interrogans serovar lai str. 56601
uggguuguuaugcaaa

SEQ ID NO: 761034 - RNA, 15 nt, Leptospira interrogans serovar lai str. 56601
uggguuucuuaaauc

SEQ ID NO: 761035 - RNA, 16 nt, Leptospira interrogans serovar lai str. 56601
ugguccggaugcgagu

SEQ ID NO: 761036 - RNA, 18 nt, Leptospira interrogans serovar lai str. 56601
uggucgaagauaccaaau

SEQ ID NO: 761037 - RNA, 20 nt, Leptospira interrogans serovar lai str. 56601
ugguauuuuagguauuucua

SEQ ID NO: 761038 - RNA, 23 nt, Leptospira interrogans serovar lai str. 56601
ugguauuuuagguauuucuaaua

SEQ ID NO: 761039 - RNA, 21 nt, Leptospira interrogans serovar lai str. 56601
uggucaacaucucaaucaaaa

SEQ ID NO: 761040 - RNA, 19 nt, Leptospira interrogans serovar lai str. 56601
uggucaaguuauuguaaaa

SEQ ID NO: 761041 - RNA, 16 nt, Leptospira interrogans serovar lai str. 56601
ugggcucaaaaaggca

SEQ ID NO: 761042 - RNA, 18 nt, Leptospira interrogans serovar lai str. 56601
uggggacuuuauuuuaua

SEQ ID NO: 761043 - RNA, 23 nt, Leptospira interrogans serovar lai str. 56601
uggcuucuuauuauucucggccu

SEQ ID NO: 761044 - RNA, 22 nt, Leptospira interrogans serovar lai str. 56601
uggcuucgagucgcgugccuuc

SEQ ID NO: 761045 - RNA, 18 nt, Leptospira interrogans serovar lai str. 56601
ugggaugauaccgaaaaa

SEQ ID NO: 761046 - RNA, 22 nt, Leptospira interrogans serovar lai str. 56601
ugggauuuuguaaugaaaucua

SEQ ID NO: 761047 - RNA, 13 nt, Leptospira interrogans serovar lai str. 56601
ugggcaaauuuag

SEQ ID NO: 761048 - RNA, 13 nt, Leptospira interrogans serovar lai str. 56601
ugggauaaauauu

SEQ ID NO: 761049 - RNA, 14 nt, Leptospira interrogans serovar lai str. 56601
ugggauaaauauuc

SEQ ID NO: 761050 - RNA, 23 nt, Leptospira interrogans serovar lai str. 56601
ugggaguucguaugaguucccac

SEQ ID NO: 761051 - RNA, 17 nt, Leptospira interrogans serovar lai str. 56601
uucagaaaaaaaaagaa

SEQ ID NO: 761052 - RNA, 20 nt, Leptospira interrogans serovar lai str. 56601
uucagaaaaaaaaagaauuu

SEQ ID NO: 761053 - RNA, 18 nt, Leptospira interrogans serovar lai str. 56601
uucagaaaaagugaauua

SEQ ID NO: 761054 - RNA, 14 nt, Leptospira interrogans serovar lai str. 56601
uucagaaaaaugaa

SEQ ID NO: 761055 - RNA, 12 nt, Leptospira interrogans serovar lai str. 56601
uucacuuuaaaa

SEQ ID NO: 761056 - RNA, 18 nt, Leptospira interrogans serovar lai str. 56601
uucagauuucaacuuuuu

SEQ ID NO: 761057 - RNA, 17 nt, Leptospira interrogans serovar lai str. 56601
uucagauuuuauuuuga

SEQ ID NO: 761058 - RNA, 17 nt, Leptospira interrogans serovar lai str. 56601
uucaccaagcuccucca

SEQ ID NO: 761059 - RNA, 20 nt, Leptospira interrogans serovar lai str. 56601
uucaaguguuccgacaagaa

SEQ ID NO: 761060 - RNA, 14 nt, Leptospira interrogans serovar lai str. 56601
uucaaugcaaaaaa

SEQ ID NO: 761061 - RNA, 20 nt, Leptospira interrogans serovar lai str. 56601
uucaauguaagaaacucauu

SEQ ID NO: 761062 - RNA, 16 nt, Leptospira interrogans serovar lai str. 56601
uucaaucuauuaacuu

SEQ ID NO: 761063 - RNA, 13 nt, Leptospira interrogans serovar lai str. 56601
uucaauuuaaaac

SEQ ID NO: 761064 - RNA, 17 nt, Leptospira interrogans serovar lai str. 56601
uucaauuuaaaauauca

SEQ ID NO: 761065 - RNA, 23 nt, Leptospira interrogans serovar lai str. 56601
uucaauuuaaaauaucagaucua

SEQ ID NO: 761066 - RNA, 12 nt, Leptospira interrogans serovar lai str. 56601
uucaauuuagaa

SEQ ID NO: 761067 - RNA, 17 nt, Leptospira interrogans serovar lai str. 56601
uucaauuuauuauagaa

SEQ ID NO: 761068 - RNA, 17 nt, Leptospira interrogans serovar lai str. 56601
uucaauugauuauagaa

SEQ ID NO: 761069 - RNA, 18 nt, Leptospira interrogans serovar lai str. 56601
uucaauugauuauagaac

SEQ ID NO: 761070 - RNA, 16 nt, Leptospira interrogans serovar lai str. 56601
uucaauuaucaaagca

SEQ ID NO: 761071 - RNA, 15 nt, Leptospira interrogans serovar lai str. 56601
uucaauuauuauaaa

SEQ ID NO: 761072 - RNA, 18 nt, Leptospira interrogans serovar lai str. 56601
uucaauucaucugaacua

SEQ ID NO: 761073 - RNA, 13 nt, Leptospira interrogans serovar lai str. 56601
uucaauuuuuaua

SEQ ID NO: 761074 - RNA, 15 nt, Leptospira interrogans serovar lai str. 56601
uucaauuuucucaaa

SEQ ID NO: 761075 - RNA, 19 nt, Leptospira interrogans serovar lai str. 56601
uucaauuuucucaaaaaau

SEQ ID NO: 761076 - RNA, 23 nt, Leptospira interrogans serovar lai str. 56601
uucaauuucuuuaauuucaauaa

SEQ ID NO: 761077 - RNA, 14 nt, Leptospira interrogans serovar lai str. 56601
uucaauuuuugaaa

SEQ ID NO: 761078 - RNA, 12 nt, Leptospira interrogans serovar lai str. 56601
uucacaaaaaaa

SEQ ID NO: 761079 - RNA, 13 nt, Leptospira interrogans serovar lai str. 56601
uucacaaaaaaau

SEQ ID NO: 761080 - RNA, 14 nt, Leptospira interrogans serovar lai str. 56601
uucacaaaaaaauu

SEQ ID NO: 761081 - RNA, 21 nt, Leptospira interrogans serovar lai str. 56601
uucacaaacgguuuuaguaaa

SEQ ID NO: 761082 - RNA, 13 nt, Leptospira interrogans serovar lai str. 56601
uucacaaaaauau

SEQ ID NO: 761083 - RNA, 15 nt, Leptospira interrogans serovar lai str. 56601
uuauugaugauugaa

SEQ ID NO: 761084 - RNA, 17 nt, Leptospira interrogans serovar lai str. 56601
uuauucguaaaaucuua

SEQ ID NO: 761085 - RNA, 13 nt, Leptospira interrogans serovar lai str. 56601
uuauucuaaacaa

SEQ ID NO: 761086 - RNA, 21 nt, Leptospira interrogans serovar lai str. 56601
uuauuuauauuucuaaaagaa

SEQ ID NO: 761087 - RNA, 20 nt, Leptospira interrogans serovar lai str. 56601
uuauuauuuuuguuaaacaa

SEQ ID NO: 761088 - RNA, 14 nt, Leptospira interrogans serovar lai str. 56601
uuauucaaaauauc

SEQ ID NO: 761089 - RNA, 21 nt, Leptospira interrogans serovar lai str. 56601
uuaggauaaaacggauuucuu

SEQ ID NO: 761090 - RNA, 19 nt, Leptospira interrogans serovar lai str. 56601
uuagggaucaaucugcaaa

SEQ ID NO: 761091 - RNA, 14 nt, Leptospira interrogans serovar lai str. 56601
uucaaagcaagaaa

SEQ ID NO: 761092 - RNA, 19 nt, Leptospira interrogans serovar lai str. 56601
uucaaagaugguggaauaa

SEQ ID NO: 761093 - RNA, 13 nt, Leptospira interrogans serovar lai str. 56601
uucaaauaaagaa

SEQ ID NO: 761094 - RNA, 10 nt, Leptospira interrogans serovar lai str. 56601
uuauuuuaac

SEQ ID NO: 761095 - RNA, 14 nt, Leptospira interrogans serovar lai str. 56601
uucaaacuugcaau

SEQ ID NO: 761096 - RNA, 17 nt, Leptospira interrogans serovar lai str. 56601
uucaaagaaauguggga

SEQ ID NO: 761097 - RNA, 17 nt, Leptospira interrogans serovar lai str. 56601
uucaaagaauauaaaau

SEQ ID NO: 761098 - RNA, 17 nt, Leptospira interrogans serovar lai str. 56601
uucaaagauaaaauaua

SEQ ID NO: 761099 - RNA, 17 nt, Leptospira interrogans serovar lai str. 56601
uucaacuuuagaaaaau

SEQ ID NO: 761100 - RNA, 18 nt, Leptospira interrogans serovar lai str. 56601
uucaacuuagaacuuguc

SEQ ID NO: 761101 - RNA, 12 nt, Leptospira interrogans serovar lai str. 56601
uucaaauuucug

SEQ ID NO: 761102 - RNA, 17 nt, Leptospira interrogans serovar lai str. 56601
uucaaauuucugaaaca

SEQ ID NO: 761103 - RNA, 14 nt, Leptospira interrogans serovar lai str. 56601
uucaacaacucuaa

SEQ ID NO: 761104 - RNA, 23 nt, Leptospira interrogans serovar lai str. 56601
uucaacaacucuaauacaaaaaa

SEQ ID NO: 761105 - RNA, 14 nt, Leptospira interrogans serovar lai str. 56601
uucaacaacucuau

SEQ ID NO: 761106 - RNA, 22 nt, Leptospira interrogans serovar lai str. 56601
uucaacaacucuauuaaagaag

SEQ ID NO: 761107 - RNA, 20 nt, Leptospira interrogans serovar lai str. 56601
uucaacaaacaaauagaaau

SEQ ID NO: 761108 - RNA, 21 nt, Leptospira interrogans serovar lai str. 56601
uucaacaaacaaauagaaaua

SEQ ID NO: 761109 - RNA, 13 nt, Leptospira interrogans serovar lai str. 56601
uucaaauuuaugu

SEQ ID NO: 761110 - RNA, 12 nt, Leptospira interrogans serovar lai str. 56601
uucaugagaaac

SEQ ID NO: 761111 - RNA, 14 nt, Leptospira interrogans serovar lai str. 56601
uucaugagaaacaa

SEQ ID NO: 761112 - RNA, 16 nt, Leptospira interrogans serovar lai str. 56601
uucaucuuuuccauug

SEQ ID NO: 761113 - RNA, 20 nt, Leptospira interrogans serovar lai str. 56601
uucaucuuugcgauuuuucc

SEQ ID NO: 761114 - RNA, 20 nt, Leptospira interrogans serovar lai str. 56601
uucauuaaacaauuuuucaa

SEQ ID NO: 761115 - RNA, 13 nt, Leptospira interrogans serovar lai str. 56601
uucauuacaaaac

SEQ ID NO: 761116 - RNA, 14 nt, Leptospira interrogans serovar lai str. 56601
uucauuucguaaaa

SEQ ID NO: 761117 - RNA, 12 nt, Leptospira interrogans serovar lai str. 56601
uucauuucgaaa

SEQ ID NO: 761118 - RNA, 19 nt, Leptospira interrogans serovar lai str. 56601
uucauuuaccuaaaauuca

SEQ ID NO: 761119 - RNA, 17 nt, Leptospira interrogans serovar lai str. 56601
uucauucagaccuuuuu

SEQ ID NO: 761120 - RNA, 14 nt, Leptospira interrogans serovar lai str. 56601
uucauucuaaagaa

SEQ ID NO: 761121 - RNA, 17 nt, Leptospira interrogans serovar lai str. 56601
uucauucugauucuaaa

SEQ ID NO: 761122 - RNA, 19 nt, Leptospira interrogans serovar lai str. 56601
uucauucugauucuaaaau

SEQ ID NO: 761123 - RNA, 18 nt, Leptospira interrogans serovar lai str. 56601
uucauuccuauaaauaaa

SEQ ID NO: 761124 - RNA, 21 nt, Leptospira interrogans serovar lai str. 56601
uuccaaaaacucaaagaauuu

SEQ ID NO: 761125 - RNA, 16 nt, Leptospira interrogans serovar lai str. 56601
uuccaaaaccucaaaa

SEQ ID NO: 761126 - RNA, 14 nt, Leptospira interrogans serovar lai str. 56601
uucauuuuucuaaa

SEQ ID NO: 761127 - RNA, 15 nt, Leptospira interrogans serovar lai str. 56601
uucauuuuucuacaa

SEQ ID NO: 761128 - RNA, 12 nt, Leptospira interrogans serovar lai str. 56601
uucauuuuucug

SEQ ID NO: 761129 - RNA, 15 nt, Leptospira interrogans serovar lai str. 56601
uucauuuuucugaaa

SEQ ID NO: 761130 - RNA, 18 nt, Leptospira interrogans serovar lai str. 56601
uucauuuugggauuuuau

SEQ ID NO: 761131 - RNA, 15 nt, Leptospira interrogans serovar lai str. 56601
uucauuuuacagaau

SEQ ID NO: 761132 - RNA, 16 nt, Leptospira interrogans serovar lai str. 56601
uuccaaaucugaaucu

SEQ ID NO: 761133 - RNA, 17 nt, Leptospira interrogans serovar lai str. 56601
uuccaaagauuuuaaaa

SEQ ID NO: 761134 - RNA, 15 nt, Leptospira interrogans serovar lai str. 56601
uuccaacguaccaaa

SEQ ID NO: 761135 - RNA, 22 nt, Leptospira interrogans serovar lai str. 56601
uuccaacuguuuauauaucuua

SEQ ID NO: 761136 - RNA, 12 nt, Leptospira interrogans serovar lai str. 56601
uuccaacuuuuu

SEQ ID NO: 761137 - RNA, 20 nt, Leptospira interrogans serovar lai str. 56601
uucaucaaacggucuuucuu

SEQ ID NO: 761138 - RNA, 20 nt, Leptospira interrogans serovar lai str. 56601
uucaucaaaguuauuucgau

SEQ ID NO: 761139 - RNA, 13 nt, Leptospira interrogans serovar lai str. 56601
uucauaucuaaaa

SEQ ID NO: 761140 - RNA, 14 nt, Leptospira interrogans serovar lai str. 56601
uucauaauucugaa

SEQ ID NO: 761141 - RNA, 15 nt, Leptospira interrogans serovar lai str. 56601
uucauaauucugaaa

SEQ ID NO: 761142 - RNA, 16 nt, Leptospira interrogans serovar lai str. 56601
uucauacuuuuaaaaa

SEQ ID NO: 761143 - RNA, 14 nt, Leptospira interrogans serovar lai str. 56601
uucauagaaaaaau

SEQ ID NO: 761144 - RNA, 14 nt, Leptospira interrogans serovar lai str. 56601
uucauauacaagac

SEQ ID NO: 761145 - RNA, 16 nt, Leptospira interrogans serovar lai str. 56601
uucauauaauaaaaau

SEQ ID NO: 761146 - RNA, 21 nt, Leptospira interrogans serovar lai str. 56601
uucagcgagugcgacuacgau

SEQ ID NO: 761147 - RNA, 17 nt, Leptospira interrogans serovar lai str. 56601
uucagugaauaaaauaa

SEQ ID NO: 761148 - RNA, 17 nt, Leptospira interrogans serovar lai str. 56601
uucauaauaaauuuuuc

SEQ ID NO: 761149 - RNA, 16 nt, Leptospira interrogans serovar lai str. 56601
uucauaacuauauaau

SEQ ID NO: 761150 - RNA, 18 nt, Leptospira interrogans serovar lai str. 56601
uucauaaaugauaauaau

SEQ ID NO: 761151 - RNA, 19 nt, Leptospira interrogans serovar lai str. 56601
uucauaaauacaaaguauu

SEQ ID NO: 761152 - RNA, 18 nt, Leptospira interrogans serovar lai str. 56601
uucaguucugagaccgcu

SEQ ID NO: 761153 - RNA, 13 nt, Leptospira interrogans serovar lai str. 56601
uucaguuuuacug

SEQ ID NO: 761154 - RNA, 17 nt, Leptospira interrogans serovar lai str. 56601
uucaguuuccacucuuu

SEQ ID NO: 761155 - RNA, 15 nt, Leptospira interrogans serovar lai str. 56601
uucuucuuccuuuuu

SEQ ID NO: 761156 - RNA, 13 nt, Leptospira interrogans serovar lai str. 56601
uucuucuucggua

SEQ ID NO: 761157 - RNA, 17 nt, Leptospira interrogans serovar lai str. 56601
uucuucuauuucuuauu

SEQ ID NO: 761158 - RNA, 13 nt, Leptospira interrogans serovar lai str. 56601
uucuuccuucuug

SEQ ID NO: 761159 - RNA, 17 nt, Leptospira interrogans serovar lai str. 56601
uucuucaauguuauaaa

SEQ ID NO: 761160 - RNA, 19 nt, Leptospira interrogans serovar lai str. 56601
uucuucagggcucauagaa

SEQ ID NO: 761161 - RNA, 13 nt, Leptospira interrogans serovar lai str. 56601
uucuucauaaaau

SEQ ID NO: 761162 - RNA, 13 nt, Leptospira interrogans serovar lai str. 56601
uucuuccaaaguc

SEQ ID NO: 761163 - RNA, 15 nt, Leptospira interrogans serovar lai str. 56601
uucuuccaaagucaa

SEQ ID NO: 761164 - RNA, 20 nt, Leptospira interrogans serovar lai str. 56601
uucuguuugaugaaauaguc

SEQ ID NO: 761165 - RNA, 15 nt, Leptospira interrogans serovar lai str. 56601
uucuuaaaaaaauga

SEQ ID NO: 761166 - RNA, 17 nt, Leptospira interrogans serovar lai str. 56601
uucuuaaaaaaaugauu

SEQ ID NO: 761167 - RNA, 13 nt, Leptospira interrogans serovar lai str. 56601
uucuguaaaaaua

SEQ ID NO: 761168 - RNA, 19 nt, Leptospira interrogans serovar lai str. 56601
uucuguaaaaauaaaaugu

SEQ ID NO: 761169 - RNA, 13 nt, Leptospira interrogans serovar lai str. 56601
uucuguaaaacuu

SEQ ID NO: 761170 - RNA, 13 nt, Leptospira interrogans serovar lai str. 56601
uucuuagaaaacu

SEQ ID NO: 761171 - RNA, 18 nt, Leptospira interrogans serovar lai str. 56601
uucuuauaucaaacuuau

SEQ ID NO: 761172 - RNA, 21 nt, Leptospira interrogans serovar lai str. 56601
uucuuagaccgaacucacaag

SEQ ID NO: 761173 - RNA, 15 nt, Leptospira interrogans serovar lai str. 56601
uucuuauguuuuuua

SEQ ID NO: 761174 - RNA, 15 nt, Leptospira interrogans serovar lai str. 56601
uucuuacaacuuuug

SEQ ID NO: 761175 - RNA, 20 nt, Leptospira interrogans serovar lai str. 56601
uucuuacaacuuuugaaacu

SEQ ID NO: 761176 - RNA, 15 nt, Leptospira interrogans serovar lai str. 56601
uucuuaauuuuacua

SEQ ID NO: 761177 - RNA, 21 nt, Leptospira interrogans serovar lai str. 56601
uucuuaauuguugcuauggaa

SEQ ID NO: 761178 - RNA, 18 nt, Leptospira interrogans serovar lai str. 56601
uucuuacucgacaaaaca

SEQ ID NO: 761179 - RNA, 14 nt, Leptospira interrogans serovar lai str. 56601
uucuuaaaauugug

SEQ ID NO: 761180 - RNA, 20 nt, Leptospira interrogans serovar lai str. 56601
uucuuaaauucuaaaaaaau

SEQ ID NO: 761181 - RNA, 15 nt, Leptospira interrogans serovar lai str. 56601
uucuuaaauaaaauu

SEQ ID NO: 761182 - RNA, 18 nt, Leptospira interrogans serovar lai str. 56601
uucuuaaauaaaauuuuc

SEQ ID NO: 761183 - RNA, 15 nt, Leptospira interrogans serovar lai str. 56601
uucuguugaguucau

SEQ ID NO: 761184 - RNA, 15 nt, Leptospira interrogans serovar lai str. 56601
uucuuaaaagauucu

SEQ ID NO: 761185 - RNA, 19 nt, Leptospira interrogans serovar lai str. 56601
uucuuaaaauguaggaacu

SEQ ID NO: 761186 - RNA, 23 nt, Leptospira interrogans serovar lai str. 56601
uucuuaaaauuccgaauucuaaa

SEQ ID NO: 761187 - RNA, 21 nt, Leptospira interrogans serovar lai str. 56601
uucucaaaaucuuaauaaaau

SEQ ID NO: 761188 - RNA, 23 nt, Leptospira interrogans serovar lai str. 56601
uucucaagaucauucuauuugga

SEQ ID NO: 761189 - RNA, 12 nt, Leptospira interrogans serovar lai str. 56601
uucucauucuug

SEQ ID NO: 761190 - RNA, 19 nt, Leptospira interrogans serovar lai str. 56601
uucuccacuuaaaaaguuu

SEQ ID NO: 761191 - RNA, 22 nt, Leptospira interrogans serovar lai str. 56601
uucuaucgaacuuacguaaaac

SEQ ID NO: 761192 - RNA, 15 nt, Leptospira interrogans serovar lai str. 56601
uucuauuuuaucaga

SEQ ID NO: 761193 - RNA, 12 nt, Leptospira interrogans serovar lai str. 56601
uucucaaaaaau

SEQ ID NO: 761194 - RNA, 17 nt, Leptospira interrogans serovar lai str. 56601
uucucaaaaaaugcauu

SEQ ID NO: 761195 - RNA, 13 nt, Leptospira interrogans serovar lai str. 56601
uucucaaaaaauu

SEQ ID NO: 761196 - RNA, 22 nt, Leptospira interrogans serovar lai str. 56601
uucuauuuucuuugaaaaaauu

SEQ ID NO: 761197 - RNA, 15 nt, Leptospira interrogans serovar lai str. 56601
uucuauuuugaguuu

SEQ ID NO: 761198 - RNA, 14 nt, Leptospira interrogans serovar lai str. 56601
uucuaucaaaaaau

SEQ ID NO: 761199 - RNA, 15 nt, Leptospira interrogans serovar lai str. 56601
uucuaucaaaaaauu

SEQ ID NO: 761200 - RNA, 17 nt, Leptospira interrogans serovar lai str. 56601
uucuauccauucuagaa

SEQ ID NO: 761201 - RNA, 18 nt, Leptospira interrogans serovar lai str. 56601
uucuauccauucuagaac

SEQ ID NO: 761202 - RNA, 17 nt, Leptospira interrogans serovar lai str. 56601
uucuacuuuauuaaaaa

SEQ ID NO: 761203 - RNA, 21 nt, Leptospira interrogans serovar lai str. 56601
uucuacuuuauuaaaaaguuu

SEQ ID NO: 761204 - RNA, 14 nt, Leptospira interrogans serovar lai str. 56601
uucuaaaaacucaa

SEQ ID NO: 761205 - RNA, 14 nt, Leptospira interrogans serovar lai str. 56601
uucuaaagccauuu

SEQ ID NO: 761206 - RNA, 15 nt, Leptospira interrogans serovar lai str. 56601
uucuagcgucuaaaa

SEQ ID NO: 761207 - RNA, 12 nt, Leptospira interrogans serovar lai str. 56601
uucuagacuuuc

SEQ ID NO: 761208 - RNA, 12 nt, Leptospira interrogans serovar lai str. 56601
uucuaaaauauc

SEQ ID NO: 761209 - RNA, 14 nt, Leptospira interrogans serovar lai str. 56601
uucuaaaauugaau

SEQ ID NO: 761210 - RNA, 15 nt, Leptospira interrogans serovar lai str. 56601
uucuaaaauugaaua

SEQ ID NO: 761211 - RNA, 14 nt, Leptospira interrogans serovar lai str. 56601
uucuaaaauuguag

SEQ ID NO: 761212 - RNA, 13 nt, Leptospira interrogans serovar lai str. 56601
uucuaaacaaaau

SEQ ID NO: 761213 - RNA, 12 nt, Leptospira interrogans serovar lai str. 56601
uucuaaaauauu

SEQ ID NO: 761214 - RNA, 20 nt, Leptospira interrogans serovar lai str. 56601
uucuaaaauauuugcauaaa

SEQ ID NO: 761215 - RNA, 21 nt, Leptospira interrogans serovar lai str. 56601
uucuaaaauauuugcauaaac

SEQ ID NO: 761216 - RNA, 21 nt, Leptospira interrogans serovar lai str. 56601
uucuaaaaucauacuuuuaaa

SEQ ID NO: 761217 - RNA, 22 nt, Leptospira interrogans serovar lai str. 56601
uucuaaaaucauacuuuuaaaa

SEQ ID NO: 761218 - RNA, 21 nt, Leptospira interrogans serovar lai str. 56601
uucuaaaauccuauucaacuu

SEQ ID NO: 761219 - RNA, 23 nt, Leptospira interrogans serovar lai str. 56601
uucuaaaauccuauucaacuugu

SEQ ID NO: 761220 - RNA, 13 nt, Leptospira interrogans serovar lai str. 56601
uucguuucuuaau

SEQ ID NO: 761221 - RNA, 13 nt, Leptospira interrogans serovar lai str. 56601
uucguuuuuguuu

SEQ ID NO: 761222 - RNA, 13 nt, Leptospira interrogans serovar lai str. 56601
uucuaaaaaaaau

SEQ ID NO: 761223 - RNA, 12 nt, Leptospira interrogans serovar lai str. 56601
uucuaaaaaaau

SEQ ID NO: 761224 - RNA, 13 nt, Leptospira interrogans serovar lai str. 56601
uucuaaaaaaauu

SEQ ID NO: 761225 - RNA, 13 nt, Leptospira interrogans serovar lai str. 56601
uucuaaaaauuuc

SEQ ID NO: 761226 - RNA, 19 nt, Leptospira interrogans serovar lai str. 56601
uucuaaaaauuuuuuuaaa

SEQ ID NO: 761227 - RNA, 16 nt, Leptospira interrogans serovar lai str. 56601
uucguuuuauaaaaac

SEQ ID NO: 761228 - RNA, 14 nt, Leptospira interrogans serovar lai str. 56601
uucugcucuucuaa

SEQ ID NO: 761229 - RNA, 15 nt, Leptospira interrogans serovar lai str. 56601
uucugauagagaaaa

SEQ ID NO: 761230 - RNA, 17 nt, Leptospira interrogans serovar lai str. 56601
uucugauagagaaaaau

SEQ ID NO: 761231 - RNA, 17 nt, Leptospira interrogans serovar lai str. 56601
uucugauaaagaaaacc

SEQ ID NO: 761232 - RNA, 22 nt, Leptospira interrogans serovar lai str. 56601
uucugaggaggauuagaagaau

SEQ ID NO: 761233 - RNA, 19 nt, Leptospira interrogans serovar lai str. 56601
uucuggaaaaauuccuaaa

SEQ ID NO: 761234 - RNA, 17 nt, Leptospira interrogans serovar lai str. 56601
uucugaaccaaauacuu

SEQ ID NO: 761235 - RNA, 17 nt, Leptospira interrogans serovar lai str. 56601
uucugaauaaaaauacu

SEQ ID NO: 761236 - RNA, 16 nt, Leptospira interrogans serovar lai str. 56601
uucugaacaagaauuu

SEQ ID NO: 761237 - RNA, 22 nt, Leptospira interrogans serovar lai str. 56601
uucugaaauuguuuuaaaacuu

SEQ ID NO: 761238 - RNA, 21 nt, Leptospira interrogans serovar lai str. 56601
uucugaaagugaaaguaaucu

SEQ ID NO: 761239 - RNA, 23 nt, Leptospira interrogans serovar lai str. 56601
uucucuuuugaccaaaagagguc

SEQ ID NO: 761240 - RNA, 23 nt, Leptospira interrogans serovar lai str. 56601
uucucuuuuuagacaaaaauacu

SEQ ID NO: 761241 - RNA, 15 nt, Leptospira interrogans serovar lai str. 56601
uucugaaaaaaguua

SEQ ID NO: 761242 - RNA, 21 nt, Leptospira interrogans serovar lai str. 56601
uucugaaaaaaguuagaaucu

SEQ ID NO: 761243 - RNA, 15 nt, Leptospira interrogans serovar lai str. 56601
uucugaaaaaaguug

SEQ ID NO: 761244 - RNA, 21 nt, Leptospira interrogans serovar lai str. 56601
uucugaaaaaaguuggaauuu

SEQ ID NO: 761245 - RNA, 14 nt, Leptospira interrogans serovar lai str. 56601
uucugaaaaaguua

SEQ ID NO: 761246 - RNA, 20 nt, Leptospira interrogans serovar lai str. 56601
uucucccuuaccuccuuuuu

SEQ ID NO: 761247 - RNA, 20 nt, Leptospira interrogans serovar lai str. 56601
uucuccauuuguuucuauuu

SEQ ID NO: 761248 - RNA, 17 nt, Leptospira interrogans serovar lai str. 56601
uucuccuccgaaaguaa

SEQ ID NO: 761249 - RNA, 16 nt, Leptospira interrogans serovar lai str. 56601
uucuccuccugaaaau

SEQ ID NO: 761250 - RNA, 19 nt, Leptospira interrogans serovar lai str. 56601
uucggcagccaauuccaaa

SEQ ID NO: 761251 - RNA, 16 nt, Leptospira interrogans serovar lai str. 56601
uucgcguuaauauaau

SEQ ID NO: 761252 - RNA, 12 nt, Leptospira interrogans serovar lai str. 56601
uucggaucgaaa

SEQ ID NO: 761253 - RNA, 21 nt, Leptospira interrogans serovar lai str. 56601
uucggguuccguagaacgaau

SEQ ID NO: 761254 - RNA, 15 nt, Leptospira interrogans serovar lai str. 56601
uucgugaacuuuaga

SEQ ID NO: 761255 - RNA, 18 nt, Leptospira interrogans serovar lai str. 56601
uucgucguuuagaggaag

SEQ ID NO: 761256 - RNA, 12 nt, Leptospira interrogans serovar lai str. 56601
uucguucuuuuu

SEQ ID NO: 761257 - RNA, 14 nt, Leptospira interrogans serovar lai str. 56601
uucguucuuuuuuc

SEQ ID NO: 761258 - RNA, 14 nt, Leptospira interrogans serovar lai str. 56601
uucgaucuaagaaa

SEQ ID NO: 761259 - RNA, 22 nt, Leptospira interrogans serovar lai str. 56601
uucgauguauggcucauuuuuc

SEQ ID NO: 761260 - RNA, 17 nt, Leptospira interrogans serovar lai str. 56601
uucgauguaagaaaaua

SEQ ID NO: 761261 - RNA, 19 nt, Leptospira interrogans serovar lai str. 56601
uucgauguaagaaaauauu

SEQ ID NO: 761262 - RNA, 14 nt, Leptospira interrogans serovar lai str. 56601
uucgauuaaaauaa

SEQ ID NO: 761263 - RNA, 14 nt, Leptospira interrogans serovar lai str. 56601
uucgaguccuuuuu

SEQ ID NO: 761264 - RNA, 22 nt, Leptospira interrogans serovar lai str. 56601
uucgacuucuuuuuuguaaguu

SEQ ID NO: 761265 - RNA, 15 nt, Leptospira interrogans serovar lai str. 56601
uucgcaaaaaaaauu

SEQ ID NO: 761266 - RNA, 11 nt, Leptospira interrogans serovar lai str. 56601
uuccuaaaauu

SEQ ID NO: 761267 - RNA, 12 nt, Leptospira interrogans serovar lai str. 56601
uuccuaaaauuu

SEQ ID NO: 761268 - RNA, 19 nt, Leptospira interrogans serovar lai str. 56601
uuccuaaaacaccuucucu

SEQ ID NO: 761269 - RNA, 19 nt, Leptospira interrogans serovar lai str. 56601
uuccuaacuuugaaaauuu

SEQ ID NO: 761270 - RNA, 20 nt, Leptospira interrogans serovar lai str. 56601
uuccuaaucuuauucaauaa

SEQ ID NO: 761271 - RNA, 21 nt, Leptospira interrogans serovar lai str. 56601
uuccuaaugcagcuucuucca

SEQ ID NO: 761272 - RNA, 14 nt, Leptospira interrogans serovar lai str. 56601
uuccgucuuuugua

SEQ ID NO: 761273 - RNA, 21 nt, Leptospira interrogans serovar lai str. 56601
uuccgucuuuuguaaguuuuc

SEQ ID NO: 761274 - RNA, 20 nt, Leptospira interrogans serovar lai str. 56601
uuccgguaaguaauauauca

SEQ ID NO: 761275 - RNA, 19 nt, Leptospira interrogans serovar lai str. 56601
uuccgguaauuauaauuga

SEQ ID NO: 761276 - RNA, 19 nt, Leptospira interrogans serovar lai str. 56601
uuccguauccuuaaaauga

SEQ ID NO: 761277 - RNA, 16 nt, Leptospira interrogans serovar lai str. 56601
uuccgucaaaucaucu

SEQ ID NO: 761278 - RNA, 17 nt, Leptospira interrogans serovar lai str. 56601
uuccuucuugaaauaau

SEQ ID NO: 761279 - RNA, 12 nt, Leptospira interrogans serovar lai str. 56601
uuccuugaaaaa

SEQ ID NO: 761280 - RNA, 21 nt, Leptospira interrogans serovar lai str. 56601
uuccuucguuuuuguuuucuu

SEQ ID NO: 761281 - RNA, 17 nt, Leptospira interrogans serovar lai str. 56601
uuccuugaaaaaaaaca

SEQ ID NO: 761282 - RNA, 17 nt, Leptospira interrogans serovar lai str. 56601
uucgaacguauaaaaac

SEQ ID NO: 761283 - RNA, 22 nt, Leptospira interrogans serovar lai str. 56601
uucgaagauauaaucuaagauu

SEQ ID NO: 761284 - RNA, 17 nt, Leptospira interrogans serovar lai str. 56601
uucgaagcccauaaaaa

SEQ ID NO: 761285 - RNA, 23 nt, Leptospira interrogans serovar lai str. 56601
uucgacaauuguaacaguucuca

SEQ ID NO: 761286 - RNA, 16 nt, Leptospira interrogans serovar lai str. 56601
uucgacaacuuauaau

SEQ ID NO: 761287 - RNA, 20 nt, Leptospira interrogans serovar lai str. 56601
uucgaauucuuucuauuuuu

SEQ ID NO: 761288 - RNA, 18 nt, Leptospira interrogans serovar lai str. 56601
uucgaauuuuaguucucu

SEQ ID NO: 761289 - RNA, 20 nt, Leptospira interrogans serovar lai str. 56601
uucgaccuuaacucuuaaau

SEQ ID NO: 761290 - RNA, 13 nt, Leptospira interrogans serovar lai str. 56601
uucccuucuccug

SEQ ID NO: 761291 - RNA, 16 nt, Leptospira interrogans serovar lai str. 56601
uuccgccccacccaaa

SEQ ID NO: 761292 - RNA, 20 nt, Leptospira interrogans serovar lai str. 56601
uuccgccccacccaaaaaua

SEQ ID NO: 761293 - RNA, 23 nt, Leptospira interrogans serovar lai str. 56601
uuccgggaggaauuuuuaaaaag

SEQ ID NO: 761294 - RNA, 19 nt, Leptospira interrogans serovar lai str. 56601
uuccccccacccaaaaaua

SEQ ID NO: 761295 - RNA, 18 nt, Leptospira interrogans serovar lai str. 56601
uucccccgguucuagguu

SEQ ID NO: 761296 - RNA, 22 nt, Leptospira interrogans serovar lai str. 56601
uucccggucucgaauuguuuuu

SEQ ID NO: 761297 - RNA, 24 nt, Leptospira interrogans serovar lai str. 56601
uucccgcuggaaaaugaaaacgau

SEQ ID NO: 761298 - RNA, 18 nt, Leptospira interrogans serovar lai str. 56601
uucccuaguuccaauuaa

SEQ ID NO: 761299 - RNA, 13 nt, Leptospira interrogans serovar lai str. 56601
uucccucaauaau

SEQ ID NO: 761300 - RNA, 14 nt, Leptospira interrogans serovar lai str. 56601
uuguccuccagaac

SEQ ID NO: 761301 - RNA, 16 nt, Leptospira interrogans serovar lai str. 56601
uuguccuaaaauuuua

SEQ ID NO: 761302 - RNA, 15 nt, Leptospira interrogans serovar lai str. 56601
uuguccgaauccaag

SEQ ID NO: 761303 - RNA, 17 nt, Leptospira interrogans serovar lai str. 56601
uugucccaaaaacucaa

SEQ ID NO: 761304 - RNA, 22 nt, Leptospira interrogans serovar lai str. 56601
uugucccaaaaccucaaaaaau

SEQ ID NO: 761305 - RNA, 14 nt, Leptospira interrogans serovar lai str. 56601
uugucccaaaauuu

SEQ ID NO: 761306 - RNA, 16 nt, Leptospira interrogans serovar lai str. 56601
uugucccaaaauuucu

SEQ ID NO: 761307 - RNA, 18 nt, Leptospira interrogans serovar lai str. 56601
uugucccaaaauuucuaa

SEQ ID NO: 761308 - RNA, 21 nt, Leptospira interrogans serovar lai str. 56601
uugucccaaaauuuuauaauu

SEQ ID NO: 761309 - RNA, 20 nt, Leptospira interrogans serovar lai str. 56601
uugucagaccuaaaauugca

SEQ ID NO: 761310 - RNA, 19 nt, Leptospira interrogans serovar lai str. 56601
uuguauccgaaaaauucca

SEQ ID NO: 761311 - RNA, 21 nt, Leptospira interrogans serovar lai str. 56601
uuguauccauuucguuucccu

SEQ ID NO: 761312 - RNA, 23 nt, Leptospira interrogans serovar lai str. 56601
uuguauccauuucguuucccucu

SEQ ID NO: 761313 - RNA, 19 nt, Leptospira interrogans serovar lai str. 56601
uuguaugauuuauaguuuu

SEQ ID NO: 761314 - RNA, 19 nt, Leptospira interrogans serovar lai str. 56601
uuguauucugaugcaaauu

SEQ ID NO: 761315 - RNA, 19 nt, Leptospira interrogans serovar lai str. 56601
uuguaugugguaguuccca

SEQ ID NO: 761316 - RNA, 20 nt, Leptospira interrogans serovar lai str. 56601
uuguauuuucccgaaagaac

SEQ ID NO: 761317 - RNA, 15 nt, Leptospira interrogans serovar lai str. 56601
uuguagaauugaaag

SEQ ID NO: 761318 - RNA, 23 nt, Leptospira interrogans serovar lai str. 56601
uuguagacaaaucauagaguuuc

SEQ ID NO: 761319 - RNA, 16 nt, Leptospira interrogans serovar lai str. 56601
uuguacccuuaaaauc

SEQ ID NO: 761320 - RNA, 18 nt, Leptospira interrogans serovar lai str. 56601
uuguacaucuuaaaaaau

SEQ ID NO: 761321 - RNA, 14 nt, Leptospira interrogans serovar lai str. 56601
uuguacaaaaccgu

SEQ ID NO: 761322 - RNA, 15 nt, Leptospira interrogans serovar lai str. 56601
uuguaguucuacauu

SEQ ID NO: 761323 - RNA, 14 nt, Leptospira interrogans serovar lai str. 56601
uuguauaagaaaug

SEQ ID NO: 761324 - RNA, 11 nt, Leptospira interrogans serovar lai str. 56601
uuguaguuuug

SEQ ID NO: 761325 - RNA, 16 nt, Leptospira interrogans serovar lai str. 56601
uuguagauaaagguaa

SEQ ID NO: 761326 - RNA, 15 nt, Leptospira interrogans serovar lai str. 56601
uuguagaucaaaucu

SEQ ID NO: 761327 - RNA, 15 nt, Leptospira interrogans serovar lai str. 56601
uuguaggaacuacua

SEQ ID NO: 761328 - RNA, 15 nt, Leptospira interrogans serovar lai str. 56601
uuguaauaguuccca

SEQ ID NO: 761329 - RNA, 20 nt, Leptospira interrogans serovar lai str. 56601
uuguaauaguucccacaaau

SEQ ID NO: 761330 - RNA, 20 nt, Leptospira interrogans serovar lai str. 56601
uuguaauaguucccacaguu

SEQ ID NO: 761331 - RNA, 22 nt, Leptospira interrogans serovar lai str. 56601
uuguaauuuguucgaaauuggc

SEQ ID NO: 761332 - RNA, 21 nt, Leptospira interrogans serovar lai str. 56601
uuguaaaucgguucuauaaaa

SEQ ID NO: 761333 - RNA, 13 nt, Leptospira interrogans serovar lai str. 56601
uuguaauaaaaau

SEQ ID NO: 761334 - RNA, 19 nt, Leptospira interrogans serovar lai str. 56601
uuguaauaaaaauuuaaaa

SEQ ID NO: 761335 - RNA, 22 nt, Leptospira interrogans serovar lai str. 56601
uuguaaguaucuaaaaguuuuc

SEQ ID NO: 761336 - RNA, 17 nt, Leptospira interrogans serovar lai str. 56601
uuguaaagcaacugugg

SEQ ID NO: 761337 - RNA, 13 nt, Leptospira interrogans serovar lai str. 56601
uuguaaaauugcu

SEQ ID NO: 761338 - RNA, 17 nt, Leptospira interrogans serovar lai str. 56601
uuguaacaguucucaca

SEQ ID NO: 761339 - RNA, 18 nt, Leptospira interrogans serovar lai str. 56601
uugguuggauuccuuucu

SEQ ID NO: 761340 - RNA, 13 nt, Leptospira interrogans serovar lai str. 56601
uuguaaaaaaaca

SEQ ID NO: 761341 - RNA, 14 nt, Leptospira interrogans serovar lai str. 56601
uuguaaaaaaacau

SEQ ID NO: 761342 - RNA, 17 nt, Leptospira interrogans serovar lai str. 56601
uugguuuguaauaguuc

SEQ ID NO: 761343 - RNA, 13 nt, Leptospira interrogans serovar lai str. 56601
uuguuuuaaaauu

SEQ ID NO: 761344 - RNA, 14 nt, Leptospira interrogans serovar lai str. 56601
uuguuuuauaaaac

SEQ ID NO: 761345 - RNA, 14 nt, Leptospira interrogans serovar lai str. 56601
uuguuuuauagaaa

SEQ ID NO: 761346 - RNA, 14 nt, Leptospira interrogans serovar lai str. 56601
uuguuuuauucuaa

SEQ ID NO: 761347 - RNA, 12 nt, Leptospira interrogans serovar lai str. 56601
uuuaaaaauaua

SEQ ID NO: 761348 - RNA, 13 nt, Leptospira interrogans serovar lai str. 56601
uuuaaaaauauaa

SEQ ID NO: 761349 - RNA, 12 nt, Leptospira interrogans serovar lai str. 56601
uuuaaaaaguuc

SEQ ID NO: 761350 - RNA, 15 nt, Leptospira interrogans serovar lai str. 56601
uuguuuucuuuucuu

SEQ ID NO: 761351 - RNA, 12 nt, Leptospira interrogans serovar lai str. 56601
uuguuuguaaaa

SEQ ID NO: 761352 - RNA, 16 nt, Leptospira interrogans serovar lai str. 56601
uuguuuucuaaaggaa

SEQ ID NO: 761353 - RNA, 16 nt, Leptospira interrogans serovar lai str. 56601
uuguugaaaaauuaau

SEQ ID NO: 761354 - RNA, 14 nt, Leptospira interrogans serovar lai str. 56601
uuguugaaaaauuc

SEQ ID NO: 761355 - RNA, 17 nt, Leptospira interrogans serovar lai str. 56601
uuguugaaaaauuuccc

SEQ ID NO: 761356 - RNA, 18 nt, Leptospira interrogans serovar lai str. 56601
uuguugaaaaauuucccu

SEQ ID NO: 761357 - RNA, 15 nt, Leptospira interrogans serovar lai str. 56601
uuguucuggagaaag

SEQ ID NO: 761358 - RNA, 21 nt, Leptospira interrogans serovar lai str. 56601
uuguucuggagaaagauuuuc

SEQ ID NO: 761359 - RNA, 13 nt, Leptospira interrogans serovar lai str. 56601
uuguuccaaaacc

SEQ ID NO: 761360 - RNA, 15 nt, Leptospira interrogans serovar lai str. 56601
uuguuccuaaaaaau

SEQ ID NO: 761361 - RNA, 20 nt, Leptospira interrogans serovar lai str. 56601
uuguguucaucguuccaaac

SEQ ID NO: 761362 - RNA, 19 nt, Leptospira interrogans serovar lai str. 56601
uuguguuugauaauuugug

SEQ ID NO: 761363 - RNA, 17 nt, Leptospira interrogans serovar lai str. 56601
uugugucaagcccuccc

SEQ ID NO: 761364 - RNA, 17 nt, Leptospira interrogans serovar lai str. 56601
uugugucaagcccuccu

SEQ ID NO: 761365 - RNA, 15 nt, Leptospira interrogans serovar lai str. 56601
uuguguuaguuccca

SEQ ID NO: 761366 - RNA, 19 nt, Leptospira interrogans serovar lai str. 56601
uugugggaacuauuacaaa

SEQ ID NO: 761367 - RNA, 21 nt, Leptospira interrogans serovar lai str. 56601
uugugggaacuauuauaaaau

SEQ ID NO: 761368 - RNA, 17 nt, Leptospira interrogans serovar lai str. 56601
uuguggauuaugaagaa

SEQ ID NO: 761369 - RNA, 16 nt, Leptospira interrogans serovar lai str. 56601
uuguggcaagaggaac

SEQ ID NO: 761370 - RNA, 23 nt, Leptospira interrogans serovar lai str. 56601
uuguggaaacgucauaguuccca

SEQ ID NO: 761371 - RNA, 16 nt, Leptospira interrogans serovar lai str. 56601
uugugcuauauucaaa

SEQ ID NO: 761372 - RNA, 22 nt, Leptospira interrogans serovar lai str. 56601
uugugaucagugauucgaaauu

SEQ ID NO: 761373 - RNA, 14 nt, Leptospira interrogans serovar lai str. 56601
uugugaucucgauu

SEQ ID NO: 761374 - RNA, 14 nt, Leptospira interrogans serovar lai str. 56601
uugugagaguucca

SEQ ID NO: 761375 - RNA, 15 nt, Leptospira interrogans serovar lai str. 56601
uugugagaguuccca

SEQ ID NO: 761376 - RNA, 13 nt, Leptospira interrogans serovar lai str. 56601
uugugaauauuuc

SEQ ID NO: 761377 - RNA, 15 nt, Leptospira interrogans serovar lai str. 56601
uugugaaucaaaagg

SEQ ID NO: 761378 - RNA, 22 nt, Leptospira interrogans serovar lai str. 56601
uugugaacgcccagagauuguc

SEQ ID NO: 761379 - RNA, 21 nt, Leptospira interrogans serovar lai str. 56601
uugugacacugaaaacauuuu

SEQ ID NO: 761380 - RNA, 17 nt, Leptospira interrogans serovar lai str. 56601
uugugaaaaucuagauu

SEQ ID NO: 761381 - RNA, 13 nt, Leptospira interrogans serovar lai str. 56601
uugugaaacucaa

SEQ ID NO: 761382 - RNA, 12 nt, Leptospira interrogans serovar lai str. 56601
uugucuuuaugc

SEQ ID NO: 761383 - RNA, 22 nt, Leptospira interrogans serovar lai str. 56601
uugucuuuauucgcauaacauu

SEQ ID NO: 761384 - RNA, 14 nt, Leptospira interrogans serovar lai str. 56601
uugucuuuaaaauu

SEQ ID NO: 761385 - RNA, 14 nt, Leptospira interrogans serovar lai str. 56601
uugucucaaaauuu

SEQ ID NO: 761386 - RNA, 15 nt, Leptospira interrogans serovar lai str. 56601
uugucucaaaauuua

SEQ ID NO: 761387 - RNA, 22 nt, Leptospira interrogans serovar lai str. 56601
uugucuccugucaauuuuccag

SEQ ID NO: 761388 - RNA, 21 nt, Leptospira interrogans serovar lai str. 56601
uugucucgaaacccaaaaaug

SEQ ID NO: 761389 - RNA, 13 nt, Leptospira interrogans serovar lai str. 56601
uuuauuuaaaaac

SEQ ID NO: 761390 - RNA, 17 nt, Leptospira interrogans serovar lai str. 56601
uuuauugugaguuuaaa

SEQ ID NO: 761391 - RNA, 18 nt, Leptospira interrogans serovar lai str. 56601
uuuauuuaauaaaauuuu

SEQ ID NO: 761392 - RNA, 16 nt, Leptospira interrogans serovar lai str. 56601
uuuauuggaaaaaguc

SEQ ID NO: 761393 - RNA, 20 nt, Leptospira interrogans serovar lai str. 56601
uuuauugggucuacaauaaa

SEQ ID NO: 761394 - RNA, 18 nt, Leptospira interrogans serovar lai str. 56601
uuuauugaaaaauagaau

SEQ ID NO: 761395 - RNA, 22 nt, Leptospira interrogans serovar lai str. 56601
uuuauugagucaagauuauuuu

SEQ ID NO: 761396 - RNA, 16 nt, Leptospira interrogans serovar lai str. 56601
uuuauuacaauuuuau

SEQ ID NO: 761397 - RNA, 15 nt, Leptospira interrogans serovar lai str. 56601
uuuauuaaaaaguuu

SEQ ID NO: 761398 - RNA, 13 nt, Leptospira interrogans serovar lai str. 56601
uuuauuaaaaaua

SEQ ID NO: 761399 - RNA, 14 nt, Leptospira interrogans serovar lai str. 56601
uuuauguaagaaaa

SEQ ID NO: 761400 - RNA, 16 nt, Leptospira interrogans serovar lai str. 56601
uuuauguaagaaaaac

SEQ ID NO: 761401 - RNA, 15 nt, Leptospira interrogans serovar lai str. 56601
uuuauuaaaaauauc

SEQ ID NO: 761402 - RNA, 17 nt, Leptospira interrogans serovar lai str. 56601
uuuauuaaaaauaucua

SEQ ID NO: 761403 - RNA, 15 nt, Leptospira interrogans serovar lai str. 56601
uuuauuaaaaauuuu

SEQ ID NO: 761404 - RNA, 13 nt, Leptospira interrogans serovar lai str. 56601
uuuauuaaagaau

SEQ ID NO: 761405 - RNA, 19 nt, Leptospira interrogans serovar lai str. 56601
uuuauuaagaauuucuaaa

SEQ ID NO: 761406 - RNA, 23 nt, Leptospira interrogans serovar lai str. 56601
uuuaugaccuaauuuauuuguaa

SEQ ID NO: 761407 - RNA, 17 nt, Leptospira interrogans serovar lai str. 56601
uuuaucuauugaaacaa

SEQ ID NO: 761408 - RNA, 19 nt, Leptospira interrogans serovar lai str. 56601
uuuaucgauuuaaaaacua

SEQ ID NO: 761409 - RNA, 16 nt, Leptospira interrogans serovar lai str. 56601
uuuaucgcaaaacauu

SEQ ID NO: 761410 - RNA, 14 nt, Leptospira interrogans serovar lai str. 56601
uuuaucgcaaagcu

SEQ ID NO: 761411 - RNA, 15 nt, Leptospira interrogans serovar lai str. 56601
uuuaucuaaaacaca

SEQ ID NO: 761412 - RNA, 21 nt, Leptospira interrogans serovar lai str. 56601
uuuaucguacaucuucucuaa

SEQ ID NO: 761413 - RNA, 23 nt, Leptospira interrogans serovar lai str. 56601
uuuauauucgcuccguuuugaau

SEQ ID NO: 761414 - RNA, 20 nt, Leptospira interrogans serovar lai str. 56601
uuuaucaauuacgaaaacua

SEQ ID NO: 761415 - RNA, 19 nt, Leptospira interrogans serovar lai str. 56601
uuuaucaaauaaaguuuua

SEQ ID NO: 761416 - RNA, 13 nt, Leptospira interrogans serovar lai str. 56601
uuuaucagaaaaa

SEQ ID NO: 761417 - RNA, 13 nt, Leptospira interrogans serovar lai str. 56601
uuuaucauuucuu

SEQ ID NO: 761418 - RNA, 19 nt, Leptospira interrogans serovar lai str. 56601
uuuauauauauucacaaaa

SEQ ID NO: 761419 - RNA, 14 nt, Leptospira interrogans serovar lai str. 56601
uuuauauauauuuu

SEQ ID NO: 761420 - RNA, 14 nt, Leptospira interrogans serovar lai str. 56601
uuuauaauucugaa

SEQ ID NO: 761421 - RNA, 16 nt, Leptospira interrogans serovar lai str. 56601
uuuauaauugaacauu

SEQ ID NO: 761422 - RNA, 20 nt, Leptospira interrogans serovar lai str. 56601
uuuauaauugaacauuuuua

SEQ ID NO: 761423 - RNA, 23 nt, Leptospira interrogans serovar lai str. 56601
uuuauaauugaacauuuuuaaaa

SEQ ID NO: 761424 - RNA, 21 nt, Leptospira interrogans serovar lai str. 56601
uuuauaauguuugaauuuuua

SEQ ID NO: 761425 - RNA, 11 nt, Leptospira interrogans serovar lai str. 56601
uuuauaauuca

SEQ ID NO: 761426 - RNA, 14 nt, Leptospira interrogans serovar lai str. 56601
uuuauaauucaaag

SEQ ID NO: 761427 - RNA, 21 nt, Leptospira interrogans serovar lai str. 56601
uuuauaauucccguuauaaau

SEQ ID NO: 761428 - RNA, 21 nt, Leptospira interrogans serovar lai str. 56601
uuuauaauagaguuacagaaa

SEQ ID NO: 761429 - RNA, 19 nt, Leptospira interrogans serovar lai str. 56601
uuuauaagagagauauaca

SEQ ID NO: 761430 - RNA, 19 nt, Leptospira interrogans serovar lai str. 56601
uuuauaacgggaauuauaa

SEQ ID NO: 761431 - RNA, 22 nt, Leptospira interrogans serovar lai str. 56601
uuuauaacuuacugauuucuau

SEQ ID NO: 761432 - RNA, 16 nt, Leptospira interrogans serovar lai str. 56601
uuuagagccaaauuuu

SEQ ID NO: 761433 - RNA, 17 nt, Leptospira interrogans serovar lai str. 56601
uuuagaguuaagagaau

SEQ ID NO: 761434 - RNA, 18 nt, Leptospira interrogans serovar lai str. 56601
uuuagaguuguuaaaaaa

SEQ ID NO: 761435 - RNA, 20 nt, Leptospira interrogans serovar lai str. 56601
uuuagacguaggaaaugaaa

SEQ ID NO: 761436 - RNA, 22 nt, Leptospira interrogans serovar lai str. 56601
uuuagacguaggaaaugaaaaa

SEQ ID NO: 761437 - RNA, 21 nt, Leptospira interrogans serovar lai str. 56601
uuuagacuucucuuuucgaaa

SEQ ID NO: 761438 - RNA, 20 nt, Leptospira interrogans serovar lai str. 56601
uuuagauaaggcuaaagaau

SEQ ID NO: 761439 - RNA, 15 nt, Leptospira interrogans serovar lai str. 56601
uuuagauaauuauuc

SEQ ID NO: 761440 - RNA, 20 nt, Leptospira interrogans serovar lai str. 56601
uuuagauauuuauaaugaau

SEQ ID NO: 761441 - RNA, 14 nt, Leptospira interrogans serovar lai str. 56601
uuuagaucuaaauu

SEQ ID NO: 761442 - RNA, 21 nt, Leptospira interrogans serovar lai str. 56601
uuuagaaucagaaugaacuca

SEQ ID NO: 761443 - RNA, 17 nt, Leptospira interrogans serovar lai str. 56601
uuuagcaauuugugaac

SEQ ID NO: 761444 - RNA, 22 nt, Leptospira interrogans serovar lai str. 56601
uuuagauuuguguuaguuccca

SEQ ID NO: 761445 - RNA, 16 nt, Leptospira interrogans serovar lai str. 56601
uuuagauuuuaacuuu

SEQ ID NO: 761446 - RNA, 22 nt, Leptospira interrogans serovar lai str. 56601
uuuagcaaauaacgauuccauu

SEQ ID NO: 761447 - RNA, 14 nt, Leptospira interrogans serovar lai str. 56601
uuuagcauuuuuaa

SEQ ID NO: 761448 - RNA, 15 nt, Leptospira interrogans serovar lai str. 56601
uuuacuacgucuucu

SEQ ID NO: 761449 - RNA, 13 nt, Leptospira interrogans serovar lai str. 56601
uuuacuucaauua

SEQ ID NO: 761450 - RNA, 15 nt, Leptospira interrogans serovar lai str. 56601
uuuacuucaauuauc

SEQ ID NO: 761451 - RNA, 23 nt, Leptospira interrogans serovar lai str. 56601
uuuacuucauccgggcuuuucuu

SEQ ID NO: 761452 - RNA, 23 nt, Leptospira interrogans serovar lai str. 56601
uuuacuucccagacguaucaaaa

SEQ ID NO: 761453 - RNA, 23 nt, Leptospira interrogans serovar lai str. 56601
uuuacuaaaaaacauaaaaauuu

SEQ ID NO: 761454 - RNA, 13 nt, Leptospira interrogans serovar lai str. 56601
uuuacuaaaagua

SEQ ID NO: 761455 - RNA, 13 nt, Leptospira interrogans serovar lai str. 56601
uuuagaauauuaa

SEQ ID NO: 761456 - RNA, 20 nt, Leptospira interrogans serovar lai str. 56601
uuuagaauauuaugaaauaa

SEQ ID NO: 761457 - RNA, 13 nt, Leptospira interrogans serovar lai str. 56601
uuuagaauuuguu

SEQ ID NO: 761458 - RNA, 20 nt, Leptospira interrogans serovar lai str. 56601
uuuagaauuuguucgugaaa

SEQ ID NO: 761459 - RNA, 15 nt, Leptospira interrogans serovar lai str. 56601
uuuagaauuuucuaa

SEQ ID NO: 761460 - RNA, 16 nt, Leptospira interrogans serovar lai str. 56601
uuuagaauuuucuaaa

SEQ ID NO: 761461 - RNA, 17 nt, Leptospira interrogans serovar lai str. 56601
uuuagaacgcaaucugu

SEQ ID NO: 761462 - RNA, 20 nt, Leptospira interrogans serovar lai str. 56601
uuuagaaauuuuuaauaaaa

SEQ ID NO: 761463 - RNA, 19 nt, Leptospira interrogans serovar lai str. 56601
uuuagaaaucgauuuguaa

SEQ ID NO: 761464 - RNA, 16 nt, Leptospira interrogans serovar lai str. 56601
uuuagaacuugucuca

SEQ ID NO: 761465 - RNA, 13 nt, Leptospira interrogans serovar lai str. 56601
uuuagaagauuga

SEQ ID NO: 761466 - RNA, 17 nt, Leptospira interrogans serovar lai str. 56601
uuuacuugcaaaaagua

SEQ ID NO: 761467 - RNA, 21 nt, Leptospira interrogans serovar lai str. 56601
uuuacuugcaaaaaguauguu

SEQ ID NO: 761468 - RNA, 22 nt, Leptospira interrogans serovar lai str. 56601
uuuagaaaaagcacaaaacgau

SEQ ID NO: 761469 - RNA, 16 nt, Leptospira interrogans serovar lai str. 56601
uuuagaaaaauauuau

SEQ ID NO: 761470 - RNA, 22 nt, Leptospira interrogans serovar lai str. 56601
uuuacaugagacuauaaaguuu

SEQ ID NO: 761471 - RNA, 14 nt, Leptospira interrogans serovar lai str. 56601
uuuacacgauaauu

SEQ ID NO: 761472 - RNA, 14 nt, Leptospira interrogans serovar lai str. 56601
uuuacggaucaauu

SEQ ID NO: 761473 - RNA, 16 nt, Leptospira interrogans serovar lai str. 56601
uuuacggcauuuuuua

SEQ ID NO: 761474 - RNA, 19 nt, Leptospira interrogans serovar lai str. 56601
uuuaccguuuuuaaaugug

SEQ ID NO: 761475 - RNA, 15 nt, Leptospira interrogans serovar lai str. 56601
uuuaccuaaaauuca

SEQ ID NO: 761476 - RNA, 21 nt, Leptospira interrogans serovar lai str. 56601
uuuaccuaaaauucaguuuca

SEQ ID NO: 761477 - RNA, 15 nt, Leptospira interrogans serovar lai str. 56601
uuuacauuuuuaaau

SEQ ID NO: 761478 - RNA, 18 nt, Leptospira interrogans serovar lai str. 56601
uuuaccggguuccauucu

SEQ ID NO: 761479 - RNA, 19 nt, Leptospira interrogans serovar lai str. 56601
uuuaaguagaaccuaaaaa

SEQ ID NO: 761480 - RNA, 21 nt, Leptospira interrogans serovar lai str. 56601
uuuaaguagaaccuaaaaaua

SEQ ID NO: 761481 - RNA, 20 nt, Leptospira interrogans serovar lai str. 56601
uuuaaguaauauuucucuca

SEQ ID NO: 761482 - RNA, 15 nt, Leptospira interrogans serovar lai str. 56601
uuuaaguucaaaaaa

SEQ ID NO: 761483 - RNA, 14 nt, Leptospira interrogans serovar lai str. 56601
uuuaaguuugugag

SEQ ID NO: 761484 - RNA, 12 nt, Leptospira interrogans serovar lai str. 56601
uuuaauaaaaug

SEQ ID NO: 761485 - RNA, 14 nt, Leptospira interrogans serovar lai str. 56601
uuuaauaaaaugca

SEQ ID NO: 761486 - RNA, 21 nt, Leptospira interrogans serovar lai str. 56601
uuuaaaacgaacuuuucuaua

SEQ ID NO: 761487 - RNA, 13 nt, Leptospira interrogans serovar lai str. 56601
uuuaaaaaugaaa

SEQ ID NO: 761488 - RNA, 20 nt, Leptospira interrogans serovar lai str. 56601
uuuaaaaauucguuuuacuu

SEQ ID NO: 761489 - RNA, 14 nt, Leptospira interrogans serovar lai str. 56601
uuuaaaaauucugu

SEQ ID NO: 761490 - RNA, 22 nt, Leptospira interrogans serovar lai str. 56601
uuuaaaaauucugucguaaaaa

SEQ ID NO: 761491 - RNA, 13 nt, Leptospira interrogans serovar lai str. 56601
uuuaaaaauuucc

SEQ ID NO: 761492 - RNA, 16 nt, Leptospira interrogans serovar lai str. 56601
uuuaaaaauuuccuuu

SEQ ID NO: 761493 - RNA, 20 nt, Leptospira interrogans serovar lai str. 56601
uuuaagauugauuuuaauuu

SEQ ID NO: 761494 - RNA, 18 nt, Leptospira interrogans serovar lai str. 56601
uuuaagcaguuuuacugu

SEQ ID NO: 761495 - RNA, 22 nt, Leptospira interrogans serovar lai str. 56601
uuuaagaauuuaucauuucuuu

SEQ ID NO: 761496 - RNA, 14 nt, Leptospira interrogans serovar lai str. 56601
uuuaagacucagca

SEQ ID NO: 761497 - RNA, 18 nt, Leptospira interrogans serovar lai str. 56601
uuuaacuuuuauucucuu

SEQ ID NO: 761498 - RNA, 18 nt, Leptospira interrogans serovar lai str. 56601
uuuaauaguuuauacuuu

SEQ ID NO: 761499 - RNA, 12 nt, Leptospira interrogans serovar lai str. 56601
uuuaauaauuca

SEQ ID NO: 761500 - RNA, 18 nt, Leptospira interrogans serovar lai str. 56601
uuuaauaccuaauucucu

SEQ ID NO: 761501 - RNA, 18 nt, Leptospira interrogans serovar lai str. 56601
uuuaauaauaugaauuca

SEQ ID NO: 761502 - RNA, 17 nt, Leptospira interrogans serovar lai str. 56601
uuuaaucaaaauuucuu

SEQ ID NO: 761503 - RNA, 22 nt, Leptospira interrogans serovar lai str. 56601
uuuaaucaugugaauucagaaa

SEQ ID NO: 761504 - RNA, 18 nt, Leptospira interrogans serovar lai str. 56601
uuuaaugaaaaauuucuu

SEQ ID NO: 761505 - RNA, 12 nt, Leptospira interrogans serovar lai str. 56601
uuuaaugagaaa

SEQ ID NO: 761506 - RNA, 18 nt, Leptospira interrogans serovar lai str. 56601
uuggguuuuacuaaaaaa

SEQ ID NO: 761507 - RNA, 22 nt, Leptospira interrogans serovar lai str. 56601
uugguagauugcuuuuuaaaag

SEQ ID NO: 761508 - RNA, 15 nt, Leptospira interrogans serovar lai str. 56601
uuggguauuuauuau

SEQ ID NO: 761509 - RNA, 12 nt, Leptospira interrogans serovar lai str. 56601
uuggggaaguaa

SEQ ID NO: 761510 - RNA, 20 nt, Leptospira interrogans serovar lai str. 56601
uugguauuuuagguauuucu

SEQ ID NO: 761511 - RNA, 20 nt, Leptospira interrogans serovar lai str. 56601
uuggugauaaucaucaaaau

SEQ ID NO: 761512 - RNA, 21 nt, Leptospira interrogans serovar lai str. 56601
uugguucaaaguuuucacaaa

SEQ ID NO: 761513 - RNA, 19 nt, Leptospira interrogans serovar lai str. 56601
uuggcgacaaaaggauucc

SEQ ID NO: 761514 - RNA, 22 nt, Leptospira interrogans serovar lai str. 56601
uuggcgacaaaaggauuccauu

SEQ ID NO: 761515 - RNA, 16 nt, Leptospira interrogans serovar lai str. 56601
uuggccucgaaaguuu

SEQ ID NO: 761516 - RNA, 23 nt, Leptospira interrogans serovar lai str. 56601
uuggccucgaaaguuuacacaac

SEQ ID NO: 761517 - RNA, 17 nt, Leptospira interrogans serovar lai str. 56601
uugggaucuaaacuuug

SEQ ID NO: 761518 - RNA, 14 nt, Leptospira interrogans serovar lai str. 56601
uugggaucugaauu

SEQ ID NO: 761519 - RNA, 16 nt, Leptospira interrogans serovar lai str. 56601
uugggauauucugaaa

SEQ ID NO: 761520 - RNA, 20 nt, Leptospira interrogans serovar lai str. 56601
uugggauaaauauucucuau

SEQ ID NO: 761521 - RNA, 22 nt, Leptospira interrogans serovar lai str. 56601
uugggagacucuaguaaagaaa

SEQ ID NO: 761522 - RNA, 20 nt, Leptospira interrogans serovar lai str. 56601
uugcuuugaaugacacaaaa

SEQ ID NO: 761523 - RNA, 12 nt, Leptospira interrogans serovar lai str. 56601
uugcuuuuuaaa

SEQ ID NO: 761524 - RNA, 19 nt, Leptospira interrogans serovar lai str. 56601
uugcuuaaagcauuaaaaa

SEQ ID NO: 761525 - RNA, 23 nt, Leptospira interrogans serovar lai str. 56601
uugcuauggaauuuuuucaaaaa

SEQ ID NO: 761526 - RNA, 15 nt, Leptospira interrogans serovar lai str. 56601
uugcugucauaaacc

SEQ ID NO: 761527 - RNA, 21 nt, Leptospira interrogans serovar lai str. 56601
uugcugguuguaaguaucuaa

SEQ ID NO: 761528 - RNA, 18 nt, Leptospira interrogans serovar lai str. 56601
uugcuguaaaauuuagau

SEQ ID NO: 761529 - RNA, 17 nt, Leptospira interrogans serovar lai str. 56601
uuggaaucuaaacuuug

SEQ ID NO: 761530 - RNA, 13 nt, Leptospira interrogans serovar lai str. 56601
uuggaaucugaau

SEQ ID NO: 761531 - RNA, 17 nt, Leptospira interrogans serovar lai str. 56601
uuggacgaauccugcua

SEQ ID NO: 761532 - RNA, 21 nt, Leptospira interrogans serovar lai str. 56601
uuggaaagccccagaacaaau

SEQ ID NO: 761533 - RNA, 14 nt, Leptospira interrogans serovar lai str. 56601
uuggaaaucgaaaa

SEQ ID NO: 761534 - RNA, 16 nt, Leptospira interrogans serovar lai str. 56601
uuggaauaaaaucaua

SEQ ID NO: 761535 - RNA, 14 nt, Leptospira interrogans serovar lai str. 56601
uuggaaauugacuu

SEQ ID NO: 761536 - RNA, 19 nt, Leptospira interrogans serovar lai str. 56601
uuggcaauuugugaacuuu

SEQ ID NO: 761537 - RNA, 14 nt, Leptospira interrogans serovar lai str. 56601
uuggauagcaaaaa

SEQ ID NO: 761538 - RNA, 13 nt, Leptospira interrogans serovar lai str. 56601
uuggaucuguaau

SEQ ID NO: 761539 - RNA, 18 nt, Leptospira interrogans serovar lai str. 56601
uuggaucgguuuuagaau

SEQ ID NO: 761540 - RNA, 14 nt, Leptospira interrogans serovar lai str. 56601
uuggaucguguaau

SEQ ID NO: 761541 - RNA, 13 nt, Leptospira interrogans serovar lai str. 56601
uuggauuccuuuc

SEQ ID NO: 761542 - RNA, 23 nt, Leptospira interrogans serovar lai str. 56601
uugccagcguccgcaauauccca

SEQ ID NO: 761543 - RNA, 19 nt, Leptospira interrogans serovar lai str. 56601
uugccuuucaccagaauuu

SEQ ID NO: 761544 - RNA, 21 nt, Leptospira interrogans serovar lai str. 56601
uugccgucccaucaaguuuuu

SEQ ID NO: 761545 - RNA, 14 nt, Leptospira interrogans serovar lai str. 56601
uugcgauuuuuccg

SEQ ID NO: 761546 - RNA, 13 nt, Leptospira interrogans serovar lai str. 56601
uugcaugaaauca

SEQ ID NO: 761547 - RNA, 17 nt, Leptospira interrogans serovar lai str. 56601
uugauuauaaccugcaa

SEQ ID NO: 761548 - RNA, 13 nt, Leptospira interrogans serovar lai str. 56601
uugauuauagaac

SEQ ID NO: 761549 - RNA, 16 nt, Leptospira interrogans serovar lai str. 56601
uugauuuacauucugg

SEQ ID NO: 761550 - RNA, 14 nt, Leptospira interrogans serovar lai str. 56601
uugauguaaagaaa

SEQ ID NO: 761551 - RNA, 20 nt, Leptospira interrogans serovar lai str. 56601
uugauaccgggauuuuaaaa

SEQ ID NO: 761552 - RNA, 15 nt, Leptospira interrogans serovar lai str. 56601
uugauaccuaaugcu

SEQ ID NO: 761553 - RNA, 13 nt, Leptospira interrogans serovar lai str. 56601
uugauaauuucau

SEQ ID NO: 761554 - RNA, 15 nt, Leptospira interrogans serovar lai str. 56601
uugauaauuucauua

SEQ ID NO: 761555 - RNA, 16 nt, Leptospira interrogans serovar lai str. 56601
uugauaauuucauuau

SEQ ID NO: 761556 - RNA, 15 nt, Leptospira interrogans serovar lai str. 56601
uugauaauuugugaa

SEQ ID NO: 761557 - RNA, 16 nt, Leptospira interrogans serovar lai str. 56601
uugauauaaucuuaau

SEQ ID NO: 761558 - RNA, 17 nt, Leptospira interrogans serovar lai str. 56601
uugaucucauaaagaca

SEQ ID NO: 761559 - RNA, 22 nt, Leptospira interrogans serovar lai str. 56601
uugaucuuguauaagaaaugag

SEQ ID NO: 761560 - RNA, 13 nt, Leptospira interrogans serovar lai str. 56601
uugaucuuuaaaa

SEQ ID NO: 761561 - RNA, 23 nt, Leptospira interrogans serovar lai str. 56601
uugaguguuuuuaguuuucauua

SEQ ID NO: 761562 - RNA, 16 nt, Leptospira interrogans serovar lai str. 56601
uugaguucauucugau

SEQ ID NO: 761563 - RNA, 16 nt, Leptospira interrogans serovar lai str. 56601
uugagguuuuaaaagu

SEQ ID NO: 761564 - RNA, 18 nt, Leptospira interrogans serovar lai str. 56601
uugagggguuuuuccuuu

SEQ ID NO: 761565 - RNA, 15 nt, Leptospira interrogans serovar lai str. 56601
uucuugucggaacac

SEQ ID NO: 761566 - RNA, 19 nt, Leptospira interrogans serovar lai str. 56601
uucuuggguucaauaaaac

SEQ ID NO: 761567 - RNA, 19 nt, Leptospira interrogans serovar lai str. 56601
uugagcaguucuaaucucg

SEQ ID NO: 761568 - RNA, 15 nt, Leptospira interrogans serovar lai str. 56601
uugagcauaaaaaaa

SEQ ID NO: 761569 - RNA, 16 nt, Leptospira interrogans serovar lai str. 56601
uugagcaguaaaaaag

SEQ ID NO: 761570 - RNA, 23 nt, Leptospira interrogans serovar lai str. 56601
uugagcaguaaaaucuuuaaguu

SEQ ID NO: 761571 - RNA, 20 nt, Leptospira interrogans serovar lai str. 56601
uugagcuaauucuuaaaaau

SEQ ID NO: 761572 - RNA, 22 nt, Leptospira interrogans serovar lai str. 56601
aagcggguuuuucuuuuuaaau

SEQ ID NO: 761573 - RNA, 17 nt, Leptospira interrogans serovar lai str. 56601
aagcucagauuccaacu

SEQ ID NO: 761574 - RNA, 15 nt, Leptospira interrogans serovar lai str. 56601
aagcugaaaauuuuc

SEQ ID NO: 761575 - RNA, 15 nt, Leptospira interrogans serovar lai str. 56601
aagcuaugaagaggu

SEQ ID NO: 761576 - RNA, 21 nt, Leptospira interrogans serovar lai str. 56601
aagcucaauuuugaagacuau

SEQ ID NO: 761577 - RNA, 15 nt, Leptospira interrogans serovar lai str. 56601
aagcugaacaaacuc

SEQ ID NO: 761578 - RNA, 22 nt, Leptospira interrogans serovar lai str. 56601
aagcugaacuuaaaaucuauuc

SEQ ID NO: 761579 - RNA, 20 nt, Leptospira interrogans serovar lai str. 56601
aagcuuauacuuuaagaaaa

SEQ ID NO: 761580 - RNA, 22 nt, Leptospira interrogans serovar lai str. 56601
aagcuuauacuuuaagaaaauu

SEQ ID NO: 761581 - RNA, 16 nt, Leptospira interrogans serovar lai str. 56601
aaggaaauaaaaauau

SEQ ID NO: 761582 - RNA, 14 nt, Leptospira interrogans serovar lai str. 56601
aaggaacacaugau

SEQ ID NO: 761583 - RNA, 14 nt, Leptospira interrogans serovar lai str. 56601
aagccgcuugaaca

SEQ ID NO: 761584 - RNA, 18 nt, Leptospira interrogans serovar lai str. 56601
aagcgacccaauaagaag

SEQ ID NO: 761585 - RNA, 19 nt, Leptospira interrogans serovar lai str. 56601
aagccuuccaucaaauaca

SEQ ID NO: 761586 - RNA, 15 nt, Leptospira interrogans serovar lai str. 56601
aagcccauaaaaacg

SEQ ID NO: 761587 - RNA, 15 nt, Leptospira interrogans serovar lai str. 56601
aagccccagaacaaa

SEQ ID NO: 761588 - RNA, 18 nt, Leptospira interrogans serovar lai str. 56601
aagcccccgaagaauuau

SEQ ID NO: 761589 - RNA, 13 nt, Leptospira interrogans serovar lai str. 56601
aagcccuccuaug

SEQ ID NO: 761590 - RNA, 21 nt, Leptospira interrogans serovar lai str. 56601
aagccauuuagguuguaacuc

SEQ ID NO: 761591 - RNA, 21 nt, Leptospira interrogans serovar lai str. 56601
aagaaguuguaucagauguuu

SEQ ID NO: 761592 - RNA, 15 nt, Leptospira interrogans serovar lai str. 56601
aaguaauuuaaaaaa

SEQ ID NO: 761593 - RNA, 16 nt, Leptospira interrogans serovar lai str. 56601
aaguaauggauuuuua

SEQ ID NO: 761594 - RNA, 16 nt, Leptospira interrogans serovar lai str. 56601
aaguaauuacacccuu

SEQ ID NO: 761595 - RNA, 19 nt, Leptospira interrogans serovar lai str. 56601
aaguacauggcauccagga

SEQ ID NO: 761596 - RNA, 12 nt, Leptospira interrogans serovar lai str. 56601
aaguagauaaau

SEQ ID NO: 761597 - RNA, 18 nt, Leptospira interrogans serovar lai str. 56601
aaguagagagugaaaaau

SEQ ID NO: 761598 - RNA, 18 nt, Leptospira interrogans serovar lai str. 56601
aaguagaaagauuaaauu

SEQ ID NO: 761599 - RNA, 20 nt, Leptospira interrogans serovar lai str. 56601
aaguagaaagauuaaauucu

SEQ ID NO: 761600 - RNA, 18 nt, Leptospira interrogans serovar lai str. 56601
aaguagaaccuaaaaaua

SEQ ID NO: 761601 - RNA, 13 nt, Leptospira interrogans serovar lai str. 56601
aaguacgaaauuc

SEQ ID NO: 761602 - RNA, 23 nt, Leptospira interrogans serovar lai str. 56601
aaguacgggcucauacauuuuua

SEQ ID NO: 761603 - RNA, 16 nt, Leptospira interrogans serovar lai str. 56601
aaguaaaaaagagcuu

SEQ ID NO: 761604 - RNA, 10 nt, Leptospira interrogans serovar lai str. 56601
aaggguuuuu

SEQ ID NO: 761605 - RNA, 19 nt, Leptospira interrogans serovar lai str. 56601
aaguaaaacguagauaauu

SEQ ID NO: 761606 - RNA, 15 nt, Leptospira interrogans serovar lai str. 56601
aaguaaaaaugcaaa

SEQ ID NO: 761607 - RNA, 13 nt, Leptospira interrogans serovar lai str. 56601
aaguaaagguuuc

SEQ ID NO: 761608 - RNA, 23 nt, Leptospira interrogans serovar lai str. 56601
aaguaaagguuucacaaauuuua

SEQ ID NO: 761609 - RNA, 13 nt, Leptospira interrogans serovar lai str. 56601
aaguaaaauuaaa

SEQ ID NO: 761610 - RNA, 15 nt, Leptospira interrogans serovar lai str. 56601
aaguaaaauuaaaag

SEQ ID NO: 761611 - RNA, 14 nt, Leptospira interrogans serovar lai str. 56601
aaguaaaauuaaau

SEQ ID NO: 761612 - RNA, 15 nt, Leptospira interrogans serovar lai str. 56601
aaguaauauuucucu

SEQ ID NO: 761613 - RNA, 18 nt, Leptospira interrogans serovar lai str. 56601
aaguaaucguuuaaagau

SEQ ID NO: 761614 - RNA, 19 nt, Leptospira interrogans serovar lai str. 56601
aaguaaucguuuaaagauu

SEQ ID NO: 761615 - RNA, 19 nt, Leptospira interrogans serovar lai str. 56601
aaguaaucuuuuuaaaagu

SEQ ID NO: 761616 - RNA, 22 nt, Leptospira interrogans serovar lai str. 56601
aaguaauccauuuuuccguaaa

SEQ ID NO: 761617 - RNA, 19 nt, Leptospira interrogans serovar lai str. 56601
aaggcuuuguaauaaaaau

SEQ ID NO: 761618 - RNA, 18 nt, Leptospira interrogans serovar lai str. 56601
aaggcuaaagaauacauu

SEQ ID NO: 761619 - RNA, 20 nt, Leptospira interrogans serovar lai str. 56601
aaggauuagcaugaaauuuu

SEQ ID NO: 761620 - RNA, 16 nt, Leptospira interrogans serovar lai str. 56601
aaggauucuuuucccg

SEQ ID NO: 761621 - RNA, 16 nt, Leptospira interrogans serovar lai str. 56601
aaggauccaauacaaa

SEQ ID NO: 761622 - RNA, 19 nt, Leptospira interrogans serovar lai str. 56601
aaggauccaauacaaaaca

SEQ ID NO: 761623 - RNA, 23 nt, Leptospira interrogans serovar lai str. 56601
aaggauccaauacaaaacaagua

SEQ ID NO: 761624 - RNA, 14 nt, Leptospira interrogans serovar lai str. 56601
aaggagaauucaau

SEQ ID NO: 761625 - RNA, 21 nt, Leptospira interrogans serovar lai str. 56601
aagggaguuuguaaagguaga

SEQ ID NO: 761626 - RNA, 22 nt, Leptospira interrogans serovar lai str. 56601
aagggaagguuuuguaaaaauu

SEQ ID NO: 761627 - RNA, 17 nt, Leptospira interrogans serovar lai str. 56601
aaggggaucaacaaaau

SEQ ID NO: 761628 - RNA, 14 nt, Leptospira interrogans serovar lai str. 56601
aaguauaauuuaaa

SEQ ID NO: 761629 - RNA, 23 nt, Leptospira interrogans serovar lai str. 56601
aaguaguuucgccaaucuccauu

SEQ ID NO: 761630 - RNA, 21 nt, Leptospira interrogans serovar lai str. 56601
aaguauaaaagugaauuuuug

SEQ ID NO: 761631 - RNA, 16 nt, Leptospira interrogans serovar lai str. 56601
aaguauauauuaaagu

SEQ ID NO: 761632 - RNA, 22 nt, Leptospira interrogans serovar lai str. 56601
aaguauauauuaaaguauuaau

SEQ ID NO: 761633 - RNA, 20 nt, Leptospira interrogans serovar lai str. 56601
aaguauuguuaagauaaauu

SEQ ID NO: 761634 - RNA, 17 nt, Leptospira interrogans serovar lai str. 56601
aaguauuugaucucaau

SEQ ID NO: 761635 - RNA, 13 nt, Leptospira interrogans serovar lai str. 56601
aaguauucuuucc

SEQ ID NO: 761636 - RNA, 20 nt, Leptospira interrogans serovar lai str. 56601
aaguaucaccguaauucuua

SEQ ID NO: 761637 - RNA, 22 nt, Leptospira interrogans serovar lai str. 56601
aaguaucagaaucaaaggaaau

SEQ ID NO: 761638 - RNA, 20 nt, Leptospira interrogans serovar lai str. 56601
aaguauuauauggaguucua

SEQ ID NO: 761639 - RNA, 22 nt, Leptospira interrogans serovar lai str. 56601
aaguauuauauggaguucuaaa

SEQ ID NO: 761640 - RNA, 22 nt, Leptospira interrogans serovar lai str. 56601
aaguagaaucaucucaaaaaua

SEQ ID NO: 761641 - RNA, 22 nt, Leptospira interrogans serovar lai str. 56601
aaguaguagucuuacaauuuua

SEQ ID NO: 761642 - RNA, 20 nt, Leptospira interrogans serovar lai str. 56601
aaguaguaugcgaaauuccu

SEQ ID NO: 761643 - RNA, 18 nt, Leptospira interrogans serovar lai str. 56601
aagucgcccaaaccccag

SEQ ID NO: 761644 - RNA, 14 nt, Leptospira interrogans serovar lai str. 56601
aagucgaauuuuuu

SEQ ID NO: 761645 - RNA, 14 nt, Leptospira interrogans serovar lai str. 56601
aaguccaaaacaaa

SEQ ID NO: 761646 - RNA, 17 nt, Leptospira interrogans serovar lai str. 56601
aaguccaaaacaaagua

SEQ ID NO: 761647 - RNA, 15 nt, Leptospira interrogans serovar lai str. 56601
aagucgaaagaauuu

SEQ ID NO: 761648 - RNA, 18 nt, Leptospira interrogans serovar lai str. 56601
aagucgaaagaauuuuug

SEQ ID NO: 761649 - RNA, 23 nt, Leptospira interrogans serovar lai str. 56601
aaguauuuugauccguuuuaaaa

SEQ ID NO: 761650 - RNA, 14 nt, Leptospira interrogans serovar lai str. 56601
aaguauuuucuaga

SEQ ID NO: 761651 - RNA, 18 nt, Leptospira interrogans serovar lai str. 56601
aagucagguuuuaucaaa

SEQ ID NO: 761652 - RNA, 17 nt, Leptospira interrogans serovar lai str. 56601
aagucaaacuuacaaaa

SEQ ID NO: 761653 - RNA, 18 nt, Leptospira interrogans serovar lai str. 56601
aagugaauuaaaagaaac

SEQ ID NO: 761654 - RNA, 22 nt, Leptospira interrogans serovar lai str. 56601
aagucugucuuaaaauuugaaa

SEQ ID NO: 761655 - RNA, 17 nt, Leptospira interrogans serovar lai str. 56601
aagugaugaagagaaag

SEQ ID NO: 761656 - RNA, 23 nt, Leptospira interrogans serovar lai str. 56601
aagugagauugaguuucacaaaa

SEQ ID NO: 761657 - RNA, 20 nt, Leptospira interrogans serovar lai str. 56601
aaguguggucuauuacaaaa

SEQ ID NO: 761658 - RNA, 20 nt, Leptospira interrogans serovar lai str. 56601
aaguguaucccuuuggcaua

SEQ ID NO: 761659 - RNA, 17 nt, Leptospira interrogans serovar lai str. 56601
aaguuauaguaguuccc

SEQ ID NO: 761660 - RNA, 21 nt, Leptospira interrogans serovar lai str. 56601
aaguuauauuagaguuuuuga

SEQ ID NO: 761661 - RNA, 22 nt, Leptospira interrogans serovar lai str. 56601
aaguuauugaauagaauuuggc

SEQ ID NO: 761662 - RNA, 19 nt, Leptospira interrogans serovar lai str. 56601
aauauaauucuguaaaaua

SEQ ID NO: 761663 - RNA, 14 nt, Leptospira interrogans serovar lai str. 56601
aauauacaaaacau

SEQ ID NO: 761664 - RNA, 21 nt, Leptospira interrogans serovar lai str. 56601
aauauacaacuuuuuuaauuu

SEQ ID NO: 761665 - RNA, 15 nt, Leptospira interrogans serovar lai str. 56601
aauauacaauaaaua

SEQ ID NO: 761666 - RNA, 15 nt, Leptospira interrogans serovar lai str. 56601
aauauaauaauuccg

SEQ ID NO: 761667 - RNA, 18 nt, Leptospira interrogans serovar lai str. 56601
aauauaauaauuguugaa

SEQ ID NO: 761668 - RNA, 18 nt, Leptospira interrogans serovar lai str. 56601
aauauacuugauauuucu

SEQ ID NO: 761669 - RNA, 19 nt, Leptospira interrogans serovar lai str. 56601
aauauacguuauuuccguc

SEQ ID NO: 761670 - RNA, 15 nt, Leptospira interrogans serovar lai str. 56601
aauaggauuuuagaa

SEQ ID NO: 761671 - RNA, 20 nt, Leptospira interrogans serovar lai str. 56601
aauaggauuuuagaaugaga

SEQ ID NO: 761672 - RNA, 16 nt, Leptospira interrogans serovar lai str. 56601
aauagggaaaacucaa

SEQ ID NO: 761673 - RNA, 20 nt, Leptospira interrogans serovar lai str. 56601
aauagggaaaacucaucaca

SEQ ID NO: 761674 - RNA, 22 nt, Leptospira interrogans serovar lai str. 56601
aauagggguuuuaccaggauga

SEQ ID NO: 761675 - RNA, 18 nt, Leptospira interrogans serovar lai str. 56601
aauagggaauauuccauu

SEQ ID NO: 761676 - RNA, 21 nt, Leptospira interrogans serovar lai str. 56601
aauaucugaauuuuuauaagu

SEQ ID NO: 761677 - RNA, 14 nt, Leptospira interrogans serovar lai str. 56601
aauaucuccaaaau

SEQ ID NO: 761678 - RNA, 17 nt, Leptospira interrogans serovar lai str. 56601
aauaucuccaaaaucau

SEQ ID NO: 761679 - RNA, 14 nt, Leptospira interrogans serovar lai str. 56601
aauaucuaauauuu

SEQ ID NO: 761680 - RNA, 15 nt, Leptospira interrogans serovar lai str. 56601
aauaucuuaagaauu

SEQ ID NO: 761681 - RNA, 16 nt, Leptospira interrogans serovar lai str. 56601
aauaucuuaagaauug

SEQ ID NO: 761682 - RNA, 18 nt, Leptospira interrogans serovar lai str. 56601
aauaucuuaauauaauaa

SEQ ID NO: 761683 - RNA, 20 nt, Leptospira interrogans serovar lai str. 56601
aauaucuuaauauaauaauu

SEQ ID NO: 761684 - RNA, 15 nt, Leptospira interrogans serovar lai str. 56601
aauauaguauaaauu

SEQ ID NO: 761685 - RNA, 15 nt, Leptospira interrogans serovar lai str. 56601
aauauagguucuugc

SEQ ID NO: 761686 - RNA, 22 nt, Leptospira interrogans serovar lai str. 56601
aauauagguucuugcaaaaaua

SEQ ID NO: 761687 - RNA, 23 nt, Leptospira interrogans serovar lai str. 56601
aauauagguucuugcaaaaauag

SEQ ID NO: 761688 - RNA, 13 nt, Leptospira interrogans serovar lai str. 56601
aauauaguuaaau

SEQ ID NO: 761689 - RNA, 14 nt, Leptospira interrogans serovar lai str. 56601
aauauaguuaaauu

SEQ ID NO: 761690 - RNA, 15 nt, Leptospira interrogans serovar lai str. 56601
aauauaguuccuaca

SEQ ID NO: 761691 - RNA, 22 nt, Leptospira interrogans serovar lai str. 56601
aauauaguuccuacaauuuuag

SEQ ID NO: 761692 - RNA, 14 nt, Leptospira interrogans serovar lai str. 56601
aauaucauaaauuu

SEQ ID NO: 761693 - RNA, 18 nt, Leptospira interrogans serovar lai str. 56601
aauacucuaauuuuuuau

SEQ ID NO: 761694 - RNA, 21 nt, Leptospira interrogans serovar lai str. 56601
aauacggcacucaauuuuaua

SEQ ID NO: 761695 - RNA, 16 nt, Leptospira interrogans serovar lai str. 56601
aauacuguuaauuuuu

SEQ ID NO: 761696 - RNA, 22 nt, Leptospira interrogans serovar lai str. 56601
aauacucgaaaccauacaauaa

SEQ ID NO: 761697 - RNA, 21 nt, Leptospira interrogans serovar lai str. 56601
aauagaaaccaguaauaguuu

SEQ ID NO: 761698 - RNA, 22 nt, Leptospira interrogans serovar lai str. 56601
aauagaaaccuuucaucuacau

SEQ ID NO: 761699 - RNA, 18 nt, Leptospira interrogans serovar lai str. 56601
aauagagugccaaaauuu

SEQ ID NO: 761700 - RNA, 19 nt, Leptospira interrogans serovar lai str. 56601
aauagagugccaaaauuuu

SEQ ID NO: 761701 - RNA, 17 nt, Leptospira interrogans serovar lai str. 56601
aauagaguuacagaaaa

SEQ ID NO: 761702 - RNA, 21 nt, Leptospira interrogans serovar lai str. 56601
aauagaguuacagaaaaaauc

SEQ ID NO: 761703 - RNA, 14 nt, Leptospira interrogans serovar lai str. 56601
aauagaguuguuaa

SEQ ID NO: 761704 - RNA, 20 nt, Leptospira interrogans serovar lai str. 56601
aauagaguuguuaaaagugg

SEQ ID NO: 761705 - RNA, 19 nt, Leptospira interrogans serovar lai str. 56601
aauagaguuguugaaaaau

SEQ ID NO: 761706 - RNA, 23 nt, Leptospira interrogans serovar lai str. 56601
aauagaguuguugaaaaauuuua

SEQ ID NO: 761707 - RNA, 13 nt, Leptospira interrogans serovar lai str. 56601
aauacuuuuaugg

SEQ ID NO: 761708 - RNA, 15 nt, Leptospira interrogans serovar lai str. 56601
aauacuuuucuuccc

SEQ ID NO: 761709 - RNA, 16 nt, Leptospira interrogans serovar lai str. 56601
aauacuuugauuauaa

SEQ ID NO: 761710 - RNA, 17 nt, Leptospira interrogans serovar lai str. 56601
aauacuuuuagaaaauu

SEQ ID NO: 761711 - RNA, 19 nt, Leptospira interrogans serovar lai str. 56601
aauagauggagaauuaauu

SEQ ID NO: 761712 - RNA, 22 nt, Leptospira interrogans serovar lai str. 56601
aauagauggagaauuaauuuuu

SEQ ID NO: 761713 - RNA, 22 nt, Leptospira interrogans serovar lai str. 56601
aauagauggagaauucauuuuu

SEQ ID NO: 761714 - RNA, 22 nt, Leptospira interrogans serovar lai str. 56601
aauagauucuaauuuuucaaaa

SEQ ID NO: 761715 - RNA, 22 nt, Leptospira interrogans serovar lai str. 56601
aauagauuucuaguuuaaacgu

SEQ ID NO: 761716 - RNA, 24 nt, Leptospira interrogans serovar lai str. 56601
aauagauuucuaguuuaaacguuu

SEQ ID NO: 761717 - RNA, 22 nt, Leptospira interrogans serovar lai str. 56601
aauagcagauuuucucaaaaaa

SEQ ID NO: 761718 - RNA, 21 nt, Leptospira interrogans serovar lai str. 56601
aauaccgauuucuauuuuaaa

SEQ ID NO: 761719 - RNA, 23 nt, Leptospira interrogans serovar lai str. 56601
aauaccuguucggaguuguauaa

SEQ ID NO: 761720 - RNA, 23 nt, Leptospira interrogans serovar lai str. 56601
aauacgauucgaaagauuuuuca

SEQ ID NO: 761721 - RNA, 12 nt, Leptospira interrogans serovar lai str. 56601
aauaauuuuuac

SEQ ID NO: 761722 - RNA, 15 nt, Leptospira interrogans serovar lai str. 56601
aauacaaaaaauguu

SEQ ID NO: 761723 - RNA, 23 nt, Leptospira interrogans serovar lai str. 56601
aauacaaaaaauguuuaaagaau

SEQ ID NO: 761724 - RNA, 13 nt, Leptospira interrogans serovar lai str. 56601
aauacaaaacaag

SEQ ID NO: 761725 - RNA, 15 nt, Leptospira interrogans serovar lai str. 56601
aauacaaaacaagua

SEQ ID NO: 761726 - RNA, 12 nt, Leptospira interrogans serovar lai str. 56601
aauacaaaacuu

SEQ ID NO: 761727 - RNA, 17 nt, Leptospira interrogans serovar lai str. 56601
aauacaaaacuuaaauu

SEQ ID NO: 761728 - RNA, 11 nt, Leptospira interrogans serovar lai str. 56601
aauacaaaaag

SEQ ID NO: 761729 - RNA, 14 nt, Leptospira interrogans serovar lai str. 56601
aauacaaaaagaau

SEQ ID NO: 761730 - RNA, 13 nt, Leptospira interrogans serovar lai str. 56601
aauacaaaaugaa

SEQ ID NO: 761731 - RNA, 15 nt, Leptospira interrogans serovar lai str. 56601
aauacaaaaugaaug

SEQ ID NO: 761732 - RNA, 18 nt, Leptospira interrogans serovar lai str. 56601
aauacaaaauguuuuuau

SEQ ID NO: 761733 - RNA, 16 nt, Leptospira interrogans serovar lai str. 56601
aauacaaaauuuuuuc

SEQ ID NO: 761734 - RNA, 18 nt, Leptospira interrogans serovar lai str. 56601
aauaauuucccauaaaaa

SEQ ID NO: 761735 - RNA, 20 nt, Leptospira interrogans serovar lai str. 56601
aauaauuucccauaaaaaga

SEQ ID NO: 761736 - RNA, 13 nt, Leptospira interrogans serovar lai str. 56601
aauaccaaaccuc

SEQ ID NO: 761737 - RNA, 15 nt, Leptospira interrogans serovar lai str. 56601
aauaccaauaacuua

SEQ ID NO: 761738 - RNA, 16 nt, Leptospira interrogans serovar lai str. 56601
aauaaucgauuuuaca

SEQ ID NO: 761739 - RNA, 13 nt, Leptospira interrogans serovar lai str. 56601
aauaaucggaaau

SEQ ID NO: 761740 - RNA, 14 nt, Leptospira interrogans serovar lai str. 56601
aauaaucuuaaaua

SEQ ID NO: 761741 - RNA, 15 nt, Leptospira interrogans serovar lai str. 56601
aauaaucuuaacuuu

SEQ ID NO: 761742 - RNA, 20 nt, Leptospira interrogans serovar lai str. 56601
aauaaucuuaacuuuaagca

SEQ ID NO: 761743 - RNA, 15 nt, Leptospira interrogans serovar lai str. 56601
aauaaugaaaacuug

SEQ ID NO: 761744 - RNA, 22 nt, Leptospira interrogans serovar lai str. 56601
aauaauugauuagaguuaaauu

SEQ ID NO: 761745 - RNA, 22 nt, Leptospira interrogans serovar lai str. 56601
aauaauuggaucucaauauaaa

SEQ ID NO: 761746 - RNA, 23 nt, Leptospira interrogans serovar lai str. 56601
aauaauuggaucucaauauaaau

SEQ ID NO: 761747 - RNA, 12 nt, Leptospira interrogans serovar lai str. 56601
aauaauuccucc

SEQ ID NO: 761748 - RNA, 14 nt, Leptospira interrogans serovar lai str. 56601
aauaauugaauaaa

SEQ ID NO: 761749 - RNA, 17 nt, Leptospira interrogans serovar lai str. 56601
aauaauucaaaauuuga

SEQ ID NO: 761750 - RNA, 20 nt, Leptospira interrogans serovar lai str. 56601
aauaauucuaucgauuccaa

SEQ ID NO: 761751 - RNA, 17 nt, Leptospira interrogans serovar lai str. 56601
aauaauguccgaaauuu

SEQ ID NO: 761752 - RNA, 21 nt, Leptospira interrogans serovar lai str. 56601
aauaaguuagaacuucuuccc

SEQ ID NO: 761753 - RNA, 13 nt, Leptospira interrogans serovar lai str. 56601
aauaaguaaaucu

SEQ ID NO: 761754 - RNA, 17 nt, Leptospira interrogans serovar lai str. 56601
aauaauaccaaguuauu

SEQ ID NO: 761755 - RNA, 18 nt, Leptospira interrogans serovar lai str. 56601
aauaauacagaauucauu

SEQ ID NO: 761756 - RNA, 20 nt, Leptospira interrogans serovar lai str. 56601
aauaauacagaauucauuuu

SEQ ID NO: 761757 - RNA, 23 nt, Leptospira interrogans serovar lai str. 56601
aauaauacagaauucauuuuaca

SEQ ID NO: 761758 - RNA, 15 nt, Leptospira interrogans serovar lai str. 56601
aauaauaaucuuaaa

SEQ ID NO: 761759 - RNA, 15 nt, Leptospira interrogans serovar lai str. 56601
aauaauaucaaaaug

SEQ ID NO: 761760 - RNA, 17 nt, Leptospira interrogans serovar lai str. 56601
aauaauauauuuauaaa

SEQ ID NO: 761761 - RNA, 21 nt, Leptospira interrogans serovar lai str. 56601
aauaauauauuuauaaaacga

SEQ ID NO: 761762 - RNA, 23 nt, Leptospira interrogans serovar lai str. 56601
aauaauaggaaucggcauaagca

SEQ ID NO: 761763 - RNA, 13 nt, Leptospira interrogans serovar lai str. 56601
aauaauauuauaa

SEQ ID NO: 761764 - RNA, 13 nt, Leptospira interrogans serovar lai str. 56601
aauaauaugaauu

SEQ ID NO: 761765 - RNA, 16 nt, Leptospira interrogans serovar lai str. 56601
aauaauaugauguaaa

SEQ ID NO: 761766 - RNA, 18 nt, Leptospira interrogans serovar lai str. 56601
aauaauaugauguaaauu

SEQ ID NO: 761767 - RNA, 13 nt, Leptospira interrogans serovar lai str. 56601
aauaauauuuuaa

SEQ ID NO: 761768 - RNA, 19 nt, Leptospira interrogans serovar lai str. 56601
aauaagaaucgaaaaaaua

SEQ ID NO: 761769 - RNA, 19 nt, Leptospira interrogans serovar lai str. 56601
aauaagaagccaauuccaa

SEQ ID NO: 761770 - RNA, 16 nt, Leptospira interrogans serovar lai str. 56601
aauaacuuuacaaaaa

SEQ ID NO: 761771 - RNA, 19 nt, Leptospira interrogans serovar lai str. 56601
aauaacuaacgugaguuca

SEQ ID NO: 761772 - RNA, 14 nt, Leptospira interrogans serovar lai str. 56601
aauaacgugaguuu

SEQ ID NO: 761773 - RNA, 23 nt, Leptospira interrogans serovar lai str. 56601
aauaacucuauuaguuuaauaua

SEQ ID NO: 761774 - RNA, 14 nt, Leptospira interrogans serovar lai str. 56601
aauaacauuuuuuc

SEQ ID NO: 761775 - RNA, 22 nt, Leptospira interrogans serovar lai str. 56601
aauaaccaaccccacaaguguu

SEQ ID NO: 761776 - RNA, 15 nt, Leptospira interrogans serovar lai str. 56601
aauaaauuuaaaugu

SEQ ID NO: 761777 - RNA, 18 nt, Leptospira interrogans serovar lai str. 56601
aauaaauugcauaaaaga

SEQ ID NO: 761778 - RNA, 23 nt, Leptospira interrogans serovar lai str. 56601
aauaaauugcauaaaagaaacau

SEQ ID NO: 761779 - RNA, 18 nt, Leptospira interrogans serovar lai str. 56601
aauaaauuguauaaaaga

SEQ ID NO: 761780 - RNA, 23 nt, Leptospira interrogans serovar lai str. 56601
aauaaauuguauaaaagaaacau

SEQ ID NO: 761781 - RNA, 19 nt, Leptospira interrogans serovar lai str. 56601
aauaacaaaaaaugcucaa

SEQ ID NO: 761782 - RNA, 12 nt, Leptospira interrogans serovar lai str. 56601
aauaaauuuuug

SEQ ID NO: 761783 - RNA, 20 nt, Leptospira interrogans serovar lai str. 56601
aauaaauugaaaguaaagau

SEQ ID NO: 761784 - RNA, 16 nt, Leptospira interrogans serovar lai str. 56601
aauaaauuccccaaaa

SEQ ID NO: 761785 - RNA, 13 nt, Leptospira interrogans serovar lai str. 56601
aauaaauuauaua

SEQ ID NO: 761786 - RNA, 15 nt, Leptospira interrogans serovar lai str. 56601
aauaaaucuucugaa

SEQ ID NO: 761787 - RNA, 22 nt, Leptospira interrogans serovar lai str. 56601
aauaaaucaaaaggaauacaau

SEQ ID NO: 761788 - RNA, 14 nt, Leptospira interrogans serovar lai str. 56601
aaguugcuaagaaa

SEQ ID NO: 761789 - RNA, 16 nt, Leptospira interrogans serovar lai str. 56601
aaguuggaaucugaau

SEQ ID NO: 761790 - RNA, 14 nt, Leptospira interrogans serovar lai str. 56601
aaguugaucuuaua

SEQ ID NO: 761791 - RNA, 23 nt, Leptospira interrogans serovar lai str. 56601
aaguugaucuuauacucuuaaaa

SEQ ID NO: 761792 - RNA, 11 nt, Leptospira interrogans serovar lai str. 56601
aaguugauucu

SEQ ID NO: 761793 - RNA, 18 nt, Leptospira interrogans serovar lai str. 56601
aaguugauugacguccuu

SEQ ID NO: 761794 - RNA, 20 nt, Leptospira interrogans serovar lai str. 56601
aaguugauugacguccuuau

SEQ ID NO: 761795 - RNA, 20 nt, Leptospira interrogans serovar lai str. 56601
aaguugaaugagcuagauuu

SEQ ID NO: 761796 - RNA, 22 nt, Leptospira interrogans serovar lai str. 56601
aaguucaucuacguuucaauua

SEQ ID NO: 761797 - RNA, 14 nt, Leptospira interrogans serovar lai str. 56601
aaguuccaaauuac

SEQ ID NO: 761798 - RNA, 19 nt, Leptospira interrogans serovar lai str. 56601
aaguuccaacguaccaaaa

SEQ ID NO: 761799 - RNA, 19 nt, Leptospira interrogans serovar lai str. 56601
aauuauguuugccauuuuu

SEQ ID NO: 761800 - RNA, 19 nt, Leptospira interrogans serovar lai str. 56601
aauuauuaacuaauuuuag

SEQ ID NO: 761801 - RNA, 14 nt, Leptospira interrogans serovar lai str. 56601
aauuauuauaaacu

SEQ ID NO: 761802 - RNA, 13 nt, Leptospira interrogans serovar lai str. 56601
aauuauaguaaca

SEQ ID NO: 761803 - RNA, 18 nt, Leptospira interrogans serovar lai str. 56601
aauuauaguaacagaaaa

SEQ ID NO: 761804 - RNA, 18 nt, Leptospira interrogans serovar lai str. 56601
aauuauaguuuuauuaga

SEQ ID NO: 761805 - RNA, 12 nt, Leptospira interrogans serovar lai str. 56601
aauuauauuaaa

SEQ ID NO: 761806 - RNA, 18 nt, Leptospira interrogans serovar lai str. 56601
aauuaucauguaaaauuu

SEQ ID NO: 761807 - RNA, 22 nt, Leptospira interrogans serovar lai str. 56601
aauuaucauguaaaauuuuuug

SEQ ID NO: 761808 - RNA, 15 nt, Leptospira interrogans serovar lai str. 56601
aauuauauucuuaua

SEQ ID NO: 761809 - RNA, 23 nt, Leptospira interrogans serovar lai str. 56601
aauuauauucuuauauaucuuug

SEQ ID NO: 761810 - RNA, 21 nt, Leptospira interrogans serovar lai str. 56601
aauuaucguguaaaauuuuuu

SEQ ID NO: 761811 - RNA, 19 nt, Leptospira interrogans serovar lai str. 56601
aauuauuuuaggauuuuug

SEQ ID NO: 761812 - RNA, 20 nt, Leptospira interrogans serovar lai str. 56601
aauuauuuuaggauuuuugg

SEQ ID NO: 761813 - RNA, 17 nt, Leptospira interrogans serovar lai str. 56601
aauuauugauaaaaaaa

SEQ ID NO: 761814 - RNA, 13 nt, Leptospira interrogans serovar lai str. 56601
aauuauuuacuuu

SEQ ID NO: 761815 - RNA, 18 nt, Leptospira interrogans serovar lai str. 56601
aauuauuuacuuuuucca

SEQ ID NO: 761816 - RNA, 22 nt, Leptospira interrogans serovar lai str. 56601
aauuauuuacuuuuuccaaaag

SEQ ID NO: 761817 - RNA, 13 nt, Leptospira interrogans serovar lai str. 56601
aauucaaaaagaa

SEQ ID NO: 761818 - RNA, 13 nt, Leptospira interrogans serovar lai str. 56601
aauucaaaauuug

SEQ ID NO: 761819 - RNA, 20 nt, Leptospira interrogans serovar lai str. 56601
aauucaaccgcaaauuuuuu

SEQ ID NO: 761820 - RNA, 16 nt, Leptospira interrogans serovar lai str. 56601
aauucaacuaaauccu

SEQ ID NO: 761821 - RNA, 14 nt, Leptospira interrogans serovar lai str. 56601
aauucaacuuguaa

SEQ ID NO: 761822 - RNA, 19 nt, Leptospira interrogans serovar lai str. 56601
aauucaacuuguaaaacag

SEQ ID NO: 761823 - RNA, 20 nt, Leptospira interrogans serovar lai str. 56601
aauucaacuuguaaaacagc

SEQ ID NO: 761824 - RNA, 17 nt, Leptospira interrogans serovar lai str. 56601
aauuagauuuauugaaa

SEQ ID NO: 761825 - RNA, 19 nt, Leptospira interrogans serovar lai str. 56601
aauuagauuuauugaaaaa

SEQ ID NO: 761826 - RNA, 19 nt, Leptospira interrogans serovar lai str. 56601
aauuauagauaauuuuuac

SEQ ID NO: 761827 - RNA, 16 nt, Leptospira interrogans serovar lai str. 56601
aauuagcuuaagaauu

SEQ ID NO: 761828 - RNA, 19 nt, Leptospira interrogans serovar lai str. 56601
aauuagcucuuguuaaaau

SEQ ID NO: 761829 - RNA, 19 nt, Leptospira interrogans serovar lai str. 56601
aauuacguagcgaagaaua

SEQ ID NO: 761830 - RNA, 18 nt, Leptospira interrogans serovar lai str. 56601
aauuacaauugauuauag

SEQ ID NO: 761831 - RNA, 19 nt, Leptospira interrogans serovar lai str. 56601
aauuacuacauuugauuaa

SEQ ID NO: 761832 - RNA, 15 nt, Leptospira interrogans serovar lai str. 56601
aauuacugauuucaa

SEQ ID NO: 761833 - RNA, 16 nt, Leptospira interrogans serovar lai str. 56601
aauguagaaacuacug

SEQ ID NO: 761834 - RNA, 18 nt, Leptospira interrogans serovar lai str. 56601
aauguaguaacuacuaug

SEQ ID NO: 761835 - RNA, 14 nt, Leptospira interrogans serovar lai str. 56601
aauguaauaugagu

SEQ ID NO: 761836 - RNA, 13 nt, Leptospira interrogans serovar lai str. 56601
aauuaacaaaacu

SEQ ID NO: 761837 - RNA, 16 nt, Leptospira interrogans serovar lai str. 56601
aauuaacaaaacuacu

SEQ ID NO: 761838 - RNA, 15 nt, Leptospira interrogans serovar lai str. 56601
aauuaacaaaacugc

SEQ ID NO: 761839 - RNA, 16 nt, Leptospira interrogans serovar lai str. 56601
aauuaacaaaacugcu

SEQ ID NO: 761840 - RNA, 16 nt, Leptospira interrogans serovar lai str. 56601
aauguacuaaaauuuu

SEQ ID NO: 761841 - RNA, 19 nt, Leptospira interrogans serovar lai str. 56601
aauguacaacauccuucaa

SEQ ID NO: 761842 - RNA, 14 nt, Leptospira interrogans serovar lai str. 56601
aauguacaauuaaa

SEQ ID NO: 761843 - RNA, 16 nt, Leptospira interrogans serovar lai str. 56601
aauguaagaguuccua

SEQ ID NO: 761844 - RNA, 22 nt, Leptospira interrogans serovar lai str. 56601
aauuaauuucuaaacaauuuua

SEQ ID NO: 761845 - RNA, 23 nt, Leptospira interrogans serovar lai str. 56601
aauuaauuuguaauucugucuuu

SEQ ID NO: 761846 - RNA, 15 nt, Leptospira interrogans serovar lai str. 56601
aauuaauuuuuuaaa

SEQ ID NO: 761847 - RNA, 16 nt, Leptospira interrogans serovar lai str. 56601
aauuaauuuuuuaaaa

SEQ ID NO: 761848 - RNA, 20 nt, Leptospira interrogans serovar lai str. 56601
aauuaauucuccaucuauuu

SEQ ID NO: 761849 - RNA, 21 nt, Leptospira interrogans serovar lai str. 56601
aauuaauucuccaucuauuuu

SEQ ID NO: 761850 - RNA, 22 nt, Leptospira interrogans serovar lai str. 56601
aauuaacaguauucaauuuuua

SEQ ID NO: 761851 - RNA, 19 nt, Leptospira interrogans serovar lai str. 56601
aauucuagcgucuaaaaaa

SEQ ID NO: 761852 - RNA, 20 nt, Leptospira interrogans serovar lai str. 56601
aauucuauaguaaagauuag

SEQ ID NO: 761853 - RNA, 23 nt, Leptospira interrogans serovar lai str. 56601
aauucuauaguaaagauuagaaa

SEQ ID NO: 761854 - RNA, 21 nt, Leptospira interrogans serovar lai str. 56601
aauucuaauauaacauuucca

SEQ ID NO: 761855 - RNA, 16 nt, Leptospira interrogans serovar lai str. 56601
aauucuaauauuauuu

SEQ ID NO: 761856 - RNA, 16 nt, Leptospira interrogans serovar lai str. 56601
aauucuacauucugaa

SEQ ID NO: 761857 - RNA, 18 nt, Leptospira interrogans serovar lai str. 56601
aauucuacgaaacuuuua

SEQ ID NO: 761858 - RNA, 19 nt, Leptospira interrogans serovar lai str. 56601
aauucuaaguaauuuaaaa

SEQ ID NO: 761859 - RNA, 22 nt, Leptospira interrogans serovar lai str. 56601
aauucuaaaguuguaggaacua

SEQ ID NO: 761860 - RNA, 15 nt, Leptospira interrogans serovar lai str. 56601
aauucuaaaaucaua

SEQ ID NO: 761861 - RNA, 23 nt, Leptospira interrogans serovar lai str. 56601
aauucuaaaaucauacuuuuaaa

SEQ ID NO: 761862 - RNA, 17 nt, Leptospira interrogans serovar lai str. 56601
aauucuaaaauuuguag

SEQ ID NO: 761863 - RNA, 15 nt, Leptospira interrogans serovar lai str. 56601
aauucuaaacacaga

SEQ ID NO: 761864 - RNA, 18 nt, Leptospira interrogans serovar lai str. 56601
aauucguuuuuuaaaaug

SEQ ID NO: 761865 - RNA, 19 nt, Leptospira interrogans serovar lai str. 56601
aauucguuuuuuaaaaugu

SEQ ID NO: 761866 - RNA, 24 nt, Leptospira interrogans serovar lai str. 56601
aauucguuuuuuaaaauguaggaa

SEQ ID NO: 761867 - RNA, 13 nt, Leptospira interrogans serovar lai str. 56601
aauucuaaaaaaa

SEQ ID NO: 761868 - RNA, 14 nt, Leptospira interrogans serovar lai str. 56601
aauucuaaaaaaau

SEQ ID NO: 761869 - RNA, 16 nt, Leptospira interrogans serovar lai str. 56601
aauucucuauggguuu

SEQ ID NO: 761870 - RNA, 19 nt, Leptospira interrogans serovar lai str. 56601
aauucucuuuugaccaaaa

SEQ ID NO: 761871 - RNA, 14 nt, Leptospira interrogans serovar lai str. 56601
aauucucuuuuugg

SEQ ID NO: 761872 - RNA, 23 nt, Leptospira interrogans serovar lai str. 56601
aauucucuuuuugggaauuuuuu

SEQ ID NO: 761873 - RNA, 15 nt, Leptospira interrogans serovar lai str. 56601
aauucugaaaaugua

SEQ ID NO: 761874 - RNA, 17 nt, Leptospira interrogans serovar lai str. 56601
aauucugaaaauguaaa

SEQ ID NO: 761875 - RNA, 13 nt, Leptospira interrogans serovar lai str. 56601
aauucugaaagag

SEQ ID NO: 761876 - RNA, 22 nt, Leptospira interrogans serovar lai str. 56601
aauucuccacaaaaccaaaucg

SEQ ID NO: 761877 - RNA, 22 nt, Leptospira interrogans serovar lai str. 56601
aauucuccuccugaaaauuuuc

SEQ ID NO: 761878 - RNA, 17 nt, Leptospira interrogans serovar lai str. 56601
aauucuccucuucacca

SEQ ID NO: 761879 - RNA, 18 nt, Leptospira interrogans serovar lai str. 56601
aauucuccucuucaccaa

SEQ ID NO: 761880 - RNA, 14 nt, Leptospira interrogans serovar lai str. 56601
aauucucaaaaaau

SEQ ID NO: 761881 - RNA, 23 nt, Leptospira interrogans serovar lai str. 56601
aauucgccguaaaaaauccauga

SEQ ID NO: 761882 - RNA, 17 nt, Leptospira interrogans serovar lai str. 56601
aauucgaucuaagaaau

SEQ ID NO: 761883 - RNA, 14 nt, Leptospira interrogans serovar lai str. 56601
aauucgguugacuc

SEQ ID NO: 761884 - RNA, 21 nt, Leptospira interrogans serovar lai str. 56601
aauucgguugacuccaaaaac

SEQ ID NO: 761885 - RNA, 13 nt, Leptospira interrogans serovar lai str. 56601
aauuccuaaaugc

SEQ ID NO: 761886 - RNA, 23 nt, Leptospira interrogans serovar lai str. 56601
aauuccuaaugcagcuucuucca

SEQ ID NO: 761887 - RNA, 17 nt, Leptospira interrogans serovar lai str. 56601
aauuccuacaguuuuag

SEQ ID NO: 761888 - RNA, 19 nt, Leptospira interrogans serovar lai str. 56601
aauuccuacaguuuuagaa

SEQ ID NO: 761889 - RNA, 20 nt, Leptospira interrogans serovar lai str. 56601
aauucacucuuaaauacuua

SEQ ID NO: 761890 - RNA, 14 nt, Leptospira interrogans serovar lai str. 56601
aauucacuguuaaa

SEQ ID NO: 761891 - RNA, 20 nt, Leptospira interrogans serovar lai str. 56601
aauucacuguuaaaagauuu

SEQ ID NO: 761892 - RNA, 20 nt, Leptospira interrogans serovar lai str. 56601
aauucagaaaaaaaaagaau

SEQ ID NO: 761893 - RNA, 21 nt, Leptospira interrogans serovar lai str. 56601
aauucagaaaaaaaaagaauu

SEQ ID NO: 761894 - RNA, 22 nt, Leptospira interrogans serovar lai str. 56601
aauucaccuuccaaagauuuua

SEQ ID NO: 761895 - RNA, 13 nt, Leptospira interrogans serovar lai str. 56601
aauucacguuaaa

SEQ ID NO: 761896 - RNA, 17 nt, Leptospira interrogans serovar lai str. 56601
aauucacguuaaaauaa

SEQ ID NO: 761897 - RNA, 18 nt, Leptospira interrogans serovar lai str. 56601
aauucacguuaaaauaau

SEQ ID NO: 761898 - RNA, 22 nt, Leptospira interrogans serovar lai str. 56601
aauucacguuaaaauaaugaua

SEQ ID NO: 761899 - RNA, 22 nt, Leptospira interrogans serovar lai str. 56601
aauucacguuauuuagaucaaa

SEQ ID NO: 761900 - RNA, 21 nt, Leptospira interrogans serovar lai str. 56601
aauucacguucaacaaacaaa

SEQ ID NO: 761901 - RNA, 16 nt, Leptospira interrogans serovar lai str. 56601
aauucaucaaugaaua

SEQ ID NO: 761902 - RNA, 20 nt, Leptospira interrogans serovar lai str. 56601
aauucauauugagauaaaaa

SEQ ID NO: 761903 - RNA, 22 nt, Leptospira interrogans serovar lai str. 56601
aauucauauugagauaaaaagu

SEQ ID NO: 761904 - RNA, 20 nt, Leptospira interrogans serovar lai str. 56601
aauucauacuuuuaaaaagu

SEQ ID NO: 761905 - RNA, 22 nt, Leptospira interrogans serovar lai str. 56601
aauucaucuccuccgauucuga

SEQ ID NO: 761906 - RNA, 16 nt, Leptospira interrogans serovar lai str. 56601
aauucaggauaaacau

SEQ ID NO: 761907 - RNA, 21 nt, Leptospira interrogans serovar lai str. 56601
aauucaggugggaguuuagaa

SEQ ID NO: 761908 - RNA, 23 nt, Leptospira interrogans serovar lai str. 56601
aauucagcuuauugaugauugaa

SEQ ID NO: 761909 - RNA, 13 nt, Leptospira interrogans serovar lai str. 56601
aauucaguuuuuc

SEQ ID NO: 761910 - RNA, 13 nt, Leptospira interrogans serovar lai str. 56601
aauucaguucuga

SEQ ID NO: 761911 - RNA, 19 nt, Leptospira interrogans serovar lai str. 56601
aauuccauagugaagauuu

SEQ ID NO: 761912 - RNA, 22 nt, Leptospira interrogans serovar lai str. 56601
aauuccauagugaagauuugua

SEQ ID NO: 761913 - RNA, 17 nt, Leptospira interrogans serovar lai str. 56601
aauuccacuaugaaagu

SEQ ID NO: 761914 - RNA, 22 nt, Leptospira interrogans serovar lai str. 56601
aauuccacuaugaaaguuuuuc

SEQ ID NO: 761915 - RNA, 15 nt, Leptospira interrogans serovar lai str. 56601
aauuccacucagacc

SEQ ID NO: 761916 - RNA, 15 nt, Leptospira interrogans serovar lai str. 56601
aauuccacuucucac

SEQ ID NO: 761917 - RNA, 16 nt, Leptospira interrogans serovar lai str. 56601
aauucauuuuacagaa

SEQ ID NO: 761918 - RNA, 23 nt, Leptospira interrogans serovar lai str. 56601
aauucauuuuucuacaauuauau

SEQ ID NO: 761919 - RNA, 18 nt, Leptospira interrogans serovar lai str. 56601
aauucauuuuucugaaaa

SEQ ID NO: 761920 - RNA, 16 nt, Leptospira interrogans serovar lai str. 56601
aauuccaaaaaucuca

SEQ ID NO: 761921 - RNA, 18 nt, Leptospira interrogans serovar lai str. 56601
aauucauuguaagaaaua

SEQ ID NO: 761922 - RNA, 15 nt, Leptospira interrogans serovar lai str. 56601
aauuccaauuuuucu

SEQ ID NO: 761923 - RNA, 18 nt, Leptospira interrogans serovar lai str. 56601
aauuccgacccagaaaaa

SEQ ID NO: 761924 - RNA, 20 nt, Leptospira interrogans serovar lai str. 56601
aauuccgacccagaaaaaac

SEQ ID NO: 761925 - RNA, 15 nt, Leptospira interrogans serovar lai str. 56601
aauucccauuaaagu

SEQ ID NO: 761926 - RNA, 23 nt, Leptospira interrogans serovar lai str. 56601
aauuccccaaaaugaauuguaaa

SEQ ID NO: 761927 - RNA, 16 nt, Leptospira interrogans serovar lai str. 56601
aauucccaaugaugaa

SEQ ID NO: 761928 - RNA, 22 nt, Leptospira interrogans serovar lai str. 56601
aauucccaaugaugaauucugg

SEQ ID NO: 761929 - RNA, 23 nt, Leptospira interrogans serovar lai str. 56601
aauuguauuuucccgaaagaacu

SEQ ID NO: 761930 - RNA, 12 nt, Leptospira interrogans serovar lai str. 56601
aauuguaugaaa

SEQ ID NO: 761931 - RNA, 13 nt, Leptospira interrogans serovar lai str. 56601
aauuguaugaaga

SEQ ID NO: 761932 - RNA, 17 nt, Leptospira interrogans serovar lai str. 56601
aauuguaugaagaaaac

SEQ ID NO: 761933 - RNA, 15 nt, Leptospira interrogans serovar lai str. 56601
aauuguagaauuuau

SEQ ID NO: 761934 - RNA, 22 nt, Leptospira interrogans serovar lai str. 56601
aauuguagaauuuauuuucaua

SEQ ID NO: 761935 - RNA, 15 nt, Leptospira interrogans serovar lai str. 56601
aauuguaggaacuac

SEQ ID NO: 761936 - RNA, 21 nt, Leptospira interrogans serovar lai str. 56601
aauuguaggaguucauauuuu

SEQ ID NO: 761937 - RNA, 17 nt, Leptospira interrogans serovar lai str. 56601
aauuguagauucuuuua

SEQ ID NO: 761938 - RNA, 21 nt, Leptospira interrogans serovar lai str. 56601
aauuguguuaguucccacauu

SEQ ID NO: 761939 - RNA, 19 nt, Leptospira interrogans serovar lai str. 56601
aauuguuccgaauuaaaaa

SEQ ID NO: 761940 - RNA, 17 nt, Leptospira interrogans serovar lai str. 56601
aauuguccguuucaaua

SEQ ID NO: 761941 - RNA, 18 nt, Leptospira interrogans serovar lai str. 56601
aauugugggaacucacac

SEQ ID NO: 761942 - RNA, 12 nt, Leptospira interrogans serovar lai str. 56601
aauuuaaaacuu

SEQ ID NO: 761943 - RNA, 21 nt, Leptospira interrogans serovar lai str. 56601
aauuuaaaacuugucccaaaa

SEQ ID NO: 761944 - RNA, 14 nt, Leptospira interrogans serovar lai str. 56601
aauuuaaaaaaauc

SEQ ID NO: 761945 - RNA, 21 nt, Leptospira interrogans serovar lai str. 56601
aauuguugaauccuacuaaca

SEQ ID NO: 761946 - RNA, 13 nt, Leptospira interrogans serovar lai str. 56601
aauuguugaaaaa

SEQ ID NO: 761947 - RNA, 18 nt, Leptospira interrogans serovar lai str. 56601
aauuguugaaaaauuuau

SEQ ID NO: 761948 - RNA, 19 nt, Leptospira interrogans serovar lai str. 56601
aauuguugaaaaauuucau

SEQ ID NO: 761949 - RNA, 15 nt, Leptospira interrogans serovar lai str. 56601
aauuguugaagaauu

SEQ ID NO: 761950 - RNA, 23 nt, Leptospira interrogans serovar lai str. 56601
aauuguuugaucucgggaaaaaa

SEQ ID NO: 761951 - RNA, 17 nt, Leptospira interrogans serovar lai str. 56601
aauuguugcuauggaau

SEQ ID NO: 761952 - RNA, 14 nt, Leptospira interrogans serovar lai str. 56601
aauuuaacgauauu

SEQ ID NO: 761953 - RNA, 17 nt, Leptospira interrogans serovar lai str. 56601
aauuuaacgauauuaga

SEQ ID NO: 761954 - RNA, 14 nt, Leptospira interrogans serovar lai str. 56601
aauuuaaaaucgua

SEQ ID NO: 761955 - RNA, 17 nt, Leptospira interrogans serovar lai str. 56601
aauuuaaauguauguuu

SEQ ID NO: 761956 - RNA, 18 nt, Leptospira interrogans serovar lai str. 56601
aauuuaaauguuuuugua

SEQ ID NO: 761957 - RNA, 19 nt, Leptospira interrogans serovar lai str. 56601
aauuuaaauguuuuuguau

SEQ ID NO: 761958 - RNA, 15 nt, Leptospira interrogans serovar lai str. 56601
aauuuaaauucccuc

SEQ ID NO: 761959 - RNA, 18 nt, Leptospira interrogans serovar lai str. 56601
aauuuaacaacauuagaa

SEQ ID NO: 761960 - RNA, 13 nt, Leptospira interrogans serovar lai str. 56601
aauuuauaugauu

SEQ ID NO: 761961 - RNA, 17 nt, Leptospira interrogans serovar lai str. 56601
aauuuauaaaguuuaac

SEQ ID NO: 761962 - RNA, 14 nt, Leptospira interrogans serovar lai str. 56601
aauuuauaaaugua

SEQ ID NO: 761963 - RNA, 21 nt, Leptospira interrogans serovar lai str. 56601
aauuuauaaauguaggaacua

SEQ ID NO: 761964 - RNA, 14 nt, Leptospira interrogans serovar lai str. 56601
aauuuaguuuuugu

SEQ ID NO: 761965 - RNA, 20 nt, Leptospira interrogans serovar lai str. 56601
aauuuaguuuuuguaugagu

SEQ ID NO: 761966 - RNA, 19 nt, Leptospira interrogans serovar lai str. 56601
aauuuaguaucauaaguuu

SEQ ID NO: 761967 - RNA, 16 nt, Leptospira interrogans serovar lai str. 56601
aauuuagaaauuuaua

SEQ ID NO: 761968 - RNA, 17 nt, Leptospira interrogans serovar lai str. 56601
aauuuagaaauuuauac

SEQ ID NO: 761969 - RNA, 17 nt, Leptospira interrogans serovar lai str. 56601
aauuuagaauaaaaacu

SEQ ID NO: 761970 - RNA, 12 nt, Leptospira interrogans serovar lai str. 56601
aauuuaggaaau

SEQ ID NO: 761971 - RNA, 15 nt, Leptospira interrogans serovar lai str. 56601
aauuuaggaaauuuu

SEQ ID NO: 761972 - RNA, 22 nt, Leptospira interrogans serovar lai str. 56601
aauuuaagauuacucuacuaua

SEQ ID NO: 761973 - RNA, 16 nt, Leptospira interrogans serovar lai str. 56601
aauuuaaguauuauaa

SEQ ID NO: 761974 - RNA, 16 nt, Leptospira interrogans serovar lai str. 56601
aauuuaauauauuaaa

SEQ ID NO: 761975 - RNA, 18 nt, Leptospira interrogans serovar lai str. 56601
aauuuaauauauuaaaau

SEQ ID NO: 761976 - RNA, 21 nt, Leptospira interrogans serovar lai str. 56601
aauuuaauauauuaaaauguu

SEQ ID NO: 761977 - RNA, 19 nt, Leptospira interrogans serovar lai str. 56601
aauuuacuucaauuaucua

SEQ ID NO: 761978 - RNA, 18 nt, Leptospira interrogans serovar lai str. 56601
aauuuacggcauuuuuua

SEQ ID NO: 761979 - RNA, 22 nt, Leptospira interrogans serovar lai str. 56601
aauuuacggcauuuuuuaaaug

SEQ ID NO: 761980 - RNA, 22 nt, Leptospira interrogans serovar lai str. 56601
aauuuacuacaucuaaugauuu

SEQ ID NO: 761981 - RNA, 15 nt, Leptospira interrogans serovar lai str. 56601
aauuuacuauuuuga

SEQ ID NO: 761982 - RNA, 16 nt, Leptospira interrogans serovar lai str. 56601
aauuuacucuuauaaa

SEQ ID NO: 761983 - RNA, 19 nt, Leptospira interrogans serovar lai str. 56601
aauuuacucuuauaaaauu

SEQ ID NO: 761984 - RNA, 21 nt, Leptospira interrogans serovar lai str. 56601
aauuuacucuuauaaaauuuu

SEQ ID NO: 761985 - RNA, 23 nt, Leptospira interrogans serovar lai str. 56601
aauuuacucuuauaaaauuuuag

SEQ ID NO: 761986 - RNA, 18 nt, Leptospira interrogans serovar lai str. 56601
aauuuacaucauguaaua

SEQ ID NO: 761987 - RNA, 17 nt, Leptospira interrogans serovar lai str. 56601
aauuucaauaacuugac

SEQ ID NO: 761988 - RNA, 13 nt, Leptospira interrogans serovar lai str. 56601
aauuuauuuuuca

SEQ ID NO: 761989 - RNA, 18 nt, Leptospira interrogans serovar lai str. 56601
aauuuauuuuucaacaac

SEQ ID NO: 761990 - RNA, 16 nt, Leptospira interrogans serovar lai str. 56601
aauuuauuuguaaaau

SEQ ID NO: 761991 - RNA, 13 nt, Leptospira interrogans serovar lai str. 56601
aauuuauuuuaaa

SEQ ID NO: 761992 - RNA, 18 nt, Leptospira interrogans serovar lai str. 56601
aauuuauuucaaaauuua

SEQ ID NO: 761993 - RNA, 17 nt, Leptospira interrogans serovar lai str. 56601
aauuuaucgauuuaaaa

SEQ ID NO: 761994 - RNA, 14 nt, Leptospira interrogans serovar lai str. 56601
aauuuauagauaua

SEQ ID NO: 761995 - RNA, 22 nt, Leptospira interrogans serovar lai str. 56601
aauuuauaggaucguauuuuag

SEQ ID NO: 761996 - RNA, 13 nt, Leptospira interrogans serovar lai str. 56601
aauuuauauagua

SEQ ID NO: 761997 - RNA, 13 nt, Leptospira interrogans serovar lai str. 56601
aauuuauuauauc

SEQ ID NO: 761998 - RNA, 20 nt, Leptospira interrogans serovar lai str. 56601
aauuuauuaugugacuuaau

SEQ ID NO: 761999 - RNA, 16 nt, Leptospira interrogans serovar lai str. 56601
aauuuauguacuuuua

SEQ ID NO: 762000 - RNA, 19 nt, Leptospira interrogans serovar lai str. 56601
aauuuauguacuuuuaaga

SEQ ID NO: 762001 - RNA, 22 nt, Leptospira interrogans serovar lai str. 56601
aauuuauguacuuuuaagaauu

SEQ ID NO: 762002 - RNA, 15 nt, Leptospira interrogans serovar lai str. 56601
aauucuguaaaaaua

SEQ ID NO: 762003 - RNA, 15 nt, Leptospira interrogans serovar lai str. 56601
aauucuuaaaaauuu

SEQ ID NO: 762004 - RNA, 16 nt, Leptospira interrogans serovar lai str. 56601
aauucuuaaaaauuua

SEQ ID NO: 762005 - RNA, 13 nt, Leptospira interrogans serovar lai str. 56601
aauucuuaaaaaa

SEQ ID NO: 762006 - RNA, 19 nt, Leptospira interrogans serovar lai str. 56601
aauucugucucuuuauaua

SEQ ID NO: 762007 - RNA, 23 nt, Leptospira interrogans serovar lai str. 56601
aauucuuccuucuugaaauaauc

SEQ ID NO: 762008 - RNA, 21 nt, Leptospira interrogans serovar lai str. 56601
aauucuuccuuuuucauuuuu

SEQ ID NO: 762009 - RNA, 22 nt, Leptospira interrogans serovar lai str. 56601
aauucuucagggcucauagaac

SEQ ID NO: 762010 - RNA, 11 nt, Leptospira interrogans serovar lai str. 56601
aauucuuaaua

SEQ ID NO: 762011 - RNA, 17 nt, Leptospira interrogans serovar lai str. 56601
aauucuuaauauacuua

SEQ ID NO: 762012 - RNA, 16 nt, Leptospira interrogans serovar lai str. 56601
aauucuuagaguaaaa

SEQ ID NO: 762013 - RNA, 17 nt, Leptospira interrogans serovar lai str. 56601
aauucuucaauaucuuu

SEQ ID NO: 762014 - RNA, 20 nt, Leptospira interrogans serovar lai str. 56601
aauucuuucuuaaauuuuuu

SEQ ID NO: 762015 - RNA, 14 nt, Leptospira interrogans serovar lai str. 56601
aauucuuuagaaau

SEQ ID NO: 762016 - RNA, 17 nt, Leptospira interrogans serovar lai str. 56601
aauucuuuagaaauuuu

SEQ ID NO: 762017 - RNA, 22 nt, Leptospira interrogans serovar lai str. 56601
aauucuuuagaaauuuuuaauc

SEQ ID NO: 762018 - RNA, 17 nt, Leptospira interrogans serovar lai str. 56601
aauucuuuggaaauuuu

SEQ ID NO: 762019 - RNA, 21 nt, Leptospira interrogans serovar lai str. 56601
aauucuuuugcauaguuuuau

SEQ ID NO: 762020 - RNA, 23 nt, Leptospira interrogans serovar lai str. 56601
aauucuuugaaccacaguuccua

SEQ ID NO: 762021 - RNA, 16 nt, Leptospira interrogans serovar lai str. 56601
aauucuuuaaaauuuu

SEQ ID NO: 762022 - RNA, 19 nt, Leptospira interrogans serovar lai str. 56601
aauucuuuaaaauuuuuaa

SEQ ID NO: 762023 - RNA, 14 nt, Leptospira interrogans serovar lai str. 56601
aauugauaaaaccg

SEQ ID NO: 762024 - RNA, 23 nt, Leptospira interrogans serovar lai str. 56601
aauugacaaagaguuguuuaucu

SEQ ID NO: 762025 - RNA, 12 nt, Leptospira interrogans serovar lai str. 56601
aauugaauuuaa

SEQ ID NO: 762026 - RNA, 21 nt, Leptospira interrogans serovar lai str. 56601
aauugaagcaguuuugcuaau

SEQ ID NO: 762027 - RNA, 16 nt, Leptospira interrogans serovar lai str. 56601
aauugaauauaaaauu

SEQ ID NO: 762028 - RNA, 18 nt, Leptospira interrogans serovar lai str. 56601
aauugaaacaauuuugcc

SEQ ID NO: 762029 - RNA, 18 nt, Leptospira interrogans serovar lai str. 56601
aauugcauaaaagaaaca

SEQ ID NO: 762030 - RNA, 17 nt, Leptospira interrogans serovar lai str. 56601
aauugcaccaguuaaau

SEQ ID NO: 762031 - RNA, 12 nt, Leptospira interrogans serovar lai str. 56601
aauugcacaaaa

SEQ ID NO: 762032 - RNA, 20 nt, Leptospira interrogans serovar lai str. 56601
aauugcacaaaagaaacgua

SEQ ID NO: 762033 - RNA, 14 nt, Leptospira interrogans serovar lai str. 56601
aauugcacauaaaa

SEQ ID NO: 762034 - RNA, 18 nt, Leptospira interrogans serovar lai str. 56601
aauuggaauguacuaaaa

SEQ ID NO: 762035 - RNA, 15 nt, Leptospira interrogans serovar lai str. 56601
aauuggcagaugaaa

SEQ ID NO: 762036 - RNA, 19 nt, Leptospira interrogans serovar lai str. 56601
aauuggcagaugaaacuaa

SEQ ID NO: 762037 - RNA, 19 nt, Leptospira interrogans serovar lai str. 56601
aauggaauuuauuauaucg

SEQ ID NO: 762038 - RNA, 13 nt, Leptospira interrogans serovar lai str. 56601
aauggaaauggau

SEQ ID NO: 762039 - RNA, 18 nt, Leptospira interrogans serovar lai str. 56601
aaugcuucauauaauaaa

SEQ ID NO: 762040 - RNA, 12 nt, Leptospira interrogans serovar lai str. 56601
aaugguuccgau

SEQ ID NO: 762041 - RNA, 14 nt, Leptospira interrogans serovar lai str. 56601
aauguaaaaaaaua

SEQ ID NO: 762042 - RNA, 19 nt, Leptospira interrogans serovar lai str. 56601
aauguaaaaaaauauuaaa

SEQ ID NO: 762043 - RNA, 17 nt, Leptospira interrogans serovar lai str. 56601
aauggauaaauuuuaga

SEQ ID NO: 762044 - RNA, 16 nt, Leptospira interrogans serovar lai str. 56601
aauggaucaaaagagu

SEQ ID NO: 762045 - RNA, 17 nt, Leptospira interrogans serovar lai str. 56601
aauggaucaaaagaguu

SEQ ID NO: 762046 - RNA, 14 nt, Leptospira interrogans serovar lai str. 56601
aaugcagcuucuuc

SEQ ID NO: 762047 - RNA, 23 nt, Leptospira interrogans serovar lai str. 56601
aaugcaguaaugccuacaaauca

SEQ ID NO: 762048 - RNA, 18 nt, Leptospira interrogans serovar lai str. 56601
aaugcaguaguuccuaua

SEQ ID NO: 762049 - RNA, 21 nt, Leptospira interrogans serovar lai str. 56601
aaugcauucaaaaaguuuuau

SEQ ID NO: 762050 - RNA, 22 nt, Leptospira interrogans serovar lai str. 56601
aaugcgaaauagauugaagcgu

SEQ ID NO: 762051 - RNA, 22 nt, Leptospira interrogans serovar lai str. 56601
aaugcgauuccaguaggauaau

SEQ ID NO: 762052 - RNA, 15 nt, Leptospira interrogans serovar lai str. 56601
aaugaucuaagauuu

SEQ ID NO: 762053 - RNA, 18 nt, Leptospira interrogans serovar lai str. 56601
aaugagcuagauuuagau

SEQ ID NO: 762054 - RNA, 20 nt, Leptospira interrogans serovar lai str. 56601
aaugcaaccuuacugcauuu

SEQ ID NO: 762055 - RNA, 14 nt, Leptospira interrogans serovar lai str. 56601
aaugcaaaaguuuu

SEQ ID NO: 762056 - RNA, 19 nt, Leptospira interrogans serovar lai str. 56601
aaugauuuuuuaaaauaac

SEQ ID NO: 762057 - RNA, 22 nt, Leptospira interrogans serovar lai str. 56601
aaugagauaucacaaauuuuaa

SEQ ID NO: 762058 - RNA, 18 nt, Leptospira interrogans serovar lai str. 56601
aaugagauuaaaacugcu

SEQ ID NO: 762059 - RNA, 22 nt, Leptospira interrogans serovar lai str. 56601
aaugagaguucgugaagaaauu

SEQ ID NO: 762060 - RNA, 20 nt, Leptospira interrogans serovar lai str. 56601
aaugagccagguuaauuaaa

SEQ ID NO: 762061 - RNA, 21 nt, Leptospira interrogans serovar lai str. 56601
aaugagccagguuaauuaaau

SEQ ID NO: 762062 - RNA, 16 nt, Leptospira interrogans serovar lai str. 56601
aaugaaucguaaaaaa

SEQ ID NO: 762063 - RNA, 18 nt, Leptospira interrogans serovar lai str. 56601
aaugaaucguaaaaaaau

SEQ ID NO: 762064 - RNA, 19 nt, Leptospira interrogans serovar lai str. 56601
aaugaaucguaaaaaaaua

SEQ ID NO: 762065 - RNA, 21 nt, Leptospira interrogans serovar lai str. 56601
aaugaaucguaaaaaaauauu

SEQ ID NO: 762066 - RNA, 17 nt, Leptospira interrogans serovar lai str. 56601
aaugaauguuuaaaauu

SEQ ID NO: 762067 - RNA, 16 nt, Leptospira interrogans serovar lai str. 56601
aaugaacaaugaauuu

SEQ ID NO: 762068 - RNA, 19 nt, Leptospira interrogans serovar lai str. 56601
aaugaaaacuuguuuuaga

SEQ ID NO: 762069 - RNA, 18 nt, Leptospira interrogans serovar lai str. 56601
aaugaaaacgaugucuuu

SEQ ID NO: 762070 - RNA, 16 nt, Leptospira interrogans serovar lai str. 56601
aaugaaaagauuucaa

SEQ ID NO: 762071 - RNA, 16 nt, Leptospira interrogans serovar lai str. 56601
aaugaaaauuauaagu

SEQ ID NO: 762072 - RNA, 16 nt, Leptospira interrogans serovar lai str. 56601
aaucuuaggacggauu

SEQ ID NO: 762073 - RNA, 20 nt, Leptospira interrogans serovar lai str. 56601
aaucuuaggcaucauucuuu

SEQ ID NO: 762074 - RNA, 20 nt, Leptospira interrogans serovar lai str. 56601
aaucuuaaaucuuuaaaaua

SEQ ID NO: 762075 - RNA, 18 nt, Leptospira interrogans serovar lai str. 56601
aaucuuaaauuagauauu

SEQ ID NO: 762076 - RNA, 18 nt, Leptospira interrogans serovar lai str. 56601
aaucuuaaaagaaaauca

SEQ ID NO: 762077 - RNA, 21 nt, Leptospira interrogans serovar lai str. 56601
aaucuuaauuuguaagaguuc

SEQ ID NO: 762078 - RNA, 20 nt, Leptospira interrogans serovar lai str. 56601
aaucuuuuuaaaaguuugau

SEQ ID NO: 762079 - RNA, 15 nt, Leptospira interrogans serovar lai str. 56601
aaugaaaaagaaacg

SEQ ID NO: 762080 - RNA, 16 nt, Leptospira interrogans serovar lai str. 56601
aaucuuuguaugaguu

SEQ ID NO: 762081 - RNA, 17 nt, Leptospira interrogans serovar lai str. 56601
aaucuuuguaugaguuc

SEQ ID NO: 762082 - RNA, 23 nt, Leptospira interrogans serovar lai str. 56601
aaucuuuuaaaaaagguauauag

SEQ ID NO: 762083 - RNA, 14 nt, Leptospira interrogans serovar lai str. 56601
aaucuuaauauuuc

SEQ ID NO: 762084 - RNA, 19 nt, Leptospira interrogans serovar lai str. 56601
aaucuguuuagaauauuuu

SEQ ID NO: 762085 - RNA, 23 nt, Leptospira interrogans serovar lai str. 56601
aaucuguuuagaauauuuucuca

SEQ ID NO: 762086 - RNA, 15 nt, Leptospira interrogans serovar lai str. 56601
aaucuguaaaucaac

SEQ ID NO: 762087 - RNA, 23 nt, Leptospira interrogans serovar lai str. 56601
aaucuguaaaucaacauuauguu

SEQ ID NO: 762088 - RNA, 22 nt, Leptospira interrogans serovar lai str. 56601
aaucugugggaacuaccacaaa

SEQ ID NO: 762089 - RNA, 22 nt, Leptospira interrogans serovar lai str. 56601
aaucugugggaacucucacaaa

SEQ ID NO: 762090 - RNA, 19 nt, Leptospira interrogans serovar lai str. 56601
aaucuaucucaaaaauacu

SEQ ID NO: 762091 - RNA, 21 nt, Leptospira interrogans serovar lai str. 56601
aaucuaucucaaaauacuuua

SEQ ID NO: 762092 - RNA, 14 nt, Leptospira interrogans serovar lai str. 56601
aaucuauuaacuuu

SEQ ID NO: 762093 - RNA, 17 nt, Leptospira interrogans serovar lai str. 56601
aaucuaguucaacguaa

SEQ ID NO: 762094 - RNA, 12 nt, Leptospira interrogans serovar lai str. 56601
aaucuaguuuau

SEQ ID NO: 762095 - RNA, 15 nt, Leptospira interrogans serovar lai str. 56601
aaucuauauuuuaca

SEQ ID NO: 762096 - RNA, 14 nt, Leptospira interrogans serovar lai str. 56601
aaucuauuguaaua

SEQ ID NO: 762097 - RNA, 12 nt, Leptospira interrogans serovar lai str. 56601
aaucuauuuuug

SEQ ID NO: 762098 - RNA, 13 nt, Leptospira interrogans serovar lai str. 56601
aaucuauuuuuga

SEQ ID NO: 762099 - RNA, 16 nt, Leptospira interrogans serovar lai str. 56601
aaucuauuuuugauuu

SEQ ID NO: 762100 - RNA, 21 nt, Leptospira interrogans serovar lai str. 56601
aaucuauuuuugauuuuagaa

SEQ ID NO: 762101 - RNA, 20 nt, Leptospira interrogans serovar lai str. 56601
aaucgccucuugaagccuuc

SEQ ID NO: 762102 - RNA, 18 nt, Leptospira interrogans serovar lai str. 56601
aauccuuccuccaaaaua

SEQ ID NO: 762103 - RNA, 19 nt, Leptospira interrogans serovar lai str. 56601
aauccuuccuccaaaauau

SEQ ID NO: 762104 - RNA, 19 nt, Leptospira interrogans serovar lai str. 56601
aauccuguuugaaaaaaug

SEQ ID NO: 762105 - RNA, 19 nt, Leptospira interrogans serovar lai str. 56601
aaucguaaaaaaauauuuc

SEQ ID NO: 762106 - RNA, 13 nt, Leptospira interrogans serovar lai str. 56601
aaucggguaaaaa

SEQ ID NO: 762107 - RNA, 13 nt, Leptospira interrogans serovar lai str. 56601
aaucuacaaaacu

SEQ ID NO: 762108 - RNA, 18 nt, Leptospira interrogans serovar lai str. 56601
aaucuacaaaacuuuacg

SEQ ID NO: 762109 - RNA, 19 nt, Leptospira interrogans serovar lai str. 56601
aaucuacaaaacuuuacga

SEQ ID NO: 762110 - RNA, 23 nt, Leptospira interrogans serovar lai str. 56601
aaucuacaaaacuuuacgaguuu

SEQ ID NO: 762111 - RNA, 19 nt, Leptospira interrogans serovar lai str. 56601
aaucgucuguaaaagaaaa

SEQ ID NO: 762112 - RNA, 17 nt, Leptospira interrogans serovar lai str. 56601
aaucuaccccaucucuu

SEQ ID NO: 762113 - RNA, 19 nt, Leptospira interrogans serovar lai str. 56601
aaucuaggauauuugauau

SEQ ID NO: 762114 - RNA, 21 nt, Leptospira interrogans serovar lai str. 56601
aaucuaggauauuugauauaa

SEQ ID NO: 762115 - RNA, 14 nt, Leptospira interrogans serovar lai str. 56601
aaucuaggaacugc

SEQ ID NO: 762116 - RNA, 21 nt, Leptospira interrogans serovar lai str. 56601
aaucuaggaacugcuuccaaa

SEQ ID NO: 762117 - RNA, 22 nt, Leptospira interrogans serovar lai str. 56601
aaucuaggaacugcuuccaaaa

SEQ ID NO: 762118 - RNA, 15 nt, Leptospira interrogans serovar lai str. 56601
aauccguagccgcuu

SEQ ID NO: 762119 - RNA, 21 nt, Leptospira interrogans serovar lai str. 56601
aauccguagccgcuucaaagu

SEQ ID NO: 762120 - RNA, 22 nt, Leptospira interrogans serovar lai str. 56601
aauccgcuuuggaauuggcuuc

SEQ ID NO: 762121 - RNA, 18 nt, Leptospira interrogans serovar lai str. 56601
aauccggaaguaauuaca

SEQ ID NO: 762122 - RNA, 23 nt, Leptospira interrogans serovar lai str. 56601
aauccggauuuguuaauuuuuag

SEQ ID NO: 762123 - RNA, 16 nt, Leptospira interrogans serovar lai str. 56601
aauccucaacagauac

SEQ ID NO: 762124 - RNA, 20 nt, Leptospira interrogans serovar lai str. 56601
aauccucgcuuuuaauaauu

SEQ ID NO: 762125 - RNA, 22 nt, Leptospira interrogans serovar lai str. 56601
aauccucgcuuuuaauaauuca

SEQ ID NO: 762126 - RNA, 18 nt, Leptospira interrogans serovar lai str. 56601
aaucccagaaaggaacua

SEQ ID NO: 762127 - RNA, 12 nt, Leptospira interrogans serovar lai str. 56601
aaucccauuuua

SEQ ID NO: 762128 - RNA, 15 nt, Leptospira interrogans serovar lai str. 56601
aauccgaaaaaccuu

SEQ ID NO: 762129 - RNA, 14 nt, Leptospira interrogans serovar lai str. 56601
aauccgaauacaaa

SEQ ID NO: 762130 - RNA, 15 nt, Leptospira interrogans serovar lai str. 56601
aauccgauuccagca

SEQ ID NO: 762131 - RNA, 14 nt, Leptospira interrogans serovar lai str. 56601
aauauuaaaacacu

SEQ ID NO: 762132 - RNA, 12 nt, Leptospira interrogans serovar lai str. 56601
aauauuaaaaaa

SEQ ID NO: 762133 - RNA, 14 nt, Leptospira interrogans serovar lai str. 56601
aauauuaaaaaaau

SEQ ID NO: 762134 - RNA, 20 nt, Leptospira interrogans serovar lai str. 56601
aauauuaaaaaaauaauaua

SEQ ID NO: 762135 - RNA, 14 nt, Leptospira interrogans serovar lai str. 56601
aauauuaaaaacac

SEQ ID NO: 762136 - RNA, 18 nt, Leptospira interrogans serovar lai str. 56601
aaucagggccggagaaaa

SEQ ID NO: 762137 - RNA, 20 nt, Leptospira interrogans serovar lai str. 56601
aaucagguuuuauaaaguga

SEQ ID NO: 762138 - RNA, 15 nt, Leptospira interrogans serovar lai str. 56601
aaucauacaaucaaa

SEQ ID NO: 762139 - RNA, 15 nt, Leptospira interrogans serovar lai str. 56601
aaucauacuuuuaaa

SEQ ID NO: 762140 - RNA, 17 nt, Leptospira interrogans serovar lai str. 56601
aaucaugaauauuuucc

SEQ ID NO: 762141 - RNA, 17 nt, Leptospira interrogans serovar lai str. 56601
aaucauggccuucugga

SEQ ID NO: 762142 - RNA, 22 nt, Leptospira interrogans serovar lai str. 56601
aaucauggccuucuggaaaaau

SEQ ID NO: 762143 - RNA, 20 nt, Leptospira interrogans serovar lai str. 56601
aaucauauggauuauccaaa

SEQ ID NO: 762144 - RNA, 21 nt, Leptospira interrogans serovar lai str. 56601
aaucauaggauacaaaacuuu

SEQ ID NO: 762145 - RNA, 14 nt, Leptospira interrogans serovar lai str. 56601
aaucauagguuauu

SEQ ID NO: 762146 - RNA, 22 nt, Leptospira interrogans serovar lai str. 56601
aaucauagucauuuugauaauu

SEQ ID NO: 762147 - RNA, 19 nt, Leptospira interrogans serovar lai str. 56601
aaucaugucucaguucaaa

SEQ ID NO: 762148 - RNA, 22 nt, Leptospira interrogans serovar lai str. 56601
aaucauucuuuagaaauuuuua

SEQ ID NO: 762149 - RNA, 23 nt, Leptospira interrogans serovar lai str. 56601
aaucauucuuuagaaauuuuuaa

SEQ ID NO: 762150 - RNA, 13 nt, Leptospira interrogans serovar lai str. 56601
aauccauuuuucc

SEQ ID NO: 762151 - RNA, 13 nt, Leptospira interrogans serovar lai str. 56601
aaucccaaaaccg

SEQ ID NO: 762152 - RNA, 15 nt, Leptospira interrogans serovar lai str. 56601
aauccauucaaaaaa

SEQ ID NO: 762153 - RNA, 22 nt, Leptospira interrogans serovar lai str. 56601
aauccauagaaagguuauccuc

SEQ ID NO: 762154 - RNA, 19 nt, Leptospira interrogans serovar lai str. 56601
aauccaucugagaauuucu

SEQ ID NO: 762155 - RNA, 12 nt, Leptospira interrogans serovar lai str. 56601
aauccauaucua

SEQ ID NO: 762156 - RNA, 23 nt, Leptospira interrogans serovar lai str. 56601
aauccauaucuacgacuaacaaa

SEQ ID NO: 762157 - RNA, 15 nt, Leptospira interrogans serovar lai str. 56601
aauccauaugaguuc

SEQ ID NO: 762158 - RNA, 16 nt, Leptospira interrogans serovar lai str. 56601
aauccagcugaaacua

SEQ ID NO: 762159 - RNA, 18 nt, Leptospira interrogans serovar lai str. 56601
aaucauuuucaauuuuua

SEQ ID NO: 762160 - RNA, 11 nt, Leptospira interrogans serovar lai str. 56601
aauccaaaauu

SEQ ID NO: 762161 - RNA, 21 nt, Leptospira interrogans serovar lai str. 56601
aaucauuuuuugggcuucuga

SEQ ID NO: 762162 - RNA, 22 nt, Leptospira interrogans serovar lai str. 56601
aauccaaaguucccgccaaaug

SEQ ID NO: 762163 - RNA, 16 nt, Leptospira interrogans serovar lai str. 56601
aaucauucuuuuguga

SEQ ID NO: 762164 - RNA, 21 nt, Leptospira interrogans serovar lai str. 56601
aauccaaguagagagugaaaa

SEQ ID NO: 762165 - RNA, 14 nt, Leptospira interrogans serovar lai str. 56601
aauccaauaaaauu

SEQ ID NO: 762166 - RNA, 18 nt, Leptospira interrogans serovar lai str. 56601
aauccaacuuaaaacugu

SEQ ID NO: 762167 - RNA, 16 nt, Leptospira interrogans serovar lai str. 56601
aacuuuuuuuaaaaaa

SEQ ID NO: 762168 - RNA, 15 nt, Leptospira interrogans serovar lai str. 56601
aacuuuuuuuagaau

SEQ ID NO: 762169 - RNA, 17 nt, Leptospira interrogans serovar lai str. 56601
aacuuuuuuagcaaaua

SEQ ID NO: 762170 - RNA, 15 nt, Leptospira interrogans serovar lai str. 56601
aacuuuuuauaaaga

SEQ ID NO: 762171 - RNA, 20 nt, Leptospira interrogans serovar lai str. 56601
aagaaaaagagaugguuuag

SEQ ID NO: 762172 - RNA, 19 nt, Leptospira interrogans serovar lai str. 56601
aagaaaaaacuuucuaaaa

SEQ ID NO: 762173 - RNA, 14 nt, Leptospira interrogans serovar lai str. 56601
aagaaaaaagcagc

SEQ ID NO: 762174 - RNA, 19 nt, Leptospira interrogans serovar lai str. 56601
aagaaaaaagcagcuaaaa

SEQ ID NO: 762175 - RNA, 16 nt, Leptospira interrogans serovar lai str. 56601
aagaaaaccuaaaaua

SEQ ID NO: 762176 - RNA, 22 nt, Leptospira interrogans serovar lai str. 56601
aagaaaaucugggcaaauuuag

SEQ ID NO: 762177 - RNA, 14 nt, Leptospira interrogans serovar lai str. 56601
aagaaacaucaaaa

SEQ ID NO: 762178 - RNA, 17 nt, Leptospira interrogans serovar lai str. 56601
aagaaaauuuaaaauau

SEQ ID NO: 762179 - RNA, 20 nt, Leptospira interrogans serovar lai str. 56601
aagaaaauuuaaaauauaaa

SEQ ID NO: 762180 - RNA, 12 nt, Leptospira interrogans serovar lai str. 56601
aagaaacaaaga

SEQ ID NO: 762181 - RNA, 15 nt, Leptospira interrogans serovar lai str. 56601
aagaaacaaagaaua

SEQ ID NO: 762182 - RNA, 15 nt, Leptospira interrogans serovar lai str. 56601
aagaaagacuuuucc

SEQ ID NO: 762183 - RNA, 18 nt, Leptospira interrogans serovar lai str. 56601
aagaaagcagcaaagaag

SEQ ID NO: 762184 - RNA, 19 nt, Leptospira interrogans serovar lai str. 56601
aagaaaccucuauaaauga

SEQ ID NO: 762185 - RNA, 17 nt, Leptospira interrogans serovar lai str. 56601
aagaaaccgaucuuaaa

SEQ ID NO: 762186 - RNA, 18 nt, Leptospira interrogans serovar lai str. 56601
aagaaaccgaucuuaaaa

SEQ ID NO: 762187 - RNA, 19 nt, Leptospira interrogans serovar lai str. 56601
aagaaacggaagaaaauua

SEQ ID NO: 762188 - RNA, 10 nt, Leptospira interrogans serovar lai str. 56601
aagaaacuca

SEQ ID NO: 762189 - RNA, 20 nt, Leptospira interrogans serovar lai str. 56601
aagaaacucauaaaauaacu

SEQ ID NO: 762190 - RNA, 15 nt, Leptospira interrogans serovar lai str. 56601
aagaaacguuauaca

SEQ ID NO: 762191 - RNA, 16 nt, Leptospira interrogans serovar lai str. 56601
aagaaacuuaauaaaa

SEQ ID NO: 762192 - RNA, 13 nt, Leptospira interrogans serovar lai str. 56601
aagaaauauuaaa

SEQ ID NO: 762193 - RNA, 15 nt, Leptospira interrogans serovar lai str. 56601
aagaaauauuaaaaa

SEQ ID NO: 762194 - RNA, 19 nt, Leptospira interrogans serovar lai str. 56601
aagaaauauuaaaaaaaua

SEQ ID NO: 762195 - RNA, 21 nt, Leptospira interrogans serovar lai str. 56601
aagaaauauuaaaaaaauaau

SEQ ID NO: 762196 - RNA, 15 nt, Leptospira interrogans serovar lai str. 56601
aagaaauagaaaagc

SEQ ID NO: 762197 - RNA, 16 nt, Leptospira interrogans serovar lai str. 56601
aagaaauagaaaagca

SEQ ID NO: 762198 - RNA, 16 nt, Leptospira interrogans serovar lai str. 56601
aagaaaguugcaaaga

SEQ ID NO: 762199 - RNA, 18 nt, Leptospira interrogans serovar lai str. 56601
aagaaaguugcaaagaag

SEQ ID NO: 762200 - RNA, 22 nt, Leptospira interrogans serovar lai str. 56601
aagaaaguuugggcgaauaaaa

SEQ ID NO: 762201 - RNA, 13 nt, Leptospira interrogans serovar lai str. 56601
aagaaaguauuaa

SEQ ID NO: 762202 - RNA, 15 nt, Leptospira interrogans serovar lai str. 56601
aagaaaguauuaauu

SEQ ID NO: 762203 - RNA, 9 nt, Leptospira interrogans serovar lai str. 56601
aagaacaac

SEQ ID NO: 762204 - RNA, 22 nt, Leptospira interrogans serovar lai str. 56601
aagaacaacccccguuauuaaa

SEQ ID NO: 762205 - RNA, 11 nt, Leptospira interrogans serovar lai str. 56601
aagaaauuuaa

SEQ ID NO: 762206 - RNA, 15 nt, Leptospira interrogans serovar lai str. 56601
aagaaauuuaaguuu

SEQ ID NO: 762207 - RNA, 16 nt, Leptospira interrogans serovar lai str. 56601
aagaaauuuaaguuuu

SEQ ID NO: 762208 - RNA, 22 nt, Leptospira interrogans serovar lai str. 56601
aagaacacugcauuuuauuaaa

SEQ ID NO: 762209 - RNA, 23 nt, Leptospira interrogans serovar lai str. 56601
aagaacacugcauuuuauuaaaa

SEQ ID NO: 762210 - RNA, 19 nt, Leptospira interrogans serovar lai str. 56601
aagaacaauuuaaaauaau

SEQ ID NO: 762211 - RNA, 20 nt, Leptospira interrogans serovar lai str. 56601
aagaacaauuuaaaauaauu

SEQ ID NO: 762212 - RNA, 22 nt, Leptospira interrogans serovar lai str. 56601
aagaaccguaacugacauucca

SEQ ID NO: 762213 - RNA, 14 nt, Leptospira interrogans serovar lai str. 56601
aagaacgauuuuuu

SEQ ID NO: 762214 - RNA, 22 nt, Leptospira interrogans serovar lai str. 56601
aagaaccucuucugauuguaac

SEQ ID NO: 762215 - RNA, 14 nt, Leptospira interrogans serovar lai str. 56601
aagaagaaaagaau

SEQ ID NO: 762216 - RNA, 16 nt, Leptospira interrogans serovar lai str. 56601
aagaagaaaagaaucu

SEQ ID NO: 762217 - RNA, 15 nt, Leptospira interrogans serovar lai str. 56601
aagaagagucaaaca

SEQ ID NO: 762218 - RNA, 12 nt, Leptospira interrogans serovar lai str. 56601
aagaagauaaaa

SEQ ID NO: 762219 - RNA, 14 nt, Leptospira interrogans serovar lai str. 56601
aagaagauaaaacu

SEQ ID NO: 762220 - RNA, 14 nt, Leptospira interrogans serovar lai str. 56601
aagaagaaauaagu

SEQ ID NO: 762221 - RNA, 19 nt, Leptospira interrogans serovar lai str. 56601
aagaagccaauuccaaaaa

SEQ ID NO: 762222 - RNA, 16 nt, Leptospira interrogans serovar lai str. 56601
aagaagaugcuuucuc

SEQ ID NO: 762223 - RNA, 21 nt, Leptospira interrogans serovar lai str. 56601
aagaagaugcuuucucuuuuu

SEQ ID NO: 762224 - RNA, 17 nt, Leptospira interrogans serovar lai str. 56601
aagaagcuaaaauugaa

SEQ ID NO: 762225 - RNA, 23 nt, Leptospira interrogans serovar lai str. 56601
aacuuacaaagcacuuuuuuccu

SEQ ID NO: 762226 - RNA, 17 nt, Leptospira interrogans serovar lai str. 56601
aacuuaaugagauuaaa

SEQ ID NO: 762227 - RNA, 14 nt, Leptospira interrogans serovar lai str. 56601
aacuuaauuuuaua

SEQ ID NO: 762228 - RNA, 19 nt, Leptospira interrogans serovar lai str. 56601
aacuuaaauucggaaauuu

SEQ ID NO: 762229 - RNA, 15 nt, Leptospira interrogans serovar lai str. 56601
aacuuauaacugcaa

SEQ ID NO: 762230 - RNA, 15 nt, Leptospira interrogans serovar lai str. 56601
aacuuauaagacauu

SEQ ID NO: 762231 - RNA, 19 nt, Leptospira interrogans serovar lai str. 56601
aacuuagguuuaucuguaa

SEQ ID NO: 762232 - RNA, 23 nt, Leptospira interrogans serovar lai str. 56601
aacuuagguuuguacguaaaaau

SEQ ID NO: 762233 - RNA, 22 nt, Leptospira interrogans serovar lai str. 56601
aacuuauacuuuauagaaaauu

SEQ ID NO: 762234 - RNA, 24 nt, Leptospira interrogans serovar lai str. 56601
aacuuaugcuauuuaauuuuguag

SEQ ID NO: 762235 - RNA, 14 nt, Leptospira interrogans serovar lai str. 56601
aacuuccuugugac

SEQ ID NO: 762236 - RNA, 19 nt, Leptospira interrogans serovar lai str. 56601
aacuucagccgcuucauca

SEQ ID NO: 762237 - RNA, 23 nt, Leptospira interrogans serovar lai str. 56601
aacuucuucccagggauaagcau

SEQ ID NO: 762238 - RNA, 14 nt, Leptospira interrogans serovar lai str. 56601
aacuucuccuuucg

SEQ ID NO: 762239 - RNA, 12 nt, Leptospira interrogans serovar lai str. 56601
aacuucuauuuu

SEQ ID NO: 762240 - RNA, 15 nt, Leptospira interrogans serovar lai str. 56601
aacuucuauuuuuua

SEQ ID NO: 762241 - RNA, 21 nt, Leptospira interrogans serovar lai str. 56601
aacuucgguauaaucuaauuc

SEQ ID NO: 762242 - RNA, 13 nt, Leptospira interrogans serovar lai str. 56601
aacuuuuucagaa

SEQ ID NO: 762243 - RNA, 19 nt, Leptospira interrogans serovar lai str. 56601
aacuuuuucagaaaaauga

SEQ ID NO: 762244 - RNA, 14 nt, Leptospira interrogans serovar lai str. 56601
aacuuuuucguuuu

SEQ ID NO: 762245 - RNA, 18 nt, Leptospira interrogans serovar lai str. 56601
aacuuuuucguuuuuuag

SEQ ID NO: 762246 - RNA, 20 nt, Leptospira interrogans serovar lai str. 56601
aacuuuucuaaauugagaau

SEQ ID NO: 762247 - RNA, 21 nt, Leptospira interrogans serovar lai str. 56601
aacuuugguuaucauaaaaau

SEQ ID NO: 762248 - RNA, 22 nt, Leptospira interrogans serovar lai str. 56601
aacuuugguuaucauaaaaaua

SEQ ID NO: 762249 - RNA, 14 nt, Leptospira interrogans serovar lai str. 56601
aacuuuuagaauuc

SEQ ID NO: 762250 - RNA, 18 nt, Leptospira interrogans serovar lai str. 56601
aacuuuuaaagaagauaa

SEQ ID NO: 762251 - RNA, 19 nt, Leptospira interrogans serovar lai str. 56601
aacuuugaccauucuuugu

SEQ ID NO: 762252 - RNA, 14 nt, Leptospira interrogans serovar lai str. 56601
aacuuucuaaaaau

SEQ ID NO: 762253 - RNA, 15 nt, Leptospira interrogans serovar lai str. 56601
aacuuuagaaaaaua

SEQ ID NO: 762254 - RNA, 23 nt, Leptospira interrogans serovar lai str. 56601
aacuuuaccggguuccauucuaa

SEQ ID NO: 762255 - RNA, 14 nt, Leptospira interrogans serovar lai str. 56601
aacuuuacgaguuu

SEQ ID NO: 762256 - RNA, 14 nt, Leptospira interrogans serovar lai str. 56601
aacuuuacaaaaau

SEQ ID NO: 762257 - RNA, 16 nt, Leptospira interrogans serovar lai str. 56601
aacuuuacaaaaaugu

SEQ ID NO: 762258 - RNA, 22 nt, Leptospira interrogans serovar lai str. 56601
aacuuuacacgauaauuuuuag

SEQ ID NO: 762259 - RNA, 22 nt, Leptospira interrogans serovar lai str. 56601
aacuuucauugauaauuucuag

SEQ ID NO: 762260 - RNA, 17 nt, Leptospira interrogans serovar lai str. 56601
aacuuucaaaauaggaa

SEQ ID NO: 762261 - RNA, 20 nt, Leptospira interrogans serovar lai str. 56601
aacuuucaaagaauauaaaa

SEQ ID NO: 762262 - RNA, 21 nt, Leptospira interrogans serovar lai str. 56601
aacuuucaaagaauauaaaau

SEQ ID NO: 762263 - RNA, 16 nt, Leptospira interrogans serovar lai str. 56601
aacuuggguuucuuaa

SEQ ID NO: 762264 - RNA, 20 nt, Leptospira interrogans serovar lai str. 56601
aacuuggaaucuuaaaaaga

SEQ ID NO: 762265 - RNA, 13 nt, Leptospira interrogans serovar lai str. 56601
aacuuguaagacu

SEQ ID NO: 762266 - RNA, 16 nt, Leptospira interrogans serovar lai str. 56601
aacuugucccaaaauu

SEQ ID NO: 762267 - RNA, 21 nt, Leptospira interrogans serovar lai str. 56601
aacuugucccaaaauuuuaua

SEQ ID NO: 762268 - RNA, 16 nt, Leptospira interrogans serovar lai str. 56601
aacuuguccuaaaauu

SEQ ID NO: 762269 - RNA, 20 nt, Leptospira interrogans serovar lai str. 56601
aacuuguccuaaaauuuuaa

SEQ ID NO: 762270 - RNA, 20 nt, Leptospira interrogans serovar lai str. 56601
aacuuguuguaccauuuuga

SEQ ID NO: 762271 - RNA, 12 nt, Leptospira interrogans serovar lai str. 56601
aacuuuaaaaaa

SEQ ID NO: 762272 - RNA, 16 nt, Leptospira interrogans serovar lai str. 56601
aacuuuaaaaaauaag

SEQ ID NO: 762273 - RNA, 23 nt, Leptospira interrogans serovar lai str. 56601
aacuuuaauuauugauauuacua

SEQ ID NO: 762274 - RNA, 14 nt, Leptospira interrogans serovar lai str. 56601
aacuuuaauuuucu

SEQ ID NO: 762275 - RNA, 14 nt, Leptospira interrogans serovar lai str. 56601
aacuugagcaaauc

SEQ ID NO: 762276 - RNA, 18 nt, Leptospira interrogans serovar lai str. 56601
aacuugccguuuuucuaa

SEQ ID NO: 762277 - RNA, 22 nt, Leptospira interrogans serovar lai str. 56601
aacuugaguucgacguaagaau

SEQ ID NO: 762278 - RNA, 15 nt, Leptospira interrogans serovar lai str. 56601
aacuguugaaaaaau

SEQ ID NO: 762279 - RNA, 22 nt, Leptospira interrogans serovar lai str. 56601
aacuguugaaaaaauccauauc

SEQ ID NO: 762280 - RNA, 13 nt, Leptospira interrogans serovar lai str. 56601
aacuuaaaacugu

SEQ ID NO: 762281 - RNA, 19 nt, Leptospira interrogans serovar lai str. 56601
aacuguaaauuagauuauu

SEQ ID NO: 762282 - RNA, 14 nt, Leptospira interrogans serovar lai str. 56601
aacugcuuccaaaa

SEQ ID NO: 762283 - RNA, 17 nt, Leptospira interrogans serovar lai str. 56601
aacugcuucaauugucc

SEQ ID NO: 762284 - RNA, 15 nt, Leptospira interrogans serovar lai str. 56601
aacuguaaacuugau

SEQ ID NO: 762285 - RNA, 16 nt, Leptospira interrogans serovar lai str. 56601
aacugcucgaaaguuu

SEQ ID NO: 762286 - RNA, 15 nt, Leptospira interrogans serovar lai str. 56601
aacugauuauaaaaa

SEQ ID NO: 762287 - RNA, 20 nt, Leptospira interrogans serovar lai str. 56601
aacugaaaaugaccaaaauu

SEQ ID NO: 762288 - RNA, 20 nt, Leptospira interrogans serovar lai str. 56601
aacucuuuuaccuuaccacc

SEQ ID NO: 762289 - RNA, 22 nt, Leptospira interrogans serovar lai str. 56601
aacuauuauacuuuauuaagaa

SEQ ID NO: 762290 - RNA, 15 nt, Leptospira interrogans serovar lai str. 56601
aacuauuacaaaucg

SEQ ID NO: 762291 - RNA, 16 nt, Leptospira interrogans serovar lai str. 56601
aacuauauaacaaagu

SEQ ID NO: 762292 - RNA, 17 nt, Leptospira interrogans serovar lai str. 56601
aacuauauaauaaagua

SEQ ID NO: 762293 - RNA, 16 nt, Leptospira interrogans serovar lai str. 56601
aacuaugaaauuuuuc

SEQ ID NO: 762294 - RNA, 15 nt, Leptospira interrogans serovar lai str. 56601
aacuaucacaaaucu

SEQ ID NO: 762295 - RNA, 16 nt, Leptospira interrogans serovar lai str. 56601
aacucacaaguugaau

SEQ ID NO: 762296 - RNA, 15 nt, Leptospira interrogans serovar lai str. 56601
aacucaauguugcuc

SEQ ID NO: 762297 - RNA, 21 nt, Leptospira interrogans serovar lai str. 56601
aacucaacacaacgcucucua

SEQ ID NO: 762298 - RNA, 22 nt, Leptospira interrogans serovar lai str. 56601
aacucaacacaacgcucuuuau

SEQ ID NO: 762299 - RNA, 13 nt, Leptospira interrogans serovar lai str. 56601
aacucaacagaac

SEQ ID NO: 762300 - RNA, 24 nt, Leptospira interrogans serovar lai str. 56601
aacucaacagaacgggcuuucuau

SEQ ID NO: 762301 - RNA, 17 nt, Leptospira interrogans serovar lai str. 56601
aacucaaagaaauuuua

SEQ ID NO: 762302 - RNA, 14 nt, Leptospira interrogans serovar lai str. 56601
aacucaaaggaaaa

SEQ ID NO: 762303 - RNA, 18 nt, Leptospira interrogans serovar lai str. 56601
aacucaaaggaaaaugaa

SEQ ID NO: 762304 - RNA, 14 nt, Leptospira interrogans serovar lai str. 56601
aacuauuuuuugua

SEQ ID NO: 762305 - RNA, 15 nt, Leptospira interrogans serovar lai str. 56601
aacuauuuuuuguau

SEQ ID NO: 762306 - RNA, 23 nt, Leptospira interrogans serovar lai str. 56601
aacuauuaucuuucgauuuuaaa

SEQ ID NO: 762307 - RNA, 15 nt, Leptospira interrogans serovar lai str. 56601
aacuauuuauaaaau

SEQ ID NO: 762308 - RNA, 20 nt, Leptospira interrogans serovar lai str. 56601
aacuauuuauaaaauaaaaa

SEQ ID NO: 762309 - RNA, 16 nt, Leptospira interrogans serovar lai str. 56601
aacucacgcuaaaaua

SEQ ID NO: 762310 - RNA, 17 nt, Leptospira interrogans serovar lai str. 56601
aacucacguuaaaagua

SEQ ID NO: 762311 - RNA, 22 nt, Leptospira interrogans serovar lai str. 56601
aacucacguuaaauagaaacca

SEQ ID NO: 762312 - RNA, 17 nt, Leptospira interrogans serovar lai str. 56601
aacucacguuacuacuc

SEQ ID NO: 762313 - RNA, 18 nt, Leptospira interrogans serovar lai str. 56601
aacucacguuauauuaau

SEQ ID NO: 762314 - RNA, 21 nt, Leptospira interrogans serovar lai str. 56601
aacucacguuauuuuaacuug

SEQ ID NO: 762315 - RNA, 23 nt, Leptospira interrogans serovar lai str. 56601
aacucacguuauuuuaacuugag

SEQ ID NO: 762316 - RNA, 19 nt, Leptospira interrogans serovar lai str. 56601
aacucauuuuucuaaaaaa

SEQ ID NO: 762317 - RNA, 23 nt, Leptospira interrogans serovar lai str. 56601
aacucaucuaaucgaaacuauaa

SEQ ID NO: 762318 - RNA, 17 nt, Leptospira interrogans serovar lai str. 56601
aacucauauagaaauua

SEQ ID NO: 762319 - RNA, 14 nt, Leptospira interrogans serovar lai str. 56601
aacucauauuuuua

SEQ ID NO: 762320 - RNA, 18 nt, Leptospira interrogans serovar lai str. 56601
aacucauauuuuuagaaa

SEQ ID NO: 762321 - RNA, 19 nt, Leptospira interrogans serovar lai str. 56601
aacucauauuuuuagaaaa

SEQ ID NO: 762322 - RNA, 21 nt, Leptospira interrogans serovar lai str. 56601
aacucauauuuuuagaaaauu

SEQ ID NO: 762323 - RNA, 22 nt, Leptospira interrogans serovar lai str. 56601
aacucauacuuuuagauaauua

SEQ ID NO: 762324 - RNA, 21 nt, Leptospira interrogans serovar lai str. 56601
aacuccgccgcgauuucucuc

SEQ ID NO: 762325 - RNA, 16 nt, Leptospira interrogans serovar lai str. 56601
aacucccugauaacuc

SEQ ID NO: 762326 - RNA, 19 nt, Leptospira interrogans serovar lai str. 56601
aacuccgacagauuuauau

SEQ ID NO: 762327 - RNA, 23 nt, Leptospira interrogans serovar lai str. 56601
aacuccauaguucaauuaacaaa

SEQ ID NO: 762328 - RNA, 18 nt, Leptospira interrogans serovar lai str. 56601
aacucccacaauuuugaa

SEQ ID NO: 762329 - RNA, 22 nt, Leptospira interrogans serovar lai str. 56601
aacuccuugguucaaaguuuuc

SEQ ID NO: 762330 - RNA, 16 nt, Leptospira interrogans serovar lai str. 56601
aacucgguguaaaaaa

SEQ ID NO: 762331 - RNA, 16 nt, Leptospira interrogans serovar lai str. 56601
aacucgguuucuuaua

SEQ ID NO: 762332 - RNA, 16 nt, Leptospira interrogans serovar lai str. 56601
aacucuaauguaggaa

SEQ ID NO: 762333 - RNA, 14 nt, Leptospira interrogans serovar lai str. 56601
aacucuaauacaaa

SEQ ID NO: 762334 - RNA, 18 nt, Leptospira interrogans serovar lai str. 56601
aacucuaauacaaaaaau

SEQ ID NO: 762335 - RNA, 20 nt, Leptospira interrogans serovar lai str. 56601
aacucuaauacaaaaaaugu

SEQ ID NO: 762336 - RNA, 23 nt, Leptospira interrogans serovar lai str. 56601
aacucuaauauaaaaaccacaaa

SEQ ID NO: 762337 - RNA, 15 nt, Leptospira interrogans serovar lai str. 56601
aacucuauauaaaga

SEQ ID NO: 762338 - RNA, 17 nt, Leptospira interrogans serovar lai str. 56601
aacucuauauaaagaaa

SEQ ID NO: 762339 - RNA, 19 nt, Leptospira interrogans serovar lai str. 56601
aacucuauucauaaaugau

SEQ ID NO: 762340 - RNA, 19 nt, Leptospira interrogans serovar lai str. 56601
aacucuauuuuauuuuucu

SEQ ID NO: 762341 - RNA, 21 nt, Leptospira interrogans serovar lai str. 56601
aacucucacaaaucaugauuu

SEQ ID NO: 762342 - RNA, 12 nt, Leptospira interrogans serovar lai str. 56601
aacucuuuaaaa

SEQ ID NO: 762343 - RNA, 16 nt, Leptospira interrogans serovar lai str. 56601
aacucuuuaaaaacuu

SEQ ID NO: 762344 - RNA, 16 nt, Leptospira interrogans serovar lai str. 56601
aacucuugaacagaaa

SEQ ID NO: 762345 - RNA, 22 nt, Leptospira interrogans serovar lai str. 56601
aacucuugaacagaaagaucau

SEQ ID NO: 762346 - RNA, 13 nt, Leptospira interrogans serovar lai str. 56601
aacucuuacaauu

SEQ ID NO: 762347 - RNA, 19 nt, Leptospira interrogans serovar lai str. 56601
aacucuuacuuugagaaaa

SEQ ID NO: 762348 - RNA, 20 nt, Leptospira interrogans serovar lai str. 56601
aacucuguucaguguaagau

SEQ ID NO: 762349 - RNA, 22 nt, Leptospira interrogans serovar lai str. 56601
aacucuguucaguguaagauua

SEQ ID NO: 762350 - RNA, 14 nt, Leptospira interrogans serovar lai str. 56601
aacguuuucaaaaa

SEQ ID NO: 762351 - RNA, 19 nt, Leptospira interrogans serovar lai str. 56601
aacguuuucaaaaaauuuc

SEQ ID NO: 762352 - RNA, 18 nt, Leptospira interrogans serovar lai str. 56601
aacguuuauuucaaaauu

SEQ ID NO: 762353 - RNA, 18 nt, Leptospira interrogans serovar lai str. 56601
aacguuauacaauauuuc

SEQ ID NO: 762354 - RNA, 23 nt, Leptospira interrogans serovar lai str. 56601
aacguuauacaauauuucgucuu

SEQ ID NO: 762355 - RNA, 14 nt, Leptospira interrogans serovar lai str. 56601
aacguucaaacaac

SEQ ID NO: 762356 - RNA, 13 nt, Leptospira interrogans serovar lai str. 56601
aacgugagcucua

SEQ ID NO: 762357 - RNA, 23 nt, Leptospira interrogans serovar lai str. 56601
aacgugaguucguggagaaaacg

SEQ ID NO: 762358 - RNA, 23 nt, Leptospira interrogans serovar lai str. 56601
aacgugaguuugauguaagguaa

SEQ ID NO: 762359 - RNA, 17 nt, Leptospira interrogans serovar lai str. 56601
aacgucuaguccucuuu

SEQ ID NO: 762360 - RNA, 14 nt, Leptospira interrogans serovar lai str. 56601
aacgucuuuaucca

SEQ ID NO: 762361 - RNA, 19 nt, Leptospira interrogans serovar lai str. 56601
aacguagauaauuaaacaa

SEQ ID NO: 762362 - RNA, 19 nt, Leptospira interrogans serovar lai str. 56601
aacguaugauguaaggagc

SEQ ID NO: 762363 - RNA, 20 nt, Leptospira interrogans serovar lai str. 56601
aacguaugauguaaggagcc

SEQ ID NO: 762364 - RNA, 13 nt, Leptospira interrogans serovar lai str. 56601
aacguauuuuuac

SEQ ID NO: 762365 - RNA, 12 nt, Leptospira interrogans serovar lai str. 56601
aacgucaaaauu

SEQ ID NO: 762366 - RNA, 22 nt, Leptospira interrogans serovar lai str. 56601
aacgucauaguucccacaaauu

SEQ ID NO: 762367 - RNA, 21 nt, Leptospira interrogans serovar lai str. 56601
aacguuuugcguuuuuaaaca

SEQ ID NO: 762368 - RNA, 18 nt, Leptospira interrogans serovar lai str. 56601
aacuaaauccuucuuuuc

SEQ ID NO: 762369 - RNA, 19 nt, Leptospira interrogans serovar lai str. 56601
aacuaauaccgguuucaua

SEQ ID NO: 762370 - RNA, 12 nt, Leptospira interrogans serovar lai str. 56601
aacuaauaaaaa

SEQ ID NO: 762371 - RNA, 16 nt, Leptospira interrogans serovar lai str. 56601
aacuaauaaaaacaau

SEQ ID NO: 762372 - RNA, 15 nt, Leptospira interrogans serovar lai str. 56601
aacuaacuaugauaa

SEQ ID NO: 762373 - RNA, 21 nt, Leptospira interrogans serovar lai str. 56601
aacuaacgcucauuuccauaa

SEQ ID NO: 762374 - RNA, 15 nt, Leptospira interrogans serovar lai str. 56601
aacuauaauaacaaa

SEQ ID NO: 762375 - RNA, 17 nt, Leptospira interrogans serovar lai str. 56601
aacuauacuuucaaaaa

SEQ ID NO: 762376 - RNA, 20 nt, Leptospira interrogans serovar lai str. 56601
aacuauacuuucaaaaaaua

SEQ ID NO: 762377 - RNA, 21 nt, Leptospira interrogans serovar lai str. 56601
aacuauacuuucaaaaaauau

SEQ ID NO: 762378 - RNA, 12 nt, Leptospira interrogans serovar lai str. 56601
aacuaguuccuu

SEQ ID NO: 762379 - RNA, 16 nt, Leptospira interrogans serovar lai str. 56601
aacuagggaauuuuuc

SEQ ID NO: 762380 - RNA, 14 nt, Leptospira interrogans serovar lai str. 56601
aacuacuuuuauaa

SEQ ID NO: 762381 - RNA, 19 nt, Leptospira interrogans serovar lai str. 56601
aacuacuuuuauaaaaagu

SEQ ID NO: 762382 - RNA, 17 nt, Leptospira interrogans serovar lai str. 56601
aacuacugcauucuuag

SEQ ID NO: 762383 - RNA, 13 nt, Leptospira interrogans serovar lai str. 56601
aacuaauuuguag

SEQ ID NO: 762384 - RNA, 19 nt, Leptospira interrogans serovar lai str. 56601
aacuaauuuuaguuuauuu

SEQ ID NO: 762385 - RNA, 18 nt, Leptospira interrogans serovar lai str. 56601
aacuacccagucuccaua

SEQ ID NO: 762386 - RNA, 16 nt, Leptospira interrogans serovar lai str. 56601
aacuaccacaaaucua

SEQ ID NO: 762387 - RNA, 22 nt, Leptospira interrogans serovar lai str. 56601
aacuaccaccaaaguaugauuu

SEQ ID NO: 762388 - RNA, 17 nt, Leptospira interrogans serovar lai str. 56601
aacuacacguuuuccua

SEQ ID NO: 762389 - RNA, 22 nt, Leptospira interrogans serovar lai str. 56601
aacuacagaauuuuuuaacaau

SEQ ID NO: 762390 - RNA, 16 nt, Leptospira interrogans serovar lai str. 56601
aacuacagcaaaucac

SEQ ID NO: 762391 - RNA, 14 nt, Leptospira interrogans serovar lai str. 56601
aacuacagcaaauu

SEQ ID NO: 762392 - RNA, 23 nt, Leptospira interrogans serovar lai str. 56601
aacuacagcaaauucugauuuua

SEQ ID NO: 762393 - RNA, 20 nt, Leptospira interrogans serovar lai str. 56601
aacuaccgcaaacaucuaga

SEQ ID NO: 762394 - RNA, 16 nt, Leptospira interrogans serovar lai str. 56601
aacuaccgcaaaucaa

SEQ ID NO: 762395 - RNA, 23 nt, Leptospira interrogans serovar lai str. 56601
aacuacuccagauuuaauuuuuc

SEQ ID NO: 762396 - RNA, 16 nt, Leptospira interrogans serovar lai str. 56601
aacuaccucaauuuuc

SEQ ID NO: 762397 - RNA, 20 nt, Leptospira interrogans serovar lai str. 56601
aacuacuaaucucuauaaaa

SEQ ID NO: 762398 - RNA, 14 nt, Leptospira interrogans serovar lai str. 56601
aacuacuaauuuau

SEQ ID NO: 762399 - RNA, 15 nt, Leptospira interrogans serovar lai str. 56601
aacuacuaauuuauc

SEQ ID NO: 762400 - RNA, 18 nt, Leptospira interrogans serovar lai str. 56601
aacuacuaauuuaucgau

SEQ ID NO: 762401 - RNA, 14 nt, Leptospira interrogans serovar lai str. 56601
aacuacuacaaaaa

SEQ ID NO: 762402 - RNA, 15 nt, Leptospira interrogans serovar lai str. 56601
aacuacuacaaaaau

SEQ ID NO: 762403 - RNA, 22 nt, Leptospira interrogans serovar lai str. 56601
aacuacuacaaaaauuuaauaa

SEQ ID NO: 762404 - RNA, 17 nt, Leptospira interrogans serovar lai str. 56601
aacuacuacgaaaacuu

SEQ ID NO: 762405 - RNA, 20 nt, Leptospira interrogans serovar lai str. 56601
aacuacuacgaaaacuuaau

SEQ ID NO: 762406 - RNA, 16 nt, Leptospira interrogans serovar lai str. 56601
aacuacuacgaaaauu

SEQ ID NO: 762407 - RNA, 18 nt, Leptospira interrogans serovar lai str. 56601
aacuacuacuuuuagaaa

SEQ ID NO: 762408 - RNA, 13 nt, Leptospira interrogans serovar lai str. 56601
aacuacuauaaau

SEQ ID NO: 762409 - RNA, 17 nt, Leptospira interrogans serovar lai str. 56601
aacuacuauaaauuacu

SEQ ID NO: 762410 - RNA, 19 nt, Leptospira interrogans serovar lai str. 56601
aacgguauuuaaaauuaau

SEQ ID NO: 762411 - RNA, 19 nt, Leptospira interrogans serovar lai str. 56601
aacggugcauuuaaaaaau

SEQ ID NO: 762412 - RNA, 18 nt, Leptospira interrogans serovar lai str. 56601
aacgguacucaauuuuac

SEQ ID NO: 762413 - RNA, 23 nt, Leptospira interrogans serovar lai str. 56601
aacggugcuuuguucaaagaaau

SEQ ID NO: 762414 - RNA, 14 nt, Leptospira interrogans serovar lai str. 56601
aacguaaauuuuua

SEQ ID NO: 762415 - RNA, 17 nt, Leptospira interrogans serovar lai str. 56601
aacguaaguuaaauaua

SEQ ID NO: 762416 - RNA, 20 nt, Leptospira interrogans serovar lai str. 56601
aacguaaguuaaauauaaaa

SEQ ID NO: 762417 - RNA, 15 nt, Leptospira interrogans serovar lai str. 56601
aacguaauacgauau

SEQ ID NO: 762418 - RNA, 21 nt, Leptospira interrogans serovar lai str. 56601
aacguaauacgauauuuuguu

SEQ ID NO: 762419 - RNA, 20 nt, Leptospira interrogans serovar lai str. 56601
aacgguuuuaguaaaauuua

SEQ ID NO: 762420 - RNA, 23 nt, Leptospira interrogans serovar lai str. 56601
aacggcuuuaguuugaaagaacg

SEQ ID NO: 762421 - RNA, 15 nt, Leptospira interrogans serovar lai str. 56601
aacggccgauugaag

SEQ ID NO: 762422 - RNA, 14 nt, Leptospira interrogans serovar lai str. 56601
aacggauuccucca

SEQ ID NO: 762423 - RNA, 18 nt, Leptospira interrogans serovar lai str. 56601
aacggaguuucucauuuu

SEQ ID NO: 762424 - RNA, 18 nt, Leptospira interrogans serovar lai str. 56601
aacggagaguuaugaguu

SEQ ID NO: 762425 - RNA, 22 nt, Leptospira interrogans serovar lai str. 56601
aacggacuguuuuaauuuguag

SEQ ID NO: 762426 - RNA, 18 nt, Leptospira interrogans serovar lai str. 56601
aacgcuuucguaaaaagc

SEQ ID NO: 762427 - RNA, 13 nt, Leptospira interrogans serovar lai str. 56601
aacgcucuuuaug

SEQ ID NO: 762428 - RNA, 14 nt, Leptospira interrogans serovar lai str. 56601
aacgcucguuguaa

SEQ ID NO: 762429 - RNA, 15 nt, Leptospira interrogans serovar lai str. 56601
aacgcgaaguauucu

SEQ ID NO: 762430 - RNA, 15 nt, Leptospira interrogans serovar lai str. 56601
aacgcgaacuuuuuu

SEQ ID NO: 762431 - RNA, 14 nt, Leptospira interrogans serovar lai str. 56601
aacgcaugaaaaua

SEQ ID NO: 762432 - RNA, 15 nt, Leptospira interrogans serovar lai str. 56601
aacgcaugaaaauaa

SEQ ID NO: 762433 - RNA, 16 nt, Leptospira interrogans serovar lai str. 56601
aacgcaugaaaauaau

SEQ ID NO: 762434 - RNA, 17 nt, Leptospira interrogans serovar lai str. 56601
aacgcaugaaaauaaua

SEQ ID NO: 762435 - RNA, 15 nt, Leptospira interrogans serovar lai str. 56601
aacgauacaaauucc

SEQ ID NO: 762436 - RNA, 13 nt, Leptospira interrogans serovar lai str. 56601
aacgauauuuuuu

SEQ ID NO: 762437 - RNA, 16 nt, Leptospira interrogans serovar lai str. 56601
aacgaucagaaaaaca

SEQ ID NO: 762438 - RNA, 21 nt, Leptospira interrogans serovar lai str. 56601
aacgagacguugaguuauaca

SEQ ID NO: 762439 - RNA, 21 nt, Leptospira interrogans serovar lai str. 56601
aacgacucauggagaauaaaa

SEQ ID NO: 762440 - RNA, 18 nt, Leptospira interrogans serovar lai str. 56601
aacgauuucuauuuuucg

SEQ ID NO: 762441 - RNA, 15 nt, Leptospira interrogans serovar lai str. 56601
aacgauuauuuuuua

SEQ ID NO: 762442 - RNA, 13 nt, Leptospira interrogans serovar lai str. 56601
aacgauuuuauac

SEQ ID NO: 762443 - RNA, 11 nt, Leptospira interrogans serovar lai str. 56601
aacgcaaaaag

SEQ ID NO: 762444 - RNA, 13 nt, Leptospira interrogans serovar lai str. 56601
aacgcaaaauacu

SEQ ID NO: 762445 - RNA, 19 nt, Leptospira interrogans serovar lai str. 56601
aaccucuguaaauacaaaa

SEQ ID NO: 762446 - RNA, 18 nt, Leptospira interrogans serovar lai str. 56601
aaccucguacuaauucuu

SEQ ID NO: 762447 - RNA, 17 nt, Leptospira interrogans serovar lai str. 56601
aaccucggaguauauaa

SEQ ID NO: 762448 - RNA, 14 nt, Leptospira interrogans serovar lai str. 56601
aaccugauuuuucc

SEQ ID NO: 762449 - RNA, 13 nt, Leptospira interrogans serovar lai str. 56601
aaccucuucugau

SEQ ID NO: 762450 - RNA, 16 nt, Leptospira interrogans serovar lai str. 56601
aaccgucccaaaaucu

SEQ ID NO: 762451 - RNA, 20 nt, Leptospira interrogans serovar lai str. 56601
aaccucaaagaaauuuuacu

SEQ ID NO: 762452 - RNA, 21 nt, Leptospira interrogans serovar lai str. 56601
aaccucaaagaaauuuuacuc

SEQ ID NO: 762453 - RNA, 20 nt, Leptospira interrogans serovar lai str. 56601
aaccuaguguuuaauuuuaa

SEQ ID NO: 762454 - RNA, 13 nt, Leptospira interrogans serovar lai str. 56601
aaccuauaucuua

SEQ ID NO: 762455 - RNA, 14 nt, Leptospira interrogans serovar lai str. 56601
aaccucaaaaaauu

SEQ ID NO: 762456 - RNA, 11 nt, Leptospira interrogans serovar lai str. 56601
aaccuuuucua

SEQ ID NO: 762457 - RNA, 15 nt, Leptospira interrogans serovar lai str. 56601
aacgaaauuauacaa

SEQ ID NO: 762458 - RNA, 20 nt, Leptospira interrogans serovar lai str. 56601
aacgaaagaagacuauaaac

SEQ ID NO: 762459 - RNA, 17 nt, Leptospira interrogans serovar lai str. 56601
aacgacauuagaacuac

SEQ ID NO: 762460 - RNA, 23 nt, Leptospira interrogans serovar lai str. 56601
aacgaccccgucauuuacucaaa

SEQ ID NO: 762461 - RNA, 13 nt, Leptospira interrogans serovar lai str. 56601
aacgacauuuuag

SEQ ID NO: 762462 - RNA, 13 nt, Leptospira interrogans serovar lai str. 56601
aacgaaucauauu

SEQ ID NO: 762463 - RNA, 17 nt, Leptospira interrogans serovar lai str. 56601
aaccuuugauagaacuc

SEQ ID NO: 762464 - RNA, 17 nt, Leptospira interrogans serovar lai str. 56601
aaccuuuguuuccucuu

SEQ ID NO: 762465 - RNA, 15 nt, Leptospira interrogans serovar lai str. 56601
aaccuuuauuuaaua

SEQ ID NO: 762466 - RNA, 18 nt, Leptospira interrogans serovar lai str. 56601
aaccuuuaccauaaauuu

SEQ ID NO: 762467 - RNA, 15 nt, Leptospira interrogans serovar lai str. 56601
aaccuuuaguuucca

SEQ ID NO: 762468 - RNA, 19 nt, Leptospira interrogans serovar lai str. 56601
aaccuuuaguuuccaaaaa

SEQ ID NO: 762469 - RNA, 20 nt, Leptospira interrogans serovar lai str. 56601
aaccuuacccacaaauaauu

SEQ ID NO: 762470 - RNA, 12 nt, Leptospira interrogans serovar lai str. 56601
aaccgcaaauuu

SEQ ID NO: 762471 - RNA, 21 nt, Leptospira interrogans serovar lai str. 56601
aaccgauuucaauuuucucaa

SEQ ID NO: 762472 - RNA, 18 nt, Leptospira interrogans serovar lai str. 56601
aaccgcuuuuaguuuuuc

SEQ ID NO: 762473 - RNA, 17 nt, Leptospira interrogans serovar lai str. 56601
aaccgguaaaaaguaaa

SEQ ID NO: 762474 - RNA, 19 nt, Leptospira interrogans serovar lai str. 56601
aaccccauuaaaaagcuca

SEQ ID NO: 762475 - RNA, 13 nt, Leptospira interrogans serovar lai str. 56601
aaccgacuugaga

SEQ ID NO: 762476 - RNA, 16 nt, Leptospira interrogans serovar lai str. 56601
aaccgaaauagaaaua

SEQ ID NO: 762477 - RNA, 15 nt, Leptospira interrogans serovar lai str. 56601
aacccugccaaaauc

SEQ ID NO: 762478 - RNA, 18 nt, Leptospira interrogans serovar lai str. 56601
aacccugccaaaauccca

SEQ ID NO: 762479 - RNA, 19 nt, Leptospira interrogans serovar lai str. 56601
aacccauacaaaauuuaaa

SEQ ID NO: 762480 - RNA, 21 nt, Leptospira interrogans serovar lai str. 56601
aacccaacuuucgcauuuguu

SEQ ID NO: 762481 - RNA, 23 nt, Leptospira interrogans serovar lai str. 56601
aacccaacuuucgcauuuguugu

SEQ ID NO: 762482 - RNA, 12 nt, Leptospira interrogans serovar lai str. 56601
aaccauuuuguu

SEQ ID NO: 762483 - RNA, 21 nt, Leptospira interrogans serovar lai str. 56601
aaccauuucaaguuuucuuuu

SEQ ID NO: 762484 - RNA, 18 nt, Leptospira interrogans serovar lai str. 56601
aaccaguuuguuuuuuau

SEQ ID NO: 762485 - RNA, 17 nt, Leptospira interrogans serovar lai str. 56601
aaccauaaaauaaaaaa

SEQ ID NO: 762486 - RNA, 19 nt, Leptospira interrogans serovar lai str. 56601
aaccaguaucguuuuccau

SEQ ID NO: 762487 - RNA, 18 nt, Leptospira interrogans serovar lai str. 56601
aaccaguaauaguuugua

SEQ ID NO: 762488 - RNA, 19 nt, Leptospira interrogans serovar lai str. 56601
aaccaugauucugaaaaaa

SEQ ID NO: 762489 - RNA, 22 nt, Leptospira interrogans serovar lai str. 56601
aaccauccgcgguuaugauaua

SEQ ID NO: 762490 - RNA, 14 nt, Leptospira interrogans serovar lai str. 56601
aaccaucucaaaaa

SEQ ID NO: 762491 - RNA, 16 nt, Leptospira interrogans serovar lai str. 56601
aaccaucucaaaaaca

SEQ ID NO: 762492 - RNA, 18 nt, Leptospira interrogans serovar lai str. 56601
aaccaucucaaaaacacu

SEQ ID NO: 762493 - RNA, 21 nt, Leptospira interrogans serovar lai str. 56601
aaccaucucaaaaauaucuua

SEQ ID NO: 762494 - RNA, 17 nt, Leptospira interrogans serovar lai str. 56601
aaccacaaaaacaaauu

SEQ ID NO: 762495 - RNA, 19 nt, Leptospira interrogans serovar lai str. 56601
aaccacaaaaacaaauuca

SEQ ID NO: 762496 - RNA, 19 nt, Leptospira interrogans serovar lai str. 56601
aaccaccuuuacauaauaa

SEQ ID NO: 762497 - RNA, 22 nt, Leptospira interrogans serovar lai str. 56601
aaccaccuuuacauaauaauac

SEQ ID NO: 762498 - RNA, 16 nt, Leptospira interrogans serovar lai str. 56601
aacaucucaaucaaaa

SEQ ID NO: 762499 - RNA, 13 nt, Leptospira interrogans serovar lai str. 56601
aacaugagaagcu

SEQ ID NO: 762500 - RNA, 17 nt, Leptospira interrogans serovar lai str. 56601
aacauuccauaaugaag

SEQ ID NO: 762501 - RNA, 22 nt, Leptospira interrogans serovar lai str. 56601
aacauucccauccgaaauccca

SEQ ID NO: 762502 - RNA, 23 nt, Leptospira interrogans serovar lai str. 56601
aacauucccauccgaaaucccaa

SEQ ID NO: 762503 - RNA, 20 nt, Leptospira interrogans serovar lai str. 56601
aacauugaguuugagaaacu

SEQ ID NO: 762504 - RNA, 17 nt, Leptospira interrogans serovar lai str. 56601
aacauugcgagauuuua

SEQ ID NO: 762505 - RNA, 15 nt, Leptospira interrogans serovar lai str. 56601
aacauuuuuaaaaau

SEQ ID NO: 762506 - RNA, 16 nt, Leptospira interrogans serovar lai str. 56601
aacauuuuuaaaaauu

SEQ ID NO: 762507 - RNA, 17 nt, Leptospira interrogans serovar lai str. 56601
aacauuuugccuuguuc

SEQ ID NO: 762508 - RNA, 16 nt, Leptospira interrogans serovar lai str. 56601
aacauuuucauauaua

SEQ ID NO: 762509 - RNA, 14 nt, Leptospira interrogans serovar lai str. 56601
aacauuuuuucaua

SEQ ID NO: 762510 - RNA, 13 nt, Leptospira interrogans serovar lai str. 56601
aaccaaaaauuca

SEQ ID NO: 762511 - RNA, 19 nt, Leptospira interrogans serovar lai str. 56601
aacauuucuaaaauauccg

SEQ ID NO: 762512 - RNA, 23 nt, Leptospira interrogans serovar lai str. 56601
aacauuuuauuauaaauuuauaa

SEQ ID NO: 762513 - RNA, 15 nt, Leptospira interrogans serovar lai str. 56601
aacauuuauuuuucg

SEQ ID NO: 762514 - RNA, 17 nt, Leptospira interrogans serovar lai str. 56601
aaccaauucuaaaauca

SEQ ID NO: 762515 - RNA, 20 nt, Leptospira interrogans serovar lai str. 56601
aaccaauucuaaaaucauac

SEQ ID NO: 762516 - RNA, 23 nt, Leptospira interrogans serovar lai str. 56601
aaccaaucgauaacuugauuuua

SEQ ID NO: 762517 - RNA, 18 nt, Leptospira interrogans serovar lai str. 56601
aaccaaccucucacuucu

SEQ ID NO: 762518 - RNA, 15 nt, Leptospira interrogans serovar lai str. 56601
aaccaaauaauaaaa

SEQ ID NO: 762519 - RNA, 20 nt, Leptospira interrogans serovar lai str. 56601
aaccaaauaauaaaacuuuu

SEQ ID NO: 762520 - RNA, 13 nt, Leptospira interrogans serovar lai str. 56601
aaccaaacagcua

SEQ ID NO: 762521 - RNA, 10 nt, Leptospira interrogans serovar lai str. 56601
aaccaaaaug

SEQ ID NO: 762522 - RNA, 15 nt, Leptospira interrogans serovar lai str. 56601
aacagucauucugua

SEQ ID NO: 762523 - RNA, 22 nt, Leptospira interrogans serovar lai str. 56601
aacaguauauuauaauuuuaaa

SEQ ID NO: 762524 - RNA, 19 nt, Leptospira interrogans serovar lai str. 56601
aacaguauucaauuuuuau

SEQ ID NO: 762525 - RNA, 17 nt, Leptospira interrogans serovar lai str. 56601
aacaguuccuaacaauu

SEQ ID NO: 762526 - RNA, 17 nt, Leptospira interrogans serovar lai str. 56601
aacaguuauuauuuaac

SEQ ID NO: 762527 - RNA, 15 nt, Leptospira interrogans serovar lai str. 56601
aacaggaaaauuuaa

SEQ ID NO: 762528 - RNA, 15 nt, Leptospira interrogans serovar lai str. 56601
aacagguaaaccugu

SEQ ID NO: 762529 - RNA, 13 nt, Leptospira interrogans serovar lai str. 56601
aacaucaauuuua

SEQ ID NO: 762530 - RNA, 13 nt, Leptospira interrogans serovar lai str. 56601
aacaucacgcaca

SEQ ID NO: 762531 - RNA, 17 nt, Leptospira interrogans serovar lai str. 56601
aacauaagaauauuaua

SEQ ID NO: 762532 - RNA, 16 nt, Leptospira interrogans serovar lai str. 56601
aacauaauguuucaau

SEQ ID NO: 762533 - RNA, 22 nt, Leptospira interrogans serovar lai str. 56601
aacauaaguuacucauuuccau

SEQ ID NO: 762534 - RNA, 22 nt, Leptospira interrogans serovar lai str. 56601
aacauacuuuuugcaaguaaaa

SEQ ID NO: 762535 - RNA, 13 nt, Leptospira interrogans serovar lai str. 56601
aacagcaucaaca

SEQ ID NO: 762536 - RNA, 14 nt, Leptospira interrogans serovar lai str. 56601
aacagaucaagaau

SEQ ID NO: 762537 - RNA, 16 nt, Leptospira interrogans serovar lai str. 56601
aacagaucaagaauua

SEQ ID NO: 762538 - RNA, 11 nt, Leptospira interrogans serovar lai str. 56601
aacacuucuug

SEQ ID NO: 762539 - RNA, 16 nt, Leptospira interrogans serovar lai str. 56601
aacacuugaaaaaugu

SEQ ID NO: 762540 - RNA, 14 nt, Leptospira interrogans serovar lai str. 56601
aacagaacgggcuu

SEQ ID NO: 762541 - RNA, 16 nt, Leptospira interrogans serovar lai str. 56601
aacagaauguauuaaa

SEQ ID NO: 762542 - RNA, 20 nt, Leptospira interrogans serovar lai str. 56601
aacagaauguauuaaaaaau

SEQ ID NO: 762543 - RNA, 23 nt, Leptospira interrogans serovar lai str. 56601
aacacgauacucaauauuuuguu

SEQ ID NO: 762544 - RNA, 14 nt, Leptospira interrogans serovar lai str. 56601
aacacguuaacaau

SEQ ID NO: 762545 - RNA, 17 nt, Leptospira interrogans serovar lai str. 56601
aacacaucuuaaaaacu

SEQ ID NO: 762546 - RNA, 16 nt, Leptospira interrogans serovar lai str. 56601
aacaaugaauuuuuau

SEQ ID NO: 762547 - RNA, 22 nt, Leptospira interrogans serovar lai str. 56601
aacaaugaauuuuuauaaaaau

SEQ ID NO: 762548 - RNA, 21 nt, Leptospira interrogans serovar lai str. 56601
aacaauccgcggauguuugaa

SEQ ID NO: 762549 - RNA, 18 nt, Leptospira interrogans serovar lai str. 56601
aacaaucuucgguauuuu

SEQ ID NO: 762550 - RNA, 21 nt, Leptospira interrogans serovar lai str. 56601
aacaauagcuucuuuaaaaac

SEQ ID NO: 762551 - RNA, 23 nt, Leptospira interrogans serovar lai str. 56601
aacaauagcuucuuuaaaaacuu

SEQ ID NO: 762552 - RNA, 15 nt, Leptospira interrogans serovar lai str. 56601
aacaauuaaucaaau

SEQ ID NO: 762553 - RNA, 19 nt, Leptospira interrogans serovar lai str. 56601
aacaauuaaucaaauuucu

SEQ ID NO: 762554 - RNA, 16 nt, Leptospira interrogans serovar lai str. 56601
aacaauuacagaaggg

SEQ ID NO: 762555 - RNA, 14 nt, Leptospira interrogans serovar lai str. 56601
aacaauuuaaaaua

SEQ ID NO: 762556 - RNA, 16 nt, Leptospira interrogans serovar lai str. 56601
aacaauuuaaaauaau

SEQ ID NO: 762557 - RNA, 20 nt, Leptospira interrogans serovar lai str. 56601
aacaauuuuuugaaaaagaa

SEQ ID NO: 762558 - RNA, 17 nt, Leptospira interrogans serovar lai str. 56601
aacacaaauauuaagaa

SEQ ID NO: 762559 - RNA, 15 nt, Leptospira interrogans serovar lai str. 56601
aacacaacgcucucu

SEQ ID NO: 762560 - RNA, 19 nt, Leptospira interrogans serovar lai str. 56601
aacacaacgcucucuacgg

SEQ ID NO: 762561 - RNA, 20 nt, Leptospira interrogans serovar lai str. 56601
aacacaacgcucuuuaugaa

SEQ ID NO: 762562 - RNA, 21 nt, Leptospira interrogans serovar lai str. 56601
aacacacacuuuauaaaagua

SEQ ID NO: 762563 - RNA, 20 nt, Leptospira interrogans serovar lai str. 56601
aaauuuucagugaauaaaau

SEQ ID NO: 762564 - RNA, 20 nt, Leptospira interrogans serovar lai str. 56601
aaauuuucuaaaaguaguag

SEQ ID NO: 762565 - RNA, 12 nt, Leptospira interrogans serovar lai str. 56601
aaauuuugaaaa

SEQ ID NO: 762566 - RNA, 16 nt, Leptospira interrogans serovar lai str. 56601
aaauuuugaaacaaau

SEQ ID NO: 762567 - RNA, 12 nt, Leptospira interrogans serovar lai str. 56601
aaauuuucuuua

SEQ ID NO: 762568 - RNA, 16 nt, Leptospira interrogans serovar lai str. 56601
aaauuuucauuuuaua

SEQ ID NO: 762569 - RNA, 18 nt, Leptospira interrogans serovar lai str. 56601
aaauuuuuauaaaauacc

SEQ ID NO: 762570 - RNA, 20 nt, Leptospira interrogans serovar lai str. 56601
aaauuuuuauaaaauaccaa

SEQ ID NO: 762571 - RNA, 14 nt, Leptospira interrogans serovar lai str. 56601
aaauuuuuaaucaa

SEQ ID NO: 762572 - RNA, 21 nt, Leptospira interrogans serovar lai str. 56601
aaauuuucuguuuauuuugaa

SEQ ID NO: 762573 - RNA, 18 nt, Leptospira interrogans serovar lai str. 56601
aaauuuugaaggaaauuu

SEQ ID NO: 762574 - RNA, 22 nt, Leptospira interrogans serovar lai str. 56601
aaauuuugaaggaaauuuuguu

SEQ ID NO: 762575 - RNA, 21 nt, Leptospira interrogans serovar lai str. 56601
aaauuuuaaccgcaaaaucau

SEQ ID NO: 762576 - RNA, 23 nt, Leptospira interrogans serovar lai str. 56601
aaauuuuaauauuauuaaauuuu

SEQ ID NO: 762577 - RNA, 17 nt, Leptospira interrogans serovar lai str. 56601
aaauuuucaaaaaauau

SEQ ID NO: 762578 - RNA, 13 nt, Leptospira interrogans serovar lai str. 56601
aaauuuuagaaua

SEQ ID NO: 762579 - RNA, 17 nt, Leptospira interrogans serovar lai str. 56601
aaauuuuauaauuaauc

SEQ ID NO: 762580 - RNA, 15 nt, Leptospira interrogans serovar lai str. 56601
aaauuuuauaguaga

SEQ ID NO: 762581 - RNA, 15 nt, Leptospira interrogans serovar lai str. 56601
aaauuugaaaguaaa

SEQ ID NO: 762582 - RNA, 23 nt, Leptospira interrogans serovar lai str. 56601
aaauuugauuccaagauuuuuua

SEQ ID NO: 762583 - RNA, 15 nt, Leptospira interrogans serovar lai str. 56601
aaauuuguaauaguu

SEQ ID NO: 762584 - RNA, 19 nt, Leptospira interrogans serovar lai str. 56601
aaauuugcgaaaaaaauaa

SEQ ID NO: 762585 - RNA, 20 nt, Leptospira interrogans serovar lai str. 56601
aaauuugcgaaaaaaauaac

SEQ ID NO: 762586 - RNA, 14 nt, Leptospira interrogans serovar lai str. 56601
aaauuugcguaaua

SEQ ID NO: 762587 - RNA, 16 nt, Leptospira interrogans serovar lai str. 56601
aaauuucuuuuuugua

SEQ ID NO: 762588 - RNA, 15 nt, Leptospira interrogans serovar lai str. 56601
aaauuucugcaugaa

SEQ ID NO: 762589 - RNA, 21 nt, Leptospira interrogans serovar lai str. 56601
aaauuucugcaugaaauugau

SEQ ID NO: 762590 - RNA, 14 nt, Leptospira interrogans serovar lai str. 56601
aaauuucuuaaaag

SEQ ID NO: 762591 - RNA, 15 nt, Leptospira interrogans serovar lai str. 56601
aaauuucuaaagaau

SEQ ID NO: 762592 - RNA, 19 nt, Leptospira interrogans serovar lai str. 56601
aaauuucuaugaaaauucu

SEQ ID NO: 762593 - RNA, 15 nt, Leptospira interrogans serovar lai str. 56601
aaauuuccacuucaa

SEQ ID NO: 762594 - RNA, 18 nt, Leptospira interrogans serovar lai str. 56601
aaauuuccacuucaaaaa

SEQ ID NO: 762595 - RNA, 23 nt, Leptospira interrogans serovar lai str. 56601
aaauuucccgauucucaaaaugg

SEQ ID NO: 762596 - RNA, 22 nt, Leptospira interrogans serovar lai str. 56601
aaauuuccggaaaacgaauauc

SEQ ID NO: 762597 - RNA, 22 nt, Leptospira interrogans serovar lai str. 56601
aaauuuauaugauuuuauaccu

SEQ ID NO: 762598 - RNA, 14 nt, Leptospira interrogans serovar lai str. 56601
aaauugaucucgau

SEQ ID NO: 762599 - RNA, 20 nt, Leptospira interrogans serovar lai str. 56601
aaauugaucucgauucugau

SEQ ID NO: 762600 - RNA, 16 nt, Leptospira interrogans serovar lai str. 56601
aaauugauaauuuuug

SEQ ID NO: 762601 - RNA, 13 nt, Leptospira interrogans serovar lai str. 56601
uuucaaaaguauu

SEQ ID NO: 762602 - RNA, 12 nt, Leptospira interrogans serovar lai str. 56601
uuucaaaaguua

SEQ ID NO: 762603 - RNA, 21 nt, Leptospira interrogans serovar lai str. 56601
uuucaaaauaagaauuuucua

SEQ ID NO: 762604 - RNA, 23 nt, Leptospira interrogans serovar lai str. 56601
uuucaaaaaccgaaauagaaaua

SEQ ID NO: 762605 - RNA, 12 nt, Leptospira interrogans serovar lai str. 56601
uuucaaaaauau

SEQ ID NO: 762606 - RNA, 13 nt, Leptospira interrogans serovar lai str. 56601
uuucaaaaauaua

SEQ ID NO: 762607 - RNA, 11 nt, Leptospira interrogans serovar lai str. 56601
uuucaaaaauu

SEQ ID NO: 762608 - RNA, 23 nt, Leptospira interrogans serovar lai str. 56601
uuuauuuuuuacgaaaaaauuga

SEQ ID NO: 762609 - RNA, 13 nt, Leptospira interrogans serovar lai str. 56601
uuucaaaaaauuu

SEQ ID NO: 762610 - RNA, 18 nt, Leptospira interrogans serovar lai str. 56601
uuucaaaaaauaaaauuu

SEQ ID NO: 762611 - RNA, 20 nt, Leptospira interrogans serovar lai str. 56601
uuucaaaaaauaaaauuuua

SEQ ID NO: 762612 - RNA, 14 nt, Leptospira interrogans serovar lai str. 56601
uuucaaaaaauaua

SEQ ID NO: 762613 - RNA, 14 nt, Leptospira interrogans serovar lai str. 56601
uuucaaaaaauauc

SEQ ID NO: 762614 - RNA, 22 nt, Leptospira interrogans serovar lai str. 56601
uuuauuuuuugaagaaaguuua

SEQ ID NO: 762615 - RNA, 11 nt, Leptospira interrogans serovar lai str. 56601
uuucaaaaaac

SEQ ID NO: 762616 - RNA, 16 nt, Leptospira interrogans serovar lai str. 56601
aaauugcaucaaagaa

SEQ ID NO: 762617 - RNA, 17 nt, Leptospira interrogans serovar lai str. 56601
aaauuguaugaaagaaa

SEQ ID NO: 762618 - RNA, 22 nt, Leptospira interrogans serovar lai str. 56601
aaauuguauaaaagaaacauaa

SEQ ID NO: 762619 - RNA, 22 nt, Leptospira interrogans serovar lai str. 56601
aaauugugagaacuacagcaaa

SEQ ID NO: 762620 - RNA, 19 nt, Leptospira interrogans serovar lai str. 56601
aaauugugagaacuacuuu

SEQ ID NO: 762621 - RNA, 13 nt, Leptospira interrogans serovar lai str. 56601
aaauuguuucaua

SEQ ID NO: 762622 - RNA, 20 nt, Leptospira interrogans serovar lai str. 56601
aaauuguuucauaaaauucu

SEQ ID NO: 762623 - RNA, 14 nt, Leptospira interrogans serovar lai str. 56601
aaauuguuuuaaaa

SEQ ID NO: 762624 - RNA, 22 nt, Leptospira interrogans serovar lai str. 56601
aaauuguuaucgcuaauacaaa

SEQ ID NO: 762625 - RNA, 13 nt, Leptospira interrogans serovar lai str. 56601
aaauuuaaaauaa

SEQ ID NO: 762626 - RNA, 14 nt, Leptospira interrogans serovar lai str. 56601
aaauuuaaaauaac

SEQ ID NO: 762627 - RNA, 11 nt, Leptospira interrogans serovar lai str. 56601
aaauuuaaauu

SEQ ID NO: 762628 - RNA, 19 nt, Leptospira interrogans serovar lai str. 56601
aaauuuacgaaaauuuuuu

SEQ ID NO: 762629 - RNA, 22 nt, Leptospira interrogans serovar lai str. 56601
aaauuuacggaacuuaauuuua

SEQ ID NO: 762630 - RNA, 16 nt, Leptospira interrogans serovar lai str. 56601
aaauuuacuucaauua

SEQ ID NO: 762631 - RNA, 15 nt, Leptospira interrogans serovar lai str. 56601
aaauuuaauuuuuac

SEQ ID NO: 762632 - RNA, 22 nt, Leptospira interrogans serovar lai str. 56601
aaauuuacacgauaauuuucuu

SEQ ID NO: 762633 - RNA, 23 nt, Leptospira interrogans serovar lai str. 56601
aaauuuacacgauaauuuucuuu

SEQ ID NO: 762634 - RNA, 17 nt, Leptospira interrogans serovar lai str. 56601
aaauuuagaauuguuau

SEQ ID NO: 762635 - RNA, 23 nt, Leptospira interrogans serovar lai str. 56601
aaauuuauacuauaacuuuaaaa

SEQ ID NO: 762636 - RNA, 16 nt, Leptospira interrogans serovar lai str. 56601
aacaaaguauuuaauu

SEQ ID NO: 762637 - RNA, 22 nt, Leptospira interrogans serovar lai str. 56601
aacaaagccgcacaaaccaaaa

SEQ ID NO: 762638 - RNA, 22 nt, Leptospira interrogans serovar lai str. 56601
aacaaagacaaaguauuuucua

SEQ ID NO: 762639 - RNA, 23 nt, Leptospira interrogans serovar lai str. 56601
aacaaauuccgaaauuguaggaa

SEQ ID NO: 762640 - RNA, 23 nt, Leptospira interrogans serovar lai str. 56601
aacaaauucuaaaauuguaggaa

SEQ ID NO: 762641 - RNA, 18 nt, Leptospira interrogans serovar lai str. 56601
aacaaauucuaaacuugu

SEQ ID NO: 762642 - RNA, 13 nt, Leptospira interrogans serovar lai str. 56601
aacaaauugaaau

SEQ ID NO: 762643 - RNA, 15 nt, Leptospira interrogans serovar lai str. 56601
aacaaauuuaaaaua

SEQ ID NO: 762644 - RNA, 19 nt, Leptospira interrogans serovar lai str. 56601
aacaacaccaccaacagca

SEQ ID NO: 762645 - RNA, 16 nt, Leptospira interrogans serovar lai str. 56601
aacaaauuaaguuuaa

SEQ ID NO: 762646 - RNA, 17 nt, Leptospira interrogans serovar lai str. 56601
aacaaauuaaguuuaaa

SEQ ID NO: 762647 - RNA, 17 nt, Leptospira interrogans serovar lai str. 56601
aacaaauggagaauuaa

SEQ ID NO: 762648 - RNA, 16 nt, Leptospira interrogans serovar lai str. 56601
aaauuuuuauugcaaa

SEQ ID NO: 762649 - RNA, 13 nt, Leptospira interrogans serovar lai str. 56601
aaauuuuucaaua

SEQ ID NO: 762650 - RNA, 12 nt, Leptospira interrogans serovar lai str. 56601
aaauuuuuauac

SEQ ID NO: 762651 - RNA, 14 nt, Leptospira interrogans serovar lai str. 56601
aaauuuuugcauaa

SEQ ID NO: 762652 - RNA, 14 nt, Leptospira interrogans serovar lai str. 56601
aaauuuuucucccu

SEQ ID NO: 762653 - RNA, 10 nt, Leptospira interrogans serovar lai str. 56601
aaauuuuugu

SEQ ID NO: 762654 - RNA, 20 nt, Leptospira interrogans serovar lai str. 56601
aaauuuuuguguaaaauuac

SEQ ID NO: 762655 - RNA, 15 nt, Leptospira interrogans serovar lai str. 56601
aaauuuuuuccuuua

SEQ ID NO: 762656 - RNA, 14 nt, Leptospira interrogans serovar lai str. 56601
aaauuuuuucucgu

SEQ ID NO: 762657 - RNA, 13 nt, Leptospira interrogans serovar lai str. 56601
aaauuuuuucuuu

SEQ ID NO: 762658 - RNA, 15 nt, Leptospira interrogans serovar lai str. 56601
aaauuuuuugaaguu

SEQ ID NO: 762659 - RNA, 17 nt, Leptospira interrogans serovar lai str. 56601
aaauuuuuugaaguuuu

SEQ ID NO: 762660 - RNA, 19 nt, Leptospira interrogans serovar lai str. 56601
aaauuuuuugcaaaaaaau

SEQ ID NO: 762661 - RNA, 13 nt, Leptospira interrogans serovar lai str. 56601
aacaaaaaucaac

SEQ ID NO: 762662 - RNA, 14 nt, Leptospira interrogans serovar lai str. 56601
aacaaaaaugagaa

SEQ ID NO: 762663 - RNA, 22 nt, Leptospira interrogans serovar lai str. 56601
aaauuuuuuucuaaaauauagg

SEQ ID NO: 762664 - RNA, 16 nt, Leptospira interrogans serovar lai str. 56601
aaauuuuuuuaagaau

SEQ ID NO: 762665 - RNA, 18 nt, Leptospira interrogans serovar lai str. 56601
aaauuuuuuuaagaauuu

SEQ ID NO: 762666 - RNA, 15 nt, Leptospira interrogans serovar lai str. 56601
aacaaacaccacaau

SEQ ID NO: 762667 - RNA, 16 nt, Leptospira interrogans serovar lai str. 56601
aacaaacaaauagaaa

SEQ ID NO: 762668 - RNA, 17 nt, Leptospira interrogans serovar lai str. 56601
aacaaaaguggaagaga

SEQ ID NO: 762669 - RNA, 22 nt, Leptospira interrogans serovar lai str. 56601
aacaaaaucaaagauauuucaa

SEQ ID NO: 762670 - RNA, 20 nt, Leptospira interrogans serovar lai str. 56601
aacaaaaaguguuuauaauu

SEQ ID NO: 762671 - RNA, 11 nt, Leptospira interrogans serovar lai str. 56601
aacaaaacugc

SEQ ID NO: 762672 - RNA, 19 nt, Leptospira interrogans serovar lai str. 56601
aacaaaacguaagauaggu

SEQ ID NO: 762673 - RNA, 16 nt, Leptospira interrogans serovar lai str. 56601
aacaacucuauuacua

SEQ ID NO: 762674 - RNA, 14 nt, Leptospira interrogans serovar lai str. 56601
aacaacucuauuuc

SEQ ID NO: 762675 - RNA, 14 nt, Leptospira interrogans serovar lai str. 56601
aacaacucuaauac

SEQ ID NO: 762676 - RNA, 17 nt, Leptospira interrogans serovar lai str. 56601
aacaacucuaauacaaa

SEQ ID NO: 762677 - RNA, 18 nt, Leptospira interrogans serovar lai str. 56601
aacaacucuaauauaaaa

SEQ ID NO: 762678 - RNA, 17 nt, Leptospira interrogans serovar lai str. 56601
aacaacaguacaagaau

SEQ ID NO: 762679 - RNA, 24 nt, Leptospira interrogans serovar lai str. 56601
aacaaccaccuuuacauaauaaua

SEQ ID NO: 762680 - RNA, 21 nt, Leptospira interrogans serovar lai str. 56601
aacaacccccguuauuaaaau

SEQ ID NO: 762681 - RNA, 20 nt, Leptospira interrogans serovar lai str. 56601
aacaacgauuucuguagaaa

SEQ ID NO: 762682 - RNA, 21 nt, Leptospira interrogans serovar lai str. 56601
aacaaggcuuuguaauaaaaa

SEQ ID NO: 762683 - RNA, 18 nt, Leptospira interrogans serovar lai str. 56601
aacaagcucaauuuugaa

SEQ ID NO: 762684 - RNA, 14 nt, Leptospira interrogans serovar lai str. 56601
aacaagauuaacaa

SEQ ID NO: 762685 - RNA, 19 nt, Leptospira interrogans serovar lai str. 56601
aacaagauuaacaaucaau

SEQ ID NO: 762686 - RNA, 21 nt, Leptospira interrogans serovar lai str. 56601
acaguauauuauaauuuuaaa

SEQ ID NO: 762687 - RNA, 20 nt, Leptospira interrogans serovar lai str. 56601
acaguauuucgucuuuaguu

SEQ ID NO: 762688 - RNA, 15 nt, Leptospira interrogans serovar lai str. 56601
acaguauuuguaaaa

SEQ ID NO: 762689 - RNA, 17 nt, Leptospira interrogans serovar lai str. 56601
acaguauuuguaaaaau

SEQ ID NO: 762690 - RNA, 19 nt, Leptospira interrogans serovar lai str. 56601
acaguaauaaucuaaacuu

SEQ ID NO: 762691 - RNA, 18 nt, Leptospira interrogans serovar lai str. 56601
acaguacuauauuuuugu

SEQ ID NO: 762692 - RNA, 14 nt, Leptospira interrogans serovar lai str. 56601
acaguacuuuguaa

SEQ ID NO: 762693 - RNA, 18 nt, Leptospira interrogans serovar lai str. 56601
acaguauucaauuuuuau

SEQ ID NO: 762694 - RNA, 22 nt, Leptospira interrogans serovar lai str. 56601
acaguauuuuccguaccccaaa

SEQ ID NO: 762695 - RNA, 14 nt, Leptospira interrogans serovar lai str. 56601
acauaaaagaccuu

SEQ ID NO: 762696 - RNA, 14 nt, Leptospira interrogans serovar lai str. 56601
acauaaugcugcaa

SEQ ID NO: 762697 - RNA, 18 nt, Leptospira interrogans serovar lai str. 56601
acaguuaaacuuuguaaa

SEQ ID NO: 762698 - RNA, 19 nt, Leptospira interrogans serovar lai str. 56601
acaguuaauaaauuguaua

SEQ ID NO: 762699 - RNA, 18 nt, Leptospira interrogans serovar lai str. 56601
acagugucuugaaauucu

SEQ ID NO: 762700 - RNA, 16 nt, Leptospira interrogans serovar lai str. 56601
acaguuauuauuuaac

SEQ ID NO: 762701 - RNA, 15 nt, Leptospira interrogans serovar lai str. 56601
acaguucucacagau

SEQ ID NO: 762702 - RNA, 15 nt, Leptospira interrogans serovar lai str. 56601
acaucuagauuuuac

SEQ ID NO: 762703 - RNA, 21 nt, Leptospira interrogans serovar lai str. 56601
acaucguuuagguaaagauuu

SEQ ID NO: 762704 - RNA, 23 nt, Leptospira interrogans serovar lai str. 56601
acaucuuauuuuuacagaaaaau

SEQ ID NO: 762705 - RNA, 13 nt, Leptospira interrogans serovar lai str. 56601
acaucuuaaaaaa

SEQ ID NO: 762706 - RNA, 14 nt, Leptospira interrogans serovar lai str. 56601
acaucuuaaaaaau

SEQ ID NO: 762707 - RNA, 17 nt, Leptospira interrogans serovar lai str. 56601
acaucuuaaaaaauaca

SEQ ID NO: 762708 - RNA, 19 nt, Leptospira interrogans serovar lai str. 56601
acaucucaaucaaaauuuu

SEQ ID NO: 762709 - RNA, 20 nt, Leptospira interrogans serovar lai str. 56601
acaucucuuuuuuaaagccu

SEQ ID NO: 762710 - RNA, 15 nt, Leptospira interrogans serovar lai str. 56601
acauaauguuucaau

SEQ ID NO: 762711 - RNA, 16 nt, Leptospira interrogans serovar lai str. 56601
acauaauguuucaauu

SEQ ID NO: 762712 - RNA, 22 nt, Leptospira interrogans serovar lai str. 56601
acaucaaaaacaaauuaaguuu

SEQ ID NO: 762713 - RNA, 20 nt, Leptospira interrogans serovar lai str. 56601
acaucauucucauauugaaa

SEQ ID NO: 762714 - RNA, 16 nt, Leptospira interrogans serovar lai str. 56601
acauccaacccaaaca

SEQ ID NO: 762715 - RNA, 22 nt, Leptospira interrogans serovar lai str. 56601
acauccaauuauaaaauuuuuc

SEQ ID NO: 762716 - RNA, 18 nt, Leptospira interrogans serovar lai str. 56601
acaucacuuccauuuuuu

SEQ ID NO: 762717 - RNA, 17 nt, Leptospira interrogans serovar lai str. 56601
acaucagcauaaguauu

SEQ ID NO: 762718 - RNA, 22 nt, Leptospira interrogans serovar lai str. 56601
acagcugaggaguuuuuauaaa

SEQ ID NO: 762719 - RNA, 20 nt, Leptospira interrogans serovar lai str. 56601
acagagcuuuacaauaaaaa

SEQ ID NO: 762720 - RNA, 22 nt, Leptospira interrogans serovar lai str. 56601
acagaucguguucuaaauugaa

SEQ ID NO: 762721 - RNA, 18 nt, Leptospira interrogans serovar lai str. 56601
acagauugauuuuuuaaa

SEQ ID NO: 762722 - RNA, 15 nt, Leptospira interrogans serovar lai str. 56601
acagauuaaauguau

SEQ ID NO: 762723 - RNA, 16 nt, Leptospira interrogans serovar lai str. 56601
acagccaccaucaaaa

SEQ ID NO: 762724 - RNA, 20 nt, Leptospira interrogans serovar lai str. 56601
acagccaccaucaaaauuua

SEQ ID NO: 762725 - RNA, 21 nt, Leptospira interrogans serovar lai str. 56601
acagccaucccacuuuuauau

SEQ ID NO: 762726 - RNA, 15 nt, Leptospira interrogans serovar lai str. 56601
acagaauuuuuuaac

SEQ ID NO: 762727 - RNA, 19 nt, Leptospira interrogans serovar lai str. 56601
acagaauuuuuuaacaauu

SEQ ID NO: 762728 - RNA, 24 nt, Leptospira interrogans serovar lai str. 56601
acagaauuuuuuaacaauucuaau

SEQ ID NO: 762729 - RNA, 21 nt, Leptospira interrogans serovar lai str. 56601
acacuuuucagggcucaaagu

SEQ ID NO: 762730 - RNA, 20 nt, Leptospira interrogans serovar lai str. 56601
acacuuugcaccgcauugau

SEQ ID NO: 762731 - RNA, 19 nt, Leptospira interrogans serovar lai str. 56601
acacuguuaguuugcaauu

SEQ ID NO: 762732 - RNA, 22 nt, Leptospira interrogans serovar lai str. 56601
acacuguuucgacguaaaaaua

SEQ ID NO: 762733 - RNA, 16 nt, Leptospira interrogans serovar lai str. 56601
acacugagucaacaaa

SEQ ID NO: 762734 - RNA, 22 nt, Leptospira interrogans serovar lai str. 56601
aauuucauagugggauugccaa

SEQ ID NO: 762735 - RNA, 18 nt, Leptospira interrogans serovar lai str. 56601
acacucuaaaucuuagga

SEQ ID NO: 762736 - RNA, 21 nt, Leptospira interrogans serovar lai str. 56601
aauuucagcgcauuuagaaga

SEQ ID NO: 762737 - RNA, 16 nt, Leptospira interrogans serovar lai str. 56601
aauuucagaaacauug

SEQ ID NO: 762738 - RNA, 19 nt, Leptospira interrogans serovar lai str. 56601
acccaaucugggugaaucc

SEQ ID NO: 762739 - RNA, 20 nt, Leptospira interrogans serovar lai str. 56601
acccaaucuuacaaguuaug

SEQ ID NO: 762740 - RNA, 12 nt, Leptospira interrogans serovar lai str. 56601
acccagaaaaaa

SEQ ID NO: 762741 - RNA, 19 nt, Leptospira interrogans serovar lai str. 56601
acccaauuguauuugcgga

SEQ ID NO: 762742 - RNA, 23 nt, Leptospira interrogans serovar lai str. 56601
accauucauuucauauccaaaac

SEQ ID NO: 762743 - RNA, 19 nt, Leptospira interrogans serovar lai str. 56601
accccacacguugaauaag

SEQ ID NO: 762744 - RNA, 17 nt, Leptospira interrogans serovar lai str. 56601
accccacaaguguugua

SEQ ID NO: 762745 - RNA, 19 nt, Leptospira interrogans serovar lai str. 56601
accccaugagccgcggcca

SEQ ID NO: 762746 - RNA, 14 nt, Leptospira interrogans serovar lai str. 56601
accauaaauuuuga

SEQ ID NO: 762747 - RNA, 22 nt, Leptospira interrogans serovar lai str. 56601
accauaaauuuugaaacaaauu

SEQ ID NO: 762748 - RNA, 17 nt, Leptospira interrogans serovar lai str. 56601
accauaaauuuugauua

SEQ ID NO: 762749 - RNA, 14 nt, Leptospira interrogans serovar lai str. 56601
accauaaauuuuua

SEQ ID NO: 762750 - RNA, 21 nt, Leptospira interrogans serovar lai str. 56601
accauaaauuuuuauuacaua

SEQ ID NO: 762751 - RNA, 14 nt, Leptospira interrogans serovar lai str. 56601
accauaaauuuuuu

SEQ ID NO: 762752 - RNA, 16 nt, Leptospira interrogans serovar lai str. 56601
accauaaaauaaaaaa

SEQ ID NO: 762753 - RNA, 20 nt, Leptospira interrogans serovar lai str. 56601
accauaaaauaaaaaacaaa

SEQ ID NO: 762754 - RNA, 18 nt, Leptospira interrogans serovar lai str. 56601
accaguuaaacuuugaaa

SEQ ID NO: 762755 - RNA, 17 nt, Leptospira interrogans serovar lai str. 56601
accaguaauaguuugua

SEQ ID NO: 762756 - RNA, 17 nt, Leptospira interrogans serovar lai str. 56601
accagugccauuuuucu

SEQ ID NO: 762757 - RNA, 18 nt, Leptospira interrogans serovar lai str. 56601
accagugccauuuuucuu

SEQ ID NO: 762758 - RNA, 20 nt, Leptospira interrogans serovar lai str. 56601
accagccugccaaaagaacu

SEQ ID NO: 762759 - RNA, 18 nt, Leptospira interrogans serovar lai str. 56601
accaaguucgauuaaaau

SEQ ID NO: 762760 - RNA, 19 nt, Leptospira interrogans serovar lai str. 56601
accaccaaaguaugauuuu

SEQ ID NO: 762761 - RNA, 21 nt, Leptospira interrogans serovar lai str. 56601
accaacucagaugaaaguuug

SEQ ID NO: 762762 - RNA, 19 nt, Leptospira interrogans serovar lai str. 56601
accaaccgaaacuuucaaa

SEQ ID NO: 762763 - RNA, 13 nt, Leptospira interrogans serovar lai str. 56601
accaacagcauca

SEQ ID NO: 762764 - RNA, 17 nt, Leptospira interrogans serovar lai str. 56601
accaacagcaucaacau

SEQ ID NO: 762765 - RNA, 23 nt, Leptospira interrogans serovar lai str. 56601
accaaaaauagggaaaacucaac

SEQ ID NO: 762766 - RNA, 11 nt, Leptospira interrogans serovar lai str. 56601
accaaaaaugc

SEQ ID NO: 762767 - RNA, 14 nt, Leptospira interrogans serovar lai str. 56601
acauuuuugugaaa

SEQ ID NO: 762768 - RNA, 18 nt, Leptospira interrogans serovar lai str. 56601
acauuuuugugaaacuca

SEQ ID NO: 762769 - RNA, 12 nt, Leptospira interrogans serovar lai str. 56601
acauuuuuuaaa

SEQ ID NO: 762770 - RNA, 17 nt, Leptospira interrogans serovar lai str. 56601
acauuuuuuaaauuuau

SEQ ID NO: 762771 - RNA, 23 nt, Leptospira interrogans serovar lai str. 56601
acauguaaaacuuagaucucacg

SEQ ID NO: 762772 - RNA, 15 nt, Leptospira interrogans serovar lai str. 56601
acgauuucauccaug

SEQ ID NO: 762773 - RNA, 17 nt, Leptospira interrogans serovar lai str. 56601
acgauuucuauccauuc

SEQ ID NO: 762774 - RNA, 17 nt, Leptospira interrogans serovar lai str. 56601
acgauuucuauuuuucg

SEQ ID NO: 762775 - RNA, 22 nt, Leptospira interrogans serovar lai str. 56601
acgauuucuccaagaacguuuc

SEQ ID NO: 762776 - RNA, 17 nt, Leptospira interrogans serovar lai str. 56601
acgauuguaaaaaaaca

SEQ ID NO: 762777 - RNA, 14 nt, Leptospira interrogans serovar lai str. 56601
acgauuugugggag

SEQ ID NO: 762778 - RNA, 17 nt, Leptospira interrogans serovar lai str. 56601
acgauugauuuuggaaa

SEQ ID NO: 762779 - RNA, 21 nt, Leptospira interrogans serovar lai str. 56601
acgauugauuuuggaaagaau

SEQ ID NO: 762780 - RNA, 16 nt, Leptospira interrogans serovar lai str. 56601
acgauuuuuuacaaaa

SEQ ID NO: 762781 - RNA, 22 nt, Leptospira interrogans serovar lai str. 56601
acgaugagccaucuuuuuuugc

SEQ ID NO: 762782 - RNA, 19 nt, Leptospira interrogans serovar lai str. 56601
acgaucugcuuuuuuaaac

SEQ ID NO: 762783 - RNA, 22 nt, Leptospira interrogans serovar lai str. 56601
acgaucugcuuuuuuaaaccuu

SEQ ID NO: 762784 - RNA, 15 nt, Leptospira interrogans serovar lai str. 56601
acgauccguaaaaau

SEQ ID NO: 762785 - RNA, 14 nt, Leptospira interrogans serovar lai str. 56601
acgaucuaaaagga

SEQ ID NO: 762786 - RNA, 23 nt, Leptospira interrogans serovar lai str. 56601
acgaucuaauuuguaagaacacu

SEQ ID NO: 762787 - RNA, 14 nt, Leptospira interrogans serovar lai str. 56601
acgauacuuaaaaa

SEQ ID NO: 762788 - RNA, 16 nt, Leptospira interrogans serovar lai str. 56601
acgauaagucucucuu

SEQ ID NO: 762789 - RNA, 15 nt, Leptospira interrogans serovar lai str. 56601
acgauauuagaacug

SEQ ID NO: 762790 - RNA, 14 nt, Leptospira interrogans serovar lai str. 56601
acgaucagaaaaac

SEQ ID NO: 762791 - RNA, 16 nt, Leptospira interrogans serovar lai str. 56601
acgauccuuuucgccc

SEQ ID NO: 762792 - RNA, 14 nt, Leptospira interrogans serovar lai str. 56601
acgauccuuuuuug

SEQ ID NO: 762793 - RNA, 18 nt, Leptospira interrogans serovar lai str. 56601
acgaacacauucuaaaau

SEQ ID NO: 762794 - RNA, 18 nt, Leptospira interrogans serovar lai str. 56601
acgaaccaauucuaaaau

SEQ ID NO: 762795 - RNA, 19 nt, Leptospira interrogans serovar lai str. 56601
acgacagauucaauuuuua

SEQ ID NO: 762796 - RNA, 21 nt, Leptospira interrogans serovar lai str. 56601
acgaauugcacauaaaagacc

SEQ ID NO: 762797 - RNA, 15 nt, Leptospira interrogans serovar lai str. 56601
acgaauucuaaaauu

SEQ ID NO: 762798 - RNA, 21 nt, Leptospira interrogans serovar lai str. 56601
acgacaaguccucuaugaaac

SEQ ID NO: 762799 - RNA, 16 nt, Leptospira interrogans serovar lai str. 56601
acgaauuuuuuagaaa

SEQ ID NO: 762800 - RNA, 22 nt, Leptospira interrogans serovar lai str. 56601
acgaauuacguagcgaagaaua

SEQ ID NO: 762801 - RNA, 18 nt, Leptospira interrogans serovar lai str. 56601
acgaauccugcuaacuga

SEQ ID NO: 762802 - RNA, 21 nt, Leptospira interrogans serovar lai str. 56601
acgaaucgacguuauguggaa

SEQ ID NO: 762803 - RNA, 14 nt, Leptospira interrogans serovar lai str. 56601
acgaaucuaauuua

SEQ ID NO: 762804 - RNA, 22 nt, Leptospira interrogans serovar lai str. 56601
acgaagucuccagcauuuagaa

SEQ ID NO: 762805 - RNA, 23 nt, Leptospira interrogans serovar lai str. 56601
acgaaguuccaacguaccaaaac

SEQ ID NO: 762806 - RNA, 22 nt, Leptospira interrogans serovar lai str. 56601
acgacuuuauucaaaauagaau

SEQ ID NO: 762807 - RNA, 20 nt, Leptospira interrogans serovar lai str. 56601
acgacucguaauuaaauuuu

SEQ ID NO: 762808 - RNA, 12 nt, Leptospira interrogans serovar lai str. 56601
acgacauuuuag

SEQ ID NO: 762809 - RNA, 15 nt, Leptospira interrogans serovar lai str. 56601
acgacauuagaacua

SEQ ID NO: 762810 - RNA, 21 nt, Leptospira interrogans serovar lai str. 56601
accuuuucuagacuuucuuug

SEQ ID NO: 762811 - RNA, 16 nt, Leptospira interrogans serovar lai str. 56601
accuuuugaaguagua

SEQ ID NO: 762812 - RNA, 16 nt, Leptospira interrogans serovar lai str. 56601
accuuuguuuccucuu

SEQ ID NO: 762813 - RNA, 15 nt, Leptospira interrogans serovar lai str. 56601
accuuugauagaacu

SEQ ID NO: 762814 - RNA, 19 nt, Leptospira interrogans serovar lai str. 56601
accuuucaucuacauaaaa

SEQ ID NO: 762815 - RNA, 19 nt, Leptospira interrogans serovar lai str. 56601
accuuuauuuaauaaaauu

SEQ ID NO: 762816 - RNA, 13 nt, Leptospira interrogans serovar lai str. 56601
accuuucuaaaaa

SEQ ID NO: 762817 - RNA, 14 nt, Leptospira interrogans serovar lai str. 56601
accuuucuaaaaau

SEQ ID NO: 762818 - RNA, 20 nt, Leptospira interrogans serovar lai str. 56601
accuuuaccauaaauuuuuu

SEQ ID NO: 762819 - RNA, 23 nt, Leptospira interrogans serovar lai str. 56601
acgaaaauuuaacgacauuagaa

SEQ ID NO: 762820 - RNA, 23 nt, Leptospira interrogans serovar lai str. 56601
acgaaaacuuaaugagauuaaaa

SEQ ID NO: 762821 - RNA, 19 nt, Leptospira interrogans serovar lai str. 56601
acgaaaaaugaauguuuaa

SEQ ID NO: 762822 - RNA, 18 nt, Leptospira interrogans serovar lai str. 56601
accuuggaaagaaaaggu

SEQ ID NO: 762823 - RNA, 18 nt, Leptospira interrogans serovar lai str. 56601
accuuccaaagauuuuaa

SEQ ID NO: 762824 - RNA, 23 nt, Leptospira interrogans serovar lai str. 56601
accuguuuuaguucaaaaacauc

SEQ ID NO: 762825 - RNA, 18 nt, Leptospira interrogans serovar lai str. 56601
accuuaaguuucaaguuu

SEQ ID NO: 762826 - RNA, 16 nt, Leptospira interrogans serovar lai str. 56601
accuuacugcauuuua

SEQ ID NO: 762827 - RNA, 19 nt, Leptospira interrogans serovar lai str. 56601
accuguucggaguuguaua

SEQ ID NO: 762828 - RNA, 13 nt, Leptospira interrogans serovar lai str. 56601
accugcuuugguu

SEQ ID NO: 762829 - RNA, 22 nt, Leptospira interrogans serovar lai str. 56601
accuggcauaguuuguuaucaa

SEQ ID NO: 762830 - RNA, 23 nt, Leptospira interrogans serovar lai str. 56601
accuggcucucagcucugguuaa

SEQ ID NO: 762831 - RNA, 16 nt, Leptospira interrogans serovar lai str. 56601
accugccuuucuuauu

SEQ ID NO: 762832 - RNA, 23 nt, Leptospira interrogans serovar lai str. 56601
accugccuuauaaugaagacgcu

SEQ ID NO: 762833 - RNA, 15 nt, Leptospira interrogans serovar lai str. 56601
accucguacuaauuc

SEQ ID NO: 762834 - RNA, 18 nt, Leptospira interrogans serovar lai str. 56601
accucuauggaauuuuuu

SEQ ID NO: 762835 - RNA, 19 nt, Leptospira interrogans serovar lai str. 56601
accucuauggaauuuuuua

SEQ ID NO: 762836 - RNA, 14 nt, Leptospira interrogans serovar lai str. 56601
accucuauaaaauc

SEQ ID NO: 762837 - RNA, 21 nt, Leptospira interrogans serovar lai str. 56601
accucuauaaaaucuaaaaaa

SEQ ID NO: 762838 - RNA, 22 nt, Leptospira interrogans serovar lai str. 56601
accucucggaauauuuuuucca

SEQ ID NO: 762839 - RNA, 21 nt, Leptospira interrogans serovar lai str. 56601
accucuguuuugcgauuauua

SEQ ID NO: 762840 - RNA, 15 nt, Leptospira interrogans serovar lai str. 56601
accugcaaauuuuuu

SEQ ID NO: 762841 - RNA, 13 nt, Leptospira interrogans serovar lai str. 56601
accugauuuuucc

SEQ ID NO: 762842 - RNA, 22 nt, Leptospira interrogans serovar lai str. 56601
accugauuuuucuguaaaaaua

SEQ ID NO: 762843 - RNA, 22 nt, Leptospira interrogans serovar lai str. 56601
accucuuuauacggaugugaau

SEQ ID NO: 762844 - RNA, 18 nt, Leptospira interrogans serovar lai str. 56601
accucaauuuuccauuuc

SEQ ID NO: 762845 - RNA, 22 nt, Leptospira interrogans serovar lai str. 56601
accucaacagaauguucuuaga

SEQ ID NO: 762846 - RNA, 15 nt, Leptospira interrogans serovar lai str. 56601
accucauaucaaaaa

SEQ ID NO: 762847 - RNA, 20 nt, Leptospira interrogans serovar lai str. 56601
accguccaaucaaauuuuug

SEQ ID NO: 762848 - RNA, 14 nt, Leptospira interrogans serovar lai str. 56601
accguagauuuuaa

SEQ ID NO: 762849 - RNA, 18 nt, Leptospira interrogans serovar lai str. 56601
accuaauauuuugcauga

SEQ ID NO: 762850 - RNA, 18 nt, Leptospira interrogans serovar lai str. 56601
accuaauuuauuuguaaa

SEQ ID NO: 762851 - RNA, 21 nt, Leptospira interrogans serovar lai str. 56601
accuaauguuuuuuauuuaaa

SEQ ID NO: 762852 - RNA, 14 nt, Leptospira interrogans serovar lai str. 56601
accguugcuauaaa

SEQ ID NO: 762853 - RNA, 23 nt, Leptospira interrogans serovar lai str. 56601
accguuuccaugaaauagaaaac

SEQ ID NO: 762854 - RNA, 14 nt, Leptospira interrogans serovar lai str. 56601
accuaaaaugaaaa

SEQ ID NO: 762855 - RNA, 15 nt, Leptospira interrogans serovar lai str. 56601
accuaaaaugaaaaa

SEQ ID NO: 762856 - RNA, 12 nt, Leptospira interrogans serovar lai str. 56601
accuaaacccug

SEQ ID NO: 762857 - RNA, 19 nt, Leptospira interrogans serovar lai str. 56601
accggguuccauucuaaga

SEQ ID NO: 762858 - RNA, 17 nt, Leptospira interrogans serovar lai str. 56601
accgguucagcuagaaa

SEQ ID NO: 762859 - RNA, 23 nt, Leptospira interrogans serovar lai str. 56601
accguaauucuuaauuuguuugg

SEQ ID NO: 762860 - RNA, 15 nt, Leptospira interrogans serovar lai str. 56601
accgggauuuuaaaa

SEQ ID NO: 762861 - RNA, 17 nt, Leptospira interrogans serovar lai str. 56601
accgccuucacccacca

SEQ ID NO: 762862 - RNA, 23 nt, Leptospira interrogans serovar lai str. 56601
accgcugaagauagguucaaaaa

SEQ ID NO: 762863 - RNA, 17 nt, Leptospira interrogans serovar lai str. 56601
accgcgcuuucagcucu

SEQ ID NO: 762864 - RNA, 15 nt, Leptospira interrogans serovar lai str. 56601
accgaucuuaaaaac

SEQ ID NO: 762865 - RNA, 18 nt, Leptospira interrogans serovar lai str. 56601
agaaagguauagaaguuc

SEQ ID NO: 762866 - RNA, 14 nt, Leptospira interrogans serovar lai str. 56601
agaaaguaaaauua

SEQ ID NO: 762867 - RNA, 16 nt, Leptospira interrogans serovar lai str. 56601
agaaaguaaaauuaca

SEQ ID NO: 762868 - RNA, 16 nt, Leptospira interrogans serovar lai str. 56601
agaaaggagaacucau

SEQ ID NO: 762869 - RNA, 20 nt, Leptospira interrogans serovar lai str. 56601
agaaagcgcagacucuucuc

SEQ ID NO: 762870 - RNA, 18 nt, Leptospira interrogans serovar lai str. 56601
agaaagcgugacuaaaau

SEQ ID NO: 762871 - RNA, 22 nt, Leptospira interrogans serovar lai str. 56601
agaaagcgugacuaaaauugac

SEQ ID NO: 762872 - RNA, 11 nt, Leptospira interrogans serovar lai str. 56601
agaaagcagca

SEQ ID NO: 762873 - RNA, 21 nt, Leptospira interrogans serovar lai str. 56601
agaaacuggaauauucuuuuu

SEQ ID NO: 762874 - RNA, 15 nt, Leptospira interrogans serovar lai str. 56601
agaaacuuauacuuu

SEQ ID NO: 762875 - RNA, 16 nt, Leptospira interrogans serovar lai str. 56601
agaaacuuauacuuua

SEQ ID NO: 762876 - RNA, 20 nt, Leptospira interrogans serovar lai str. 56601
agaaagcccguucuguugag

SEQ ID NO: 762877 - RNA, 17 nt, Leptospira interrogans serovar lai str. 56601
agaaacuauuauacuuu

SEQ ID NO: 762878 - RNA, 18 nt, Leptospira interrogans serovar lai str. 56601
agaaacuauuauacuuua

SEQ ID NO: 762879 - RNA, 16 nt, Leptospira interrogans serovar lai str. 56601
agaaacucaguaaaac

SEQ ID NO: 762880 - RNA, 22 nt, Leptospira interrogans serovar lai str. 56601
agaaacucauuuuucuaaaaaa

SEQ ID NO: 762881 - RNA, 20 nt, Leptospira interrogans serovar lai str. 56601
agaaacucgcaaacguccag

SEQ ID NO: 762882 - RNA, 21 nt, Leptospira interrogans serovar lai str. 56601
agaaacucgcaaacguccaga

SEQ ID NO: 762883 - RNA, 10 nt, Leptospira interrogans serovar lai str. 56601
agaaaauucg

SEQ ID NO: 762884 - RNA, 23 nt, Leptospira interrogans serovar lai str. 56601
agaaaaugugagagaggauacua

SEQ ID NO: 762885 - RNA, 18 nt, Leptospira interrogans serovar lai str. 56601
agaaaauuauaaacaaau

SEQ ID NO: 762886 - RNA, 22 nt, Leptospira interrogans serovar lai str. 56601
agaaaaauugaaaggaagaucg

SEQ ID NO: 762887 - RNA, 13 nt, Leptospira interrogans serovar lai str. 56601
agaaaaaugaauu

SEQ ID NO: 762888 - RNA, 22 nt, Leptospira interrogans serovar lai str. 56601
agaaaauccagucaaguaaaga

SEQ ID NO: 762889 - RNA, 18 nt, Leptospira interrogans serovar lai str. 56601
agaaacggaagaaaauua

SEQ ID NO: 762890 - RNA, 21 nt, Leptospira interrogans serovar lai str. 56601
agaaacguaauacgauauuuu

SEQ ID NO: 762891 - RNA, 22 nt, Leptospira interrogans serovar lai str. 56601
agaaacguuauacaauauuucg

SEQ ID NO: 762892 - RNA, 21 nt, Leptospira interrogans serovar lai str. 56601
agaaacggauggagaauuuau

SEQ ID NO: 762893 - RNA, 23 nt, Leptospira interrogans serovar lai str. 56601
agaaacggugcauuuaaaaaauu

SEQ ID NO: 762894 - RNA, 17 nt, Leptospira interrogans serovar lai str. 56601
agaaaccauaaaauaaa

SEQ ID NO: 762895 - RNA, 18 nt, Leptospira interrogans serovar lai str. 56601
agaaaccauaaaauaaaa

SEQ ID NO: 762896 - RNA, 16 nt, Leptospira interrogans serovar lai str. 56601
agaaaccgauuuuaau

SEQ ID NO: 762897 - RNA, 16 nt, Leptospira interrogans serovar lai str. 56601
agaaaccucuauaaau

SEQ ID NO: 762898 - RNA, 16 nt, Leptospira interrogans serovar lai str. 56601
agaaaccuuuauagaa

SEQ ID NO: 762899 - RNA, 14 nt, Leptospira interrogans serovar lai str. 56601
agaaaccuuuucua

SEQ ID NO: 762900 - RNA, 23 nt, Leptospira interrogans serovar lai str. 56601
acuuuuuugauaccgggauuuua

SEQ ID NO: 762901 - RNA, 13 nt, Leptospira interrogans serovar lai str. 56601
acuuuuuuauaua

SEQ ID NO: 762902 - RNA, 21 nt, Leptospira interrogans serovar lai str. 56601
acuuuuuuaauuuuaauuaag

SEQ ID NO: 762903 - RNA, 23 nt, Leptospira interrogans serovar lai str. 56601
acuuuuuucggagucauacauuu

SEQ ID NO: 762904 - RNA, 16 nt, Leptospira interrogans serovar lai str. 56601
agaaaaagcacaaaac

SEQ ID NO: 762905 - RNA, 20 nt, Leptospira interrogans serovar lai str. 56601
agaaaaaucagguuuuauaa

SEQ ID NO: 762906 - RNA, 13 nt, Leptospira interrogans serovar lai str. 56601
acuuuuucagaaa

SEQ ID NO: 762907 - RNA, 19 nt, Leptospira interrogans serovar lai str. 56601
acuuuuucagaaaaaugaa

SEQ ID NO: 762908 - RNA, 20 nt, Leptospira interrogans serovar lai str. 56601
acuuuuucagaaaaaugaau

SEQ ID NO: 762909 - RNA, 15 nt, Leptospira interrogans serovar lai str. 56601
acuuuuuauaaaaag

SEQ ID NO: 762910 - RNA, 16 nt, Leptospira interrogans serovar lai str. 56601
acuuuuuauaaagauu

SEQ ID NO: 762911 - RNA, 20 nt, Leptospira interrogans serovar lai str. 56601
acuuuuguugcggagaaugu

SEQ ID NO: 762912 - RNA, 13 nt, Leptospira interrogans serovar lai str. 56601
acuuuuucugguu

SEQ ID NO: 762913 - RNA, 14 nt, Leptospira interrogans serovar lai str. 56601
acuuuucuauaaaa

SEQ ID NO: 762914 - RNA, 17 nt, Leptospira interrogans serovar lai str. 56601
acuuuucggaacaagau

SEQ ID NO: 762915 - RNA, 17 nt, Leptospira interrogans serovar lai str. 56601
acuuuuguaauaaaaau

SEQ ID NO: 762916 - RNA, 19 nt, Leptospira interrogans serovar lai str. 56601
acuuuuguaauaaaaauuu

SEQ ID NO: 762917 - RNA, 12 nt, Leptospira interrogans serovar lai str. 56601
acuuuucuuccc

SEQ ID NO: 762918 - RNA, 21 nt, Leptospira interrogans serovar lai str. 56601
agaaccuuuaguuuccaaaaa

SEQ ID NO: 762919 - RNA, 13 nt, Leptospira interrogans serovar lai str. 56601
agaacgaacuaau

SEQ ID NO: 762920 - RNA, 19 nt, Leptospira interrogans serovar lai str. 56601
agaacgaauugcacauaaa

SEQ ID NO: 762921 - RNA, 21 nt, Leptospira interrogans serovar lai str. 56601
agaacgcgaacuuuuuuauaa

SEQ ID NO: 762922 - RNA, 23 nt, Leptospira interrogans serovar lai str. 56601
agaacgcgaacuuuuuuauaaau

SEQ ID NO: 762923 - RNA, 17 nt, Leptospira interrogans serovar lai str. 56601
agaacgauuuuuuacaa

SEQ ID NO: 762924 - RNA, 20 nt, Leptospira interrogans serovar lai str. 56601
agaacgauuuuuuacaaaag

SEQ ID NO: 762925 - RNA, 18 nt, Leptospira interrogans serovar lai str. 56601
agaaccgaauaucggaau

SEQ ID NO: 762926 - RNA, 16 nt, Leptospira interrogans serovar lai str. 56601
agaaccguaacugaca

SEQ ID NO: 762927 - RNA, 22 nt, Leptospira interrogans serovar lai str. 56601
agaaccuaauguugaaugaaac

SEQ ID NO: 762928 - RNA, 13 nt, Leptospira interrogans serovar lai str. 56601
agaaccuggaaaa

SEQ ID NO: 762929 - RNA, 17 nt, Leptospira interrogans serovar lai str. 56601
agaaccuggaaaagaau

SEQ ID NO: 762930 - RNA, 20 nt, Leptospira interrogans serovar lai str. 56601
agaacgugucauguuuuaau

SEQ ID NO: 762931 - RNA, 15 nt, Leptospira interrogans serovar lai str. 56601
agaacgggcuuucua

SEQ ID NO: 762932 - RNA, 16 nt, Leptospira interrogans serovar lai str. 56601
agaacgggcuuucuau

SEQ ID NO: 762933 - RNA, 17 nt, Leptospira interrogans serovar lai str. 56601
agaacguuuugcuaaaa

SEQ ID NO: 762934 - RNA, 19 nt, Leptospira interrogans serovar lai str. 56601
agaacuacuuuuauaaaaa

SEQ ID NO: 762935 - RNA, 20 nt, Leptospira interrogans serovar lai str. 56601
agaacuacuuuuauaaaaag

SEQ ID NO: 762936 - RNA, 21 nt, Leptospira interrogans serovar lai str. 56601
agaacuacuuuuauaaaaagu

SEQ ID NO: 762937 - RNA, 23 nt, Leptospira interrogans serovar lai str. 56601
agaacuacuuuuauaaaaaguuu

SEQ ID NO: 762938 - RNA, 17 nt, Leptospira interrogans serovar lai str. 56601
agaacuagaaagaccuu

SEQ ID NO: 762939 - RNA, 13 nt, Leptospira interrogans serovar lai str. 56601
agaacucauucaa

SEQ ID NO: 762940 - RNA, 22 nt, Leptospira interrogans serovar lai str. 56601
agaacucauucaaguaacgagu

SEQ ID NO: 762941 - RNA, 14 nt, Leptospira interrogans serovar lai str. 56601
agaacucacguuaa

SEQ ID NO: 762942 - RNA, 23 nt, Leptospira interrogans serovar lai str. 56601
agaacucuuuuaccuuaccaccg

SEQ ID NO: 762943 - RNA, 18 nt, Leptospira interrogans serovar lai str. 56601
agaacuggauucaaaauu

SEQ ID NO: 762944 - RNA, 19 nt, Leptospira interrogans serovar lai str. 56601
agaacccaauaaaaacuaa

SEQ ID NO: 762945 - RNA, 17 nt, Leptospira interrogans serovar lai str. 56601
agaacacugcauuuuau

SEQ ID NO: 762946 - RNA, 17 nt, Leptospira interrogans serovar lai str. 56601
agaacaagauuaacaau

SEQ ID NO: 762947 - RNA, 17 nt, Leptospira interrogans serovar lai str. 56601
agaacaauuuaaaauaa

SEQ ID NO: 762948 - RNA, 20 nt, Leptospira interrogans serovar lai str. 56601
agaacaauuuaaaauaauug

SEQ ID NO: 762949 - RNA, 14 nt, Leptospira interrogans serovar lai str. 56601
agaaauuuucaaaa

SEQ ID NO: 762950 - RNA, 18 nt, Leptospira interrogans serovar lai str. 56601
agaaauuuucaaaaaaua

SEQ ID NO: 762951 - RNA, 21 nt, Leptospira interrogans serovar lai str. 56601
agaaauuuucaaaaaauauca

SEQ ID NO: 762952 - RNA, 12 nt, Leptospira interrogans serovar lai str. 56601
agaaauuuuuaa

SEQ ID NO: 762953 - RNA, 15 nt, Leptospira interrogans serovar lai str. 56601
agaaauuuuuaauaa

SEQ ID NO: 762954 - RNA, 18 nt, Leptospira interrogans serovar lai str. 56601
agaaauuuuuaauaaaau

SEQ ID NO: 762955 - RNA, 19 nt, Leptospira interrogans serovar lai str. 56601
agaaauuuuuaauaaaaug

SEQ ID NO: 762956 - RNA, 21 nt, Leptospira interrogans serovar lai str. 56601
agaaauuuuuaauaaaaugca

SEQ ID NO: 762957 - RNA, 23 nt, Leptospira interrogans serovar lai str. 56601
agaaauuuuuaauaaaauguagu

SEQ ID NO: 762958 - RNA, 18 nt, Leptospira interrogans serovar lai str. 56601
agaaauuuuuaaucaaau

SEQ ID NO: 762959 - RNA, 19 nt, Leptospira interrogans serovar lai str. 56601
agaaauuuuuaaucaaaug

SEQ ID NO: 762960 - RNA, 19 nt, Leptospira interrogans serovar lai str. 56601
agaaauuucuaauaaaaua

SEQ ID NO: 762961 - RNA, 14 nt, Leptospira interrogans serovar lai str. 56601
agacauaaaaaaau

SEQ ID NO: 762962 - RNA, 15 nt, Leptospira interrogans serovar lai str. 56601
agacauaaaaaaauu

SEQ ID NO: 762963 - RNA, 20 nt, Leptospira interrogans serovar lai str. 56601
agacauaaaaaaauuaaaaa

SEQ ID NO: 762964 - RNA, 15 nt, Leptospira interrogans serovar lai str. 56601
agacaagaagaaaag

SEQ ID NO: 762965 - RNA, 16 nt, Leptospira interrogans serovar lai str. 56601
agacaagaagaaaaga

SEQ ID NO: 762966 - RNA, 17 nt, Leptospira interrogans serovar lai str. 56601
agaauuuauucguaaaa

SEQ ID NO: 762967 - RNA, 20 nt, Leptospira interrogans serovar lai str. 56601
agaauuuauucguaaaaucu

SEQ ID NO: 762968 - RNA, 16 nt, Leptospira interrogans serovar lai str. 56601
agaauuucuuucucuc

SEQ ID NO: 762969 - RNA, 16 nt, Leptospira interrogans serovar lai str. 56601
agaauuucuaaaagua

SEQ ID NO: 762970 - RNA, 21 nt, Leptospira interrogans serovar lai str. 56601
agaauuucuaaaauucuuccg

SEQ ID NO: 762971 - RNA, 18 nt, Leptospira interrogans serovar lai str. 56601
agaauuucuauaaaaucu

SEQ ID NO: 762972 - RNA, 18 nt, Leptospira interrogans serovar lai str. 56601
agaauuuauuuguaaaau

SEQ ID NO: 762973 - RNA, 15 nt, Leptospira interrogans serovar lai str. 56601
agaauuuauuuuuca

SEQ ID NO: 762974 - RNA, 16 nt, Leptospira interrogans serovar lai str. 56601
agaauuuaauaaaaaa

SEQ ID NO: 762975 - RNA, 15 nt, Leptospira interrogans serovar lai str. 56601
agaauugauuuuuca

SEQ ID NO: 762976 - RNA, 21 nt, Leptospira interrogans serovar lai str. 56601
agaauugauuuuucaacaacu

SEQ ID NO: 762977 - RNA, 15 nt, Leptospira interrogans serovar lai str. 56601
agaauuguugaaaaa

SEQ ID NO: 762978 - RNA, 19 nt, Leptospira interrogans serovar lai str. 56601
agaauuguugaaaaauuaa

SEQ ID NO: 762979 - RNA, 19 nt, Leptospira interrogans serovar lai str. 56601
agaauuguugaaaaauuua

SEQ ID NO: 762980 - RNA, 17 nt, Leptospira interrogans serovar lai str. 56601
agaauucuacauucuga

SEQ ID NO: 762981 - RNA, 18 nt, Leptospira interrogans serovar lai str. 56601
agaauucuacauucugaa

SEQ ID NO: 762982 - RNA, 13 nt, Leptospira interrogans serovar lai str. 56601
agaauucuccaca

SEQ ID NO: 762983 - RNA, 12 nt, Leptospira interrogans serovar lai str. 56601
agaauucuuuga

SEQ ID NO: 762984 - RNA, 23 nt, Leptospira interrogans serovar lai str. 56601
agaauugaaagaagauagauuua

SEQ ID NO: 762985 - RNA, 18 nt, Leptospira interrogans serovar lai str. 56601
agaccaguaguauguuuu

SEQ ID NO: 762986 - RNA, 20 nt, Leptospira interrogans serovar lai str. 56601
agaccaguaguauguuuuuc

SEQ ID NO: 762987 - RNA, 19 nt, Leptospira interrogans serovar lai str. 56601
agaccagugccauuuuucu

SEQ ID NO: 762988 - RNA, 19 nt, Leptospira interrogans serovar lai str. 56601
agacgauuccuaaaaauug

SEQ ID NO: 762989 - RNA, 17 nt, Leptospira interrogans serovar lai str. 56601
agacguaggaaaugaaa

SEQ ID NO: 762990 - RNA, 14 nt, Leptospira interrogans serovar lai str. 56601
agacguaucaaaau

SEQ ID NO: 762991 - RNA, 18 nt, Leptospira interrogans serovar lai str. 56601
agacguauuauccauuuc

SEQ ID NO: 762992 - RNA, 13 nt, Leptospira interrogans serovar lai str. 56601
agaauauuaaauu

SEQ ID NO: 762993 - RNA, 19 nt, Leptospira interrogans serovar lai str. 56601
agaaucaaaggaaauaaaa

SEQ ID NO: 762994 - RNA, 21 nt, Leptospira interrogans serovar lai str. 56601
agaauauuuucucaguaaaau

SEQ ID NO: 762995 - RNA, 14 nt, Leptospira interrogans serovar lai str. 56601
agaauauuauaaau

SEQ ID NO: 762996 - RNA, 21 nt, Leptospira interrogans serovar lai str. 56601
agaauauuauaaauauuaauu

SEQ ID NO: 762997 - RNA, 13 nt, Leptospira interrogans serovar lai str. 56601
agaauauuaugaa

SEQ ID NO: 762998 - RNA, 20 nt, Leptospira interrogans serovar lai str. 56601
agaauauuaugaaauaaaga

SEQ ID NO: 762999 - RNA, 20 nt, Leptospira interrogans serovar lai str. 56601
agaauccuguuugaaaaaau

SEQ ID NO: 763000 - RNA, 22 nt, Leptospira interrogans serovar lai str. 56601
agaauccuguuugaaaaaaugu

SEQ ID NO: 763001 - RNA, 19 nt, Leptospira interrogans serovar lai str. 56601
agaaucgauaggaguauaa

SEQ ID NO: 763002 - RNA, 17 nt, Leptospira interrogans serovar lai str. 56601
agaaucgaaaaaauaca

SEQ ID NO: 763003 - RNA, 12 nt, Leptospira interrogans serovar lai str. 56601
agaaucuaucuc

SEQ ID NO: 763004 - RNA, 20 nt, Leptospira interrogans serovar lai str. 56601
agaaucuaucucaaaauacu

SEQ ID NO: 763005 - RNA, 20 nt, Leptospira interrogans serovar lai str. 56601
agaaucgucgcucaaucaaa

SEQ ID NO: 763006 - RNA, 22 nt, Leptospira interrogans serovar lai str. 56601
agaauuccuacauucauuuuua

SEQ ID NO: 763007 - RNA, 22 nt, Leptospira interrogans serovar lai str. 56601
agaauucauuuuacagaauauu

SEQ ID NO: 763008 - RNA, 15 nt, Leptospira interrogans serovar lai str. 56601
agaauucauuuuucu

SEQ ID NO: 763009 - RNA, 22 nt, Leptospira interrogans serovar lai str. 56601
agaauguaaaagcuuuugcuuu

SEQ ID NO: 763010 - RNA, 18 nt, Leptospira interrogans serovar lai str. 56601
agaaucuugggguuuuug

SEQ ID NO: 763011 - RNA, 16 nt, Leptospira interrogans serovar lai str. 56601
agaauaauuuaaacuu

SEQ ID NO: 763012 - RNA, 18 nt, Leptospira interrogans serovar lai str. 56601
agaagccaauuccaaaaa

SEQ ID NO: 763013 - RNA, 19 nt, Leptospira interrogans serovar lai str. 56601
agaagcuuuauuaaauuau

SEQ ID NO: 763014 - RNA, 21 nt, Leptospira interrogans serovar lai str. 56601
agaagcuuuauuaaauuauau

SEQ ID NO: 763015 - RNA, 20 nt, Leptospira interrogans serovar lai str. 56601
agaagccaauaaccaacccc

SEQ ID NO: 763016 - RNA, 18 nt, Leptospira interrogans serovar lai str. 56601
agaagauuuuaucgaaua

SEQ ID NO: 763017 - RNA, 14 nt, Leptospira interrogans serovar lai str. 56601
agaagauuuuuacu

SEQ ID NO: 763018 - RNA, 13 nt, Leptospira interrogans serovar lai str. 56601
agaacuuucucga

SEQ ID NO: 763019 - RNA, 17 nt, Leptospira interrogans serovar lai str. 56601
agaacuguugaaaaaau

SEQ ID NO: 763020 - RNA, 19 nt, Leptospira interrogans serovar lai str. 56601
agauguugaguuucuuuug

SEQ ID NO: 763021 - RNA, 12 nt, Leptospira interrogans serovar lai str. 56601
agauuaaaaaga

SEQ ID NO: 763022 - RNA, 14 nt, Leptospira interrogans serovar lai str. 56601
agauuaaaaagaac

SEQ ID NO: 763023 - RNA, 13 nt, Leptospira interrogans serovar lai str. 56601
agauuaaaaccgu

SEQ ID NO: 763024 - RNA, 12 nt, Leptospira interrogans serovar lai str. 56601
agauguuuuaaa

SEQ ID NO: 763025 - RNA, 18 nt, Leptospira interrogans serovar lai str. 56601
agauguuuuaaaaguuuu

SEQ ID NO: 763026 - RNA, 21 nt, Leptospira interrogans serovar lai str. 56601
agauuacauuuuucuaaauua

SEQ ID NO: 763027 - RNA, 14 nt, Leptospira interrogans serovar lai str. 56601
agauuaaaaucgga

SEQ ID NO: 763028 - RNA, 15 nt, Leptospira interrogans serovar lai str. 56601
agaugugggaacuac

SEQ ID NO: 763029 - RNA, 15 nt, Leptospira interrogans serovar lai str. 56601
agaugggguugaauc

SEQ ID NO: 763030 - RNA, 19 nt, Leptospira interrogans serovar lai str. 56601
agauggagaauuaauuuuu

SEQ ID NO: 763031 - RNA, 20 nt, Leptospira interrogans serovar lai str. 56601
agauggagaauuaauuuuuc

SEQ ID NO: 763032 - RNA, 22 nt, Leptospira interrogans serovar lai str. 56601
agaugcuuucucuuuuuagaca

SEQ ID NO: 763033 - RNA, 23 nt, Leptospira interrogans serovar lai str. 56601
agaugcucggcuucuucaauguu

SEQ ID NO: 763034 - RNA, 21 nt, Leptospira interrogans serovar lai str. 56601
agauuggagggcaaucgauuu

SEQ ID NO: 763035 - RNA, 15 nt, Leptospira interrogans serovar lai str. 56601
agauugcuuuuuaaa

SEQ ID NO: 763036 - RNA, 16 nt, Leptospira interrogans serovar lai str. 56601
agauugcuuuuuaaaa

SEQ ID NO: 763037 - RNA, 17 nt, Leptospira interrogans serovar lai str. 56601
agauugcuuuuuaaaag

SEQ ID NO: 763038 - RNA, 18 nt, Leptospira interrogans serovar lai str. 56601
agauugcuuuuuaaaaga

SEQ ID NO: 763039 - RNA, 14 nt, Leptospira interrogans serovar lai str. 56601
agauugauuuuaau

SEQ ID NO: 763040 - RNA, 21 nt, Leptospira interrogans serovar lai str. 56601
agauugaguuucacaaaaugc

SEQ ID NO: 763041 - RNA, 22 nt, Leptospira interrogans serovar lai str. 56601
agauugauauucaaauuuacuc

SEQ ID NO: 763042 - RNA, 18 nt, Leptospira interrogans serovar lai str. 56601
agauugauucuuuaaaug

SEQ ID NO: 763043 - RNA, 14 nt, Leptospira interrogans serovar lai str. 56601
agauugaaugaaau

SEQ ID NO: 763044 - RNA, 15 nt, Leptospira interrogans serovar lai str. 56601
agauugaaugaaauc

SEQ ID NO: 763045 - RNA, 22 nt, Leptospira interrogans serovar lai str. 56601
agauucuucuccucuuccggaa

SEQ ID NO: 763046 - RNA, 14 nt, Leptospira interrogans serovar lai str. 56601
agauucuugauaaa

SEQ ID NO: 763047 - RNA, 20 nt, Leptospira interrogans serovar lai str. 56601
agauucuaauuuuucaaaaa

SEQ ID NO: 763048 - RNA, 16 nt, Leptospira interrogans serovar lai str. 56601
agauucuauuuucuuu

SEQ ID NO: 763049 - RNA, 23 nt, Leptospira interrogans serovar lai str. 56601
agauucuauuuugagaaaaucca

SEQ ID NO: 763050 - RNA, 21 nt, Leptospira interrogans serovar lai str. 56601
agauuccuuuuaagaauacug

SEQ ID NO: 763051 - RNA, 21 nt, Leptospira interrogans serovar lai str. 56601
agauucgaacuuuuuuuagaa

SEQ ID NO: 763052 - RNA, 17 nt, Leptospira interrogans serovar lai str. 56601
agauuaguuuaaaaacu

SEQ ID NO: 763053 - RNA, 13 nt, Leptospira interrogans serovar lai str. 56601
agauuauuuuuga

SEQ ID NO: 763054 - RNA, 19 nt, Leptospira interrogans serovar lai str. 56601
agauuauuucaaaaauuua

SEQ ID NO: 763055 - RNA, 23 nt, Leptospira interrogans serovar lai str. 56601
agauuauuucaaaaauuuaaaug

SEQ ID NO: 763056 - RNA, 14 nt, Leptospira interrogans serovar lai str. 56601
agauucaauuuuua

SEQ ID NO: 763057 - RNA, 16 nt, Leptospira interrogans serovar lai str. 56601
agauucacuuuugcug

SEQ ID NO: 763058 - RNA, 16 nt, Leptospira interrogans serovar lai str. 56601
agauucaucgcuuuua

SEQ ID NO: 763059 - RNA, 18 nt, Leptospira interrogans serovar lai str. 56601
agauucaucgcuuuuaaa

SEQ ID NO: 763060 - RNA, 18 nt, Leptospira interrogans serovar lai str. 56601
agauuccagcuuuuuuca

SEQ ID NO: 763061 - RNA, 23 nt, Leptospira interrogans serovar lai str. 56601
agauuccguuuuuauuucuuuug

SEQ ID NO: 763062 - RNA, 17 nt, Leptospira interrogans serovar lai str. 56601
agaugauuuuguuaauu

SEQ ID NO: 763063 - RNA, 23 nt, Leptospira interrogans serovar lai str. 56601
agaucuugagauccaauuauuua

SEQ ID NO: 763064 - RNA, 22 nt, Leptospira interrogans serovar lai str. 56601
agaucugauauuuuaaauugaa

SEQ ID NO: 763065 - RNA, 17 nt, Leptospira interrogans serovar lai str. 56601
agaucgauucuuuaaau

SEQ ID NO: 763066 - RNA, 18 nt, Leptospira interrogans serovar lai str. 56601
agaucgauucuuuaaaug

SEQ ID NO: 763067 - RNA, 21 nt, Leptospira interrogans serovar lai str. 56601
agaucuacggaagcuaaaacu

SEQ ID NO: 763068 - RNA, 23 nt, Leptospira interrogans serovar lai str. 56601
agaucuaugauucugaaaaaaau

SEQ ID NO: 763069 - RNA, 15 nt, Leptospira interrogans serovar lai str. 56601
agaucauuaaugcga

SEQ ID NO: 763070 - RNA, 17 nt, Leptospira interrogans serovar lai str. 56601
agaucauuuaaaacuca

SEQ ID NO: 763071 - RNA, 19 nt, Leptospira interrogans serovar lai str. 56601
agauccacuacggaaggaa

SEQ ID NO: 763072 - RNA, 15 nt, Leptospira interrogans serovar lai str. 56601
agaucaguuauaagu

SEQ ID NO: 763073 - RNA, 16 nt, Leptospira interrogans serovar lai str. 56601
agaucaguuauaagua

SEQ ID NO: 763074 - RNA, 14 nt, Leptospira interrogans serovar lai str. 56601
agaucaauucuuua

SEQ ID NO: 763075 - RNA, 23 nt, Leptospira interrogans serovar lai str. 56601
agaucaauuuguuccuaaaaaau

SEQ ID NO: 763076 - RNA, 13 nt, Leptospira interrogans serovar lai str. 56601
agauauuuuccuu

SEQ ID NO: 763077 - RNA, 13 nt, Leptospira interrogans serovar lai str. 56601
agaucaaauaagc

SEQ ID NO: 763078 - RNA, 14 nt, Leptospira interrogans serovar lai str. 56601
agauauaacuuagu

SEQ ID NO: 763079 - RNA, 15 nt, Leptospira interrogans serovar lai str. 56601
agauauagaaauuuu

SEQ ID NO: 763080 - RNA, 15 nt, Leptospira interrogans serovar lai str. 56601
agauagguuuuguaa

SEQ ID NO: 763081 - RNA, 18 nt, Leptospira interrogans serovar lai str. 56601
agauagugcacugcuaua

SEQ ID NO: 763082 - RNA, 18 nt, Leptospira interrogans serovar lai str. 56601
agauauuaacaaauuuaa

SEQ ID NO: 763083 - RNA, 19 nt, Leptospira interrogans serovar lai str. 56601
agauauugcacaugauaua

SEQ ID NO: 763084 - RNA, 18 nt, Leptospira interrogans serovar lai str. 56601
agauagaaccuauaucuu

SEQ ID NO: 763085 - RNA, 19 nt, Leptospira interrogans serovar lai str. 56601
agauagagaauuaauuuuu

SEQ ID NO: 763086 - RNA, 20 nt, Leptospira interrogans serovar lai str. 56601
agauagagaauuaauuuuuc

SEQ ID NO: 763087 - RNA, 17 nt, Leptospira interrogans serovar lai str. 56601
agaguuugaguuucuuu

SEQ ID NO: 763088 - RNA, 17 nt, Leptospira interrogans serovar lai str. 56601
agaguuguuaaaaaauu

SEQ ID NO: 763089 - RNA, 18 nt, Leptospira interrogans serovar lai str. 56601
agaguuucuaaaaaaauu

SEQ ID NO: 763090 - RNA, 23 nt, Leptospira interrogans serovar lai str. 56601
agaguuguuuaucuucucuagaa

SEQ ID NO: 763091 - RNA, 18 nt, Leptospira interrogans serovar lai str. 56601
agaguucguuaagaauaa

SEQ ID NO: 763092 - RNA, 22 nt, Leptospira interrogans serovar lai str. 56601
agagugaccguugugagaaaua

SEQ ID NO: 763093 - RNA, 14 nt, Leptospira interrogans serovar lai str. 56601
agauacaauuaaac

SEQ ID NO: 763094 - RNA, 12 nt, Leptospira interrogans serovar lai str. 56601
agauaauuuuua

SEQ ID NO: 763095 - RNA, 11 nt, Leptospira interrogans serovar lai str. 56601
agauaaaaaag

SEQ ID NO: 763096 - RNA, 21 nt, Leptospira interrogans serovar lai str. 56601
agagucuauaaaauaucuuua

SEQ ID NO: 763097 - RNA, 16 nt, Leptospira interrogans serovar lai str. 56601
agagucauuuuuaaau

SEQ ID NO: 763098 - RNA, 19 nt, Leptospira interrogans serovar lai str. 56601
agagucauuuuuaaauacu

SEQ ID NO: 763099 - RNA, 18 nt, Leptospira interrogans serovar lai str. 56601
agagucaaaucaauuuua

SEQ ID NO: 763100 - RNA, 14 nt, Leptospira interrogans serovar lai str. 56601
agagucaaaaguuu

SEQ ID NO: 763101 - RNA, 17 nt, Leptospira interrogans serovar lai str. 56601
agaggugaaauuuccac

SEQ ID NO: 763102 - RNA, 23 nt, Leptospira interrogans serovar lai str. 56601
agaggucgucucaaaaauauugu

SEQ ID NO: 763103 - RNA, 13 nt, Leptospira interrogans serovar lai str. 56601
agagcugcuugaa

SEQ ID NO: 763104 - RNA, 23 nt, Leptospira interrogans serovar lai str. 56601
agagggucuuucgagauuaaaau

SEQ ID NO: 763105 - RNA, 19 nt, Leptospira interrogans serovar lai str. 56601
agagcuuuacaauaaaaau

SEQ ID NO: 763106 - RNA, 23 nt, Leptospira interrogans serovar lai str. 56601
agagcuuuacaauaaaaauuaga

SEQ ID NO: 763107 - RNA, 18 nt, Leptospira interrogans serovar lai str. 56601
agagcgauauaauaaaau

SEQ ID NO: 763108 - RNA, 20 nt, Leptospira interrogans serovar lai str. 56601
agacucacaccuucuuuuuu

SEQ ID NO: 763109 - RNA, 20 nt, Leptospira interrogans serovar lai str. 56601
agagauauagaaauuuucaa

SEQ ID NO: 763110 - RNA, 22 nt, Leptospira interrogans serovar lai str. 56601
agagaucauuaaugcgaaaauu

SEQ ID NO: 763111 - RNA, 18 nt, Leptospira interrogans serovar lai str. 56601
agagaugugaguuuuaaa

SEQ ID NO: 763112 - RNA, 15 nt, Leptospira interrogans serovar lai str. 56601
acuuauaauaaaauc

SEQ ID NO: 763113 - RNA, 14 nt, Leptospira interrogans serovar lai str. 56601
acuuagucuuuguu

SEQ ID NO: 763114 - RNA, 16 nt, Leptospira interrogans serovar lai str. 56601
acuuauaauuuucuua

SEQ ID NO: 763115 - RNA, 16 nt, Leptospira interrogans serovar lai str. 56601
acuuauaaagaauuuu

SEQ ID NO: 763116 - RNA, 18 nt, Leptospira interrogans serovar lai str. 56601
acuuaucacgaaaauuaa

SEQ ID NO: 763117 - RNA, 22 nt, Leptospira interrogans serovar lai str. 56601
acuuaucacgaaaauuaaaaaa

SEQ ID NO: 763118 - RNA, 18 nt, Leptospira interrogans serovar lai str. 56601
acuuaugagaguucccac

SEQ ID NO: 763119 - RNA, 13 nt, Leptospira interrogans serovar lai str. 56601
acuucagccgcuu

SEQ ID NO: 763120 - RNA, 20 nt, Leptospira interrogans serovar lai str. 56601
acuuccauuggauucugcuc

SEQ ID NO: 763121 - RNA, 19 nt, Leptospira interrogans serovar lai str. 56601
acuuccauuuuuugauuug

SEQ ID NO: 763122 - RNA, 22 nt, Leptospira interrogans serovar lai str. 56601
acuucccagacguaucaaaaua

SEQ ID NO: 763123 - RNA, 18 nt, Leptospira interrogans serovar lai str. 56601
acuuagcagaacgcucuc

SEQ ID NO: 763124 - RNA, 11 nt, Leptospira interrogans serovar lai str. 56601
acuuaaucuca

SEQ ID NO: 763125 - RNA, 16 nt, Leptospira interrogans serovar lai str. 56601
acuuaaucugugggaa

SEQ ID NO: 763126 - RNA, 23 nt, Leptospira interrogans serovar lai str. 56601
acuuagguuuguacguaaaaaug

SEQ ID NO: 763127 - RNA, 22 nt, Leptospira interrogans serovar lai str. 56601
acuuaggauaaaacggauuucu

SEQ ID NO: 763128 - RNA, 13 nt, Leptospira interrogans serovar lai str. 56601
acuuaaaaacccc

SEQ ID NO: 763129 - RNA, 20 nt, Leptospira interrogans serovar lai str. 56601
acuguuuuugaaacauuucu

SEQ ID NO: 763130 - RNA, 14 nt, Leptospira interrogans serovar lai str. 56601
acuguugaaaaaau

SEQ ID NO: 763131 - RNA, 18 nt, Leptospira interrogans serovar lai str. 56601
acuuaaaagaagauuuuu

SEQ ID NO: 763132 - RNA, 20 nt, Leptospira interrogans serovar lai str. 56601
acuuaaaagaagauuuuucu

SEQ ID NO: 763133 - RNA, 21 nt, Leptospira interrogans serovar lai str. 56601
acuuaaaagaagauuuuucuu

SEQ ID NO: 763134 - RNA, 22 nt, Leptospira interrogans serovar lai str. 56601
acuuaaaagaagauuuuucuuu

SEQ ID NO: 763135 - RNA, 12 nt, Leptospira interrogans serovar lai str. 56601
acuuaaaaucua

SEQ ID NO: 763136 - RNA, 13 nt, Leptospira interrogans serovar lai str. 56601
acuuaaaaugaga

SEQ ID NO: 763137 - RNA, 16 nt, Leptospira interrogans serovar lai str. 56601
acuguuaguuugcaau

SEQ ID NO: 763138 - RNA, 21 nt, Leptospira interrogans serovar lai str. 56601
acuguguuucuaauuuucuug

SEQ ID NO: 763139 - RNA, 12 nt, Leptospira interrogans serovar lai str. 56601
acuguguucuuu

SEQ ID NO: 763140 - RNA, 14 nt, Leptospira interrogans serovar lai str. 56601
acuguaaaauuuaa

SEQ ID NO: 763141 - RNA, 15 nt, Leptospira interrogans serovar lai str. 56601
acuguaaaauuuaaa

SEQ ID NO: 763142 - RNA, 18 nt, Leptospira interrogans serovar lai str. 56601
acuguaaacuugauuaaa

SEQ ID NO: 763143 - RNA, 21 nt, Leptospira interrogans serovar lai str. 56601
acuggauucaaaauuggauga

SEQ ID NO: 763144 - RNA, 20 nt, Leptospira interrogans serovar lai str. 56601
acuggaauauucuuuuuaga

SEQ ID NO: 763145 - RNA, 12 nt, Leptospira interrogans serovar lai str. 56601
acugcuauaauu

SEQ ID NO: 763146 - RNA, 18 nt, Leptospira interrogans serovar lai str. 56601
acugcucgaaaguucaca

SEQ ID NO: 763147 - RNA, 18 nt, Leptospira interrogans serovar lai str. 56601
acugcauuuuauuaaaaa

SEQ ID NO: 763148 - RNA, 18 nt, Leptospira interrogans serovar lai str. 56601
acugcauuuuauuaaaga

SEQ ID NO: 763149 - RNA, 21 nt, Leptospira interrogans serovar lai str. 56601
acugauuuucaugaauuaaag

SEQ ID NO: 763150 - RNA, 17 nt, Leptospira interrogans serovar lai str. 56601
acugauuuaauuauuua

SEQ ID NO: 763151 - RNA, 15 nt, Leptospira interrogans serovar lai str. 56601
acugauucuuuaaau

SEQ ID NO: 763152 - RNA, 12 nt, Leptospira interrogans serovar lai str. 56601
acugaaaauuua

SEQ ID NO: 763153 - RNA, 15 nt, Leptospira interrogans serovar lai str. 56601
acugaaaauuuaauu

SEQ ID NO: 763154 - RNA, 19 nt, Leptospira interrogans serovar lai str. 56601
acugaaaaugaccaaaauu

SEQ ID NO: 763155 - RNA, 12 nt, Leptospira interrogans serovar lai str. 56601
acugaaaccauc

SEQ ID NO: 763156 - RNA, 16 nt, Leptospira interrogans serovar lai str. 56601
acugaguuucaaacac

SEQ ID NO: 763157 - RNA, 18 nt, Leptospira interrogans serovar lai str. 56601
acugagucaacaaauauu

SEQ ID NO: 763158 - RNA, 19 nt, Leptospira interrogans serovar lai str. 56601
acucuuaaauuucggacuu

SEQ ID NO: 763159 - RNA, 22 nt, Leptospira interrogans serovar lai str. 56601
acucuguucaguguaagauuaa

SEQ ID NO: 763160 - RNA, 21 nt, Leptospira interrogans serovar lai str. 56601
acucuguaaauucaaagcaag

SEQ ID NO: 763161 - RNA, 13 nt, Leptospira interrogans serovar lai str. 56601
acucuuuuucuuc

SEQ ID NO: 763162 - RNA, 18 nt, Leptospira interrogans serovar lai str. 56601
acucugcaaaauuuaaaa

SEQ ID NO: 763163 - RNA, 17 nt, Leptospira interrogans serovar lai str. 56601
acucuauagauugauuu

SEQ ID NO: 763164 - RNA, 20 nt, Leptospira interrogans serovar lai str. 56601
acucuauagauugauuuaaa

SEQ ID NO: 763165 - RNA, 22 nt, Leptospira interrogans serovar lai str. 56601
acucuaucacgaaauuugugga

SEQ ID NO: 763166 - RNA, 17 nt, Leptospira interrogans serovar lai str. 56601
acucuaguaaagaaacu

SEQ ID NO: 763167 - RNA, 17 nt, Leptospira interrogans serovar lai str. 56601
acucuaagcuauuuuug

SEQ ID NO: 763168 - RNA, 23 nt, Leptospira interrogans serovar lai str. 56601
acucuaagcuuuagaaaauaaua

SEQ ID NO: 763169 - RNA, 14 nt, Leptospira interrogans serovar lai str. 56601
acucggaaauuuau

SEQ ID NO: 763170 - RNA, 21 nt, Leptospira interrogans serovar lai str. 56601
acucgaacuucguuggaaagu

SEQ ID NO: 763171 - RNA, 23 nt, Leptospira interrogans serovar lai str. 56601
acucaauccgaauaguuuacaua

SEQ ID NO: 763172 - RNA, 17 nt, Leptospira interrogans serovar lai str. 56601
acucaacgauaagaaua

SEQ ID NO: 763173 - RNA, 18 nt, Leptospira interrogans serovar lai str. 56601
acucaaugcaucucuucu

SEQ ID NO: 763174 - RNA, 15 nt, Leptospira interrogans serovar lai str. 56601
acuaaugcaaguucu

SEQ ID NO: 763175 - RNA, 16 nt, Leptospira interrogans serovar lai str. 56601
acuaaacgauuuuaua

SEQ ID NO: 763176 - RNA, 19 nt, Leptospira interrogans serovar lai str. 56601
acuacauuugauuaaaaau

SEQ ID NO: 763177 - RNA, 17 nt, Leptospira interrogans serovar lai str. 56601
acuacaucgucuucuuu

SEQ ID NO: 763178 - RNA, 18 nt, Leptospira interrogans serovar lai str. 56601
acuacaucgucuucuuuu

SEQ ID NO: 763179 - RNA, 20 nt, Leptospira interrogans serovar lai str. 56601
acuacaucuaaugauuucuu

SEQ ID NO: 763180 - RNA, 21 nt, Leptospira interrogans serovar lai str. 56601
acuacaucuaaugauuucuug

SEQ ID NO: 763181 - RNA, 13 nt, Leptospira interrogans serovar lai str. 56601
acuaccaaagcuu

SEQ ID NO: 763182 - RNA, 19 nt, Leptospira interrogans serovar lai str. 56601
acuaauuuaucgauuuaaa

SEQ ID NO: 763183 - RNA, 19 nt, Leptospira interrogans serovar lai str. 56601
acuaauucuuuugcauagu

SEQ ID NO: 763184 - RNA, 18 nt, Leptospira interrogans serovar lai str. 56601
acuacuuuuagaaaaaau

SEQ ID NO: 763185 - RNA, 14 nt, Leptospira interrogans serovar lai str. 56601
acuaccacaaaacu

SEQ ID NO: 763186 - RNA, 13 nt, Leptospira interrogans serovar lai str. 56601
acuaccuuauaaa

SEQ ID NO: 763187 - RNA, 20 nt, Leptospira interrogans serovar lai str. 56601
acuauucuacagauaaaaau

SEQ ID NO: 763188 - RNA, 14 nt, Leptospira interrogans serovar lai str. 56601
acuauuuuauuaca

SEQ ID NO: 763189 - RNA, 21 nt, Leptospira interrogans serovar lai str. 56601
acuauuuuauuacaauuuuau

SEQ ID NO: 763190 - RNA, 13 nt, Leptospira interrogans serovar lai str. 56601
acuauuucuucca

SEQ ID NO: 763191 - RNA, 20 nt, Leptospira interrogans serovar lai str. 56601
acuauuuugaugaaugaaua

SEQ ID NO: 763192 - RNA, 18 nt, Leptospira interrogans serovar lai str. 56601
acuauaacuuuaaaaaau

SEQ ID NO: 763193 - RNA, 22 nt, Leptospira interrogans serovar lai str. 56601
acuauaacuuuaaaaaauaaga

SEQ ID NO: 763194 - RNA, 22 nt, Leptospira interrogans serovar lai str. 56601
acuauaaauuacugauuucaaa

SEQ ID NO: 763195 - RNA, 21 nt, Leptospira interrogans serovar lai str. 56601
acuaucacaaaaaugaaaaaa

SEQ ID NO: 763196 - RNA, 22 nt, Leptospira interrogans serovar lai str. 56601
acuaucacaaaaaugaaaaaac

SEQ ID NO: 763197 - RNA, 14 nt, Leptospira interrogans serovar lai str. 56601
acuauaauaacaaa

SEQ ID NO: 763198 - RNA, 12 nt, Leptospira interrogans serovar lai str. 56601
acuauauuuuug

SEQ ID NO: 763199 - RNA, 17 nt, Leptospira interrogans serovar lai str. 56601
acuauauuuuugugaaa

SEQ ID NO: 763200 - RNA, 17 nt, Leptospira interrogans serovar lai str. 56601
acuauuacuuuuuaaac

SEQ ID NO: 763201 - RNA, 16 nt, Leptospira interrogans serovar lai str. 56601
acuauuacaaaaucug

SEQ ID NO: 763202 - RNA, 21 nt, Leptospira interrogans serovar lai str. 56601
acuauuaaauugaguuuucca

SEQ ID NO: 763203 - RNA, 13 nt, Leptospira interrogans serovar lai str. 56601
acuauggaauuuu

SEQ ID NO: 763204 - RNA, 15 nt, Leptospira interrogans serovar lai str. 56601
acuauggaauuuuuu

SEQ ID NO: 763205 - RNA, 14 nt, Leptospira interrogans serovar lai str. 56601
acguucaacaaaca

SEQ ID NO: 763206 - RNA, 20 nt, Leptospira interrogans serovar lai str. 56601
acguucaacaaacaaauaga

SEQ ID NO: 763207 - RNA, 16 nt, Leptospira interrogans serovar lai str. 56601
acguuuauuucaaaau

SEQ ID NO: 763208 - RNA, 18 nt, Leptospira interrogans serovar lai str. 56601
acguuuugcuaaaagucu

SEQ ID NO: 763209 - RNA, 19 nt, Leptospira interrogans serovar lai str. 56601
acguuuugaccugccuuuc

SEQ ID NO: 763210 - RNA, 11 nt, Leptospira interrogans serovar lai str. 56601
acguuuuaaag

SEQ ID NO: 763211 - RNA, 22 nt, Leptospira interrogans serovar lai str. 56601
acguuuuaaucaugugaauuca

SEQ ID NO: 763212 - RNA, 12 nt, Leptospira interrogans serovar lai str. 56601
acuaaaaauuca

SEQ ID NO: 763213 - RNA, 13 nt, Leptospira interrogans serovar lai str. 56601
acuaaaaauucau

SEQ ID NO: 763214 - RNA, 9 nt, Leptospira interrogans serovar lai str. 56601
acuaaaaaa

SEQ ID NO: 763215 - RNA, 10 nt, Leptospira interrogans serovar lai str. 56601
acuaaaaaac

SEQ ID NO: 763216 - RNA, 18 nt, Leptospira interrogans serovar lai str. 56601
acuaaaaaacauaaaaau

SEQ ID NO: 763217 - RNA, 13 nt, Leptospira interrogans serovar lai str. 56601
acuaaaauuaaaa

SEQ ID NO: 763218 - RNA, 14 nt, Leptospira interrogans serovar lai str. 56601
acuaaaauuaaaaa

SEQ ID NO: 763219 - RNA, 18 nt, Leptospira interrogans serovar lai str. 56601
acuaaaauuuuauaaaaa

SEQ ID NO: 763220 - RNA, 16 nt, Leptospira interrogans serovar lai str. 56601
acgucuacagauaaac

SEQ ID NO: 763221 - RNA, 16 nt, Leptospira interrogans serovar lai str. 56601
acguaaucugugggaa

SEQ ID NO: 763222 - RNA, 19 nt, Leptospira interrogans serovar lai str. 56601
acgucccguauaaaagugu

SEQ ID NO: 763223 - RNA, 15 nt, Leptospira interrogans serovar lai str. 56601
acguaccaaaaccca

SEQ ID NO: 763224 - RNA, 18 nt, Leptospira interrogans serovar lai str. 56601
acguaaaggaauccauga

SEQ ID NO: 763225 - RNA, 21 nt, Leptospira interrogans serovar lai str. 56601
acguaaauaaaugggccccac

SEQ ID NO: 763226 - RNA, 19 nt, Leptospira interrogans serovar lai str. 56601
acgguuuucuaauuuauga

SEQ ID NO: 763227 - RNA, 23 nt, Leptospira interrogans serovar lai str. 56601
acgguuuuaguaaaauuuaaauu

SEQ ID NO: 763228 - RNA, 13 nt, Leptospira interrogans serovar lai str. 56601
acgguauaaaaag

SEQ ID NO: 763229 - RNA, 16 nt, Leptospira interrogans serovar lai str. 56601
acgguaauauauucaa

SEQ ID NO: 763230 - RNA, 16 nt, Leptospira interrogans serovar lai str. 56601
acgguaaaaucuuuaa

SEQ ID NO: 763231 - RNA, 18 nt, Leptospira interrogans serovar lai str. 56601
acgguaaaaucuuuaagu

SEQ ID NO: 763232 - RNA, 20 nt, Leptospira interrogans serovar lai str. 56601
acgguaaaaucuuuaaguuu

SEQ ID NO: 763233 - RNA, 15 nt, Leptospira interrogans serovar lai str. 56601
acggcaaugugcaaa

SEQ ID NO: 763234 - RNA, 15 nt, Leptospira interrogans serovar lai str. 56601
acggcauuuuuuaaa

SEQ ID NO: 763235 - RNA, 19 nt, Leptospira interrogans serovar lai str. 56601
acggauugccuaaauuccu

SEQ ID NO: 763236 - RNA, 17 nt, Leptospira interrogans serovar lai str. 56601
acggauuccuccagugc

SEQ ID NO: 763237 - RNA, 12 nt, Leptospira interrogans serovar lai str. 56601
acgcuuaaaaau

SEQ ID NO: 763238 - RNA, 12 nt, Leptospira interrogans serovar lai str. 56601
acggaaauguua

SEQ ID NO: 763239 - RNA, 20 nt, Leptospira interrogans serovar lai str. 56601
acggaaaauaccgcacuuuu

SEQ ID NO: 763240 - RNA, 14 nt, Leptospira interrogans serovar lai str. 56601
acggaaggaaaaaa

SEQ ID NO: 763241 - RNA, 17 nt, Leptospira interrogans serovar lai str. 56601
acggaacuuaauuuuau

SEQ ID NO: 763242 - RNA, 16 nt, Leptospira interrogans serovar lai str. 56601
acggaaucggcuugcu

SEQ ID NO: 763243 - RNA, 16 nt, Leptospira interrogans serovar lai str. 56601
aggaauuuuuaaaaag

SEQ ID NO: 763244 - RNA, 19 nt, Leptospira interrogans serovar lai str. 56601
aggaauuuuuaaaaagaau

SEQ ID NO: 763245 - RNA, 22 nt, Leptospira interrogans serovar lai str. 56601
aggaauuuccgauaaagaaagu

SEQ ID NO: 763246 - RNA, 15 nt, Leptospira interrogans serovar lai str. 56601
aggaauuuuuuaaac

SEQ ID NO: 763247 - RNA, 20 nt, Leptospira interrogans serovar lai str. 56601
aggaauucauacuuuuaaaa

SEQ ID NO: 763248 - RNA, 23 nt, Leptospira interrogans serovar lai str. 56601
aggaauagucaaugguugcaaaa

SEQ ID NO: 763249 - RNA, 14 nt, Leptospira interrogans serovar lai str. 56601
aggaagucuauuca

SEQ ID NO: 763250 - RNA, 17 nt, Leptospira interrogans serovar lai str. 56601
aggaaggaguaucaaua

SEQ ID NO: 763251 - RNA, 19 nt, Leptospira interrogans serovar lai str. 56601
aggaaauucuuuuccaaaa

SEQ ID NO: 763252 - RNA, 13 nt, Leptospira interrogans serovar lai str. 56601
aggaaauuuuguu

SEQ ID NO: 763253 - RNA, 13 nt, Leptospira interrogans serovar lai str. 56601
aggaacacaugau

SEQ ID NO: 763254 - RNA, 13 nt, Leptospira interrogans serovar lai str. 56601
aggaacuacuacu

SEQ ID NO: 763255 - RNA, 17 nt, Leptospira interrogans serovar lai str. 56601
aggaacugcuuccaaaa

SEQ ID NO: 763256 - RNA, 22 nt, Leptospira interrogans serovar lai str. 56601
aggaaauaaaaauauacaauaa

SEQ ID NO: 763257 - RNA, 20 nt, Leptospira interrogans serovar lai str. 56601
aggaaauaauuccuccauga

SEQ ID NO: 763258 - RNA, 22 nt, Leptospira interrogans serovar lai str. 56601
aggaaacgaguguuucaugucc

SEQ ID NO: 763259 - RNA, 18 nt, Leptospira interrogans serovar lai str. 56601
aggaaaauuuaacaacau

SEQ ID NO: 763260 - RNA, 17 nt, Leptospira interrogans serovar lai str. 56601
agcuuuuuuagaaaaag

SEQ ID NO: 763261 - RNA, 20 nt, Leptospira interrogans serovar lai str. 56601
aggauccaauacaaaacaag

SEQ ID NO: 763262 - RNA, 15 nt, Leptospira interrogans serovar lai str. 56601
aggauauuugauaua

SEQ ID NO: 763263 - RNA, 14 nt, Leptospira interrogans serovar lai str. 56601
aggauaaacuguaa

SEQ ID NO: 763264 - RNA, 17 nt, Leptospira interrogans serovar lai str. 56601
aggaggauuagaagaau

SEQ ID NO: 763265 - RNA, 19 nt, Leptospira interrogans serovar lai str. 56601
aggaguccaugauucugaa

SEQ ID NO: 763266 - RNA, 15 nt, Leptospira interrogans serovar lai str. 56601
aggagguggaaaagu

SEQ ID NO: 763267 - RNA, 20 nt, Leptospira interrogans serovar lai str. 56601
aggagaaggauaaagucuau

SEQ ID NO: 763268 - RNA, 17 nt, Leptospira interrogans serovar lai str. 56601
aggaccugcuuugguuu

SEQ ID NO: 763269 - RNA, 19 nt, Leptospira interrogans serovar lai str. 56601
aggaccugcuuugguuuuc

SEQ ID NO: 763270 - RNA, 19 nt, Leptospira interrogans serovar lai str. 56601
aggaccgcagacuguauca

SEQ ID NO: 763271 - RNA, 15 nt, Leptospira interrogans serovar lai str. 56601
aggcaucauucuuua

SEQ ID NO: 763272 - RNA, 17 nt, Leptospira interrogans serovar lai str. 56601
aggcccgaauuuuaaau

SEQ ID NO: 763273 - RNA, 14 nt, Leptospira interrogans serovar lai str. 56601
aggcacauuuuuca

SEQ ID NO: 763274 - RNA, 15 nt, Leptospira interrogans serovar lai str. 56601
aggcacauuuuucaa

SEQ ID NO: 763275 - RNA, 21 nt, Leptospira interrogans serovar lai str. 56601
aggcaauuuagaauaaagaga

SEQ ID NO: 763276 - RNA, 22 nt, Leptospira interrogans serovar lai str. 56601
aggcaauuuagaauaaagagaa

SEQ ID NO: 763277 - RNA, 23 nt, Leptospira interrogans serovar lai str. 56601
aggcaauuuagaauaaagagaag

SEQ ID NO: 763278 - RNA, 13 nt, Leptospira interrogans serovar lai str. 56601
aggcaauuuucuc

SEQ ID NO: 763279 - RNA, 19 nt, Leptospira interrogans serovar lai str. 56601
aggauuuuuggaauaaaau

SEQ ID NO: 763280 - RNA, 19 nt, Leptospira interrogans serovar lai str. 56601
aggauuuuagaaugagaag

SEQ ID NO: 763281 - RNA, 12 nt, Leptospira interrogans serovar lai str. 56601
aggauuuuauga

SEQ ID NO: 763282 - RNA, 15 nt, Leptospira interrogans serovar lai str. 56601
aggauuggcauucaa

SEQ ID NO: 763283 - RNA, 21 nt, Leptospira interrogans serovar lai str. 56601
aggauuccauugauuuucauu

SEQ ID NO: 763284 - RNA, 22 nt, Leptospira interrogans serovar lai str. 56601
aggauuccauugauuuucauuu

SEQ ID NO: 763285 - RNA, 16 nt, Leptospira interrogans serovar lai str. 56601
aggauuccauuucauu

SEQ ID NO: 763286 - RNA, 17 nt, Leptospira interrogans serovar lai str. 56601
aggaugaauccggggac

SEQ ID NO: 763287 - RNA, 20 nt, Leptospira interrogans serovar lai str. 56601
aggaugaauugcuaaaaaag

SEQ ID NO: 763288 - RNA, 21 nt, Leptospira interrogans serovar lai str. 56601
aggaucuccuugaaucaaaua

SEQ ID NO: 763289 - RNA, 22 nt, Leptospira interrogans serovar lai str. 56601
agcuuguuucaaaaguuagaau

SEQ ID NO: 763290 - RNA, 23 nt, Leptospira interrogans serovar lai str. 56601
agcuuuagaaaauaauaauauuu

SEQ ID NO: 763291 - RNA, 20 nt, Leptospira interrogans serovar lai str. 56601
agcuuuuaguuguacaaaaa

SEQ ID NO: 763292 - RNA, 21 nt, Leptospira interrogans serovar lai str. 56601
agcuuauacuuuaagaaaauu

SEQ ID NO: 763293 - RNA, 14 nt, Leptospira interrogans serovar lai str. 56601
agcuuaaaagugau

SEQ ID NO: 763294 - RNA, 12 nt, Leptospira interrogans serovar lai str. 56601
agcuuccuuuuu

SEQ ID NO: 763295 - RNA, 20 nt, Leptospira interrogans serovar lai str. 56601
agcuguucuuagucuaaaaa

SEQ ID NO: 763296 - RNA, 20 nt, Leptospira interrogans serovar lai str. 56601
agcuggaugaagcuaugaag

SEQ ID NO: 763297 - RNA, 22 nt, Leptospira interrogans serovar lai str. 56601
agcucauaaucaauuaaccuga

SEQ ID NO: 763298 - RNA, 20 nt, Leptospira interrogans serovar lai str. 56601
agcucagauuccaacuuuuu

SEQ ID NO: 763299 - RNA, 13 nt, Leptospira interrogans serovar lai str. 56601
agcucagcaaagc

SEQ ID NO: 763300 - RNA, 15 nt, Leptospira interrogans serovar lai str. 56601
agcucacguugaagu

SEQ ID NO: 763301 - RNA, 14 nt, Leptospira interrogans serovar lai str. 56601
agcucuagucaagu

SEQ ID NO: 763302 - RNA, 15 nt, Leptospira interrogans serovar lai str. 56601
agcucuccaucuuuu

SEQ ID NO: 763303 - RNA, 14 nt, Leptospira interrogans serovar lai str. 56601
agcucaucauucug

SEQ ID NO: 763304 - RNA, 14 nt, Leptospira interrogans serovar lai str. 56601
agcugaacuuaaaa

SEQ ID NO: 763305 - RNA, 13 nt, Leptospira interrogans serovar lai str. 56601
agcucuuuugcuu

SEQ ID NO: 763306 - RNA, 18 nt, Leptospira interrogans serovar lai str. 56601
agcgucucacuccccaug

SEQ ID NO: 763307 - RNA, 23 nt, Leptospira interrogans serovar lai str. 56601
agcuaugaagagguacagaaaca

SEQ ID NO: 763308 - RNA, 22 nt, Leptospira interrogans serovar lai str. 56601
agcuauuuuugagaugauuuau

SEQ ID NO: 763309 - RNA, 14 nt, Leptospira interrogans serovar lai str. 56601
agcuauuuucagaa

SEQ ID NO: 763310 - RNA, 20 nt, Leptospira interrogans serovar lai str. 56601
agcuauuuucagaaaaauga

SEQ ID NO: 763311 - RNA, 16 nt, Leptospira interrogans serovar lai str. 56601
agcuaagcauaaaauu

SEQ ID NO: 763312 - RNA, 20 nt, Leptospira interrogans serovar lai str. 56601
agcuaagcauaaaauucuaa

SEQ ID NO: 763313 - RNA, 23 nt, Leptospira interrogans serovar lai str. 56601
agcuaagucuuuaaaaauaggaa

SEQ ID NO: 763314 - RNA, 12 nt, Leptospira interrogans serovar lai str. 56601
agggaguuccua

SEQ ID NO: 763315 - RNA, 16 nt, Leptospira interrogans serovar lai str. 56601
agggaaaguuauuucu

SEQ ID NO: 763316 - RNA, 15 nt, Leptospira interrogans serovar lai str. 56601
agggaaaaaagcaua

SEQ ID NO: 763317 - RNA, 21 nt, Leptospira interrogans serovar lai str. 56601
aggcuuuguaauaaaaauuua

SEQ ID NO: 763318 - RNA, 23 nt, Leptospira interrogans serovar lai str. 56601
agggaagguuuuguaaaaauucu

SEQ ID NO: 763319 - RNA, 16 nt, Leptospira interrogans serovar lai str. 56601
aggcuuuacauuuuua

SEQ ID NO: 763320 - RNA, 18 nt, Leptospira interrogans serovar lai str. 56601
aggcuuguuugaauuuuu

SEQ ID NO: 763321 - RNA, 23 nt, Leptospira interrogans serovar lai str. 56601
aggcugccgcucuuucuuccgga

SEQ ID NO: 763322 - RNA, 17 nt, Leptospira interrogans serovar lai str. 56601
agggcucgguaaaaaga

SEQ ID NO: 763323 - RNA, 22 nt, Leptospira interrogans serovar lai str. 56601
agggccgucuauaaaauucaaa

SEQ ID NO: 763324 - RNA, 21 nt, Leptospira interrogans serovar lai str. 56601
aggcucgaauuuuuuucagua

SEQ ID NO: 763325 - RNA, 20 nt, Leptospira interrogans serovar lai str. 56601
aguaaauggauaaauuuuag

SEQ ID NO: 763326 - RNA, 21 nt, Leptospira interrogans serovar lai str. 56601
aguaaauggauaaauuuuaga

SEQ ID NO: 763327 - RNA, 22 nt, Leptospira interrogans serovar lai str. 56601
aguaacagaaaaauguuaaaaa

SEQ ID NO: 763328 - RNA, 14 nt, Leptospira interrogans serovar lai str. 56601
aguaacgaguagaa

SEQ ID NO: 763329 - RNA, 19 nt, Leptospira interrogans serovar lai str. 56601
aguaagcccccgaagaauu

SEQ ID NO: 763330 - RNA, 16 nt, Leptospira interrogans serovar lai str. 56601
aguaaggauucuuuuc

SEQ ID NO: 763331 - RNA, 17 nt, Leptospira interrogans serovar lai str. 56601
aguaaggauucuuuucc

SEQ ID NO: 763332 - RNA, 14 nt, Leptospira interrogans serovar lai str. 56601
aguaaggcaaacuu

SEQ ID NO: 763333 - RNA, 23 nt, Leptospira interrogans serovar lai str. 56601
aguaaggcaaacuuuuuuagcaa

SEQ ID NO: 763334 - RNA, 14 nt, Leptospira interrogans serovar lai str. 56601
aguaagaaacauca

SEQ ID NO: 763335 - RNA, 15 nt, Leptospira interrogans serovar lai str. 56601
aguaagaaacaucaa

SEQ ID NO: 763336 - RNA, 16 nt, Leptospira interrogans serovar lai str. 56601
aguaagauauuaacaa

SEQ ID NO: 763337 - RNA, 14 nt, Leptospira interrogans serovar lai str. 56601
aguaaguucaaauu

SEQ ID NO: 763338 - RNA, 12 nt, Leptospira interrogans serovar lai str. 56601
aguaauuuaaaa

SEQ ID NO: 763339 - RNA, 21 nt, Leptospira interrogans serovar lai str. 56601
aguaauuuaauauauuaaaau

SEQ ID NO: 763340 - RNA, 12 nt, Leptospira interrogans serovar lai str. 56601
aguaauucuaaa

SEQ ID NO: 763341 - RNA, 18 nt, Leptospira interrogans serovar lai str. 56601
aguaauucuaaguaauuu

SEQ ID NO: 763342 - RNA, 22 nt, Leptospira interrogans serovar lai str. 56601
aguaauucuaaguaauuuaaaa

SEQ ID NO: 763343 - RNA, 20 nt, Leptospira interrogans serovar lai str. 56601
aguaauuuucgaauucuuuc

SEQ ID NO: 763344 - RNA, 12 nt, Leptospira interrogans serovar lai str. 56601
aguaauuuugaa

SEQ ID NO: 763345 - RNA, 20 nt, Leptospira interrogans serovar lai str. 56601
aguaaugccuacaaaucaaa

SEQ ID NO: 763346 - RNA, 23 nt, Leptospira interrogans serovar lai str. 56601
aguaauuacccuaaagcuauuuu

SEQ ID NO: 763347 - RNA, 19 nt, Leptospira interrogans serovar lai str. 56601
aguaaucuuuuuaaaaguu

SEQ ID NO: 763348 - RNA, 20 nt, Leptospira interrogans serovar lai str. 56601
aguaauauuucucucaaauu

SEQ ID NO: 763349 - RNA, 13 nt, Leptospira interrogans serovar lai str. 56601
aguacaauucaaa

SEQ ID NO: 763350 - RNA, 15 nt, Leptospira interrogans serovar lai str. 56601
aguacaagaaucaaa

SEQ ID NO: 763351 - RNA, 16 nt, Leptospira interrogans serovar lai str. 56601
aguaccaaguuauuaa

SEQ ID NO: 763352 - RNA, 17 nt, Leptospira interrogans serovar lai str. 56601
agguuaaaaauuuaauu

SEQ ID NO: 763353 - RNA, 17 nt, Leptospira interrogans serovar lai str. 56601
agguguuuauaaaaacc

SEQ ID NO: 763354 - RNA, 19 nt, Leptospira interrogans serovar lai str. 56601
agguucaaaaaaauuaaac

SEQ ID NO: 763355 - RNA, 16 nt, Leptospira interrogans serovar lai str. 56601
agguucuuagaacuua

SEQ ID NO: 763356 - RNA, 18 nt, Leptospira interrogans serovar lai str. 56601
agguucuugcaaaaauag

SEQ ID NO: 763357 - RNA, 20 nt, Leptospira interrogans serovar lai str. 56601
agguucgaacguauaaaaac

SEQ ID NO: 763358 - RNA, 16 nt, Leptospira interrogans serovar lai str. 56601
agguugaguaguaaaa

SEQ ID NO: 763359 - RNA, 19 nt, Leptospira interrogans serovar lai str. 56601
agguugaguaguaaaaucu

SEQ ID NO: 763360 - RNA, 16 nt, Leptospira interrogans serovar lai str. 56601
agguugaguucuuuua

SEQ ID NO: 763361 - RNA, 23 nt, Leptospira interrogans serovar lai str. 56601
aguaaagaacgauuuuuuacaaa

SEQ ID NO: 763362 - RNA, 13 nt, Leptospira interrogans serovar lai str. 56601
aguaaagaaacuc

SEQ ID NO: 763363 - RNA, 15 nt, Leptospira interrogans serovar lai str. 56601
aguaaacuacuaaau

SEQ ID NO: 763364 - RNA, 22 nt, Leptospira interrogans serovar lai str. 56601
aguaaacuacuaaaucucaauu

SEQ ID NO: 763365 - RNA, 14 nt, Leptospira interrogans serovar lai str. 56601
aguaaaagaaaauu

SEQ ID NO: 763366 - RNA, 15 nt, Leptospira interrogans serovar lai str. 56601
aguaaaagaaaauua

SEQ ID NO: 763367 - RNA, 18 nt, Leptospira interrogans serovar lai str. 56601
aguaaaacccaauaccaa

SEQ ID NO: 763368 - RNA, 18 nt, Leptospira interrogans serovar lai str. 56601
aguaaaacgcucucuacc

SEQ ID NO: 763369 - RNA, 18 nt, Leptospira interrogans serovar lai str. 56601
aguaaaaauggauacuua

SEQ ID NO: 763370 - RNA, 14 nt, Leptospira interrogans serovar lai str. 56601
aguaaaaaagcgaa

SEQ ID NO: 763371 - RNA, 23 nt, Leptospira interrogans serovar lai str. 56601
aguaaaaucuucaaguuugugag

SEQ ID NO: 763372 - RNA, 13 nt, Leptospira interrogans serovar lai str. 56601
aguaaaauuuaaa

SEQ ID NO: 763373 - RNA, 15 nt, Leptospira interrogans serovar lai str. 56601
aguaaaauuuaaauu

SEQ ID NO: 763374 - RNA, 20 nt, Leptospira interrogans serovar lai str. 56601
aguaaaauuuaaauuuauaa

SEQ ID NO: 763375 - RNA, 20 nt, Leptospira interrogans serovar lai str. 56601
agguuguaacucaaaauuuc

SEQ ID NO: 763376 - RNA, 14 nt, Leptospira interrogans serovar lai str. 56601
aggugcaaauuacg

SEQ ID NO: 763377 - RNA, 12 nt, Leptospira interrogans serovar lai str. 56601
aggugauuaaac

SEQ ID NO: 763378 - RNA, 21 nt, Leptospira interrogans serovar lai str. 56601
aggugauuaaaccgguaaaaa

SEQ ID NO: 763379 - RNA, 13 nt, Leptospira interrogans serovar lai str. 56601
aggucauuuuuca

SEQ ID NO: 763380 - RNA, 13 nt, Leptospira interrogans serovar lai str. 56601
aggucccacaauc

SEQ ID NO: 763381 - RNA, 16 nt, Leptospira interrogans serovar lai str. 56601
aggugaaauuuccacu

SEQ ID NO: 763382 - RNA, 21 nt, Leptospira interrogans serovar lai str. 56601
agguaacuaccgcaaaucaca

SEQ ID NO: 763383 - RNA, 21 nt, Leptospira interrogans serovar lai str. 56601
agguaaaagagacauugaaga

SEQ ID NO: 763384 - RNA, 16 nt, Leptospira interrogans serovar lai str. 56601
aggguuuuuacaauua

SEQ ID NO: 763385 - RNA, 15 nt, Leptospira interrogans serovar lai str. 56601
agguacagaaacaaa

SEQ ID NO: 763386 - RNA, 13 nt, Leptospira interrogans serovar lai str. 56601
agguaauuuagga

SEQ ID NO: 763387 - RNA, 14 nt, Leptospira interrogans serovar lai str. 56601
agguaauuuaggaa

SEQ ID NO: 763388 - RNA, 15 nt, Leptospira interrogans serovar lai str. 56601
agguaauagaaaacu

SEQ ID NO: 763389 - RNA, 20 nt, Leptospira interrogans serovar lai str. 56601
agguauuuuagagaaacuuu

SEQ ID NO: 763390 - RNA, 18 nt, Leptospira interrogans serovar lai str. 56601
aggucacauuugauaauu

SEQ ID NO: 763391 - RNA, 21 nt, Leptospira interrogans serovar lai str. 56601
aucagaaaaacauacuuuuug

SEQ ID NO: 763392 - RNA, 17 nt, Leptospira interrogans serovar lai str. 56601
aucagaauagauucuua

SEQ ID NO: 763393 - RNA, 18 nt, Leptospira interrogans serovar lai str. 56601
aucagaauagauucuuaa

SEQ ID NO: 763394 - RNA, 18 nt, Leptospira interrogans serovar lai str. 56601
aucagaaugaacucaaca

SEQ ID NO: 763395 - RNA, 15 nt, Leptospira interrogans serovar lai str. 56601
aucagaauuaaaaau

SEQ ID NO: 763396 - RNA, 16 nt, Leptospira interrogans serovar lai str. 56601
aucagaauuaaaaauu

SEQ ID NO: 763397 - RNA, 19 nt, Leptospira interrogans serovar lai str. 56601
aucagaauuucuuucucuc

SEQ ID NO: 763398 - RNA, 18 nt, Leptospira interrogans serovar lai str. 56601
aucagauguuuuaaaagu

SEQ ID NO: 763399 - RNA, 18 nt, Leptospira interrogans serovar lai str. 56601
aucagaucuauuucuuaa

SEQ ID NO: 763400 - RNA, 19 nt, Leptospira interrogans serovar lai str. 56601
aucacgauuuuacaaacaa

SEQ ID NO: 763401 - RNA, 14 nt, Leptospira interrogans serovar lai str. 56601
aucacgaaaaauga

SEQ ID NO: 763402 - RNA, 15 nt, Leptospira interrogans serovar lai str. 56601
aucacgaaaaaugaa

SEQ ID NO: 763403 - RNA, 23 nt, Leptospira interrogans serovar lai str. 56601
aucacgaaaaaugaauguuuaaa

SEQ ID NO: 763404 - RNA, 21 nt, Leptospira interrogans serovar lai str. 56601
aucacauccaacccaaacaca

SEQ ID NO: 763405 - RNA, 16 nt, Leptospira interrogans serovar lai str. 56601
aucaccguaauucuua

SEQ ID NO: 763406 - RNA, 18 nt, Leptospira interrogans serovar lai str. 56601
aucaccguaauucuuaau

SEQ ID NO: 763407 - RNA, 21 nt, Leptospira interrogans serovar lai str. 56601
aucaauguugugauaaagagu

SEQ ID NO: 763408 - RNA, 24 nt, Leptospira interrogans serovar lai str. 56601
aucaauucacucuuaaauacuuaa

SEQ ID NO: 763409 - RNA, 23 nt, Leptospira interrogans serovar lai str. 56601
aucaauggaaaauuaauuuuuca

SEQ ID NO: 763410 - RNA, 13 nt, Leptospira interrogans serovar lai str. 56601
aucaauuuuagaa

SEQ ID NO: 763411 - RNA, 13 nt, Leptospira interrogans serovar lai str. 56601
aucaauuuuaaau

SEQ ID NO: 763412 - RNA, 22 nt, Leptospira interrogans serovar lai str. 56601
aucaauugacuuucuguauuuu

SEQ ID NO: 763413 - RNA, 14 nt, Leptospira interrogans serovar lai str. 56601
aucaauucugaaaa

SEQ ID NO: 763414 - RNA, 15 nt, Leptospira interrogans serovar lai str. 56601
aucacaaauuuuaaa

SEQ ID NO: 763415 - RNA, 23 nt, Leptospira interrogans serovar lai str. 56601
aucacaaggguuguuucaguaag

SEQ ID NO: 763416 - RNA, 18 nt, Leptospira interrogans serovar lai str. 56601
aucacaauuuuaagaaca

SEQ ID NO: 763417 - RNA, 20 nt, Leptospira interrogans serovar lai str. 56601
aucacaauuuuuuuagaauc

SEQ ID NO: 763418 - RNA, 19 nt, Leptospira interrogans serovar lai str. 56601
aucaacauuauguuaaacu

SEQ ID NO: 763419 - RNA, 17 nt, Leptospira interrogans serovar lai str. 56601
aucaaacggucuuucuu

SEQ ID NO: 763420 - RNA, 14 nt, Leptospira interrogans serovar lai str. 56601
aucaaaccuuucuu

SEQ ID NO: 763421 - RNA, 19 nt, Leptospira interrogans serovar lai str. 56601
aucaaaccuuucuuucuga

SEQ ID NO: 763422 - RNA, 12 nt, Leptospira interrogans serovar lai str. 56601
auaugagugaau

SEQ ID NO: 763423 - RNA, 23 nt, Leptospira interrogans serovar lai str. 56601
auaugaguucccacaaauuccug

SEQ ID NO: 763424 - RNA, 22 nt, Leptospira interrogans serovar lai str. 56601
auaugaguucccacauuuuuaa

SEQ ID NO: 763425 - RNA, 15 nt, Leptospira interrogans serovar lai str. 56601
auauuauuauauuua

SEQ ID NO: 763426 - RNA, 17 nt, Leptospira interrogans serovar lai str. 56601
auauuauuauauuuaaa

SEQ ID NO: 763427 - RNA, 17 nt, Leptospira interrogans serovar lai str. 56601
auauuauuaaauuuuua

SEQ ID NO: 763428 - RNA, 20 nt, Leptospira interrogans serovar lai str. 56601
auauuauucuucaucauuau

SEQ ID NO: 763429 - RNA, 13 nt, Leptospira interrogans serovar lai str. 56601
auauucaaaagau

SEQ ID NO: 763430 - RNA, 19 nt, Leptospira interrogans serovar lai str. 56601
auauucaaaaaaguuuaua

SEQ ID NO: 763431 - RNA, 23 nt, Leptospira interrogans serovar lai str. 56601
auauuauuuguaguuucaauuua

SEQ ID NO: 763432 - RNA, 14 nt, Leptospira interrogans serovar lai str. 56601
auauuauuuuaacu

SEQ ID NO: 763433 - RNA, 22 nt, Leptospira interrogans serovar lai str. 56601
auauucagaaacuggaauauuc

SEQ ID NO: 763434 - RNA, 21 nt, Leptospira interrogans serovar lai str. 56601
auauucuuggguuuuaucuaa

SEQ ID NO: 763435 - RNA, 20 nt, Leptospira interrogans serovar lai str. 56601
auauucugaaagugaaagua

SEQ ID NO: 763436 - RNA, 13 nt, Leptospira interrogans serovar lai str. 56601
auauucuauuaua

SEQ ID NO: 763437 - RNA, 16 nt, Leptospira interrogans serovar lai str. 56601
auauucuagaagaguu

SEQ ID NO: 763438 - RNA, 20 nt, Leptospira interrogans serovar lai str. 56601
auauucgcuccguuuugaau

SEQ ID NO: 763439 - RNA, 16 nt, Leptospira interrogans serovar lai str. 56601
auauucguaagaaaaa

SEQ ID NO: 763440 - RNA, 17 nt, Leptospira interrogans serovar lai str. 56601
auauucguaagaaaaaa

SEQ ID NO: 763441 - RNA, 22 nt, Leptospira interrogans serovar lai str. 56601
auauucguaagaaaaaauuucu

SEQ ID NO: 763442 - RNA, 19 nt, Leptospira interrogans serovar lai str. 56601
auauucguguucuauuaua

SEQ ID NO: 763443 - RNA, 20 nt, Leptospira interrogans serovar lai str. 56601
auauucguguucuauuauau

SEQ ID NO: 763444 - RNA, 20 nt, Leptospira interrogans serovar lai str. 56601
auauucgaucaaguaagaau

SEQ ID NO: 763445 - RNA, 21 nt, Leptospira interrogans serovar lai str. 56601
auauucgaucaaguaagaauc

SEQ ID NO: 763446 - RNA, 15 nt, Leptospira interrogans serovar lai str. 56601
auauuuuccaaaaau

SEQ ID NO: 763447 - RNA, 14 nt, Leptospira interrogans serovar lai str. 56601
auauuuucuauuua

SEQ ID NO: 763448 - RNA, 16 nt, Leptospira interrogans serovar lai str. 56601
auauuuucuauuuaac

SEQ ID NO: 763449 - RNA, 18 nt, Leptospira interrogans serovar lai str. 56601
auauuuugcaugaaauca

SEQ ID NO: 763450 - RNA, 12 nt, Leptospira interrogans serovar lai str. 56601
auauuuuuagaa

SEQ ID NO: 763451 - RNA, 13 nt, Leptospira interrogans serovar lai str. 56601
auauuuuuaaagc

SEQ ID NO: 763452 - RNA, 14 nt, Leptospira interrogans serovar lai str. 56601
auauuuuuaaacuc

SEQ ID NO: 763453 - RNA, 16 nt, Leptospira interrogans serovar lai str. 56601
auauuuuuaaacucau

SEQ ID NO: 763454 - RNA, 20 nt, Leptospira interrogans serovar lai str. 56601
auauuuuuauguauuuuaaa

SEQ ID NO: 763455 - RNA, 18 nt, Leptospira interrogans serovar lai str. 56601
auauuuuugugaaacuca

SEQ ID NO: 763456 - RNA, 19 nt, Leptospira interrogans serovar lai str. 56601
auauuuuugugaaacucaa

SEQ ID NO: 763457 - RNA, 12 nt, Leptospira interrogans serovar lai str. 56601
auauuuuuuaaa

SEQ ID NO: 763458 - RNA, 13 nt, Leptospira interrogans serovar lai str. 56601
auauuuuuuaaaa

SEQ ID NO: 763459 - RNA, 20 nt, Leptospira interrogans serovar lai str. 56601
auauuuuuuaaaaauauaaa

SEQ ID NO: 763460 - RNA, 12 nt, Leptospira interrogans serovar lai str. 56601
aucaaaaacaaa

SEQ ID NO: 763461 - RNA, 23 nt, Leptospira interrogans serovar lai str. 56601
auauuuuuuccaaaaagaaaaac

SEQ ID NO: 763462 - RNA, 13 nt, Leptospira interrogans serovar lai str. 56601
auauuguuuaaua

SEQ ID NO: 763463 - RNA, 22 nt, Leptospira interrogans serovar lai str. 56601
auauuuuaauuuucuaauauaa

SEQ ID NO: 763464 - RNA, 19 nt, Leptospira interrogans serovar lai str. 56601
auauuuuacaguaaaacuu

SEQ ID NO: 763465 - RNA, 15 nt, Leptospira interrogans serovar lai str. 56601
auauuuucaggcaua

SEQ ID NO: 763466 - RNA, 11 nt, Leptospira interrogans serovar lai str. 56601
auauuuuccuu

SEQ ID NO: 763467 - RNA, 13 nt, Leptospira interrogans serovar lai str. 56601
auauuuucaaaaa

SEQ ID NO: 763468 - RNA, 14 nt, Leptospira interrogans serovar lai str. 56601
auauuuuaaagaaa

SEQ ID NO: 763469 - RNA, 18 nt, Leptospira interrogans serovar lai str. 56601
auauuuuaaagaaacuca

SEQ ID NO: 763470 - RNA, 15 nt, Leptospira interrogans serovar lai str. 56601
auauuuaaaaauucu

SEQ ID NO: 763471 - RNA, 20 nt, Leptospira interrogans serovar lai str. 56601
auaucuuuuuuauucuuccg

SEQ ID NO: 763472 - RNA, 11 nt, Leptospira interrogans serovar lai str. 56601
auaucuugaac

SEQ ID NO: 763473 - RNA, 18 nt, Leptospira interrogans serovar lai str. 56601
auaucuacgacuaacaaa

SEQ ID NO: 763474 - RNA, 14 nt, Leptospira interrogans serovar lai str. 56601
auaucuuaagaauu

SEQ ID NO: 763475 - RNA, 18 nt, Leptospira interrogans serovar lai str. 56601
auaucuuaauuaaaaaau

SEQ ID NO: 763476 - RNA, 21 nt, Leptospira interrogans serovar lai str. 56601
auaucuuauguucccaaauga

SEQ ID NO: 763477 - RNA, 17 nt, Leptospira interrogans serovar lai str. 56601
auaucgaauuucuucau

SEQ ID NO: 763478 - RNA, 17 nt, Leptospira interrogans serovar lai str. 56601
auaucuacaaaagauuu

SEQ ID NO: 763479 - RNA, 17 nt, Leptospira interrogans serovar lai str. 56601
auaucuaauauuuuucc

SEQ ID NO: 763480 - RNA, 18 nt, Leptospira interrogans serovar lai str. 56601
auaucuaauauuuuucca

SEQ ID NO: 763481 - RNA, 13 nt, Leptospira interrogans serovar lai str. 56601
auauauucuuuuc

SEQ ID NO: 763482 - RNA, 14 nt, Leptospira interrogans serovar lai str. 56601
auauauugaaauau

SEQ ID NO: 763483 - RNA, 19 nt, Leptospira interrogans serovar lai str. 56601
auauauugaaauauuauaa

SEQ ID NO: 763484 - RNA, 20 nt, Leptospira interrogans serovar lai str. 56601
auauauugaaauauuauaaa

SEQ ID NO: 763485 - RNA, 12 nt, Leptospira interrogans serovar lai str. 56601
auauauuauaau

SEQ ID NO: 763486 - RNA, 14 nt, Leptospira interrogans serovar lai str. 56601
auauauuauaauaa

SEQ ID NO: 763487 - RNA, 15 nt, Leptospira interrogans serovar lai str. 56601
auauauuagaauaua

SEQ ID NO: 763488 - RNA, 16 nt, Leptospira interrogans serovar lai str. 56601
auauauuagaauauac

SEQ ID NO: 763489 - RNA, 22 nt, Leptospira interrogans serovar lai str. 56601
auauauuagaauuguugaaaaa

SEQ ID NO: 763490 - RNA, 17 nt, Leptospira interrogans serovar lai str. 56601
auauauucaauuucuuu

SEQ ID NO: 763491 - RNA, 19 nt, Leptospira interrogans serovar lai str. 56601
auauauucacaaaaaaauu

SEQ ID NO: 763492 - RNA, 14 nt, Leptospira interrogans serovar lai str. 56601
auauauuuuuaaag

SEQ ID NO: 763493 - RNA, 13 nt, Leptospira interrogans serovar lai str. 56601
auauauuuuuaau

SEQ ID NO: 763494 - RNA, 13 nt, Leptospira interrogans serovar lai str. 56601
auauagaaauuau

SEQ ID NO: 763495 - RNA, 14 nt, Leptospira interrogans serovar lai str. 56601
auauagaaauuaua

SEQ ID NO: 763496 - RNA, 13 nt, Leptospira interrogans serovar lai str. 56601
auauagaaauuuu

SEQ ID NO: 763497 - RNA, 17 nt, Leptospira interrogans serovar lai str. 56601
auauagaaauuuucaaa

SEQ ID NO: 763498 - RNA, 18 nt, Leptospira interrogans serovar lai str. 56601
auauagaaauuuucaaaa

SEQ ID NO: 763499 - RNA, 22 nt, Leptospira interrogans serovar lai str. 56601
auauagaaauuuucaaaaaaua

SEQ ID NO: 763500 - RNA, 17 nt, Leptospira interrogans serovar lai str. 56601
auauagaacuuuucugg

SEQ ID NO: 763501 - RNA, 22 nt, Leptospira interrogans serovar lai str. 56601
auauacaacuuuuuuaauuuua

SEQ ID NO: 763502 - RNA, 19 nt, Leptospira interrogans serovar lai str. 56601
auauacuuauaaagaauuu

SEQ ID NO: 763503 - RNA, 21 nt, Leptospira interrogans serovar lai str. 56601
auauacuuauaaagaauuuua

SEQ ID NO: 763504 - RNA, 23 nt, Leptospira interrogans serovar lai str. 56601
auauacuuauaaagaauuuuaaa

SEQ ID NO: 763505 - RNA, 15 nt, Leptospira interrogans serovar lai str. 56601
auauacuuuucaaac

SEQ ID NO: 763506 - RNA, 12 nt, Leptospira interrogans serovar lai str. 56601
auaucaaacuua

SEQ ID NO: 763507 - RNA, 16 nt, Leptospira interrogans serovar lai str. 56601
auaucaaauucaugau

SEQ ID NO: 763508 - RNA, 20 nt, Leptospira interrogans serovar lai str. 56601
auaucaauccuguaaauuca

SEQ ID NO: 763509 - RNA, 23 nt, Leptospira interrogans serovar lai str. 56601
auaucaaugaucauauccgaaag

SEQ ID NO: 763510 - RNA, 15 nt, Leptospira interrogans serovar lai str. 56601
auaucacaaauuuua

SEQ ID NO: 763511 - RNA, 21 nt, Leptospira interrogans serovar lai str. 56601
auaucacaaauuuuaaaguaa

SEQ ID NO: 763512 - RNA, 16 nt, Leptospira interrogans serovar lai str. 56601
auauaauuuacuucau

SEQ ID NO: 763513 - RNA, 12 nt, Leptospira interrogans serovar lai str. 56601
auauaauuuuua

SEQ ID NO: 763514 - RNA, 14 nt, Leptospira interrogans serovar lai str. 56601
auauaacuuuuuca

SEQ ID NO: 763515 - RNA, 15 nt, Leptospira interrogans serovar lai str. 56601
auauaagaaaguauu

SEQ ID NO: 763516 - RNA, 11 nt, Leptospira interrogans serovar lai str. 56601
auauaaaaaau

SEQ ID NO: 763517 - RNA, 14 nt, Leptospira interrogans serovar lai str. 56601
auauaaaaaauaau

SEQ ID NO: 763518 - RNA, 13 nt, Leptospira interrogans serovar lai str. 56601
auauaaaaaaugu

SEQ ID NO: 763519 - RNA, 14 nt, Leptospira interrogans serovar lai str. 56601
auauaaaagugaac

SEQ ID NO: 763520 - RNA, 17 nt, Leptospira interrogans serovar lai str. 56601
auauaaaaucuuaaauu

SEQ ID NO: 763521 - RNA, 19 nt, Leptospira interrogans serovar lai str. 56601
auauaacaaaguauuuaau

SEQ ID NO: 763522 - RNA, 20 nt, Leptospira interrogans serovar lai str. 56601
auauaacaaaguauuuaauu

SEQ ID NO: 763523 - RNA, 14 nt, Leptospira interrogans serovar lai str. 56601
auauaacuuagucu

SEQ ID NO: 763524 - RNA, 23 nt, Leptospira interrogans serovar lai str. 56601
auaguuuuuguuaggcaauauua

SEQ ID NO: 763525 - RNA, 18 nt, Leptospira interrogans serovar lai str. 56601
auaguuuguacaucuuaa

SEQ ID NO: 763526 - RNA, 16 nt, Leptospira interrogans serovar lai str. 56601
auaguuuuaugugggu

SEQ ID NO: 763527 - RNA, 16 nt, Leptospira interrogans serovar lai str. 56601
auaguuuugagauuac

SEQ ID NO: 763528 - RNA, 21 nt, Leptospira interrogans serovar lai str. 56601
auaguuuugagauuacaaaaa

SEQ ID NO: 763529 - RNA, 20 nt, Leptospira interrogans serovar lai str. 56601
auaguuuacauaucaauccu

SEQ ID NO: 763530 - RNA, 21 nt, Leptospira interrogans serovar lai str. 56601
auaguauaauccuuuuacuuc

SEQ ID NO: 763531 - RNA, 20 nt, Leptospira interrogans serovar lai str. 56601
auaguaaagauuagaaaaac

SEQ ID NO: 763532 - RNA, 21 nt, Leptospira interrogans serovar lai str. 56601
auaguaaagauuagaaaaacu

SEQ ID NO: 763533 - RNA, 13 nt, Leptospira interrogans serovar lai str. 56601
auaguaacagaaa

SEQ ID NO: 763534 - RNA, 22 nt, Leptospira interrogans serovar lai str. 56601
auaguaacagaaaaauguuaaa

SEQ ID NO: 763535 - RNA, 23 nt, Leptospira interrogans serovar lai str. 56601
auaguaacagaaaaauguuaaaa

SEQ ID NO: 763536 - RNA, 23 nt, Leptospira interrogans serovar lai str. 56601
auaguaagcccccgaagaauuau

SEQ ID NO: 763537 - RNA, 19 nt, Leptospira interrogans serovar lai str. 56601
auagguuuuguaagaauuc

SEQ ID NO: 763538 - RNA, 13 nt, Leptospira interrogans serovar lai str. 56601
auaguaaaagaaa

SEQ ID NO: 763539 - RNA, 15 nt, Leptospira interrogans serovar lai str. 56601
auaguaaaagaaaau

SEQ ID NO: 763540 - RNA, 15 nt, Leptospira interrogans serovar lai str. 56601
auagguucuggauuu

SEQ ID NO: 763541 - RNA, 15 nt, Leptospira interrogans serovar lai str. 56601
auaggauuuuagaau

SEQ ID NO: 763542 - RNA, 13 nt, Leptospira interrogans serovar lai str. 56601
auaggaguuccua

SEQ ID NO: 763543 - RNA, 14 nt, Leptospira interrogans serovar lai str. 56601
auaggaucagaauu

SEQ ID NO: 763544 - RNA, 14 nt, Leptospira interrogans serovar lai str. 56601
auagggaguuccua

SEQ ID NO: 763545 - RNA, 15 nt, Leptospira interrogans serovar lai str. 56601
auagggaaaacucaa

SEQ ID NO: 763546 - RNA, 16 nt, Leptospira interrogans serovar lai str. 56601
auagggaaaacucaac

SEQ ID NO: 763547 - RNA, 20 nt, Leptospira interrogans serovar lai str. 56601
auagggaaaacucaacacaa

SEQ ID NO: 763548 - RNA, 14 nt, Leptospira interrogans serovar lai str. 56601
auaggcuaaucaaa

SEQ ID NO: 763549 - RNA, 17 nt, Leptospira interrogans serovar lai str. 56601
auaggcgcggaaaaauu

SEQ ID NO: 763550 - RNA, 16 nt, Leptospira interrogans serovar lai str. 56601
auagcuucuuuaaaaa

SEQ ID NO: 763551 - RNA, 21 nt, Leptospira interrogans serovar lai str. 56601
auagcuucuuuaaaaacuuca

SEQ ID NO: 763552 - RNA, 16 nt, Leptospira interrogans serovar lai str. 56601
auagcuuaaaagugau

SEQ ID NO: 763553 - RNA, 19 nt, Leptospira interrogans serovar lai str. 56601
auaggaaauaauuccucca

SEQ ID NO: 763554 - RNA, 23 nt, Leptospira interrogans serovar lai str. 56601
auaggaacucuuacuuugagaaa

SEQ ID NO: 763555 - RNA, 21 nt, Leptospira interrogans serovar lai str. 56601
auagcuuuugagcaguaaaaa

SEQ ID NO: 763556 - RNA, 20 nt, Leptospira interrogans serovar lai str. 56601
auagcgucguuaaauuugcg

SEQ ID NO: 763557 - RNA, 20 nt, Leptospira interrogans serovar lai str. 56601
auagcagaugagcauuuuuu

SEQ ID NO: 763558 - RNA, 20 nt, Leptospira interrogans serovar lai str. 56601
auagcagauuuucucaaaaa

SEQ ID NO: 763559 - RNA, 23 nt, Leptospira interrogans serovar lai str. 56601
auagcagauuuucucaaaaaaag

SEQ ID NO: 763560 - RNA, 22 nt, Leptospira interrogans serovar lai str. 56601
auagauuaagucacauuguguu

SEQ ID NO: 763561 - RNA, 18 nt, Leptospira interrogans serovar lai str. 56601
auagauuaaguccagagc

SEQ ID NO: 763562 - RNA, 22 nt, Leptospira interrogans serovar lai str. 56601
auagauggagaauuaauuuuuu

SEQ ID NO: 763563 - RNA, 19 nt, Leptospira interrogans serovar lai str. 56601
auagauggagaauucauuu

SEQ ID NO: 763564 - RNA, 18 nt, Leptospira interrogans serovar lai str. 56601
auagaugcugaaaauggu

SEQ ID NO: 763565 - RNA, 15 nt, Leptospira interrogans serovar lai str. 56601
auagagucuuuaaaa

SEQ ID NO: 763566 - RNA, 20 nt, Leptospira interrogans serovar lai str. 56601
auagaggucgucucaaaaau

SEQ ID NO: 763567 - RNA, 22 nt, Leptospira interrogans serovar lai str. 56601
auagaggucgucucaaaaauau

SEQ ID NO: 763568 - RNA, 18 nt, Leptospira interrogans serovar lai str. 56601
auagaguaccauaaauuu

SEQ ID NO: 763569 - RNA, 21 nt, Leptospira interrogans serovar lai str. 56601
auagagcuuuguaauaaaaau

SEQ ID NO: 763570 - RNA, 22 nt, Leptospira interrogans serovar lai str. 56601
auagagcuuuguaauaaaaauu

SEQ ID NO: 763571 - RNA, 14 nt, Leptospira interrogans serovar lai str. 56601
auagaggaugaauc

SEQ ID NO: 763572 - RNA, 14 nt, Leptospira interrogans serovar lai str. 56601
auacuuuuaaaaaa

SEQ ID NO: 763573 - RNA, 15 nt, Leptospira interrogans serovar lai str. 56601
auacuuuuaaaaagu

SEQ ID NO: 763574 - RNA, 22 nt, Leptospira interrogans serovar lai str. 56601
auacuuuuaaaaaguucucuuc

SEQ ID NO: 763575 - RNA, 21 nt, Leptospira interrogans serovar lai str. 56601
auacuuuauagguucuggauu

SEQ ID NO: 763576 - RNA, 20 nt, Leptospira interrogans serovar lai str. 56601
auacuuuaagaaaauuuaaa

SEQ ID NO: 763577 - RNA, 16 nt, Leptospira interrogans serovar lai str. 56601
auacuuuaauaauaua

SEQ ID NO: 763578 - RNA, 19 nt, Leptospira interrogans serovar lai str. 56601
auacuuuaauaauaugaau

SEQ ID NO: 763579 - RNA, 22 nt, Leptospira interrogans serovar lai str. 56601
auacuuuauuuguauucaagag

SEQ ID NO: 763580 - RNA, 17 nt, Leptospira interrogans serovar lai str. 56601
auacuuucaaaaaauau

SEQ ID NO: 763581 - RNA, 18 nt, Leptospira interrogans serovar lai str. 56601
auacuugccauggaaauu

SEQ ID NO: 763582 - RNA, 20 nt, Leptospira interrogans serovar lai str. 56601
auacuuuaaaaaauaucuua

SEQ ID NO: 763583 - RNA, 13 nt, Leptospira interrogans serovar lai str. 56601
auacuuuuagaag

SEQ ID NO: 763584 - RNA, 20 nt, Leptospira interrogans serovar lai str. 56601
auacuuuuagaagauuuuua

SEQ ID NO: 763585 - RNA, 22 nt, Leptospira interrogans serovar lai str. 56601
auacuuuuagauaauuauucuc

SEQ ID NO: 763586 - RNA, 20 nt, Leptospira interrogans serovar lai str. 56601
auagagagcguuuuguugag

SEQ ID NO: 763587 - RNA, 17 nt, Leptospira interrogans serovar lai str. 56601
auacugacagauugaua

SEQ ID NO: 763588 - RNA, 14 nt, Leptospira interrogans serovar lai str. 56601
auacuucuaaaaaa

SEQ ID NO: 763589 - RNA, 16 nt, Leptospira interrogans serovar lai str. 56601
auacuucuaaaaaauu

SEQ ID NO: 763590 - RNA, 19 nt, Leptospira interrogans serovar lai str. 56601
auacuucuaaaaaauucuu

SEQ ID NO: 763591 - RNA, 17 nt, Leptospira interrogans serovar lai str. 56601
auacuguuaauuuuuau

SEQ ID NO: 763592 - RNA, 23 nt, Leptospira interrogans serovar lai str. 56601
auacucaauauuuuguuuugaaa

SEQ ID NO: 763593 - RNA, 21 nt, Leptospira interrogans serovar lai str. 56601
auacucgaaaccauacaauaa

SEQ ID NO: 763594 - RNA, 22 nt, Leptospira interrogans serovar lai str. 56601
auacucgaaaccauacaauaaa

SEQ ID NO: 763595 - RNA, 19 nt, Leptospira interrogans serovar lai str. 56601
auacgugucauuuccacau

SEQ ID NO: 763596 - RNA, 13 nt, Leptospira interrogans serovar lai str. 56601
auacguuauucua

SEQ ID NO: 763597 - RNA, 22 nt, Leptospira interrogans serovar lai str. 56601
auacguuauucuauucguauuu

SEQ ID NO: 763598 - RNA, 17 nt, Leptospira interrogans serovar lai str. 56601
auacguuccuucuacaa

SEQ ID NO: 763599 - RNA, 21 nt, Leptospira interrogans serovar lai str. 56601
auacguuccuucuacaauccu

SEQ ID NO: 763600 - RNA, 17 nt, Leptospira interrogans serovar lai str. 56601
auacuauuaauuuacuu

SEQ ID NO: 763601 - RNA, 14 nt, Leptospira interrogans serovar lai str. 56601
auacguaaaaauaa

SEQ ID NO: 763602 - RNA, 15 nt, Leptospira interrogans serovar lai str. 56601
auacggguaaaucgc

SEQ ID NO: 763603 - RNA, 16 nt, Leptospira interrogans serovar lai str. 56601
auacgauagauucaau

SEQ ID NO: 763604 - RNA, 13 nt, Leptospira interrogans serovar lai str. 56601
auacgauauuuug

SEQ ID NO: 763605 - RNA, 23 nt, Leptospira interrogans serovar lai str. 56601
auaauuagcucuuguuaaaauaa

SEQ ID NO: 763606 - RNA, 13 nt, Leptospira interrogans serovar lai str. 56601
auaauuaauaaaa

SEQ ID NO: 763607 - RNA, 16 nt, Leptospira interrogans serovar lai str. 56601
auaauuaauaaaacug

SEQ ID NO: 763608 - RNA, 16 nt, Leptospira interrogans serovar lai str. 56601
auaauuagaaaaauau

SEQ ID NO: 763609 - RNA, 16 nt, Leptospira interrogans serovar lai str. 56601
auaccgggauuuuaaa

SEQ ID NO: 763610 - RNA, 13 nt, Leptospira interrogans serovar lai str. 56601
auaccuguuuuag

SEQ ID NO: 763611 - RNA, 18 nt, Leptospira interrogans serovar lai str. 56601
aguuuuacuguaaaauuu

SEQ ID NO: 763612 - RNA, 17 nt, Leptospira interrogans serovar lai str. 56601
aguuuucucaaaaucuu

SEQ ID NO: 763613 - RNA, 21 nt, Leptospira interrogans serovar lai str. 56601
aguuuucucgaacuacccaaa

SEQ ID NO: 763614 - RNA, 22 nt, Leptospira interrogans serovar lai str. 56601
aguuuucuuuuuuaucauucuu

SEQ ID NO: 763615 - RNA, 15 nt, Leptospira interrogans serovar lai str. 56601
aguuuugagauuaca

SEQ ID NO: 763616 - RNA, 16 nt, Leptospira interrogans serovar lai str. 56601
aguuuguuuuuuauau

SEQ ID NO: 763617 - RNA, 19 nt, Leptospira interrogans serovar lai str. 56601
aguuuguuuguaaagcaac

SEQ ID NO: 763618 - RNA, 17 nt, Leptospira interrogans serovar lai str. 56601
aguuuuacaaagaguuu

SEQ ID NO: 763619 - RNA, 20 nt, Leptospira interrogans serovar lai str. 56601
aguuuuacaaagaguuuaaa

SEQ ID NO: 763620 - RNA, 16 nt, Leptospira interrogans serovar lai str. 56601
aguuuuacaaauuagu

SEQ ID NO: 763621 - RNA, 18 nt, Leptospira interrogans serovar lai str. 56601
aguuuuacagaagauuuu

SEQ ID NO: 763622 - RNA, 21 nt, Leptospira interrogans serovar lai str. 56601
aguuuguuaucaauagaaaua

SEQ ID NO: 763623 - RNA, 22 nt, Leptospira interrogans serovar lai str. 56601
aguuuguuccaaaaccucaaaa

SEQ ID NO: 763624 - RNA, 15 nt, Leptospira interrogans serovar lai str. 56601
aguuuguucuaaaaa

SEQ ID NO: 763625 - RNA, 14 nt, Leptospira interrogans serovar lai str. 56601
aguuuuuuuauaaa

SEQ ID NO: 763626 - RNA, 16 nt, Leptospira interrogans serovar lai str. 56601
aguuuuuuuauaaaau

SEQ ID NO: 763627 - RNA, 18 nt, Leptospira interrogans serovar lai str. 56601
aguuuuuugagaaacaac

SEQ ID NO: 763628 - RNA, 22 nt, Leptospira interrogans serovar lai str. 56601
aguuuuuauaaaaucuaaaaag

SEQ ID NO: 763629 - RNA, 15 nt, Leptospira interrogans serovar lai str. 56601
aguuuuuaguauucu

SEQ ID NO: 763630 - RNA, 19 nt, Leptospira interrogans serovar lai str. 56601
aguuugucuguaaaaugau

SEQ ID NO: 763631 - RNA, 22 nt, Leptospira interrogans serovar lai str. 56601
aguuugaucuuuuugauaaaau

SEQ ID NO: 763632 - RNA, 21 nt, Leptospira interrogans serovar lai str. 56601
aguuucuuauauaaaaguaau

SEQ ID NO: 763633 - RNA, 13 nt, Leptospira interrogans serovar lai str. 56601
aguuugaaagucu

SEQ ID NO: 763634 - RNA, 19 nt, Leptospira interrogans serovar lai str. 56601
aguuugaaagucuaacagu

SEQ ID NO: 763635 - RNA, 17 nt, Leptospira interrogans serovar lai str. 56601
aguuucuucuuuuagag

SEQ ID NO: 763636 - RNA, 19 nt, Leptospira interrogans serovar lai str. 56601
aguuucuacauuuuuguga

SEQ ID NO: 763637 - RNA, 17 nt, Leptospira interrogans serovar lai str. 56601
aguuucuccacuuaaaa

SEQ ID NO: 763638 - RNA, 22 nt, Leptospira interrogans serovar lai str. 56601
aguuucuccggcgaccuuucua

SEQ ID NO: 763639 - RNA, 19 nt, Leptospira interrogans serovar lai str. 56601
aguuuacauaucaauccug

SEQ ID NO: 763640 - RNA, 18 nt, Leptospira interrogans serovar lai str. 56601
aguuuaccccgaagagcu

SEQ ID NO: 763641 - RNA, 17 nt, Leptospira interrogans serovar lai str. 56601
aguuguuauaaaccaau

SEQ ID NO: 763642 - RNA, 17 nt, Leptospira interrogans serovar lai str. 56601
aguuguugaaaaauuuc

SEQ ID NO: 763643 - RNA, 18 nt, Leptospira interrogans serovar lai str. 56601
aguuuaacgcgaaguauu

SEQ ID NO: 763644 - RNA, 14 nt, Leptospira interrogans serovar lai str. 56601
aguugaaaguuuuu

SEQ ID NO: 763645 - RNA, 22 nt, Leptospira interrogans serovar lai str. 56601
aguugaaaucugaauuuaaaga

SEQ ID NO: 763646 - RNA, 17 nt, Leptospira interrogans serovar lai str. 56601
aguugaaauucaccuuc

SEQ ID NO: 763647 - RNA, 20 nt, Leptospira interrogans serovar lai str. 56601
aguugaagcaguuuuguuaa

SEQ ID NO: 763648 - RNA, 14 nt, Leptospira interrogans serovar lai str. 56601
aguugaauaggauu

SEQ ID NO: 763649 - RNA, 20 nt, Leptospira interrogans serovar lai str. 56601
aguuccuuaaauauaucuuc

SEQ ID NO: 763650 - RNA, 22 nt, Leptospira interrogans serovar lai str. 56601
aguucgacauaagaaagaauuu

SEQ ID NO: 763651 - RNA, 19 nt, Leptospira interrogans serovar lai str. 56601
aguucgacguaaagaauuc

SEQ ID NO: 763652 - RNA, 21 nt, Leptospira interrogans serovar lai str. 56601
aguucggcguaagaaaaccau

SEQ ID NO: 763653 - RNA, 15 nt, Leptospira interrogans serovar lai str. 56601
aguucgguguaaaaa

SEQ ID NO: 763654 - RNA, 21 nt, Leptospira interrogans serovar lai str. 56601
aguucgguguaaaaaaucaug

SEQ ID NO: 763655 - RNA, 20 nt, Leptospira interrogans serovar lai str. 56601
aguucgguguaaggaauuca

SEQ ID NO: 763656 - RNA, 22 nt, Leptospira interrogans serovar lai str. 56601
aguucgguagaaagaauuuucu

SEQ ID NO: 763657 - RNA, 16 nt, Leptospira interrogans serovar lai str. 56601
aguucguuauaaacaa

SEQ ID NO: 763658 - RNA, 14 nt, Leptospira interrogans serovar lai str. 56601
aguucguaugaguu

SEQ ID NO: 763659 - RNA, 23 nt, Leptospira interrogans serovar lai str. 56601
aguucgugaagaaauuuaaguuu

SEQ ID NO: 763660 - RNA, 17 nt, Leptospira interrogans serovar lai str. 56601
aguucuggguaaaaaaa

SEQ ID NO: 763661 - RNA, 22 nt, Leptospira interrogans serovar lai str. 56601
aguucuggguaaaaaaaaauga

SEQ ID NO: 763662 - RNA, 19 nt, Leptospira interrogans serovar lai str. 56601
aguucuuacuuuuugagua

SEQ ID NO: 763663 - RNA, 16 nt, Leptospira interrogans serovar lai str. 56601
aguucuuaaauaaaau

SEQ ID NO: 763664 - RNA, 18 nt, Leptospira interrogans serovar lai str. 56601
aguucuuaaauaaaauuu

SEQ ID NO: 763665 - RNA, 19 nt, Leptospira interrogans serovar lai str. 56601
aguucuuaaauaaaauuuu

SEQ ID NO: 763666 - RNA, 13 nt, Leptospira interrogans serovar lai str. 56601
aguucuucaaaau

SEQ ID NO: 763667 - RNA, 14 nt, Leptospira interrogans serovar lai str. 56601
aguucuucaaaauc

SEQ ID NO: 763668 - RNA, 23 nt, Leptospira interrogans serovar lai str. 56601
aguucuucaaaaucguuuuaaaa

SEQ ID NO: 763669 - RNA, 13 nt, Leptospira interrogans serovar lai str. 56601
aguucaaaaaaag

SEQ ID NO: 763670 - RNA, 14 nt, Leptospira interrogans serovar lai str. 56601
aguucaaaaaaagg

SEQ ID NO: 763671 - RNA, 19 nt, Leptospira interrogans serovar lai str. 56601
aguucaaaaaaaggauuau

SEQ ID NO: 763672 - RNA, 14 nt, Leptospira interrogans serovar lai str. 56601
aguuauauaauaaa

SEQ ID NO: 763673 - RNA, 22 nt, Leptospira interrogans serovar lai str. 56601
aguucacaaauugcaaaauacg

SEQ ID NO: 763674 - RNA, 21 nt, Leptospira interrogans serovar lai str. 56601
aguucaauguaagaaacucau

SEQ ID NO: 763675 - RNA, 14 nt, Leptospira interrogans serovar lai str. 56601
aguucaauuaacaa

SEQ ID NO: 763676 - RNA, 18 nt, Leptospira interrogans serovar lai str. 56601
aguuccaacguaccaaaa

SEQ ID NO: 763677 - RNA, 21 nt, Leptospira interrogans serovar lai str. 56601
aguuccaauuaacaaaacugc

SEQ ID NO: 763678 - RNA, 16 nt, Leptospira interrogans serovar lai str. 56601
aguuccacauuuuaaa

SEQ ID NO: 763679 - RNA, 20 nt, Leptospira interrogans serovar lai str. 56601
aguuccacauuuuaaagguu

SEQ ID NO: 763680 - RNA, 13 nt, Leptospira interrogans serovar lai str. 56601
aguucccacaaau

SEQ ID NO: 763681 - RNA, 18 nt, Leptospira interrogans serovar lai str. 56601
aguucccacaaauuccug

SEQ ID NO: 763682 - RNA, 20 nt, Leptospira interrogans serovar lai str. 56601
aguucccacaaauuccugcc

SEQ ID NO: 763683 - RNA, 15 nt, Leptospira interrogans serovar lai str. 56601
aguucccacauuuca

SEQ ID NO: 763684 - RNA, 17 nt, Leptospira interrogans serovar lai str. 56601
aguucccacauuuuaaa

SEQ ID NO: 763685 - RNA, 17 nt, Leptospira interrogans serovar lai str. 56601
aguucccacauuuugaa

SEQ ID NO: 763686 - RNA, 17 nt, Leptospira interrogans serovar lai str. 56601
aguucccacauuuugug

SEQ ID NO: 763687 - RNA, 15 nt, Leptospira interrogans serovar lai str. 56601
aguuaaacuuugaaa

SEQ ID NO: 763688 - RNA, 21 nt, Leptospira interrogans serovar lai str. 56601
aguuacgcugaguuugagaga

SEQ ID NO: 763689 - RNA, 21 nt, Leptospira interrogans serovar lai str. 56601
aguuaaaacauuucguuuuua

SEQ ID NO: 763690 - RNA, 13 nt, Leptospira interrogans serovar lai str. 56601
aguguuugcugag

SEQ ID NO: 763691 - RNA, 15 nt, Leptospira interrogans serovar lai str. 56601
aguuacucauuucca

SEQ ID NO: 763692 - RNA, 16 nt, Leptospira interrogans serovar lai str. 56601
aguuacucauuuccau

SEQ ID NO: 763693 - RNA, 17 nt, Leptospira interrogans serovar lai str. 56601
aguuacucauuuccauc

SEQ ID NO: 763694 - RNA, 16 nt, Leptospira interrogans serovar lai str. 56601
aguuacuuauuuuuga

SEQ ID NO: 763695 - RNA, 21 nt, Leptospira interrogans serovar lai str. 56601
aguguuccgacaagaaugagu

SEQ ID NO: 763696 - RNA, 17 nt, Leptospira interrogans serovar lai str. 56601
aguguuuauaauuuuua

SEQ ID NO: 763697 - RNA, 20 nt, Leptospira interrogans serovar lai str. 56601
aguguuguguugaguuucaa

SEQ ID NO: 763698 - RNA, 14 nt, Leptospira interrogans serovar lai str. 56601
agugggaaggaauu

SEQ ID NO: 763699 - RNA, 22 nt, Leptospira interrogans serovar lai str. 56601
agugggaaggaauuuccuaaaa

SEQ ID NO: 763700 - RNA, 18 nt, Leptospira interrogans serovar lai str. 56601
agugguuuguaauaguuc

SEQ ID NO: 763701 - RNA, 17 nt, Leptospira interrogans serovar lai str. 56601
agugguuuucaaauauu

SEQ ID NO: 763702 - RNA, 20 nt, Leptospira interrogans serovar lai str. 56601
agugguuuucaaauauuuua

SEQ ID NO: 763703 - RNA, 13 nt, Leptospira interrogans serovar lai str. 56601
aguggugaauuuu

SEQ ID NO: 763704 - RNA, 15 nt, Leptospira interrogans serovar lai str. 56601
aguguaauaugaauu

SEQ ID NO: 763705 - RNA, 16 nt, Leptospira interrogans serovar lai str. 56601
aguguaaucuuauuuu

SEQ ID NO: 763706 - RNA, 19 nt, Leptospira interrogans serovar lai str. 56601
aguguaaaauuaaaauccu

SEQ ID NO: 763707 - RNA, 15 nt, Leptospira interrogans serovar lai str. 56601
aguguccauuucaau

SEQ ID NO: 763708 - RNA, 15 nt, Leptospira interrogans serovar lai str. 56601
agugcagauuaaaaa

SEQ ID NO: 763709 - RNA, 21 nt, Leptospira interrogans serovar lai str. 56601
agugcaguaguuccuacaaau

SEQ ID NO: 763710 - RNA, 12 nt, Leptospira interrogans serovar lai str. 56601
agucuagaauuc

SEQ ID NO: 763711 - RNA, 16 nt, Leptospira interrogans serovar lai str. 56601
agucuagaauucuuug

SEQ ID NO: 763712 - RNA, 13 nt, Leptospira interrogans serovar lai str. 56601
agucuaaaaacaa

SEQ ID NO: 763713 - RNA, 18 nt, Leptospira interrogans serovar lai str. 56601
agucuaacaguaaaacuu

SEQ ID NO: 763714 - RNA, 20 nt, Leptospira interrogans serovar lai str. 56601
aguccuuuuugagaaacuuc

SEQ ID NO: 763715 - RNA, 13 nt, Leptospira interrogans serovar lai str. 56601
agucgaaagaauu

SEQ ID NO: 763716 - RNA, 12 nt, Leptospira interrogans serovar lai str. 56601
agucgaauuuuu

SEQ ID NO: 763717 - RNA, 14 nt, Leptospira interrogans serovar lai str. 56601
aguccguuccuuua

SEQ ID NO: 763718 - RNA, 22 nt, Leptospira interrogans serovar lai str. 56601
aguaccuaauauuuugcaugaa

SEQ ID NO: 763719 - RNA, 23 nt, Leptospira interrogans serovar lai str. 56601
aguaccuaauauuuugcaugaaa

SEQ ID NO: 763720 - RNA, 14 nt, Leptospira interrogans serovar lai str. 56601
agucuucaaaauug

SEQ ID NO: 763721 - RNA, 17 nt, Leptospira interrogans serovar lai str. 56601
agucuuacaauuuuaga

SEQ ID NO: 763722 - RNA, 18 nt, Leptospira interrogans serovar lai str. 56601
agucugguuuauuuuuga

SEQ ID NO: 763723 - RNA, 14 nt, Leptospira interrogans serovar lai str. 56601
agucugaaauaaau

SEQ ID NO: 763724 - RNA, 20 nt, Leptospira interrogans serovar lai str. 56601
agucuuuuuacuugcaaaaa

SEQ ID NO: 763725 - RNA, 15 nt, Leptospira interrogans serovar lai str. 56601
agugaauuuuugugg

SEQ ID NO: 763726 - RNA, 15 nt, Leptospira interrogans serovar lai str. 56601
auaagaaaguauuaa

SEQ ID NO: 763727 - RNA, 20 nt, Leptospira interrogans serovar lai str. 56601
auaacuuucuucgaucggaa

SEQ ID NO: 763728 - RNA, 15 nt, Leptospira interrogans serovar lai str. 56601
auaagaaaaauugaa

SEQ ID NO: 763729 - RNA, 13 nt, Leptospira interrogans serovar lai str. 56601
auaacuugacucc

SEQ ID NO: 763730 - RNA, 21 nt, Leptospira interrogans serovar lai str. 56601
auaacuuuaaaaaauaagaag

SEQ ID NO: 763731 - RNA, 19 nt, Leptospira interrogans serovar lai str. 56601
auaacugcaagaaaccucu

SEQ ID NO: 763732 - RNA, 19 nt, Leptospira interrogans serovar lai str. 56601
auaacucuauuaguuuaau

SEQ ID NO: 763733 - RNA, 19 nt, Leptospira interrogans serovar lai str. 56601
auaacuuagaaucuaucuc

SEQ ID NO: 763734 - RNA, 21 nt, Leptospira interrogans serovar lai str. 56601
auaacuaacgugaguucagac

SEQ ID NO: 763735 - RNA, 14 nt, Leptospira interrogans serovar lai str. 56601
auaacuaauaaaaa

SEQ ID NO: 763736 - RNA, 17 nt, Leptospira interrogans serovar lai str. 56601
auaacuaauaaaaacaa

SEQ ID NO: 763737 - RNA, 18 nt, Leptospira interrogans serovar lai str. 56601
auaacuaauaaaaacaau

SEQ ID NO: 763738 - RNA, 14 nt, Leptospira interrogans serovar lai str. 56601
auaacguuauaaaa

SEQ ID NO: 763739 - RNA, 16 nt, Leptospira interrogans serovar lai str. 56601
auaaccuaaaauuucc

SEQ ID NO: 763740 - RNA, 17 nt, Leptospira interrogans serovar lai str. 56601
auaaccuaaaauuucca

SEQ ID NO: 763741 - RNA, 18 nt, Leptospira interrogans serovar lai str. 56601
auaaccuaaaauuuccau

SEQ ID NO: 763742 - RNA, 22 nt, Leptospira interrogans serovar lai str. 56601
auaacgucuugauuauuuucug

SEQ ID NO: 763743 - RNA, 16 nt, Leptospira interrogans serovar lai str. 56601
auaaccucaacauaaa

SEQ ID NO: 763744 - RNA, 12 nt, Leptospira interrogans serovar lai str. 56601
auaaauuuuucu

SEQ ID NO: 763745 - RNA, 18 nt, Leptospira interrogans serovar lai str. 56601
auaaauuuuucuggaaaa

SEQ ID NO: 763746 - RNA, 11 nt, Leptospira interrogans serovar lai str. 56601
auaaauuuuuu

SEQ ID NO: 763747 - RNA, 23 nt, Leptospira interrogans serovar lai str. 56601
auaaauuuuaaccgcaaaaucau

SEQ ID NO: 763748 - RNA, 13 nt, Leptospira interrogans serovar lai str. 56601
auaaauuuugaaa

SEQ ID NO: 763749 - RNA, 16 nt, Leptospira interrogans serovar lai str. 56601
auaaauuuuuuggaaa

SEQ ID NO: 763750 - RNA, 18 nt, Leptospira interrogans serovar lai str. 56601
auaaauuuugagccgaau

SEQ ID NO: 763751 - RNA, 15 nt, Leptospira interrogans serovar lai str. 56601
auaaauuaguaauuu

SEQ ID NO: 763752 - RNA, 19 nt, Leptospira interrogans serovar lai str. 56601
auaaauuacugauuucaaa

SEQ ID NO: 763753 - RNA, 20 nt, Leptospira interrogans serovar lai str. 56601
auaaauuacugauuucaaaa

SEQ ID NO: 763754 - RNA, 23 nt, Leptospira interrogans serovar lai str. 56601
auaaauuacugauuucaaaaaua

SEQ ID NO: 763755 - RNA, 14 nt, Leptospira interrogans serovar lai str. 56601
auaaauuagaaaau

SEQ ID NO: 763756 - RNA, 17 nt, Leptospira interrogans serovar lai str. 56601
auaaauuagaaaauuau

SEQ ID NO: 763757 - RNA, 20 nt, Leptospira interrogans serovar lai str. 56601
auaaauuagaaaauuauaaa

SEQ ID NO: 763758 - RNA, 15 nt, Leptospira interrogans serovar lai str. 56601
auaaauuauacaauu

SEQ ID NO: 763759 - RNA, 18 nt, Leptospira interrogans serovar lai str. 56601
auaaauuauacaauuuaa

SEQ ID NO: 763760 - RNA, 23 nt, Leptospira interrogans serovar lai str. 56601
auaaauuauaguuuuauuagaac

SEQ ID NO: 763761 - RNA, 14 nt, Leptospira interrogans serovar lai str. 56601
auaaaugugggaac

SEQ ID NO: 763762 - RNA, 15 nt, Leptospira interrogans serovar lai str. 56601
auaacauuuuuucau

SEQ ID NO: 763763 - RNA, 23 nt, Leptospira interrogans serovar lai str. 56601
auaaccaaccccacaaguauuug

SEQ ID NO: 763764 - RNA, 14 nt, Leptospira interrogans serovar lai str. 56601
auaaaauuuuuaaa

SEQ ID NO: 763765 - RNA, 15 nt, Leptospira interrogans serovar lai str. 56601
auaaaauuuuuaaaa

SEQ ID NO: 763766 - RNA, 16 nt, Leptospira interrogans serovar lai str. 56601
auaaaauuuuuaaaaa

SEQ ID NO: 763767 - RNA, 20 nt, Leptospira interrogans serovar lai str. 56601
auaaaauuuuuaaaaaauua

SEQ ID NO: 763768 - RNA, 13 nt, Leptospira interrogans serovar lai str. 56601
auaaaauuuuaga

SEQ ID NO: 763769 - RNA, 20 nt, Leptospira interrogans serovar lai str. 56601
auaaaauuuuagauacguuu

SEQ ID NO: 763770 - RNA, 22 nt, Leptospira interrogans serovar lai str. 56601
auaaaauuuuccggacuuucca

SEQ ID NO: 763771 - RNA, 14 nt, Leptospira interrogans serovar lai str. 56601
auaaacaaaauuca

SEQ ID NO: 763772 - RNA, 15 nt, Leptospira interrogans serovar lai str. 56601
auaaaccaauaacca

SEQ ID NO: 763773 - RNA, 16 nt, Leptospira interrogans serovar lai str. 56601
auaaacaauaugaaag

SEQ ID NO: 763774 - RNA, 13 nt, Leptospira interrogans serovar lai str. 56601
auaaaauuugaaa

SEQ ID NO: 763775 - RNA, 18 nt, Leptospira interrogans serovar lai str. 56601
auaaaauuugaaaguaaa

SEQ ID NO: 763776 - RNA, 23 nt, Leptospira interrogans serovar lai str. 56601
auaaaauuugaaaguaaaaaaga

SEQ ID NO: 763777 - RNA, 22 nt, Leptospira interrogans serovar lai str. 56601
auaaaauuugauuccaagauuu

SEQ ID NO: 763778 - RNA, 21 nt, Leptospira interrogans serovar lai str. 56601
auaaaaaguuuguuuguaaag

SEQ ID NO: 763779 - RNA, 19 nt, Leptospira interrogans serovar lai str. 56601
auaaaaauaaagaaacugu

SEQ ID NO: 763780 - RNA, 12 nt, Leptospira interrogans serovar lai str. 56601
auaaaaagaacc

SEQ ID NO: 763781 - RNA, 12 nt, Leptospira interrogans serovar lai str. 56601
auaaaaagaaga

SEQ ID NO: 763782 - RNA, 11 nt, Leptospira interrogans serovar lai str. 56601
auaaaaaaaug

SEQ ID NO: 763783 - RNA, 19 nt, Leptospira interrogans serovar lai str. 56601
auaaaaaaaugaauuuuuu

SEQ ID NO: 763784 - RNA, 12 nt, Leptospira interrogans serovar lai str. 56601
auaaaaaaaugu

SEQ ID NO: 763785 - RNA, 20 nt, Leptospira interrogans serovar lai str. 56601
auaaaaaaauucauuucguu

SEQ ID NO: 763786 - RNA, 19 nt, Leptospira interrogans serovar lai str. 56601
auaaaccaucucaaaaaca

SEQ ID NO: 763787 - RNA, 17 nt, Leptospira interrogans serovar lai str. 56601
auaaaccgauuuuccca

SEQ ID NO: 763788 - RNA, 20 nt, Leptospira interrogans serovar lai str. 56601
auaaacuucuauuuuauaaa

SEQ ID NO: 763789 - RNA, 19 nt, Leptospira interrogans serovar lai str. 56601
auaaacuucucaaauugaa

SEQ ID NO: 763790 - RNA, 17 nt, Leptospira interrogans serovar lai str. 56601
auaaacuucucuuaaaa

SEQ ID NO: 763791 - RNA, 19 nt, Leptospira interrogans serovar lai str. 56601
auaaacuucucuuaaaauu

SEQ ID NO: 763792 - RNA, 22 nt, Leptospira interrogans serovar lai str. 56601
auaaacuucucuuaaaauuuag

SEQ ID NO: 763793 - RNA, 19 nt, Leptospira interrogans serovar lai str. 56601
auaaagauucacuuagaaa

SEQ ID NO: 763794 - RNA, 20 nt, Leptospira interrogans serovar lai str. 56601
auaaagauuuccuaauaacu

SEQ ID NO: 763795 - RNA, 12 nt, Leptospira interrogans serovar lai str. 56601
auaaauauuucc

SEQ ID NO: 763796 - RNA, 13 nt, Leptospira interrogans serovar lai str. 56601
auaaauauuucca

SEQ ID NO: 763797 - RNA, 20 nt, Leptospira interrogans serovar lai str. 56601
auaaaucuguacuuaaauuu

SEQ ID NO: 763798 - RNA, 18 nt, Leptospira interrogans serovar lai str. 56601
auaaauaaugaaaacuug

SEQ ID NO: 763799 - RNA, 18 nt, Leptospira interrogans serovar lai str. 56601
auaaauauuaauuuaaaa

SEQ ID NO: 763800 - RNA, 19 nt, Leptospira interrogans serovar lai str. 56601
auaaauauuaauuuaaaaa

SEQ ID NO: 763801 - RNA, 22 nt, Leptospira interrogans serovar lai str. 56601
auaaauauuaauuuaaaaacaa

SEQ ID NO: 763802 - RNA, 23 nt, Leptospira interrogans serovar lai str. 56601
auaaauauuaauuuaaaaacaag

SEQ ID NO: 763803 - RNA, 16 nt, Leptospira interrogans serovar lai str. 56601
auaaaguauagaacag

SEQ ID NO: 763804 - RNA, 13 nt, Leptospira interrogans serovar lai str. 56601
auaaaguaaaauu

SEQ ID NO: 763805 - RNA, 22 nt, Leptospira interrogans serovar lai str. 56601
auaaagguuuuauagucuucaa

SEQ ID NO: 763806 - RNA, 19 nt, Leptospira interrogans serovar lai str. 56601
auaaaggugcaugaaaaua

SEQ ID NO: 763807 - RNA, 17 nt, Leptospira interrogans serovar lai str. 56601
auaaaguaccuaauauu

SEQ ID NO: 763808 - RNA, 15 nt, Leptospira interrogans serovar lai str. 56601
auaaaguaccuauuu

SEQ ID NO: 763809 - RNA, 18 nt, Leptospira interrogans serovar lai str. 56601
auaaaguacuaauucaau

SEQ ID NO: 763810 - RNA, 16 nt, Leptospira interrogans serovar lai str. 56601
auaaaguagacaacua

SEQ ID NO: 763811 - RNA, 18 nt, Leptospira interrogans serovar lai str. 56601
auaaagcgauucuacuua

SEQ ID NO: 763812 - RNA, 15 nt, Leptospira interrogans serovar lai str. 56601
auaaguuguuauaaa

SEQ ID NO: 763813 - RNA, 21 nt, Leptospira interrogans serovar lai str. 56601
auaaguuuucuaguaaaaaug

SEQ ID NO: 763814 - RNA, 18 nt, Leptospira interrogans serovar lai str. 56601
auaaguuuuuauuauaaa

SEQ ID NO: 763815 - RNA, 19 nt, Leptospira interrogans serovar lai str. 56601
auaaguuuuuauuauaaaa

SEQ ID NO: 763816 - RNA, 18 nt, Leptospira interrogans serovar lai str. 56601
auaauaaaauuauuaacu

SEQ ID NO: 763817 - RNA, 17 nt, Leptospira interrogans serovar lai str. 56601
auaaguuaaauuuuuug

SEQ ID NO: 763818 - RNA, 18 nt, Leptospira interrogans serovar lai str. 56601
auaagucgaucuacuaaa

SEQ ID NO: 763819 - RNA, 20 nt, Leptospira interrogans serovar lai str. 56601
auaagguuuuauaaaaugaa

SEQ ID NO: 763820 - RNA, 22 nt, Leptospira interrogans serovar lai str. 56601
auaagguuagauuauuucaaaa

SEQ ID NO: 763821 - RNA, 12 nt, Leptospira interrogans serovar lai str. 56601
auaaguauuaua

SEQ ID NO: 763822 - RNA, 21 nt, Leptospira interrogans serovar lai str. 56601
auaaggcgguaaaacaaaaaa

SEQ ID NO: 763823 - RNA, 19 nt, Leptospira interrogans serovar lai str. 56601
auaagcuaagcauaaaauu

SEQ ID NO: 763824 - RNA, 18 nt, Leptospira interrogans serovar lai str. 56601
auaagcugaacaaacucu

SEQ ID NO: 763825 - RNA, 11 nt, Leptospira interrogans serovar lai str. 56601
auaagcaugag

SEQ ID NO: 763826 - RNA, 23 nt, Leptospira interrogans serovar lai str. 56601
auaagaaucgaaaaaauacaaac

SEQ ID NO: 763827 - RNA, 23 nt, Leptospira interrogans serovar lai str. 56601
auaagagugcagauuaaaaaaua

SEQ ID NO: 763828 - RNA, 20 nt, Leptospira interrogans serovar lai str. 56601
auaagcaaaaauaaaguauu

SEQ ID NO: 763829 - RNA, 14 nt, Leptospira interrogans serovar lai str. 56601
auaagauuuuagaa

SEQ ID NO: 763830 - RNA, 16 nt, Leptospira interrogans serovar lai str. 56601
auaagauuuuagaauc

SEQ ID NO: 763831 - RNA, 18 nt, Leptospira interrogans serovar lai str. 56601
auaagauuuuagaaucag

SEQ ID NO: 763832 - RNA, 15 nt, Leptospira interrogans serovar lai str. 56601
auaagaucuaucuca

SEQ ID NO: 763833 - RNA, 20 nt, Leptospira interrogans serovar lai str. 56601
auaauaaucgcuuucgcauu

SEQ ID NO: 763834 - RNA, 13 nt, Leptospira interrogans serovar lai str. 56601
auaauacaugaau

SEQ ID NO: 763835 - RNA, 22 nt, Leptospira interrogans serovar lai str. 56601
auaauaauuagaaaaauauuuu

SEQ ID NO: 763836 - RNA, 22 nt, Leptospira interrogans serovar lai str. 56601
auaauacaauucugaaauuguu

SEQ ID NO: 763837 - RNA, 21 nt, Leptospira interrogans serovar lai str. 56601
auaauaaauuuuucuggaaaa

SEQ ID NO: 763838 - RNA, 18 nt, Leptospira interrogans serovar lai str. 56601
auaauaacaaaaaaugcu

SEQ ID NO: 763839 - RNA, 23 nt, Leptospira interrogans serovar lai str. 56601
auaauaagagugcagauuaaaaa

SEQ ID NO: 763840 - RNA, 16 nt, Leptospira interrogans serovar lai str. 56601
auaauaccaaguuauu

SEQ ID NO: 763841 - RNA, 22 nt, Leptospira interrogans serovar lai str. 56601
auaauaccuauacaauucuuuc

SEQ ID NO: 763842 - RNA, 13 nt, Leptospira interrogans serovar lai str. 56601
auaauauuuuuau

SEQ ID NO: 763843 - RNA, 12 nt, Leptospira interrogans serovar lai str. 56601
auaauauuuuua

SEQ ID NO: 763844 - RNA, 11 nt, Leptospira interrogans serovar lai str. 56601
auaauauuuau

SEQ ID NO: 763845 - RNA, 13 nt, Leptospira interrogans serovar lai str. 56601
auaauauuuauuu

SEQ ID NO: 763846 - RNA, 15 nt, Leptospira interrogans serovar lai str. 56601
auaauauucuaauuu

SEQ ID NO: 763847 - RNA, 15 nt, Leptospira interrogans serovar lai str. 56601
auaauauuauaaaua

SEQ ID NO: 763848 - RNA, 17 nt, Leptospira interrogans serovar lai str. 56601
auaaucaaauacaaaaa

SEQ ID NO: 763849 - RNA, 18 nt, Leptospira interrogans serovar lai str. 56601
auaaucaaauacaaaaac

SEQ ID NO: 763850 - RNA, 18 nt, Leptospira interrogans serovar lai str. 56601
auaauaguuacgacauuu

SEQ ID NO: 763851 - RNA, 23 nt, Leptospira interrogans serovar lai str. 56601
auaauaguuacgacauuuuaaua

SEQ ID NO: 763852 - RNA, 17 nt, Leptospira interrogans serovar lai str. 56601
auaauauacuaaauuau

SEQ ID NO: 763853 - RNA, 14 nt, Leptospira interrogans serovar lai str. 56601
auaaucuuaauauu

SEQ ID NO: 763854 - RNA, 20 nt, Leptospira interrogans serovar lai str. 56601
auaaucuuaauauuucucuu

SEQ ID NO: 763855 - RNA, 18 nt, Leptospira interrogans serovar lai str. 56601
auaaucuuuugaguauuu

SEQ ID NO: 763856 - RNA, 17 nt, Leptospira interrogans serovar lai str. 56601
auaaucuaagacgaaaa

SEQ ID NO: 763857 - RNA, 20 nt, Leptospira interrogans serovar lai str. 56601
auaaucuaagacgaaaagaa

SEQ ID NO: 763858 - RNA, 12 nt, Leptospira interrogans serovar lai str. 56601
auaaucuaagau

SEQ ID NO: 763859 - RNA, 19 nt, Leptospira interrogans serovar lai str. 56601
auaaucuaagaucaacaca

SEQ ID NO: 763860 - RNA, 15 nt, Leptospira interrogans serovar lai str. 56601
auaaugaaucguaaa

SEQ ID NO: 763861 - RNA, 18 nt, Leptospira interrogans serovar lai str. 56601
auaaugaaucguaaaaaa

SEQ ID NO: 763862 - RNA, 23 nt, Leptospira interrogans serovar lai str. 56601
auaaugaaucguaaaaaaauauu

SEQ ID NO: 763863 - RNA, 14 nt, Leptospira interrogans serovar lai str. 56601
auaauuaaacaaag

SEQ ID NO: 763864 - RNA, 17 nt, Leptospira interrogans serovar lai str. 56601
auaauuaaacaaagaau

SEQ ID NO: 763865 - RNA, 19 nt, Leptospira interrogans serovar lai str. 56601
auaauuaaacaaagaauaa

SEQ ID NO: 763866 - RNA, 16 nt, Leptospira interrogans serovar lai str. 56601
auaauuaaaaagauaa

SEQ ID NO: 763867 - RNA, 18 nt, Leptospira interrogans serovar lai str. 56601
auaauguuugaauuuuua

SEQ ID NO: 763868 - RNA, 19 nt, Leptospira interrogans serovar lai str. 56601
auaauguuugaauuuuuaa

SEQ ID NO: 763869 - RNA, 13 nt, Leptospira interrogans serovar lai str. 56601
auaauguuaauuu

SEQ ID NO: 763870 - RNA, 22 nt, Leptospira interrogans serovar lai str. 56601
aucgcauuugacaauuugugaa

SEQ ID NO: 763871 - RNA, 22 nt, Leptospira interrogans serovar lai str. 56601
aucgcauuuggcaauuugugaa

SEQ ID NO: 763872 - RNA, 19 nt, Leptospira interrogans serovar lai str. 56601
aucgcagguugcaauccaa

SEQ ID NO: 763873 - RNA, 21 nt, Leptospira interrogans serovar lai str. 56601
aucgccguucugggcucaaaa

SEQ ID NO: 763874 - RNA, 23 nt, Leptospira interrogans serovar lai str. 56601
aucgccguucugggcuccaaaag

SEQ ID NO: 763875 - RNA, 14 nt, Leptospira interrogans serovar lai str. 56601
aucgaaaaaauaca

SEQ ID NO: 763876 - RNA, 19 nt, Leptospira interrogans serovar lai str. 56601
aucgauaacuugauuuuac

SEQ ID NO: 763877 - RNA, 19 nt, Leptospira interrogans serovar lai str. 56601
aucgcuaaacuaucuauua

SEQ ID NO: 763878 - RNA, 16 nt, Leptospira interrogans serovar lai str. 56601
aucuaaauuuguaaua

SEQ ID NO: 763879 - RNA, 19 nt, Leptospira interrogans serovar lai str. 56601
aucuacagaacccaauaaa

SEQ ID NO: 763880 - RNA, 18 nt, Leptospira interrogans serovar lai str. 56601
aucuacauaaaaaaggaa

SEQ ID NO: 763881 - RNA, 14 nt, Leptospira interrogans serovar lai str. 56601
aucuacauuggaag

SEQ ID NO: 763882 - RNA, 20 nt, Leptospira interrogans serovar lai str. 56601
aucuaaacuagccccguuuu

SEQ ID NO: 763883 - RNA, 16 nt, Leptospira interrogans serovar lai str. 56601
aucuaaacuuugcaaa

SEQ ID NO: 763884 - RNA, 20 nt, Leptospira interrogans serovar lai str. 56601
aucuaaacuuuguaaaucua

SEQ ID NO: 763885 - RNA, 17 nt, Leptospira interrogans serovar lai str. 56601
aucguguaaaauuuuuu

SEQ ID NO: 763886 - RNA, 21 nt, Leptospira interrogans serovar lai str. 56601
aucguguaacaaagccgcaca

SEQ ID NO: 763887 - RNA, 22 nt, Leptospira interrogans serovar lai str. 56601
aucguguaacaaagccgcacaa

SEQ ID NO: 763888 - RNA, 19 nt, Leptospira interrogans serovar lai str. 56601
aucguguuugagauuaaaa

SEQ ID NO: 763889 - RNA, 23 nt, Leptospira interrogans serovar lai str. 56601
aucguguuugagauuaaaaagaa

SEQ ID NO: 763890 - RNA, 17 nt, Leptospira interrogans serovar lai str. 56601
aucugaaccugcaaauu

SEQ ID NO: 763891 - RNA, 17 nt, Leptospira interrogans serovar lai str. 56601
aucugaaauucaucaaa

SEQ ID NO: 763892 - RNA, 23 nt, Leptospira interrogans serovar lai str. 56601
aucugaauuuuaccaaauuguuu

SEQ ID NO: 763893 - RNA, 16 nt, Leptospira interrogans serovar lai str. 56601
aucugauauuuuaaau

SEQ ID NO: 763894 - RNA, 17 nt, Leptospira interrogans serovar lai str. 56601
aucugauauuuuaaauu

SEQ ID NO: 763895 - RNA, 19 nt, Leptospira interrogans serovar lai str. 56601
aucugauauuuuaaauuga

SEQ ID NO: 763896 - RNA, 22 nt, Leptospira interrogans serovar lai str. 56601
aucugauugagaaaauaaaaaa

SEQ ID NO: 763897 - RNA, 16 nt, Leptospira interrogans serovar lai str. 56601
aucugcaucuuuucua

SEQ ID NO: 763898 - RNA, 14 nt, Leptospira interrogans serovar lai str. 56601
aucugcgauuaaag

SEQ ID NO: 763899 - RNA, 23 nt, Leptospira interrogans serovar lai str. 56601
aucugcgauuaaagauuuuucuu

SEQ ID NO: 763900 - RNA, 17 nt, Leptospira interrogans serovar lai str. 56601
aucucuauaaaaucaag

SEQ ID NO: 763901 - RNA, 16 nt, Leptospira interrogans serovar lai str. 56601
aucucguuaaauuuuc

SEQ ID NO: 763902 - RNA, 19 nt, Leptospira interrogans serovar lai str. 56601
aucucguauugaauuuuuu

SEQ ID NO: 763903 - RNA, 17 nt, Leptospira interrogans serovar lai str. 56601
aucucugauaauuuuuu

SEQ ID NO: 763904 - RNA, 19 nt, Leptospira interrogans serovar lai str. 56601
aucucgauuucuaaaaugu

SEQ ID NO: 763905 - RNA, 18 nt, Leptospira interrogans serovar lai str. 56601
aucuccuugaaucaaaua

SEQ ID NO: 763906 - RNA, 17 nt, Leptospira interrogans serovar lai str. 56601
aucucccgaaugaauuu

SEQ ID NO: 763907 - RNA, 15 nt, Leptospira interrogans serovar lai str. 56601
aucuccgcucuauuu

SEQ ID NO: 763908 - RNA, 18 nt, Leptospira interrogans serovar lai str. 56601
aucuccaaaaucauuuaa

SEQ ID NO: 763909 - RNA, 12 nt, Leptospira interrogans serovar lai str. 56601
aucuccacuuga

SEQ ID NO: 763910 - RNA, 18 nt, Leptospira interrogans serovar lai str. 56601
aucucagaaaauuuuaca

SEQ ID NO: 763911 - RNA, 14 nt, Leptospira interrogans serovar lai str. 56601
aucucaaucaaaau

SEQ ID NO: 763912 - RNA, 23 nt, Leptospira interrogans serovar lai str. 56601
aucuauuuccguuauauuaaaau

SEQ ID NO: 763913 - RNA, 14 nt, Leptospira interrogans serovar lai str. 56601
aucuauucuuaaaa

SEQ ID NO: 763914 - RNA, 17 nt, Leptospira interrogans serovar lai str. 56601
aucuauucuuaaaaugu

SEQ ID NO: 763915 - RNA, 21 nt, Leptospira interrogans serovar lai str. 56601
aucuauucuuaaaauguagga

SEQ ID NO: 763916 - RNA, 14 nt, Leptospira interrogans serovar lai str. 56601
aucuauugaaacaa

SEQ ID NO: 763917 - RNA, 22 nt, Leptospira interrogans serovar lai str. 56601
aucucaaaaauacuuugaacuu

SEQ ID NO: 763918 - RNA, 12 nt, Leptospira interrogans serovar lai str. 56601
aucuauuuuuga

SEQ ID NO: 763919 - RNA, 17 nt, Leptospira interrogans serovar lai str. 56601
aucucaauauaaaucug

SEQ ID NO: 763920 - RNA, 23 nt, Leptospira interrogans serovar lai str. 56601
aucuauauuuuacaguaaaacuu

SEQ ID NO: 763921 - RNA, 15 nt, Leptospira interrogans serovar lai str. 56601
aucuaucuuuucaaa

SEQ ID NO: 763922 - RNA, 18 nt, Leptospira interrogans serovar lai str. 56601
aucuaucucaaaaauacu

SEQ ID NO: 763923 - RNA, 15 nt, Leptospira interrogans serovar lai str. 56601
aucuaucucaaaaua

SEQ ID NO: 763924 - RNA, 19 nt, Leptospira interrogans serovar lai str. 56601
aucuaugauucugaaaaaa

SEQ ID NO: 763925 - RNA, 22 nt, Leptospira interrogans serovar lai str. 56601
aucuauuagaacaucaauuuua

SEQ ID NO: 763926 - RNA, 15 nt, Leptospira interrogans serovar lai str. 56601
aucuacuauuauaau

SEQ ID NO: 763927 - RNA, 17 nt, Leptospira interrogans serovar lai str. 56601
aucuacguuucaauuac

SEQ ID NO: 763928 - RNA, 12 nt, Leptospira interrogans serovar lai str. 56601
aucuacuaaauc

SEQ ID NO: 763929 - RNA, 21 nt, Leptospira interrogans serovar lai str. 56601
aucuagcguucugaggaggau

SEQ ID NO: 763930 - RNA, 13 nt, Leptospira interrogans serovar lai str. 56601
aucuagauuuuac

SEQ ID NO: 763931 - RNA, 22 nt, Leptospira interrogans serovar lai str. 56601
aucuagauuuuacgauuaaauu

SEQ ID NO: 763932 - RNA, 19 nt, Leptospira interrogans serovar lai str. 56601
aucuagcaacacauuuuca

SEQ ID NO: 763933 - RNA, 14 nt, Leptospira interrogans serovar lai str. 56601
augcaguaguuccu

SEQ ID NO: 763934 - RNA, 16 nt, Leptospira interrogans serovar lai str. 56601
augcaguaguuccuac

SEQ ID NO: 763935 - RNA, 20 nt, Leptospira interrogans serovar lai str. 56601
augcaguaguuccuauaaau

SEQ ID NO: 763936 - RNA, 13 nt, Leptospira interrogans serovar lai str. 56601
augcagcuauuuu

SEQ ID NO: 763937 - RNA, 22 nt, Leptospira interrogans serovar lai str. 56601
augcagcuucuuccaaagucaa

SEQ ID NO: 763938 - RNA, 16 nt, Leptospira interrogans serovar lai str. 56601
augcaggaaacauaau

SEQ ID NO: 763939 - RNA, 15 nt, Leptospira interrogans serovar lai str. 56601
augcaggaaacauac

SEQ ID NO: 763940 - RNA, 17 nt, Leptospira interrogans serovar lai str. 56601
augcaauuuauugacug

SEQ ID NO: 763941 - RNA, 14 nt, Leptospira interrogans serovar lai str. 56601
augcaauaguuccu

SEQ ID NO: 763942 - RNA, 15 nt, Leptospira interrogans serovar lai str. 56601
augcaauaguuccug

SEQ ID NO: 763943 - RNA, 13 nt, Leptospira interrogans serovar lai str. 56601
augauuuguaaua

SEQ ID NO: 763944 - RNA, 13 nt, Leptospira interrogans serovar lai str. 56601
augcaaauacaac

SEQ ID NO: 763945 - RNA, 14 nt, Leptospira interrogans serovar lai str. 56601
augcaaauacaacu

SEQ ID NO: 763946 - RNA, 15 nt, Leptospira interrogans serovar lai str. 56601
augcaaccuuacugc

SEQ ID NO: 763947 - RNA, 20 nt, Leptospira interrogans serovar lai str. 56601
augauaaauuguuucauaaa

SEQ ID NO: 763948 - RNA, 22 nt, Leptospira interrogans serovar lai str. 56601
augauaaauuguuucauaaaau

SEQ ID NO: 763949 - RNA, 19 nt, Leptospira interrogans serovar lai str. 56601
augaguuuuagaauauuaa

SEQ ID NO: 763950 - RNA, 15 nt, Leptospira interrogans serovar lai str. 56601
augauaaaaauuguu

SEQ ID NO: 763951 - RNA, 12 nt, Leptospira interrogans serovar lai str. 56601
augaguucccac

SEQ ID NO: 763952 - RNA, 14 nt, Leptospira interrogans serovar lai str. 56601
augaguucccacaa

SEQ ID NO: 763953 - RNA, 23 nt, Leptospira interrogans serovar lai str. 56601
augaguucccacaaauuccugcc

SEQ ID NO: 763954 - RNA, 22 nt, Leptospira interrogans serovar lai str. 56601
augaguucccacauuuuuaaaa

SEQ ID NO: 763955 - RNA, 21 nt, Leptospira interrogans serovar lai str. 56601
augaguuucuccacuuaaaaa

SEQ ID NO: 763956 - RNA, 11 nt, Leptospira interrogans serovar lai str. 56601
augaguuccua

SEQ ID NO: 763957 - RNA, 15 nt, Leptospira interrogans serovar lai str. 56601
augaguucacuucuu

SEQ ID NO: 763958 - RNA, 14 nt, Leptospira interrogans serovar lai str. 56601
augaauuaaagaag

SEQ ID NO: 763959 - RNA, 17 nt, Leptospira interrogans serovar lai str. 56601
augaauugaauuuuuua

SEQ ID NO: 763960 - RNA, 20 nt, Leptospira interrogans serovar lai str. 56601
augaauugaauuuuuuaaau

SEQ ID NO: 763961 - RNA, 14 nt, Leptospira interrogans serovar lai str. 56601
augaauuguaaaaa

SEQ ID NO: 763962 - RNA, 14 nt, Leptospira interrogans serovar lai str. 56601
augaauucucuauc

SEQ ID NO: 763963 - RNA, 19 nt, Leptospira interrogans serovar lai str. 56601
augaauucucuaucuuguu

SEQ ID NO: 763964 - RNA, 22 nt, Leptospira interrogans serovar lai str. 56601
augaaucuuucauguauuacuc

SEQ ID NO: 763965 - RNA, 13 nt, Leptospira interrogans serovar lai str. 56601
augaauaaaaaag

SEQ ID NO: 763966 - RNA, 14 nt, Leptospira interrogans serovar lai str. 56601
augaaguaaguuau

SEQ ID NO: 763967 - RNA, 19 nt, Leptospira interrogans serovar lai str. 56601
augaaguaugaaguaaguu

SEQ ID NO: 763968 - RNA, 15 nt, Leptospira interrogans serovar lai str. 56601
augaaucguaaaaaa

SEQ ID NO: 763969 - RNA, 20 nt, Leptospira interrogans serovar lai str. 56601
augaaucguaaaaaaauauu

SEQ ID NO: 763970 - RNA, 22 nt, Leptospira interrogans serovar lai str. 56601
augaaucguaaaaaaauauuuc

SEQ ID NO: 763971 - RNA, 18 nt, Leptospira interrogans serovar lai str. 56601
augaauauuuuccaaaaa

SEQ ID NO: 763972 - RNA, 18 nt, Leptospira interrogans serovar lai str. 56601
augaauaggcgauuuuac

SEQ ID NO: 763973 - RNA, 17 nt, Leptospira interrogans serovar lai str. 56601
augacgauuuucuccuc

SEQ ID NO: 763974 - RNA, 21 nt, Leptospira interrogans serovar lai str. 56601
augacuugcauuuaauauauu

SEQ ID NO: 763975 - RNA, 14 nt, Leptospira interrogans serovar lai str. 56601
augacuuaaucugu

SEQ ID NO: 763976 - RNA, 19 nt, Leptospira interrogans serovar lai str. 56601
augacuuaaucugugggaa

SEQ ID NO: 763977 - RNA, 12 nt, Leptospira interrogans serovar lai str. 56601
augagaaacaaa

SEQ ID NO: 763978 - RNA, 17 nt, Leptospira interrogans serovar lai str. 56601
augagaaacaaaguaga

SEQ ID NO: 763979 - RNA, 14 nt, Leptospira interrogans serovar lai str. 56601
augagaaagaauuu

SEQ ID NO: 763980 - RNA, 16 nt, Leptospira interrogans serovar lai str. 56601
augagucccuacaauu

SEQ ID NO: 763981 - RNA, 23 nt, Leptospira interrogans serovar lai str. 56601
augagucuuuuuacuugcaaaaa

SEQ ID NO: 763982 - RNA, 15 nt, Leptospira interrogans serovar lai str. 56601
augaguaaacuauug

SEQ ID NO: 763983 - RNA, 13 nt, Leptospira interrogans serovar lai str. 56601
augagauuuuugg

SEQ ID NO: 763984 - RNA, 15 nt, Leptospira interrogans serovar lai str. 56601
augagauuaaaacug

SEQ ID NO: 763985 - RNA, 14 nt, Leptospira interrogans serovar lai str. 56601
augagaguucccac

SEQ ID NO: 763986 - RNA, 17 nt, Leptospira interrogans serovar lai str. 56601
augagaaggaucaaaac

SEQ ID NO: 763987 - RNA, 17 nt, Leptospira interrogans serovar lai str. 56601
aucuuuuagauauuuau

SEQ ID NO: 763988 - RNA, 16 nt, Leptospira interrogans serovar lai str. 56601
aucuuucgauuuuaaa

SEQ ID NO: 763989 - RNA, 21 nt, Leptospira interrogans serovar lai str. 56601
aucuuuugaaaguuuuuuuau

SEQ ID NO: 763990 - RNA, 15 nt, Leptospira interrogans serovar lai str. 56601
aucuuuucaaaagua

SEQ ID NO: 763991 - RNA, 15 nt, Leptospira interrogans serovar lai str. 56601
aucuuuucuuaaaau

SEQ ID NO: 763992 - RNA, 16 nt, Leptospira interrogans serovar lai str. 56601
augaaaauaauaccaa

SEQ ID NO: 763993 - RNA, 21 nt, Leptospira interrogans serovar lai str. 56601
augaaaauaauaucaaaauga

SEQ ID NO: 763994 - RNA, 12 nt, Leptospira interrogans serovar lai str. 56601
augaaaauucuu

SEQ ID NO: 763995 - RNA, 15 nt, Leptospira interrogans serovar lai str. 56601
augaaaauuauaagu

SEQ ID NO: 763996 - RNA, 22 nt, Leptospira interrogans serovar lai str. 56601
augaaagaaacauaaugcaaua

SEQ ID NO: 763997 - RNA, 16 nt, Leptospira interrogans serovar lai str. 56601
augaagagaaaguaac

SEQ ID NO: 763998 - RNA, 19 nt, Leptospira interrogans serovar lai str. 56601
augaagacgcuuaaaaaug

SEQ ID NO: 763999 - RNA, 21 nt, Leptospira interrogans serovar lai str. 56601
augaagagguacagaaacaaa

SEQ ID NO: 764000 - RNA, 19 nt, Leptospira interrogans serovar lai str. 56601
augaacucuuacaauuuca

SEQ ID NO: 764001 - RNA, 20 nt, Leptospira interrogans serovar lai str. 56601
augaaaucuacaaaacuguu

SEQ ID NO: 764002 - RNA, 19 nt, Leptospira interrogans serovar lai str. 56601
augaaaucuaguucaacgu

SEQ ID NO: 764003 - RNA, 13 nt, Leptospira interrogans serovar lai str. 56601
augaaauagucaa

SEQ ID NO: 764004 - RNA, 20 nt, Leptospira interrogans serovar lai str. 56601
augaagaagcuaaaauugaa

SEQ ID NO: 764005 - RNA, 17 nt, Leptospira interrogans serovar lai str. 56601
augaaauacaaaaagaa

SEQ ID NO: 764006 - RNA, 11 nt, Leptospira interrogans serovar lai str. 56601
augaaauaaag

SEQ ID NO: 764007 - RNA, 13 nt, Leptospira interrogans serovar lai str. 56601
aucuuuaaaagag

SEQ ID NO: 764008 - RNA, 20 nt, Leptospira interrogans serovar lai str. 56601
aucuugagauccaauuauuu

SEQ ID NO: 764009 - RNA, 15 nt, Leptospira interrogans serovar lai str. 56601
aucuugaaucgaauc

SEQ ID NO: 764010 - RNA, 21 nt, Leptospira interrogans serovar lai str. 56601
aucuugaaucgaaucuuuugc

SEQ ID NO: 764011 - RNA, 12 nt, Leptospira interrogans serovar lai str. 56601
aucuuuaaguuu

SEQ ID NO: 764012 - RNA, 20 nt, Leptospira interrogans serovar lai str. 56601
aucuuuaaaauacuuuaccg

SEQ ID NO: 764013 - RNA, 22 nt, Leptospira interrogans serovar lai str. 56601
aucuuuaagagccuuucacauc

SEQ ID NO: 764014 - RNA, 19 nt, Leptospira interrogans serovar lai str. 56601
aucuuucacuuuaaaacau

SEQ ID NO: 764015 - RNA, 18 nt, Leptospira interrogans serovar lai str. 56601
aucuuucauguauuacuc

SEQ ID NO: 764016 - RNA, 17 nt, Leptospira interrogans serovar lai str. 56601
aucuucucuagaaacug

SEQ ID NO: 764017 - RNA, 17 nt, Leptospira interrogans serovar lai str. 56601
aucugggcaaauuuagc

SEQ ID NO: 764018 - RNA, 23 nt, Leptospira interrogans serovar lai str. 56601
aucuucuucauccuggauauaua

SEQ ID NO: 764019 - RNA, 16 nt, Leptospira interrogans serovar lai str. 56601
aucuucuguaaaacuu

SEQ ID NO: 764020 - RNA, 14 nt, Leptospira interrogans serovar lai str. 56601
augugacuuuaauu

SEQ ID NO: 764021 - RNA, 15 nt, Leptospira interrogans serovar lai str. 56601
augugagaguuccca

SEQ ID NO: 764022 - RNA, 23 nt, Leptospira interrogans serovar lai str. 56601
augugaguucccacauuuuaaag

SEQ ID NO: 764023 - RNA, 14 nt, Leptospira interrogans serovar lai str. 56601
augugaguucccau

SEQ ID NO: 764024 - RNA, 20 nt, Leptospira interrogans serovar lai str. 56601
augugaguuuuaaaacucac

SEQ ID NO: 764025 - RNA, 16 nt, Leptospira interrogans serovar lai str. 56601
augugaauucagaaaa

SEQ ID NO: 764026 - RNA, 17 nt, Leptospira interrogans serovar lai str. 56601
auguccuuuuuuucuuu

SEQ ID NO: 764027 - RNA, 12 nt, Leptospira interrogans serovar lai str. 56601
auguuauuuuua

SEQ ID NO: 764028 - RNA, 14 nt, Leptospira interrogans serovar lai str. 56601
auguuauuuuuaag

SEQ ID NO: 764029 - RNA, 14 nt, Leptospira interrogans serovar lai str. 56601
auguuauuuuugca

SEQ ID NO: 764030 - RNA, 23 nt, Leptospira interrogans serovar lai str. 56601
auguuaaaaaacuauaaaucauu

SEQ ID NO: 764031 - RNA, 19 nt, Leptospira interrogans serovar lai str. 56601
augugcaaaggaguauuuu

SEQ ID NO: 764032 - RNA, 19 nt, Leptospira interrogans serovar lai str. 56601
augugggaacuaccacaaa

SEQ ID NO: 764033 - RNA, 21 nt, Leptospira interrogans serovar lai str. 56601
augugggaacuacuacaaaaa

SEQ ID NO: 764034 - RNA, 15 nt, Leptospira interrogans serovar lai str. 56601
augugggaacuacuc

SEQ ID NO: 764035 - RNA, 21 nt, Leptospira interrogans serovar lai str. 56601
auguauuccaugguuuuuuca

SEQ ID NO: 764036 - RNA, 17 nt, Leptospira interrogans serovar lai str. 56601
auguauggcucauuuuu

SEQ ID NO: 764037 - RNA, 22 nt, Leptospira interrogans serovar lai str. 56601
auguauggcucauuuuucuuaa

SEQ ID NO: 764038 - RNA, 22 nt, Leptospira interrogans serovar lai str. 56601
auguauuacucagaguuauaua

SEQ ID NO: 764039 - RNA, 19 nt, Leptospira interrogans serovar lai str. 56601
auguauauucguuguuucu

SEQ ID NO: 764040 - RNA, 23 nt, Leptospira interrogans serovar lai str. 56601
auguaggaacccauacaaaauuu

SEQ ID NO: 764041 - RNA, 23 nt, Leptospira interrogans serovar lai str. 56601
auguaauauaaguuaagugaaaa

SEQ ID NO: 764042 - RNA, 21 nt, Leptospira interrogans serovar lai str. 56601
auguaaucuauaauaagauuu

SEQ ID NO: 764043 - RNA, 13 nt, Leptospira interrogans serovar lai str. 56601
augguuuuuucaa

SEQ ID NO: 764044 - RNA, 20 nt, Leptospira interrogans serovar lai str. 56601
auguaaaaacuaccacaaau

SEQ ID NO: 764045 - RNA, 15 nt, Leptospira interrogans serovar lai str. 56601
auguaagaaaaacua

SEQ ID NO: 764046 - RNA, 21 nt, Leptospira interrogans serovar lai str. 56601
auguaagaaacucauuuuucu

SEQ ID NO: 764047 - RNA, 21 nt, Leptospira interrogans serovar lai str. 56601
auguaaaagcuuauacuuuaa

SEQ ID NO: 764048 - RNA, 19 nt, Leptospira interrogans serovar lai str. 56601
augguuguuaggauaaaag

SEQ ID NO: 764049 - RNA, 16 nt, Leptospira interrogans serovar lai str. 56601
augguuucaauuuaaa

SEQ ID NO: 764050 - RNA, 20 nt, Leptospira interrogans serovar lai str. 56601
auggcucugaguagaaaguu

SEQ ID NO: 764051 - RNA, 22 nt, Leptospira interrogans serovar lai str. 56601
auggcucauuuuucuuaaaaaa

SEQ ID NO: 764052 - RNA, 13 nt, Leptospira interrogans serovar lai str. 56601
augggaccaagag

SEQ ID NO: 764053 - RNA, 20 nt, Leptospira interrogans serovar lai str. 56601
augggccccaccuaaaauga

SEQ ID NO: 764054 - RNA, 14 nt, Leptospira interrogans serovar lai str. 56601
augguaaggaaccc

SEQ ID NO: 764055 - RNA, 17 nt, Leptospira interrogans serovar lai str. 56601
auggguuuucauuuuua

SEQ ID NO: 764056 - RNA, 20 nt, Leptospira interrogans serovar lai str. 56601
auggguuuucauuuuuacaa

SEQ ID NO: 764057 - RNA, 22 nt, Leptospira interrogans serovar lai str. 56601
auggucgcucugugaaacucag

SEQ ID NO: 764058 - RNA, 17 nt, Leptospira interrogans serovar lai str. 56601
auuaaucuguaaaucaa

SEQ ID NO: 764059 - RNA, 22 nt, Leptospira interrogans serovar lai str. 56601
auuaauccucuuucguuuuuuu

SEQ ID NO: 764060 - RNA, 20 nt, Leptospira interrogans serovar lai str. 56601
auuaaugcgaaaauuuaacu

SEQ ID NO: 764061 - RNA, 22 nt, Leptospira interrogans serovar lai str. 56601
auuaauagcuugucacuauuuu

SEQ ID NO: 764062 - RNA, 19 nt, Leptospira interrogans serovar lai str. 56601
auuaauauucuaauucauu

SEQ ID NO: 764063 - RNA, 12 nt, Leptospira interrogans serovar lai str. 56601
auuaauauuuau

SEQ ID NO: 764064 - RNA, 15 nt, Leptospira interrogans serovar lai str. 56601
auuaauauuuauaaa

SEQ ID NO: 764065 - RNA, 15 nt, Leptospira interrogans serovar lai str. 56601
auuaaguuuuuuaaa

SEQ ID NO: 764066 - RNA, 16 nt, Leptospira interrogans serovar lai str. 56601
auuaaguuuuuuaaau

SEQ ID NO: 764067 - RNA, 19 nt, Leptospira interrogans serovar lai str. 56601
auuaaguuuuuuaaauuua

SEQ ID NO: 764068 - RNA, 15 nt, Leptospira interrogans serovar lai str. 56601
auuaaguaguuuuuu

SEQ ID NO: 764069 - RNA, 19 nt, Leptospira interrogans serovar lai str. 56601
auuaagucccauuuagcaa

SEQ ID NO: 764070 - RNA, 16 nt, Leptospira interrogans serovar lai str. 56601
auuaaguuacauuaug

SEQ ID NO: 764071 - RNA, 23 nt, Leptospira interrogans serovar lai str. 56601
auuaagucacauuguguuuuuua

SEQ ID NO: 764072 - RNA, 21 nt, Leptospira interrogans serovar lai str. 56601
auuaaguuuauucaauuuuag

SEQ ID NO: 764073 - RNA, 13 nt, Leptospira interrogans serovar lai str. 56601
auuaaauucuaca

SEQ ID NO: 764074 - RNA, 22 nt, Leptospira interrogans serovar lai str. 56601
auuaaauucuagcgucuaaaaa

SEQ ID NO: 764075 - RNA, 12 nt, Leptospira interrogans serovar lai str. 56601
auuaaauuuuua

SEQ ID NO: 764076 - RNA, 19 nt, Leptospira interrogans serovar lai str. 56601
auuaaauuuuuauacuuuu

SEQ ID NO: 764077 - RNA, 13 nt, Leptospira interrogans serovar lai str. 56601
auuaacaaaacug

SEQ ID NO: 764078 - RNA, 16 nt, Leptospira interrogans serovar lai str. 56601
auuaaaugaaguguaa

SEQ ID NO: 764079 - RNA, 14 nt, Leptospira interrogans serovar lai str. 56601
auuaacaaucaauu

SEQ ID NO: 764080 - RNA, 16 nt, Leptospira interrogans serovar lai str. 56601
auuaacaaauuuaaaa

SEQ ID NO: 764081 - RNA, 14 nt, Leptospira interrogans serovar lai str. 56601
auuaacagccgaau

SEQ ID NO: 764082 - RNA, 13 nt, Leptospira interrogans serovar lai str. 56601
auuaacuuuacau

SEQ ID NO: 764083 - RNA, 18 nt, Leptospira interrogans serovar lai str. 56601
auuaacuuuacaucaauu

SEQ ID NO: 764084 - RNA, 22 nt, Leptospira interrogans serovar lai str. 56601
auuaacuuucuucgauuucuuu

SEQ ID NO: 764085 - RNA, 20 nt, Leptospira interrogans serovar lai str. 56601
auuaagcagaagcuuuauua

SEQ ID NO: 764086 - RNA, 17 nt, Leptospira interrogans serovar lai str. 56601
auuaaccguagauuuua

SEQ ID NO: 764087 - RNA, 12 nt, Leptospira interrogans serovar lai str. 56601
auuaaaaauuuu

SEQ ID NO: 764088 - RNA, 12 nt, Leptospira interrogans serovar lai str. 56601
auuaaaaaguuu

SEQ ID NO: 764089 - RNA, 21 nt, Leptospira interrogans serovar lai str. 56601
auuaaaacgauaagucucucu

SEQ ID NO: 764090 - RNA, 12 nt, Leptospira interrogans serovar lai str. 56601
auuaaaauaaac

SEQ ID NO: 764091 - RNA, 14 nt, Leptospira interrogans serovar lai str. 56601
auuaaaauaaacua

SEQ ID NO: 764092 - RNA, 13 nt, Leptospira interrogans serovar lai str. 56601
auuaaaauaggau

SEQ ID NO: 764093 - RNA, 19 nt, Leptospira interrogans serovar lai str. 56601
auuaaaauguacaauuaaa

SEQ ID NO: 764094 - RNA, 15 nt, Leptospira interrogans serovar lai str. 56601
auuaaaauccucaac

SEQ ID NO: 764095 - RNA, 22 nt, Leptospira interrogans serovar lai str. 56601
auuaaaaauaucuaaagaauga

SEQ ID NO: 764096 - RNA, 11 nt, Leptospira interrogans serovar lai str. 56601
auuaaaaagaa

SEQ ID NO: 764097 - RNA, 15 nt, Leptospira interrogans serovar lai str. 56601
auuaaaaaaauaaua

SEQ ID NO: 764098 - RNA, 16 nt, Leptospira interrogans serovar lai str. 56601
auguuuuuuauuuaaa

SEQ ID NO: 764099 - RNA, 20 nt, Leptospira interrogans serovar lai str. 56601
auuaaaaaaaaauguaaaaa

SEQ ID NO: 764100 - RNA, 20 nt, Leptospira interrogans serovar lai str. 56601
auguuuuucugauagagaaa

SEQ ID NO: 764101 - RNA, 17 nt, Leptospira interrogans serovar lai str. 56601
auguuuuguuaugauau

SEQ ID NO: 764102 - RNA, 18 nt, Leptospira interrogans serovar lai str. 56601
auguuuuuaaaaucuucu

SEQ ID NO: 764103 - RNA, 14 nt, Leptospira interrogans serovar lai str. 56601
auuaaacccauuuu

SEQ ID NO: 764104 - RNA, 18 nt, Leptospira interrogans serovar lai str. 56601
auuaaaccgguaaaaagu

SEQ ID NO: 764105 - RNA, 20 nt, Leptospira interrogans serovar lai str. 56601
auuaaaccgguaaaaaguaa

SEQ ID NO: 764106 - RNA, 21 nt, Leptospira interrogans serovar lai str. 56601
auuaaaccgguaaaaaguaaa

SEQ ID NO: 764107 - RNA, 22 nt, Leptospira interrogans serovar lai str. 56601
auuaaaccgguaaaaaguaaaa

SEQ ID NO: 764108 - RNA, 15 nt, Leptospira interrogans serovar lai str. 56601
auuaaacaaagaaua

SEQ ID NO: 764109 - RNA, 21 nt, Leptospira interrogans serovar lai str. 56601
auuaaaauucuagaaagaauu

SEQ ID NO: 764110 - RNA, 15 nt, Leptospira interrogans serovar lai str. 56601
auuaaacuucaaaaa

SEQ ID NO: 764111 - RNA, 21 nt, Leptospira interrogans serovar lai str. 56601
auuaaaguauuaauuuaauca

SEQ ID NO: 764112 - RNA, 22 nt, Leptospira interrogans serovar lai str. 56601
auuaaaguccaaaucaaaaaag

SEQ ID NO: 764113 - RNA, 15 nt, Leptospira interrogans serovar lai str. 56601
auguuguuuguggau

SEQ ID NO: 764114 - RNA, 15 nt, Leptospira interrogans serovar lai str. 56601
auguuuaaagaauuu

SEQ ID NO: 764115 - RNA, 21 nt, Leptospira interrogans serovar lai str. 56601
auguuuacuugaaaauaaaaa

SEQ ID NO: 764116 - RNA, 16 nt, Leptospira interrogans serovar lai str. 56601
auguuucuugugucaa

SEQ ID NO: 764117 - RNA, 23 nt, Leptospira interrogans serovar lai str. 56601
auguuucaagacaacagaacaaa

SEQ ID NO: 764118 - RNA, 21 nt, Leptospira interrogans serovar lai str. 56601
auguuucaguauucuagaaua

SEQ ID NO: 764119 - RNA, 18 nt, Leptospira interrogans serovar lai str. 56601
auguuugagguuuuaaaa

SEQ ID NO: 764120 - RNA, 16 nt, Leptospira interrogans serovar lai str. 56601
auguuuguccuagauc

SEQ ID NO: 764121 - RNA, 16 nt, Leptospira interrogans serovar lai str. 56601
auuaucuuuauauuau

SEQ ID NO: 764122 - RNA, 19 nt, Leptospira interrogans serovar lai str. 56601
auuaucuuucgauuuuaaa

SEQ ID NO: 764123 - RNA, 17 nt, Leptospira interrogans serovar lai str. 56601
auuaucuuguguuucau

SEQ ID NO: 764124 - RNA, 18 nt, Leptospira interrogans serovar lai str. 56601
auuaucuucuaauuaaau

SEQ ID NO: 764125 - RNA, 14 nt, Leptospira interrogans serovar lai str. 56601
auuaugaauuuuua

SEQ ID NO: 764126 - RNA, 16 nt, Leptospira interrogans serovar lai str. 56601
auuaugauagucaaaa

SEQ ID NO: 764127 - RNA, 15 nt, Leptospira interrogans serovar lai str. 56601
auuaucccaguugag

SEQ ID NO: 764128 - RNA, 18 nt, Leptospira interrogans serovar lai str. 56601
auuauccguuuauccuaa

SEQ ID NO: 764129 - RNA, 14 nt, Leptospira interrogans serovar lai str. 56601
auuauuauauuuaa

SEQ ID NO: 764130 - RNA, 22 nt, Leptospira interrogans serovar lai str. 56601
auuauuagaguuguugaaaaau

SEQ ID NO: 764131 - RNA, 14 nt, Leptospira interrogans serovar lai str. 56601
auuauguuugccau

SEQ ID NO: 764132 - RNA, 14 nt, Leptospira interrogans serovar lai str. 56601
auuaugccgaauuc

SEQ ID NO: 764133 - RNA, 14 nt, Leptospira interrogans serovar lai str. 56601
auuaugcaguauuu

SEQ ID NO: 764134 - RNA, 15 nt, Leptospira interrogans serovar lai str. 56601
auuaugccucuuuau

SEQ ID NO: 764135 - RNA, 18 nt, Leptospira interrogans serovar lai str. 56601
auuaugauuuuuuugaaa

SEQ ID NO: 764136 - RNA, 17 nt, Leptospira interrogans serovar lai str. 56601
auuauggacuauuuuau

SEQ ID NO: 764137 - RNA, 14 nt, Leptospira interrogans serovar lai str. 56601
auuauguaguuuug

SEQ ID NO: 764138 - RNA, 12 nt, Leptospira interrogans serovar lai str. 56601
auuauuuacaua

SEQ ID NO: 764139 - RNA, 18 nt, Leptospira interrogans serovar lai str. 56601
auuauuuauaauuuuaua

SEQ ID NO: 764140 - RNA, 11 nt, Leptospira interrogans serovar lai str. 56601
auuauuuugaa

SEQ ID NO: 764141 - RNA, 18 nt, Leptospira interrogans serovar lai str. 56601
auuauuucaaaaauuuaa

SEQ ID NO: 764142 - RNA, 13 nt, Leptospira interrogans serovar lai str. 56601
auuauuugaaaaa

SEQ ID NO: 764143 - RNA, 11 nt, Leptospira interrogans serovar lai str. 56601
auucaaaauug

SEQ ID NO: 764144 - RNA, 19 nt, Leptospira interrogans serovar lai str. 56601
auucaaaauaucuuaagaa

SEQ ID NO: 764145 - RNA, 13 nt, Leptospira interrogans serovar lai str. 56601
auucaaaauagaa

SEQ ID NO: 764146 - RNA, 19 nt, Leptospira interrogans serovar lai str. 56601
auucaaagauaaaauauag

SEQ ID NO: 764147 - RNA, 15 nt, Leptospira interrogans serovar lai str. 56601
auucaaaacuauuaa

SEQ ID NO: 764148 - RNA, 21 nt, Leptospira interrogans serovar lai str. 56601
auucaaaacuauuaaauugag

SEQ ID NO: 764149 - RNA, 12 nt, Leptospira interrogans serovar lai str. 56601
auucaaaagucu

SEQ ID NO: 764150 - RNA, 16 nt, Leptospira interrogans serovar lai str. 56601
auucaaaaacuaaaau

SEQ ID NO: 764151 - RNA, 14 nt, Leptospira interrogans serovar lai str. 56601
auuauuuuuuaaaa

SEQ ID NO: 764152 - RNA, 17 nt, Leptospira interrogans serovar lai str. 56601
auuauuuuuuaaaaauc

SEQ ID NO: 764153 - RNA, 18 nt, Leptospira interrogans serovar lai str. 56601
auucaaauucuuuuugga

SEQ ID NO: 764154 - RNA, 19 nt, Leptospira interrogans serovar lai str. 56601
auucaaauuucugaaacaa

SEQ ID NO: 764155 - RNA, 12 nt, Leptospira interrogans serovar lai str. 56601
auucaaaugucu

SEQ ID NO: 764156 - RNA, 20 nt, Leptospira interrogans serovar lai str. 56601
auucaaccgcaaauuuuuuc

SEQ ID NO: 764157 - RNA, 16 nt, Leptospira interrogans serovar lai str. 56601
auucaacaucauucuc

SEQ ID NO: 764158 - RNA, 18 nt, Leptospira interrogans serovar lai str. 56601
auucaaguggguuacuuu

SEQ ID NO: 764159 - RNA, 17 nt, Leptospira interrogans serovar lai str. 56601
auucaaguuaauacagu

SEQ ID NO: 764160 - RNA, 15 nt, Leptospira interrogans serovar lai str. 56601
auucaacuuuuugaa

SEQ ID NO: 764161 - RNA, 22 nt, Leptospira interrogans serovar lai str. 56601
auucaacuuuuugaagaaacaa

SEQ ID NO: 764162 - RNA, 18 nt, Leptospira interrogans serovar lai str. 56601
auucaccuuccaaagauu

SEQ ID NO: 764163 - RNA, 19 nt, Leptospira interrogans serovar lai str. 56601
auucaccuuccaaagauuu

SEQ ID NO: 764164 - RNA, 23 nt, Leptospira interrogans serovar lai str. 56601
auucaccuuccaaagauuuuaaa

SEQ ID NO: 764165 - RNA, 18 nt, Leptospira interrogans serovar lai str. 56601
auucacgaccuuaaauaa

SEQ ID NO: 764166 - RNA, 14 nt, Leptospira interrogans serovar lai str. 56601
auucacucuuaaau

SEQ ID NO: 764167 - RNA, 17 nt, Leptospira interrogans serovar lai str. 56601
auucacguuaaaauaau

SEQ ID NO: 764168 - RNA, 19 nt, Leptospira interrogans serovar lai str. 56601
auucacuguuaaaagauuu

SEQ ID NO: 764169 - RNA, 21 nt, Leptospira interrogans serovar lai str. 56601
auucacuuguuauuaaaaucu

SEQ ID NO: 764170 - RNA, 19 nt, Leptospira interrogans serovar lai str. 56601
auucacuuuuccaaauaua

SEQ ID NO: 764171 - RNA, 21 nt, Leptospira interrogans serovar lai str. 56601
auucagaaaaaaaaagaauuu

SEQ ID NO: 764172 - RNA, 20 nt, Leptospira interrogans serovar lai str. 56601
auucagagugguuucuuaug

SEQ ID NO: 764173 - RNA, 20 nt, Leptospira interrogans serovar lai str. 56601
auucagacacgguccuacau

SEQ ID NO: 764174 - RNA, 12 nt, Leptospira interrogans serovar lai str. 56601
auucaauuuuua

SEQ ID NO: 764175 - RNA, 20 nt, Leptospira interrogans serovar lai str. 56601
auucacaaacgguuuuagua

SEQ ID NO: 764176 - RNA, 14 nt, Leptospira interrogans serovar lai str. 56601
auucaauuuauaaa

SEQ ID NO: 764177 - RNA, 16 nt, Leptospira interrogans serovar lai str. 56601
auucaauuucuuuaau

SEQ ID NO: 764178 - RNA, 20 nt, Leptospira interrogans serovar lai str. 56601
auucacauuauauauuuauu

SEQ ID NO: 764179 - RNA, 22 nt, Leptospira interrogans serovar lai str. 56601
auucacauaaaguuaauacaaa

SEQ ID NO: 764180 - RNA, 18 nt, Leptospira interrogans serovar lai str. 56601
auuagaguuucuaaaaaa

SEQ ID NO: 764181 - RNA, 21 nt, Leptospira interrogans serovar lai str. 56601
auuagaguuucuaaaaaaauu

SEQ ID NO: 764182 - RNA, 22 nt, Leptospira interrogans serovar lai str. 56601
auuagaguuugaguuucuuuuu

SEQ ID NO: 764183 - RNA, 12 nt, Leptospira interrogans serovar lai str. 56601
auuagaguuauu

SEQ ID NO: 764184 - RNA, 15 nt, Leptospira interrogans serovar lai str. 56601
auuagaguuguugaa

SEQ ID NO: 764185 - RNA, 18 nt, Leptospira interrogans serovar lai str. 56601
auuagaguuguugaaaaa

SEQ ID NO: 764186 - RNA, 20 nt, Leptospira interrogans serovar lai str. 56601
auuagagaaguuaaaaaaug

SEQ ID NO: 764187 - RNA, 22 nt, Leptospira interrogans serovar lai str. 56601
auuagaauuuuaugauuuucuu

SEQ ID NO: 764188 - RNA, 18 nt, Leptospira interrogans serovar lai str. 56601
auuagaauuguugaaaaa

SEQ ID NO: 764189 - RNA, 21 nt, Leptospira interrogans serovar lai str. 56601
auuagaauuguugaaaaacuc

SEQ ID NO: 764190 - RNA, 23 nt, Leptospira interrogans serovar lai str. 56601
auuagaauuguugaaaaacucca

SEQ ID NO: 764191 - RNA, 21 nt, Leptospira interrogans serovar lai str. 56601
auuagcucuuguuaaaauaaa

SEQ ID NO: 764192 - RNA, 22 nt, Leptospira interrogans serovar lai str. 56601
auuagcucuuguuaaaauaaaa

SEQ ID NO: 764193 - RNA, 23 nt, Leptospira interrogans serovar lai str. 56601
auuagcucuuguuaaaauaaaaa

SEQ ID NO: 764194 - RNA, 13 nt, Leptospira interrogans serovar lai str. 56601
auuagcuuaacuu

SEQ ID NO: 764195 - RNA, 18 nt, Leptospira interrogans serovar lai str. 56601
auuagcuuaacuucggua

SEQ ID NO: 764196 - RNA, 16 nt, Leptospira interrogans serovar lai str. 56601
auuagcuuaagaauuu

SEQ ID NO: 764197 - RNA, 17 nt, Leptospira interrogans serovar lai str. 56601
auuagcaugaaauuuuc

SEQ ID NO: 764198 - RNA, 19 nt, Leptospira interrogans serovar lai str. 56601
auuagcaugaaauuuucuu

SEQ ID NO: 764199 - RNA, 14 nt, Leptospira interrogans serovar lai str. 56601
auuagcaaauuuac

SEQ ID NO: 764200 - RNA, 15 nt, Leptospira interrogans serovar lai str. 56601
auuagcaaauuuacu

SEQ ID NO: 764201 - RNA, 13 nt, Leptospira interrogans serovar lai str. 56601
auuacucuuugag

SEQ ID NO: 764202 - RNA, 16 nt, Leptospira interrogans serovar lai str. 56601
auuacucuuugagaaa

SEQ ID NO: 764203 - RNA, 19 nt, Leptospira interrogans serovar lai str. 56601
auuagaauguaaaugaauu

SEQ ID NO: 764204 - RNA, 18 nt, Leptospira interrogans serovar lai str. 56601
auuagaacuacucacaaa

SEQ ID NO: 764205 - RNA, 19 nt, Leptospira interrogans serovar lai str. 56601
auuagaacuguguuucuaa

SEQ ID NO: 764206 - RNA, 13 nt, Leptospira interrogans serovar lai str. 56601
auuagaagaauug

SEQ ID NO: 764207 - RNA, 14 nt, Leptospira interrogans serovar lai str. 56601
auuacuuuuuaaac

SEQ ID NO: 764208 - RNA, 14 nt, Leptospira interrogans serovar lai str. 56601
auuauauaaguauu

SEQ ID NO: 764209 - RNA, 18 nt, Leptospira interrogans serovar lai str. 56601
auuauaguuuuuucaaaa

SEQ ID NO: 764210 - RNA, 15 nt, Leptospira interrogans serovar lai str. 56601
auuauauaaucugau

SEQ ID NO: 764211 - RNA, 16 nt, Leptospira interrogans serovar lai str. 56601
auuauauaaucugauu

SEQ ID NO: 764212 - RNA, 15 nt, Leptospira interrogans serovar lai str. 56601
auuauauaauuuuua

SEQ ID NO: 764213 - RNA, 23 nt, Leptospira interrogans serovar lai str. 56601
auuauauuuugagguauuuuaga

SEQ ID NO: 764214 - RNA, 18 nt, Leptospira interrogans serovar lai str. 56601
auuauauuuuuaaaaagu

SEQ ID NO: 764215 - RNA, 19 nt, Leptospira interrogans serovar lai str. 56601
auuauauuuuuaaaaagua

SEQ ID NO: 764216 - RNA, 19 nt, Leptospira interrogans serovar lai str. 56601
auuauauucuuauauaucu

SEQ ID NO: 764217 - RNA, 22 nt, Leptospira interrogans serovar lai str. 56601
auuauauaguuaugaauaaaaa

SEQ ID NO: 764218 - RNA, 22 nt, Leptospira interrogans serovar lai str. 56601
auuauacaauuuaauaguuuau

SEQ ID NO: 764219 - RNA, 22 nt, Leptospira interrogans serovar lai str. 56601
auuauacaaaacucuuuaaaaa

SEQ ID NO: 764220 - RNA, 20 nt, Leptospira interrogans serovar lai str. 56601
auuauaggaacgagaaggcu

SEQ ID NO: 764221 - RNA, 22 nt, Leptospira interrogans serovar lai str. 56601
auuauacuuuauuaagaauuuc

SEQ ID NO: 764222 - RNA, 16 nt, Leptospira interrogans serovar lai str. 56601
auuauaaguagaaauu

SEQ ID NO: 764223 - RNA, 18 nt, Leptospira interrogans serovar lai str. 56601
auuauaaguagaaauuua

SEQ ID NO: 764224 - RNA, 22 nt, Leptospira interrogans serovar lai str. 56601
auuauaaguagaaauuuaauuu

SEQ ID NO: 764225 - RNA, 12 nt, Leptospira interrogans serovar lai str. 56601
auuauaaauuua

SEQ ID NO: 764226 - RNA, 16 nt, Leptospira interrogans serovar lai str. 56601
auuauaaauuuaaaaa

SEQ ID NO: 764227 - RNA, 21 nt, Leptospira interrogans serovar lai str. 56601
auuauaaauuuaaaaaaccgc

SEQ ID NO: 764228 - RNA, 19 nt, Leptospira interrogans serovar lai str. 56601
auuaguacuuuugaauuua

SEQ ID NO: 764229 - RNA, 22 nt, Leptospira interrogans serovar lai str. 56601
auuaguuuaauauacaaaacau

SEQ ID NO: 764230 - RNA, 18 nt, Leptospira interrogans serovar lai str. 56601
auuaguuauguuuuaaaa

SEQ ID NO: 764231 - RNA, 14 nt, Leptospira interrogans serovar lai str. 56601
auuauaaaaacaag

SEQ ID NO: 764232 - RNA, 20 nt, Leptospira interrogans serovar lai str. 56601
auuauaaaaacaaguuuaaa

SEQ ID NO: 764233 - RNA, 16 nt, Leptospira interrogans serovar lai str. 56601
auuauaaaauacaaaa

SEQ ID NO: 764234 - RNA, 15 nt, Leptospira interrogans serovar lai str. 56601
auuauaaaauuuuuc

SEQ ID NO: 764235 - RNA, 16 nt, Leptospira interrogans serovar lai str. 56601
auuauaaaauuuuucu

SEQ ID NO: 764236 - RNA, 21 nt, Leptospira interrogans serovar lai str. 56601
auuauaaacagucgcuaaacu

SEQ ID NO: 764237 - RNA, 20 nt, Leptospira interrogans serovar lai str. 56601
auuauaaacuucuauuuuau

SEQ ID NO: 764238 - RNA, 15 nt, Leptospira interrogans serovar lai str. 56601
auuaguuaacgugaa

SEQ ID NO: 764239 - RNA, 15 nt, Leptospira interrogans serovar lai str. 56601
auuaauucuccauuu

SEQ ID NO: 764240 - RNA, 22 nt, Leptospira interrogans serovar lai str. 56601
auuaauucccaaugaugaauuc

SEQ ID NO: 764241 - RNA, 13 nt, Leptospira interrogans serovar lai str. 56601
auuaauuauaugg

SEQ ID NO: 764242 - RNA, 20 nt, Leptospira interrogans serovar lai str. 56601
auuaauggcuuuaaucuuuu

SEQ ID NO: 764243 - RNA, 21 nt, Leptospira interrogans serovar lai str. 56601
auuaauuuaaucaaaauuucu

SEQ ID NO: 764244 - RNA, 12 nt, Leptospira interrogans serovar lai str. 56601
auuaauuucuaa

SEQ ID NO: 764245 - RNA, 21 nt, Leptospira interrogans serovar lai str. 56601
auuaauuugaauauaauaaaa

SEQ ID NO: 764246 - RNA, 14 nt, Leptospira interrogans serovar lai str. 56601
auuacaaaacuuag

SEQ ID NO: 764247 - RNA, 15 nt, Leptospira interrogans serovar lai str. 56601
auuaauuuuucaaca

SEQ ID NO: 764248 - RNA, 15 nt, Leptospira interrogans serovar lai str. 56601
auuaauuuuucaaua

SEQ ID NO: 764249 - RNA, 14 nt, Leptospira interrogans serovar lai str. 56601
auuaauuuuuuaaa

SEQ ID NO: 764250 - RNA, 15 nt, Leptospira interrogans serovar lai str. 56601
auuaauuuuuuaaaa

SEQ ID NO: 764251 - RNA, 18 nt, Leptospira interrogans serovar lai str. 56601
auuaauuuuuauagaauu

SEQ ID NO: 764252 - RNA, 23 nt, Leptospira interrogans serovar lai str. 56601
auuaauuuuuauagaauuuaagu

SEQ ID NO: 764253 - RNA, 11 nt, Leptospira interrogans serovar lai str. 56601
auuaauuuuuc

SEQ ID NO: 764254 - RNA, 19 nt, Leptospira interrogans serovar lai str. 56601
auuacauaauaaaguacua

SEQ ID NO: 764255 - RNA, 20 nt, Leptospira interrogans serovar lai str. 56601
auuacauaauaaaguacuaa

SEQ ID NO: 764256 - RNA, 22 nt, Leptospira interrogans serovar lai str. 56601
auuacacuucuuuuaugcaauu

SEQ ID NO: 764257 - RNA, 15 nt, Leptospira interrogans serovar lai str. 56601
auuacaauuauacua

SEQ ID NO: 764258 - RNA, 20 nt, Leptospira interrogans serovar lai str. 56601
auuacaauugauuauagaac

SEQ ID NO: 764259 - RNA, 15 nt, Leptospira interrogans serovar lai str. 56601
auuacaaaaucugaa

SEQ ID NO: 764260 - RNA, 22 nt, Leptospira interrogans serovar lai str. 56601
auuacaaaaucugaauuuuacc

SEQ ID NO: 764261 - RNA, 15 nt, Leptospira interrogans serovar lai str. 56601
auuacaaaguaucuu

SEQ ID NO: 764262 - RNA, 13 nt, Leptospira interrogans serovar lai str. 56601
auuaccaauugau

SEQ ID NO: 764263 - RNA, 17 nt, Leptospira interrogans serovar lai str. 56601
auuacauuuuucuaaau

SEQ ID NO: 764264 - RNA, 16 nt, Leptospira interrogans serovar lai str. 56601
auuacgcugauuagaa

SEQ ID NO: 764265 - RNA, 19 nt, Leptospira interrogans serovar lai str. 56601
auuacgcugauuagaauuc

SEQ ID NO: 764266 - RNA, 20 nt, Leptospira interrogans serovar lai str. 56601
auuacgauuuuuugauucau

SEQ ID NO: 764267 - RNA, 20 nt, Leptospira interrogans serovar lai str. 56601
auuacguagcgaagaauauc

SEQ ID NO: 764268 - RNA, 20 nt, Leptospira interrogans serovar lai str. 56601
auuacucggauguauaaaaa

SEQ ID NO: 764269 - RNA, 20 nt, Leptospira interrogans serovar lai str. 56601
auuacuauggaauauaaaag

SEQ ID NO: 764270 - RNA, 22 nt, Leptospira interrogans serovar lai str. 56601
auuacuauggaauauaaaagaa

SEQ ID NO: 764271 - RNA, 19 nt, Leptospira interrogans serovar lai str. 56601
auuuauuacaaaguaucuu

SEQ ID NO: 764272 - RNA, 15 nt, Leptospira interrogans serovar lai str. 56601
auuuauucuacauga

SEQ ID NO: 764273 - RNA, 13 nt, Leptospira interrogans serovar lai str. 56601
auuuauucucuau

SEQ ID NO: 764274 - RNA, 13 nt, Leptospira interrogans serovar lai str. 56601
auuuauucaaaau

SEQ ID NO: 764275 - RNA, 14 nt, Leptospira interrogans serovar lai str. 56601
auuuauucaaaaua

SEQ ID NO: 764276 - RNA, 16 nt, Leptospira interrogans serovar lai str. 56601
auuuauuucaaaauuu

SEQ ID NO: 764277 - RNA, 18 nt, Leptospira interrogans serovar lai str. 56601
auuuauuucaaaauuuau

SEQ ID NO: 764278 - RNA, 14 nt, Leptospira interrogans serovar lai str. 56601
auuuauuuuaaaga

SEQ ID NO: 764279 - RNA, 16 nt, Leptospira interrogans serovar lai str. 56601
auuuauuuuuuuuaau

SEQ ID NO: 764280 - RNA, 21 nt, Leptospira interrogans serovar lai str. 56601
auuuauuuuuuuuaauauagu

SEQ ID NO: 764281 - RNA, 22 nt, Leptospira interrogans serovar lai str. 56601
auuuauuuuuuuuaauauagua

SEQ ID NO: 764282 - RNA, 23 nt, Leptospira interrogans serovar lai str. 56601
auuuauuuuuuuuaauauaguau

SEQ ID NO: 764283 - RNA, 18 nt, Leptospira interrogans serovar lai str. 56601
auuucaaaaaacuuucuu

SEQ ID NO: 764284 - RNA, 22 nt, Leptospira interrogans serovar lai str. 56601
auuucaaaaaacuuucuuaaau

SEQ ID NO: 764285 - RNA, 20 nt, Leptospira interrogans serovar lai str. 56601
auuucaauacaauaaaaaca

SEQ ID NO: 764286 - RNA, 14 nt, Leptospira interrogans serovar lai str. 56601
auuucaauauaaaa

SEQ ID NO: 764287 - RNA, 14 nt, Leptospira interrogans serovar lai str. 56601
auuucaaaauuuau

SEQ ID NO: 764288 - RNA, 14 nt, Leptospira interrogans serovar lai str. 56601
auuucaaaauuuuu

SEQ ID NO: 764289 - RNA, 14 nt, Leptospira interrogans serovar lai str. 56601
auuucaaaaauaua

SEQ ID NO: 764290 - RNA, 13 nt, Leptospira interrogans serovar lai str. 56601
auuucaaaaauuu

SEQ ID NO: 764291 - RNA, 14 nt, Leptospira interrogans serovar lai str. 56601
auuucaaaaauuuu

SEQ ID NO: 764292 - RNA, 15 nt, Leptospira interrogans serovar lai str. 56601
auuucaaaaauuuuc

SEQ ID NO: 764293 - RNA, 18 nt, Leptospira interrogans serovar lai str. 56601
auuucaaugcaacagaaa

SEQ ID NO: 764294 - RNA, 15 nt, Leptospira interrogans serovar lai str. 56601
auuucagcuccaaaa

SEQ ID NO: 764295 - RNA, 17 nt, Leptospira interrogans serovar lai str. 56601
auuucagcuccaaaaaa

SEQ ID NO: 764296 - RNA, 18 nt, Leptospira interrogans serovar lai str. 56601
auuucauccaugucuucu

SEQ ID NO: 764297 - RNA, 22 nt, Leptospira interrogans serovar lai str. 56601
auuucaggaaucguuuguaaaa

SEQ ID NO: 764298 - RNA, 19 nt, Leptospira interrogans serovar lai str. 56601
auuuauaauucguuuuuua

SEQ ID NO: 764299 - RNA, 12 nt, Leptospira interrogans serovar lai str. 56601
auuuauaaugaa

SEQ ID NO: 764300 - RNA, 19 nt, Leptospira interrogans serovar lai str. 56601
auuuauaacgggaauuaua

SEQ ID NO: 764301 - RNA, 20 nt, Leptospira interrogans serovar lai str. 56601
auuuauaacgggaauuauaa

SEQ ID NO: 764302 - RNA, 15 nt, Leptospira interrogans serovar lai str. 56601
auuuauaaauguagg

SEQ ID NO: 764303 - RNA, 13 nt, Leptospira interrogans serovar lai str. 56601
auuuauaaaauaa

SEQ ID NO: 764304 - RNA, 20 nt, Leptospira interrogans serovar lai str. 56601
auuuaguuucaauuuaaaac

SEQ ID NO: 764305 - RNA, 20 nt, Leptospira interrogans serovar lai str. 56601
auuuaucgauuuaaaaacua

SEQ ID NO: 764306 - RNA, 13 nt, Leptospira interrogans serovar lai str. 56601
auuuaucuaaaac

SEQ ID NO: 764307 - RNA, 19 nt, Leptospira interrogans serovar lai str. 56601
auuuaaugaccacaaacua

SEQ ID NO: 764308 - RNA, 21 nt, Leptospira interrogans serovar lai str. 56601
auuuaaugaccacaaacuauc

SEQ ID NO: 764309 - RNA, 17 nt, Leptospira interrogans serovar lai str. 56601
auuuagaacgcaaucug

SEQ ID NO: 764310 - RNA, 12 nt, Leptospira interrogans serovar lai str. 56601
auuuagaauaaa

SEQ ID NO: 764311 - RNA, 14 nt, Leptospira interrogans serovar lai str. 56601
auuuaauauauuuu

SEQ ID NO: 764312 - RNA, 18 nt, Leptospira interrogans serovar lai str. 56601
auuuagaagauugaggau

SEQ ID NO: 764313 - RNA, 17 nt, Leptospira interrogans serovar lai str. 56601
auuuagaauuguuaucu

SEQ ID NO: 764314 - RNA, 19 nt, Leptospira interrogans serovar lai str. 56601
auuuaguaguaaauaaaaa

SEQ ID NO: 764315 - RNA, 13 nt, Leptospira interrogans serovar lai str. 56601
auuguaaacuucu

SEQ ID NO: 764316 - RNA, 21 nt, Leptospira interrogans serovar lai str. 56601
auugguuuccgcuguaugaaa

SEQ ID NO: 764317 - RNA, 15 nt, Leptospira interrogans serovar lai str. 56601
auuguaaaaaaacau

SEQ ID NO: 764318 - RNA, 16 nt, Leptospira interrogans serovar lai str. 56601
auuguaaaaaaacaug

SEQ ID NO: 764319 - RNA, 21 nt, Leptospira interrogans serovar lai str. 56601
auuguaaaaaaacaugaagaa

SEQ ID NO: 764320 - RNA, 14 nt, Leptospira interrogans serovar lai str. 56601
auuggguuugauuu

SEQ ID NO: 764321 - RNA, 21 nt, Leptospira interrogans serovar lai str. 56601
auuggguauaagaagauuuua

SEQ ID NO: 764322 - RNA, 16 nt, Leptospira interrogans serovar lai str. 56601
auuguaguucuacauu

SEQ ID NO: 764323 - RNA, 22 nt, Leptospira interrogans serovar lai str. 56601
auuguagaaacuuauacuuuau

SEQ ID NO: 764324 - RNA, 19 nt, Leptospira interrogans serovar lai str. 56601
auuguagaauuuauuuuca

SEQ ID NO: 764325 - RNA, 15 nt, Leptospira interrogans serovar lai str. 56601
auuguaugaagaaaa

SEQ ID NO: 764326 - RNA, 17 nt, Leptospira interrogans serovar lai str. 56601
auuguaugaagaaaacc

SEQ ID NO: 764327 - RNA, 23 nt, Leptospira interrogans serovar lai str. 56601
auuguaugaagaaaaccuaaaau

SEQ ID NO: 764328 - RNA, 22 nt, Leptospira interrogans serovar lai str. 56601
auugugggaacuauuauaaaau

SEQ ID NO: 764329 - RNA, 20 nt, Leptospira interrogans serovar lai str. 56601
auugugaucucgauuccuaa

SEQ ID NO: 764330 - RNA, 14 nt, Leptospira interrogans serovar lai str. 56601
auugucuugaauua

SEQ ID NO: 764331 - RNA, 15 nt, Leptospira interrogans serovar lai str. 56601
auuguccauuuccau

SEQ ID NO: 764332 - RNA, 16 nt, Leptospira interrogans serovar lai str. 56601
auugucucaaaauuaa

SEQ ID NO: 764333 - RNA, 12 nt, Leptospira interrogans serovar lai str. 56601
auuguguuuuuu

SEQ ID NO: 764334 - RNA, 17 nt, Leptospira interrogans serovar lai str. 56601
auuguuccgaauuaaaa

SEQ ID NO: 764335 - RNA, 15 nt, Leptospira interrogans serovar lai str. 56601
auuguucguuucguu

SEQ ID NO: 764336 - RNA, 12 nt, Leptospira interrogans serovar lai str. 56601
auuguugaagaa

SEQ ID NO: 764337 - RNA, 15 nt, Leptospira interrogans serovar lai str. 56601
auuguugaagaauua

SEQ ID NO: 764338 - RNA, 16 nt, Leptospira interrogans serovar lai str. 56601
auuguugaagaauuaa

SEQ ID NO: 764339 - RNA, 21 nt, Leptospira interrogans serovar lai str. 56601
auuguugaagaauuaauucuc

SEQ ID NO: 764340 - RNA, 19 nt, Leptospira interrogans serovar lai str. 56601
auuguuggcuuuuuuaugu

SEQ ID NO: 764341 - RNA, 21 nt, Leptospira interrogans serovar lai str. 56601
auuguuugaaaguucccaaau

SEQ ID NO: 764342 - RNA, 17 nt, Leptospira interrogans serovar lai str. 56601
auuguuuguuuuuucca

SEQ ID NO: 764343 - RNA, 19 nt, Leptospira interrogans serovar lai str. 56601
auuuaaagcaaauaccaaa

SEQ ID NO: 764344 - RNA, 20 nt, Leptospira interrogans serovar lai str. 56601
auuuaaacuuacuaugaagu

SEQ ID NO: 764345 - RNA, 16 nt, Leptospira interrogans serovar lai str. 56601
auuuaaaucccauuuu

SEQ ID NO: 764346 - RNA, 20 nt, Leptospira interrogans serovar lai str. 56601
auuuaaauguauguuuacuu

SEQ ID NO: 764347 - RNA, 12 nt, Leptospira interrogans serovar lai str. 56601
auuuaaaugucu

SEQ ID NO: 764348 - RNA, 22 nt, Leptospira interrogans serovar lai str. 56601
auuuaaauguuauuuuguauaa

SEQ ID NO: 764349 - RNA, 21 nt, Leptospira interrogans serovar lai str. 56601
auuuaaauguuuuuguauuuu

SEQ ID NO: 764350 - RNA, 13 nt, Leptospira interrogans serovar lai str. 56601
auuuaaauucccu

SEQ ID NO: 764351 - RNA, 15 nt, Leptospira interrogans serovar lai str. 56601
auuuaaauuuauaau

SEQ ID NO: 764352 - RNA, 23 nt, Leptospira interrogans serovar lai str. 56601
auuuaaauuugugguaguuccua

SEQ ID NO: 764353 - RNA, 17 nt, Leptospira interrogans serovar lai str. 56601
auugcucaaagaauuuc

SEQ ID NO: 764354 - RNA, 12 nt, Leptospira interrogans serovar lai str. 56601
auugcuaaaaaa

SEQ ID NO: 764355 - RNA, 17 nt, Leptospira interrogans serovar lai str. 56601
auuggaguuuuuuaaaa

SEQ ID NO: 764356 - RNA, 18 nt, Leptospira interrogans serovar lai str. 56601
auuggaguuuuuuaaaau

SEQ ID NO: 764357 - RNA, 20 nt, Leptospira interrogans serovar lai str. 56601
auuggacgguuuugggacaa

SEQ ID NO: 764358 - RNA, 15 nt, Leptospira interrogans serovar lai str. 56601
auuggacuaaaccac

SEQ ID NO: 764359 - RNA, 12 nt, Leptospira interrogans serovar lai str. 56601
auugauuuuuca

SEQ ID NO: 764360 - RNA, 12 nt, Leptospira interrogans serovar lai str. 56601
auugauuuuucu

SEQ ID NO: 764361 - RNA, 20 nt, Leptospira interrogans serovar lai str. 56601
auugcaacuuugguuaucau

SEQ ID NO: 764362 - RNA, 14 nt, Leptospira interrogans serovar lai str. 56601
auugcacaaaagaa

SEQ ID NO: 764363 - RNA, 20 nt, Leptospira interrogans serovar lai str. 56601
auugaguguuuuuaguuuuc

SEQ ID NO: 764364 - RNA, 19 nt, Leptospira interrogans serovar lai str. 56601
auugagucaagauuauuuu

SEQ ID NO: 764365 - RNA, 15 nt, Leptospira interrogans serovar lai str. 56601
auugaguuucuugaa

SEQ ID NO: 764366 - RNA, 20 nt, Leptospira interrogans serovar lai str. 56601
auugaguuuaagaaacucag

SEQ ID NO: 764367 - RNA, 18 nt, Leptospira interrogans serovar lai str. 56601
auugaguuuuuguuugaa

SEQ ID NO: 764368 - RNA, 21 nt, Leptospira interrogans serovar lai str. 56601
auugaguuuuuguuugaaugu

SEQ ID NO: 764369 - RNA, 13 nt, Leptospira interrogans serovar lai str. 56601
auugaguuuuuua

SEQ ID NO: 764370 - RNA, 19 nt, Leptospira interrogans serovar lai str. 56601
auugagcuuguuuuuaaau

SEQ ID NO: 764371 - RNA, 19 nt, Leptospira interrogans serovar lai str. 56601
auugagggaauucccacau

SEQ ID NO: 764372 - RNA, 23 nt, Leptospira interrogans serovar lai str. 56601
auugcagaauguuuucuacaaau

SEQ ID NO: 764373 - RNA, 16 nt, Leptospira interrogans serovar lai str. 56601
auugccuaaauuccuu

SEQ ID NO: 764374 - RNA, 15 nt, Leptospira interrogans serovar lai str. 56601
auugccucuacaagu

SEQ ID NO: 764375 - RNA, 17 nt, Leptospira interrogans serovar lai str. 56601
auucuuagaauuuuccu

SEQ ID NO: 764376 - RNA, 16 nt, Leptospira interrogans serovar lai str. 56601
auucuuaauuuguuug

SEQ ID NO: 764377 - RNA, 19 nt, Leptospira interrogans serovar lai str. 56601
auucuuauguuuuuuaugg

SEQ ID NO: 764378 - RNA, 15 nt, Leptospira interrogans serovar lai str. 56601
auucuuuuuauuuuu

SEQ ID NO: 764379 - RNA, 16 nt, Leptospira interrogans serovar lai str. 56601
auucuuuuuauuuuua

SEQ ID NO: 764380 - RNA, 23 nt, Leptospira interrogans serovar lai str. 56601
auucuucaaauaacauuuuuuca

SEQ ID NO: 764381 - RNA, 19 nt, Leptospira interrogans serovar lai str. 56601
auucuucaauaucuuuauu

SEQ ID NO: 764382 - RNA, 11 nt, Leptospira interrogans serovar lai str. 56601
auugaaaaauu

SEQ ID NO: 764383 - RNA, 17 nt, Leptospira interrogans serovar lai str. 56601
auucuuuuugccaauuc

SEQ ID NO: 764384 - RNA, 22 nt, Leptospira interrogans serovar lai str. 56601
auugaaacguuuucaaaaaauu

SEQ ID NO: 764385 - RNA, 20 nt, Leptospira interrogans serovar lai str. 56601
auugaaacaauuuugccaau

SEQ ID NO: 764386 - RNA, 16 nt, Leptospira interrogans serovar lai str. 56601
auugaagcguuuuguu

SEQ ID NO: 764387 - RNA, 18 nt, Leptospira interrogans serovar lai str. 56601
auugaagcguuuuguuaa

SEQ ID NO: 764388 - RNA, 17 nt, Leptospira interrogans serovar lai str. 56601
auugaaggaguuuuguu

SEQ ID NO: 764389 - RNA, 14 nt, Leptospira interrogans serovar lai str. 56601
auugaaauauuaua

SEQ ID NO: 764390 - RNA, 14 nt, Leptospira interrogans serovar lai str. 56601
auugaaauagaauc

SEQ ID NO: 764391 - RNA, 14 nt, Leptospira interrogans serovar lai str. 56601
auugacuuucugua

SEQ ID NO: 764392 - RNA, 15 nt, Leptospira interrogans serovar lai str. 56601
auugacuuucuguau

SEQ ID NO: 764393 - RNA, 22 nt, Leptospira interrogans serovar lai str. 56601
auugagaaaauaaaaaauuuuc

SEQ ID NO: 764394 - RNA, 17 nt, Leptospira interrogans serovar lai str. 56601
auugagaauucuacauu

SEQ ID NO: 764395 - RNA, 20 nt, Leptospira interrogans serovar lai str. 56601
auugagaauuuguuuuaaaa

SEQ ID NO: 764396 - RNA, 22 nt, Leptospira interrogans serovar lai str. 56601
auugagauuuggugauuuaaaa

SEQ ID NO: 764397 - RNA, 13 nt, Leptospira interrogans serovar lai str. 56601
auugagauaaaaa

SEQ ID NO: 764398 - RNA, 21 nt, Leptospira interrogans serovar lai str. 56601
auugaauaucauaaauuuuua

SEQ ID NO: 764399 - RNA, 18 nt, Leptospira interrogans serovar lai str. 56601
auugaaggguaacucagc

SEQ ID NO: 764400 - RNA, 16 nt, Leptospira interrogans serovar lai str. 56601
auugaauaaacuguuu

SEQ ID NO: 764401 - RNA, 21 nt, Leptospira interrogans serovar lai str. 56601
auugaauccuuccuccaaaau

SEQ ID NO: 764402 - RNA, 20 nt, Leptospira interrogans serovar lai str. 56601
auucuauaguaaagauuaga

SEQ ID NO: 764403 - RNA, 18 nt, Leptospira interrogans serovar lai str. 56601
auucuauauauugaaaua

SEQ ID NO: 764404 - RNA, 15 nt, Leptospira interrogans serovar lai str. 56601
auucuauaaaguuga

SEQ ID NO: 764405 - RNA, 15 nt, Leptospira interrogans serovar lai str. 56601
auucuaggcauuuca

SEQ ID NO: 764406 - RNA, 19 nt, Leptospira interrogans serovar lai str. 56601
auucucccccaacugaaaa

SEQ ID NO: 764407 - RNA, 17 nt, Leptospira interrogans serovar lai str. 56601
auucuauuaguuuuuau

SEQ ID NO: 764408 - RNA, 22 nt, Leptospira interrogans serovar lai str. 56601
auucuauuaguuuuuaugccuu

SEQ ID NO: 764409 - RNA, 19 nt, Leptospira interrogans serovar lai str. 56601
auucuauuauauacauggg

SEQ ID NO: 764410 - RNA, 18 nt, Leptospira interrogans serovar lai str. 56601
auucuauucguauuuuau

SEQ ID NO: 764411 - RNA, 15 nt, Leptospira interrogans serovar lai str. 56601
auucuauugugggaa

SEQ ID NO: 764412 - RNA, 22 nt, Leptospira interrogans serovar lai str. 56601
auucuaugaaacgaaauauauu

SEQ ID NO: 764413 - RNA, 23 nt, Leptospira interrogans serovar lai str. 56601
auucuaugaaacgaaauauauua

SEQ ID NO: 764414 - RNA, 13 nt, Leptospira interrogans serovar lai str. 56601
auucuaucgauuc

SEQ ID NO: 764415 - RNA, 21 nt, Leptospira interrogans serovar lai str. 56601
auucuauuagaauaguaguuu

SEQ ID NO: 764416 - RNA, 21 nt, Leptospira interrogans serovar lai str. 56601
auucaggauuacuaaugcaau

SEQ ID NO: 764417 - RNA, 19 nt, Leptospira interrogans serovar lai str. 56601
auucagcaucgaauauccu

SEQ ID NO: 764418 - RNA, 22 nt, Leptospira interrogans serovar lai str. 56601
auucugcucgaauuuuuuuuau

SEQ ID NO: 764419 - RNA, 20 nt, Leptospira interrogans serovar lai str. 56601
auucucuauggguuuucguu

SEQ ID NO: 764420 - RNA, 22 nt, Leptospira interrogans serovar lai str. 56601
auucuccguuaugcaugaauuu

SEQ ID NO: 764421 - RNA, 13 nt, Leptospira interrogans serovar lai str. 56601
auucuccuccuga

SEQ ID NO: 764422 - RNA, 21 nt, Leptospira interrogans serovar lai str. 56601
auucuccuccugaaaauuuuc

SEQ ID NO: 764423 - RNA, 15 nt, Leptospira interrogans serovar lai str. 56601
auucucgcauuuucc

SEQ ID NO: 764424 - RNA, 17 nt, Leptospira interrogans serovar lai str. 56601
auucucgcauuuuccuu

SEQ ID NO: 764425 - RNA, 21 nt, Leptospira interrogans serovar lai str. 56601
auucucgcauuuuccuuuuuc

SEQ ID NO: 764426 - RNA, 19 nt, Leptospira interrogans serovar lai str. 56601
auucuguaaaauaaauuua

SEQ ID NO: 764427 - RNA, 19 nt, Leptospira interrogans serovar lai str. 56601
auucuuaaaaauuuauaaa

SEQ ID NO: 764428 - RNA, 21 nt, Leptospira interrogans serovar lai str. 56601
auucuuaaaaauuuauaaaga

SEQ ID NO: 764429 - RNA, 15 nt, Leptospira interrogans serovar lai str. 56601
auucuuaaaaaauau

SEQ ID NO: 764430 - RNA, 17 nt, Leptospira interrogans serovar lai str. 56601
auucuuaauauacuuaa

SEQ ID NO: 764431 - RNA, 17 nt, Leptospira interrogans serovar lai str. 56601
auucuuaaugucccaga

SEQ ID NO: 764432 - RNA, 15 nt, Leptospira interrogans serovar lai str. 56601
auuuuaaagguugag

SEQ ID NO: 764433 - RNA, 21 nt, Leptospira interrogans serovar lai str. 56601
auuuuaagaucuauuccuaaa

SEQ ID NO: 764434 - RNA, 14 nt, Leptospira interrogans serovar lai str. 56601
auuuuaacuugagu

SEQ ID NO: 764435 - RNA, 20 nt, Leptospira interrogans serovar lai str. 56601
auuuuaacuuuuuuuaaaaa

SEQ ID NO: 764436 - RNA, 16 nt, Leptospira interrogans serovar lai str. 56601
auuuuaagaacaauuu

SEQ ID NO: 764437 - RNA, 23 nt, Leptospira interrogans serovar lai str. 56601
auuuuaagaacaauuuaaaauaa

SEQ ID NO: 764438 - RNA, 20 nt, Leptospira interrogans serovar lai str. 56601
auuuuaagacaaacuuuuag

SEQ ID NO: 764439 - RNA, 20 nt, Leptospira interrogans serovar lai str. 56601
auuuuaacagauuaaaugua

SEQ ID NO: 764440 - RNA, 14 nt, Leptospira interrogans serovar lai str. 56601
auuuuaacgugagu

SEQ ID NO: 764441 - RNA, 14 nt, Leptospira interrogans serovar lai str. 56601
auuuuaauauauug

SEQ ID NO: 764442 - RNA, 15 nt, Leptospira interrogans serovar lai str. 56601
auuuuacuauaaaca

SEQ ID NO: 764443 - RNA, 14 nt, Leptospira interrogans serovar lai str. 56601
auuuuacgauuaaa

SEQ ID NO: 764444 - RNA, 18 nt, Leptospira interrogans serovar lai str. 56601
auuuuacgcuuaaauaga

SEQ ID NO: 764445 - RNA, 19 nt, Leptospira interrogans serovar lai str. 56601
auuuuagaaucaaaaugaa

SEQ ID NO: 764446 - RNA, 18 nt, Leptospira interrogans serovar lai str. 56601
auuuuagaaucagaauga

SEQ ID NO: 764447 - RNA, 14 nt, Leptospira interrogans serovar lai str. 56601
auuuuagaaauauu

SEQ ID NO: 764448 - RNA, 12 nt, Leptospira interrogans serovar lai str. 56601
auuuuagaaauc

SEQ ID NO: 764449 - RNA, 23 nt, Leptospira interrogans serovar lai str. 56601
auuuuagaaaucgauuuguaaaa

SEQ ID NO: 764450 - RNA, 14 nt, Leptospira interrogans serovar lai str. 56601
auuuuacugcuuga

SEQ ID NO: 764451 - RNA, 15 nt, Leptospira interrogans serovar lai str. 56601
auuuuauguaagaaa

SEQ ID NO: 764452 - RNA, 18 nt, Leptospira interrogans serovar lai str. 56601
auuuuauguaagaaaaac

SEQ ID NO: 764453 - RNA, 14 nt, Leptospira interrogans serovar lai str. 56601
auuuuaugauuuuc

SEQ ID NO: 764454 - RNA, 17 nt, Leptospira interrogans serovar lai str. 56601
auuuuauguuauauauu

SEQ ID NO: 764455 - RNA, 13 nt, Leptospira interrogans serovar lai str. 56601
auuuuauuaaaua

SEQ ID NO: 764456 - RNA, 15 nt, Leptospira interrogans serovar lai str. 56601
auuuuauuaaauaaa

SEQ ID NO: 764457 - RNA, 17 nt, Leptospira interrogans serovar lai str. 56601
auuuuaugaauaaaaaa

SEQ ID NO: 764458 - RNA, 15 nt, Leptospira interrogans serovar lai str. 56601
auuuuaucuuaaugu

SEQ ID NO: 764459 - RNA, 18 nt, Leptospira interrogans serovar lai str. 56601
auuuuagauacguuuuau

SEQ ID NO: 764460 - RNA, 17 nt, Leptospira interrogans serovar lai str. 56601
auuuuauugaagauauu

SEQ ID NO: 764461 - RNA, 22 nt, Leptospira interrogans serovar lai str. 56601
auuuuauugaagauauuuuccu

SEQ ID NO: 764462 - RNA, 21 nt, Leptospira interrogans serovar lai str. 56601
auuuuauugugaguuuaaaga

SEQ ID NO: 764463 - RNA, 19 nt, Leptospira interrogans serovar lai str. 56601
auuuuauuguguuuuuucu

SEQ ID NO: 764464 - RNA, 15 nt, Leptospira interrogans serovar lai str. 56601
auuuucagaaaaaug

SEQ ID NO: 764465 - RNA, 16 nt, Leptospira interrogans serovar lai str. 56601
auuuucagaaaaauga

SEQ ID NO: 764466 - RNA, 17 nt, Leptospira interrogans serovar lai str. 56601
auuuucagaaaaaugaa

SEQ ID NO: 764467 - RNA, 21 nt, Leptospira interrogans serovar lai str. 56601
auuuucauaauaaauuuuucu

SEQ ID NO: 764468 - RNA, 15 nt, Leptospira interrogans serovar lai str. 56601
auuuucauagaaaaa

SEQ ID NO: 764469 - RNA, 18 nt, Leptospira interrogans serovar lai str. 56601
auuuucaggcauagaauc

SEQ ID NO: 764470 - RNA, 19 nt, Leptospira interrogans serovar lai str. 56601
auuuucagggaaaaauaag

SEQ ID NO: 764471 - RNA, 17 nt, Leptospira interrogans serovar lai str. 56601
auuuugauuacaaagca

SEQ ID NO: 764472 - RNA, 22 nt, Leptospira interrogans serovar lai str. 56601
auuuugauuccaaagauaaaaa

SEQ ID NO: 764473 - RNA, 22 nt, Leptospira interrogans serovar lai str. 56601
auuuugagguauuuuagagaaa

SEQ ID NO: 764474 - RNA, 18 nt, Leptospira interrogans serovar lai str. 56601
auuuugauccguuuuaaa

SEQ ID NO: 764475 - RNA, 18 nt, Leptospira interrogans serovar lai str. 56601
auuuugaucuuuuuuucu

SEQ ID NO: 764476 - RNA, 19 nt, Leptospira interrogans serovar lai str. 56601
auuuucuuauugaacguaa

SEQ ID NO: 764477 - RNA, 23 nt, Leptospira interrogans serovar lai str. 56601
auuuugagacaggcucaauauuu

SEQ ID NO: 764478 - RNA, 22 nt, Leptospira interrogans serovar lai str. 56601
auuuugagcagauucuaaaaau

SEQ ID NO: 764479 - RNA, 15 nt, Leptospira interrogans serovar lai str. 56601
auuuugugaaacuua

SEQ ID NO: 764480 - RNA, 22 nt, Leptospira interrogans serovar lai str. 56601
auuuugugaaacuuaaaucuca

SEQ ID NO: 764481 - RNA, 17 nt, Leptospira interrogans serovar lai str. 56601
auuuuguauugaaauag

SEQ ID NO: 764482 - RNA, 23 nt, Leptospira interrogans serovar lai str. 56601
auuuuguuugaauccaaaaguuu

SEQ ID NO: 764483 - RNA, 20 nt, Leptospira interrogans serovar lai str. 56601
auuuuccggacuuuccagaa

SEQ ID NO: 764484 - RNA, 17 nt, Leptospira interrogans serovar lai str. 56601
auuuuccguaccccaaa

SEQ ID NO: 764485 - RNA, 22 nt, Leptospira interrogans serovar lai str. 56601
auuuuccuuaagacccuaaaaa

SEQ ID NO: 764486 - RNA, 19 nt, Leptospira interrogans serovar lai str. 56601
auuuuccuauuuucgaaaa

SEQ ID NO: 764487 - RNA, 13 nt, Leptospira interrogans serovar lai str. 56601
auuuucuguuuau

SEQ ID NO: 764488 - RNA, 20 nt, Leptospira interrogans serovar lai str. 56601
auuuucuuaauaaacuuuca

SEQ ID NO: 764489 - RNA, 18 nt, Leptospira interrogans serovar lai str. 56601
auuuucuuagguaauuua

SEQ ID NO: 764490 - RNA, 17 nt, Leptospira interrogans serovar lai str. 56601
auuuucgccgaaacauu

SEQ ID NO: 764491 - RNA, 16 nt, Leptospira interrogans serovar lai str. 56601
auuuucggcauuuuau

SEQ ID NO: 764492 - RNA, 14 nt, Leptospira interrogans serovar lai str. 56601
auuuucgauuuaau

SEQ ID NO: 764493 - RNA, 15 nt, Leptospira interrogans serovar lai str. 56601
auuuucgaauucuuu

SEQ ID NO: 764494 - RNA, 20 nt, Leptospira interrogans serovar lai str. 56601
auuuucgaauucuuucuauu

SEQ ID NO: 764495 - RNA, 22 nt, Leptospira interrogans serovar lai str. 56601
auuuucgauuuaauauauuuuc

SEQ ID NO: 764496 - RNA, 15 nt, Leptospira interrogans serovar lai str. 56601
auuuucgcacauucu

SEQ ID NO: 764497 - RNA, 16 nt, Leptospira interrogans serovar lai str. 56601
auuuucgcacauucua

SEQ ID NO: 764498 - RNA, 18 nt, Leptospira interrogans serovar lai str. 56601
auuuucgcacauucuaua

SEQ ID NO: 764499 - RNA, 16 nt, Leptospira interrogans serovar lai str. 56601
auuuguauucaagagc

SEQ ID NO: 764500 - RNA, 20 nt, Leptospira interrogans serovar lai str. 56601
auuugucucaaaauuuaaga

SEQ ID NO: 764501 - RNA, 19 nt, Leptospira interrogans serovar lai str. 56601
auuuguggaaacuauuaca

SEQ ID NO: 764502 - RNA, 16 nt, Leptospira interrogans serovar lai str. 56601
auuugugcaaaaauuu

SEQ ID NO: 764503 - RNA, 19 nt, Leptospira interrogans serovar lai str. 56601
auuugugcaaaaauuuuuu

SEQ ID NO: 764504 - RNA, 20 nt, Leptospira interrogans serovar lai str. 56601
auuugugggaguucccacau

SEQ ID NO: 764505 - RNA, 19 nt, Leptospira interrogans serovar lai str. 56601
auuuuaaacaaagacaaag

SEQ ID NO: 764506 - RNA, 14 nt, Leptospira interrogans serovar lai str. 56601
auuuuaaaauucac

SEQ ID NO: 764507 - RNA, 20 nt, Leptospira interrogans serovar lai str. 56601
auuuuaaaauucacauuaua

SEQ ID NO: 764508 - RNA, 15 nt, Leptospira interrogans serovar lai str. 56601
auuuuaaagaaacuc

SEQ ID NO: 764509 - RNA, 17 nt, Leptospira interrogans serovar lai str. 56601
auuuguuccuaaaaaau

SEQ ID NO: 764510 - RNA, 15 nt, Leptospira interrogans serovar lai str. 56601
auuuguucuuaaaau

SEQ ID NO: 764511 - RNA, 15 nt, Leptospira interrogans serovar lai str. 56601
auuugauaugaauca

SEQ ID NO: 764512 - RNA, 17 nt, Leptospira interrogans serovar lai str. 56601
auuugguaauuugugaa

SEQ ID NO: 764513 - RNA, 20 nt, Leptospira interrogans serovar lai str. 56601
auuugguaauuugugaaccu

SEQ ID NO: 764514 - RNA, 22 nt, Leptospira interrogans serovar lai str. 56601
auuugcggaaucaauuuuagaa

SEQ ID NO: 764515 - RNA, 22 nt, Leptospira interrogans serovar lai str. 56601
auuuggaucgggacaaaucaua

SEQ ID NO: 764516 - RNA, 18 nt, Leptospira interrogans serovar lai str. 56601
auuucuuuuuuguuuugu

SEQ ID NO: 764517 - RNA, 21 nt, Leptospira interrogans serovar lai str. 56601
auuugaaaaaccgcugaagau

SEQ ID NO: 764518 - RNA, 20 nt, Leptospira interrogans serovar lai str. 56601
auuugaaaaagggauucuau

SEQ ID NO: 764519 - RNA, 13 nt, Leptospira interrogans serovar lai str. 56601
auuugaaaagaaa

SEQ ID NO: 764520 - RNA, 18 nt, Leptospira interrogans serovar lai str. 56601
auuugaaaauugaauuua

SEQ ID NO: 764521 - RNA, 13 nt, Leptospira interrogans serovar lai str. 56601
auuugaaaguaaa

SEQ ID NO: 764522 - RNA, 19 nt, Leptospira interrogans serovar lai str. 56601
auuugaaaguaaaaaagag

SEQ ID NO: 764523 - RNA, 15 nt, Leptospira interrogans serovar lai str. 56601
auuugaaguauuuua

SEQ ID NO: 764524 - RNA, 19 nt, Leptospira interrogans serovar lai str. 56601
auuucuucguuauuuuuau

SEQ ID NO: 764525 - RNA, 22 nt, Leptospira interrogans serovar lai str. 56601
auuucuucguuauuuuuauaaa

SEQ ID NO: 764526 - RNA, 22 nt, Leptospira interrogans serovar lai str. 56601
auuucuuauuuauuaaagugag

SEQ ID NO: 764527 - RNA, 18 nt, Leptospira interrogans serovar lai str. 56601
auuucuucauaucaaauu

SEQ ID NO: 764528 - RNA, 20 nt, Leptospira interrogans serovar lai str. 56601
auuucuucauaucaaauuca

SEQ ID NO: 764529 - RNA, 14 nt, Leptospira interrogans serovar lai str. 56601
auuucguuucccau

SEQ ID NO: 764530 - RNA, 17 nt, Leptospira interrogans serovar lai str. 56601
auuucguuucccucuuc

SEQ ID NO: 764531 - RNA, 13 nt, Leptospira interrogans serovar lai str. 56601
auuucguuuuuuu

SEQ ID NO: 764532 - RNA, 21 nt, Leptospira interrogans serovar lai str. 56601
auuucguuuuuuuaauauuac

SEQ ID NO: 764533 - RNA, 17 nt, Leptospira interrogans serovar lai str. 56601
auuucguucggaaaaaa

SEQ ID NO: 764534 - RNA, 22 nt, Leptospira interrogans serovar lai str. 56601
auuucguucggaaaaaauauga

SEQ ID NO: 764535 - RNA, 23 nt, Leptospira interrogans serovar lai str. 56601
auuucguucggaaaaaauaugau

SEQ ID NO: 764536 - RNA, 21 nt, Leptospira interrogans serovar lai str. 56601
auuucaugcaaaaauuuaauu

SEQ ID NO: 764537 - RNA, 12 nt, Leptospira interrogans serovar lai str. 56601
auuucuaaaauu

SEQ ID NO: 764538 - RNA, 15 nt, Leptospira interrogans serovar lai str. 56601
auuucuaaaagaaga

SEQ ID NO: 764539 - RNA, 16 nt, Leptospira interrogans serovar lai str. 56601
auuucuaaaagaagau

SEQ ID NO: 764540 - RNA, 12 nt, Leptospira interrogans serovar lai str. 56601
auuucuaaaagu

SEQ ID NO: 764541 - RNA, 12 nt, Leptospira interrogans serovar lai str. 56601
auuucuaaaaua

SEQ ID NO: 764542 - RNA, 15 nt, Leptospira interrogans serovar lai str. 56601
auuucuauuuuaaaa

SEQ ID NO: 764543 - RNA, 17 nt, Leptospira interrogans serovar lai str. 56601
auuucuauuuuaaaagg

SEQ ID NO: 764544 - RNA, 21 nt, Leptospira interrogans serovar lai str. 56601
auuucuaaauugugagaacua

SEQ ID NO: 764545 - RNA, 13 nt, Leptospira interrogans serovar lai str. 56601
auuucuaaguccu

SEQ ID NO: 764546 - RNA, 16 nt, Leptospira interrogans serovar lai str. 56601
auuucuaaguccuuuu

SEQ ID NO: 764547 - RNA, 17 nt, Leptospira interrogans serovar lai str. 56601
auuucuaaguccuuuuc

SEQ ID NO: 764548 - RNA, 19 nt, Leptospira interrogans serovar lai str. 56601
auuucuaaguccuuuucuu

SEQ ID NO: 764549 - RNA, 22 nt, Leptospira interrogans serovar lai str. 56601
auuucuaaguccuuuucuuaua

SEQ ID NO: 764550 - RNA, 20 nt, Leptospira interrogans serovar lai str. 56601
auuucuccaagaacguuucc

SEQ ID NO: 764551 - RNA, 15 nt, Leptospira interrogans serovar lai str. 56601
caaaaacucaaagaa

SEQ ID NO: 764552 - RNA, 16 nt, Leptospira interrogans serovar lai str. 56601
caaaaacuaaaauaca

SEQ ID NO: 764553 - RNA, 14 nt, Leptospira interrogans serovar lai str. 56601
caaaaacgcaaaaa

SEQ ID NO: 764554 - RNA, 14 nt, Leptospira interrogans serovar lai str. 56601
caaaaaauaaaauu

SEQ ID NO: 764555 - RNA, 12 nt, Leptospira interrogans serovar lai str. 56601
caaaaaauauac

SEQ ID NO: 764556 - RNA, 16 nt, Leptospira interrogans serovar lai str. 56601
caaaaaauauacuuuu

SEQ ID NO: 764557 - RNA, 13 nt, Leptospira interrogans serovar lai str. 56601
caaaaaauggaac

SEQ ID NO: 764558 - RNA, 17 nt, Leptospira interrogans serovar lai str. 56601
caaaaaaugguuuuuua

SEQ ID NO: 764559 - RNA, 23 nt, Leptospira interrogans serovar lai str. 56601
caaaaaauucuuuuuauuuuuac

SEQ ID NO: 764560 - RNA, 18 nt, Leptospira interrogans serovar lai str. 56601
caaaaaauugcauauucc

SEQ ID NO: 764561 - RNA, 20 nt, Leptospira interrogans serovar lai str. 56601
caaaaaauuucuaugaaaau

SEQ ID NO: 764562 - RNA, 21 nt, Leptospira interrogans serovar lai str. 56601
caaaaaaugcauucaaaaagu

SEQ ID NO: 764563 - RNA, 11 nt, Leptospira interrogans serovar lai str. 56601
caaaaaguaug

SEQ ID NO: 764564 - RNA, 12 nt, Leptospira interrogans serovar lai str. 56601
caaaaaguaugu

SEQ ID NO: 764565 - RNA, 21 nt, Leptospira interrogans serovar lai str. 56601
caaaaaggcacauuuuucaag

SEQ ID NO: 764566 - RNA, 20 nt, Leptospira interrogans serovar lai str. 56601
caaaaauaaauuccccaaaa

SEQ ID NO: 764567 - RNA, 13 nt, Leptospira interrogans serovar lai str. 56601
caaaaauuguaaa

SEQ ID NO: 764568 - RNA, 12 nt, Leptospira interrogans serovar lai str. 56601
caaaaauuccaa

SEQ ID NO: 764569 - RNA, 13 nt, Leptospira interrogans serovar lai str. 56601
caaaaauucaggu

SEQ ID NO: 764570 - RNA, 13 nt, Leptospira interrogans serovar lai str. 56601
caaaaaugagaau

SEQ ID NO: 764571 - RNA, 21 nt, Leptospira interrogans serovar lai str. 56601
caaaaauagggaaaacucaac

SEQ ID NO: 764572 - RNA, 22 nt, Leptospira interrogans serovar lai str. 56601
caaaaauagggaaaacucaaca

SEQ ID NO: 764573 - RNA, 21 nt, Leptospira interrogans serovar lai str. 56601
caaaaauagggaaaacucauc

SEQ ID NO: 764574 - RNA, 14 nt, Leptospira interrogans serovar lai str. 56601
caaaaauagcagau

SEQ ID NO: 764575 - RNA, 14 nt, Leptospira interrogans serovar lai str. 56601
caaaaauacuaaau

SEQ ID NO: 764576 - RNA, 16 nt, Leptospira interrogans serovar lai str. 56601
caaaaauacuaaauua

SEQ ID NO: 764577 - RNA, 18 nt, Leptospira interrogans serovar lai str. 56601
caaaaauagaauuuuugu

SEQ ID NO: 764578 - RNA, 19 nt, Leptospira interrogans serovar lai str. 56601
caaaagauugaauuuuuau

SEQ ID NO: 764579 - RNA, 12 nt, Leptospira interrogans serovar lai str. 56601
caaaagaacuuu

SEQ ID NO: 764580 - RNA, 16 nt, Leptospira interrogans serovar lai str. 56601
caaaacuaggaucucc

SEQ ID NO: 764581 - RNA, 15 nt, Leptospira interrogans serovar lai str. 56601
caaaacuaaaaccga

SEQ ID NO: 764582 - RNA, 22 nt, Leptospira interrogans serovar lai str. 56601
caaaacgguaauuucauaaaau

SEQ ID NO: 764583 - RNA, 18 nt, Leptospira interrogans serovar lai str. 56601
caaaacucuuuaaaaacu

SEQ ID NO: 764584 - RNA, 14 nt, Leptospira interrogans serovar lai str. 56601
caaaaauuuaaguc

SEQ ID NO: 764585 - RNA, 12 nt, Leptospira interrogans serovar lai str. 56601
caaaaauuuaau

SEQ ID NO: 764586 - RNA, 19 nt, Leptospira interrogans serovar lai str. 56601
caaaaauuuucuaaaagua

SEQ ID NO: 764587 - RNA, 14 nt, Leptospira interrogans serovar lai str. 56601
caaaaauuuuuuag

SEQ ID NO: 764588 - RNA, 16 nt, Leptospira interrogans serovar lai str. 56601
caaaaauuuuuuagag

SEQ ID NO: 764589 - RNA, 22 nt, Leptospira interrogans serovar lai str. 56601
caaaacaaaguauaacccaaaa

SEQ ID NO: 764590 - RNA, 14 nt, Leptospira interrogans serovar lai str. 56601
caaaaccaaaacau

SEQ ID NO: 764591 - RNA, 20 nt, Leptospira interrogans serovar lai str. 56601
caaaacgauauuuuuuaaaa

SEQ ID NO: 764592 - RNA, 18 nt, Leptospira interrogans serovar lai str. 56601
caaaaccuguaaaugaau

SEQ ID NO: 764593 - RNA, 23 nt, Leptospira interrogans serovar lai str. 56601
caaaaccuaauaaacaaaauuca

SEQ ID NO: 764594 - RNA, 15 nt, Leptospira interrogans serovar lai str. 56601
caaaaccucaaaaaa

SEQ ID NO: 764595 - RNA, 16 nt, Leptospira interrogans serovar lai str. 56601
caaaaccucaaaaaau

SEQ ID NO: 764596 - RNA, 17 nt, Leptospira interrogans serovar lai str. 56601
caaaaccucaaaaaauu

SEQ ID NO: 764597 - RNA, 15 nt, Leptospira interrogans serovar lai str. 56601
caaaaccauuuuugc

SEQ ID NO: 764598 - RNA, 14 nt, Leptospira interrogans serovar lai str. 56601
auuuuuuucuccuu

SEQ ID NO: 764599 - RNA, 15 nt, Leptospira interrogans serovar lai str. 56601
auuuuuuucuccuuu

SEQ ID NO: 764600 - RNA, 24 nt, Leptospira interrogans serovar lai str. 56601
auuuuuuucgcaaauucuacuauu

SEQ ID NO: 764601 - RNA, 14 nt, Leptospira interrogans serovar lai str. 56601
auuuuuuuguaaaa

SEQ ID NO: 764602 - RNA, 15 nt, Leptospira interrogans serovar lai str. 56601
auuuuuuuguaaaaa

SEQ ID NO: 764603 - RNA, 16 nt, Leptospira interrogans serovar lai str. 56601
auuuuuuucuaaaaua

SEQ ID NO: 764604 - RNA, 17 nt, Leptospira interrogans serovar lai str. 56601
auuuuuuuuauuuuuag

SEQ ID NO: 764605 - RNA, 13 nt, Leptospira interrogans serovar lai str. 56601
auuuuuuuuaaua

SEQ ID NO: 764606 - RNA, 15 nt, Leptospira interrogans serovar lai str. 56601
auuuuuuuuaaucau

SEQ ID NO: 764607 - RNA, 14 nt, Leptospira interrogans serovar lai str. 56601
caaaaaagaaagca

SEQ ID NO: 764608 - RNA, 17 nt, Leptospira interrogans serovar lai str. 56601
caaaaaagaaagcagca

SEQ ID NO: 764609 - RNA, 15 nt, Leptospira interrogans serovar lai str. 56601
caaaaaacucagcga

SEQ ID NO: 764610 - RNA, 14 nt, Leptospira interrogans serovar lai str. 56601
auuuuuuuaaaaaa

SEQ ID NO: 764611 - RNA, 12 nt, Leptospira interrogans serovar lai str. 56601
auuuuuuuaaac

SEQ ID NO: 764612 - RNA, 22 nt, Leptospira interrogans serovar lai str. 56601
auuuuuuuaaacuuuaaucauu

SEQ ID NO: 764613 - RNA, 17 nt, Leptospira interrogans serovar lai str. 56601
auuuuuuggaaauuuuu

SEQ ID NO: 764614 - RNA, 18 nt, Leptospira interrogans serovar lai str. 56601
auuuuuuggaaauuuuua

SEQ ID NO: 764615 - RNA, 17 nt, Leptospira interrogans serovar lai str. 56601
auuuuuugggcuucuga

SEQ ID NO: 764616 - RNA, 12 nt, Leptospira interrogans serovar lai str. 56601
auuuuuugcaaa

SEQ ID NO: 764617 - RNA, 17 nt, Leptospira interrogans serovar lai str. 56601
auuuuuuucaguauguu

SEQ ID NO: 764618 - RNA, 15 nt, Leptospira interrogans serovar lai str. 56601
auuuuuuuaucuauu

SEQ ID NO: 764619 - RNA, 16 nt, Leptospira interrogans serovar lai str. 56601
auuuuuuuaagaauuu

SEQ ID NO: 764620 - RNA, 15 nt, Leptospira interrogans serovar lai str. 56601
auuuuuuuaauacaa

SEQ ID NO: 764621 - RNA, 17 nt, Leptospira interrogans serovar lai str. 56601
auuuuuuguaugaguuc

SEQ ID NO: 764622 - RNA, 12 nt, Leptospira interrogans serovar lai str. 56601
auuuuuuaucaa

SEQ ID NO: 764623 - RNA, 18 nt, Leptospira interrogans serovar lai str. 56601
auuuuuucguuccuuuga

SEQ ID NO: 764624 - RNA, 13 nt, Leptospira interrogans serovar lai str. 56601
auuuuuuccuuua

SEQ ID NO: 764625 - RNA, 10 nt, Leptospira interrogans serovar lai str. 56601
auuuuuuccc

SEQ ID NO: 764626 - RNA, 22 nt, Leptospira interrogans serovar lai str. 56601
auuuuuucuaaauuagaauuuu

SEQ ID NO: 764627 - RNA, 11 nt, Leptospira interrogans serovar lai str. 56601
auuuuuucuuu

SEQ ID NO: 764628 - RNA, 13 nt, Leptospira interrogans serovar lai str. 56601
auuuuuugaaaaa

SEQ ID NO: 764629 - RNA, 18 nt, Leptospira interrogans serovar lai str. 56601
auuuuuugaaaaagaaua

SEQ ID NO: 764630 - RNA, 16 nt, Leptospira interrogans serovar lai str. 56601
auuuuuaaacucauuc

SEQ ID NO: 764631 - RNA, 17 nt, Leptospira interrogans serovar lai str. 56601
auuuuuaaaaguagaau

SEQ ID NO: 764632 - RNA, 15 nt, Leptospira interrogans serovar lai str. 56601
auuuuuaaaaagaau

SEQ ID NO: 764633 - RNA, 13 nt, Leptospira interrogans serovar lai str. 56601
auuuuuaaaaagu

SEQ ID NO: 764634 - RNA, 17 nt, Leptospira interrogans serovar lai str. 56601
auuuuguuuuauagaaa

SEQ ID NO: 764635 - RNA, 14 nt, Leptospira interrogans serovar lai str. 56601
auuuuguuuugaaa

SEQ ID NO: 764636 - RNA, 12 nt, Leptospira interrogans serovar lai str. 56601
auuuuuaaaaaa

SEQ ID NO: 764637 - RNA, 18 nt, Leptospira interrogans serovar lai str. 56601
auuuuuccagcgauucua

SEQ ID NO: 764638 - RNA, 11 nt, Leptospira interrogans serovar lai str. 56601
auuuuucuagu

SEQ ID NO: 764639 - RNA, 16 nt, Leptospira interrogans serovar lai str. 56601
auuuuucguaauggga

SEQ ID NO: 764640 - RNA, 13 nt, Leptospira interrogans serovar lai str. 56601
auuuuucuaaaaa

SEQ ID NO: 764641 - RNA, 12 nt, Leptospira interrogans serovar lai str. 56601
auuuuucucuau

SEQ ID NO: 764642 - RNA, 21 nt, Leptospira interrogans serovar lai str. 56601
auuuuucucuaucagaaaaac

SEQ ID NO: 764643 - RNA, 19 nt, Leptospira interrogans serovar lai str. 56601
auuuuucugaaaaaaguug

SEQ ID NO: 764644 - RNA, 23 nt, Leptospira interrogans serovar lai str. 56601
auuuuucuggaaaaguuuuuaaa

SEQ ID NO: 764645 - RNA, 15 nt, Leptospira interrogans serovar lai str. 56601
auuuuuccauaaaaa

SEQ ID NO: 764646 - RNA, 18 nt, Leptospira interrogans serovar lai str. 56601
auuuuucgaagauauaau

SEQ ID NO: 764647 - RNA, 22 nt, Leptospira interrogans serovar lai str. 56601
auuuuuccgauggucgaagaua

SEQ ID NO: 764648 - RNA, 22 nt, Leptospira interrogans serovar lai str. 56601
auuuuucuuaaaaaaauuguga

SEQ ID NO: 764649 - RNA, 23 nt, Leptospira interrogans serovar lai str. 56601
auuuuucuuaaaaaaauugugau

SEQ ID NO: 764650 - RNA, 17 nt, Leptospira interrogans serovar lai str. 56601
auuuuucuuaauuucuc

SEQ ID NO: 764651 - RNA, 12 nt, Leptospira interrogans serovar lai str. 56601
auuuuucuuuua

SEQ ID NO: 764652 - RNA, 15 nt, Leptospira interrogans serovar lai str. 56601
auuuuucuuuuaaaa

SEQ ID NO: 764653 - RNA, 16 nt, Leptospira interrogans serovar lai str. 56601
auuuuucuuuuaaaau

SEQ ID NO: 764654 - RNA, 16 nt, Leptospira interrogans serovar lai str. 56601
auuuuugaauuuuuua

SEQ ID NO: 764655 - RNA, 19 nt, Leptospira interrogans serovar lai str. 56601
auuuuugcaccaaauugca

SEQ ID NO: 764656 - RNA, 22 nt, Leptospira interrogans serovar lai str. 56601
auuuuuuaaaugcagcuauuuu

SEQ ID NO: 764657 - RNA, 23 nt, Leptospira interrogans serovar lai str. 56601
auuuuuuaaaugcagcuauuuuu

SEQ ID NO: 764658 - RNA, 21 nt, Leptospira interrogans serovar lai str. 56601
auuuuuguuuguaaaauuuaa

SEQ ID NO: 764659 - RNA, 11 nt, Leptospira interrogans serovar lai str. 56601
auuuuuuaaaa

SEQ ID NO: 764660 - RNA, 15 nt, Leptospira interrogans serovar lai str. 56601
auuuuuuaaaaauuu

SEQ ID NO: 764661 - RNA, 14 nt, Leptospira interrogans serovar lai str. 56601
auuuuuuaaaauaa

SEQ ID NO: 764662 - RNA, 12 nt, Leptospira interrogans serovar lai str. 56601
auuuuuuaaacu

SEQ ID NO: 764663 - RNA, 14 nt, Leptospira interrogans serovar lai str. 56601
auuuuugugaaacu

SEQ ID NO: 764664 - RNA, 23 nt, Leptospira interrogans serovar lai str. 56601
auuuuuguaaaauccagaauaau

SEQ ID NO: 764665 - RNA, 15 nt, Leptospira interrogans serovar lai str. 56601
auuuuuguacaaaac

SEQ ID NO: 764666 - RNA, 21 nt, Leptospira interrogans serovar lai str. 56601
auuuuuguagaauugaaagaa

SEQ ID NO: 764667 - RNA, 21 nt, Leptospira interrogans serovar lai str. 56601
auuuuuuagaaaucaauucuu

SEQ ID NO: 764668 - RNA, 14 nt, Leptospira interrogans serovar lai str. 56601
auuuuugugaaguu

SEQ ID NO: 764669 - RNA, 14 nt, Leptospira interrogans serovar lai str. 56601
auuuuuuaaauuua

SEQ ID NO: 764670 - RNA, 21 nt, Leptospira interrogans serovar lai str. 56601
caagccggauucgcccagauc

SEQ ID NO: 764671 - RNA, 16 nt, Leptospira interrogans serovar lai str. 56601
caacuuauaauuuucu

SEQ ID NO: 764672 - RNA, 21 nt, Leptospira interrogans serovar lai str. 56601
caacuuauaauuuucuuaaua

SEQ ID NO: 764673 - RNA, 22 nt, Leptospira interrogans serovar lai str. 56601
caacuuauaauuuucuuaauaa

SEQ ID NO: 764674 - RNA, 16 nt, Leptospira interrogans serovar lai str. 56601
caagcacauccgcauu

SEQ ID NO: 764675 - RNA, 23 nt, Leptospira interrogans serovar lai str. 56601
caaguauaaaagugaauuuuugu

SEQ ID NO: 764676 - RNA, 18 nt, Leptospira interrogans serovar lai str. 56601
caaguaggaauuggagga

SEQ ID NO: 764677 - RNA, 16 nt, Leptospira interrogans serovar lai str. 56601
caaguauucuauuuau

SEQ ID NO: 764678 - RNA, 23 nt, Leptospira interrogans serovar lai str. 56601
caaguauuugaucucaauauaaa

SEQ ID NO: 764679 - RNA, 15 nt, Leptospira interrogans serovar lai str. 56601
caaguuuaaaugaaa

SEQ ID NO: 764680 - RNA, 17 nt, Leptospira interrogans serovar lai str. 56601
caaguuuaaaugaaaug

SEQ ID NO: 764681 - RNA, 19 nt, Leptospira interrogans serovar lai str. 56601
caaguuuuugugacuuccu

SEQ ID NO: 764682 - RNA, 22 nt, Leptospira interrogans serovar lai str. 56601
caaguuuuucgguaaaaucauu

SEQ ID NO: 764683 - RNA, 15 nt, Leptospira interrogans serovar lai str. 56601
caaguuuucuuuuuu

SEQ ID NO: 764684 - RNA, 19 nt, Leptospira interrogans serovar lai str. 56601
caaguuuucuuuuuuucuc

SEQ ID NO: 764685 - RNA, 16 nt, Leptospira interrogans serovar lai str. 56601
caauaaaaacagaugg

SEQ ID NO: 764686 - RNA, 13 nt, Leptospira interrogans serovar lai str. 56601
caauaaaaacuaa

SEQ ID NO: 764687 - RNA, 15 nt, Leptospira interrogans serovar lai str. 56601
caauaaaaacuaaua

SEQ ID NO: 764688 - RNA, 14 nt, Leptospira interrogans serovar lai str. 56601
caauaaaauaccau

SEQ ID NO: 764689 - RNA, 17 nt, Leptospira interrogans serovar lai str. 56601
caauaaaauaccauaaa

SEQ ID NO: 764690 - RNA, 13 nt, Leptospira interrogans serovar lai str. 56601
caauaaaaauuag

SEQ ID NO: 764691 - RNA, 14 nt, Leptospira interrogans serovar lai str. 56601
caauaaaaucaaua

SEQ ID NO: 764692 - RNA, 15 nt, Leptospira interrogans serovar lai str. 56601
caauaaaucaaaagg

SEQ ID NO: 764693 - RNA, 21 nt, Leptospira interrogans serovar lai str. 56601
caauaacaaccaccuuuacau

SEQ ID NO: 764694 - RNA, 23 nt, Leptospira interrogans serovar lai str. 56601
caauaacaaccaccuuuacauaa

SEQ ID NO: 764695 - RNA, 22 nt, Leptospira interrogans serovar lai str. 56601
caauaaauugaaaguaaagaug

SEQ ID NO: 764696 - RNA, 17 nt, Leptospira interrogans serovar lai str. 56601
caauaaguuagaacuuc

SEQ ID NO: 764697 - RNA, 23 nt, Leptospira interrogans serovar lai str. 56601
caauacuuacacuccucaaagau

SEQ ID NO: 764698 - RNA, 21 nt, Leptospira interrogans serovar lai str. 56601
caauaauuucccauaaaaaga

SEQ ID NO: 764699 - RNA, 15 nt, Leptospira interrogans serovar lai str. 56601
caauacaacgaaaau

SEQ ID NO: 764700 - RNA, 13 nt, Leptospira interrogans serovar lai str. 56601
caauacaaaacaa

SEQ ID NO: 764701 - RNA, 14 nt, Leptospira interrogans serovar lai str. 56601
caauacaaaacaag

SEQ ID NO: 764702 - RNA, 18 nt, Leptospira interrogans serovar lai str. 56601
caauagcuucuuuaaaaa

SEQ ID NO: 764703 - RNA, 19 nt, Leptospira interrogans serovar lai str. 56601
caauagcuucuuuaaaaac

SEQ ID NO: 764704 - RNA, 21 nt, Leptospira interrogans serovar lai str. 56601
caauaguuucuacauuuuugu

SEQ ID NO: 764705 - RNA, 13 nt, Leptospira interrogans serovar lai str. 56601
caauauaaaaauu

SEQ ID NO: 764706 - RNA, 23 nt, Leptospira interrogans serovar lai str. 56601
caauggaaaguguuaguucccac

SEQ ID NO: 764707 - RNA, 14 nt, Leptospira interrogans serovar lai str. 56601
caaugguugcaaaa

SEQ ID NO: 764708 - RNA, 20 nt, Leptospira interrogans serovar lai str. 56601
caaugguugcaaaaaagaaa

SEQ ID NO: 764709 - RNA, 21 nt, Leptospira interrogans serovar lai str. 56601
caauguaacggaaauagaugg

SEQ ID NO: 764710 - RNA, 15 nt, Leptospira interrogans serovar lai str. 56601
caauguaagaaacuc

SEQ ID NO: 764711 - RNA, 12 nt, Leptospira interrogans serovar lai str. 56601
caaugaaauuuu

SEQ ID NO: 764712 - RNA, 16 nt, Leptospira interrogans serovar lai str. 56601
caaugaauuuuuauaa

SEQ ID NO: 764713 - RNA, 20 nt, Leptospira interrogans serovar lai str. 56601
caaugaauuuuuauaaaaau

SEQ ID NO: 764714 - RNA, 22 nt, Leptospira interrogans serovar lai str. 56601
caaugacaacagucauucugua

SEQ ID NO: 764715 - RNA, 15 nt, Leptospira interrogans serovar lai str. 56601
caaugaaaaagcaua

SEQ ID NO: 764716 - RNA, 20 nt, Leptospira interrogans serovar lai str. 56601
caaucuuccugggaaguugu

SEQ ID NO: 764717 - RNA, 21 nt, Leptospira interrogans serovar lai str. 56601
caaucuguuuagaauauuuuc

SEQ ID NO: 764718 - RNA, 22 nt, Leptospira interrogans serovar lai str. 56601
caaucuguuuagaauauuuucu

SEQ ID NO: 764719 - RNA, 23 nt, Leptospira interrogans serovar lai str. 56601
caaugauucuaacuuuugcaauc

SEQ ID NO: 764720 - RNA, 14 nt, Leptospira interrogans serovar lai str. 56601
caauauucuugauu

SEQ ID NO: 764721 - RNA, 14 nt, Leptospira interrogans serovar lai str. 56601
caauauucuaauuu

SEQ ID NO: 764722 - RNA, 15 nt, Leptospira interrogans serovar lai str. 56601
caauauuuaaaaauu

SEQ ID NO: 764723 - RNA, 20 nt, Leptospira interrogans serovar lai str. 56601
caaucauauuuuaauuuucu

SEQ ID NO: 764724 - RNA, 20 nt, Leptospira interrogans serovar lai str. 56601
caaucauagauacauaaacu

SEQ ID NO: 764725 - RNA, 13 nt, Leptospira interrogans serovar lai str. 56601
caaucaaauuuuu

SEQ ID NO: 764726 - RNA, 15 nt, Leptospira interrogans serovar lai str. 56601
caaucaaauuuuugc

SEQ ID NO: 764727 - RNA, 21 nt, Leptospira interrogans serovar lai str. 56601
caaucaaauuuuugcauaaaa

SEQ ID NO: 764728 - RNA, 14 nt, Leptospira interrogans serovar lai str. 56601
caaucaugaauauu

SEQ ID NO: 764729 - RNA, 13 nt, Leptospira interrogans serovar lai str. 56601
caaucauucuuua

SEQ ID NO: 764730 - RNA, 19 nt, Leptospira interrogans serovar lai str. 56601
caauccgcggauguuugaa

SEQ ID NO: 764731 - RNA, 16 nt, Leptospira interrogans serovar lai str. 56601
caaucggguaaaaaau

SEQ ID NO: 764732 - RNA, 20 nt, Leptospira interrogans serovar lai str. 56601
caaucgauaacuugauuuua

SEQ ID NO: 764733 - RNA, 22 nt, Leptospira interrogans serovar lai str. 56601
caauccucgcuuuuaauaauuc

SEQ ID NO: 764734 - RNA, 14 nt, Leptospira interrogans serovar lai str. 56601
caaucgucuguaaa

SEQ ID NO: 764735 - RNA, 19 nt, Leptospira interrogans serovar lai str. 56601
caaucgucuguaaaagaaa

SEQ ID NO: 764736 - RNA, 21 nt, Leptospira interrogans serovar lai str. 56601
caaucgucuguaaaagaaaaa

SEQ ID NO: 764737 - RNA, 20 nt, Leptospira interrogans serovar lai str. 56601
caaucuccacuauggaauuu

SEQ ID NO: 764738 - RNA, 21 nt, Leptospira interrogans serovar lai str. 56601
caaucugcaaagcucagauuc

SEQ ID NO: 764739 - RNA, 14 nt, Leptospira interrogans serovar lai str. 56601
caacggauuccucc

SEQ ID NO: 764740 - RNA, 14 nt, Leptospira interrogans serovar lai str. 56601
caacgcucucuacg

SEQ ID NO: 764741 - RNA, 18 nt, Leptospira interrogans serovar lai str. 56601
caacgcucuuuaugaauc

SEQ ID NO: 764742 - RNA, 13 nt, Leptospira interrogans serovar lai str. 56601
caacguaccaaaa

SEQ ID NO: 764743 - RNA, 20 nt, Leptospira interrogans serovar lai str. 56601
caacguagucguguuguuua

SEQ ID NO: 764744 - RNA, 17 nt, Leptospira interrogans serovar lai str. 56601
caacgucccuauuguau

SEQ ID NO: 764745 - RNA, 19 nt, Leptospira interrogans serovar lai str. 56601
caacucuucuucuagauuu

SEQ ID NO: 764746 - RNA, 21 nt, Leptospira interrogans serovar lai str. 56601
caacugaaaaugaccaaaauu

SEQ ID NO: 764747 - RNA, 14 nt, Leptospira interrogans serovar lai str. 56601
caacuguuuauaua

SEQ ID NO: 764748 - RNA, 19 nt, Leptospira interrogans serovar lai str. 56601
caacuuaaaacuguacaau

SEQ ID NO: 764749 - RNA, 24 nt, Leptospira interrogans serovar lai str. 56601
caacccaaacacaugagcauucuu

SEQ ID NO: 764750 - RNA, 19 nt, Leptospira interrogans serovar lai str. 56601
caaccagagcauauaauua

SEQ ID NO: 764751 - RNA, 12 nt, Leptospira interrogans serovar lai str. 56601
caaccaagaauu

SEQ ID NO: 764752 - RNA, 19 nt, Leptospira interrogans serovar lai str. 56601
caacauuaugaaucuuuca

SEQ ID NO: 764753 - RNA, 21 nt, Leptospira interrogans serovar lai str. 56601
caaauuuacucuuauaaaauu

SEQ ID NO: 764754 - RNA, 17 nt, Leptospira interrogans serovar lai str. 56601
caaauuucugaaacaau

SEQ ID NO: 764755 - RNA, 15 nt, Leptospira interrogans serovar lai str. 56601
caaauuucugcauca

SEQ ID NO: 764756 - RNA, 18 nt, Leptospira interrogans serovar lai str. 56601
caaauuucugcaugaaau

SEQ ID NO: 764757 - RNA, 18 nt, Leptospira interrogans serovar lai str. 56601
caaauuggguauaagaag

SEQ ID NO: 764758 - RNA, 17 nt, Leptospira interrogans serovar lai str. 56601
caacaauucuauuagaa

SEQ ID NO: 764759 - RNA, 17 nt, Leptospira interrogans serovar lai str. 56601
caacacaacgcucucua

SEQ ID NO: 764760 - RNA, 18 nt, Leptospira interrogans serovar lai str. 56601
caacacaacgcucuuuau

SEQ ID NO: 764761 - RNA, 21 nt, Leptospira interrogans serovar lai str. 56601
caacacacacuuuauaaaagu

SEQ ID NO: 764762 - RNA, 23 nt, Leptospira interrogans serovar lai str. 56601
caacacacacuuuauaaaaguau

SEQ ID NO: 764763 - RNA, 18 nt, Leptospira interrogans serovar lai str. 56601
caaauuugcgaaaaaaau

SEQ ID NO: 764764 - RNA, 19 nt, Leptospira interrogans serovar lai str. 56601
caaauuugcgaaaaaaaua

SEQ ID NO: 764765 - RNA, 19 nt, Leptospira interrogans serovar lai str. 56601
caaauuuggaaauugugag

SEQ ID NO: 764766 - RNA, 20 nt, Leptospira interrogans serovar lai str. 56601
caacagaaacggauggagaa

SEQ ID NO: 764767 - RNA, 16 nt, Leptospira interrogans serovar lai str. 56601
caacagaauguucuua

SEQ ID NO: 764768 - RNA, 14 nt, Leptospira interrogans serovar lai str. 56601
caacacauuuucau

SEQ ID NO: 764769 - RNA, 19 nt, Leptospira interrogans serovar lai str. 56601
caacaccaccaacagcauc

SEQ ID NO: 764770 - RNA, 20 nt, Leptospira interrogans serovar lai str. 56601
caacaccaauucgguugacu

SEQ ID NO: 764771 - RNA, 15 nt, Leptospira interrogans serovar lai str. 56601
caaaucuaaauuuua

SEQ ID NO: 764772 - RNA, 14 nt, Leptospira interrogans serovar lai str. 56601
caaaucugaaauuc

SEQ ID NO: 764773 - RNA, 19 nt, Leptospira interrogans serovar lai str. 56601
caaaucgcugguuuuauuu

SEQ ID NO: 764774 - RNA, 18 nt, Leptospira interrogans serovar lai str. 56601
caaaucagguuuuuacag

SEQ ID NO: 764775 - RNA, 21 nt, Leptospira interrogans serovar lai str. 56601
caaaucaucccgcccaaagua

SEQ ID NO: 764776 - RNA, 16 nt, Leptospira interrogans serovar lai str. 56601
caaaucgcauuguuua

SEQ ID NO: 764777 - RNA, 14 nt, Leptospira interrogans serovar lai str. 56601
caaaucaauuuuaa

SEQ ID NO: 764778 - RNA, 16 nt, Leptospira interrogans serovar lai str. 56601
caaaucaauuuuaaau

SEQ ID NO: 764779 - RNA, 17 nt, Leptospira interrogans serovar lai str. 56601
caaaucacaauuuuaag

SEQ ID NO: 764780 - RNA, 16 nt, Leptospira interrogans serovar lai str. 56601
caaaucacaauuuuac

SEQ ID NO: 764781 - RNA, 15 nt, Leptospira interrogans serovar lai str. 56601
caaauuaguauuuuu

SEQ ID NO: 764782 - RNA, 17 nt, Leptospira interrogans serovar lai str. 56601
caaauuaguauuuuucu

SEQ ID NO: 764783 - RNA, 22 nt, Leptospira interrogans serovar lai str. 56601
caaauuaguauuuuucuuaauu

SEQ ID NO: 764784 - RNA, 22 nt, Leptospira interrogans serovar lai str. 56601
caaauugaacggacuguuuuaa

SEQ ID NO: 764785 - RNA, 13 nt, Leptospira interrogans serovar lai str. 56601
caaauucuuuuug

SEQ ID NO: 764786 - RNA, 18 nt, Leptospira interrogans serovar lai str. 56601
caaauucgucaaaaccaa

SEQ ID NO: 764787 - RNA, 20 nt, Leptospira interrogans serovar lai str. 56601
caaauucuaaaauuguagaa

SEQ ID NO: 764788 - RNA, 20 nt, Leptospira interrogans serovar lai str. 56601
caaauucuaaacuuguaaga

SEQ ID NO: 764789 - RNA, 15 nt, Leptospira interrogans serovar lai str. 56601
caaauucuucuuccu

SEQ ID NO: 764790 - RNA, 23 nt, Leptospira interrogans serovar lai str. 56601
caaaugcgaccuaacuuguagaa

SEQ ID NO: 764791 - RNA, 23 nt, Leptospira interrogans serovar lai str. 56601
caaaugcaguaaugccuacaaau

SEQ ID NO: 764792 - RNA, 13 nt, Leptospira interrogans serovar lai str. 56601
caaauacaaaaac

SEQ ID NO: 764793 - RNA, 14 nt, Leptospira interrogans serovar lai str. 56601
caaauaauaaaacu

SEQ ID NO: 764794 - RNA, 18 nt, Leptospira interrogans serovar lai str. 56601
caaauaauaaaacuacuc

SEQ ID NO: 764795 - RNA, 17 nt, Leptospira interrogans serovar lai str. 56601
caaauaauaaaacuuuu

SEQ ID NO: 764796 - RNA, 12 nt, Leptospira interrogans serovar lai str. 56601
caaauaaaagga

SEQ ID NO: 764797 - RNA, 23 nt, Leptospira interrogans serovar lai str. 56601
caaauaaaaggcugcuuuuuuga

SEQ ID NO: 764798 - RNA, 16 nt, Leptospira interrogans serovar lai str. 56601
caaauaaaacuucucc

SEQ ID NO: 764799 - RNA, 11 nt, Leptospira interrogans serovar lai str. 56601
caaauaaaaac

SEQ ID NO: 764800 - RNA, 12 nt, Leptospira interrogans serovar lai str. 56601
caaauaaaaaca

SEQ ID NO: 764801 - RNA, 13 nt, Leptospira interrogans serovar lai str. 56601
caaauaaaaacac

SEQ ID NO: 764802 - RNA, 21 nt, Leptospira interrogans serovar lai str. 56601
caaaguuuucacaaaaaaauu

SEQ ID NO: 764803 - RNA, 19 nt, Leptospira interrogans serovar lai str. 56601
caaaguuauugaauagaau

SEQ ID NO: 764804 - RNA, 16 nt, Leptospira interrogans serovar lai str. 56601
caaaguuacuucccuu

SEQ ID NO: 764805 - RNA, 22 nt, Leptospira interrogans serovar lai str. 56601
caaagucuugaacuuucuuauc

SEQ ID NO: 764806 - RNA, 19 nt, Leptospira interrogans serovar lai str. 56601
caaaguuucuuauauaaaa

SEQ ID NO: 764807 - RNA, 19 nt, Leptospira interrogans serovar lai str. 56601
caaagucgcccaaacccca

SEQ ID NO: 764808 - RNA, 15 nt, Leptospira interrogans serovar lai str. 56601
caaaguauucuuucc

SEQ ID NO: 764809 - RNA, 23 nt, Leptospira interrogans serovar lai str. 56601
caaagucaaaggagaaggauaaa

SEQ ID NO: 764810 - RNA, 13 nt, Leptospira interrogans serovar lai str. 56601
caaaguaugauuu

SEQ ID NO: 764811 - RNA, 15 nt, Leptospira interrogans serovar lai str. 56601
caaagccgcacaaac

SEQ ID NO: 764812 - RNA, 18 nt, Leptospira interrogans serovar lai str. 56601
caaagccgcacaaaccaa

SEQ ID NO: 764813 - RNA, 22 nt, Leptospira interrogans serovar lai str. 56601
caaagccggauucgcucaaauu

SEQ ID NO: 764814 - RNA, 16 nt, Leptospira interrogans serovar lai str. 56601
caaagauuuuaaaaau

SEQ ID NO: 764815 - RNA, 15 nt, Leptospira interrogans serovar lai str. 56601
caaagaauaccaaaa

SEQ ID NO: 764816 - RNA, 21 nt, Leptospira interrogans serovar lai str. 56601
caaagaauaccaaaaaaguac

SEQ ID NO: 764817 - RNA, 20 nt, Leptospira interrogans serovar lai str. 56601
caaagaauauaaaaucuuaa

SEQ ID NO: 764818 - RNA, 13 nt, Leptospira interrogans serovar lai str. 56601
caaagaaucauuu

SEQ ID NO: 764819 - RNA, 18 nt, Leptospira interrogans serovar lai str. 56601
caaagaaauuuuacucga

SEQ ID NO: 764820 - RNA, 15 nt, Leptospira interrogans serovar lai str. 56601
caaacuuuuagauaa

SEQ ID NO: 764821 - RNA, 15 nt, Leptospira interrogans serovar lai str. 56601
caaacuuuuguaaua

SEQ ID NO: 764822 - RNA, 18 nt, Leptospira interrogans serovar lai str. 56601
caaacuuuuguaauaaaa

SEQ ID NO: 764823 - RNA, 17 nt, Leptospira interrogans serovar lai str. 56601
caaacuuuuuauaaaaa

SEQ ID NO: 764824 - RNA, 19 nt, Leptospira interrogans serovar lai str. 56601
caaacuuuuuauaaaaagc

SEQ ID NO: 764825 - RNA, 18 nt, Leptospira interrogans serovar lai str. 56601
caaagaaauagaaaagca

SEQ ID NO: 764826 - RNA, 22 nt, Leptospira interrogans serovar lai str. 56601
caaagaaacguuauacaauauu

SEQ ID NO: 764827 - RNA, 18 nt, Leptospira interrogans serovar lai str. 56601
caaagaaagaaaauacau

SEQ ID NO: 764828 - RNA, 11 nt, Leptospira interrogans serovar lai str. 56601
caaaaggauuc

SEQ ID NO: 764829 - RNA, 18 nt, Leptospira interrogans serovar lai str. 56601
caaaagguauaaaauaaa

SEQ ID NO: 764830 - RNA, 21 nt, Leptospira interrogans serovar lai str. 56601
caaaagguauaaaauaaaaau

SEQ ID NO: 764831 - RNA, 22 nt, Leptospira interrogans serovar lai str. 56601
caaaagguauaaaauaaaaauu

SEQ ID NO: 764832 - RNA, 13 nt, Leptospira interrogans serovar lai str. 56601
cagcaaagaaggc

SEQ ID NO: 764833 - RNA, 13 nt, Leptospira interrogans serovar lai str. 56601
cagcacaacgcug

SEQ ID NO: 764834 - RNA, 23 nt, Leptospira interrogans serovar lai str. 56601
cagaugagcauuuuuuuaauaca

SEQ ID NO: 764835 - RNA, 20 nt, Leptospira interrogans serovar lai str. 56601
cagaugaauugaauuuuuua

SEQ ID NO: 764836 - RNA, 23 nt, Leptospira interrogans serovar lai str. 56601
cagaugaauugaauuuuuuaaau

SEQ ID NO: 764837 - RNA, 18 nt, Leptospira interrogans serovar lai str. 56601
cagauggagaauuaauuu

SEQ ID NO: 764838 - RNA, 22 nt, Leptospira interrogans serovar lai str. 56601
cagaucgcguuuuauaauaaau

SEQ ID NO: 764839 - RNA, 15 nt, Leptospira interrogans serovar lai str. 56601
cagauuuauuuuaga

SEQ ID NO: 764840 - RNA, 21 nt, Leptospira interrogans serovar lai str. 56601
cagauuucagcuccaaaaaaa

SEQ ID NO: 764841 - RNA, 22 nt, Leptospira interrogans serovar lai str. 56601
cagauuucagcuccaaaaaaau

SEQ ID NO: 764842 - RNA, 24 nt, Leptospira interrogans serovar lai str. 56601
cagauuguuauuggaucguguaau

SEQ ID NO: 764843 - RNA, 20 nt, Leptospira interrogans serovar lai str. 56601
cagauuuuuucugguggaau

SEQ ID NO: 764844 - RNA, 21 nt, Leptospira interrogans serovar lai str. 56601
cagauuuuuucugguggaauu

SEQ ID NO: 764845 - RNA, 18 nt, Leptospira interrogans serovar lai str. 56601
cagcaaaaccuucgugaa

SEQ ID NO: 764846 - RNA, 19 nt, Leptospira interrogans serovar lai str. 56601
cagcaaaacacuuuccuua

SEQ ID NO: 764847 - RNA, 14 nt, Leptospira interrogans serovar lai str. 56601
cagauuaaaaaaua

SEQ ID NO: 764848 - RNA, 17 nt, Leptospira interrogans serovar lai str. 56601
cagauucuaaaaaugaa

SEQ ID NO: 764849 - RNA, 14 nt, Leptospira interrogans serovar lai str. 56601
cagaucauuuugua

SEQ ID NO: 764850 - RNA, 15 nt, Leptospira interrogans serovar lai str. 56601
cagagucuauaaaau

SEQ ID NO: 764851 - RNA, 16 nt, Leptospira interrogans serovar lai str. 56601
cagagucuauaaaaua

SEQ ID NO: 764852 - RNA, 16 nt, Leptospira interrogans serovar lai str. 56601
cagaguuauauaagau

SEQ ID NO: 764853 - RNA, 20 nt, Leptospira interrogans serovar lai str. 56601
cagagcgauauaauaaaauc

SEQ ID NO: 764854 - RNA, 20 nt, Leptospira interrogans serovar lai str. 56601
cagagcuuuacaauaaaaau

SEQ ID NO: 764855 - RNA, 18 nt, Leptospira interrogans serovar lai str. 56601
cagaggcaguacaauuca

SEQ ID NO: 764856 - RNA, 22 nt, Leptospira interrogans serovar lai str. 56601
cagagaauaucugaauuuuuau

SEQ ID NO: 764857 - RNA, 12 nt, Leptospira interrogans serovar lai str. 56601
cagacuuugaau

SEQ ID NO: 764858 - RNA, 15 nt, Leptospira interrogans serovar lai str. 56601
cagacuuugaaugca

SEQ ID NO: 764859 - RNA, 15 nt, Leptospira interrogans serovar lai str. 56601
cagacugacugaaaa

SEQ ID NO: 764860 - RNA, 15 nt, Leptospira interrogans serovar lai str. 56601
cagacugauucuuua

SEQ ID NO: 764861 - RNA, 13 nt, Leptospira interrogans serovar lai str. 56601
cagacugauuuuu

SEQ ID NO: 764862 - RNA, 18 nt, Leptospira interrogans serovar lai str. 56601
cagacugauuuuuuaaau

SEQ ID NO: 764863 - RNA, 19 nt, Leptospira interrogans serovar lai str. 56601
cagagcaucauacaguaaa

SEQ ID NO: 764864 - RNA, 14 nt, Leptospira interrogans serovar lai str. 56601
cagagagcgaccau

SEQ ID NO: 764865 - RNA, 17 nt, Leptospira interrogans serovar lai str. 56601
cagagauuccgauucuc

SEQ ID NO: 764866 - RNA, 18 nt, Leptospira interrogans serovar lai str. 56601
cagagauuccgauucucc

SEQ ID NO: 764867 - RNA, 21 nt, Leptospira interrogans serovar lai str. 56601
cagacaugauucauuuuucug

SEQ ID NO: 764868 - RNA, 14 nt, Leptospira interrogans serovar lai str. 56601
cagaauuuugaaca

SEQ ID NO: 764869 - RNA, 16 nt, Leptospira interrogans serovar lai str. 56601
cagaauuuuuuaacaa

SEQ ID NO: 764870 - RNA, 21 nt, Leptospira interrogans serovar lai str. 56601
cagacaauccuauaucaacaa

SEQ ID NO: 764871 - RNA, 16 nt, Leptospira interrogans serovar lai str. 56601
cagaauguuuucuaca

SEQ ID NO: 764872 - RNA, 14 nt, Leptospira interrogans serovar lai str. 56601
cagaauuaaaaauu

SEQ ID NO: 764873 - RNA, 13 nt, Leptospira interrogans serovar lai str. 56601
cagaauaaaguac

SEQ ID NO: 764874 - RNA, 12 nt, Leptospira interrogans serovar lai str. 56601
cagaaucaaagg

SEQ ID NO: 764875 - RNA, 23 nt, Leptospira interrogans serovar lai str. 56601
cagaaucaaaggaaauaaaaaua

SEQ ID NO: 764876 - RNA, 15 nt, Leptospira interrogans serovar lai str. 56601
cagaaugaacucaac

SEQ ID NO: 764877 - RNA, 16 nt, Leptospira interrogans serovar lai str. 56601
cagaaugaacucaaca

SEQ ID NO: 764878 - RNA, 16 nt, Leptospira interrogans serovar lai str. 56601
cagaaguauuccauau

SEQ ID NO: 764879 - RNA, 23 nt, Leptospira interrogans serovar lai str. 56601
cagaagggagaauaucuacuuua

SEQ ID NO: 764880 - RNA, 18 nt, Leptospira interrogans serovar lai str. 56601
cagaacgggcuuucuaug

SEQ ID NO: 764881 - RNA, 14 nt, Leptospira interrogans serovar lai str. 56601
cagaaccucaaaga

SEQ ID NO: 764882 - RNA, 17 nt, Leptospira interrogans serovar lai str. 56601
cagaaaccauaaaauaa

SEQ ID NO: 764883 - RNA, 18 nt, Leptospira interrogans serovar lai str. 56601
cagaaaccauaaaauaaa

SEQ ID NO: 764884 - RNA, 20 nt, Leptospira interrogans serovar lai str. 56601
cagaaacggauggagaauuu

SEQ ID NO: 764885 - RNA, 17 nt, Leptospira interrogans serovar lai str. 56601
cagaaauauauucuuuu

SEQ ID NO: 764886 - RNA, 19 nt, Leptospira interrogans serovar lai str. 56601
cagaacaaaacguuaucga

SEQ ID NO: 764887 - RNA, 23 nt, Leptospira interrogans serovar lai str. 56601
cacuuuauaaaaguauaauauuu

SEQ ID NO: 764888 - RNA, 15 nt, Leptospira interrogans serovar lai str. 56601
cacuuguuauuaaaa

SEQ ID NO: 764889 - RNA, 23 nt, Leptospira interrogans serovar lai str. 56601
cagaaaaaaaaagaauuucuaaa

SEQ ID NO: 764890 - RNA, 16 nt, Leptospira interrogans serovar lai str. 56601
cagaaaaaauccauau

SEQ ID NO: 764891 - RNA, 14 nt, Leptospira interrogans serovar lai str. 56601
cacuuuuuuaaagu

SEQ ID NO: 764892 - RNA, 23 nt, Leptospira interrogans serovar lai str. 56601
cacuuuuuacaugagacuauaaa

SEQ ID NO: 764893 - RNA, 20 nt, Leptospira interrogans serovar lai str. 56601
cagaaaaauguuaaaaaacu

SEQ ID NO: 764894 - RNA, 15 nt, Leptospira interrogans serovar lai str. 56601
cacuuugagaaagaa

SEQ ID NO: 764895 - RNA, 12 nt, Leptospira interrogans serovar lai str. 56601
cacuuuuaaaga

SEQ ID NO: 764896 - RNA, 13 nt, Leptospira interrogans serovar lai str. 56601
cacuuuuccaaau

SEQ ID NO: 764897 - RNA, 12 nt, Leptospira interrogans serovar lai str. 56601
cacuucuuuuag

SEQ ID NO: 764898 - RNA, 19 nt, Leptospira interrogans serovar lai str. 56601
cacuuaugauuuaguaaaa

SEQ ID NO: 764899 - RNA, 15 nt, Leptospira interrogans serovar lai str. 56601
cacuuccauuuuuug

SEQ ID NO: 764900 - RNA, 11 nt, Leptospira interrogans serovar lai str. 56601
cacuuaaaaag

SEQ ID NO: 764901 - RNA, 18 nt, Leptospira interrogans serovar lai str. 56601
cacuuaaaaaguuuuucu

SEQ ID NO: 764902 - RNA, 14 nt, Leptospira interrogans serovar lai str. 56601
caauguugcuccuu

SEQ ID NO: 764903 - RNA, 20 nt, Leptospira interrogans serovar lai str. 56601
caauguuuuucgcuuaucaa

SEQ ID NO: 764904 - RNA, 12 nt, Leptospira interrogans serovar lai str. 56601
caauuaaaaaga

SEQ ID NO: 764905 - RNA, 19 nt, Leptospira interrogans serovar lai str. 56601
caauguuccuguggaaacg

SEQ ID NO: 764906 - RNA, 17 nt, Leptospira interrogans serovar lai str. 56601
caaugugggaacuacua

SEQ ID NO: 764907 - RNA, 17 nt, Leptospira interrogans serovar lai str. 56601
caaugugccuucguuua

SEQ ID NO: 764908 - RNA, 18 nt, Leptospira interrogans serovar lai str. 56601
cacugcauuuuauuaaaa

SEQ ID NO: 764909 - RNA, 18 nt, Leptospira interrogans serovar lai str. 56601
cagcgaauaccucuaaaa

SEQ ID NO: 764910 - RNA, 21 nt, Leptospira interrogans serovar lai str. 56601
cagccgaauuugcgaaaaaaa

SEQ ID NO: 764911 - RNA, 17 nt, Leptospira interrogans serovar lai str. 56601
cagcccauucuuucccc

SEQ ID NO: 764912 - RNA, 14 nt, Leptospira interrogans serovar lai str. 56601
cagccaaagaaaua

SEQ ID NO: 764913 - RNA, 20 nt, Leptospira interrogans serovar lai str. 56601
cagcaucgaauauccuugaa

SEQ ID NO: 764914 - RNA, 21 nt, Leptospira interrogans serovar lai str. 56601
cagcacuaaaagcuaauaauc

SEQ ID NO: 764915 - RNA, 22 nt, Leptospira interrogans serovar lai str. 56601
cauucuuagaauuuuccucccg

SEQ ID NO: 764916 - RNA, 14 nt, Leptospira interrogans serovar lai str. 56601
cauugaguuuuuua

SEQ ID NO: 764917 - RNA, 23 nt, Leptospira interrogans serovar lai str. 56601
cauugaguuuuuuaguaguucca

SEQ ID NO: 764918 - RNA, 13 nt, Leptospira interrogans serovar lai str. 56601
cauugaguuugag

SEQ ID NO: 764919 - RNA, 16 nt, Leptospira interrogans serovar lai str. 56601
cauucuaagaucugau

SEQ ID NO: 764920 - RNA, 12 nt, Leptospira interrogans serovar lai str. 56601
cauucuaaaauu

SEQ ID NO: 764921 - RNA, 14 nt, Leptospira interrogans serovar lai str. 56601
cauucuaaagaagg

SEQ ID NO: 764922 - RNA, 15 nt, Leptospira interrogans serovar lai str. 56601
cauucuaaagaaggg

SEQ ID NO: 764923 - RNA, 20 nt, Leptospira interrogans serovar lai str. 56601
cauucuacuuugaaugaaaa

SEQ ID NO: 764924 - RNA, 23 nt, Leptospira interrogans serovar lai str. 56601
cauucuagaaccuggaaaagaau

SEQ ID NO: 764925 - RNA, 22 nt, Leptospira interrogans serovar lai str. 56601
cauucuaguuuguuuauccaua

SEQ ID NO: 764926 - RNA, 16 nt, Leptospira interrogans serovar lai str. 56601
cauucugaaaaaaguu

SEQ ID NO: 764927 - RNA, 19 nt, Leptospira interrogans serovar lai str. 56601
cauucugaaacuuuucaaa

SEQ ID NO: 764928 - RNA, 21 nt, Leptospira interrogans serovar lai str. 56601
cauucuauuuggauuuuauaa

SEQ ID NO: 764929 - RNA, 19 nt, Leptospira interrogans serovar lai str. 56601
cauuaugaauuuuuaaaca

SEQ ID NO: 764930 - RNA, 16 nt, Leptospira interrogans serovar lai str. 56601
cauuggauucugcucu

SEQ ID NO: 764931 - RNA, 16 nt, Leptospira interrogans serovar lai str. 56601
cauuggaguuaagccc

SEQ ID NO: 764932 - RNA, 15 nt, Leptospira interrogans serovar lai str. 56601
cauuggcaaauguua

SEQ ID NO: 764933 - RNA, 14 nt, Leptospira interrogans serovar lai str. 56601
cauugucuauuuua

SEQ ID NO: 764934 - RNA, 11 nt, Leptospira interrogans serovar lai str. 56601
cauuguuugaa

SEQ ID NO: 764935 - RNA, 17 nt, Leptospira interrogans serovar lai str. 56601
cauuguuuuacucuuau

SEQ ID NO: 764936 - RNA, 12 nt, Leptospira interrogans serovar lai str. 56601
cauuuaaaaaau

SEQ ID NO: 764937 - RNA, 14 nt, Leptospira interrogans serovar lai str. 56601
cauuuaaaaauuga

SEQ ID NO: 764938 - RNA, 20 nt, Leptospira interrogans serovar lai str. 56601
cauugauuuucauuuugcua

SEQ ID NO: 764939 - RNA, 17 nt, Leptospira interrogans serovar lai str. 56601
cauugauaauuucuagu

SEQ ID NO: 764940 - RNA, 22 nt, Leptospira interrogans serovar lai str. 56601
cauugauaauuucuaguuugaa

SEQ ID NO: 764941 - RNA, 19 nt, Leptospira interrogans serovar lai str. 56601
cauuuuguugcguuuaaaa

SEQ ID NO: 764942 - RNA, 17 nt, Leptospira interrogans serovar lai str. 56601
cauuuuggcguuuuugu

SEQ ID NO: 764943 - RNA, 23 nt, Leptospira interrogans serovar lai str. 56601
cauuuugcuaaggugcugagaag

SEQ ID NO: 764944 - RNA, 14 nt, Leptospira interrogans serovar lai str. 56601
cauuuuuuaaaugc

SEQ ID NO: 764945 - RNA, 14 nt, Leptospira interrogans serovar lai str. 56601
cauuuuuuaaauuu

SEQ ID NO: 764946 - RNA, 15 nt, Leptospira interrogans serovar lai str. 56601
cauuuuuuaaauuua

SEQ ID NO: 764947 - RNA, 13 nt, Leptospira interrogans serovar lai str. 56601
cauuuuucuucuu

SEQ ID NO: 764948 - RNA, 16 nt, Leptospira interrogans serovar lai str. 56601
cauuuuugugaaacuc

SEQ ID NO: 764949 - RNA, 23 nt, Leptospira interrogans serovar lai str. 56601
cauuuuugugaaguuaaaacauu

SEQ ID NO: 764950 - RNA, 13 nt, Leptospira interrogans serovar lai str. 56601
cauuuuucuaaaa

SEQ ID NO: 764951 - RNA, 14 nt, Leptospira interrogans serovar lai str. 56601
cauuuuucuaaaaa

SEQ ID NO: 764952 - RNA, 20 nt, Leptospira interrogans serovar lai str. 56601
cauuuuucuacaauuauauu

SEQ ID NO: 764953 - RNA, 16 nt, Leptospira interrogans serovar lai str. 56601
cauuuuuccauaaaaa

SEQ ID NO: 764954 - RNA, 14 nt, Leptospira interrogans serovar lai str. 56601
cauuuuucaaauaa

SEQ ID NO: 764955 - RNA, 16 nt, Leptospira interrogans serovar lai str. 56601
cauuuuuacaauaacc

SEQ ID NO: 764956 - RNA, 15 nt, Leptospira interrogans serovar lai str. 56601
cauuuuuaagauuac

SEQ ID NO: 764957 - RNA, 18 nt, Leptospira interrogans serovar lai str. 56601
cauuuucagguuuuaaaa

SEQ ID NO: 764958 - RNA, 15 nt, Leptospira interrogans serovar lai str. 56601
cauuuucauaauaaa

SEQ ID NO: 764959 - RNA, 19 nt, Leptospira interrogans serovar lai str. 56601
cauuuucauucuaaagaag

SEQ ID NO: 764960 - RNA, 14 nt, Leptospira interrogans serovar lai str. 56601
cauuuucaauuuuu

SEQ ID NO: 764961 - RNA, 16 nt, Leptospira interrogans serovar lai str. 56601
cauuuucaauuuuuau

SEQ ID NO: 764962 - RNA, 21 nt, Leptospira interrogans serovar lai str. 56601
cauuuucuauaguuguuaaaa

SEQ ID NO: 764963 - RNA, 13 nt, Leptospira interrogans serovar lai str. 56601
cauuuuaauaauc

SEQ ID NO: 764964 - RNA, 15 nt, Leptospira interrogans serovar lai str. 56601
cauuuuaaaaauuca

SEQ ID NO: 764965 - RNA, 14 nt, Leptospira interrogans serovar lai str. 56601
cauuuuacagaaua

SEQ ID NO: 764966 - RNA, 14 nt, Leptospira interrogans serovar lai str. 56601
cauuuuauacuuau

SEQ ID NO: 764967 - RNA, 19 nt, Leptospira interrogans serovar lai str. 56601
cauuuuauuuuuacaaaaa

SEQ ID NO: 764968 - RNA, 22 nt, Leptospira interrogans serovar lai str. 56601
cauuuuauugugaguuuaaaga

SEQ ID NO: 764969 - RNA, 23 nt, Leptospira interrogans serovar lai str. 56601
cauuuggaucuguaauuggaaug

SEQ ID NO: 764970 - RNA, 17 nt, Leptospira interrogans serovar lai str. 56601
cauuugcauaggugauu

SEQ ID NO: 764971 - RNA, 20 nt, Leptospira interrogans serovar lai str. 56601
cauuuuaaacaaagacaaag

SEQ ID NO: 764972 - RNA, 19 nt, Leptospira interrogans serovar lai str. 56601
cauuuguuuuuuauaauuu

SEQ ID NO: 764973 - RNA, 15 nt, Leptospira interrogans serovar lai str. 56601
cauuuguaaauaaac

SEQ ID NO: 764974 - RNA, 18 nt, Leptospira interrogans serovar lai str. 56601
cauuugacaauuugugaa

SEQ ID NO: 764975 - RNA, 19 nt, Leptospira interrogans serovar lai str. 56601
cauuugauuaaaaauuucu

SEQ ID NO: 764976 - RNA, 14 nt, Leptospira interrogans serovar lai str. 56601
cauuugaauuuaua

SEQ ID NO: 764977 - RNA, 15 nt, Leptospira interrogans serovar lai str. 56601
cauuugaauuuauag

SEQ ID NO: 764978 - RNA, 20 nt, Leptospira interrogans serovar lai str. 56601
cauuuaauauauucaaaaga

SEQ ID NO: 764979 - RNA, 22 nt, Leptospira interrogans serovar lai str. 56601
cauuuaaaugucuacuugucuu

SEQ ID NO: 764980 - RNA, 18 nt, Leptospira interrogans serovar lai str. 56601
cauuaaaguccaaaucaa

SEQ ID NO: 764981 - RNA, 19 nt, Leptospira interrogans serovar lai str. 56601
cauuaaaguccaaaucaaa

SEQ ID NO: 764982 - RNA, 20 nt, Leptospira interrogans serovar lai str. 56601
cauuaaaauaggauuuaaau

SEQ ID NO: 764983 - RNA, 21 nt, Leptospira interrogans serovar lai str. 56601
cauuaaaauuuucaucuuuuc

SEQ ID NO: 764984 - RNA, 16 nt, Leptospira interrogans serovar lai str. 56601
cauguuuuauauaaag

SEQ ID NO: 764985 - RNA, 14 nt, Leptospira interrogans serovar lai str. 56601
caugucuucuaaau

SEQ ID NO: 764986 - RNA, 16 nt, Leptospira interrogans serovar lai str. 56601
caugucucaguucaaa

SEQ ID NO: 764987 - RNA, 17 nt, Leptospira interrogans serovar lai str. 56601
cauuaauauaaaaaaua

SEQ ID NO: 764988 - RNA, 20 nt, Leptospira interrogans serovar lai str. 56601
cauuaagggaguuuguaaag

SEQ ID NO: 764989 - RNA, 17 nt, Leptospira interrogans serovar lai str. 56601
cauuaacuauauaauaa

SEQ ID NO: 764990 - RNA, 14 nt, Leptospira interrogans serovar lai str. 56601
cauuagaacuacuc

SEQ ID NO: 764991 - RNA, 22 nt, Leptospira interrogans serovar lai str. 56601
cauuagagucguugaaaauucu

SEQ ID NO: 764992 - RNA, 21 nt, Leptospira interrogans serovar lai str. 56601
caucuuuucuaagguuugucu

SEQ ID NO: 764993 - RNA, 19 nt, Leptospira interrogans serovar lai str. 56601
caugaaaauaauacuacca

SEQ ID NO: 764994 - RNA, 15 nt, Leptospira interrogans serovar lai str. 56601
caucuuuuuuuucua

SEQ ID NO: 764995 - RNA, 21 nt, Leptospira interrogans serovar lai str. 56601
caucuuuuuuuucuaaaauau

SEQ ID NO: 764996 - RNA, 21 nt, Leptospira interrogans serovar lai str. 56601
caugaaaucaguguuuuguga

SEQ ID NO: 764997 - RNA, 18 nt, Leptospira interrogans serovar lai str. 56601
caugcaaaaauuuaauug

SEQ ID NO: 764998 - RNA, 16 nt, Leptospira interrogans serovar lai str. 56601
cauggaggcugccgcu

SEQ ID NO: 764999 - RNA, 22 nt, Leptospira interrogans serovar lai str. 56601
cauggaggcugccgcucuuucu

SEQ ID NO: 765000 - RNA, 23 nt, Leptospira interrogans serovar lai str. 56601
cauggaggcugccgcucuuucuu

SEQ ID NO: 765001 - RNA, 18 nt, Leptospira interrogans serovar lai str. 56601
cauggaugaauugauuuu

SEQ ID NO: 765002 - RNA, 16 nt, Leptospira interrogans serovar lai str. 56601
cauggcuuugaaaaag

SEQ ID NO: 765003 - RNA, 13 nt, Leptospira interrogans serovar lai str. 56601
caucuucuucauc

SEQ ID NO: 765004 - RNA, 17 nt, Leptospira interrogans serovar lai str. 56601
caucuuauuuuuacaga

SEQ ID NO: 765005 - RNA, 14 nt, Leptospira interrogans serovar lai str. 56601
caucuuaaaaacuc

SEQ ID NO: 765006 - RNA, 16 nt, Leptospira interrogans serovar lai str. 56601
caucuguuucuugccc

SEQ ID NO: 765007 - RNA, 15 nt, Leptospira interrogans serovar lai str. 56601
caucuguggagaaaa

SEQ ID NO: 765008 - RNA, 21 nt, Leptospira interrogans serovar lai str. 56601
caucugaacuaugaaauuuuu

SEQ ID NO: 765009 - RNA, 19 nt, Leptospira interrogans serovar lai str. 56601
caucuauuccguacuguuu

SEQ ID NO: 765010 - RNA, 21 nt, Leptospira interrogans serovar lai str. 56601
cauccuuguuuaggugcaaau

SEQ ID NO: 765011 - RNA, 17 nt, Leptospira interrogans serovar lai str. 56601
cauccuaagaaucaaau

SEQ ID NO: 765012 - RNA, 14 nt, Leptospira interrogans serovar lai str. 56601
cauccuauuucugu

SEQ ID NO: 765013 - RNA, 12 nt, Leptospira interrogans serovar lai str. 56601
caucauaaaggu

SEQ ID NO: 765014 - RNA, 20 nt, Leptospira interrogans serovar lai str. 56601
caucauaaaggugcaugaaa

SEQ ID NO: 765015 - RNA, 23 nt, Leptospira interrogans serovar lai str. 56601
caucauauuauuuguaguuucaa

SEQ ID NO: 765016 - RNA, 12 nt, Leptospira interrogans serovar lai str. 56601
caucauucuuua

SEQ ID NO: 765017 - RNA, 20 nt, Leptospira interrogans serovar lai str. 56601
caucauucuuuagaaauuuu

SEQ ID NO: 765018 - RNA, 23 nt, Leptospira interrogans serovar lai str. 56601
caucauucuuuagaaauuuuuaa

SEQ ID NO: 765019 - RNA, 12 nt, Leptospira interrogans serovar lai str. 56601
caucauucugaa

SEQ ID NO: 765020 - RNA, 16 nt, Leptospira interrogans serovar lai str. 56601
caucauucugaaaaaa

SEQ ID NO: 765021 - RNA, 19 nt, Leptospira interrogans serovar lai str. 56601
caucauucugaaaaaaguu

SEQ ID NO: 765022 - RNA, 20 nt, Leptospira interrogans serovar lai str. 56601
cauauuauuuguaguuucaa

SEQ ID NO: 765023 - RNA, 21 nt, Leptospira interrogans serovar lai str. 56601
cauauuauuuguaguuucaau

SEQ ID NO: 765024 - RNA, 17 nt, Leptospira interrogans serovar lai str. 56601
caucaaccaagaauuuc

SEQ ID NO: 765025 - RNA, 23 nt, Leptospira interrogans serovar lai str. 56601
caucaacaucacgcacaucguua

SEQ ID NO: 765026 - RNA, 16 nt, Leptospira interrogans serovar lai str. 56601
caucaaacggucuuuc

SEQ ID NO: 765027 - RNA, 19 nt, Leptospira interrogans serovar lai str. 56601
caucaacucuguaaauuca

SEQ ID NO: 765028 - RNA, 14 nt, Leptospira interrogans serovar lai str. 56601
cauaugaaaauaau

SEQ ID NO: 765029 - RNA, 13 nt, Leptospira interrogans serovar lai str. 56601
cauaucuacaaaa

SEQ ID NO: 765030 - RNA, 11 nt, Leptospira interrogans serovar lai str. 56601
cauaucaaauu

SEQ ID NO: 765031 - RNA, 21 nt, Leptospira interrogans serovar lai str. 56601
cauauaggacggugcaugcau

SEQ ID NO: 765032 - RNA, 16 nt, Leptospira interrogans serovar lai str. 56601
cauacuuuuaaaaagu

SEQ ID NO: 765033 - RNA, 22 nt, Leptospira interrogans serovar lai str. 56601
cauacuuuuagaagauuuuuac

SEQ ID NO: 765034 - RNA, 16 nt, Leptospira interrogans serovar lai str. 56601
cauacuuuuagauaau

SEQ ID NO: 765035 - RNA, 20 nt, Leptospira interrogans serovar lai str. 56601
cauacuuuuugcaaguaaaa

SEQ ID NO: 765036 - RNA, 19 nt, Leptospira interrogans serovar lai str. 56601
cauagaaaaaauacauaaa

SEQ ID NO: 765037 - RNA, 18 nt, Leptospira interrogans serovar lai str. 56601
cauauaauuaaaaagaua

SEQ ID NO: 765038 - RNA, 23 nt, Leptospira interrogans serovar lai str. 56601
cauaccuguuuuaguucaaaaac

SEQ ID NO: 765039 - RNA, 16 nt, Leptospira interrogans serovar lai str. 56601
cauacuaaucuaugga

SEQ ID NO: 765040 - RNA, 17 nt, Leptospira interrogans serovar lai str. 56601
cauacuaaucuauggau

SEQ ID NO: 765041 - RNA, 16 nt, Leptospira interrogans serovar lai str. 56601
cauacuucuaaaaaau

SEQ ID NO: 765042 - RNA, 17 nt, Leptospira interrogans serovar lai str. 56601
cauacuucuaaaaaauu

SEQ ID NO: 765043 - RNA, 19 nt, Leptospira interrogans serovar lai str. 56601
cauacuuuagaaauuucua

SEQ ID NO: 765044 - RNA, 13 nt, Leptospira interrogans serovar lai str. 56601
cauacauuuugua

SEQ ID NO: 765045 - RNA, 13 nt, Leptospira interrogans serovar lai str. 56601
cauaacuaauaaa

SEQ ID NO: 765046 - RNA, 14 nt, Leptospira interrogans serovar lai str. 56601
cauaacuaauaaaa

SEQ ID NO: 765047 - RNA, 19 nt, Leptospira interrogans serovar lai str. 56601
cauaacuaauaaaaacaau

SEQ ID NO: 765048 - RNA, 21 nt, Leptospira interrogans serovar lai str. 56601
cauaacgucuugauuauuuuc

SEQ ID NO: 765049 - RNA, 14 nt, Leptospira interrogans serovar lai str. 56601
cauaaccuuaccca

SEQ ID NO: 765050 - RNA, 21 nt, Leptospira interrogans serovar lai str. 56601
cauaaccuuacccacaaauaa

SEQ ID NO: 765051 - RNA, 11 nt, Leptospira interrogans serovar lai str. 56601
cauaaaaaaau

SEQ ID NO: 765052 - RNA, 12 nt, Leptospira interrogans serovar lai str. 56601
cauaaaaaaaua

SEQ ID NO: 765053 - RNA, 13 nt, Leptospira interrogans serovar lai str. 56601
cauaaaaaaauau

SEQ ID NO: 765054 - RNA, 17 nt, Leptospira interrogans serovar lai str. 56601
cauaaaaaaauuaaaaa

SEQ ID NO: 765055 - RNA, 18 nt, Leptospira interrogans serovar lai str. 56601
cauaaaaaaauuaaaaaa

SEQ ID NO: 765056 - RNA, 13 nt, Leptospira interrogans serovar lai str. 56601
cauaaaaaacaua

SEQ ID NO: 765057 - RNA, 17 nt, Leptospira interrogans serovar lai str. 56601
cauaaaaauuuuuuaaa

SEQ ID NO: 765058 - RNA, 16 nt, Leptospira interrogans serovar lai str. 56601
cauaaaaauacuuuau

SEQ ID NO: 765059 - RNA, 18 nt, Leptospira interrogans serovar lai str. 56601
cauaaacuucaucuauuc

SEQ ID NO: 765060 - RNA, 21 nt, Leptospira interrogans serovar lai str. 56601
cauaaagagcguuguguugag

SEQ ID NO: 765061 - RNA, 20 nt, Leptospira interrogans serovar lai str. 56601
cauaaacgauuauuuuuuaa

SEQ ID NO: 765062 - RNA, 20 nt, Leptospira interrogans serovar lai str. 56601
cauaaaugauacuuuguaaa

SEQ ID NO: 765063 - RNA, 16 nt, Leptospira interrogans serovar lai str. 56601
cauaacaaaaauacuu

SEQ ID NO: 765064 - RNA, 14 nt, Leptospira interrogans serovar lai str. 56601
cauaacaaauaaaa

SEQ ID NO: 765065 - RNA, 18 nt, Leptospira interrogans serovar lai str. 56601
cauaaauuuuuauuacau

SEQ ID NO: 765066 - RNA, 16 nt, Leptospira interrogans serovar lai str. 56601
caguucuuaaauaaaa

SEQ ID NO: 765067 - RNA, 17 nt, Leptospira interrogans serovar lai str. 56601
caguugagaguuuuucu

SEQ ID NO: 765068 - RNA, 21 nt, Leptospira interrogans serovar lai str. 56601
caguuaaacuuugaaaauugu

SEQ ID NO: 765069 - RNA, 17 nt, Leptospira interrogans serovar lai str. 56601
caguuaaacuuuguaaa

SEQ ID NO: 765070 - RNA, 17 nt, Leptospira interrogans serovar lai str. 56601
cagucgcuaaacucauu

SEQ ID NO: 765071 - RNA, 17 nt, Leptospira interrogans serovar lai str. 56601
cagucaccucuauaaaa

SEQ ID NO: 765072 - RNA, 18 nt, Leptospira interrogans serovar lai str. 56601
cagucaccucuauaaaau

SEQ ID NO: 765073 - RNA, 15 nt, Leptospira interrogans serovar lai str. 56601
cagugaauaaaauaa

SEQ ID NO: 765074 - RNA, 21 nt, Leptospira interrogans serovar lai str. 56601
cagguuuuucgaaaagaaaua

SEQ ID NO: 765075 - RNA, 19 nt, Leptospira interrogans serovar lai str. 56601
caguaaaaucuaaauuugu

SEQ ID NO: 765076 - RNA, 15 nt, Leptospira interrogans serovar lai str. 56601
caguaaaaucuuuaa

SEQ ID NO: 765077 - RNA, 17 nt, Leptospira interrogans serovar lai str. 56601
caguaaaaucuuuaagu

SEQ ID NO: 765078 - RNA, 21 nt, Leptospira interrogans serovar lai str. 56601
caguaaaaucuuuaaguuugu

SEQ ID NO: 765079 - RNA, 17 nt, Leptospira interrogans serovar lai str. 56601
caguacuauauuuuugu

SEQ ID NO: 765080 - RNA, 22 nt, Leptospira interrogans serovar lai str. 56601
caguauauuauaauuuuaaaua

SEQ ID NO: 765081 - RNA, 13 nt, Leptospira interrogans serovar lai str. 56601
caguauuuuguau

SEQ ID NO: 765082 - RNA, 15 nt, Leptospira interrogans serovar lai str. 56601
cagggccggagaaaa

SEQ ID NO: 765083 - RNA, 18 nt, Leptospira interrogans serovar lai str. 56601
caggaaucguuuguaaaa

SEQ ID NO: 765084 - RNA, 13 nt, Leptospira interrogans serovar lai str. 56601
cagcuauaaaaua

SEQ ID NO: 765085 - RNA, 14 nt, Leptospira interrogans serovar lai str. 56601
cagcuagaaaagga

SEQ ID NO: 765086 - RNA, 20 nt, Leptospira interrogans serovar lai str. 56601
ccuuauuaaaaccaucuuug

SEQ ID NO: 765087 - RNA, 19 nt, Leptospira interrogans serovar lai str. 56601
ccuuacgaugucuuuucaa

SEQ ID NO: 765088 - RNA, 16 nt, Leptospira interrogans serovar lai str. 56601
ccuuaccuccuuuuuc

SEQ ID NO: 765089 - RNA, 21 nt, Leptospira interrogans serovar lai str. 56601
ccuucaggauagguuccaauu

SEQ ID NO: 765090 - RNA, 12 nt, Leptospira interrogans serovar lai str. 56601
ccuuaaaaugac

SEQ ID NO: 765091 - RNA, 22 nt, Leptospira interrogans serovar lai str. 56601
ccuuaaauauaucuucuuuggu

SEQ ID NO: 765092 - RNA, 15 nt, Leptospira interrogans serovar lai str. 56601
ccuuaccaccccacc

SEQ ID NO: 765093 - RNA, 16 nt, Leptospira interrogans serovar lai str. 56601
ccuguuugaaaaaaug

SEQ ID NO: 765094 - RNA, 18 nt, Leptospira interrogans serovar lai str. 56601
ccuguuugaaaaaaugua

SEQ ID NO: 765095 - RNA, 16 nt, Leptospira interrogans serovar lai str. 56601
ccugguuucaaaaaau

SEQ ID NO: 765096 - RNA, 13 nt, Leptospira interrogans serovar lai str. 56601
ccuggaaaagaau

SEQ ID NO: 765097 - RNA, 15 nt, Leptospira interrogans serovar lai str. 56601
ccugccaaaauccca

SEQ ID NO: 765098 - RNA, 19 nt, Leptospira interrogans serovar lai str. 56601
ccugccaaaaucccagaaa

SEQ ID NO: 765099 - RNA, 22 nt, Leptospira interrogans serovar lai str. 56601
ccucuauaaaugaauuuuaaau

SEQ ID NO: 765100 - RNA, 19 nt, Leptospira interrogans serovar lai str. 56601
ccucuaugaaacuuaguuc

SEQ ID NO: 765101 - RNA, 17 nt, Leptospira interrogans serovar lai str. 56601
ccucuauccacuaaaau

SEQ ID NO: 765102 - RNA, 17 nt, Leptospira interrogans serovar lai str. 56601
ccucuguaaauacaaaa

SEQ ID NO: 765103 - RNA, 17 nt, Leptospira interrogans serovar lai str. 56601
ccguaauaucuccaaaa

SEQ ID NO: 765104 - RNA, 18 nt, Leptospira interrogans serovar lai str. 56601
ccguaauaucuccaaaau

SEQ ID NO: 765105 - RNA, 17 nt, Leptospira interrogans serovar lai str. 56601
ccgguucuagguucuug

SEQ ID NO: 765106 - RNA, 14 nt, Leptospira interrogans serovar lai str. 56601
ccgggauuuuaaaa

SEQ ID NO: 765107 - RNA, 13 nt, Leptospira interrogans serovar lai str. 56601
ccuagaggagcca

SEQ ID NO: 765108 - RNA, 20 nt, Leptospira interrogans serovar lai str. 56601
ccuacuccggcuaaaaaacu

SEQ ID NO: 765109 - RNA, 20 nt, Leptospira interrogans serovar lai str. 56601
ccuacuuauuucuauaaaau

SEQ ID NO: 765110 - RNA, 22 nt, Leptospira interrogans serovar lai str. 56601
ccuacuuauuucuauaaaauug

SEQ ID NO: 765111 - RNA, 21 nt, Leptospira interrogans serovar lai str. 56601
ccuacacuguguucuuuuuga

SEQ ID NO: 765112 - RNA, 20 nt, Leptospira interrogans serovar lai str. 56601
ccuacacucuaaguuuuuaa

SEQ ID NO: 765113 - RNA, 23 nt, Leptospira interrogans serovar lai str. 56601
ccuaguuccaauuaacaaaacug

SEQ ID NO: 765114 - RNA, 20 nt, Leptospira interrogans serovar lai str. 56601
ccuaguguuuaauuuuaaag

SEQ ID NO: 765115 - RNA, 22 nt, Leptospira interrogans serovar lai str. 56601
ccucacuccgauacauuugcuu

SEQ ID NO: 765116 - RNA, 13 nt, Leptospira interrogans serovar lai str. 56601
ccuauguuucuug

SEQ ID NO: 765117 - RNA, 17 nt, Leptospira interrogans serovar lai str. 56601
ccuauguuucuuguguc

SEQ ID NO: 765118 - RNA, 15 nt, Leptospira interrogans serovar lai str. 56601
ccuauggacagaauc

SEQ ID NO: 765119 - RNA, 19 nt, Leptospira interrogans serovar lai str. 56601
ccuauuucuguuuuauaga

SEQ ID NO: 765120 - RNA, 19 nt, Leptospira interrogans serovar lai str. 56601
ccucaaagaaauuuuacuc

SEQ ID NO: 765121 - RNA, 20 nt, Leptospira interrogans serovar lai str. 56601
ccucaacggguucuucauua

SEQ ID NO: 765122 - RNA, 17 nt, Leptospira interrogans serovar lai str. 56601
ccucaacucugguuauu

SEQ ID NO: 765123 - RNA, 21 nt, Leptospira interrogans serovar lai str. 56601
ccucaaagauuacauaauaaa

SEQ ID NO: 765124 - RNA, 11 nt, Leptospira interrogans serovar lai str. 56601
ccuauuuuugg

SEQ ID NO: 765125 - RNA, 15 nt, Leptospira interrogans serovar lai str. 56601
ccucaaaaaauuuua

SEQ ID NO: 765126 - RNA, 23 nt, Leptospira interrogans serovar lai str. 56601
ccguuacauaaguuguuauaaac

SEQ ID NO: 765127 - RNA, 13 nt, Leptospira interrogans serovar lai str. 56601
ccuaaaaaauaaa

SEQ ID NO: 765128 - RNA, 14 nt, Leptospira interrogans serovar lai str. 56601
ccuaaaaaauaaau

SEQ ID NO: 765129 - RNA, 22 nt, Leptospira interrogans serovar lai str. 56601
ccguuguuuuacagccaccauc

SEQ ID NO: 765130 - RNA, 14 nt, Leptospira interrogans serovar lai str. 56601
ccuaaaaugaaaaa

SEQ ID NO: 765131 - RNA, 19 nt, Leptospira interrogans serovar lai str. 56601
ccuaaaaugugggaacuac

SEQ ID NO: 765132 - RNA, 11 nt, Leptospira interrogans serovar lai str. 56601
ccuaaaauugc

SEQ ID NO: 765133 - RNA, 18 nt, Leptospira interrogans serovar lai str. 56601
ccuaaaauuuuaaaaaau

SEQ ID NO: 765134 - RNA, 12 nt, Leptospira interrogans serovar lai str. 56601
ccuaaaaauugu

SEQ ID NO: 765135 - RNA, 12 nt, Leptospira interrogans serovar lai str. 56601
ccuaauuuacua

SEQ ID NO: 765136 - RNA, 16 nt, Leptospira interrogans serovar lai str. 56601
ccuaagcguucuaagu

SEQ ID NO: 765137 - RNA, 18 nt, Leptospira interrogans serovar lai str. 56601
ccuaaauuccuuccaagu

SEQ ID NO: 765138 - RNA, 14 nt, Leptospira interrogans serovar lai str. 56601
ccuaaauauuuauu

SEQ ID NO: 765139 - RNA, 18 nt, Leptospira interrogans serovar lai str. 56601
ccgcuggaaaaugaaaac

SEQ ID NO: 765140 - RNA, 12 nt, Leptospira interrogans serovar lai str. 56601
ccgccuuuccaa

SEQ ID NO: 765141 - RNA, 18 nt, Leptospira interrogans serovar lai str. 56601
ccggauucgcucaaauuu

SEQ ID NO: 765142 - RNA, 19 nt, Leptospira interrogans serovar lai str. 56601
ccggauuuguuaauuuuua

SEQ ID NO: 765143 - RNA, 20 nt, Leptospira interrogans serovar lai str. 56601
ccggauuuguuaauuuuuag

SEQ ID NO: 765144 - RNA, 12 nt, Leptospira interrogans serovar lai str. 56601
ccgcacuuuuuu

SEQ ID NO: 765145 - RNA, 19 nt, Leptospira interrogans serovar lai str. 56601
ccgcauucucacaaaucac

SEQ ID NO: 765146 - RNA, 19 nt, Leptospira interrogans serovar lai str. 56601
ccgaaacuuucaaaauagg

SEQ ID NO: 765147 - RNA, 12 nt, Leptospira interrogans serovar lai str. 56601
ccgaaagaacuc

SEQ ID NO: 765148 - RNA, 23 nt, Leptospira interrogans serovar lai str. 56601
ccgaaagacuaaucgccucugag

SEQ ID NO: 765149 - RNA, 22 nt, Leptospira interrogans serovar lai str. 56601
ccgaaacguuuugcguuuuuaa

SEQ ID NO: 765150 - RNA, 20 nt, Leptospira interrogans serovar lai str. 56601
ccgaauucacguuauuuaga

SEQ ID NO: 765151 - RNA, 22 nt, Leptospira interrogans serovar lai str. 56601
ccgaauucuaaaauacuuuuga

SEQ ID NO: 765152 - RNA, 20 nt, Leptospira interrogans serovar lai str. 56601
cccggaucggcuuuuccauc

SEQ ID NO: 765153 - RNA, 14 nt, Leptospira interrogans serovar lai str. 56601
cccgucauuuacuc

SEQ ID NO: 765154 - RNA, 17 nt, Leptospira interrogans serovar lai str. 56601
cccuaagcguucuaagu

SEQ ID NO: 765155 - RNA, 19 nt, Leptospira interrogans serovar lai str. 56601
cccuccuauguuucuugug

SEQ ID NO: 765156 - RNA, 20 nt, Leptospira interrogans serovar lai str. 56601
cccuccuauguuucuugugu

SEQ ID NO: 765157 - RNA, 21 nt, Leptospira interrogans serovar lai str. 56601
cccuccguuuacaaaaugauu

SEQ ID NO: 765158 - RNA, 12 nt, Leptospira interrogans serovar lai str. 56601
cccgguagugga

SEQ ID NO: 765159 - RNA, 23 nt, Leptospira interrogans serovar lai str. 56601
ccccuccguuuacaaaaugauuu

SEQ ID NO: 765160 - RNA, 20 nt, Leptospira interrogans serovar lai str. 56601
cccgaauuuuaaauauuaau

SEQ ID NO: 765161 - RNA, 17 nt, Leptospira interrogans serovar lai str. 56601
cccgauauuaaaaugag

SEQ ID NO: 765162 - RNA, 12 nt, Leptospira interrogans serovar lai str. 56601
ccccaaaaugaa

SEQ ID NO: 765163 - RNA, 20 nt, Leptospira interrogans serovar lai str. 56601
ccccaccuaaaaugaaaaaa

SEQ ID NO: 765164 - RNA, 15 nt, Leptospira interrogans serovar lai str. 56601
ccccacaaguguugu

SEQ ID NO: 765165 - RNA, 13 nt, Leptospira interrogans serovar lai str. 56601
cccccaccaaaaa

SEQ ID NO: 765166 - RNA, 13 nt, Leptospira interrogans serovar lai str. 56601
cccacaaguauuu

SEQ ID NO: 765167 - RNA, 19 nt, Leptospira interrogans serovar lai str. 56601
cccacauuuugaagguuga

SEQ ID NO: 765168 - RNA, 21 nt, Leptospira interrogans serovar lai str. 56601
cccacauuuugaagguugagc

SEQ ID NO: 765169 - RNA, 13 nt, Leptospira interrogans serovar lai str. 56601
cccacauuuuguu

SEQ ID NO: 765170 - RNA, 13 nt, Leptospira interrogans serovar lai str. 56601
cccacauuuuuaa

SEQ ID NO: 765171 - RNA, 20 nt, Leptospira interrogans serovar lai str. 56601
cccacauuuuugugaaacuu

SEQ ID NO: 765172 - RNA, 15 nt, Leptospira interrogans serovar lai str. 56601
ccauuucaaaaauau

SEQ ID NO: 765173 - RNA, 13 nt, Leptospira interrogans serovar lai str. 56601
ccaucuuuuuuug

SEQ ID NO: 765174 - RNA, 15 nt, Leptospira interrogans serovar lai str. 56601
ccaucuuuuuuuucu

SEQ ID NO: 765175 - RNA, 12 nt, Leptospira interrogans serovar lai str. 56601
ccauuuuccuuc

SEQ ID NO: 765176 - RNA, 17 nt, Leptospira interrogans serovar lai str. 56601
ccauuucguuucccucu

SEQ ID NO: 765177 - RNA, 15 nt, Leptospira interrogans serovar lai str. 56601
cccaaaaccgaaucu

SEQ ID NO: 765178 - RNA, 13 nt, Leptospira interrogans serovar lai str. 56601
ccagucuucuugu

SEQ ID NO: 765179 - RNA, 23 nt, Leptospira interrogans serovar lai str. 56601
ccaguuggggggaauauacguua

SEQ ID NO: 765180 - RNA, 19 nt, Leptospira interrogans serovar lai str. 56601
ccaucuuuauaucuugaac

SEQ ID NO: 765181 - RNA, 15 nt, Leptospira interrogans serovar lai str. 56601
ccauacaaaauuuaa

SEQ ID NO: 765182 - RNA, 15 nt, Leptospira interrogans serovar lai str. 56601
ccauaugaguuccca

SEQ ID NO: 765183 - RNA, 22 nt, Leptospira interrogans serovar lai str. 56601
ccauaucuacaaaagauuuuua

SEQ ID NO: 765184 - RNA, 17 nt, Leptospira interrogans serovar lai str. 56601
ccagcgauucuaggauc

SEQ ID NO: 765185 - RNA, 16 nt, Leptospira interrogans serovar lai str. 56601
ccagauucccuuuuga

SEQ ID NO: 765186 - RNA, 18 nt, Leptospira interrogans serovar lai str. 56601
ccagauaugacaauuucu

SEQ ID NO: 765187 - RNA, 20 nt, Leptospira interrogans serovar lai str. 56601
ccagcaccuucugaaaguag

SEQ ID NO: 765188 - RNA, 18 nt, Leptospira interrogans serovar lai str. 56601
ccacuuaaaaaguuuuuc

SEQ ID NO: 765189 - RNA, 12 nt, Leptospira interrogans serovar lai str. 56601
ccagaacaaaac

SEQ ID NO: 765190 - RNA, 18 nt, Leptospira interrogans serovar lai str. 56601
ccacuucugguuuuuuaa

SEQ ID NO: 765191 - RNA, 18 nt, Leptospira interrogans serovar lai str. 56601
ccacuucucacaaaucau

SEQ ID NO: 765192 - RNA, 19 nt, Leptospira interrogans serovar lai str. 56601
ccacguuuugaagguugag

SEQ ID NO: 765193 - RNA, 19 nt, Leptospira interrogans serovar lai str. 56601
ccacgucccguauaaaagu

SEQ ID NO: 765194 - RNA, 17 nt, Leptospira interrogans serovar lai str. 56601
cauuuuuuucgaauuga

SEQ ID NO: 765195 - RNA, 13 nt, Leptospira interrogans serovar lai str. 56601
cauuuuuugaaaa

SEQ ID NO: 765196 - RNA, 21 nt, Leptospira interrogans serovar lai str. 56601
ccaaaaaaagucucaaaaccu

SEQ ID NO: 765197 - RNA, 14 nt, Leptospira interrogans serovar lai str. 56601
ccaaaaaaauaaau

SEQ ID NO: 765198 - RNA, 16 nt, Leptospira interrogans serovar lai str. 56601
cggauaaccaaaaacg

SEQ ID NO: 765199 - RNA, 21 nt, Leptospira interrogans serovar lai str. 56601
cggaucgcguuugaaacucag

SEQ ID NO: 765200 - RNA, 20 nt, Leptospira interrogans serovar lai str. 56601
cggagaucuacgaaaauucu

SEQ ID NO: 765201 - RNA, 14 nt, Leptospira interrogans serovar lai str. 56601
cggauuuguuaauu

SEQ ID NO: 765202 - RNA, 20 nt, Leptospira interrogans serovar lai str. 56601
cggauuuauuuuaaaauuca

SEQ ID NO: 765203 - RNA, 18 nt, Leptospira interrogans serovar lai str. 56601
cggauuucugaaaaaauc

SEQ ID NO: 765204 - RNA, 19 nt, Leptospira interrogans serovar lai str. 56601
cggauuucguuucuuuuuc

SEQ ID NO: 765205 - RNA, 22 nt, Leptospira interrogans serovar lai str. 56601
cggauugccuaaauuccuucca

SEQ ID NO: 765206 - RNA, 15 nt, Leptospira interrogans serovar lai str. 56601
cggaugugaauucuc

SEQ ID NO: 765207 - RNA, 18 nt, Leptospira interrogans serovar lai str. 56601
cggauucucgcauuuucc

SEQ ID NO: 765208 - RNA, 15 nt, Leptospira interrogans serovar lai str. 56601
cggcccucugggauc

SEQ ID NO: 765209 - RNA, 13 nt, Leptospira interrogans serovar lai str. 56601
cgcucaaaauucu

SEQ ID NO: 765210 - RNA, 19 nt, Leptospira interrogans serovar lai str. 56601
cgcuagaaguuauaaugau

SEQ ID NO: 765211 - RNA, 13 nt, Leptospira interrogans serovar lai str. 56601
cgcuaaaaguacu

SEQ ID NO: 765212 - RNA, 14 nt, Leptospira interrogans serovar lai str. 56601
cgcuaaaaguacuu

SEQ ID NO: 765213 - RNA, 18 nt, Leptospira interrogans serovar lai str. 56601
cgcuaaacucauuuuaaa

SEQ ID NO: 765214 - RNA, 15 nt, Leptospira interrogans serovar lai str. 56601
cgcuaaacuucuuca

SEQ ID NO: 765215 - RNA, 22 nt, Leptospira interrogans serovar lai str. 56601
cgcggauuuauuuuaaaauuca

SEQ ID NO: 765216 - RNA, 21 nt, Leptospira interrogans serovar lai str. 56601
cgcugguuuuauuucugcugc

SEQ ID NO: 765217 - RNA, 18 nt, Leptospira interrogans serovar lai str. 56601
cggaaaauugaauauuca

SEQ ID NO: 765218 - RNA, 13 nt, Leptospira interrogans serovar lai str. 56601
cgcuugauuccaa

SEQ ID NO: 765219 - RNA, 15 nt, Leptospira interrogans serovar lai str. 56601
cgcuuaucuaauuuu

SEQ ID NO: 765220 - RNA, 16 nt, Leptospira interrogans serovar lai str. 56601
cgcuuacaaagugaug

SEQ ID NO: 765221 - RNA, 13 nt, Leptospira interrogans serovar lai str. 56601
cgcugaguuugag

SEQ ID NO: 765222 - RNA, 18 nt, Leptospira interrogans serovar lai str. 56601
cgcugaguuugagagagc

SEQ ID NO: 765223 - RNA, 20 nt, Leptospira interrogans serovar lai str. 56601
cgcucugaaguaucucuucu

SEQ ID NO: 765224 - RNA, 21 nt, Leptospira interrogans serovar lai str. 56601
cgcucuauuuccaccggagua

SEQ ID NO: 765225 - RNA, 16 nt, Leptospira interrogans serovar lai str. 56601
cgggaauaaaaacaaa

SEQ ID NO: 765226 - RNA, 15 nt, Leptospira interrogans serovar lai str. 56601
cggcuuuuuuuacuu

SEQ ID NO: 765227 - RNA, 15 nt, Leptospira interrogans serovar lai str. 56601
cgggcccaaauaaaa

SEQ ID NO: 765228 - RNA, 16 nt, Leptospira interrogans serovar lai str. 56601
cggcuucaaugaggaa

SEQ ID NO: 765229 - RNA, 13 nt, Leptospira interrogans serovar lai str. 56601
cgucauaguuccc

SEQ ID NO: 765230 - RNA, 21 nt, Leptospira interrogans serovar lai str. 56601
cgucacuuuacaaauuuacua

SEQ ID NO: 765231 - RNA, 16 nt, Leptospira interrogans serovar lai str. 56601
cguauuggauuauauc

SEQ ID NO: 765232 - RNA, 14 nt, Leptospira interrogans serovar lai str. 56601
cguauacuuuaaaa

SEQ ID NO: 765233 - RNA, 12 nt, Leptospira interrogans serovar lai str. 56601
cguauauaaaaa

SEQ ID NO: 765234 - RNA, 15 nt, Leptospira interrogans serovar lai str. 56601
cguauauaaaaaaug

SEQ ID NO: 765235 - RNA, 21 nt, Leptospira interrogans serovar lai str. 56601
cguauaaaaacgguauuuaaa

SEQ ID NO: 765236 - RNA, 21 nt, Leptospira interrogans serovar lai str. 56601
cguagauaauuaaacaaagaa

SEQ ID NO: 765237 - RNA, 16 nt, Leptospira interrogans serovar lai str. 56601
cguagaucuuuuauaa

SEQ ID NO: 765238 - RNA, 14 nt, Leptospira interrogans serovar lai str. 56601
cguagauuuuaaca

SEQ ID NO: 765239 - RNA, 23 nt, Leptospira interrogans serovar lai str. 56601
cgguuguuuugcucuaaaauaau

SEQ ID NO: 765240 - RNA, 13 nt, Leptospira interrogans serovar lai str. 56601
cgguuuaaaacua

SEQ ID NO: 765241 - RNA, 15 nt, Leptospira interrogans serovar lai str. 56601
cguaaacaaaagugg

SEQ ID NO: 765242 - RNA, 17 nt, Leptospira interrogans serovar lai str. 56601
cgguggcuuuuguaaau

SEQ ID NO: 765243 - RNA, 22 nt, Leptospira interrogans serovar lai str. 56601
cgccguaaaaaauccaugauuc

SEQ ID NO: 765244 - RNA, 12 nt, Leptospira interrogans serovar lai str. 56601
cgcgauucauaa

SEQ ID NO: 765245 - RNA, 19 nt, Leptospira interrogans serovar lai str. 56601
cgcgauuauguaauauaca

SEQ ID NO: 765246 - RNA, 22 nt, Leptospira interrogans serovar lai str. 56601
cgcgaucuaucgaacgaccugc

SEQ ID NO: 765247 - RNA, 12 nt, Leptospira interrogans serovar lai str. 56601
cgccugcauuuu

SEQ ID NO: 765248 - RNA, 15 nt, Leptospira interrogans serovar lai str. 56601
cgccaucgucaggga

SEQ ID NO: 765249 - RNA, 22 nt, Leptospira interrogans serovar lai str. 56601
cgccccaugcgccccagcccuc

SEQ ID NO: 765250 - RNA, 20 nt, Leptospira interrogans serovar lai str. 56601
cgcauaaaacucuaaauuca

SEQ ID NO: 765251 - RNA, 18 nt, Leptospira interrogans serovar lai str. 56601
cgauccuuuuuuguaaag

SEQ ID NO: 765252 - RNA, 22 nt, Leptospira interrogans serovar lai str. 56601
cgaucgcaacauaaugcuccaa

SEQ ID NO: 765253 - RNA, 16 nt, Leptospira interrogans serovar lai str. 56601
cgauacuuaaaaauac

SEQ ID NO: 765254 - RNA, 22 nt, Leptospira interrogans serovar lai str. 56601
cgauaaagaaaguaauuuugaa

SEQ ID NO: 765255 - RNA, 16 nt, Leptospira interrogans serovar lai str. 56601
cgaucuguaaaaugua

SEQ ID NO: 765256 - RNA, 13 nt, Leptospira interrogans serovar lai str. 56601
cgaucuauagaga

SEQ ID NO: 765257 - RNA, 14 nt, Leptospira interrogans serovar lai str. 56601
cgaucuaaaaggac

SEQ ID NO: 765258 - RNA, 20 nt, Leptospira interrogans serovar lai str. 56601
cgaugaucgauuuuuuagca

SEQ ID NO: 765259 - RNA, 18 nt, Leptospira interrogans serovar lai str. 56601
cgaugagccaucuuuuuu

SEQ ID NO: 765260 - RNA, 21 nt, Leptospira interrogans serovar lai str. 56601
cgaugagcuuuuuuagaaaaa

SEQ ID NO: 765261 - RNA, 20 nt, Leptospira interrogans serovar lai str. 56601
cgauguauggcucauuuuuc

SEQ ID NO: 765262 - RNA, 22 nt, Leptospira interrogans serovar lai str. 56601
cgaugguuucaauuuaaaauau

SEQ ID NO: 765263 - RNA, 14 nt, Leptospira interrogans serovar lai str. 56601
cgcaacacacacuu

SEQ ID NO: 765264 - RNA, 16 nt, Leptospira interrogans serovar lai str. 56601
cgauucauaaagagcg

SEQ ID NO: 765265 - RNA, 21 nt, Leptospira interrogans serovar lai str. 56601
cuucccucgaaaucugaccuc

SEQ ID NO: 765266 - RNA, 13 nt, Leptospira interrogans serovar lai str. 56601
cuucacuucuuuu

SEQ ID NO: 765267 - RNA, 17 nt, Leptospira interrogans serovar lai str. 56601
cuuccacaucuuuuuuc

SEQ ID NO: 765268 - RNA, 16 nt, Leptospira interrogans serovar lai str. 56601
cuucguuagaagacaa

SEQ ID NO: 765269 - RNA, 17 nt, Leptospira interrogans serovar lai str. 56601
cuucuagcaaucuuccu

SEQ ID NO: 765270 - RNA, 22 nt, Leptospira interrogans serovar lai str. 56601
cuucuauuucuuauuuauuaaa

SEQ ID NO: 765271 - RNA, 22 nt, Leptospira interrogans serovar lai str. 56601
cuucuaaaucuaauucuucuaa

SEQ ID NO: 765272 - RNA, 13 nt, Leptospira interrogans serovar lai str. 56601
cuuccuuuuucau

SEQ ID NO: 765273 - RNA, 19 nt, Leptospira interrogans serovar lai str. 56601
cuuccuuuuucauuuuuaa

SEQ ID NO: 765274 - RNA, 16 nt, Leptospira interrogans serovar lai str. 56601
cuucaauaucuuuauu

SEQ ID NO: 765275 - RNA, 23 nt, Leptospira interrogans serovar lai str. 56601
cuuauuuauauuucuaaaagaag

SEQ ID NO: 765276 - RNA, 22 nt, Leptospira interrogans serovar lai str. 56601
cuuauugaacguaaguuaaaua

SEQ ID NO: 765277 - RNA, 18 nt, Leptospira interrogans serovar lai str. 56601
cuuauuuaguuucaauuu

SEQ ID NO: 765278 - RNA, 15 nt, Leptospira interrogans serovar lai str. 56601
cuucaaaacuaggau

SEQ ID NO: 765279 - RNA, 20 nt, Leptospira interrogans serovar lai str. 56601
cuucaaaacuaggaucuccu

SEQ ID NO: 765280 - RNA, 17 nt, Leptospira interrogans serovar lai str. 56601
cuuauuuuuuuauuuua

SEQ ID NO: 765281 - RNA, 18 nt, Leptospira interrogans serovar lai str. 56601
cuucaaauaacauuuuuu

SEQ ID NO: 765282 - RNA, 18 nt, Leptospira interrogans serovar lai str. 56601
cuuaguuuuguacuuuac

SEQ ID NO: 765283 - RNA, 19 nt, Leptospira interrogans serovar lai str. 56601
cuuauaaagaauuuuaaau

SEQ ID NO: 765284 - RNA, 22 nt, Leptospira interrogans serovar lai str. 56601
cuuauaagaaucgauucagagu

SEQ ID NO: 765285 - RNA, 23 nt, Leptospira interrogans serovar lai str. 56601
cuuaugguuuuuuaauauuagaa

SEQ ID NO: 765286 - RNA, 20 nt, Leptospira interrogans serovar lai str. 56601
cuuaaguuugucuguaaaau

SEQ ID NO: 765287 - RNA, 15 nt, Leptospira interrogans serovar lai str. 56601
cuuaauaaaauuuuc

SEQ ID NO: 765288 - RNA, 21 nt, Leptospira interrogans serovar lai str. 56601
cuuaaggaaauucauuuuucu

SEQ ID NO: 765289 - RNA, 22 nt, Leptospira interrogans serovar lai str. 56601
cuuaagagaaccucuauaaaau

SEQ ID NO: 765290 - RNA, 18 nt, Leptospira interrogans serovar lai str. 56601
cuuaagauagccuaauuu

SEQ ID NO: 765291 - RNA, 20 nt, Leptospira interrogans serovar lai str. 56601
cuuaacuuuaagcaaagauu

SEQ ID NO: 765292 - RNA, 19 nt, Leptospira interrogans serovar lai str. 56601
cuuaagacccuaaaaaauu

SEQ ID NO: 765293 - RNA, 19 nt, Leptospira interrogans serovar lai str. 56601
cuuaaaucuuagauucacu

SEQ ID NO: 765294 - RNA, 20 nt, Leptospira interrogans serovar lai str. 56601
cuuaaaucuuagauucacuu

SEQ ID NO: 765295 - RNA, 17 nt, Leptospira interrogans serovar lai str. 56601
cuuaaaucuuuaaaaua

SEQ ID NO: 765296 - RNA, 20 nt, Leptospira interrogans serovar lai str. 56601
cuuaaaucuuuaaaauacuu

SEQ ID NO: 765297 - RNA, 20 nt, Leptospira interrogans serovar lai str. 56601
cuuaauguaaaguucuuuuc

SEQ ID NO: 765298 - RNA, 21 nt, Leptospira interrogans serovar lai str. 56601
cuuaauguaaaguucuuuucu

SEQ ID NO: 765299 - RNA, 12 nt, Leptospira interrogans serovar lai str. 56601
cuuacauuagag

SEQ ID NO: 765300 - RNA, 22 nt, Leptospira interrogans serovar lai str. 56601
cuuacaucccaaaccucuuuau

SEQ ID NO: 765301 - RNA, 19 nt, Leptospira interrogans serovar lai str. 56601
cuuaaugagauuaaaacug

SEQ ID NO: 765302 - RNA, 12 nt, Leptospira interrogans serovar lai str. 56601
cuuaaucugugg

SEQ ID NO: 765303 - RNA, 21 nt, Leptospira interrogans serovar lai str. 56601
cuuagaaagcgugacuaaaau

SEQ ID NO: 765304 - RNA, 17 nt, Leptospira interrogans serovar lai str. 56601
cuuacccacaaauaauu

SEQ ID NO: 765305 - RNA, 15 nt, Leptospira interrogans serovar lai str. 56601
cuuagucuaaaaaca

SEQ ID NO: 765306 - RNA, 17 nt, Leptospira interrogans serovar lai str. 56601
cuuagucuaaaaacaac

SEQ ID NO: 765307 - RNA, 17 nt, Leptospira interrogans serovar lai str. 56601
cuuagucugaaauaaau

SEQ ID NO: 765308 - RNA, 20 nt, Leptospira interrogans serovar lai str. 56601
cuuaggcccgaauuuuaaau

SEQ ID NO: 765309 - RNA, 21 nt, Leptospira interrogans serovar lai str. 56601
cuuaggcccgaauuuuaaaua

SEQ ID NO: 765310 - RNA, 16 nt, Leptospira interrogans serovar lai str. 56601
cuuagguuuaucugua

SEQ ID NO: 765311 - RNA, 23 nt, Leptospira interrogans serovar lai str. 56601
cuuagguuuaucuguaaaaugau

SEQ ID NO: 765312 - RNA, 22 nt, Leptospira interrogans serovar lai str. 56601
cuuagaguaaaacuuuuaaaga

SEQ ID NO: 765313 - RNA, 15 nt, Leptospira interrogans serovar lai str. 56601
cuuagccuuuaaacu

SEQ ID NO: 765314 - RNA, 14 nt, Leptospira interrogans serovar lai str. 56601
cuuagaauaauagg

SEQ ID NO: 765315 - RNA, 17 nt, Leptospira interrogans serovar lai str. 56601
cuuagaauuuuuucguu

SEQ ID NO: 765316 - RNA, 19 nt, Leptospira interrogans serovar lai str. 56601
cuuuggauuuuauuuuuac

SEQ ID NO: 765317 - RNA, 20 nt, Leptospira interrogans serovar lai str. 56601
cuuuggaugcauacauagau

SEQ ID NO: 765318 - RNA, 20 nt, Leptospira interrogans serovar lai str. 56601
cuuuggaauuggcuucuuau

SEQ ID NO: 765319 - RNA, 18 nt, Leptospira interrogans serovar lai str. 56601
cuuuggaaauuuuuaaua

SEQ ID NO: 765320 - RNA, 16 nt, Leptospira interrogans serovar lai str. 56601
cuuugcucucgcaaug

SEQ ID NO: 765321 - RNA, 23 nt, Leptospira interrogans serovar lai str. 56601
cuuugcagacugauucuuuaaau

SEQ ID NO: 765322 - RNA, 17 nt, Leptospira interrogans serovar lai str. 56601
cuuuccagaaagaaguu

SEQ ID NO: 765323 - RNA, 23 nt, Leptospira interrogans serovar lai str. 56601
cuuuccagaaagaaguuguauca

SEQ ID NO: 765324 - RNA, 15 nt, Leptospira interrogans serovar lai str. 56601
cuuucuuaaauuuuu

SEQ ID NO: 765325 - RNA, 17 nt, Leptospira interrogans serovar lai str. 56601
cuuucuuccaauuguuc

SEQ ID NO: 765326 - RNA, 22 nt, Leptospira interrogans serovar lai str. 56601
cuuugaacuuguccuaaaauuu

SEQ ID NO: 765327 - RNA, 15 nt, Leptospira interrogans serovar lai str. 56601
cuuugagaaaauuuu

SEQ ID NO: 765328 - RNA, 14 nt, Leptospira interrogans serovar lai str. 56601
cuuugacuacuucc

SEQ ID NO: 765329 - RNA, 22 nt, Leptospira interrogans serovar lai str. 56601
cuuugagaagcggguuuuucuu

SEQ ID NO: 765330 - RNA, 20 nt, Leptospira interrogans serovar lai str. 56601
cuuugagaugugggaacuac

SEQ ID NO: 765331 - RNA, 23 nt, Leptospira interrogans serovar lai str. 56601
cuuugacccauaaaaauacuuua

SEQ ID NO: 765332 - RNA, 19 nt, Leptospira interrogans serovar lai str. 56601
cuuuauagaaaauuuuuuc

SEQ ID NO: 765333 - RNA, 23 nt, Leptospira interrogans serovar lai str. 56601
cuuuauaauugaacauuuuuaaa

SEQ ID NO: 765334 - RNA, 15 nt, Leptospira interrogans serovar lai str. 56601
cuuuaguuuccaaaa

SEQ ID NO: 765335 - RNA, 13 nt, Leptospira interrogans serovar lai str. 56601
cuuuaguuugaaa

SEQ ID NO: 765336 - RNA, 13 nt, Leptospira interrogans serovar lai str. 56601
cuuuauuuaaaaa

SEQ ID NO: 765337 - RNA, 16 nt, Leptospira interrogans serovar lai str. 56601
cuuuaucuuuauaaaa

SEQ ID NO: 765338 - RNA, 21 nt, Leptospira interrogans serovar lai str. 56601
cuuuaucuuuauaaaaaugau

SEQ ID NO: 765339 - RNA, 23 nt, Leptospira interrogans serovar lai str. 56601
cuuucagcuacaaucaauaaauu

SEQ ID NO: 765340 - RNA, 14 nt, Leptospira interrogans serovar lai str. 56601
cuuuauuuguauuc

SEQ ID NO: 765341 - RNA, 19 nt, Leptospira interrogans serovar lai str. 56601
cuuuauuuguauucaagag

SEQ ID NO: 765342 - RNA, 18 nt, Leptospira interrogans serovar lai str. 56601
cuuucaaaaauuuaaguc

SEQ ID NO: 765343 - RNA, 22 nt, Leptospira interrogans serovar lai str. 56601
cuuuauuuuauaauucugaaua

SEQ ID NO: 765344 - RNA, 23 nt, Leptospira interrogans serovar lai str. 56601
cuuucaagaauuuauuuacaauc

SEQ ID NO: 765345 - RNA, 20 nt, Leptospira interrogans serovar lai str. 56601
cuuucaaagaauauaaaauc

SEQ ID NO: 765346 - RNA, 11 nt, Leptospira interrogans serovar lai str. 56601
cuuuagaaaaa

SEQ ID NO: 765347 - RNA, 16 nt, Leptospira interrogans serovar lai str. 56601
cuuuagacauuguuuu

SEQ ID NO: 765348 - RNA, 15 nt, Leptospira interrogans serovar lai str. 56601
cuuuagaaauuucua

SEQ ID NO: 765349 - RNA, 14 nt, Leptospira interrogans serovar lai str. 56601
cuuuagaaauuuuu

SEQ ID NO: 765350 - RNA, 15 nt, Leptospira interrogans serovar lai str. 56601
cuuuagaaauuuuua

SEQ ID NO: 765351 - RNA, 16 nt, Leptospira interrogans serovar lai str. 56601
cuuuagaaauuuuuaa

SEQ ID NO: 765352 - RNA, 18 nt, Leptospira interrogans serovar lai str. 56601
cuuuagaaauuuuuaaua

SEQ ID NO: 765353 - RNA, 12 nt, Leptospira interrogans serovar lai str. 56601
cuuuacauuuuu

SEQ ID NO: 765354 - RNA, 20 nt, Leptospira interrogans serovar lai str. 56601
cuuuaauuucaauaacuuga

SEQ ID NO: 765355 - RNA, 17 nt, Leptospira interrogans serovar lai str. 56601
cuuuacaauaaaaauua

SEQ ID NO: 765356 - RNA, 15 nt, Leptospira interrogans serovar lai str. 56601
cuuuacaguuuuuaa

SEQ ID NO: 765357 - RNA, 21 nt, Leptospira interrogans serovar lai str. 56601
cuuuacauaauaauacagaau

SEQ ID NO: 765358 - RNA, 18 nt, Leptospira interrogans serovar lai str. 56601
cuuuacacgauaauuuuu

SEQ ID NO: 765359 - RNA, 15 nt, Leptospira interrogans serovar lai str. 56601
cuuuacagaucaauu

SEQ ID NO: 765360 - RNA, 20 nt, Leptospira interrogans serovar lai str. 56601
cuuuacagaucaauucuuua

SEQ ID NO: 765361 - RNA, 14 nt, Leptospira interrogans serovar lai str. 56601
cuuuaagugaacca

SEQ ID NO: 765362 - RNA, 17 nt, Leptospira interrogans serovar lai str. 56601
cuuuaagugaaccucug

SEQ ID NO: 765363 - RNA, 21 nt, Leptospira interrogans serovar lai str. 56601
cuuuaaugcuucauauaauaa

SEQ ID NO: 765364 - RNA, 21 nt, Leptospira interrogans serovar lai str. 56601
cuuuaagagucauuuuuaaau

SEQ ID NO: 765365 - RNA, 17 nt, Leptospira interrogans serovar lai str. 56601
cuuuaagaucauuuaaa

SEQ ID NO: 765366 - RNA, 13 nt, Leptospira interrogans serovar lai str. 56601
cuuuaagaaaauu

SEQ ID NO: 765367 - RNA, 23 nt, Leptospira interrogans serovar lai str. 56601
cuuuaagaaaauuuaaaauauaa

SEQ ID NO: 765368 - RNA, 20 nt, Leptospira interrogans serovar lai str. 56601
cuuuaagcaaagauuaagua

SEQ ID NO: 765369 - RNA, 18 nt, Leptospira interrogans serovar lai str. 56601
cuugucacuauuuuuaug

SEQ ID NO: 765370 - RNA, 16 nt, Leptospira interrogans serovar lai str. 56601
cuuguauaagaaauga

SEQ ID NO: 765371 - RNA, 18 nt, Leptospira interrogans serovar lai str. 56601
cuuguauuuuauuuuugg

SEQ ID NO: 765372 - RNA, 18 nt, Leptospira interrogans serovar lai str. 56601
cuuggaguucuuacuuuu

SEQ ID NO: 765373 - RNA, 15 nt, Leptospira interrogans serovar lai str. 56601
cuugccauuuccaau

SEQ ID NO: 765374 - RNA, 23 nt, Leptospira interrogans serovar lai str. 56601
cuugccauggaaauuuuuccguc

SEQ ID NO: 765375 - RNA, 23 nt, Leptospira interrogans serovar lai str. 56601
cuugauuugagaaucuucauuuu

SEQ ID NO: 765376 - RNA, 13 nt, Leptospira interrogans serovar lai str. 56601
cuugcaaaaauag

SEQ ID NO: 765377 - RNA, 21 nt, Leptospira interrogans serovar lai str. 56601
cuugcaaaaauagaauuuuug

SEQ ID NO: 765378 - RNA, 22 nt, Leptospira interrogans serovar lai str. 56601
cuugagaagggugaauuuuuuc

SEQ ID NO: 765379 - RNA, 20 nt, Leptospira interrogans serovar lai str. 56601
cuugauauuucuguaaaaaa

SEQ ID NO: 765380 - RNA, 20 nt, Leptospira interrogans serovar lai str. 56601
cuugagauuccuuuuaagaa

SEQ ID NO: 765381 - RNA, 23 nt, Leptospira interrogans serovar lai str. 56601
cuugaauagaaccuuuugaagua

SEQ ID NO: 765382 - RNA, 22 nt, Leptospira interrogans serovar lai str. 56601
cuugaauaaagagaaaacaauu

SEQ ID NO: 765383 - RNA, 20 nt, Leptospira interrogans serovar lai str. 56601
cuugaacucaauguugcucc

SEQ ID NO: 765384 - RNA, 11 nt, Leptospira interrogans serovar lai str. 56601
cuugaagauuu

SEQ ID NO: 765385 - RNA, 15 nt, Leptospira interrogans serovar lai str. 56601
cuucuauuuuuuaau

SEQ ID NO: 765386 - RNA, 14 nt, Leptospira interrogans serovar lai str. 56601
cugugggaacucuc

SEQ ID NO: 765387 - RNA, 12 nt, Leptospira interrogans serovar lai str. 56601
cuguguucuuuu

SEQ ID NO: 765388 - RNA, 20 nt, Leptospira interrogans serovar lai str. 56601
cuguuaauuuuuauuggaaa

SEQ ID NO: 765389 - RNA, 14 nt, Leptospira interrogans serovar lai str. 56601
cugucccaaaaucu

SEQ ID NO: 765390 - RNA, 13 nt, Leptospira interrogans serovar lai str. 56601
cugugaaacucag

SEQ ID NO: 765391 - RNA, 14 nt, Leptospira interrogans serovar lai str. 56601
cuguaucauagaau

SEQ ID NO: 765392 - RNA, 19 nt, Leptospira interrogans serovar lai str. 56601
cuguagaaauucuauuuua

SEQ ID NO: 765393 - RNA, 23 nt, Leptospira interrogans serovar lai str. 56601
cuguagaaauucuauuuuauuga

SEQ ID NO: 765394 - RNA, 19 nt, Leptospira interrogans serovar lai str. 56601
cuguaagauuucguucgga

SEQ ID NO: 765395 - RNA, 22 nt, Leptospira interrogans serovar lai str. 56601
cugguuucaaaaaaucgacuuu

SEQ ID NO: 765396 - RNA, 16 nt, Leptospira interrogans serovar lai str. 56601
cugguuccauaaagac

SEQ ID NO: 765397 - RNA, 19 nt, Leptospira interrogans serovar lai str. 56601
cuggguaaaaaaaaaugag

SEQ ID NO: 765398 - RNA, 13 nt, Leptospira interrogans serovar lai str. 56601
cugggaucggaac

SEQ ID NO: 765399 - RNA, 17 nt, Leptospira interrogans serovar lai str. 56601
cuggauuuguaauaguu

SEQ ID NO: 765400 - RNA, 19 nt, Leptospira interrogans serovar lai str. 56601
cuggauuuugaucuuuuuu

SEQ ID NO: 765401 - RNA, 20 nt, Leptospira interrogans serovar lai str. 56601
cugccuucuuuuuucuaaau

SEQ ID NO: 765402 - RNA, 13 nt, Leptospira interrogans serovar lai str. 56601
cugcucuucuaau

SEQ ID NO: 765403 - RNA, 20 nt, Leptospira interrogans serovar lai str. 56601
cugcugaauuuaccuccucc

SEQ ID NO: 765404 - RNA, 23 nt, Leptospira interrogans serovar lai str. 56601
cugcuggaccuaacggcccucug

SEQ ID NO: 765405 - RNA, 14 nt, Leptospira interrogans serovar lai str. 56601
cugcaucuuuucua

SEQ ID NO: 765406 - RNA, 14 nt, Leptospira interrogans serovar lai str. 56601
cugccaaaagaacu

SEQ ID NO: 765407 - RNA, 13 nt, Leptospira interrogans serovar lai str. 56601
cugccaaaauccc

SEQ ID NO: 765408 - RNA, 15 nt, Leptospira interrogans serovar lai str. 56601
cugcauuuuauuaaa

SEQ ID NO: 765409 - RNA, 16 nt, Leptospira interrogans serovar lai str. 56601
cugcaaauuuuuuucu

SEQ ID NO: 765410 - RNA, 22 nt, Leptospira interrogans serovar lai str. 56601
cugcaaauuuuuuucuaaaaua

SEQ ID NO: 765411 - RNA, 20 nt, Leptospira interrogans serovar lai str. 56601
cugauuuuuauaauuuagag

SEQ ID NO: 765412 - RNA, 14 nt, Leptospira interrogans serovar lai str. 56601
cugauuuuuuaaau

SEQ ID NO: 765413 - RNA, 16 nt, Leptospira interrogans serovar lai str. 56601
cugauuuuuuaaaugu

SEQ ID NO: 765414 - RNA, 16 nt, Leptospira interrogans serovar lai str. 56601
cugauucuuuaaaugu

SEQ ID NO: 765415 - RNA, 22 nt, Leptospira interrogans serovar lai str. 56601
cugagauuugucucaaaauuua

SEQ ID NO: 765416 - RNA, 14 nt, Leptospira interrogans serovar lai str. 56601
cugacauuccagcu

SEQ ID NO: 765417 - RNA, 16 nt, Leptospira interrogans serovar lai str. 56601
cugaauuuuaccaaau

SEQ ID NO: 765418 - RNA, 13 nt, Leptospira interrogans serovar lai str. 56601
cugaauuuuauag

SEQ ID NO: 765419 - RNA, 22 nt, Leptospira interrogans serovar lai str. 56601
cugaauuuuuauaaguuuaauu

SEQ ID NO: 765420 - RNA, 17 nt, Leptospira interrogans serovar lai str. 56601
cugaauaauugaauaaa

SEQ ID NO: 765421 - RNA, 13 nt, Leptospira interrogans serovar lai str. 56601
cugaauaaaaaua

SEQ ID NO: 765422 - RNA, 14 nt, Leptospira interrogans serovar lai str. 56601
cugaauaaaaauac

SEQ ID NO: 765423 - RNA, 23 nt, Leptospira interrogans serovar lai str. 56601
cugaauggacucauaacgugaca

SEQ ID NO: 765424 - RNA, 21 nt, Leptospira interrogans serovar lai str. 56601
cugaaaucuuaggacggauuu

SEQ ID NO: 765425 - RNA, 20 nt, Leptospira interrogans serovar lai str. 56601
cugaaauucaucaaauuugc

SEQ ID NO: 765426 - RNA, 15 nt, Leptospira interrogans serovar lai str. 56601
cugaaauuguuuuaa

SEQ ID NO: 765427 - RNA, 14 nt, Leptospira interrogans serovar lai str. 56601
cugaacuuaaaauc

SEQ ID NO: 765428 - RNA, 13 nt, Leptospira interrogans serovar lai str. 56601
cucuuuuuuaaag

SEQ ID NO: 765429 - RNA, 18 nt, Leptospira interrogans serovar lai str. 56601
cucuuuuucuucugcugc

SEQ ID NO: 765430 - RNA, 19 nt, Leptospira interrogans serovar lai str. 56601
cucuuuuucuucugcugca

SEQ ID NO: 765431 - RNA, 20 nt, Leptospira interrogans serovar lai str. 56601
cucuuuuugggaauuuuuuu

SEQ ID NO: 765432 - RNA, 17 nt, Leptospira interrogans serovar lai str. 56601
cugaaaaaaauuagaau

SEQ ID NO: 765433 - RNA, 18 nt, Leptospira interrogans serovar lai str. 56601
cugaaaaaaucuguacuu

SEQ ID NO: 765434 - RNA, 12 nt, Leptospira interrogans serovar lai str. 56601
cugaaaaaaguu

SEQ ID NO: 765435 - RNA, 16 nt, Leptospira interrogans serovar lai str. 56601
cugaaaaaaguugaaa

SEQ ID NO: 765436 - RNA, 18 nt, Leptospira interrogans serovar lai str. 56601
cugaaaaaaguugaaauc

SEQ ID NO: 765437 - RNA, 18 nt, Leptospira interrogans serovar lai str. 56601
cugaaaaaaacgucuuua

SEQ ID NO: 765438 - RNA, 22 nt, Leptospira interrogans serovar lai str. 56601
cugaaaaaaacgucuuuaucca

SEQ ID NO: 765439 - RNA, 18 nt, Leptospira interrogans serovar lai str. 56601
cucuuucguuuuuuucau

SEQ ID NO: 765440 - RNA, 16 nt, Leptospira interrogans serovar lai str. 56601
cucuuugaaaucucua

SEQ ID NO: 765441 - RNA, 18 nt, Leptospira interrogans serovar lai str. 56601
cucuuugacccauaaaaa

SEQ ID NO: 765442 - RNA, 16 nt, Leptospira interrogans serovar lai str. 56601
cucuuuuuauuuuuug

SEQ ID NO: 765443 - RNA, 15 nt, Leptospira interrogans serovar lai str. 56601
cucuuuuaccuuacc

SEQ ID NO: 765444 - RNA, 17 nt, Leptospira interrogans serovar lai str. 56601
cucuuuuacgacuuuau

SEQ ID NO: 765445 - RNA, 20 nt, Leptospira interrogans serovar lai str. 56601
cugaaacuuuucaaaaucua

SEQ ID NO: 765446 - RNA, 18 nt, Leptospira interrogans serovar lai str. 56601
cugaaacuugaacuguuu

SEQ ID NO: 765447 - RNA, 12 nt, Leptospira interrogans serovar lai str. 56601
cugaaauagaau

SEQ ID NO: 765448 - RNA, 14 nt, Leptospira interrogans serovar lai str. 56601
cugaaauagaauuu

SEQ ID NO: 765449 - RNA, 11 nt, Leptospira interrogans serovar lai str. 56601
cugaaauaaaa

SEQ ID NO: 765450 - RNA, 11 nt, Leptospira interrogans serovar lai str. 56601
cugaaauaaau

SEQ ID NO: 765451 - RNA, 15 nt, Leptospira interrogans serovar lai str. 56601
cugaaaauuuaauua

SEQ ID NO: 765452 - RNA, 16 nt, Leptospira interrogans serovar lai str. 56601
cugaaaauuuuccuuu

SEQ ID NO: 765453 - RNA, 17 nt, Leptospira interrogans serovar lai str. 56601
cugaaaauuuuccuuua

SEQ ID NO: 765454 - RNA, 15 nt, Leptospira interrogans serovar lai str. 56601
cugaaaaugaccaaa

SEQ ID NO: 765455 - RNA, 16 nt, Leptospira interrogans serovar lai str. 56601
cugaaaaugaccaaaa

SEQ ID NO: 765456 - RNA, 14 nt, Leptospira interrogans serovar lai str. 56601
cucuucucccauca

SEQ ID NO: 765457 - RNA, 20 nt, Leptospira interrogans serovar lai str. 56601
cucuucuaauucaguuuuuc

SEQ ID NO: 765458 - RNA, 17 nt, Leptospira interrogans serovar lai str. 56601
cucuugcgguucuugcu

SEQ ID NO: 765459 - RNA, 18 nt, Leptospira interrogans serovar lai str. 56601
cucuugcgguucuugcuu

SEQ ID NO: 765460 - RNA, 19 nt, Leptospira interrogans serovar lai str. 56601
cucuugcuaaaauuuuuuu

SEQ ID NO: 765461 - RNA, 22 nt, Leptospira interrogans serovar lai str. 56601
cucuuuaagagucauuuuuaaa

SEQ ID NO: 765462 - RNA, 14 nt, Leptospira interrogans serovar lai str. 56601
cucuuaauggauca

SEQ ID NO: 765463 - RNA, 12 nt, Leptospira interrogans serovar lai str. 56601
cucuuacauuuu

SEQ ID NO: 765464 - RNA, 13 nt, Leptospira interrogans serovar lai str. 56601
cucuuacauuuug

SEQ ID NO: 765465 - RNA, 15 nt, Leptospira interrogans serovar lai str. 56601
cucuuacauuuugag

SEQ ID NO: 765466 - RNA, 19 nt, Leptospira interrogans serovar lai str. 56601
cucuuacgcaugauaaaaa

SEQ ID NO: 765467 - RNA, 18 nt, Leptospira interrogans serovar lai str. 56601
cucuuaaguugaguucuu

SEQ ID NO: 765468 - RNA, 20 nt, Leptospira interrogans serovar lai str. 56601
cucuuauuuauauuucuaaa

SEQ ID NO: 765469 - RNA, 20 nt, Leptospira interrogans serovar lai str. 56601
cucuuagccccaguaaauaa

SEQ ID NO: 765470 - RNA, 14 nt, Leptospira interrogans serovar lai str. 56601
cucuuauaaaauuu

SEQ ID NO: 765471 - RNA, 13 nt, Leptospira interrogans serovar lai str. 56601
cucuuaaaauuua

SEQ ID NO: 765472 - RNA, 21 nt, Leptospira interrogans serovar lai str. 56601
cucuuaaaauuuagaaauaga

SEQ ID NO: 765473 - RNA, 20 nt, Leptospira interrogans serovar lai str. 56601
cucuuccgguggauuuuuuu

SEQ ID NO: 765474 - RNA, 21 nt, Leptospira interrogans serovar lai str. 56601
cucuggucaaguuauuguaaa

SEQ ID NO: 765475 - RNA, 17 nt, Leptospira interrogans serovar lai str. 56601
cucugcuauuauaaucu

SEQ ID NO: 765476 - RNA, 22 nt, Leptospira interrogans serovar lai str. 56601
cucugcaucgaucccuuuugca

SEQ ID NO: 765477 - RNA, 17 nt, Leptospira interrogans serovar lai str. 56601
cucugaguagaaaguua

SEQ ID NO: 765478 - RNA, 23 nt, Leptospira interrogans serovar lai str. 56601
cucugaagcccgaguauucuuaa

SEQ ID NO: 765479 - RNA, 13 nt, Leptospira interrogans serovar lai str. 56601
cucugaaguaucu

SEQ ID NO: 765480 - RNA, 16 nt, Leptospira interrogans serovar lai str. 56601
cucugaaaagaaacag

SEQ ID NO: 765481 - RNA, 21 nt, Leptospira interrogans serovar lai str. 56601
cucugagucuagaauucuuug

SEQ ID NO: 765482 - RNA, 19 nt, Leptospira interrogans serovar lai str. 56601
cucugauaauuuuuuaaaa

SEQ ID NO: 765483 - RNA, 22 nt, Leptospira interrogans serovar lai str. 56601
cucugauaauuuuuuaaaaaaa

SEQ ID NO: 765484 - RNA, 12 nt, Leptospira interrogans serovar lai str. 56601
cucugaauucac

SEQ ID NO: 765485 - RNA, 14 nt, Leptospira interrogans serovar lai str. 56601
cucugaauucacau

SEQ ID NO: 765486 - RNA, 19 nt, Leptospira interrogans serovar lai str. 56601
cucucguaauaucuaaaac

SEQ ID NO: 765487 - RNA, 18 nt, Leptospira interrogans serovar lai str. 56601
cucucguauaacgaaacu

SEQ ID NO: 765488 - RNA, 15 nt, Leptospira interrogans serovar lai str. 56601
cucuccaucuuuuuu

SEQ ID NO: 765489 - RNA, 13 nt, Leptospira interrogans serovar lai str. 56601
cucucaaacucag

SEQ ID NO: 765490 - RNA, 15 nt, Leptospira interrogans serovar lai str. 56601
cucucacaaaucgug

SEQ ID NO: 765491 - RNA, 14 nt, Leptospira interrogans serovar lai str. 56601
cucuauaaaaguaa

SEQ ID NO: 765492 - RNA, 14 nt, Leptospira interrogans serovar lai str. 56601
cucuauaaaauuaa

SEQ ID NO: 765493 - RNA, 16 nt, Leptospira interrogans serovar lai str. 56601
cucguauugaauuuuu

SEQ ID NO: 765494 - RNA, 18 nt, Leptospira interrogans serovar lai str. 56601
cucguauugaauuuuuuc

SEQ ID NO: 765495 - RNA, 19 nt, Leptospira interrogans serovar lai str. 56601
cucguauugaauuuuuucg

SEQ ID NO: 765496 - RNA, 20 nt, Leptospira interrogans serovar lai str. 56601
cucguauugaauuuuuucgu

SEQ ID NO: 765497 - RNA, 15 nt, Leptospira interrogans serovar lai str. 56601
cucgguguaaaaaaa

SEQ ID NO: 765498 - RNA, 14 nt, Leptospira interrogans serovar lai str. 56601
cucguacuaauucu

SEQ ID NO: 765499 - RNA, 13 nt, Leptospira interrogans serovar lai str. 56601
cucuaauuuuuua

SEQ ID NO: 765500 - RNA, 13 nt, Leptospira interrogans serovar lai str. 56601
cucuaauguacaa

SEQ ID NO: 765501 - RNA, 23 nt, Leptospira interrogans serovar lai str. 56601
cucuaauguacaacauccuucaa

SEQ ID NO: 765502 - RNA, 23 nt, Leptospira interrogans serovar lai str. 56601
cucuaauauuuuaaagaaacuca

SEQ ID NO: 765503 - RNA, 14 nt, Leptospira interrogans serovar lai str. 56601
cucgaauuuauaua

SEQ ID NO: 765504 - RNA, 24 nt, Leptospira interrogans serovar lai str. 56601
cucgaauuuauauaguaaauaccu

SEQ ID NO: 765505 - RNA, 16 nt, Leptospira interrogans serovar lai str. 56601
cucgaauuuuuuucag

SEQ ID NO: 765506 - RNA, 13 nt, Leptospira interrogans serovar lai str. 56601
cucgacaaaacac

SEQ ID NO: 765507 - RNA, 19 nt, Leptospira interrogans serovar lai str. 56601
cucgaaaugagauuuuguc

SEQ ID NO: 765508 - RNA, 19 nt, Leptospira interrogans serovar lai str. 56601
cucgaacgcaugaaaauaa

SEQ ID NO: 765509 - RNA, 14 nt, Leptospira interrogans serovar lai str. 56601
cucgaacuucguug

SEQ ID NO: 765510 - RNA, 18 nt, Leptospira interrogans serovar lai str. 56601
cucgaacuucguuggaaa

SEQ ID NO: 765511 - RNA, 15 nt, Leptospira interrogans serovar lai str. 56601
cucgaaaaucucaga

SEQ ID NO: 765512 - RNA, 19 nt, Leptospira interrogans serovar lai str. 56601
cucgaaaccauacaauaaa

SEQ ID NO: 765513 - RNA, 20 nt, Leptospira interrogans serovar lai str. 56601
cuccuuuuucaaaauaagaa

SEQ ID NO: 765514 - RNA, 22 nt, Leptospira interrogans serovar lai str. 56601
cuccuuuuucaaaauaagaauu

SEQ ID NO: 765515 - RNA, 15 nt, Leptospira interrogans serovar lai str. 56601
cucgcauuuuccuuu

SEQ ID NO: 765516 - RNA, 14 nt, Leptospira interrogans serovar lai str. 56601
cucccguuauuuuu

SEQ ID NO: 765517 - RNA, 15 nt, Leptospira interrogans serovar lai str. 56601
cuccgauaauuguag

SEQ ID NO: 765518 - RNA, 20 nt, Leptospira interrogans serovar lai str. 56601
cuccgauaauuguagaagca

SEQ ID NO: 765519 - RNA, 17 nt, Leptospira interrogans serovar lai str. 56601
cuccgugaacuucuuuc

SEQ ID NO: 765520 - RNA, 18 nt, Leptospira interrogans serovar lai str. 56601
cuccguuaugcaugaauu

SEQ ID NO: 765521 - RNA, 22 nt, Leptospira interrogans serovar lai str. 56601
cuccguuaugcaugaauuuguu

SEQ ID NO: 765522 - RNA, 16 nt, Leptospira interrogans serovar lai str. 56601
cuccgcucuauuucca

SEQ ID NO: 765523 - RNA, 17 nt, Leptospira interrogans serovar lai str. 56601
cuccugaaaauuuuccu

SEQ ID NO: 765524 - RNA, 13 nt, Leptospira interrogans serovar lai str. 56601
cuccucuucacca

SEQ ID NO: 765525 - RNA, 22 nt, Leptospira interrogans serovar lai str. 56601
cucagcgaaaauacuucucuaa

SEQ ID NO: 765526 - RNA, 13 nt, Leptospira interrogans serovar lai str. 56601
cucauacauuuuu

SEQ ID NO: 765527 - RNA, 24 nt, Leptospira interrogans serovar lai str. 56601
cucauacuuaauuucaaucuauua

SEQ ID NO: 765528 - RNA, 14 nt, Leptospira interrogans serovar lai str. 56601
cucauacuucuaaa

SEQ ID NO: 765529 - RNA, 11 nt, Leptospira interrogans serovar lai str. 56601
cucauacuuuu

SEQ ID NO: 765530 - RNA, 16 nt, Leptospira interrogans serovar lai str. 56601
cucauacuuuuagaag

SEQ ID NO: 765531 - RNA, 22 nt, Leptospira interrogans serovar lai str. 56601
cucauacuuuuagaagauuuuu

SEQ ID NO: 765532 - RNA, 19 nt, Leptospira interrogans serovar lai str. 56601
cucauaguuauauaauaaa

SEQ ID NO: 765533 - RNA, 14 nt, Leptospira interrogans serovar lai str. 56601
cucauaaaauaacu

SEQ ID NO: 765534 - RNA, 22 nt, Leptospira interrogans serovar lai str. 56601
cucauugugaauguauauuuuu

SEQ ID NO: 765535 - RNA, 14 nt, Leptospira interrogans serovar lai str. 56601
cuccaaacaauuuu

SEQ ID NO: 765536 - RNA, 17 nt, Leptospira interrogans serovar lai str. 56601
cuccaaacaauuuuuug

SEQ ID NO: 765537 - RNA, 15 nt, Leptospira interrogans serovar lai str. 56601
cucaugaaaaucuag

SEQ ID NO: 765538 - RNA, 15 nt, Leptospira interrogans serovar lai str. 56601
cucaucagucauuaa

SEQ ID NO: 765539 - RNA, 18 nt, Leptospira interrogans serovar lai str. 56601
cucaucauucugaaaaaa

SEQ ID NO: 765540 - RNA, 21 nt, Leptospira interrogans serovar lai str. 56601
cucaucauucugaaaaaaguu

SEQ ID NO: 765541 - RNA, 21 nt, Leptospira interrogans serovar lai str. 56601
cucacaaaucagguuuuuaca

SEQ ID NO: 765542 - RNA, 23 nt, Leptospira interrogans serovar lai str. 56601
cucacaccggauucacauuaaaa

SEQ ID NO: 765543 - RNA, 23 nt, Leptospira interrogans serovar lai str. 56601
cucacagauucagucucauuuca

SEQ ID NO: 765544 - RNA, 15 nt, Leptospira interrogans serovar lai str. 56601
cucacagaaauauau

SEQ ID NO: 765545 - RNA, 17 nt, Leptospira interrogans serovar lai str. 56601
cucaauagauuuuugau

SEQ ID NO: 765546 - RNA, 18 nt, Leptospira interrogans serovar lai str. 56601
cucaaucaaaauuuuuuu

SEQ ID NO: 765547 - RNA, 16 nt, Leptospira interrogans serovar lai str. 56601
cucaaucaaauuuuug

SEQ ID NO: 765548 - RNA, 15 nt, Leptospira interrogans serovar lai str. 56601
cucacguuaauuuag

SEQ ID NO: 765549 - RNA, 18 nt, Leptospira interrogans serovar lai str. 56601
cucacguuauuuuaacuu

SEQ ID NO: 765550 - RNA, 21 nt, Leptospira interrogans serovar lai str. 56601
cucacguuauuuuaacuugag

SEQ ID NO: 765551 - RNA, 11 nt, Leptospira interrogans serovar lai str. 56601
cucacuaccuu

SEQ ID NO: 765552 - RNA, 15 nt, Leptospira interrogans serovar lai str. 56601
cucacucauuuuuag

SEQ ID NO: 765553 - RNA, 16 nt, Leptospira interrogans serovar lai str. 56601
cucacucauuuuuaga

SEQ ID NO: 765554 - RNA, 14 nt, Leptospira interrogans serovar lai str. 56601
cuauuguaauaaau

SEQ ID NO: 765555 - RNA, 22 nt, Leptospira interrogans serovar lai str. 56601
cuauugcuuuaucuuuauaaaa

SEQ ID NO: 765556 - RNA, 22 nt, Leptospira interrogans serovar lai str. 56601
cuauugaaacaaaaaugagaau

SEQ ID NO: 765557 - RNA, 18 nt, Leptospira interrogans serovar lai str. 56601
cucaaaaucuuaauaaaa

SEQ ID NO: 765558 - RNA, 14 nt, Leptospira interrogans serovar lai str. 56601
cucaaaauuaagaa

SEQ ID NO: 765559 - RNA, 20 nt, Leptospira interrogans serovar lai str. 56601
cucaaaauuucggaaccggc

SEQ ID NO: 765560 - RNA, 15 nt, Leptospira interrogans serovar lai str. 56601
cucaaaauucuuaaa

SEQ ID NO: 765561 - RNA, 20 nt, Leptospira interrogans serovar lai str. 56601
cucaaaauucuuaaaaaaua

SEQ ID NO: 765562 - RNA, 15 nt, Leptospira interrogans serovar lai str. 56601
cucaaaucuacaaaa

SEQ ID NO: 765563 - RNA, 14 nt, Leptospira interrogans serovar lai str. 56601
cucaaaauacuuua

SEQ ID NO: 765564 - RNA, 21 nt, Leptospira interrogans serovar lai str. 56601
cucaacucugguuauuaaauu

SEQ ID NO: 765565 - RNA, 22 nt, Leptospira interrogans serovar lai str. 56601
cucaaaucuucgguuuaauaua

SEQ ID NO: 765566 - RNA, 15 nt, Leptospira interrogans serovar lai str. 56601
cuauguuucuugugu

SEQ ID NO: 765567 - RNA, 18 nt, Leptospira interrogans serovar lai str. 56601
cuauguuucuugugucaa

SEQ ID NO: 765568 - RNA, 22 nt, Leptospira interrogans serovar lai str. 56601
cuauguuucuugugucaagccc

SEQ ID NO: 765569 - RNA, 19 nt, Leptospira interrogans serovar lai str. 56601
cuauuauaauauauauaaa

SEQ ID NO: 765570 - RNA, 19 nt, Leptospira interrogans serovar lai str. 56601
cuauuaggaaauacaaaaa

SEQ ID NO: 765571 - RNA, 16 nt, Leptospira interrogans serovar lai str. 56601
cuauucuacagauaaa

SEQ ID NO: 765572 - RNA, 18 nt, Leptospira interrogans serovar lai str. 56601
cuauucuacagauaaaaa

SEQ ID NO: 765573 - RNA, 20 nt, Leptospira interrogans serovar lai str. 56601
cuauuccguacuguuuuuga

SEQ ID NO: 765574 - RNA, 20 nt, Leptospira interrogans serovar lai str. 56601
cuauucuauuaguuuuuaug

SEQ ID NO: 765575 - RNA, 17 nt, Leptospira interrogans serovar lai str. 56601
cuauucucguuucuaau

SEQ ID NO: 765576 - RNA, 14 nt, Leptospira interrogans serovar lai str. 56601
cuauucauaaauga

SEQ ID NO: 765577 - RNA, 17 nt, Leptospira interrogans serovar lai str. 56601
cuauucauaaaugauaa

SEQ ID NO: 765578 - RNA, 17 nt, Leptospira interrogans serovar lai str. 56601
cuaugauucugaaaaaa

SEQ ID NO: 765579 - RNA, 18 nt, Leptospira interrogans serovar lai str. 56601
cuaugauucugaaaaaaa

SEQ ID NO: 765580 - RNA, 20 nt, Leptospira interrogans serovar lai str. 56601
cuaugauucugaaaaaaauu

SEQ ID NO: 765581 - RNA, 23 nt, Leptospira interrogans serovar lai str. 56601
cuaucgcuaaacggcacuuugug

SEQ ID NO: 765582 - RNA, 13 nt, Leptospira interrogans serovar lai str. 56601
cuauguaagaaaa

SEQ ID NO: 765583 - RNA, 18 nt, Leptospira interrogans serovar lai str. 56601
cuauguccuuuuuuucuu

SEQ ID NO: 765584 - RNA, 18 nt, Leptospira interrogans serovar lai str. 56601
cuaguuuaugugaguucc

SEQ ID NO: 765585 - RNA, 14 nt, Leptospira interrogans serovar lai str. 56601
cuauagauugauuu

SEQ ID NO: 765586 - RNA, 12 nt, Leptospira interrogans serovar lai str. 56601
cuauauucaaaa

SEQ ID NO: 765587 - RNA, 13 nt, Leptospira interrogans serovar lai str. 56601
cuauauucaaaaa

SEQ ID NO: 765588 - RNA, 15 nt, Leptospira interrogans serovar lai str. 56601
cuauauucaaaaaau

SEQ ID NO: 765589 - RNA, 21 nt, Leptospira interrogans serovar lai str. 56601
cuauccaauugaauauaaaau

SEQ ID NO: 765590 - RNA, 17 nt, Leptospira interrogans serovar lai str. 56601
cuauauuuuacaguaaa

SEQ ID NO: 765591 - RNA, 21 nt, Leptospira interrogans serovar lai str. 56601
cuauauuuuugugaaacucaa

SEQ ID NO: 765592 - RNA, 22 nt, Leptospira interrogans serovar lai str. 56601
cuauauuuuugugaaacucaau

SEQ ID NO: 765593 - RNA, 21 nt, Leptospira interrogans serovar lai str. 56601
cuaucaacaagaaugaaaaaa

SEQ ID NO: 765594 - RNA, 16 nt, Leptospira interrogans serovar lai str. 56601
cuaucagaaaaacaua

SEQ ID NO: 765595 - RNA, 13 nt, Leptospira interrogans serovar lai str. 56601
cuaucaaaaaauu

SEQ ID NO: 765596 - RNA, 13 nt, Leptospira interrogans serovar lai str. 56601
cuagguuuccuuc

SEQ ID NO: 765597 - RNA, 15 nt, Leptospira interrogans serovar lai str. 56601
cuaguccucuuuuuu

SEQ ID NO: 765598 - RNA, 16 nt, Leptospira interrogans serovar lai str. 56601
cuaguccucuuuuuug

SEQ ID NO: 765599 - RNA, 19 nt, Leptospira interrogans serovar lai str. 56601
cuaguauuauuuuccuuua

SEQ ID NO: 765600 - RNA, 19 nt, Leptospira interrogans serovar lai str. 56601
cuagauuuagauucuaaaa

SEQ ID NO: 765601 - RNA, 23 nt, Leptospira interrogans serovar lai str. 56601
cuagauuuuacgauuaaauuuug

SEQ ID NO: 765602 - RNA, 23 nt, Leptospira interrogans serovar lai str. 56601
cuagauauuucaagaauuuuaga

SEQ ID NO: 765603 - RNA, 24 nt, Leptospira interrogans serovar lai str. 56601
cuagggaauuuuucaacaacucua

SEQ ID NO: 765604 - RNA, 19 nt, Leptospira interrogans serovar lai str. 56601
cuagggaaaguuuuuuaaa

SEQ ID NO: 765605 - RNA, 14 nt, Leptospira interrogans serovar lai str. 56601
cuaggaaacucaag

SEQ ID NO: 765606 - RNA, 21 nt, Leptospira interrogans serovar lai str. 56601
cuacuuuccguagaucuuuua

SEQ ID NO: 765607 - RNA, 19 nt, Leptospira interrogans serovar lai str. 56601
cuacuuauuucuauaaaau

SEQ ID NO: 765608 - RNA, 21 nt, Leptospira interrogans serovar lai str. 56601
cuagacuuucuuugaacuuuu

SEQ ID NO: 765609 - RNA, 17 nt, Leptospira interrogans serovar lai str. 56601
cuacucgaauuuauaua

SEQ ID NO: 765610 - RNA, 18 nt, Leptospira interrogans serovar lai str. 56601
cuacuccggcuaaaaaac

SEQ ID NO: 765611 - RNA, 20 nt, Leptospira interrogans serovar lai str. 56601
cuacucggaaauuuauuuua

SEQ ID NO: 765612 - RNA, 19 nt, Leptospira interrogans serovar lai str. 56601
cuacugcauuuuauuaaaa

SEQ ID NO: 765613 - RNA, 19 nt, Leptospira interrogans serovar lai str. 56601
cuaccgcaaaucaagauuu

SEQ ID NO: 765614 - RNA, 14 nt, Leptospira interrogans serovar lai str. 56601
cuaccgcaaaucac

SEQ ID NO: 765615 - RNA, 16 nt, Leptospira interrogans serovar lai str. 56601
cuacucacaaauuguc

SEQ ID NO: 765616 - RNA, 13 nt, Leptospira interrogans serovar lai str. 56601
cuaaugauuucuu

SEQ ID NO: 765617 - RNA, 16 nt, Leptospira interrogans serovar lai str. 56601
cuaauguugaaugaaa

SEQ ID NO: 765618 - RNA, 20 nt, Leptospira interrogans serovar lai str. 56601
cuaauucuaaaaauuuuuuu

SEQ ID NO: 765619 - RNA, 17 nt, Leptospira interrogans serovar lai str. 56601
cuaauucucuucguuuu

SEQ ID NO: 765620 - RNA, 18 nt, Leptospira interrogans serovar lai str. 56601
cuaauucuuaaaaauuua

SEQ ID NO: 765621 - RNA, 16 nt, Leptospira interrogans serovar lai str. 56601
cuaauucaguuuuucg

SEQ ID NO: 765622 - RNA, 17 nt, Leptospira interrogans serovar lai str. 56601
cuaauucgaaagcgauu

SEQ ID NO: 765623 - RNA, 22 nt, Leptospira interrogans serovar lai str. 56601
cuaaucgagcuuuucuguucau

SEQ ID NO: 765624 - RNA, 17 nt, Leptospira interrogans serovar lai str. 56601
cuaauauuuuaaagaaa

SEQ ID NO: 765625 - RNA, 13 nt, Leptospira interrogans serovar lai str. 56601
cuaaguaaaaaug

SEQ ID NO: 765626 - RNA, 14 nt, Leptospira interrogans serovar lai str. 56601
cuaauaaaaacaau

SEQ ID NO: 765627 - RNA, 14 nt, Leptospira interrogans serovar lai str. 56601
cuaauaaacaaaau

SEQ ID NO: 765628 - RNA, 22 nt, Leptospira interrogans serovar lai str. 56601
cuaaggauccaauacaaaacaa

SEQ ID NO: 765629 - RNA, 23 nt, Leptospira interrogans serovar lai str. 56601
cuaaggauccaauacaaaacaag

SEQ ID NO: 765630 - RNA, 16 nt, Leptospira interrogans serovar lai str. 56601
cuaaauauuuauuaca

SEQ ID NO: 765631 - RNA, 19 nt, Leptospira interrogans serovar lai str. 56601
cuaaauauuuauuacaaag

SEQ ID NO: 765632 - RNA, 14 nt, Leptospira interrogans serovar lai str. 56601
cuaaauccuucaaa

SEQ ID NO: 765633 - RNA, 15 nt, Leptospira interrogans serovar lai str. 56601
cuaaauccuucuuuu

SEQ ID NO: 765634 - RNA, 17 nt, Leptospira interrogans serovar lai str. 56601
cuaaauccuucuuuucu

SEQ ID NO: 765635 - RNA, 23 nt, Leptospira interrogans serovar lai str. 56601
cuaaaucucaauucaguaaauua

SEQ ID NO: 765636 - RNA, 15 nt, Leptospira interrogans serovar lai str. 56601
cuaagaucaaagaga

SEQ ID NO: 765637 - RNA, 17 nt, Leptospira interrogans serovar lai str. 56601
cuaagaucaaagagaug

SEQ ID NO: 765638 - RNA, 23 nt, Leptospira interrogans serovar lai str. 56601
cuaacuaugauaaguaauuugug

SEQ ID NO: 765639 - RNA, 20 nt, Leptospira interrogans serovar lai str. 56601
cuaauuuaaaaaagaagaau

SEQ ID NO: 765640 - RNA, 14 nt, Leptospira interrogans serovar lai str. 56601
cuaauuuacuacau

SEQ ID NO: 765641 - RNA, 22 nt, Leptospira interrogans serovar lai str. 56601
cuaauuuaugaaagucuuuuuu

SEQ ID NO: 765642 - RNA, 23 nt, Leptospira interrogans serovar lai str. 56601
cuaauuucauugaguuuuuuagu

SEQ ID NO: 765643 - RNA, 13 nt, Leptospira interrogans serovar lai str. 56601
cuaauuugcgauu

SEQ ID NO: 765644 - RNA, 23 nt, Leptospira interrogans serovar lai str. 56601
cuaauuuguaggaauuacuacau

SEQ ID NO: 765645 - RNA, 17 nt, Leptospira interrogans serovar lai str. 56601
cuaauuuuucaaaaacu

SEQ ID NO: 765646 - RNA, 15 nt, Leptospira interrogans serovar lai str. 56601
cuaauuuuagagaau

SEQ ID NO: 765647 - RNA, 16 nt, Leptospira interrogans serovar lai str. 56601
cuacaaaauuuagaac

SEQ ID NO: 765648 - RNA, 17 nt, Leptospira interrogans serovar lai str. 56601
cuacaaaagauuuuuau

SEQ ID NO: 765649 - RNA, 13 nt, Leptospira interrogans serovar lai str. 56601
cuacaaucacuuu

SEQ ID NO: 765650 - RNA, 20 nt, Leptospira interrogans serovar lai str. 56601
cuacaaugucuaucaaaguu

SEQ ID NO: 765651 - RNA, 15 nt, Leptospira interrogans serovar lai str. 56601
cuacaauuaaaaaga

SEQ ID NO: 765652 - RNA, 14 nt, Leptospira interrogans serovar lai str. 56601
cuacaaauucauca

SEQ ID NO: 765653 - RNA, 18 nt, Leptospira interrogans serovar lai str. 56601
cuacaaauucuucuuccu

SEQ ID NO: 765654 - RNA, 20 nt, Leptospira interrogans serovar lai str. 56601
cuacaaauucuucuuccuuu

SEQ ID NO: 765655 - RNA, 21 nt, Leptospira interrogans serovar lai str. 56601
cuacaaauucuucuuccuuuu

SEQ ID NO: 765656 - RNA, 15 nt, Leptospira interrogans serovar lai str. 56601
cuacaauuuuagaau

SEQ ID NO: 765657 - RNA, 19 nt, Leptospira interrogans serovar lai str. 56601
cuacaauuuuagaauuugu

SEQ ID NO: 765658 - RNA, 20 nt, Leptospira interrogans serovar lai str. 56601
cuacaauuuuagaauuuguu

SEQ ID NO: 765659 - RNA, 13 nt, Leptospira interrogans serovar lai str. 56601
cuacaucuaauga

SEQ ID NO: 765660 - RNA, 21 nt, Leptospira interrogans serovar lai str. 56601
cuacaguuuuagaaucuguuc

SEQ ID NO: 765661 - RNA, 21 nt, Leptospira interrogans serovar lai str. 56601
cuacauaaaaaaggaagcaca

SEQ ID NO: 765662 - RNA, 16 nt, Leptospira interrogans serovar lai str. 56601
cuacagauaaaaauag

SEQ ID NO: 765663 - RNA, 20 nt, Leptospira interrogans serovar lai str. 56601
cuacauuugauuaaaaauuu

SEQ ID NO: 765664 - RNA, 20 nt, Leptospira interrogans serovar lai str. 56601
cuacauucugaaacuuuuca

SEQ ID NO: 765665 - RNA, 20 nt, Leptospira interrogans serovar lai str. 56601
cuacauuagaguuguugaaa

SEQ ID NO: 765666 - RNA, 18 nt, Leptospira interrogans serovar lai str. 56601
cuacauucaauuucuuua

SEQ ID NO: 765667 - RNA, 14 nt, Leptospira interrogans serovar lai str. 56601
cuacauucauuuuu

SEQ ID NO: 765668 - RNA, 15 nt, Leptospira interrogans serovar lai str. 56601
cuacauucauuuuua

SEQ ID NO: 765669 - RNA, 15 nt, Leptospira interrogans serovar lai str. 56601
cuacauguaaaacuu

SEQ ID NO: 765670 - RNA, 16 nt, Leptospira interrogans serovar lai str. 56601
cuacaugauucauuua

SEQ ID NO: 765671 - RNA, 22 nt, Leptospira interrogans serovar lai str. 56601
cuacaugauucauuuaaaaauu

SEQ ID NO: 765672 - RNA, 21 nt, Leptospira interrogans serovar lai str. 56601
cuacauuuuugugaaacucaa

SEQ ID NO: 765673 - RNA, 22 nt, Leptospira interrogans serovar lai str. 56601
cuacauuuuugugaaacucaau

SEQ ID NO: 765674 - RNA, 18 nt, Leptospira interrogans serovar lai str. 56601
cuacauuuuuuaaauuua

SEQ ID NO: 765675 - RNA, 20 nt, Leptospira interrogans serovar lai str. 56601
cuacauuuuuuaaauuuauc

SEQ ID NO: 765676 - RNA, 15 nt, Leptospira interrogans serovar lai str. 56601
cuacauuuuauugug

SEQ ID NO: 765677 - RNA, 12 nt, Leptospira interrogans serovar lai str. 56601
cuaccacaaaac

SEQ ID NO: 765678 - RNA, 20 nt, Leptospira interrogans serovar lai str. 56601
cuaccaugagcuugucccaa

SEQ ID NO: 765679 - RNA, 18 nt, Leptospira interrogans serovar lai str. 56601
cuaccaucaccaacccca

SEQ ID NO: 765680 - RNA, 16 nt, Leptospira interrogans serovar lai str. 56601
cguuucuaauguuugu

SEQ ID NO: 765681 - RNA, 20 nt, Leptospira interrogans serovar lai str. 56601
cguuucguucccguuuagaa

SEQ ID NO: 765682 - RNA, 14 nt, Leptospira interrogans serovar lai str. 56601
cguuucguucuuuu

SEQ ID NO: 765683 - RNA, 16 nt, Leptospira interrogans serovar lai str. 56601
cguuuuauaaaaacuu

SEQ ID NO: 765684 - RNA, 16 nt, Leptospira interrogans serovar lai str. 56601
cguuuuaucuuagagu

SEQ ID NO: 765685 - RNA, 17 nt, Leptospira interrogans serovar lai str. 56601
cguuuuaucuuagaguu

SEQ ID NO: 765686 - RNA, 17 nt, Leptospira interrogans serovar lai str. 56601
cguuuuauuauauaauu

SEQ ID NO: 765687 - RNA, 15 nt, Leptospira interrogans serovar lai str. 56601
cguuuucaaaaaauu

SEQ ID NO: 765688 - RNA, 16 nt, Leptospira interrogans serovar lai str. 56601
cguuuucaauuauuuu

SEQ ID NO: 765689 - RNA, 14 nt, Leptospira interrogans serovar lai str. 56601
cguuucuuuuucua

SEQ ID NO: 765690 - RNA, 20 nt, Leptospira interrogans serovar lai str. 56601
cguuucuugucucuacucuu

SEQ ID NO: 765691 - RNA, 15 nt, Leptospira interrogans serovar lai str. 56601
cguuuuuaguuucaa

SEQ ID NO: 765692 - RNA, 19 nt, Leptospira interrogans serovar lai str. 56601
cguuuuuaagcgauuugag

SEQ ID NO: 765693 - RNA, 12 nt, Leptospira interrogans serovar lai str. 56601
cguuuuuaaaca

SEQ ID NO: 765694 - RNA, 15 nt, Leptospira interrogans serovar lai str. 56601
cguuuugcugaguuu

SEQ ID NO: 765695 - RNA, 14 nt, Leptospira interrogans serovar lai str. 56601
cuaaacaauuuuau

SEQ ID NO: 765696 - RNA, 15 nt, Leptospira interrogans serovar lai str. 56601
cuaaacaauuuuauu

SEQ ID NO: 765697 - RNA, 22 nt, Leptospira interrogans serovar lai str. 56601
cuaaacaauuuuauuugacucu

SEQ ID NO: 765698 - RNA, 15 nt, Leptospira interrogans serovar lai str. 56601
cuaaaauuucauuuc

SEQ ID NO: 765699 - RNA, 18 nt, Leptospira interrogans serovar lai str. 56601
cuaaaauuuuauaaaaau

SEQ ID NO: 765700 - RNA, 20 nt, Leptospira interrogans serovar lai str. 56601
cuaaaauuuuauaaaaaucu

SEQ ID NO: 765701 - RNA, 16 nt, Leptospira interrogans serovar lai str. 56601
cuaaaauuuuuuuaag

SEQ ID NO: 765702 - RNA, 19 nt, Leptospira interrogans serovar lai str. 56601
cuaaaauuuuuuuaagaau

SEQ ID NO: 765703 - RNA, 22 nt, Leptospira interrogans serovar lai str. 56601
cuaaaauaaaguauccaguacu

SEQ ID NO: 765704 - RNA, 16 nt, Leptospira interrogans serovar lai str. 56601
cuaaaauaauuuuuac

SEQ ID NO: 765705 - RNA, 22 nt, Leptospira interrogans serovar lai str. 56601
cuaaaauacuuuuagaaaauua

SEQ ID NO: 765706 - RNA, 11 nt, Leptospira interrogans serovar lai str. 56601
cuaaaauguag

SEQ ID NO: 765707 - RNA, 15 nt, Leptospira interrogans serovar lai str. 56601
cuaaaauuaaaaauu

SEQ ID NO: 765708 - RNA, 21 nt, Leptospira interrogans serovar lai str. 56601
cuaaaauuacgcugauuagaa

SEQ ID NO: 765709 - RNA, 18 nt, Leptospira interrogans serovar lai str. 56601
cuaaaaucuggauuuuga

SEQ ID NO: 765710 - RNA, 19 nt, Leptospira interrogans serovar lai str. 56601
cuaaaaucuggauuuugau

SEQ ID NO: 765711 - RNA, 21 nt, Leptospira interrogans serovar lai str. 56601
cuaaaauauuugcauaaacuu

SEQ ID NO: 765712 - RNA, 22 nt, Leptospira interrogans serovar lai str. 56601
cuaaaaucauacuuuuaaaaaa

SEQ ID NO: 765713 - RNA, 23 nt, Leptospira interrogans serovar lai str. 56601
cuaaaaucauacuuuuaaaaaau

SEQ ID NO: 765714 - RNA, 14 nt, Leptospira interrogans serovar lai str. 56601
cuaaaauauaggaa

SEQ ID NO: 765715 - RNA, 15 nt, Leptospira interrogans serovar lai str. 56601
cuaaagucgaauuuu

SEQ ID NO: 765716 - RNA, 15 nt, Leptospira interrogans serovar lai str. 56601
cuaaaggaaaacgau

SEQ ID NO: 765717 - RNA, 16 nt, Leptospira interrogans serovar lai str. 56601
cuaaacuucuucaucu

SEQ ID NO: 765718 - RNA, 19 nt, Leptospira interrogans serovar lai str. 56601
cuaaagcuugauuauuauu

SEQ ID NO: 765719 - RNA, 22 nt, Leptospira interrogans serovar lai str. 56601
cuaaacuaucuauuagaacauc

SEQ ID NO: 765720 - RNA, 17 nt, Leptospira interrogans serovar lai str. 56601
cuaaacuaaaaaaaaua

SEQ ID NO: 765721 - RNA, 20 nt, Leptospira interrogans serovar lai str. 56601
cuaaacucucguuguaacua

SEQ ID NO: 765722 - RNA, 16 nt, Leptospira interrogans serovar lai str. 56601
cguuccaaacccugcc

SEQ ID NO: 765723 - RNA, 21 nt, Leptospira interrogans serovar lai str. 56601
cguuauaauucuuuaaaauuu

SEQ ID NO: 765724 - RNA, 14 nt, Leptospira interrogans serovar lai str. 56601
cguuauuaaaauuu

SEQ ID NO: 765725 - RNA, 22 nt, Leptospira interrogans serovar lai str. 56601
cguugaaguagucauauaaaag

SEQ ID NO: 765726 - RNA, 12 nt, Leptospira interrogans serovar lai str. 56601
cguugaauaaga

SEQ ID NO: 765727 - RNA, 16 nt, Leptospira interrogans serovar lai str. 56601
aaaaaaaugaauuuuu

SEQ ID NO: 765728 - RNA, 21 nt, Leptospira interrogans serovar lai str. 56601
aaaaaaauaauauauuuauaa

SEQ ID NO: 765729 - RNA, 21 nt, Leptospira interrogans serovar lai str. 56601
aaaaaaauagcgauacuuaaa

SEQ ID NO: 765730 - RNA, 14 nt, Leptospira interrogans serovar lai str. 56601
aaaaaaauauuaaa

SEQ ID NO: 765731 - RNA, 12 nt, Leptospira interrogans serovar lai str. 56601
aaaaaaacauga

SEQ ID NO: 765732 - RNA, 13 nt, Leptospira interrogans serovar lai str. 56601
aaaaaaacaugaa

SEQ ID NO: 765733 - RNA, 11 nt, Leptospira interrogans serovar lai str. 56601
aaaaaaaaugu

SEQ ID NO: 765734 - RNA, 20 nt, Leptospira interrogans serovar lai str. 56601
aaaaaaaucaggcuuuauaa

SEQ ID NO: 765735 - RNA, 12 nt, Leptospira interrogans serovar lai str. 56601
aaaaaaauaaua

SEQ ID NO: 765736 - RNA, 20 nt, Leptospira interrogans serovar lai str. 56601
aaaaaaauaauauauuuaua

SEQ ID NO: 765737 - RNA, 13 nt, Leptospira interrogans serovar lai str. 56601
aaaaaaaguuuua

SEQ ID NO: 765738 - RNA, 13 nt, Leptospira interrogans serovar lai str. 56601
aaaaaaauaaaau

SEQ ID NO: 765739 - RNA, 11 nt, Leptospira interrogans serovar lai str. 56601
aaaaaaauaag

SEQ ID NO: 765740 - RNA, 14 nt, Leptospira interrogans serovar lai str. 56601
aaaaaaaaagaauu

SEQ ID NO: 765741 - RNA, 13 nt, Leptospira interrogans serovar lai str. 56601
aaaaaaaaaugag

SEQ ID NO: 765742 - RNA, 13 nt, Leptospira interrogans serovar lai str. 56601
aaaaaaauuagaa

SEQ ID NO: 765743 - RNA, 13 nt, Leptospira interrogans serovar lai str. 56601
aaaaaaaugauuu

SEQ ID NO: 765744 - RNA, 13 nt, Leptospira interrogans serovar lai str. 56601
aaaaaaauguuua

SEQ ID NO: 765745 - RNA, 15 nt, Leptospira interrogans serovar lai str. 56601
aaaaaaauauuucaa

SEQ ID NO: 765746 - RNA, 22 nt, Leptospira interrogans serovar lai str. 56601
aaaaaaguugggaucugaauuu

SEQ ID NO: 765747 - RNA, 20 nt, Leptospira interrogans serovar lai str. 56601
aaaaaaguuuauacuucaaa

SEQ ID NO: 765748 - RNA, 13 nt, Leptospira interrogans serovar lai str. 56601
aaaaaauaaaaug

SEQ ID NO: 765749 - RNA, 14 nt, Leptospira interrogans serovar lai str. 56601
aaaaaauaaaauuu

SEQ ID NO: 765750 - RNA, 18 nt, Leptospira interrogans serovar lai str. 56601
aaaaaauaagaaagaauu

SEQ ID NO: 765751 - RNA, 22 nt, Leptospira interrogans serovar lai str. 56601
aaaaaauacgauucgaaagauu

SEQ ID NO: 765752 - RNA, 21 nt, Leptospira interrogans serovar lai str. 56601
aaaaaauacggcacucaauuu

SEQ ID NO: 765753 - RNA, 22 nt, Leptospira interrogans serovar lai str. 56601
aaaaaaguugaaaucugaauuu

SEQ ID NO: 765754 - RNA, 21 nt, Leptospira interrogans serovar lai str. 56601
aaaaaacgaaucauauuuaac

SEQ ID NO: 765755 - RNA, 12 nt, Leptospira interrogans serovar lai str. 56601
aaaaaaauuaaa

SEQ ID NO: 765756 - RNA, 13 nt, Leptospira interrogans serovar lai str. 56601
aaaaaaauuaaaa

SEQ ID NO: 765757 - RNA, 12 nt, Leptospira interrogans serovar lai str. 56601
aaaaaaauuaga

SEQ ID NO: 765758 - RNA, 13 nt, Leptospira interrogans serovar lai str. 56601
aaaaaaauuuuua

SEQ ID NO: 765759 - RNA, 13 nt, Leptospira interrogans serovar lai str. 56601
aaaaaagauaaaa

SEQ ID NO: 765760 - RNA, 11 nt, Leptospira interrogans serovar lai str. 56601
aaaaaacaaau

SEQ ID NO: 765761 - RNA, 17 nt, Leptospira interrogans serovar lai str. 56601
aaaaaaguauauauuaa

SEQ ID NO: 765762 - RNA, 19 nt, Leptospira interrogans serovar lai str. 56601
aaaaaaguauauauuaaag

SEQ ID NO: 765763 - RNA, 17 nt, Leptospira interrogans serovar lai str. 56601
aaaaaaguccaaaacaa

SEQ ID NO: 765764 - RNA, 15 nt, Leptospira interrogans serovar lai str. 56601
aaaaaagcgaaagaa

SEQ ID NO: 765765 - RNA, 22 nt, Leptospira interrogans serovar lai str. 56601
aaaaaaucgacuuuucugauuu

SEQ ID NO: 765766 - RNA, 14 nt, Leptospira interrogans serovar lai str. 56601
aaaaaauccccuuu

SEQ ID NO: 765767 - RNA, 14 nt, Leptospira interrogans serovar lai str. 56601
aaaaaauauuuucu

SEQ ID NO: 765768 - RNA, 22 nt, Leptospira interrogans serovar lai str. 56601
aaaaaaugcauucaaaaaguuu

SEQ ID NO: 765769 - RNA, 22 nt, Leptospira interrogans serovar lai str. 56601
aaaaaaugaauguuuaaaauuu

SEQ ID NO: 765770 - RNA, 12 nt, Leptospira interrogans serovar lai str. 56601
aaaaaaugaauu

SEQ ID NO: 765771 - RNA, 15 nt, Leptospira interrogans serovar lai str. 56601
aaaaaaugaauuuag

SEQ ID NO: 765772 - RNA, 18 nt, Leptospira interrogans serovar lai str. 56601
aaaaaaugagaaagaauu

SEQ ID NO: 765773 - RNA, 23 nt, Leptospira interrogans serovar lai str. 56601
aaaaacaguaucgaaaauuaaca

SEQ ID NO: 765774 - RNA, 13 nt, Leptospira interrogans serovar lai str. 56601
aaaaaaguuagaa

SEQ ID NO: 765775 - RNA, 23 nt, Leptospira interrogans serovar lai str. 56601
aaaaaaguuagaauuugaacuuu

SEQ ID NO: 765776 - RNA, 16 nt, Leptospira interrogans serovar lai str. 56601
aaaaaaguaauuacuc

SEQ ID NO: 765777 - RNA, 13 nt, Leptospira interrogans serovar lai str. 56601
aaaaaaguuggaa

SEQ ID NO: 765778 - RNA, 21 nt, Leptospira interrogans serovar lai str. 56601
aaaaaaguuggaaucugaauu

SEQ ID NO: 765779 - RNA, 22 nt, Leptospira interrogans serovar lai str. 56601
aaaaaaguuggaaucugaauuu

SEQ ID NO: 765780 - RNA, 22 nt, Leptospira interrogans serovar lai str. 56601
aaaaaaguuggaauuugaauuu

SEQ ID NO: 765781 - RNA, 12 nt, Leptospira interrogans serovar lai str. 56601
aaaaaauaaaau

SEQ ID NO: 765782 - RNA, 13 nt, Leptospira interrogans serovar lai str. 56601
aaaaaauaaaauu

SEQ ID NO: 765783 - RNA, 17 nt, Leptospira interrogans serovar lai str. 56601
aaaaaauaaaucaugau

SEQ ID NO: 765784 - RNA, 23 nt, Leptospira interrogans serovar lai str. 56601
aaaaaauauaauauacuagggaa

SEQ ID NO: 765785 - RNA, 20 nt, Leptospira interrogans serovar lai str. 56601
aaaaaauagcgauacuuaaa

SEQ ID NO: 765786 - RNA, 14 nt, Leptospira interrogans serovar lai str. 56601
aaaaaauacgauuc

SEQ ID NO: 765787 - RNA, 21 nt, Leptospira interrogans serovar lai str. 56601
aaaaaauaacgauacuuaaaa

SEQ ID NO: 765788 - RNA, 12 nt, Leptospira interrogans serovar lai str. 56601
aaaaaauacaaa

SEQ ID NO: 765789 - RNA, 16 nt, Leptospira interrogans serovar lai str. 56601
aaaaaauacaaaguuu

SEQ ID NO: 765790 - RNA, 15 nt, Leptospira interrogans serovar lai str. 56601
aaaaaauaauauuau

SEQ ID NO: 765791 - RNA, 20 nt, Leptospira interrogans serovar lai str. 56601
aaaaaauauuucaaaaauuu

SEQ ID NO: 765792 - RNA, 14 nt, Leptospira interrogans serovar lai str. 56601
aaaaaauaucuuau

SEQ ID NO: 765793 - RNA, 14 nt, Leptospira interrogans serovar lai str. 56601
aaaaaauaucauuu

SEQ ID NO: 765794 - RNA, 14 nt, Leptospira interrogans serovar lai str. 56601
aaaaaauauuaaaa

SEQ ID NO: 765795 - RNA, 22 nt, Leptospira interrogans serovar lai str. 56601
aaaaaauuucuucaauuguuuu

SEQ ID NO: 765796 - RNA, 12 nt, Leptospira interrogans serovar lai str. 56601
aaaaaauuuuua

SEQ ID NO: 765797 - RNA, 12 nt, Leptospira interrogans serovar lai str. 56601
aaaaaauuuuuc

SEQ ID NO: 765798 - RNA, 12 nt, Leptospira interrogans serovar lai str. 56601
aaaaaauuuuuu

SEQ ID NO: 765799 - RNA, 14 nt, Leptospira interrogans serovar lai str. 56601
aaaaacaaaaucaa

SEQ ID NO: 765800 - RNA, 20 nt, Leptospira interrogans serovar lai str. 56601
aaaaacaaauuaaguuuaaa

SEQ ID NO: 765801 - RNA, 18 nt, Leptospira interrogans serovar lai str. 56601
aaaaacagaauugaguuu

SEQ ID NO: 765802 - RNA, 19 nt, Leptospira interrogans serovar lai str. 56601
aaaaacaauuaaucaaauu

SEQ ID NO: 765803 - RNA, 14 nt, Leptospira interrogans serovar lai str. 56601
aaaaacaauauucu

SEQ ID NO: 765804 - RNA, 18 nt, Leptospira interrogans serovar lai str. 56601
aaaaacagcacuaaaagc

SEQ ID NO: 765805 - RNA, 14 nt, Leptospira interrogans serovar lai str. 56601
aaaaaauuaacuuu

SEQ ID NO: 765806 - RNA, 11 nt, Leptospira interrogans serovar lai str. 56601
aaaaaauguuu

SEQ ID NO: 765807 - RNA, 22 nt, Leptospira interrogans serovar lai str. 56601
aaaaaauguuuagacuucucuu

SEQ ID NO: 765808 - RNA, 14 nt, Leptospira interrogans serovar lai str. 56601
aaaaaauucuuucu

SEQ ID NO: 765809 - RNA, 14 nt, Leptospira interrogans serovar lai str. 56601
aaaaaauucuuuuu

SEQ ID NO: 765810 - RNA, 12 nt, Leptospira interrogans serovar lai str. 56601
aaaaaauuaauu

SEQ ID NO: 765811 - RNA, 14 nt, Leptospira interrogans serovar lai str. 56601
aaaaaauucgauuu

SEQ ID NO: 765812 - RNA, 10 nt, Leptospira interrogans serovar lai str. 56601
aaaaaauuca

SEQ ID NO: 765813 - RNA, 12 nt, Leptospira interrogans serovar lai str. 56601
aaaaaauucaau

SEQ ID NO: 765814 - RNA, 22 nt, Leptospira interrogans serovar lai str. 56601
aaaaaauucauuccuauaaaua

SEQ ID NO: 765815 - RNA, 22 nt, Leptospira interrogans serovar lai str. 56601
aaaaaaugcucaaaaauuauaa

SEQ ID NO: 765816 - RNA, 18 nt, Leptospira interrogans serovar lai str. 56601
aaaaaaugaauguuuaaa

SEQ ID NO: 765817 - RNA, 11 nt, Leptospira interrogans serovar lai str. 56601
aaaacauccuc

SEQ ID NO: 765818 - RNA, 15 nt, Leptospira interrogans serovar lai str. 56601
aaaacagcacuaaaa

SEQ ID NO: 765819 - RNA, 19 nt, Leptospira interrogans serovar lai str. 56601
aaaacagaucaagaauuaa

SEQ ID NO: 765820 - RNA, 19 nt, Leptospira interrogans serovar lai str. 56601
aaaacagauggagaauuaa

SEQ ID NO: 765821 - RNA, 22 nt, Leptospira interrogans serovar lai str. 56601
aaaacagauggagaauugauuu

SEQ ID NO: 765822 - RNA, 19 nt, Leptospira interrogans serovar lai str. 56601
aaaacacuuuacauuuuua

SEQ ID NO: 765823 - RNA, 15 nt, Leptospira interrogans serovar lai str. 56601
aaaacauuauuucaa

SEQ ID NO: 765824 - RNA, 23 nt, Leptospira interrogans serovar lai str. 56601
aaaacauuauuucaaugcaaaaa

SEQ ID NO: 765825 - RNA, 16 nt, Leptospira interrogans serovar lai str. 56601
aaaacaccuucucuuu

SEQ ID NO: 765826 - RNA, 22 nt, Leptospira interrogans serovar lai str. 56601
aaaacaccuucucuuuuaaaaa

SEQ ID NO: 765827 - RNA, 16 nt, Leptospira interrogans serovar lai str. 56601
aaaacacgauuuauag

SEQ ID NO: 765828 - RNA, 20 nt, Leptospira interrogans serovar lai str. 56601
aaaacaauagcuucuuuaaa

SEQ ID NO: 765829 - RNA, 22 nt, Leptospira interrogans serovar lai str. 56601
aaaacaaucuucaaauucuaca

SEQ ID NO: 765830 - RNA, 12 nt, Leptospira interrogans serovar lai str. 56601
aaaaauuagaac

SEQ ID NO: 765831 - RNA, 20 nt, Leptospira interrogans serovar lai str. 56601
aaaaauuagaaucugaaccu

SEQ ID NO: 765832 - RNA, 20 nt, Leptospira interrogans serovar lai str. 56601
aaaaauuagagaaguuaaaa

SEQ ID NO: 765833 - RNA, 19 nt, Leptospira interrogans serovar lai str. 56601
aaaaauucaacuaaauccu

SEQ ID NO: 765834 - RNA, 24 nt, Leptospira interrogans serovar lai str. 56601
aaaaauucaacuaaauccuucuuu

SEQ ID NO: 765835 - RNA, 24 nt, Leptospira interrogans serovar lai str. 56601
aaaaauuaaaauucuagaaagaau

SEQ ID NO: 765836 - RNA, 21 nt, Leptospira interrogans serovar lai str. 56601
aaaaauuaaacccauuuuaga

SEQ ID NO: 765837 - RNA, 14 nt, Leptospira interrogans serovar lai str. 56601
aaaaauccaugauu

SEQ ID NO: 765838 - RNA, 12 nt, Leptospira interrogans serovar lai str. 56601
aaaaauuaaaaa

SEQ ID NO: 765839 - RNA, 17 nt, Leptospira interrogans serovar lai str. 56601
aaaaauguuuaaagaau

SEQ ID NO: 765840 - RNA, 15 nt, Leptospira interrogans serovar lai str. 56601
aaaaauuaaaaaaga

SEQ ID NO: 765841 - RNA, 12 nt, Leptospira interrogans serovar lai str. 56601
aaaaauucaauu

SEQ ID NO: 765842 - RNA, 18 nt, Leptospira interrogans serovar lai str. 56601
aaaaauuuauucucuauc

SEQ ID NO: 765843 - RNA, 17 nt, Leptospira interrogans serovar lai str. 56601
aaaaauuucuaugaaaa

SEQ ID NO: 765844 - RNA, 15 nt, Leptospira interrogans serovar lai str. 56601
aaaaauuucuuaaaa

SEQ ID NO: 765845 - RNA, 17 nt, Leptospira interrogans serovar lai str. 56601
aaaaauuucuuaaaaga

SEQ ID NO: 765846 - RNA, 16 nt, Leptospira interrogans serovar lai str. 56601
aaaaauuucuucaauu

SEQ ID NO: 765847 - RNA, 13 nt, Leptospira interrogans serovar lai str. 56601
aaaaauuucagau

SEQ ID NO: 765848 - RNA, 13 nt, Leptospira interrogans serovar lai str. 56601
aaaaauuucauag

SEQ ID NO: 765849 - RNA, 21 nt, Leptospira interrogans serovar lai str. 56601
aaaaauuucauaguucaauua

SEQ ID NO: 765850 - RNA, 20 nt, Leptospira interrogans serovar lai str. 56601
aaaaauuucccuaguuccaa

SEQ ID NO: 765851 - RNA, 20 nt, Leptospira interrogans serovar lai str. 56601
aaaaauuuccggaaaacgaa

SEQ ID NO: 765852 - RNA, 23 nt, Leptospira interrogans serovar lai str. 56601
aaaaauuugauauauuuuuaaag

SEQ ID NO: 765853 - RNA, 15 nt, Leptospira interrogans serovar lai str. 56601
aaaaauuuuauuaaa

SEQ ID NO: 765854 - RNA, 19 nt, Leptospira interrogans serovar lai str. 56601
aaaaauuuuauuaaauaaa

SEQ ID NO: 765855 - RNA, 14 nt, Leptospira interrogans serovar lai str. 56601
aaaaauuuuccgaa

SEQ ID NO: 765856 - RNA, 22 nt, Leptospira interrogans serovar lai str. 56601
aaaaauuuuccgaaccuuacca

SEQ ID NO: 765857 - RNA, 21 nt, Leptospira interrogans serovar lai str. 56601
aaaaauuuucuaaaaguaaaa

SEQ ID NO: 765858 - RNA, 19 nt, Leptospira interrogans serovar lai str. 56601
aaaaauuuuuucuuuuuag

SEQ ID NO: 765859 - RNA, 15 nt, Leptospira interrogans serovar lai str. 56601
aaaaauuuuuuuaaa

SEQ ID NO: 765860 - RNA, 16 nt, Leptospira interrogans serovar lai str. 56601
aaaaauuuuuuuaaac

SEQ ID NO: 765861 - RNA, 19 nt, Leptospira interrogans serovar lai str. 56601
aaaacaagcucaauuuuga

SEQ ID NO: 765862 - RNA, 13 nt, Leptospira interrogans serovar lai str. 56601
aaaaauauauuau

SEQ ID NO: 765863 - RNA, 13 nt, Leptospira interrogans serovar lai str. 56601
aaaaauauaguuc

SEQ ID NO: 765864 - RNA, 21 nt, Leptospira interrogans serovar lai str. 56601
aaaaauauaguuccuacaauu

SEQ ID NO: 765865 - RNA, 16 nt, Leptospira interrogans serovar lai str. 56601
aaaaauauaaaucaau

SEQ ID NO: 765866 - RNA, 14 nt, Leptospira interrogans serovar lai str. 56601
aaaaauauaauaua

SEQ ID NO: 765867 - RNA, 19 nt, Leptospira interrogans serovar lai str. 56601
aaaaauauacaauaaauca

SEQ ID NO: 765868 - RNA, 17 nt, Leptospira interrogans serovar lai str. 56601
aaaaauagggaaaacuc

SEQ ID NO: 765869 - RNA, 17 nt, Leptospira interrogans serovar lai str. 56601
aaaaauaguauccaaaa

SEQ ID NO: 765870 - RNA, 15 nt, Leptospira interrogans serovar lai str. 56601
aaaaaucauauccaa

SEQ ID NO: 765871 - RNA, 13 nt, Leptospira interrogans serovar lai str. 56601
aaaaaucauaaaa

SEQ ID NO: 765872 - RNA, 15 nt, Leptospira interrogans serovar lai str. 56601
aaaaaucauaaaaca

SEQ ID NO: 765873 - RNA, 12 nt, Leptospira interrogans serovar lai str. 56601
aaaaauaucuaa

SEQ ID NO: 765874 - RNA, 12 nt, Leptospira interrogans serovar lai str. 56601
aaaaauccauga

SEQ ID NO: 765875 - RNA, 20 nt, Leptospira interrogans serovar lai str. 56601
aaaaauacaaacagucaaaa

SEQ ID NO: 765876 - RNA, 16 nt, Leptospira interrogans serovar lai str. 56601
aaaaauacuguuaauu

SEQ ID NO: 765877 - RNA, 20 nt, Leptospira interrogans serovar lai str. 56601
aaaaauagcgauacuuaaaa

SEQ ID NO: 765878 - RNA, 23 nt, Leptospira interrogans serovar lai str. 56601
aaaaauagaugugggaacucuca

SEQ ID NO: 765879 - RNA, 20 nt, Leptospira interrogans serovar lai str. 56601
aaaaauacggguaaaucgcu

SEQ ID NO: 765880 - RNA, 19 nt, Leptospira interrogans serovar lai str. 56601
aaaaaccccauuaaaaagc

SEQ ID NO: 765881 - RNA, 14 nt, Leptospira interrogans serovar lai str. 56601
aaaaaccacaaaaa

SEQ ID NO: 765882 - RNA, 18 nt, Leptospira interrogans serovar lai str. 56601
aaaaaccacaaaaacaaa

SEQ ID NO: 765883 - RNA, 18 nt, Leptospira interrogans serovar lai str. 56601
aaaaacauaaaaauuuuu

SEQ ID NO: 765884 - RNA, 22 nt, Leptospira interrogans serovar lai str. 56601
aaaaacauaaaaauuuuuuaaa

SEQ ID NO: 765885 - RNA, 15 nt, Leptospira interrogans serovar lai str. 56601
aaaaacauaagaaua

SEQ ID NO: 765886 - RNA, 22 nt, Leptospira interrogans serovar lai str. 56601
aaaaacauaagaauauuauaaa

SEQ ID NO: 765887 - RNA, 23 nt, Leptospira interrogans serovar lai str. 56601
aaaaacaucagguacuuuauuua

SEQ ID NO: 765888 - RNA, 17 nt, Leptospira interrogans serovar lai str. 56601
aaaaacagguaaaccug

SEQ ID NO: 765889 - RNA, 23 nt, Leptospira interrogans serovar lai str. 56601
aaaaacaguauuuguaaaaauga

SEQ ID NO: 765890 - RNA, 13 nt, Leptospira interrogans serovar lai str. 56601
aaaaaguuuuaca

SEQ ID NO: 765891 - RNA, 17 nt, Leptospira interrogans serovar lai str. 56601
aaaaauaauauauuuau

SEQ ID NO: 765892 - RNA, 16 nt, Leptospira interrogans serovar lai str. 56601
aaaagaguaauucuaa

SEQ ID NO: 765893 - RNA, 20 nt, Leptospira interrogans serovar lai str. 56601
aaaagauaccgggccuuuuu

SEQ ID NO: 765894 - RNA, 17 nt, Leptospira interrogans serovar lai str. 56601
aaaagauugaauuuuua

SEQ ID NO: 765895 - RNA, 22 nt, Leptospira interrogans serovar lai str. 56601
aaaagcaccuucuaaauuccaa

SEQ ID NO: 765896 - RNA, 15 nt, Leptospira interrogans serovar lai str. 56601
aaaagcacaaaacga

SEQ ID NO: 765897 - RNA, 13 nt, Leptospira interrogans serovar lai str. 56601
aaaagauuuguuu

SEQ ID NO: 765898 - RNA, 20 nt, Leptospira interrogans serovar lai str. 56601
aaaagacccgcuacuauucu

SEQ ID NO: 765899 - RNA, 18 nt, Leptospira interrogans serovar lai str. 56601
aaaagagaugguuuagaa

SEQ ID NO: 765900 - RNA, 16 nt, Leptospira interrogans serovar lai str. 56601
aaaagagccauaaaug

SEQ ID NO: 765901 - RNA, 19 nt, Leptospira interrogans serovar lai str. 56601
aaaagacuauauucuucgc

SEQ ID NO: 765902 - RNA, 21 nt, Leptospira interrogans serovar lai str. 56601
aaaagaaucgucgcucaauca

SEQ ID NO: 765903 - RNA, 20 nt, Leptospira interrogans serovar lai str. 56601
aaaagaauuucuaaaauucu

SEQ ID NO: 765904 - RNA, 14 nt, Leptospira interrogans serovar lai str. 56601
aaaagaauauuucu

SEQ ID NO: 765905 - RNA, 21 nt, Leptospira interrogans serovar lai str. 56601
aaaagaaucaucgucuaauca

SEQ ID NO: 765906 - RNA, 19 nt, Leptospira interrogans serovar lai str. 56601
aaaagaaaguugcaaagaa

SEQ ID NO: 765907 - RNA, 14 nt, Leptospira interrogans serovar lai str. 56601
aaaagaaaaucaca

SEQ ID NO: 765908 - RNA, 22 nt, Leptospira interrogans serovar lai str. 56601
aaaagaaaccuuuauagaauuc

SEQ ID NO: 765909 - RNA, 13 nt, Leptospira interrogans serovar lai str. 56601
aaaagaaaaacag

SEQ ID NO: 765910 - RNA, 14 nt, Leptospira interrogans serovar lai str. 56601
aaaagaaaaaucuu

SEQ ID NO: 765911 - RNA, 16 nt, Leptospira interrogans serovar lai str. 56601
aaaagaaauauuaaaa

SEQ ID NO: 765912 - RNA, 20 nt, Leptospira interrogans serovar lai str. 56601
aaaagaaauauuaaaaaaau

SEQ ID NO: 765913 - RNA, 19 nt, Leptospira interrogans serovar lai str. 56601
aaaagaaauuuaauacaau

SEQ ID NO: 765914 - RNA, 20 nt, Leptospira interrogans serovar lai str. 56601
aaaagaagaugcuuucucuu

SEQ ID NO: 765915 - RNA, 21 nt, Leptospira interrogans serovar lai str. 56601
aaaagaagauuuuucuuuaaa

SEQ ID NO: 765916 - RNA, 17 nt, Leptospira interrogans serovar lai str. 56601
aaaagaagaaugaaaaa

SEQ ID NO: 765917 - RNA, 18 nt, Leptospira interrogans serovar lai str. 56601
aaaagaagaaugaaaaaa

SEQ ID NO: 765918 - RNA, 17 nt, Leptospira interrogans serovar lai str. 56601
aaaacuugucccaaaau

SEQ ID NO: 765919 - RNA, 17 nt, Leptospira interrogans serovar lai str. 56601
aaaacuuugguuuguaa

SEQ ID NO: 765920 - RNA, 19 nt, Leptospira interrogans serovar lai str. 56601
aaaacuuucggaauaaaac

SEQ ID NO: 765921 - RNA, 15 nt, Leptospira interrogans serovar lai str. 56601
aaaacuuucuuaaau

SEQ ID NO: 765922 - RNA, 21 nt, Leptospira interrogans serovar lai str. 56601
aaaacuuugaccauucuuugu

SEQ ID NO: 765923 - RNA, 13 nt, Leptospira interrogans serovar lai str. 56601
aaaacuuuuuaaa

SEQ ID NO: 765924 - RNA, 14 nt, Leptospira interrogans serovar lai str. 56601
aaaacuuuuuaaaa

SEQ ID NO: 765925 - RNA, 15 nt, Leptospira interrogans serovar lai str. 56601
aaaacuuuuuauaaa

SEQ ID NO: 765926 - RNA, 23 nt, Leptospira interrogans serovar lai str. 56601
aaaacuuggguuucuuaaaucuu

SEQ ID NO: 765927 - RNA, 23 nt, Leptospira interrogans serovar lai str. 56601
aaaacuugguuggauuccuuucu

SEQ ID NO: 765928 - RNA, 17 nt, Leptospira interrogans serovar lai str. 56601
aaaacuuccauuuuuua

SEQ ID NO: 765929 - RNA, 14 nt, Leptospira interrogans serovar lai str. 56601
aaaacuucaaagaa

SEQ ID NO: 765930 - RNA, 18 nt, Leptospira interrogans serovar lai str. 56601
aaaacuucaaagaaucuu

SEQ ID NO: 765931 - RNA, 23 nt, Leptospira interrogans serovar lai str. 56601
aaaacuuaaaucccauuuuaacg

SEQ ID NO: 765932 - RNA, 16 nt, Leptospira interrogans serovar lai str. 56601
aaaacugcuucaauug

SEQ ID NO: 765933 - RNA, 14 nt, Leptospira interrogans serovar lai str. 56601
aaaacucuuuaaaa

SEQ ID NO: 765934 - RNA, 17 nt, Leptospira interrogans serovar lai str. 56601
aaaacucuuuaaaaacu

SEQ ID NO: 765935 - RNA, 22 nt, Leptospira interrogans serovar lai str. 56601
aaaacucaaaggaaaaugaaga

SEQ ID NO: 765936 - RNA, 15 nt, Leptospira interrogans serovar lai str. 56601
aaaacucaacacaac

SEQ ID NO: 765937 - RNA, 20 nt, Leptospira interrogans serovar lai str. 56601
aaaacucaacacaacgcucu

SEQ ID NO: 765938 - RNA, 21 nt, Leptospira interrogans serovar lai str. 56601
aaaacucuaccuuuauuuaaa

SEQ ID NO: 765939 - RNA, 16 nt, Leptospira interrogans serovar lai str. 56601
aaaacgguauuuaaaa

SEQ ID NO: 765940 - RNA, 19 nt, Leptospira interrogans serovar lai str. 56601
aaaacgguauuuaaaauua

SEQ ID NO: 765941 - RNA, 18 nt, Leptospira interrogans serovar lai str. 56601
aaaacgguaauuucauaa

SEQ ID NO: 765942 - RNA, 15 nt, Leptospira interrogans serovar lai str. 56601
aaaacgguaauuuua

SEQ ID NO: 765943 - RNA, 16 nt, Leptospira interrogans serovar lai str. 56601
aaaacggugauuguuu

SEQ ID NO: 765944 - RNA, 14 nt, Leptospira interrogans serovar lai str. 56601
aaaacauuucguuu

SEQ ID NO: 765945 - RNA, 14 nt, Leptospira interrogans serovar lai str. 56601
aaaaccaaaaugcu

SEQ ID NO: 765946 - RNA, 17 nt, Leptospira interrogans serovar lai str. 56601
aaaaccaaauaauaaaa

SEQ ID NO: 765947 - RNA, 15 nt, Leptospira interrogans serovar lai str. 56601
aaaaguuaauucuaa

SEQ ID NO: 765948 - RNA, 14 nt, Leptospira interrogans serovar lai str. 56601
aaaaguuagaauuu

SEQ ID NO: 765949 - RNA, 18 nt, Leptospira interrogans serovar lai str. 56601
aaaauaaaaaacaaacac

SEQ ID NO: 765950 - RNA, 13 nt, Leptospira interrogans serovar lai str. 56601
aaaauaaaaaauu

SEQ ID NO: 765951 - RNA, 12 nt, Leptospira interrogans serovar lai str. 56601
aaaauaaaaauu

SEQ ID NO: 765952 - RNA, 13 nt, Leptospira interrogans serovar lai str. 56601
aaaauaaaaauuu

SEQ ID NO: 765953 - RNA, 18 nt, Leptospira interrogans serovar lai str. 56601
aaaauaaaaauuucagau

SEQ ID NO: 765954 - RNA, 17 nt, Leptospira interrogans serovar lai str. 56601
aaaauaauaccaaguua

SEQ ID NO: 765955 - RNA, 14 nt, Leptospira interrogans serovar lai str. 56601
aaaauaauaauauu

SEQ ID NO: 765956 - RNA, 18 nt, Leptospira interrogans serovar lai str. 56601
aaaauaauaucaaaauga

SEQ ID NO: 765957 - RNA, 17 nt, Leptospira interrogans serovar lai str. 56601
aaaauaaacguggaaau

SEQ ID NO: 765958 - RNA, 16 nt, Leptospira interrogans serovar lai str. 56601
aaaauaaacuaucuaa

SEQ ID NO: 765959 - RNA, 18 nt, Leptospira interrogans serovar lai str. 56601
aaaauaagguuuuauaaa

SEQ ID NO: 765960 - RNA, 17 nt, Leptospira interrogans serovar lai str. 56601
aaaaguauaauuuaaaa

SEQ ID NO: 765961 - RNA, 16 nt, Leptospira interrogans serovar lai str. 56601
aaaaguagaaagauua

SEQ ID NO: 765962 - RNA, 16 nt, Leptospira interrogans serovar lai str. 56601
aaaaguauguuuuucu

SEQ ID NO: 765963 - RNA, 16 nt, Leptospira interrogans serovar lai str. 56601
aaaaguauauauuaaa

SEQ ID NO: 765964 - RNA, 14 nt, Leptospira interrogans serovar lai str. 56601
aaaagucaaaaaau

SEQ ID NO: 765965 - RNA, 15 nt, Leptospira interrogans serovar lai str. 56601
aaaaguaauggauuu

SEQ ID NO: 765966 - RNA, 19 nt, Leptospira interrogans serovar lai str. 56601
aaaauccauaucuacaaaa

SEQ ID NO: 765967 - RNA, 17 nt, Leptospira interrogans serovar lai str. 56601
aaaauccagaauaauaa

SEQ ID NO: 765968 - RNA, 22 nt, Leptospira interrogans serovar lai str. 56601
aaaaucauuuaaagcaaauacc

SEQ ID NO: 765969 - RNA, 17 nt, Leptospira interrogans serovar lai str. 56601
aaaaucacguucuuagc

SEQ ID NO: 765970 - RNA, 21 nt, Leptospira interrogans serovar lai str. 56601
aaaauccuaguuuuacgauuu

SEQ ID NO: 765971 - RNA, 14 nt, Leptospira interrogans serovar lai str. 56601
aaaauccucaacag

SEQ ID NO: 765972 - RNA, 21 nt, Leptospira interrogans serovar lai str. 56601
aaaauauacuuuucaaacgau

SEQ ID NO: 765973 - RNA, 21 nt, Leptospira interrogans serovar lai str. 56601
aaaauauacaauaaaucaaaa

SEQ ID NO: 765974 - RNA, 12 nt, Leptospira interrogans serovar lai str. 56601
aaaauauaauau

SEQ ID NO: 765975 - RNA, 23 nt, Leptospira interrogans serovar lai str. 56601
aaaauauaaauugggcuuguaga

SEQ ID NO: 765976 - RNA, 22 nt, Leptospira interrogans serovar lai str. 56601
aaaauauaggaacucuuacuuu

SEQ ID NO: 765977 - RNA, 21 nt, Leptospira interrogans serovar lai str. 56601
aaaauauauucagaaaacaga

SEQ ID NO: 765978 - RNA, 14 nt, Leptospira interrogans serovar lai str. 56601
aaaaucaaagauau

SEQ ID NO: 765979 - RNA, 16 nt, Leptospira interrogans serovar lai str. 56601
aaaaucaaagauauuu

SEQ ID NO: 765980 - RNA, 17 nt, Leptospira interrogans serovar lai str. 56601
aaaaucacaaaaaagau

SEQ ID NO: 765981 - RNA, 18 nt, Leptospira interrogans serovar lai str. 56601
aaaaucacaaaaaagaua

SEQ ID NO: 765982 - RNA, 22 nt, Leptospira interrogans serovar lai str. 56601
aaaaucacaaaaaagauaaaaa

SEQ ID NO: 765983 - RNA, 15 nt, Leptospira interrogans serovar lai str. 56601
aaaaucaaauauaca

SEQ ID NO: 765984 - RNA, 13 nt, Leptospira interrogans serovar lai str. 56601
aaaauacuuugaa

SEQ ID NO: 765985 - RNA, 20 nt, Leptospira interrogans serovar lai str. 56601
aaaauacuuugaacuugucc

SEQ ID NO: 765986 - RNA, 16 nt, Leptospira interrogans serovar lai str. 56601
aaaauacuuuuagaaa

SEQ ID NO: 765987 - RNA, 20 nt, Leptospira interrogans serovar lai str. 56601
aaaauacuuuuagaaaauua

SEQ ID NO: 765988 - RNA, 22 nt, Leptospira interrogans serovar lai str. 56601
aaaauacuuuuagaaaauuaga

SEQ ID NO: 765989 - RNA, 15 nt, Leptospira interrogans serovar lai str. 56601
aaaauacuuuugaaa

SEQ ID NO: 765990 - RNA, 22 nt, Leptospira interrogans serovar lai str. 56601
aaaauacuaaaagaguaauucu

SEQ ID NO: 765991 - RNA, 21 nt, Leptospira interrogans serovar lai str. 56601
aaaauacuggggacuuuauuu

SEQ ID NO: 765992 - RNA, 16 nt, Leptospira interrogans serovar lai str. 56601
aaaauacuguuaauuu

SEQ ID NO: 765993 - RNA, 16 nt, Leptospira interrogans serovar lai str. 56601
aaaauacuuuaucuuu

SEQ ID NO: 765994 - RNA, 14 nt, Leptospira interrogans serovar lai str. 56601
aaaauacuuuauuu

SEQ ID NO: 765995 - RNA, 22 nt, Leptospira interrogans serovar lai str. 56601
aaaauacggcacucaauuuuau

SEQ ID NO: 765996 - RNA, 14 nt, Leptospira interrogans serovar lai str. 56601
aaaauagaauaaau

SEQ ID NO: 765997 - RNA, 14 nt, Leptospira interrogans serovar lai str. 56601
aaaauagauccaaa

SEQ ID NO: 765998 - RNA, 16 nt, Leptospira interrogans serovar lai str. 56601
aaaauagggaaaacuc

SEQ ID NO: 765999 - RNA, 19 nt, Leptospira interrogans serovar lai str. 56601
aaaauaguauccaaaauua

SEQ ID NO: 766000 - RNA, 15 nt, Leptospira interrogans serovar lai str. 56601
aaaauaggauuuaaa

SEQ ID NO: 766001 - RNA, 14 nt, Leptospira interrogans serovar lai str. 56601
aaaauuauucugaa

SEQ ID NO: 766002 - RNA, 19 nt, Leptospira interrogans serovar lai str. 56601
aaaauuaguuuucuucuau

SEQ ID NO: 766003 - RNA, 19 nt, Leptospira interrogans serovar lai str. 56601
aaaauuauaaguagaaauu

SEQ ID NO: 766004 - RNA, 22 nt, Leptospira interrogans serovar lai str. 56601
aaaauggacugcaaaaucaguu

SEQ ID NO: 766005 - RNA, 16 nt, Leptospira interrogans serovar lai str. 56601
aaaauggaaaaaagau

SEQ ID NO: 766006 - RNA, 21 nt, Leptospira interrogans serovar lai str. 56601
aaaauuagagaaguuaaaaaa

SEQ ID NO: 766007 - RNA, 22 nt, Leptospira interrogans serovar lai str. 56601
aaaauuagagaaguuaaaaaau

SEQ ID NO: 766008 - RNA, 21 nt, Leptospira interrogans serovar lai str. 56601
aaaauuagauuuauugaaaaa

SEQ ID NO: 766009 - RNA, 13 nt, Leptospira interrogans serovar lai str. 56601
aaaaugcucaaaa

SEQ ID NO: 766010 - RNA, 17 nt, Leptospira interrogans serovar lai str. 56601
aaaaugcucaaaaauua

SEQ ID NO: 766011 - RNA, 17 nt, Leptospira interrogans serovar lai str. 56601
aaaaugcuguaacucau

SEQ ID NO: 766012 - RNA, 20 nt, Leptospira interrogans serovar lai str. 56601
aaaaugcauucaaaaaguuu

SEQ ID NO: 766013 - RNA, 21 nt, Leptospira interrogans serovar lai str. 56601
aaaaugcaaaaguuuucaaaa

SEQ ID NO: 766014 - RNA, 22 nt, Leptospira interrogans serovar lai str. 56601
aaaaucgugauuugugggaguu

SEQ ID NO: 766015 - RNA, 15 nt, Leptospira interrogans serovar lai str. 56601
aaaaugauguaggaa

SEQ ID NO: 766016 - RNA, 19 nt, Leptospira interrogans serovar lai str. 56601
aaaaucuaucucaaaaaua

SEQ ID NO: 766017 - RNA, 17 nt, Leptospira interrogans serovar lai str. 56601
aaaaucucagaaaauuu

SEQ ID NO: 766018 - RNA, 15 nt, Leptospira interrogans serovar lai str. 56601
aaaaucuaaaaaaaa

SEQ ID NO: 766019 - RNA, 15 nt, Leptospira interrogans serovar lai str. 56601
aaaaucuaaaaaaac

SEQ ID NO: 766020 - RNA, 17 nt, Leptospira interrogans serovar lai str. 56601
aaaaucuaaaaaaacaa

SEQ ID NO: 766021 - RNA, 18 nt, Leptospira interrogans serovar lai str. 56601
aaaaucuaaaaaaacaau

SEQ ID NO: 766022 - RNA, 15 nt, Leptospira interrogans serovar lai str. 56601
aaaaucuaaaaagaa

SEQ ID NO: 766023 - RNA, 15 nt, Leptospira interrogans serovar lai str. 56601
aaaaucuaaaaauaa

SEQ ID NO: 766024 - RNA, 14 nt, Leptospira interrogans serovar lai str. 56601
aaaaucguaaaaaa

SEQ ID NO: 766025 - RNA, 17 nt, Leptospira interrogans serovar lai str. 56601
aaaaucguaaaaaagau

SEQ ID NO: 766026 - RNA, 20 nt, Leptospira interrogans serovar lai str. 56601
aaaaucggcauucaauuuag

SEQ ID NO: 766027 - RNA, 17 nt, Leptospira interrogans serovar lai str. 56601
aaaaucgauuacucuuu

SEQ ID NO: 766028 - RNA, 16 nt, Leptospira interrogans serovar lai str. 56601
aaaaucgauuugaucu

SEQ ID NO: 766029 - RNA, 21 nt, Leptospira interrogans serovar lai str. 56601
aaaaucgaguuucacaaaaau

SEQ ID NO: 766030 - RNA, 11 nt, Leptospira interrogans serovar lai str. 56601
aaaauuuuaaa

SEQ ID NO: 766031 - RNA, 12 nt, Leptospira interrogans serovar lai str. 56601
aaaauuuuaaaa

SEQ ID NO: 766032 - RNA, 13 nt, Leptospira interrogans serovar lai str. 56601
aaaauuuuauaaa

SEQ ID NO: 766033 - RNA, 17 nt, Leptospira interrogans serovar lai str. 56601
aaaauuuuauaaaaauc

SEQ ID NO: 766034 - RNA, 18 nt, Leptospira interrogans serovar lai str. 56601
aaaauuuuauaaaaaucu

SEQ ID NO: 766035 - RNA, 20 nt, Leptospira interrogans serovar lai str. 56601
aaaauuuuauaauagaguua

SEQ ID NO: 766036 - RNA, 21 nt, Leptospira interrogans serovar lai str. 56601
aaaauuuuauaguagauauua

SEQ ID NO: 766037 - RNA, 13 nt, Leptospira interrogans serovar lai str. 56601
aaaauuuucauuu

SEQ ID NO: 766038 - RNA, 18 nt, Leptospira interrogans serovar lai str. 56601
aaaauuuucauuuuauac

SEQ ID NO: 766039 - RNA, 11 nt, Leptospira interrogans serovar lai str. 56601
aaaauuuuccg

SEQ ID NO: 766040 - RNA, 12 nt, Leptospira interrogans serovar lai str. 56601
aaaauuuuccuu

SEQ ID NO: 766041 - RNA, 19 nt, Leptospira interrogans serovar lai str. 56601
aaaauuuucuaaaaguagu

SEQ ID NO: 766042 - RNA, 20 nt, Leptospira interrogans serovar lai str. 56601
aaaauuuuacacgaucauuc

SEQ ID NO: 766043 - RNA, 23 nt, Leptospira interrogans serovar lai str. 56601
aaaauuuuacccugguuucaaaa

SEQ ID NO: 766044 - RNA, 13 nt, Leptospira interrogans serovar lai str. 56601
aaaauuugaaagu

SEQ ID NO: 766045 - RNA, 19 nt, Leptospira interrogans serovar lai str. 56601
aaaauuugaaaguaaaaaa

SEQ ID NO: 766046 - RNA, 20 nt, Leptospira interrogans serovar lai str. 56601
aaaauuugaaaguaaaaaag

SEQ ID NO: 766047 - RNA, 22 nt, Leptospira interrogans serovar lai str. 56601
aaaauuugaaaguaaaaaagag

SEQ ID NO: 766048 - RNA, 23 nt, Leptospira interrogans serovar lai str. 56601
aaaauuugaaaguaaaaaagagc

SEQ ID NO: 766049 - RNA, 23 nt, Leptospira interrogans serovar lai str. 56601
aaaauuugauauauuuuuaaagc

SEQ ID NO: 766050 - RNA, 22 nt, Leptospira interrogans serovar lai str. 56601
aaaauuugauccucuaaucgcu

SEQ ID NO: 766051 - RNA, 12 nt, Leptospira interrogans serovar lai str. 56601
aaaauuuagaac

SEQ ID NO: 766052 - RNA, 12 nt, Leptospira interrogans serovar lai str. 56601
aaaauuuagaau

SEQ ID NO: 766053 - RNA, 15 nt, Leptospira interrogans serovar lai str. 56601
aaaauuuaaagauuu

SEQ ID NO: 766054 - RNA, 17 nt, Leptospira interrogans serovar lai str. 56601
aaaauuuccaacgaagu

SEQ ID NO: 766055 - RNA, 23 nt, Leptospira interrogans serovar lai str. 56601
aaaauuuaacgacauuagaacua

SEQ ID NO: 766056 - RNA, 14 nt, Leptospira interrogans serovar lai str. 56601
aaaauuuaauaaca

SEQ ID NO: 766057 - RNA, 17 nt, Leptospira interrogans serovar lai str. 56601
aaaauuccgaauucuaa

SEQ ID NO: 766058 - RNA, 18 nt, Leptospira interrogans serovar lai str. 56601
aaaauuccgaauucuaaa

SEQ ID NO: 766059 - RNA, 18 nt, Leptospira interrogans serovar lai str. 56601
aaaauuccuaaaacaccu

SEQ ID NO: 766060 - RNA, 21 nt, Leptospira interrogans serovar lai str. 56601
aaaauucaaguggguuacuuu

SEQ ID NO: 766061 - RNA, 17 nt, Leptospira interrogans serovar lai str. 56601
aaaauucaacuuguaaa

SEQ ID NO: 766062 - RNA, 19 nt, Leptospira interrogans serovar lai str. 56601
aaaauuccauagcaacaau

SEQ ID NO: 766063 - RNA, 11 nt, Leptospira interrogans serovar lai str. 56601
aaacaaauuca

SEQ ID NO: 766064 - RNA, 16 nt, Leptospira interrogans serovar lai str. 56601
aaacaaauuccgaaau

SEQ ID NO: 766065 - RNA, 11 nt, Leptospira interrogans serovar lai str. 56601
aaacaaauucu

SEQ ID NO: 766066 - RNA, 16 nt, Leptospira interrogans serovar lai str. 56601
aaacaaauucuaaaau

SEQ ID NO: 766067 - RNA, 20 nt, Leptospira interrogans serovar lai str. 56601
aaacaaauucucauuuagag

SEQ ID NO: 766068 - RNA, 19 nt, Leptospira interrogans serovar lai str. 56601
aaacaaauccgaaaaugua

SEQ ID NO: 766069 - RNA, 15 nt, Leptospira interrogans serovar lai str. 56601
aaacaaauggagaau

SEQ ID NO: 766070 - RNA, 17 nt, Leptospira interrogans serovar lai str. 56601
aaacaaauggagaauua

SEQ ID NO: 766071 - RNA, 12 nt, Leptospira interrogans serovar lai str. 56601
aaacaaagagcc

SEQ ID NO: 766072 - RNA, 20 nt, Leptospira interrogans serovar lai str. 56601
aaacaaaacguaagauaggu

SEQ ID NO: 766073 - RNA, 11 nt, Leptospira interrogans serovar lai str. 56601
aaaauuuuuaa

SEQ ID NO: 766074 - RNA, 16 nt, Leptospira interrogans serovar lai str. 56601
aaaauuuuuaauaaaa

SEQ ID NO: 766075 - RNA, 17 nt, Leptospira interrogans serovar lai str. 56601
aaaauuuuuaauaaaau

SEQ ID NO: 766076 - RNA, 18 nt, Leptospira interrogans serovar lai str. 56601
aaaauuuuuaauaaaaug

SEQ ID NO: 766077 - RNA, 20 nt, Leptospira interrogans serovar lai str. 56601
aaaauuuuuacgcguaauuu

SEQ ID NO: 766078 - RNA, 11 nt, Leptospira interrogans serovar lai str. 56601
aaaauuuuucu

SEQ ID NO: 766079 - RNA, 20 nt, Leptospira interrogans serovar lai str. 56601
aaaauuuuuguguaaaauua

SEQ ID NO: 766080 - RNA, 17 nt, Leptospira interrogans serovar lai str. 56601
aaaauuuuuuagaguua

SEQ ID NO: 766081 - RNA, 22 nt, Leptospira interrogans serovar lai str. 56601
aaaauuuuuuauuuuaugaaua

SEQ ID NO: 766082 - RNA, 15 nt, Leptospira interrogans serovar lai str. 56601
aaaauuuuuuuaaac

SEQ ID NO: 766083 - RNA, 15 nt, Leptospira interrogans serovar lai str. 56601
aaaauuuuuaugacu

SEQ ID NO: 766084 - RNA, 15 nt, Leptospira interrogans serovar lai str. 56601
aaaauuuuucucccu

SEQ ID NO: 766085 - RNA, 17 nt, Leptospira interrogans serovar lai str. 56601
aaauuacgcugauuaga

SEQ ID NO: 766086 - RNA, 16 nt, Leptospira interrogans serovar lai str. 56601
aaauuacuacuuaaac

SEQ ID NO: 766087 - RNA, 23 nt, Leptospira interrogans serovar lai str. 56601
aaauuauauacaggaaagguuau

SEQ ID NO: 766088 - RNA, 17 nt, Leptospira interrogans serovar lai str. 56601
aaauucacguucaacaa

SEQ ID NO: 766089 - RNA, 17 nt, Leptospira interrogans serovar lai str. 56601
aaauucaacuuguaaaa

SEQ ID NO: 766090 - RNA, 21 nt, Leptospira interrogans serovar lai str. 56601
aaauucacuguuaaaagauuu

SEQ ID NO: 766091 - RNA, 13 nt, Leptospira interrogans serovar lai str. 56601
aaauucagauuuc

SEQ ID NO: 766092 - RNA, 15 nt, Leptospira interrogans serovar lai str. 56601
aaauucagauuucag

SEQ ID NO: 766093 - RNA, 22 nt, Leptospira interrogans serovar lai str. 56601
aaauucagauuucagcuccaaa

SEQ ID NO: 766094 - RNA, 23 nt, Leptospira interrogans serovar lai str. 56601
aaauucaggauaaacauccucaa

SEQ ID NO: 766095 - RNA, 21 nt, Leptospira interrogans serovar lai str. 56601
aaauucagaaaaaaaaagaau

SEQ ID NO: 766096 - RNA, 23 nt, Leptospira interrogans serovar lai str. 56601
aaauucaggugggaguuuagaac

SEQ ID NO: 766097 - RNA, 19 nt, Leptospira interrogans serovar lai str. 56601
aaauucgaaucauuuugua

SEQ ID NO: 766098 - RNA, 19 nt, Leptospira interrogans serovar lai str. 56601
aaauucuacaaauucuucu

SEQ ID NO: 766099 - RNA, 21 nt, Leptospira interrogans serovar lai str. 56601
aaauucuacaaauucuucuuc

SEQ ID NO: 766100 - RNA, 15 nt, Leptospira interrogans serovar lai str. 56601
aaauucuaagaucaa

SEQ ID NO: 766101 - RNA, 16 nt, Leptospira interrogans serovar lai str. 56601
aaauucuaauauaaca

SEQ ID NO: 766102 - RNA, 22 nt, Leptospira interrogans serovar lai str. 56601
aaauucuacaccuucuaaauca

SEQ ID NO: 766103 - RNA, 22 nt, Leptospira interrogans serovar lai str. 56601
aaauucuaaacuuguaagacuc

SEQ ID NO: 766104 - RNA, 14 nt, Leptospira interrogans serovar lai str. 56601
aaauucuaaaguug

SEQ ID NO: 766105 - RNA, 13 nt, Leptospira interrogans serovar lai str. 56601
aaauucuaaaaaa

SEQ ID NO: 766106 - RNA, 14 nt, Leptospira interrogans serovar lai str. 56601
aaauucuaaaaaaa

SEQ ID NO: 766107 - RNA, 15 nt, Leptospira interrogans serovar lai str. 56601
aaauucuaaaaaaau

SEQ ID NO: 766108 - RNA, 17 nt, Leptospira interrogans serovar lai str. 56601
aaauucuaaaaaaauac

SEQ ID NO: 766109 - RNA, 18 nt, Leptospira interrogans serovar lai str. 56601
aaauucuaaaaaaauacg

SEQ ID NO: 766110 - RNA, 16 nt, Leptospira interrogans serovar lai str. 56601
aaauucgucaaaacca

SEQ ID NO: 766111 - RNA, 17 nt, Leptospira interrogans serovar lai str. 56601
aaauucgucaaaaccaa

SEQ ID NO: 766112 - RNA, 21 nt, Leptospira interrogans serovar lai str. 56601
aaauucgucaaaaccaaaaca

SEQ ID NO: 766113 - RNA, 19 nt, Leptospira interrogans serovar lai str. 56601
aaauucguugagacgaaaa

SEQ ID NO: 766114 - RNA, 21 nt, Leptospira interrogans serovar lai str. 56601
aaauucuaugggaauuuuugu

SEQ ID NO: 766115 - RNA, 20 nt, Leptospira interrogans serovar lai str. 56601
aaauucuagcgucuaaaaaa

SEQ ID NO: 766116 - RNA, 20 nt, Leptospira interrogans serovar lai str. 56601
aaauucgauacugccaauga

SEQ ID NO: 766117 - RNA, 19 nt, Leptospira interrogans serovar lai str. 56601
aaauucgauagaauccaau

SEQ ID NO: 766118 - RNA, 22 nt, Leptospira interrogans serovar lai str. 56601
aaauucgccguaaaaaauccau

SEQ ID NO: 766119 - RNA, 16 nt, Leptospira interrogans serovar lai str. 56601
aaauucggaaauuuua

SEQ ID NO: 766120 - RNA, 20 nt, Leptospira interrogans serovar lai str. 56601
aaauuccuuccaaguuuuug

SEQ ID NO: 766121 - RNA, 22 nt, Leptospira interrogans serovar lai str. 56601
aaauuccuaaugcagcuucuuc

SEQ ID NO: 766122 - RNA, 11 nt, Leptospira interrogans serovar lai str. 56601
aaauuccuuac

SEQ ID NO: 766123 - RNA, 18 nt, Leptospira interrogans serovar lai str. 56601
aaauuccugccuucucuc

SEQ ID NO: 766124 - RNA, 22 nt, Leptospira interrogans serovar lai str. 56601
aaauuaacuacccuuaagauag

SEQ ID NO: 766125 - RNA, 16 nt, Leptospira interrogans serovar lai str. 56601
aaauggauggaaaaug

SEQ ID NO: 766126 - RNA, 14 nt, Leptospira interrogans serovar lai str. 56601
aaauuaaacaguaa

SEQ ID NO: 766127 - RNA, 20 nt, Leptospira interrogans serovar lai str. 56601
aaauuaaacccauuuuagaa

SEQ ID NO: 766128 - RNA, 15 nt, Leptospira interrogans serovar lai str. 56601
aaauguuauuuugua

SEQ ID NO: 766129 - RNA, 15 nt, Leptospira interrogans serovar lai str. 56601
aaauguuccaaagcc

SEQ ID NO: 766130 - RNA, 13 nt, Leptospira interrogans serovar lai str. 56601
aaauggaaaauug

SEQ ID NO: 766131 - RNA, 18 nt, Leptospira interrogans serovar lai str. 56601
aaauggaaaauugaaaca

SEQ ID NO: 766132 - RNA, 16 nt, Leptospira interrogans serovar lai str. 56601
aaauggauacuuauua

SEQ ID NO: 766133 - RNA, 19 nt, Leptospira interrogans serovar lai str. 56601
aaaugugggaacuacuaca

SEQ ID NO: 766134 - RNA, 17 nt, Leptospira interrogans serovar lai str. 56601
aaauggauaaauuuuag

SEQ ID NO: 766135 - RNA, 22 nt, Leptospira interrogans serovar lai str. 56601
aaauggauaaauuuuagaauau

SEQ ID NO: 766136 - RNA, 22 nt, Leptospira interrogans serovar lai str. 56601
aaaaagcggucuugaaaauuca

SEQ ID NO: 766137 - RNA, 18 nt, Leptospira interrogans serovar lai str. 56601
aaaaagcuguuguuauag

SEQ ID NO: 766138 - RNA, 18 nt, Leptospira interrogans serovar lai str. 56601
aaaaaggcacauuuuuca

SEQ ID NO: 766139 - RNA, 21 nt, Leptospira interrogans serovar lai str. 56601
aaauuaauucuccauuuguuu

SEQ ID NO: 766140 - RNA, 13 nt, Leptospira interrogans serovar lai str. 56601
aaauuaauuuuuc

SEQ ID NO: 766141 - RNA, 22 nt, Leptospira interrogans serovar lai str. 56601
aaaugcucgguacucuauuaua

SEQ ID NO: 766142 - RNA, 17 nt, Leptospira interrogans serovar lai str. 56601
aaaugcucaaaaauuau

SEQ ID NO: 766143 - RNA, 18 nt, Leptospira interrogans serovar lai str. 56601
aaaugcuguaacucauau

SEQ ID NO: 766144 - RNA, 21 nt, Leptospira interrogans serovar lai str. 56601
aaaugaaaaauuacuuccauu

SEQ ID NO: 766145 - RNA, 14 nt, Leptospira interrogans serovar lai str. 56601
aaaugaacaaugaa

SEQ ID NO: 766146 - RNA, 13 nt, Leptospira interrogans serovar lai str. 56601
aaaugauguagga

SEQ ID NO: 766147 - RNA, 13 nt, Leptospira interrogans serovar lai str. 56601
aaaugauguggga

SEQ ID NO: 766148 - RNA, 14 nt, Leptospira interrogans serovar lai str. 56601
aaaugauuuugccg

SEQ ID NO: 766149 - RNA, 16 nt, Leptospira interrogans serovar lai str. 56601
aaaugauuuuuuaaaa

SEQ ID NO: 766150 - RNA, 19 nt, Leptospira interrogans serovar lai str. 56601
aaaugauuuuuuaaaauaa

SEQ ID NO: 766151 - RNA, 20 nt, Leptospira interrogans serovar lai str. 56601
aaaugaaaaagaauuuuuaa

SEQ ID NO: 766152 - RNA, 15 nt, Leptospira interrogans serovar lai str. 56601
aaaugaaaaaaaaca

SEQ ID NO: 766153 - RNA, 22 nt, Leptospira interrogans serovar lai str. 56601
aaaucuucaaguuugugagagu

SEQ ID NO: 766154 - RNA, 17 nt, Leptospira interrogans serovar lai str. 56601
aaaucuuaggaacuuuu

SEQ ID NO: 766155 - RNA, 18 nt, Leptospira interrogans serovar lai str. 56601
aaaucuuaggaacuuuua

SEQ ID NO: 766156 - RNA, 18 nt, Leptospira interrogans serovar lai str. 56601
aaaucuucgguuuaauau

SEQ ID NO: 766157 - RNA, 21 nt, Leptospira interrogans serovar lai str. 56601
aaaucuucgguuuaauauacu

SEQ ID NO: 766158 - RNA, 16 nt, Leptospira interrogans serovar lai str. 56601
aaaucuuaauuuguaa

SEQ ID NO: 766159 - RNA, 21 nt, Leptospira interrogans serovar lai str. 56601
aaaucauucuuuugugacuau

SEQ ID NO: 766160 - RNA, 18 nt, Leptospira interrogans serovar lai str. 56601
aaaucauuuaaagcaaau

SEQ ID NO: 766161 - RNA, 19 nt, Leptospira interrogans serovar lai str. 56601
aaaucgauuugaucuacaa

SEQ ID NO: 766162 - RNA, 14 nt, Leptospira interrogans serovar lai str. 56601
aaaucgauuuguaa

SEQ ID NO: 766163 - RNA, 20 nt, Leptospira interrogans serovar lai str. 56601
aaaucgauuuguaaaauuca

SEQ ID NO: 766164 - RNA, 20 nt, Leptospira interrogans serovar lai str. 56601
aaaucgaugguuucaauuua

SEQ ID NO: 766165 - RNA, 23 nt, Leptospira interrogans serovar lai str. 56601
aaaucgauugaucuaucuuucca

SEQ ID NO: 766166 - RNA, 16 nt, Leptospira interrogans serovar lai str. 56601
aaaucgcgaagaaagg

SEQ ID NO: 766167 - RNA, 22 nt, Leptospira interrogans serovar lai str. 56601
aaaucgcgaagaaagguaauau

SEQ ID NO: 766168 - RNA, 14 nt, Leptospira interrogans serovar lai str. 56601
aaaucaugauucau

SEQ ID NO: 766169 - RNA, 18 nt, Leptospira interrogans serovar lai str. 56601
aaaucaucuaucuuuuca

SEQ ID NO: 766170 - RNA, 18 nt, Leptospira interrogans serovar lai str. 56601
aaaucauauuuucaaaaa

SEQ ID NO: 766171 - RNA, 16 nt, Leptospira interrogans serovar lai str. 56601
aaaucuauauuuuaca

SEQ ID NO: 766172 - RNA, 17 nt, Leptospira interrogans serovar lai str. 56601
aaaucuagguuuccuuc

SEQ ID NO: 766173 - RNA, 23 nt, Leptospira interrogans serovar lai str. 56601
aaaucuaguucaacguaagaaaa

SEQ ID NO: 766174 - RNA, 15 nt, Leptospira interrogans serovar lai str. 56601
aaaucuacaaaacuu

SEQ ID NO: 766175 - RNA, 15 nt, Leptospira interrogans serovar lai str. 56601
aaaucuaauucuucu

SEQ ID NO: 766176 - RNA, 23 nt, Leptospira interrogans serovar lai str. 56601
aaaucuaauucuucuaaugaagu

SEQ ID NO: 766177 - RNA, 15 nt, Leptospira interrogans serovar lai str. 56601
aaaucuaaauuugua

SEQ ID NO: 766178 - RNA, 16 nt, Leptospira interrogans serovar lai str. 56601
aaaucuaaauuuguaa

SEQ ID NO: 766179 - RNA, 21 nt, Leptospira interrogans serovar lai str. 56601
aaaucuaaauuuuacaauuaa

SEQ ID NO: 766180 - RNA, 13 nt, Leptospira interrogans serovar lai str. 56601
aaaucuaaaagaa

SEQ ID NO: 766181 - RNA, 21 nt, Leptospira interrogans serovar lai str. 56601
aaaucucaauucaguaaauua

SEQ ID NO: 766182 - RNA, 16 nt, Leptospira interrogans serovar lai str. 56601
aaaucuaucucaaaaa

SEQ ID NO: 766183 - RNA, 12 nt, Leptospira interrogans serovar lai str. 56601
aaaucucagaaa

SEQ ID NO: 766184 - RNA, 16 nt, Leptospira interrogans serovar lai str. 56601
aaaucucagaaaauuu

SEQ ID NO: 766185 - RNA, 18 nt, Leptospira interrogans serovar lai str. 56601
aaaucucagaaaauuuua

SEQ ID NO: 766186 - RNA, 19 nt, Leptospira interrogans serovar lai str. 56601
aaaucucagaaaauuuuac

SEQ ID NO: 766187 - RNA, 15 nt, Leptospira interrogans serovar lai str. 56601
aaauacgcuucucuu

SEQ ID NO: 766188 - RNA, 21 nt, Leptospira interrogans serovar lai str. 56601
aaauacucaauccgaauaguu

SEQ ID NO: 766189 - RNA, 15 nt, Leptospira interrogans serovar lai str. 56601
aaauaauauuauaaa

SEQ ID NO: 766190 - RNA, 14 nt, Leptospira interrogans serovar lai str. 56601
aaauacuuagaauu

SEQ ID NO: 766191 - RNA, 16 nt, Leptospira interrogans serovar lai str. 56601
aaauacuuaaaaaccc

SEQ ID NO: 766192 - RNA, 16 nt, Leptospira interrogans serovar lai str. 56601
aaauacuuaaaaugag

SEQ ID NO: 766193 - RNA, 17 nt, Leptospira interrogans serovar lai str. 56601
aaauacucuaauuuuuu

SEQ ID NO: 766194 - RNA, 23 nt, Leptospira interrogans serovar lai str. 56601
aaauacuuuaccgucaauuuuua

SEQ ID NO: 766195 - RNA, 23 nt, Leptospira interrogans serovar lai str. 56601
aaauacuuuauaauugaacauuu

SEQ ID NO: 766196 - RNA, 14 nt, Leptospira interrogans serovar lai str. 56601
aaauacuuuaucuu

SEQ ID NO: 766197 - RNA, 21 nt, Leptospira interrogans serovar lai str. 56601
aaauaaaucaugaucaaauuc

SEQ ID NO: 766198 - RNA, 12 nt, Leptospira interrogans serovar lai str. 56601
aaauaaauuuaa

SEQ ID NO: 766199 - RNA, 13 nt, Leptospira interrogans serovar lai str. 56601
aaauaaauuuaaa

SEQ ID NO: 766200 - RNA, 14 nt, Leptospira interrogans serovar lai str. 56601
aaauaaauuuauaa

SEQ ID NO: 766201 - RNA, 19 nt, Leptospira interrogans serovar lai str. 56601
aaauaaaaggaguaauucu

SEQ ID NO: 766202 - RNA, 17 nt, Leptospira interrogans serovar lai str. 56601
aaagucgcccaaacccc

SEQ ID NO: 766203 - RNA, 14 nt, Leptospira interrogans serovar lai str. 56601
aaagucgaauuuuu

SEQ ID NO: 766204 - RNA, 16 nt, Leptospira interrogans serovar lai str. 56601
aaaguccaauuuuaaa

SEQ ID NO: 766205 - RNA, 20 nt, Leptospira interrogans serovar lai str. 56601
aaauaacgauuccauuuuuu

SEQ ID NO: 766206 - RNA, 15 nt, Leptospira interrogans serovar lai str. 56601
aaauaacaauagcuu

SEQ ID NO: 766207 - RNA, 19 nt, Leptospira interrogans serovar lai str. 56601
aaauaacgauacuuaaaaa

SEQ ID NO: 766208 - RNA, 12 nt, Leptospira interrogans serovar lai str. 56601
aaauaauaaaac

SEQ ID NO: 766209 - RNA, 21 nt, Leptospira interrogans serovar lai str. 56601
aaauaauaauaugauguaaau

SEQ ID NO: 766210 - RNA, 19 nt, Leptospira interrogans serovar lai str. 56601
aaauaauaauauuuuuaug

SEQ ID NO: 766211 - RNA, 16 nt, Leptospira interrogans serovar lai str. 56601
aaauaagguuuuauaa

SEQ ID NO: 766212 - RNA, 18 nt, Leptospira interrogans serovar lai str. 56601
aaauaagcgcggauuuau

SEQ ID NO: 766213 - RNA, 16 nt, Leptospira interrogans serovar lai str. 56601
aaauaagaaucgaaaa

SEQ ID NO: 766214 - RNA, 16 nt, Leptospira interrogans serovar lai str. 56601
aaauaagaauuuucua

SEQ ID NO: 766215 - RNA, 15 nt, Leptospira interrogans serovar lai str. 56601
aaauaggauuuaaau

SEQ ID NO: 766216 - RNA, 16 nt, Leptospira interrogans serovar lai str. 56601
aaauaggauuuaaauu

SEQ ID NO: 766217 - RNA, 15 nt, Leptospira interrogans serovar lai str. 56601
aaauagggaaaacuc

SEQ ID NO: 766218 - RNA, 19 nt, Leptospira interrogans serovar lai str. 56601
aaauagggaaaacucaaca

SEQ ID NO: 766219 - RNA, 19 nt, Leptospira interrogans serovar lai str. 56601
aaauagggaaaacucauca

SEQ ID NO: 766220 - RNA, 22 nt, Leptospira interrogans serovar lai str. 56601
aaauagggaaaacucaucacaa

SEQ ID NO: 766221 - RNA, 19 nt, Leptospira interrogans serovar lai str. 56601
aaauagggaauauuccauu

SEQ ID NO: 766222 - RNA, 22 nt, Leptospira interrogans serovar lai str. 56601
aaauaguauauuaacuuucauu

SEQ ID NO: 766223 - RNA, 20 nt, Leptospira interrogans serovar lai str. 56601
aaauaguauauuuucugcuu

SEQ ID NO: 766224 - RNA, 15 nt, Leptospira interrogans serovar lai str. 56601
aaauaguauuuugug

SEQ ID NO: 766225 - RNA, 17 nt, Leptospira interrogans serovar lai str. 56601
aaauagggguuuuacca

SEQ ID NO: 766226 - RNA, 15 nt, Leptospira interrogans serovar lai str. 56601
aaauaugacgauuaa

SEQ ID NO: 766227 - RNA, 21 nt, Leptospira interrogans serovar lai str. 56601
aaauaugaauuacuacaaaag

SEQ ID NO: 766228 - RNA, 15 nt, Leptospira interrogans serovar lai str. 56601
aaauaugauuuaaaa

SEQ ID NO: 766229 - RNA, 16 nt, Leptospira interrogans serovar lai str. 56601
aaauauuauauuuuua

SEQ ID NO: 766230 - RNA, 22 nt, Leptospira interrogans serovar lai str. 56601
aaauauuauauuuuuaaaaagu

SEQ ID NO: 766231 - RNA, 19 nt, Leptospira interrogans serovar lai str. 56601
aaauauuuuuuuuaaucau

SEQ ID NO: 766232 - RNA, 14 nt, Leptospira interrogans serovar lai str. 56601
aaaucaaagauauu

SEQ ID NO: 766233 - RNA, 17 nt, Leptospira interrogans serovar lai str. 56601
aaauauugaucuaaacu

SEQ ID NO: 766234 - RNA, 22 nt, Leptospira interrogans serovar lai str. 56601
aaauauucgaucaaguaagaau

SEQ ID NO: 766235 - RNA, 14 nt, Leptospira interrogans serovar lai str. 56601
aaauauucucuaug

SEQ ID NO: 766236 - RNA, 16 nt, Leptospira interrogans serovar lai str. 56601
aaaucacgauuuuaca

SEQ ID NO: 766237 - RNA, 17 nt, Leptospira interrogans serovar lai str. 56601
aaaucauacuuuuaaaa

SEQ ID NO: 766238 - RNA, 18 nt, Leptospira interrogans serovar lai str. 56601
aaaucauacuuuuaaaaa

SEQ ID NO: 766239 - RNA, 20 nt, Leptospira interrogans serovar lai str. 56601
aaaucauacuuuuaaaaaau

SEQ ID NO: 766240 - RNA, 19 nt, Leptospira interrogans serovar lai str. 56601
aaaucaggcuuuauaaaau

SEQ ID NO: 766241 - RNA, 21 nt, Leptospira interrogans serovar lai str. 56601
aaaucaggcuuuauaaaauga

SEQ ID NO: 766242 - RNA, 16 nt, Leptospira interrogans serovar lai str. 56601
aaaucagguuuuauaa

SEQ ID NO: 766243 - RNA, 21 nt, Leptospira interrogans serovar lai str. 56601
aaaucagguuuuauaaaguga

SEQ ID NO: 766244 - RNA, 16 nt, Leptospira interrogans serovar lai str. 56601
aaaucagguuuuuaca

SEQ ID NO: 766245 - RNA, 17 nt, Leptospira interrogans serovar lai str. 56601
aaaucaauucuucuuuc

SEQ ID NO: 766246 - RNA, 12 nt, Leptospira interrogans serovar lai str. 56601
aaaucaauuuua

SEQ ID NO: 766247 - RNA, 14 nt, Leptospira interrogans serovar lai str. 56601
aaaucaauuuuaaa

SEQ ID NO: 766248 - RNA, 16 nt, Leptospira interrogans serovar lai str. 56601
aaaucaauuuucuuuc

SEQ ID NO: 766249 - RNA, 17 nt, Leptospira interrogans serovar lai str. 56601
aaaucaauuuucuuucu

SEQ ID NO: 766250 - RNA, 14 nt, Leptospira interrogans serovar lai str. 56601
aaaucaauggaaaa

SEQ ID NO: 766251 - RNA, 16 nt, Leptospira interrogans serovar lai str. 56601
aaaucaauaggaaagg

SEQ ID NO: 766252 - RNA, 14 nt, Leptospira interrogans serovar lai str. 56601
aaaucacaauuuua

SEQ ID NO: 766253 - RNA, 16 nt, Leptospira interrogans serovar lai str. 56601
aaaucacaauuuuaag

SEQ ID NO: 766254 - RNA, 17 nt, Leptospira interrogans serovar lai str. 56601
aaaucacaauuuuaaga

SEQ ID NO: 766255 - RNA, 22 nt, Leptospira interrogans serovar lai str. 56601
aaaucacaauuuuaagaacaau

SEQ ID NO: 766256 - RNA, 14 nt, Leptospira interrogans serovar lai str. 56601
aaaucacaaaaaag

SEQ ID NO: 766257 - RNA, 15 nt, Leptospira interrogans serovar lai str. 56601
aaaucacaaaaaaga

SEQ ID NO: 766258 - RNA, 23 nt, Leptospira interrogans serovar lai str. 56601
aaaucacaaaaaagauaaaaaga

SEQ ID NO: 766259 - RNA, 23 nt, Leptospira interrogans serovar lai str. 56601
aaaucaaguaccauaaauuuuga

SEQ ID NO: 766260 - RNA, 21 nt, Leptospira interrogans serovar lai str. 56601
aaaguaauuuaucuguaauuu

SEQ ID NO: 766261 - RNA, 13 nt, Leptospira interrogans serovar lai str. 56601
aaaguaauuuuga

SEQ ID NO: 766262 - RNA, 14 nt, Leptospira interrogans serovar lai str. 56601
aaaguaauuuugaa

SEQ ID NO: 766263 - RNA, 18 nt, Leptospira interrogans serovar lai str. 56601
aaaguaauggauuuuuau

SEQ ID NO: 766264 - RNA, 16 nt, Leptospira interrogans serovar lai str. 56601
aaaguaaucuuuuuaa

SEQ ID NO: 766265 - RNA, 18 nt, Leptospira interrogans serovar lai str. 56601
aaaguaaucuuuuuaaaa

SEQ ID NO: 766266 - RNA, 22 nt, Leptospira interrogans serovar lai str. 56601
aaaguaaucuuuuuaaaaguuu

SEQ ID NO: 766267 - RNA, 20 nt, Leptospira interrogans serovar lai str. 56601
aaaguaucagaaucaaagga

SEQ ID NO: 766268 - RNA, 23 nt, Leptospira interrogans serovar lai str. 56601
aaaguacgaaauuccuacaguuu

SEQ ID NO: 766269 - RNA, 17 nt, Leptospira interrogans serovar lai str. 56601
aaagucaaaggagaagg

SEQ ID NO: 766270 - RNA, 13 nt, Leptospira interrogans serovar lai str. 56601
aaaguauuuuuaa

SEQ ID NO: 766271 - RNA, 22 nt, Leptospira interrogans serovar lai str. 56601
aaaguaucuuagaauuguugaa

SEQ ID NO: 766272 - RNA, 15 nt, Leptospira interrogans serovar lai str. 56601
aaaguaugauuuuac

SEQ ID NO: 766273 - RNA, 20 nt, Leptospira interrogans serovar lai str. 56601
aaaguauccaguacuuuacg

SEQ ID NO: 766274 - RNA, 11 nt, Leptospira interrogans serovar lai str. 56601
aaagguugagu

SEQ ID NO: 766275 - RNA, 23 nt, Leptospira interrogans serovar lai str. 56601
aaagguuauguaacaaucuuauu

SEQ ID NO: 766276 - RNA, 14 nt, Leptospira interrogans serovar lai str. 56601
aaagguuaaaaauu

SEQ ID NO: 766277 - RNA, 18 nt, Leptospira interrogans serovar lai str. 56601
aaagguuucacaaauuuu

SEQ ID NO: 766278 - RNA, 16 nt, Leptospira interrogans serovar lai str. 56601
aaaguaaaacccaaua

SEQ ID NO: 766279 - RNA, 19 nt, Leptospira interrogans serovar lai str. 56601
aaagcccguucuguugagu

SEQ ID NO: 766280 - RNA, 18 nt, Leptospira interrogans serovar lai str. 56601
aaagccgcacaaaccaaa

SEQ ID NO: 766281 - RNA, 18 nt, Leptospira interrogans serovar lai str. 56601
aaagccauuucaaaaaua

SEQ ID NO: 766282 - RNA, 16 nt, Leptospira interrogans serovar lai str. 56601
aaagccccagaacaaa

SEQ ID NO: 766283 - RNA, 18 nt, Leptospira interrogans serovar lai str. 56601
aaagcguuucauugaguu

SEQ ID NO: 766284 - RNA, 17 nt, Leptospira interrogans serovar lai str. 56601
aaagcguuguguugagu

SEQ ID NO: 766285 - RNA, 15 nt, Leptospira interrogans serovar lai str. 56601
aaaggaauccaugau

SEQ ID NO: 766286 - RNA, 21 nt, Leptospira interrogans serovar lai str. 56601
aaaggaauccaugauucugaa

SEQ ID NO: 766287 - RNA, 15 nt, Leptospira interrogans serovar lai str. 56601
aaagcuuauacuuua

SEQ ID NO: 766288 - RNA, 18 nt, Leptospira interrogans serovar lai str. 56601
aaaggaagcacaagcuuc

SEQ ID NO: 766289 - RNA, 22 nt, Leptospira interrogans serovar lai str. 56601
aaaggaaggaguaucaauagaa

SEQ ID NO: 766290 - RNA, 16 nt, Leptospira interrogans serovar lai str. 56601
aaagcagcuaaaaaga

SEQ ID NO: 766291 - RNA, 20 nt, Leptospira interrogans serovar lai str. 56601
aaagcagcuaaaaagaaagu

SEQ ID NO: 766292 - RNA, 17 nt, Leptospira interrogans serovar lai str. 56601
aaagcacuguuuuaacg

SEQ ID NO: 766293 - RNA, 16 nt, Leptospira interrogans serovar lai str. 56601
aaagcaccuucuaaau

SEQ ID NO: 766294 - RNA, 14 nt, Leptospira interrogans serovar lai str. 56601
aaagauagaaguuu

SEQ ID NO: 766295 - RNA, 20 nt, Leptospira interrogans serovar lai str. 56601
aaagauauuucaauauaaaa

SEQ ID NO: 766296 - RNA, 13 nt, Leptospira interrogans serovar lai str. 56601
aaagauuuuaaaa

SEQ ID NO: 766297 - RNA, 23 nt, Leptospira interrogans serovar lai str. 56601
aaagauuuuaaaaauucaacuaa

SEQ ID NO: 766298 - RNA, 17 nt, Leptospira interrogans serovar lai str. 56601
aaagauuuguuuuauaa

SEQ ID NO: 766299 - RNA, 14 nt, Leptospira interrogans serovar lai str. 56601
aaagauuuuuaucg

SEQ ID NO: 766300 - RNA, 18 nt, Leptospira interrogans serovar lai str. 56601
aaagauuuuuaucgauuc

SEQ ID NO: 766301 - RNA, 15 nt, Leptospira interrogans serovar lai str. 56601
aaagauuuucgucuu

SEQ ID NO: 766302 - RNA, 13 nt, Leptospira interrogans serovar lai str. 56601
aaagauuuuucuu

SEQ ID NO: 766303 - RNA, 21 nt, Leptospira interrogans serovar lai str. 56601
aaagcaaacuuuuuauaaaaa

SEQ ID NO: 766304 - RNA, 17 nt, Leptospira interrogans serovar lai str. 56601
aaagacgauccuuuuuu

SEQ ID NO: 766305 - RNA, 17 nt, Leptospira interrogans serovar lai str. 56601
aaagacgauuccuaaaa

SEQ ID NO: 766306 - RNA, 12 nt, Leptospira interrogans serovar lai str. 56601
aaagaauauuau

SEQ ID NO: 766307 - RNA, 22 nt, Leptospira interrogans serovar lai str. 56601
aaagaauauuauuauauuuaaa

SEQ ID NO: 766308 - RNA, 15 nt, Leptospira interrogans serovar lai str. 56601
aaagaauaccaaaaa

SEQ ID NO: 766309 - RNA, 17 nt, Leptospira interrogans serovar lai str. 56601
aaagaauaauauuuuaa

SEQ ID NO: 766310 - RNA, 23 nt, Leptospira interrogans serovar lai str. 56601
aaacuuuguaaaucuauucuuaa

SEQ ID NO: 766311 - RNA, 16 nt, Leptospira interrogans serovar lai str. 56601
aaacuuucuuuuucuu

SEQ ID NO: 766312 - RNA, 22 nt, Leptospira interrogans serovar lai str. 56601
aaacuuucggaauaaaacccuu

SEQ ID NO: 766313 - RNA, 19 nt, Leptospira interrogans serovar lai str. 56601
aaacuuuucaucggaucua

SEQ ID NO: 766314 - RNA, 16 nt, Leptospira interrogans serovar lai str. 56601
aaacuuuuaauaaaac

SEQ ID NO: 766315 - RNA, 18 nt, Leptospira interrogans serovar lai str. 56601
aaacuuuuaauaaaacgu

SEQ ID NO: 766316 - RNA, 19 nt, Leptospira interrogans serovar lai str. 56601
aaagaaggcagcuaagaaa

SEQ ID NO: 766317 - RNA, 22 nt, Leptospira interrogans serovar lai str. 56601
aaagaaggcagcuaagaaaaaa

SEQ ID NO: 766318 - RNA, 18 nt, Leptospira interrogans serovar lai str. 56601
aaagaagggaugaaauuu

SEQ ID NO: 766319 - RNA, 20 nt, Leptospira interrogans serovar lai str. 56601
aaagaagggaugaaauuuua

SEQ ID NO: 766320 - RNA, 22 nt, Leptospira interrogans serovar lai str. 56601
aaagaagggaugaaauuuuaaa

SEQ ID NO: 766321 - RNA, 15 nt, Leptospira interrogans serovar lai str. 56601
aaagaaguuuguaga

SEQ ID NO: 766322 - RNA, 16 nt, Leptospira interrogans serovar lai str. 56601
aaagaaguuuguagau

SEQ ID NO: 766323 - RNA, 19 nt, Leptospira interrogans serovar lai str. 56601
aaagaagucugguuuauuu

SEQ ID NO: 766324 - RNA, 23 nt, Leptospira interrogans serovar lai str. 56601
aaagaagucugguuuauuuuuga

SEQ ID NO: 766325 - RNA, 21 nt, Leptospira interrogans serovar lai str. 56601
aaagagacguaaucuguggga

SEQ ID NO: 766326 - RNA, 21 nt, Leptospira interrogans serovar lai str. 56601
aaagagacauugaagaaaaaa

SEQ ID NO: 766327 - RNA, 15 nt, Leptospira interrogans serovar lai str. 56601
aaagacucacaccuu

SEQ ID NO: 766328 - RNA, 13 nt, Leptospira interrogans serovar lai str. 56601
aaagacuaaaaag

SEQ ID NO: 766329 - RNA, 14 nt, Leptospira interrogans serovar lai str. 56601
aaagagaaagaaaa

SEQ ID NO: 766330 - RNA, 17 nt, Leptospira interrogans serovar lai str. 56601
aaagagaaagaaaaaga

SEQ ID NO: 766331 - RNA, 13 nt, Leptospira interrogans serovar lai str. 56601
aaagauaaaaaag

SEQ ID NO: 766332 - RNA, 16 nt, Leptospira interrogans serovar lai str. 56601
aaagauaaaucgcaaa

SEQ ID NO: 766333 - RNA, 20 nt, Leptospira interrogans serovar lai str. 56601
aaagauaaaucgcaaauaca

SEQ ID NO: 766334 - RNA, 14 nt, Leptospira interrogans serovar lai str. 56601
aaagauaacaucuu

SEQ ID NO: 766335 - RNA, 14 nt, Leptospira interrogans serovar lai str. 56601
aaagaguuguuuau

SEQ ID NO: 766336 - RNA, 18 nt, Leptospira interrogans serovar lai str. 56601
aaagaguuguuuaucuuc

SEQ ID NO: 766337 - RNA, 23 nt, Leptospira interrogans serovar lai str. 56601
aaagagaugguuuagaaaacgga

SEQ ID NO: 766338 - RNA, 14 nt, Leptospira interrogans serovar lai str. 56601
aaacuuacauuagu

SEQ ID NO: 766339 - RNA, 20 nt, Leptospira interrogans serovar lai str. 56601
aaacuuaaguuugucuguaa

SEQ ID NO: 766340 - RNA, 15 nt, Leptospira interrogans serovar lai str. 56601
aaacuuaauaaaaau

SEQ ID NO: 766341 - RNA, 16 nt, Leptospira interrogans serovar lai str. 56601
aaacuuaauaaaaauc

SEQ ID NO: 766342 - RNA, 19 nt, Leptospira interrogans serovar lai str. 56601
aaacuuaaugagauuaaaa

SEQ ID NO: 766343 - RNA, 12 nt, Leptospira interrogans serovar lai str. 56601
aaacuucaaaaa

SEQ ID NO: 766344 - RNA, 19 nt, Leptospira interrogans serovar lai str. 56601
aaacuucucuuaaaauuua

SEQ ID NO: 766345 - RNA, 22 nt, Leptospira interrogans serovar lai str. 56601
aaacuucucuuaaaauuuagaa

SEQ ID NO: 766346 - RNA, 15 nt, Leptospira interrogans serovar lai str. 56601
aaacuuguuguacca

SEQ ID NO: 766347 - RNA, 13 nt, Leptospira interrogans serovar lai str. 56601
aaacuuguuuuag

SEQ ID NO: 766348 - RNA, 12 nt, Leptospira interrogans serovar lai str. 56601
aaacuuuaaaua

SEQ ID NO: 766349 - RNA, 16 nt, Leptospira interrogans serovar lai str. 56601
aaacuuuaaauacuuu

SEQ ID NO: 766350 - RNA, 18 nt, Leptospira interrogans serovar lai str. 56601
aaacuuucaaaauaggaa

SEQ ID NO: 766351 - RNA, 17 nt, Leptospira interrogans serovar lai str. 56601
aaacuugucccaaaauu

SEQ ID NO: 766352 - RNA, 18 nt, Leptospira interrogans serovar lai str. 56601
aaacuuuccacuuuucuc

SEQ ID NO: 766353 - RNA, 15 nt, Leptospira interrogans serovar lai str. 56601
aaacuuucuaaaaau

SEQ ID NO: 766354 - RNA, 11 nt, Leptospira interrogans serovar lai str. 56601
aaacuuucuuc

SEQ ID NO: 766355 - RNA, 13 nt, Leptospira interrogans serovar lai str. 56601
aaacuuucuucca

SEQ ID NO: 766356 - RNA, 18 nt, Leptospira interrogans serovar lai str. 56601
aaacuuucuuccaauugu

SEQ ID NO: 766357 - RNA, 15 nt, Leptospira interrogans serovar lai str. 56601
aaacuuguaagacuc

SEQ ID NO: 766358 - RNA, 21 nt, Leptospira interrogans serovar lai str. 56601
aaacuugguuggauuccuuuc

SEQ ID NO: 766359 - RNA, 14 nt, Leptospira interrogans serovar lai str. 56601
aaacugauuuaauu

SEQ ID NO: 766360 - RNA, 22 nt, Leptospira interrogans serovar lai str. 56601
aaacugauuuaauuauuuauuu

SEQ ID NO: 766361 - RNA, 22 nt, Leptospira interrogans serovar lai str. 56601
aaacugagauuugucucaaaau

SEQ ID NO: 766362 - RNA, 18 nt, Leptospira interrogans serovar lai str. 56601
aaacugcgguaauaccug

SEQ ID NO: 766363 - RNA, 13 nt, Leptospira interrogans serovar lai str. 56601
aaacuguuuaaua

SEQ ID NO: 766364 - RNA, 13 nt, Leptospira interrogans serovar lai str. 56601
aaacuuaaaucuc

SEQ ID NO: 766365 - RNA, 14 nt, Leptospira interrogans serovar lai str. 56601
aaacuuaaaucuca

SEQ ID NO: 766366 - RNA, 14 nt, Leptospira interrogans serovar lai str. 56601
aaacuuaaauucgg

SEQ ID NO: 766367 - RNA, 14 nt, Leptospira interrogans serovar lai str. 56601
aaacuguuuccagu

SEQ ID NO: 766368 - RNA, 22 nt, Leptospira interrogans serovar lai str. 56601
aaacuguuucuuacucgacaaa

SEQ ID NO: 766369 - RNA, 18 nt, Leptospira interrogans serovar lai str. 56601
aaacugucaugaugauug

SEQ ID NO: 766370 - RNA, 17 nt, Leptospira interrogans serovar lai str. 56601
aaacuauuuaauauagg

SEQ ID NO: 766371 - RNA, 16 nt, Leptospira interrogans serovar lai str. 56601
aaacucaaugcugcuc

SEQ ID NO: 766372 - RNA, 14 nt, Leptospira interrogans serovar lai str. 56601
aaacucaauguauc

SEQ ID NO: 766373 - RNA, 19 nt, Leptospira interrogans serovar lai str. 56601
aaacucaauguguugucua

SEQ ID NO: 766374 - RNA, 20 nt, Leptospira interrogans serovar lai str. 56601
aaacucaacacaacgcucuc

SEQ ID NO: 766375 - RNA, 16 nt, Leptospira interrogans serovar lai str. 56601
aaacucaacacaacgg

SEQ ID NO: 766376 - RNA, 17 nt, Leptospira interrogans serovar lai str. 56601
aaacucaaagaaauuuu

SEQ ID NO: 766377 - RNA, 15 nt, Leptospira interrogans serovar lai str. 56601
aaacucaaagaauuu

SEQ ID NO: 766378 - RNA, 22 nt, Leptospira interrogans serovar lai str. 56601
aaacucaaaggaaaaugaagaa

SEQ ID NO: 766379 - RNA, 18 nt, Leptospira interrogans serovar lai str. 56601
aaacucaaaucuacaaaa

SEQ ID NO: 766380 - RNA, 16 nt, Leptospira interrogans serovar lai str. 56601
aaacuauuauacuuua

SEQ ID NO: 766381 - RNA, 12 nt, Leptospira interrogans serovar lai str. 56601
aaacuaucacaa

SEQ ID NO: 766382 - RNA, 22 nt, Leptospira interrogans serovar lai str. 56601
aaacuaucuauuagaacaucaa

SEQ ID NO: 766383 - RNA, 18 nt, Leptospira interrogans serovar lai str. 56601
aaacuauacuuucaaaaa

SEQ ID NO: 766384 - RNA, 20 nt, Leptospira interrogans serovar lai str. 56601
aaacuauacuuucaaaaaau

SEQ ID NO: 766385 - RNA, 18 nt, Leptospira interrogans serovar lai str. 56601
aaacuauagagaaaucca

SEQ ID NO: 766386 - RNA, 17 nt, Leptospira interrogans serovar lai str. 56601
aaacuacuaaaucucaa

SEQ ID NO: 766387 - RNA, 21 nt, Leptospira interrogans serovar lai str. 56601
aaacuaccucaauuuuccauu

SEQ ID NO: 766388 - RNA, 22 nt, Leptospira interrogans serovar lai str. 56601
aaacuaccacaaaucuaaauuu

SEQ ID NO: 766389 - RNA, 16 nt, Leptospira interrogans serovar lai str. 56601
aaacuaggaacuccuu

SEQ ID NO: 766390 - RNA, 23 nt, Leptospira interrogans serovar lai str. 56601
aaacuagggaaaguuuuuuaaaa

SEQ ID NO: 766391 - RNA, 20 nt, Leptospira interrogans serovar lai str. 56601
aaacuaauuuguaggaauua

SEQ ID NO: 766392 - RNA, 12 nt, Leptospira interrogans serovar lai str. 56601
aaacuaauaauu

SEQ ID NO: 766393 - RNA, 17 nt, Leptospira interrogans serovar lai str. 56601
aaacucuauuagaauug

SEQ ID NO: 766394 - RNA, 14 nt, Leptospira interrogans serovar lai str. 56601
aaacucuaaauuca

SEQ ID NO: 766395 - RNA, 17 nt, Leptospira interrogans serovar lai str. 56601
aaacucuuuauuuuuaa

SEQ ID NO: 766396 - RNA, 22 nt, Leptospira interrogans serovar lai str. 56601
aaacucuuaaucugcugaauuu

SEQ ID NO: 766397 - RNA, 20 nt, Leptospira interrogans serovar lai str. 56601
aaacucuuuuucuucugcug

SEQ ID NO: 766398 - RNA, 14 nt, Leptospira interrogans serovar lai str. 56601
aaacucauuuuaaa

SEQ ID NO: 766399 - RNA, 15 nt, Leptospira interrogans serovar lai str. 56601
aaacucauuuuaaac

SEQ ID NO: 766400 - RNA, 14 nt, Leptospira interrogans serovar lai str. 56601
aaacucauuuuucu

SEQ ID NO: 766401 - RNA, 16 nt, Leptospira interrogans serovar lai str. 56601
aaacucaguaaaacgc

SEQ ID NO: 766402 - RNA, 20 nt, Leptospira interrogans serovar lai str. 56601
aaacucaguaaaacgcucuc

SEQ ID NO: 766403 - RNA, 15 nt, Leptospira interrogans serovar lai str. 56601
aaacucaguaaacuc

SEQ ID NO: 766404 - RNA, 15 nt, Leptospira interrogans serovar lai str. 56601
aaacucauaaaauaa

SEQ ID NO: 766405 - RNA, 16 nt, Leptospira interrogans serovar lai str. 56601
aaacucauaaaauaac

SEQ ID NO: 766406 - RNA, 19 nt, Leptospira interrogans serovar lai str. 56601
aaacucacgcuaaaauaaa

SEQ ID NO: 766407 - RNA, 13 nt, Leptospira interrogans serovar lai str. 56601
aaacgauuuaaaa

SEQ ID NO: 766408 - RNA, 15 nt, Leptospira interrogans serovar lai str. 56601
aaacgauuuuucaaa

SEQ ID NO: 766409 - RNA, 18 nt, Leptospira interrogans serovar lai str. 56601
aaacgauauuuuuuaaaa

SEQ ID NO: 766410 - RNA, 17 nt, Leptospira interrogans serovar lai str. 56601
aaacgaucagaaaaaca

SEQ ID NO: 766411 - RNA, 22 nt, Leptospira interrogans serovar lai str. 56601
aaacgauucucguucaacuuuc

SEQ ID NO: 766412 - RNA, 16 nt, Leptospira interrogans serovar lai str. 56601
aaacgauugauugaag

SEQ ID NO: 766413 - RNA, 22 nt, Leptospira interrogans serovar lai str. 56601
aaacgauuaugauuuuuuugaa

SEQ ID NO: 766414 - RNA, 18 nt, Leptospira interrogans serovar lai str. 56601
aaacgauuauuuuuuaaa

SEQ ID NO: 766415 - RNA, 21 nt, Leptospira interrogans serovar lai str. 56601
aaacgagauagcguaauacga

SEQ ID NO: 766416 - RNA, 23 nt, Leptospira interrogans serovar lai str. 56601
aaaccuuuccccccacccaaaaa

SEQ ID NO: 766417 - RNA, 12 nt, Leptospira interrogans serovar lai str. 56601
aaaccuuuucua

SEQ ID NO: 766418 - RNA, 19 nt, Leptospira interrogans serovar lai str. 56601
aaaccuucuuuaagauauu

SEQ ID NO: 766419 - RNA, 16 nt, Leptospira interrogans serovar lai str. 56601
aaaccuuuauagaauu

SEQ ID NO: 766420 - RNA, 16 nt, Leptospira interrogans serovar lai str. 56601
aaaccugauuuuucca

SEQ ID NO: 766421 - RNA, 16 nt, Leptospira interrogans serovar lai str. 56601
aaacgcgauccguaga

SEQ ID NO: 766422 - RNA, 18 nt, Leptospira interrogans serovar lai str. 56601
aaacgggcccaaauaaaa

SEQ ID NO: 766423 - RNA, 21 nt, Leptospira interrogans serovar lai str. 56601
aaacgggcccaaauaaaaaca

SEQ ID NO: 766424 - RNA, 14 nt, Leptospira interrogans serovar lai str. 56601
aaacggaagaaaau

SEQ ID NO: 766425 - RNA, 16 nt, Leptospira interrogans serovar lai str. 56601
aaacggaagaaaauua

SEQ ID NO: 766426 - RNA, 14 nt, Leptospira interrogans serovar lai str. 56601
aaacguagauaauu

SEQ ID NO: 766427 - RNA, 14 nt, Leptospira interrogans serovar lai str. 56601
aaacgguuuucuaa

SEQ ID NO: 766428 - RNA, 15 nt, Leptospira interrogans serovar lai str. 56601
aaacguauaaaaaca

SEQ ID NO: 766429 - RNA, 18 nt, Leptospira interrogans serovar lai str. 56601
aaacgucacuuuacaaau

SEQ ID NO: 766430 - RNA, 16 nt, Leptospira interrogans serovar lai str. 56601
aaacggugcauuuaaa

SEQ ID NO: 766431 - RNA, 20 nt, Leptospira interrogans serovar lai str. 56601
aaacggugcauuuaaaaaau

SEQ ID NO: 766432 - RNA, 17 nt, Leptospira interrogans serovar lai str. 56601
aaacgguuuuaguaaaa

SEQ ID NO: 766433 - RNA, 22 nt, Leptospira interrogans serovar lai str. 56601
aaacgguuuuaguaaaauuuaa

SEQ ID NO: 766434 - RNA, 23 nt, Leptospira interrogans serovar lai str. 56601
aaacguaagcuugauuuucgauu

SEQ ID NO: 766435 - RNA, 16 nt, Leptospira interrogans serovar lai str. 56601
aaacgguaaaaggagc

SEQ ID NO: 766436 - RNA, 20 nt, Leptospira interrogans serovar lai str. 56601
aaacgguaauuucauaaaau

SEQ ID NO: 766437 - RNA, 18 nt, Leptospira interrogans serovar lai str. 56601
aaacgguauuuaaaauua

SEQ ID NO: 766438 - RNA, 12 nt, Leptospira interrogans serovar lai str. 56601
aaacguuuucaa

SEQ ID NO: 766439 - RNA, 17 nt, Leptospira interrogans serovar lai str. 56601
aaacguuuucaaaaaau

SEQ ID NO: 766440 - RNA, 12 nt, Leptospira interrogans serovar lai str. 56601
aaacuaaaaaaa

SEQ ID NO: 766441 - RNA, 21 nt, Leptospira interrogans serovar lai str. 56601
aaacguggauuuuauguaaga

SEQ ID NO: 766442 - RNA, 13 nt, Leptospira interrogans serovar lai str. 56601
aagcugaacaaac

SEQ ID NO: 766443 - RNA, 22 nt, Leptospira interrogans serovar lai str. 56601
aagcuuuuaguuguacaaaaau

SEQ ID NO: 766444 - RNA, 19 nt, Leptospira interrogans serovar lai str. 56601
aaggagaacucauucaagu

SEQ ID NO: 766445 - RNA, 17 nt, Leptospira interrogans serovar lai str. 56601
aagcuuuggauuuugau

SEQ ID NO: 766446 - RNA, 16 nt, Leptospira interrogans serovar lai str. 56601
aaggaaaguucuauaa

SEQ ID NO: 766447 - RNA, 22 nt, Leptospira interrogans serovar lai str. 56601
aaggagcucaucauucugaaaa

SEQ ID NO: 766448 - RNA, 18 nt, Leptospira interrogans serovar lai str. 56601
aaggauaacccucaucag

SEQ ID NO: 766449 - RNA, 20 nt, Leptospira interrogans serovar lai str. 56601
aagcgcggucgcgagccauu

SEQ ID NO: 766450 - RNA, 13 nt, Leptospira interrogans serovar lai str. 56601
aagcguuuucuua

SEQ ID NO: 766451 - RNA, 20 nt, Leptospira interrogans serovar lai str. 56601
aagcguuuuguuaauuguug

SEQ ID NO: 766452 - RNA, 14 nt, Leptospira interrogans serovar lai str. 56601
aagcguuucguucu

SEQ ID NO: 766453 - RNA, 18 nt, Leptospira interrogans serovar lai str. 56601
aagcuccuccaaccagag

SEQ ID NO: 766454 - RNA, 18 nt, Leptospira interrogans serovar lai str. 56601
aagcugaaaauuuucccu

SEQ ID NO: 766455 - RNA, 19 nt, Leptospira interrogans serovar lai str. 56601
aagcugaaaauuuucccua

SEQ ID NO: 766456 - RNA, 15 nt, Leptospira interrogans serovar lai str. 56601
aagcugaacuuaaaa

SEQ ID NO: 766457 - RNA, 21 nt, Leptospira interrogans serovar lai str. 56601
aagcugaagacuuccacgaau

SEQ ID NO: 766458 - RNA, 16 nt, Leptospira interrogans serovar lai str. 56601
aagcucuccaucuuuu

SEQ ID NO: 766459 - RNA, 17 nt, Leptospira interrogans serovar lai str. 56601
aagcucgaauaaaaaca

SEQ ID NO: 766460 - RNA, 14 nt, Leptospira interrogans serovar lai str. 56601
aagggugaauuuuu

SEQ ID NO: 766461 - RNA, 16 nt, Leptospira interrogans serovar lai str. 56601
aagggaguuuguaaag

SEQ ID NO: 766462 - RNA, 19 nt, Leptospira interrogans serovar lai str. 56601
aaggcgguaaaacaaaaaa

SEQ ID NO: 766463 - RNA, 17 nt, Leptospira interrogans serovar lai str. 56601
aaggugaucuuagaaaa

SEQ ID NO: 766464 - RNA, 15 nt, Leptospira interrogans serovar lai str. 56601
aaggucugaaggaau

SEQ ID NO: 766465 - RNA, 13 nt, Leptospira interrogans serovar lai str. 56601
aaggucucaacaa

SEQ ID NO: 766466 - RNA, 15 nt, Leptospira interrogans serovar lai str. 56601
aaggucucaacaacu

SEQ ID NO: 766467 - RNA, 18 nt, Leptospira interrogans serovar lai str. 56601
aagguaauuuauauuaca

SEQ ID NO: 766468 - RNA, 16 nt, Leptospira interrogans serovar lai str. 56601
aaggugcaugaaaaua

SEQ ID NO: 766469 - RNA, 18 nt, Leptospira interrogans serovar lai str. 56601
aaggugcaugaaaauaau

SEQ ID NO: 766470 - RNA, 15 nt, Leptospira interrogans serovar lai str. 56601
aagguuaaaaauuua

SEQ ID NO: 766471 - RNA, 18 nt, Leptospira interrogans serovar lai str. 56601
aagguguuuauaaaaacc

SEQ ID NO: 766472 - RNA, 21 nt, Leptospira interrogans serovar lai str. 56601
aagguuggaaucuaaacucua

SEQ ID NO: 766473 - RNA, 22 nt, Leptospira interrogans serovar lai str. 56601
aagcauucgcgacgauugauca

SEQ ID NO: 766474 - RNA, 12 nt, Leptospira interrogans serovar lai str. 56601
aagccaaaacca

SEQ ID NO: 766475 - RNA, 13 nt, Leptospira interrogans serovar lai str. 56601
aagccaaaaccaa

SEQ ID NO: 766476 - RNA, 13 nt, Leptospira interrogans serovar lai str. 56601
aagccagaauuuu

SEQ ID NO: 766477 - RNA, 16 nt, Leptospira interrogans serovar lai str. 56601
aagccagaauuuugaa

SEQ ID NO: 766478 - RNA, 15 nt, Leptospira interrogans serovar lai str. 56601
aagccauuucaaaaa

SEQ ID NO: 766479 - RNA, 20 nt, Leptospira interrogans serovar lai str. 56601
aagcccuauauccggaaaca

SEQ ID NO: 766480 - RNA, 13 nt, Leptospira interrogans serovar lai str. 56601
aagcaguuuuguu

SEQ ID NO: 766481 - RNA, 21 nt, Leptospira interrogans serovar lai str. 56601
aagcagaagcuuuauuaaauu

SEQ ID NO: 766482 - RNA, 15 nt, Leptospira interrogans serovar lai str. 56601
aagcagcaaagaagg

SEQ ID NO: 766483 - RNA, 18 nt, Leptospira interrogans serovar lai str. 56601
aagcagcuaaaaagaaag

SEQ ID NO: 766484 - RNA, 15 nt, Leptospira interrogans serovar lai str. 56601
aagcaauucuaagac

SEQ ID NO: 766485 - RNA, 15 nt, Leptospira interrogans serovar lai str. 56601
aagcaauccauucaa

SEQ ID NO: 766486 - RNA, 15 nt, Leptospira interrogans serovar lai str. 56601
aagcaaucuguuuag

SEQ ID NO: 766487 - RNA, 23 nt, Leptospira interrogans serovar lai str. 56601
aagauuuguugaaaagugaguuu

SEQ ID NO: 766488 - RNA, 14 nt, Leptospira interrogans serovar lai str. 56601
aagauuuguuuuau

SEQ ID NO: 766489 - RNA, 18 nt, Leptospira interrogans serovar lai str. 56601
aagauuuuaaaaauucaa

SEQ ID NO: 766490 - RNA, 15 nt, Leptospira interrogans serovar lai str. 56601
aagauuuuagaauca

SEQ ID NO: 766491 - RNA, 21 nt, Leptospira interrogans serovar lai str. 56601
aagauuggacgauguuguuua

SEQ ID NO: 766492 - RNA, 20 nt, Leptospira interrogans serovar lai str. 56601
aagauuucguucggaaaaaa

SEQ ID NO: 766493 - RNA, 22 nt, Leptospira interrogans serovar lai str. 56601
aagauuucguucggaaaaaaua

SEQ ID NO: 766494 - RNA, 23 nt, Leptospira interrogans serovar lai str. 56601
aagauuucguucggaaaaaauau

SEQ ID NO: 766495 - RNA, 22 nt, Leptospira interrogans serovar lai str. 56601
aagauuucguucggaaaaagua

SEQ ID NO: 766496 - RNA, 18 nt, Leptospira interrogans serovar lai str. 56601
aagauuuccuaauaacuu

SEQ ID NO: 766497 - RNA, 17 nt, Leptospira interrogans serovar lai str. 56601
aagcaaaguuucuuaua

SEQ ID NO: 766498 - RNA, 20 nt, Leptospira interrogans serovar lai str. 56601
aagaugauauguuauauaaa

SEQ ID NO: 766499 - RNA, 21 nt, Leptospira interrogans serovar lai str. 56601
aagaugauuuuguuaauuaaa

SEQ ID NO: 766500 - RNA, 22 nt, Leptospira interrogans serovar lai str. 56601
aagaugauuuuguuaauuaaac

SEQ ID NO: 766501 - RNA, 16 nt, Leptospira interrogans serovar lai str. 56601
aagaauauuauuauau

SEQ ID NO: 766502 - RNA, 20 nt, Leptospira interrogans serovar lai str. 56601
aagaauguauaccaauaauu

SEQ ID NO: 766503 - RNA, 13 nt, Leptospira interrogans serovar lai str. 56601
aagaauccgaaaa

SEQ ID NO: 766504 - RNA, 11 nt, Leptospira interrogans serovar lai str. 56601
aagaucuauuc

SEQ ID NO: 766505 - RNA, 17 nt, Leptospira interrogans serovar lai str. 56601
aagaauuaucauguaaa

SEQ ID NO: 766506 - RNA, 18 nt, Leptospira interrogans serovar lai str. 56601
aagaauuaucguguaaaa

SEQ ID NO: 766507 - RNA, 21 nt, Leptospira interrogans serovar lai str. 56601
aagaugcucggcuucuucaau

SEQ ID NO: 766508 - RNA, 17 nt, Leptospira interrogans serovar lai str. 56601
aagaugcuuucucuuuu

SEQ ID NO: 766509 - RNA, 20 nt, Leptospira interrogans serovar lai str. 56601
aagaugggcacugaauaaaa

SEQ ID NO: 766510 - RNA, 20 nt, Leptospira interrogans serovar lai str. 56601
aagauuaucuucuaauuaaa

SEQ ID NO: 766511 - RNA, 14 nt, Leptospira interrogans serovar lai str. 56601
aagauuagaaaaac

SEQ ID NO: 766512 - RNA, 14 nt, Leptospira interrogans serovar lai str. 56601
aagauuaaucuggu

SEQ ID NO: 766513 - RNA, 13 nt, Leptospira interrogans serovar lai str. 56601
aagauuaaagauu

SEQ ID NO: 766514 - RNA, 13 nt, Leptospira interrogans serovar lai str. 56601
aagauuaacaauc

SEQ ID NO: 766515 - RNA, 18 nt, Leptospira interrogans serovar lai str. 56601
aagauuaaccguagauuu

SEQ ID NO: 766516 - RNA, 15 nt, Leptospira interrogans serovar lai str. 56601
aagauucuauuuuga

SEQ ID NO: 766517 - RNA, 16 nt, Leptospira interrogans serovar lai str. 56601
aagauucuauuuugag

SEQ ID NO: 766518 - RNA, 14 nt, Leptospira interrogans serovar lai str. 56601
aagauugaaugaaa

SEQ ID NO: 766519 - RNA, 16 nt, Leptospira interrogans serovar lai str. 56601
aagauugaauuuuuau

SEQ ID NO: 766520 - RNA, 22 nt, Leptospira interrogans serovar lai str. 56601
aaaaauacgauucgaaagauuu

SEQ ID NO: 766521 - RNA, 14 nt, Leptospira interrogans serovar lai str. 56601
aaaaauacuaaauu

SEQ ID NO: 766522 - RNA, 18 nt, Leptospira interrogans serovar lai str. 56601
aaaaauacauaaaaaaau

SEQ ID NO: 766523 - RNA, 14 nt, Leptospira interrogans serovar lai str. 56601
aauaacgauacuua

SEQ ID NO: 766524 - RNA, 14 nt, Leptospira interrogans serovar lai str. 56601
aaaaauauuucaaa

SEQ ID NO: 766525 - RNA, 21 nt, Leptospira interrogans serovar lai str. 56601
aaaaauauuggguauuuauua

SEQ ID NO: 766526 - RNA, 13 nt, Leptospira interrogans serovar lai str. 56601
aaaaauauuaaaa

SEQ ID NO: 766527 - RNA, 14 nt, Leptospira interrogans serovar lai str. 56601
aaaaauauuaaaac

SEQ ID NO: 766528 - RNA, 15 nt, Leptospira interrogans serovar lai str. 56601
aaaaauauuaaaaca

SEQ ID NO: 766529 - RNA, 18 nt, Leptospira interrogans serovar lai str. 56601
aaaaauauuaaaacacuu

SEQ ID NO: 766530 - RNA, 16 nt, Leptospira interrogans serovar lai str. 56601
aaaaauaucuuagaau

SEQ ID NO: 766531 - RNA, 17 nt, Leptospira interrogans serovar lai str. 56601
aaaaauaucuuagaaua

SEQ ID NO: 766532 - RNA, 19 nt, Leptospira interrogans serovar lai str. 56601
aaaaauaucuuagaauaau

SEQ ID NO: 766533 - RNA, 21 nt, Leptospira interrogans serovar lai str. 56601
aaaaauaucuuagaauaauag

SEQ ID NO: 766534 - RNA, 12 nt, Leptospira interrogans serovar lai str. 56601
aaaaauaugauu

SEQ ID NO: 766535 - RNA, 16 nt, Leptospira interrogans serovar lai str. 56601
aaaaauaugauuuaaa

SEQ ID NO: 766536 - RNA, 24 nt, Leptospira interrogans serovar lai str. 56601
aaaaauaugauuuaaaaucacaaa

SEQ ID NO: 766537 - RNA, 22 nt, Leptospira interrogans serovar lai str. 56601
aaaaaucaggcuuuauaaaaug

SEQ ID NO: 766538 - RNA, 18 nt, Leptospira interrogans serovar lai str. 56601
aaaaaucagguuuuauaa

SEQ ID NO: 766539 - RNA, 22 nt, Leptospira interrogans serovar lai str. 56601
aaaaaucaccguccaaucaaau

SEQ ID NO: 766540 - RNA, 17 nt, Leptospira interrogans serovar lai str. 56601
aauaauaugaauucauu

SEQ ID NO: 766541 - RNA, 19 nt, Leptospira interrogans serovar lai str. 56601
aauaauaugauguaaauuu

SEQ ID NO: 766542 - RNA, 16 nt, Leptospira interrogans serovar lai str. 56601
aauaauauauuuauaa

SEQ ID NO: 766543 - RNA, 21 nt, Leptospira interrogans serovar lai str. 56601
aauaauauggguauugguuug

SEQ ID NO: 766544 - RNA, 14 nt, Leptospira interrogans serovar lai str. 56601
aauaauauuuuuau

SEQ ID NO: 766545 - RNA, 14 nt, Leptospira interrogans serovar lai str. 56601
aauaauauacuaaa

SEQ ID NO: 766546 - RNA, 16 nt, Leptospira interrogans serovar lai str. 56601
aauaauauacuaaauu

SEQ ID NO: 766547 - RNA, 14 nt, Leptospira interrogans serovar lai str. 56601
aaaaauacuuuacg

SEQ ID NO: 766548 - RNA, 15 nt, Leptospira interrogans serovar lai str. 56601
aauaaucgauuuuac

SEQ ID NO: 766549 - RNA, 13 nt, Leptospira interrogans serovar lai str. 56601
aauaaucuaagac

SEQ ID NO: 766550 - RNA, 14 nt, Leptospira interrogans serovar lai str. 56601
aauaauguuuuuag

SEQ ID NO: 766551 - RNA, 15 nt, Leptospira interrogans serovar lai str. 56601
aauaauguggaacuc

SEQ ID NO: 766552 - RNA, 15 nt, Leptospira interrogans serovar lai str. 56601
aauaaucuuaaauau

SEQ ID NO: 766553 - RNA, 14 nt, Leptospira interrogans serovar lai str. 56601
aauaauuagcucuu

SEQ ID NO: 766554 - RNA, 22 nt, Leptospira interrogans serovar lai str. 56601
aauaauuagcucuuguuaaaau

SEQ ID NO: 766555 - RNA, 23 nt, Leptospira interrogans serovar lai str. 56601
aauaauuagcucuuguuaaaaua

SEQ ID NO: 766556 - RNA, 15 nt, Leptospira interrogans serovar lai str. 56601
aauaauuagaaaaau

SEQ ID NO: 766557 - RNA, 16 nt, Leptospira interrogans serovar lai str. 56601
aauaauuagaaaaaua

SEQ ID NO: 766558 - RNA, 17 nt, Leptospira interrogans serovar lai str. 56601
aauaauuagaaaaauau

SEQ ID NO: 766559 - RNA, 19 nt, Leptospira interrogans serovar lai str. 56601
aauaauuagaaaaauauuu

SEQ ID NO: 766560 - RNA, 14 nt, Leptospira interrogans serovar lai str. 56601
aauaauucaaaauu

SEQ ID NO: 766561 - RNA, 15 nt, Leptospira interrogans serovar lai str. 56601
aauaauucaaaauuu

SEQ ID NO: 766562 - RNA, 19 nt, Leptospira interrogans serovar lai str. 56601
aauacaaaguuuguaguaa

SEQ ID NO: 766563 - RNA, 21 nt, Leptospira interrogans serovar lai str. 56601
aauacaaaguuuguaguaacu

SEQ ID NO: 766564 - RNA, 17 nt, Leptospira interrogans serovar lai str. 56601
aauacaaacagucaaaa

SEQ ID NO: 766565 - RNA, 12 nt, Leptospira interrogans serovar lai str. 56601
aauaauucuacg

SEQ ID NO: 766566 - RNA, 14 nt, Leptospira interrogans serovar lai str. 56601
aauaauucuauuuu

SEQ ID NO: 766567 - RNA, 13 nt, Leptospira interrogans serovar lai str. 56601
aauacaauaaaaa

SEQ ID NO: 766568 - RNA, 18 nt, Leptospira interrogans serovar lai str. 56601
aauacaauaaaaacagau

SEQ ID NO: 766569 - RNA, 18 nt, Leptospira interrogans serovar lai str. 56601
aauacaauugauuuaaaa

SEQ ID NO: 766570 - RNA, 20 nt, Leptospira interrogans serovar lai str. 56601
aauacaggcgguuuaaaagc

SEQ ID NO: 766571 - RNA, 19 nt, Leptospira interrogans serovar lai str. 56601
aauacuugccguuacauaa

SEQ ID NO: 766572 - RNA, 11 nt, Leptospira interrogans serovar lai str. 56601
aauacuuuacc

SEQ ID NO: 766573 - RNA, 23 nt, Leptospira interrogans serovar lai str. 56601
aauacuuuaccgucaauuuuuag

SEQ ID NO: 766574 - RNA, 23 nt, Leptospira interrogans serovar lai str. 56601
aauacuuuuagaaaauuagaaag

SEQ ID NO: 766575 - RNA, 13 nt, Leptospira interrogans serovar lai str. 56601
aauacuuuucuuc

SEQ ID NO: 766576 - RNA, 16 nt, Leptospira interrogans serovar lai str. 56601
aauacuuuucuuccca

SEQ ID NO: 766577 - RNA, 18 nt, Leptospira interrogans serovar lai str. 56601
aauacuuuugaaauagau

SEQ ID NO: 766578 - RNA, 14 nt, Leptospira interrogans serovar lai str. 56601
aauagaaaagcaua

SEQ ID NO: 766579 - RNA, 15 nt, Leptospira interrogans serovar lai str. 56601
aauagaggaugaauc

SEQ ID NO: 766580 - RNA, 20 nt, Leptospira interrogans serovar lai str. 56601
aauagaguaccauaaauuuu

SEQ ID NO: 766581 - RNA, 19 nt, Leptospira interrogans serovar lai str. 56601
aauagagcuuuguaauaaa

SEQ ID NO: 766582 - RNA, 21 nt, Leptospira interrogans serovar lai str. 56601
aauagagcuuuguaauaaaaa

SEQ ID NO: 766583 - RNA, 11 nt, Leptospira interrogans serovar lai str. 56601
aauagaaauac

SEQ ID NO: 766584 - RNA, 16 nt, Leptospira interrogans serovar lai str. 56601
aauagaaaccuuucau

SEQ ID NO: 766585 - RNA, 13 nt, Leptospira interrogans serovar lai str. 56601
aauagaaagacuu

SEQ ID NO: 766586 - RNA, 18 nt, Leptospira interrogans serovar lai str. 56601
aauagaaagacuuuucau

SEQ ID NO: 766587 - RNA, 19 nt, Leptospira interrogans serovar lai str. 56601
aauagaaagacuuuucauc

SEQ ID NO: 766588 - RNA, 20 nt, Leptospira interrogans serovar lai str. 56601
aauagaaccuuuugaaguag

SEQ ID NO: 766589 - RNA, 15 nt, Leptospira interrogans serovar lai str. 56601
aauacucuaauuuuu

SEQ ID NO: 766590 - RNA, 13 nt, Leptospira interrogans serovar lai str. 56601
aauacuguuaauu

SEQ ID NO: 766591 - RNA, 18 nt, Leptospira interrogans serovar lai str. 56601
aauacuguuaauuuuuau

SEQ ID NO: 766592 - RNA, 23 nt, Leptospira interrogans serovar lai str. 56601
aauacuggggacuuuauuuuaua

SEQ ID NO: 766593 - RNA, 18 nt, Leptospira interrogans serovar lai str. 56601
aauacuuagaauuuuuuc

SEQ ID NO: 766594 - RNA, 16 nt, Leptospira interrogans serovar lai str. 56601
aauacuuaaaaacccc

SEQ ID NO: 766595 - RNA, 23 nt, Leptospira interrogans serovar lai str. 56601
aauacgaauuuaacuaguuccuu

SEQ ID NO: 766596 - RNA, 19 nt, Leptospira interrogans serovar lai str. 56601
aauaccgcacuuuuuuuag

SEQ ID NO: 766597 - RNA, 16 nt, Leptospira interrogans serovar lai str. 56601
aauacaucucuuuuuu

SEQ ID NO: 766598 - RNA, 24 nt, Leptospira interrogans serovar lai str. 56601
aauacaucucuuuuuuaaagccuc

SEQ ID NO: 766599 - RNA, 21 nt, Leptospira interrogans serovar lai str. 56601
aauacauacaaugaaaaagca

SEQ ID NO: 766600 - RNA, 15 nt, Leptospira interrogans serovar lai str. 56601
aauacauaaaaaaau

SEQ ID NO: 766601 - RNA, 23 nt, Leptospira interrogans serovar lai str. 56601
aauacgacagauucaauuuuuau

SEQ ID NO: 766602 - RNA, 22 nt, Leptospira interrogans serovar lai str. 56601
aauacgauagauucaauuauua

SEQ ID NO: 766603 - RNA, 18 nt, Leptospira interrogans serovar lai str. 56601
aauacgaucuaauuugua

SEQ ID NO: 766604 - RNA, 21 nt, Leptospira interrogans serovar lai str. 56601
aauacgaucuaauuuguaaga

SEQ ID NO: 766605 - RNA, 17 nt, Leptospira interrogans serovar lai str. 56601
aaguaaucuuuuuaaaa

SEQ ID NO: 766606 - RNA, 21 nt, Leptospira interrogans serovar lai str. 56601
aaguaaucuuuuuaaaaguuu

SEQ ID NO: 766607 - RNA, 22 nt, Leptospira interrogans serovar lai str. 56601
aaguaaucuuuuuaaaaguuug

SEQ ID NO: 766608 - RNA, 18 nt, Leptospira interrogans serovar lai str. 56601
aagucugguuuauuuuug

SEQ ID NO: 766609 - RNA, 13 nt, Leptospira interrogans serovar lai str. 56601
aaguaauccauuu

SEQ ID NO: 766610 - RNA, 17 nt, Leptospira interrogans serovar lai str. 56601
aaguaaguugagaauau

SEQ ID NO: 766611 - RNA, 17 nt, Leptospira interrogans serovar lai str. 56601
aaguaaauggauaaauu

SEQ ID NO: 766612 - RNA, 18 nt, Leptospira interrogans serovar lai str. 56601
aaguaacguaaauuuuua

SEQ ID NO: 766613 - RNA, 12 nt, Leptospira interrogans serovar lai str. 56601
aagucuuuaaaa

SEQ ID NO: 766614 - RNA, 14 nt, Leptospira interrogans serovar lai str. 56601
aagucuuuaaaaau

SEQ ID NO: 766615 - RNA, 19 nt, Leptospira interrogans serovar lai str. 56601
aagugaugaagagaaagua

SEQ ID NO: 766616 - RNA, 14 nt, Leptospira interrogans serovar lai str. 56601
aagugaugaaguuu

SEQ ID NO: 766617 - RNA, 21 nt, Leptospira interrogans serovar lai str. 56601
aagugauucauucuaagauuu

SEQ ID NO: 766618 - RNA, 16 nt, Leptospira interrogans serovar lai str. 56601
aaguugggaucugaau

SEQ ID NO: 766619 - RNA, 21 nt, Leptospira interrogans serovar lai str. 56601
aaguuuacacaacauuaugaa

SEQ ID NO: 766620 - RNA, 18 nt, Leptospira interrogans serovar lai str. 56601
aaguuuacaucaaaaaca

SEQ ID NO: 766621 - RNA, 20 nt, Leptospira interrogans serovar lai str. 56601
aaguuuaccacgaauuaaau

SEQ ID NO: 766622 - RNA, 14 nt, Leptospira interrogans serovar lai str. 56601
aaguuuaugaauuu

SEQ ID NO: 766623 - RNA, 17 nt, Leptospira interrogans serovar lai str. 56601
aaguuuauucaauuuua

SEQ ID NO: 766624 - RNA, 15 nt, Leptospira interrogans serovar lai str. 56601
aaguuucaaguuuag

SEQ ID NO: 766625 - RNA, 15 nt, Leptospira interrogans serovar lai str. 56601
aaguuugguccuuug

SEQ ID NO: 766626 - RNA, 19 nt, Leptospira interrogans serovar lai str. 56601
aaguugcaaagaagaaaua

SEQ ID NO: 766627 - RNA, 15 nt, Leptospira interrogans serovar lai str. 56601
aaguucuuuucuuaa

SEQ ID NO: 766628 - RNA, 17 nt, Leptospira interrogans serovar lai str. 56601
aaguuauauuagaguuu

SEQ ID NO: 766629 - RNA, 14 nt, Leptospira interrogans serovar lai str. 56601
aaguuauaaugaua

SEQ ID NO: 766630 - RNA, 15 nt, Leptospira interrogans serovar lai str. 56601
aaguuauaaugauaa

SEQ ID NO: 766631 - RNA, 16 nt, Leptospira interrogans serovar lai str. 56601
aaguuauaaugauaaa

SEQ ID NO: 766632 - RNA, 20 nt, Leptospira interrogans serovar lai str. 56601
aaguuaggugauauuuucua

SEQ ID NO: 766633 - RNA, 14 nt, Leptospira interrogans serovar lai str. 56601
aaguucuauaaacu

SEQ ID NO: 766634 - RNA, 17 nt, Leptospira interrogans serovar lai str. 56601
aaguucuauaaacucaa

SEQ ID NO: 766635 - RNA, 15 nt, Leptospira interrogans serovar lai str. 56601
aaguucgauuaaaau

SEQ ID NO: 766636 - RNA, 13 nt, Leptospira interrogans serovar lai str. 56601
aaguuagaauaua

SEQ ID NO: 766637 - RNA, 17 nt, Leptospira interrogans serovar lai str. 56601
aaguguaucccuuuggc

SEQ ID NO: 766638 - RNA, 13 nt, Leptospira interrogans serovar lai str. 56601
aaguguaugaaaa

SEQ ID NO: 766639 - RNA, 17 nt, Leptospira interrogans serovar lai str. 56601
aaguguaaaauuaaaau

SEQ ID NO: 766640 - RNA, 12 nt, Leptospira interrogans serovar lai str. 56601
aauaaauuuaaa

SEQ ID NO: 766641 - RNA, 22 nt, Leptospira interrogans serovar lai str. 56601
aauaaauugaacguaauacaaa

SEQ ID NO: 766642 - RNA, 17 nt, Leptospira interrogans serovar lai str. 56601
aauaaauugcacaaaag

SEQ ID NO: 766643 - RNA, 17 nt, Leptospira interrogans serovar lai str. 56601
aauaaauuaaaaaaaaa

SEQ ID NO: 766644 - RNA, 18 nt, Leptospira interrogans serovar lai str. 56601
aauaaauuaaaaaaaaau

SEQ ID NO: 766645 - RNA, 20 nt, Leptospira interrogans serovar lai str. 56601
aauaaauuccccaaaaugaa

SEQ ID NO: 766646 - RNA, 12 nt, Leptospira interrogans serovar lai str. 56601
aauaacaaaaaa

SEQ ID NO: 766647 - RNA, 12 nt, Leptospira interrogans serovar lai str. 56601
aauaaauuuuuc

SEQ ID NO: 766648 - RNA, 22 nt, Leptospira interrogans serovar lai str. 56601
aauaaauuuuucuggaaaaguu

SEQ ID NO: 766649 - RNA, 23 nt, Leptospira interrogans serovar lai str. 56601
aauaaauuuuucuggaaaaguuu

SEQ ID NO: 766650 - RNA, 20 nt, Leptospira interrogans serovar lai str. 56601
aauaaauuuuugacuaccuu

SEQ ID NO: 766651 - RNA, 14 nt, Leptospira interrogans serovar lai str. 56601
aauaaauaaugaaa

SEQ ID NO: 766652 - RNA, 16 nt, Leptospira interrogans serovar lai str. 56601
aauaaagguuuuauag

SEQ ID NO: 766653 - RNA, 15 nt, Leptospira interrogans serovar lai str. 56601
aauaaaguuuuauac

SEQ ID NO: 766654 - RNA, 14 nt, Leptospira interrogans serovar lai str. 56601
aauaaaguaccuaa

SEQ ID NO: 766655 - RNA, 20 nt, Leptospira interrogans serovar lai str. 56601
aauaaagauucacuuagaaa

SEQ ID NO: 766656 - RNA, 16 nt, Leptospira interrogans serovar lai str. 56601
aauaaagagaaaacaa

SEQ ID NO: 766657 - RNA, 15 nt, Leptospira interrogans serovar lai str. 56601
aauaaaccgcauaaa

SEQ ID NO: 766658 - RNA, 15 nt, Leptospira interrogans serovar lai str. 56601
aauaaaauaaaaaaa

SEQ ID NO: 766659 - RNA, 16 nt, Leptospira interrogans serovar lai str. 56601
aauaaaauaaaaaaau

SEQ ID NO: 766660 - RNA, 15 nt, Leptospira interrogans serovar lai str. 56601
aauaaaauacaguac

SEQ ID NO: 766661 - RNA, 19 nt, Leptospira interrogans serovar lai str. 56601
aauaaaaccgcugaaaaaa

SEQ ID NO: 766662 - RNA, 20 nt, Leptospira interrogans serovar lai str. 56601
aauaaaaccgcugaaaaaaa

SEQ ID NO: 766663 - RNA, 23 nt, Leptospira interrogans serovar lai str. 56601
aauaaaaccgcugaaaaaaaaau

SEQ ID NO: 766664 - RNA, 13 nt, Leptospira interrogans serovar lai str. 56601
aauaaaauuauua

SEQ ID NO: 766665 - RNA, 15 nt, Leptospira interrogans serovar lai str. 56601
aauaaaauuaacagu

SEQ ID NO: 766666 - RNA, 19 nt, Leptospira interrogans serovar lai str. 56601
aauaaaaucauauuuucaa

SEQ ID NO: 766667 - RNA, 19 nt, Leptospira interrogans serovar lai str. 56601
aauaaaaugcaguaguucc

SEQ ID NO: 766668 - RNA, 17 nt, Leptospira interrogans serovar lai str. 56601
aauaaaauguaaaaacu

SEQ ID NO: 766669 - RNA, 17 nt, Leptospira interrogans serovar lai str. 56601
aauaaaauguaguaacu

SEQ ID NO: 766670 - RNA, 13 nt, Leptospira interrogans serovar lai str. 56601
aauaaaauuuuua

SEQ ID NO: 766671 - RNA, 14 nt, Leptospira interrogans serovar lai str. 56601
aauaaaauuuuuaa

SEQ ID NO: 766672 - RNA, 14 nt, Leptospira interrogans serovar lai str. 56601
aauaaaauuuuaua

SEQ ID NO: 766673 - RNA, 17 nt, Leptospira interrogans serovar lai str. 56601
aauaaaauuuuauaaua

SEQ ID NO: 766674 - RNA, 13 nt, Leptospira interrogans serovar lai str. 56601
aauaaaauuuuca

SEQ ID NO: 766675 - RNA, 19 nt, Leptospira interrogans serovar lai str. 56601
aauaaacaauaaaauaacu

SEQ ID NO: 766676 - RNA, 16 nt, Leptospira interrogans serovar lai str. 56601
aaguuuuaguuuacaa

SEQ ID NO: 766677 - RNA, 16 nt, Leptospira interrogans serovar lai str. 56601
aaguuuucaaaaaaug

SEQ ID NO: 766678 - RNA, 16 nt, Leptospira interrogans serovar lai str. 56601
aaguuuguuuguaaag

SEQ ID NO: 766679 - RNA, 14 nt, Leptospira interrogans serovar lai str. 56601
aaguuugugagagu

SEQ ID NO: 766680 - RNA, 18 nt, Leptospira interrogans serovar lai str. 56601
aaguuugugagaguuccc

SEQ ID NO: 766681 - RNA, 20 nt, Leptospira interrogans serovar lai str. 56601
aaguuugugagaguucccac

SEQ ID NO: 766682 - RNA, 16 nt, Leptospira interrogans serovar lai str. 56601
aaguuuugaauuuuag

SEQ ID NO: 766683 - RNA, 14 nt, Leptospira interrogans serovar lai str. 56601
aaguuuuuaaaaau

SEQ ID NO: 766684 - RNA, 12 nt, Leptospira interrogans serovar lai str. 56601
aaguuuugauag

SEQ ID NO: 766685 - RNA, 22 nt, Leptospira interrogans serovar lai str. 56601
aaguuuugauagaaaaacucug

SEQ ID NO: 766686 - RNA, 17 nt, Leptospira interrogans serovar lai str. 56601
aaguuuuucuuaaaaag

SEQ ID NO: 766687 - RNA, 19 nt, Leptospira interrogans serovar lai str. 56601
aaguuuuucuuaaaaaguu

SEQ ID NO: 766688 - RNA, 13 nt, Leptospira interrogans serovar lai str. 56601
aaguuuuggaaga

SEQ ID NO: 766689 - RNA, 17 nt, Leptospira interrogans serovar lai str. 56601
aauaaaaacuaauaauu

SEQ ID NO: 766690 - RNA, 16 nt, Leptospira interrogans serovar lai str. 56601
aauaaaaaauuuuccg

SEQ ID NO: 766691 - RNA, 18 nt, Leptospira interrogans serovar lai str. 56601
aauaaaaacaaaaucaaa

SEQ ID NO: 766692 - RNA, 19 nt, Leptospira interrogans serovar lai str. 56601
aauaaaaaacucaaugugu

SEQ ID NO: 766693 - RNA, 16 nt, Leptospira interrogans serovar lai str. 56601
aauaaaaaaaugaauu

SEQ ID NO: 766694 - RNA, 13 nt, Leptospira interrogans serovar lai str. 56601
aauaaaaaacaaa

SEQ ID NO: 766695 - RNA, 18 nt, Leptospira interrogans serovar lai str. 56601
aauaaaaaucauaaaaca

SEQ ID NO: 766696 - RNA, 13 nt, Leptospira interrogans serovar lai str. 56601
aauaaaaauuuaa

SEQ ID NO: 766697 - RNA, 17 nt, Leptospira interrogans serovar lai str. 56601
aauaaaaauuuaaaaua

SEQ ID NO: 766698 - RNA, 14 nt, Leptospira interrogans serovar lai str. 56601
aauaaaaauuuaca

SEQ ID NO: 766699 - RNA, 15 nt, Leptospira interrogans serovar lai str. 56601
aagaagggaugaaau

SEQ ID NO: 766700 - RNA, 22 nt, Leptospira interrogans serovar lai str. 56601
aagaagggaugaaauuuuaaaa

SEQ ID NO: 766701 - RNA, 21 nt, Leptospira interrogans serovar lai str. 56601
aagaaggcagcuaagaaaaaa

SEQ ID NO: 766702 - RNA, 11 nt, Leptospira interrogans serovar lai str. 56601
aagaauaaaag

SEQ ID NO: 766703 - RNA, 13 nt, Leptospira interrogans serovar lai str. 56601
aagaauaaauccg

SEQ ID NO: 766704 - RNA, 22 nt, Leptospira interrogans serovar lai str. 56601
aagaauaaauccggaaguaauu

SEQ ID NO: 766705 - RNA, 12 nt, Leptospira interrogans serovar lai str. 56601
aagaaucaaaac

SEQ ID NO: 766706 - RNA, 11 nt, Leptospira interrogans serovar lai str. 56601
aagaaucaaua

SEQ ID NO: 766707 - RNA, 17 nt, Leptospira interrogans serovar lai str. 56601
aagaacuucgaucauuu

SEQ ID NO: 766708 - RNA, 20 nt, Leptospira interrogans serovar lai str. 56601
aagaacuuucucgaaaaucu

SEQ ID NO: 766709 - RNA, 22 nt, Leptospira interrogans serovar lai str. 56601
aagaacuuucucgaaaaucuca

SEQ ID NO: 766710 - RNA, 14 nt, Leptospira interrogans serovar lai str. 56601
aagaacgaacuaau

SEQ ID NO: 766711 - RNA, 21 nt, Leptospira interrogans serovar lai str. 56601
aagaacguuuccagaaagcuc

SEQ ID NO: 766712 - RNA, 17 nt, Leptospira interrogans serovar lai str. 56601
aagaacuggauucaaaa

SEQ ID NO: 766713 - RNA, 22 nt, Leptospira interrogans serovar lai str. 56601
aagaagccaauuccaaaaaucu

SEQ ID NO: 766714 - RNA, 20 nt, Leptospira interrogans serovar lai str. 56601
aagaagagccucaaguaaaa

SEQ ID NO: 766715 - RNA, 18 nt, Leptospira interrogans serovar lai str. 56601
aagaagaggugaaauuuc

SEQ ID NO: 766716 - RNA, 20 nt, Leptospira interrogans serovar lai str. 56601
aagaagauaaaacucaaagg

SEQ ID NO: 766717 - RNA, 18 nt, Leptospira interrogans serovar lai str. 56601
aagaagauagauuuauaa

SEQ ID NO: 766718 - RNA, 10 nt, Leptospira interrogans serovar lai str. 56601
aagaaauucu

SEQ ID NO: 766719 - RNA, 16 nt, Leptospira interrogans serovar lai str. 56601
aagaaauuuaauacaa

SEQ ID NO: 766720 - RNA, 16 nt, Leptospira interrogans serovar lai str. 56601
aagaaaguauuaauuu

SEQ ID NO: 766721 - RNA, 15 nt, Leptospira interrogans serovar lai str. 56601
aagaaagcagcaaag

SEQ ID NO: 766722 - RNA, 14 nt, Leptospira interrogans serovar lai str. 56601
aagaacaauuuaaa

SEQ ID NO: 766723 - RNA, 15 nt, Leptospira interrogans serovar lai str. 56601
aagaacaauuuaaaa

SEQ ID NO: 766724 - RNA, 18 nt, Leptospira interrogans serovar lai str. 56601
aagaacgauccguaaaaa

SEQ ID NO: 766725 - RNA, 15 nt, Leptospira interrogans serovar lai str. 56601
aagaaacuguuuaau

SEQ ID NO: 766726 - RNA, 23 nt, Leptospira interrogans serovar lai str. 56601
aagaaacuguuuaauaaagauuc

SEQ ID NO: 766727 - RNA, 13 nt, Leptospira interrogans serovar lai str. 56601
aagaaacucagua

SEQ ID NO: 766728 - RNA, 21 nt, Leptospira interrogans serovar lai str. 56601
aagaaacucauuuuucuaaaa

SEQ ID NO: 766729 - RNA, 19 nt, Leptospira interrogans serovar lai str. 56601
aagaaaaccuaaaauagau

SEQ ID NO: 766730 - RNA, 23 nt, Leptospira interrogans serovar lai str. 56601
aagaaaaccacccccaccaaaaa

SEQ ID NO: 766731 - RNA, 15 nt, Leptospira interrogans serovar lai str. 56601
aagaaaaccaugauu

SEQ ID NO: 766732 - RNA, 19 nt, Leptospira interrogans serovar lai str. 56601
aagaaaaaaguugcuaaga

SEQ ID NO: 766733 - RNA, 21 nt, Leptospira interrogans serovar lai str. 56601
aacuuggguuucuuaaaucuu

SEQ ID NO: 766734 - RNA, 22 nt, Leptospira interrogans serovar lai str. 56601
aacuugcucaaaagcucauaau

SEQ ID NO: 766735 - RNA, 17 nt, Leptospira interrogans serovar lai str. 56601
aacuuggaaucuuaaaa

SEQ ID NO: 766736 - RNA, 20 nt, Leptospira interrogans serovar lai str. 56601
aacuugcaauuuuacuuaua

SEQ ID NO: 766737 - RNA, 16 nt, Leptospira interrogans serovar lai str. 56601
aacuucaaaaaauaua

SEQ ID NO: 766738 - RNA, 20 nt, Leptospira interrogans serovar lai str. 56601
aacuucaaaaaauauaggaa

SEQ ID NO: 766739 - RNA, 19 nt, Leptospira interrogans serovar lai str. 56601
aacuuauugaagauaaaaa

SEQ ID NO: 766740 - RNA, 23 nt, Leptospira interrogans serovar lai str. 56601
aacuuaugcuauuuaauuuugua

SEQ ID NO: 766741 - RNA, 15 nt, Leptospira interrogans serovar lai str. 56601
aacuugaaucgagcg

SEQ ID NO: 766742 - RNA, 22 nt, Leptospira interrogans serovar lai str. 56601
aacuugaguuugacguaagaaa

SEQ ID NO: 766743 - RNA, 13 nt, Leptospira interrogans serovar lai str. 56601
aacuuaaaaaugu

SEQ ID NO: 766744 - RNA, 22 nt, Leptospira interrogans serovar lai str. 56601
aacuuacugauuucuauaaaau

SEQ ID NO: 766745 - RNA, 23 nt, Leptospira interrogans serovar lai str. 56601
aacuuacugauuucuauaaaauu

SEQ ID NO: 766746 - RNA, 16 nt, Leptospira interrogans serovar lai str. 56601
aacuuacguaaaacgg

SEQ ID NO: 766747 - RNA, 15 nt, Leptospira interrogans serovar lai str. 56601
aacuuagguuuugua

SEQ ID NO: 766748 - RNA, 23 nt, Leptospira interrogans serovar lai str. 56601
aacuuaguucccgccucacaacg

SEQ ID NO: 766749 - RNA, 16 nt, Leptospira interrogans serovar lai str. 56601
aacuuaaaucucacgg

SEQ ID NO: 766750 - RNA, 22 nt, Leptospira interrogans serovar lai str. 56601
aacuuaaguuugucuguaaaau

SEQ ID NO: 766751 - RNA, 12 nt, Leptospira interrogans serovar lai str. 56601
aacuuacagauu

SEQ ID NO: 766752 - RNA, 15 nt, Leptospira interrogans serovar lai str. 56601
aacuuacauuaaaua

SEQ ID NO: 766753 - RNA, 16 nt, Leptospira interrogans serovar lai str. 56601
aacuauuuauaaaaua

SEQ ID NO: 766754 - RNA, 17 nt, Leptospira interrogans serovar lai str. 56601
aacucaaaaaauuuuua

SEQ ID NO: 766755 - RNA, 18 nt, Leptospira interrogans serovar lai str. 56601
aacucaaaaaauuuuuac

SEQ ID NO: 766756 - RNA, 14 nt, Leptospira interrogans serovar lai str. 56601
aacucaaaauuucg

SEQ ID NO: 766757 - RNA, 24 nt, Leptospira interrogans serovar lai str. 56601
aacucaaagaaauuuuacacguaa

SEQ ID NO: 766758 - RNA, 16 nt, Leptospira interrogans serovar lai str. 56601
aacucaaagaauuuua

SEQ ID NO: 766759 - RNA, 21 nt, Leptospira interrogans serovar lai str. 56601
aacucaaaggaaaaugaagaa

SEQ ID NO: 766760 - RNA, 19 nt, Leptospira interrogans serovar lai str. 56601
aacucaaaucuacaaaacu

SEQ ID NO: 766761 - RNA, 22 nt, Leptospira interrogans serovar lai str. 56601
aacucuucuucuagauuuuaaa

SEQ ID NO: 766762 - RNA, 18 nt, Leptospira interrogans serovar lai str. 56601
aacucuuuuaccuuacca

SEQ ID NO: 766763 - RNA, 16 nt, Leptospira interrogans serovar lai str. 56601
aacucuuuauuuuuaa

SEQ ID NO: 766764 - RNA, 14 nt, Leptospira interrogans serovar lai str. 56601
aacugauuaaaauc

SEQ ID NO: 766765 - RNA, 19 nt, Leptospira interrogans serovar lai str. 56601
aacucaacguuaguaacac

SEQ ID NO: 766766 - RNA, 17 nt, Leptospira interrogans serovar lai str. 56601
aacugaaaaugaccaaa

SEQ ID NO: 766767 - RNA, 16 nt, Leptospira interrogans serovar lai str. 56601
aacuggauucaaaauu

SEQ ID NO: 766768 - RNA, 21 nt, Leptospira interrogans serovar lai str. 56601
aacugcucgaaaguucacaaa

SEQ ID NO: 766769 - RNA, 17 nt, Leptospira interrogans serovar lai str. 56601
aacgugaauugucauga

SEQ ID NO: 766770 - RNA, 23 nt, Leptospira interrogans serovar lai str. 56601
aacgugaguuugacguaaaaaaa

SEQ ID NO: 766771 - RNA, 16 nt, Leptospira interrogans serovar lai str. 56601
aacguuacuuuuaaga

SEQ ID NO: 766772 - RNA, 22 nt, Leptospira interrogans serovar lai str. 56601
aacgugucauguuuuaaugaaa

SEQ ID NO: 766773 - RNA, 23 nt, Leptospira interrogans serovar lai str. 56601
aacguauuuuuacccgaucuuuu

SEQ ID NO: 766774 - RNA, 14 nt, Leptospira interrogans serovar lai str. 56601
aacguagauaauua

SEQ ID NO: 766775 - RNA, 23 nt, Leptospira interrogans serovar lai str. 56601
aacguaggcuugucguaaaaaaa

SEQ ID NO: 766776 - RNA, 16 nt, Leptospira interrogans serovar lai str. 56601
aacguaaguuaaauau

SEQ ID NO: 766777 - RNA, 16 nt, Leptospira interrogans serovar lai str. 56601
aacguaccaaaaccca

SEQ ID NO: 766778 - RNA, 16 nt, Leptospira interrogans serovar lai str. 56601
aacguaagcuugauuu

SEQ ID NO: 766779 - RNA, 15 nt, Leptospira interrogans serovar lai str. 56601
aacgucacuuuacaa

SEQ ID NO: 766780 - RNA, 20 nt, Leptospira interrogans serovar lai str. 56601
aacguccagauaugacaauu

SEQ ID NO: 766781 - RNA, 20 nt, Leptospira interrogans serovar lai str. 56601
aacgugaacuaaauauggau

SEQ ID NO: 766782 - RNA, 18 nt, Leptospira interrogans serovar lai str. 56601
aacuagggaaaguuuuuu

SEQ ID NO: 766783 - RNA, 17 nt, Leptospira interrogans serovar lai str. 56601
aacuacuuuuauaaaaa

SEQ ID NO: 766784 - RNA, 20 nt, Leptospira interrogans serovar lai str. 56601
aacuacuuccgucuuuugua

SEQ ID NO: 766785 - RNA, 21 nt, Leptospira interrogans serovar lai str. 56601
aacuacuuccgucuuuuguaa

SEQ ID NO: 766786 - RNA, 16 nt, Leptospira interrogans serovar lai str. 56601
aacuacugcauucuua

SEQ ID NO: 766787 - RNA, 18 nt, Leptospira interrogans serovar lai str. 56601
aacuaguuccuuaaauau

SEQ ID NO: 766788 - RNA, 19 nt, Leptospira interrogans serovar lai str. 56601
aacuaguuccuuaaauaua

SEQ ID NO: 766789 - RNA, 16 nt, Leptospira interrogans serovar lai str. 56601
aacuauaauaacaaaa

SEQ ID NO: 766790 - RNA, 15 nt, Leptospira interrogans serovar lai str. 56601
aacuacuacaaauca

SEQ ID NO: 766791 - RNA, 18 nt, Leptospira interrogans serovar lai str. 56601
aacuacuacaauuaaaaa

SEQ ID NO: 766792 - RNA, 15 nt, Leptospira interrogans serovar lai str. 56601
aacuacuacuuuuag

SEQ ID NO: 766793 - RNA, 21 nt, Leptospira interrogans serovar lai str. 56601
aacuacuacuuuuagaaaauu

SEQ ID NO: 766794 - RNA, 17 nt, Leptospira interrogans serovar lai str. 56601
aacuacuacuuuucuga

SEQ ID NO: 766795 - RNA, 15 nt, Leptospira interrogans serovar lai str. 56601
aacuacuauaaauua

SEQ ID NO: 766796 - RNA, 22 nt, Leptospira interrogans serovar lai str. 56601
aacuacuccccgaacuauacaa

SEQ ID NO: 766797 - RNA, 21 nt, Leptospira interrogans serovar lai str. 56601
aacuacccauuaacuauauaa

SEQ ID NO: 766798 - RNA, 13 nt, Leptospira interrogans serovar lai str. 56601
aacuacccaaaac

SEQ ID NO: 766799 - RNA, 12 nt, Leptospira interrogans serovar lai str. 56601
aacuaccacaaa

SEQ ID NO: 766800 - RNA, 15 nt, Leptospira interrogans serovar lai str. 56601
aacuaccacaaaacu

SEQ ID NO: 766801 - RNA, 19 nt, Leptospira interrogans serovar lai str. 56601
aacuaccaccaaaguauga

SEQ ID NO: 766802 - RNA, 22 nt, Leptospira interrogans serovar lai str. 56601
aacuaauuuuaguuuauuuuaa

SEQ ID NO: 766803 - RNA, 13 nt, Leptospira interrogans serovar lai str. 56601
aacuacagcaaau

SEQ ID NO: 766804 - RNA, 16 nt, Leptospira interrogans serovar lai str. 56601
aacuacacguuuuccu

SEQ ID NO: 766805 - RNA, 16 nt, Leptospira interrogans serovar lai str. 56601
aacuacagaauuuuuu

SEQ ID NO: 766806 - RNA, 21 nt, Leptospira interrogans serovar lai str. 56601
aacuacagaauuuuuuaacaa

SEQ ID NO: 766807 - RNA, 21 nt, Leptospira interrogans serovar lai str. 56601
aacuaaagacguaauauugua

SEQ ID NO: 766808 - RNA, 14 nt, Leptospira interrogans serovar lai str. 56601
aacuaaaaaaaaua

SEQ ID NO: 766809 - RNA, 15 nt, Leptospira interrogans serovar lai str. 56601
aacuaauauguuuag

SEQ ID NO: 766810 - RNA, 13 nt, Leptospira interrogans serovar lai str. 56601
aacuaaguuuuac

SEQ ID NO: 766811 - RNA, 18 nt, Leptospira interrogans serovar lai str. 56601
aacuaaguuuuacagaag

SEQ ID NO: 766812 - RNA, 15 nt, Leptospira interrogans serovar lai str. 56601
aacuaauaaaaacaa

SEQ ID NO: 766813 - RNA, 13 nt, Leptospira interrogans serovar lai str. 56601
aacuaaugaagga

SEQ ID NO: 766814 - RNA, 13 nt, Leptospira interrogans serovar lai str. 56601
aacuaaauuuuuc

SEQ ID NO: 766815 - RNA, 16 nt, Leptospira interrogans serovar lai str. 56601
aacggugcauuuaaaa

SEQ ID NO: 766816 - RNA, 18 nt, Leptospira interrogans serovar lai str. 56601
aacgguuuuaguaaaauu

SEQ ID NO: 766817 - RNA, 20 nt, Leptospira interrogans serovar lai str. 56601
aacgguaauuucauaaaauu

SEQ ID NO: 766818 - RNA, 17 nt, Leptospira interrogans serovar lai str. 56601
aacgguaaaaggagcca

SEQ ID NO: 766819 - RNA, 21 nt, Leptospira interrogans serovar lai str. 56601
aacggguucuuacaauaaaaa

SEQ ID NO: 766820 - RNA, 20 nt, Leptospira interrogans serovar lai str. 56601
aacggacuguuuuaauuugu

SEQ ID NO: 766821 - RNA, 14 nt, Leptospira interrogans serovar lai str. 56601
aacggaauuuuguu

SEQ ID NO: 766822 - RNA, 13 nt, Leptospira interrogans serovar lai str. 56601
aacggaauuuuuc

SEQ ID NO: 766823 - RNA, 16 nt, Leptospira interrogans serovar lai str. 56601
aacgcaaaaagccaga

SEQ ID NO: 766824 - RNA, 23 nt, Leptospira interrogans serovar lai str. 56601
aacgcaaguuccgcgauugaaaa

SEQ ID NO: 766825 - RNA, 13 nt, Leptospira interrogans serovar lai str. 56601
aacgauuguaaaa

SEQ ID NO: 766826 - RNA, 19 nt, Leptospira interrogans serovar lai str. 56601
aacgauuguaaaaaaacau

SEQ ID NO: 766827 - RNA, 21 nt, Leptospira interrogans serovar lai str. 56601
aacgauuaugauuuuuuugaa

SEQ ID NO: 766828 - RNA, 22 nt, Leptospira interrogans serovar lai str. 56601
aacgauuauuuuuuaaaaaucu

SEQ ID NO: 766829 - RNA, 17 nt, Leptospira interrogans serovar lai str. 56601
aacgauuucuauuuuuc

SEQ ID NO: 766830 - RNA, 18 nt, Leptospira interrogans serovar lai str. 56601
aacgauuucuguagaaau

SEQ ID NO: 766831 - RNA, 18 nt, Leptospira interrogans serovar lai str. 56601
aacgauuccauuuuuuag

SEQ ID NO: 766832 - RNA, 15 nt, Leptospira interrogans serovar lai str. 56601
aacgaucagaaaaac

SEQ ID NO: 766833 - RNA, 21 nt, Leptospira interrogans serovar lai str. 56601
aacgaucauacuuuagaaauu

SEQ ID NO: 766834 - RNA, 19 nt, Leptospira interrogans serovar lai str. 56601
aacgaugagccaucuuuuu

SEQ ID NO: 766835 - RNA, 16 nt, Leptospira interrogans serovar lai str. 56601
aaccaugauucugaaa

SEQ ID NO: 766836 - RNA, 20 nt, Leptospira interrogans serovar lai str. 56601
aaccaugauucugaaaaaag

SEQ ID NO: 766837 - RNA, 16 nt, Leptospira interrogans serovar lai str. 56601
aaccauggauuuuuac

SEQ ID NO: 766838 - RNA, 12 nt, Leptospira interrogans serovar lai str. 56601
aaccaucaccaa

SEQ ID NO: 766839 - RNA, 17 nt, Leptospira interrogans serovar lai str. 56601
aaccaucucaaaaacac

SEQ ID NO: 766840 - RNA, 21 nt, Leptospira interrogans serovar lai str. 56601
aaccacgucccguauaaaagu

SEQ ID NO: 766841 - RNA, 13 nt, Leptospira interrogans serovar lai str. 56601
aacccaaaaaugu

SEQ ID NO: 766842 - RNA, 14 nt, Leptospira interrogans serovar lai str. 56601
aacccaaacacaug

SEQ ID NO: 766843 - RNA, 23 nt, Leptospira interrogans serovar lai str. 56601
aacccaucgcacgucccacaaau

SEQ ID NO: 766844 - RNA, 16 nt, Leptospira interrogans serovar lai str. 56601
aacccaucguaaacaa

SEQ ID NO: 766845 - RNA, 23 nt, Leptospira interrogans serovar lai str. 56601
aacccggauuuguugauuuuuga

SEQ ID NO: 766846 - RNA, 18 nt, Leptospira interrogans serovar lai str. 56601
aaccgcauaaaagaaauu

SEQ ID NO: 766847 - RNA, 17 nt, Leptospira interrogans serovar lai str. 56601
aaccgaucuuaaaaacu

SEQ ID NO: 766848 - RNA, 15 nt, Leptospira interrogans serovar lai str. 56601
aaccgcugaaaaaaa

SEQ ID NO: 766849 - RNA, 23 nt, Leptospira interrogans serovar lai str. 56601
aaccgaaauagaaauacauaaau

SEQ ID NO: 766850 - RNA, 14 nt, Leptospira interrogans serovar lai str. 56601
aaccgacuugagau

SEQ ID NO: 766851 - RNA, 15 nt, Leptospira interrogans serovar lai str. 56601
aacccucaucaguca

SEQ ID NO: 766852 - RNA, 22 nt, Leptospira interrogans serovar lai str. 56601
aacauacuaaucuauggaucgc

SEQ ID NO: 766853 - RNA, 13 nt, Leptospira interrogans serovar lai str. 56601
aacagcccaaaaa

SEQ ID NO: 766854 - RNA, 18 nt, Leptospira interrogans serovar lai str. 56601
aacagcccaaaaagguga

SEQ ID NO: 766855 - RNA, 18 nt, Leptospira interrogans serovar lai str. 56601
aacaugaagaagcuaaaa

SEQ ID NO: 766856 - RNA, 20 nt, Leptospira interrogans serovar lai str. 56601
aacaugaagaagcuaaaauu

SEQ ID NO: 766857 - RNA, 16 nt, Leptospira interrogans serovar lai str. 56601
aacauauuauuuucag

SEQ ID NO: 766858 - RNA, 22 nt, Leptospira interrogans serovar lai str. 56601
aacaucauucucauauugaaau

SEQ ID NO: 766859 - RNA, 24 nt, Leptospira interrogans serovar lai str. 56601
aaccacaagacaaacaaacaugca

SEQ ID NO: 766860 - RNA, 13 nt, Leptospira interrogans serovar lai str. 56601
aaccaauuuuuca

SEQ ID NO: 766861 - RNA, 14 nt, Leptospira interrogans serovar lai str. 56601
aaccaauuuuucaa

SEQ ID NO: 766862 - RNA, 18 nt, Leptospira interrogans serovar lai str. 56601
aacauugcgagauuuuaa

SEQ ID NO: 766863 - RNA, 19 nt, Leptospira interrogans serovar lai str. 56601
aacauugcgagauuuuaag

SEQ ID NO: 766864 - RNA, 14 nt, Leptospira interrogans serovar lai str. 56601
aacaugagaagcuu

SEQ ID NO: 766865 - RNA, 22 nt, Leptospira interrogans serovar lai str. 56601
aacauuagaguuguugaaaaau

SEQ ID NO: 766866 - RNA, 14 nt, Leptospira interrogans serovar lai str. 56601
aacauuauguuaaa

SEQ ID NO: 766867 - RNA, 21 nt, Leptospira interrogans serovar lai str. 56601
aacagagcuuuacaauaaaaa

SEQ ID NO: 766868 - RNA, 19 nt, Leptospira interrogans serovar lai str. 56601
aacagaucaagaauuaauu

SEQ ID NO: 766869 - RNA, 14 nt, Leptospira interrogans serovar lai str. 56601
aacacuuugagaaa

SEQ ID NO: 766870 - RNA, 21 nt, Leptospira interrogans serovar lai str. 56601
aacagaauguucuuagacuca

SEQ ID NO: 766871 - RNA, 15 nt, Leptospira interrogans serovar lai str. 56601
aacagaacaaaauuu

SEQ ID NO: 766872 - RNA, 18 nt, Leptospira interrogans serovar lai str. 56601
aacagaacgggcuuucua

SEQ ID NO: 766873 - RNA, 23 nt, Leptospira interrogans serovar lai str. 56601
aacaccuucucuuuuaaaaacuu

SEQ ID NO: 766874 - RNA, 22 nt, Leptospira interrogans serovar lai str. 56601
aacacgggaauaaaaacaaaau

SEQ ID NO: 766875 - RNA, 13 nt, Leptospira interrogans serovar lai str. 56601
aacacguuaacaa

SEQ ID NO: 766876 - RNA, 14 nt, Leptospira interrogans serovar lai str. 56601
aacacgauuuauag

SEQ ID NO: 766877 - RNA, 18 nt, Leptospira interrogans serovar lai str. 56601
aacacuaaguaaaaaugc

SEQ ID NO: 766878 - RNA, 20 nt, Leptospira interrogans serovar lai str. 56601
aacacugagucaacaaauau

SEQ ID NO: 766879 - RNA, 23 nt, Leptospira interrogans serovar lai str. 56601
aacacuguuucgacguaaaaaua

SEQ ID NO: 766880 - RNA, 17 nt, Leptospira interrogans serovar lai str. 56601
aacaauuaaucaaauuu

SEQ ID NO: 766881 - RNA, 11 nt, Leptospira interrogans serovar lai str. 56601
aacaauucaga

SEQ ID NO: 766882 - RNA, 23 nt, Leptospira interrogans serovar lai str. 56601
aacaauucagauuccguuuuuau

SEQ ID NO: 766883 - RNA, 16 nt, Leptospira interrogans serovar lai str. 56601
aacaauucuauuagaa

SEQ ID NO: 766884 - RNA, 21 nt, Leptospira interrogans serovar lai str. 56601
aacaauucucgauagaacaau

SEQ ID NO: 766885 - RNA, 20 nt, Leptospira interrogans serovar lai str. 56601
aacaauucuuccuuuuucau

SEQ ID NO: 766886 - RNA, 13 nt, Leptospira interrogans serovar lai str. 56601
aacaauuuaaaau

SEQ ID NO: 766887 - RNA, 15 nt, Leptospira interrogans serovar lai str. 56601
aacaauuuaaaauaa

SEQ ID NO: 766888 - RNA, 22 nt, Leptospira interrogans serovar lai str. 56601
aacaaucuucaaauucuacacc

SEQ ID NO: 766889 - RNA, 20 nt, Leptospira interrogans serovar lai str. 56601
aacaaucucggacagauaua

SEQ ID NO: 766890 - RNA, 19 nt, Leptospira interrogans serovar lai str. 56601
aacaaucguacgaaucaga

SEQ ID NO: 766891 - RNA, 20 nt, Leptospira interrogans serovar lai str. 56601
aacaauauucuaauuuuaua

SEQ ID NO: 766892 - RNA, 15 nt, Leptospira interrogans serovar lai str. 56601
aacaaucaauugaaa

SEQ ID NO: 766893 - RNA, 19 nt, Leptospira interrogans serovar lai str. 56601
aacaauagcuucuuuaaaa

SEQ ID NO: 766894 - RNA, 22 nt, Leptospira interrogans serovar lai str. 56601
aacaaguuccaaauuacucuuu

SEQ ID NO: 766895 - RNA, 20 nt, Leptospira interrogans serovar lai str. 56601
aaauucuuagaguaaaacuu

SEQ ID NO: 766896 - RNA, 21 nt, Leptospira interrogans serovar lai str. 56601
aaauucuuagaguaaaacuuu

SEQ ID NO: 766897 - RNA, 13 nt, Leptospira interrogans serovar lai str. 56601
aaauucugauuuu

SEQ ID NO: 766898 - RNA, 17 nt, Leptospira interrogans serovar lai str. 56601
aaauucucuuuugacca

SEQ ID NO: 766899 - RNA, 20 nt, Leptospira interrogans serovar lai str. 56601
aaauucucuuuugaccaaaa

SEQ ID NO: 766900 - RNA, 15 nt, Leptospira interrogans serovar lai str. 56601
aaauucugaaagagu

SEQ ID NO: 766901 - RNA, 15 nt, Leptospira interrogans serovar lai str. 56601
aaauucuuaaaaaau

SEQ ID NO: 766902 - RNA, 18 nt, Leptospira interrogans serovar lai str. 56601
aaauucugcucgaauuuu

SEQ ID NO: 766903 - RNA, 20 nt, Leptospira interrogans serovar lai str. 56601
aaauucugcucgaauuuuuu

SEQ ID NO: 766904 - RNA, 16 nt, Leptospira interrogans serovar lai str. 56601
aacaauuuuuugaaaa

SEQ ID NO: 766905 - RNA, 19 nt, Leptospira interrogans serovar lai str. 56601
aacaauuuuuugaaaaaga

SEQ ID NO: 766906 - RNA, 23 nt, Leptospira interrogans serovar lai str. 56601
aacaauuuuuugaaaaagaauau

SEQ ID NO: 766907 - RNA, 20 nt, Leptospira interrogans serovar lai str. 56601
aacacaaauauuaagaauuc

SEQ ID NO: 766908 - RNA, 13 nt, Leptospira interrogans serovar lai str. 56601
aacacaacggcuc

SEQ ID NO: 766909 - RNA, 22 nt, Leptospira interrogans serovar lai str. 56601
aacacaaaggaaucccaaauuc

SEQ ID NO: 766910 - RNA, 15 nt, Leptospira interrogans serovar lai str. 56601
aacacaaguuuggaa

SEQ ID NO: 766911 - RNA, 12 nt, Leptospira interrogans serovar lai str. 56601
aacaauuuuuca

SEQ ID NO: 766912 - RNA, 11 nt, Leptospira interrogans serovar lai str. 56601
aacacacacuu

SEQ ID NO: 766913 - RNA, 18 nt, Leptospira interrogans serovar lai str. 56601
aacacaguuugaauuuua

SEQ ID NO: 766914 - RNA, 24 nt, Leptospira interrogans serovar lai str. 56601
aaaaagggauucuauucucguuuc

SEQ ID NO: 766915 - RNA, 15 nt, Leptospira interrogans serovar lai str. 56601
aacaccaccaacagc

SEQ ID NO: 766916 - RNA, 19 nt, Leptospira interrogans serovar lai str. 56601
aacacauuuucauucuaaa

SEQ ID NO: 766917 - RNA, 21 nt, Leptospira interrogans serovar lai str. 56601
aaaaaguaguaauucuuacau

SEQ ID NO: 766918 - RNA, 19 nt, Leptospira interrogans serovar lai str. 56601
aaaaaguccaaaacaaagu

SEQ ID NO: 766919 - RNA, 14 nt, Leptospira interrogans serovar lai str. 56601
aaaaaguauaauuu

SEQ ID NO: 766920 - RNA, 15 nt, Leptospira interrogans serovar lai str. 56601
aaaaagucucaaaac

SEQ ID NO: 766921 - RNA, 21 nt, Leptospira interrogans serovar lai str. 56601
aaaaagucugucuuaaaauuu

SEQ ID NO: 766922 - RNA, 13 nt, Leptospira interrogans serovar lai str. 56601
aaucaugaauauu

SEQ ID NO: 766923 - RNA, 18 nt, Leptospira interrogans serovar lai str. 56601
aaucaugaauauuuucca

SEQ ID NO: 766924 - RNA, 17 nt, Leptospira interrogans serovar lai str. 56601
aaucaugaucaaauuca

SEQ ID NO: 766925 - RNA, 20 nt, Leptospira interrogans serovar lai str. 56601
aaucauuggaguuuuuuaaa

SEQ ID NO: 766926 - RNA, 16 nt, Leptospira interrogans serovar lai str. 56601
aaucagauuuuuguag

SEQ ID NO: 766927 - RNA, 19 nt, Leptospira interrogans serovar lai str. 56601
aaucagauccuuauacuuu

SEQ ID NO: 766928 - RNA, 18 nt, Leptospira interrogans serovar lai str. 56601
aaucagagucuauuuaau

SEQ ID NO: 766929 - RNA, 22 nt, Leptospira interrogans serovar lai str. 56601
aaucaucuugcucuaaaugacu

SEQ ID NO: 766930 - RNA, 14 nt, Leptospira interrogans serovar lai str. 56601
aaucauuuuuuguu

SEQ ID NO: 766931 - RNA, 16 nt, Leptospira interrogans serovar lai str. 56601
aauccaugauccauuu

SEQ ID NO: 766932 - RNA, 18 nt, Leptospira interrogans serovar lai str. 56601
aauccaugauccauuuuu

SEQ ID NO: 766933 - RNA, 18 nt, Leptospira interrogans serovar lai str. 56601
aauccaugauucugaaaa

SEQ ID NO: 766934 - RNA, 22 nt, Leptospira interrogans serovar lai str. 56601
aauccaugauucugaaaaaagu

SEQ ID NO: 766935 - RNA, 16 nt, Leptospira interrogans serovar lai str. 56601
aaucccagaaaggaac

SEQ ID NO: 766936 - RNA, 16 nt, Leptospira interrogans serovar lai str. 56601
aaucccaaauucuuuc

SEQ ID NO: 766937 - RNA, 20 nt, Leptospira interrogans serovar lai str. 56601
aaucccaaauucuuuccuuu

SEQ ID NO: 766938 - RNA, 18 nt, Leptospira interrogans serovar lai str. 56601
aaucgacuuuucugauuu

SEQ ID NO: 766939 - RNA, 21 nt, Leptospira interrogans serovar lai str. 56601
aaucgaucuguaaaauucaga

SEQ ID NO: 766940 - RNA, 16 nt, Leptospira interrogans serovar lai str. 56601
aauccuauaucaacaa

SEQ ID NO: 766941 - RNA, 19 nt, Leptospira interrogans serovar lai str. 56601
aauccuauaucaacaaucg

SEQ ID NO: 766942 - RNA, 13 nt, Leptospira interrogans serovar lai str. 56601
aauccuauaauaa

SEQ ID NO: 766943 - RNA, 18 nt, Leptospira interrogans serovar lai str. 56601
aauccuguuugaaaaaau

SEQ ID NO: 766944 - RNA, 23 nt, Leptospira interrogans serovar lai str. 56601
aauccuguuugaaaaaauguaac

SEQ ID NO: 766945 - RNA, 13 nt, Leptospira interrogans serovar lai str. 56601
aauccuucuuuuc

SEQ ID NO: 766946 - RNA, 18 nt, Leptospira interrogans serovar lai str. 56601
aauccuuccaaaucugaa

SEQ ID NO: 766947 - RNA, 18 nt, Leptospira interrogans serovar lai str. 56601
aauccgcggauguuugaa

SEQ ID NO: 766948 - RNA, 16 nt, Leptospira interrogans serovar lai str. 56601
aauccgaaaaaccuug

SEQ ID NO: 766949 - RNA, 14 nt, Leptospira interrogans serovar lai str. 56601
aaucugaaaaagag

SEQ ID NO: 766950 - RNA, 12 nt, Leptospira interrogans serovar lai str. 56601
aaucugaaauag

SEQ ID NO: 766951 - RNA, 13 nt, Leptospira interrogans serovar lai str. 56601
aaucugaaauuca

SEQ ID NO: 766952 - RNA, 19 nt, Leptospira interrogans serovar lai str. 56601
aaucugaaauucaucaaau

SEQ ID NO: 766953 - RNA, 14 nt, Leptospira interrogans serovar lai str. 56601
aaucugaaccugca

SEQ ID NO: 766954 - RNA, 18 nt, Leptospira interrogans serovar lai str. 56601
aaucugcaaagcucagau

SEQ ID NO: 766955 - RNA, 16 nt, Leptospira interrogans serovar lai str. 56601
aaucugauugagaaaa

SEQ ID NO: 766956 - RNA, 19 nt, Leptospira interrogans serovar lai str. 56601
aaucugcugaauuuaccuc

SEQ ID NO: 766957 - RNA, 15 nt, Leptospira interrogans serovar lai str. 56601
aaucugcaucuuuuc

SEQ ID NO: 766958 - RNA, 16 nt, Leptospira interrogans serovar lai str. 56601
aaucugggcaaauuua

SEQ ID NO: 766959 - RNA, 19 nt, Leptospira interrogans serovar lai str. 56601
aaucuggaagccaaaacca

SEQ ID NO: 766960 - RNA, 22 nt, Leptospira interrogans serovar lai str. 56601
aaucugugggaacuaucacaaa

SEQ ID NO: 766961 - RNA, 19 nt, Leptospira interrogans serovar lai str. 56601
aaucuguggacuuaugaga

SEQ ID NO: 766962 - RNA, 17 nt, Leptospira interrogans serovar lai str. 56601
aaucuuaauaaaauuuu

SEQ ID NO: 766963 - RNA, 20 nt, Leptospira interrogans serovar lai str. 56601
aaucuguuuuaucuuagauc

SEQ ID NO: 766964 - RNA, 12 nt, Leptospira interrogans serovar lai str. 56601
aaucuuaaaaag

SEQ ID NO: 766965 - RNA, 16 nt, Leptospira interrogans serovar lai str. 56601
aaucuuaaaaagagua

SEQ ID NO: 766966 - RNA, 18 nt, Leptospira interrogans serovar lai str. 56601
aaucuuaaaaagaguauu

SEQ ID NO: 766967 - RNA, 17 nt, Leptospira interrogans serovar lai str. 56601
aaucuuaaaucuuuaaa

SEQ ID NO: 766968 - RNA, 17 nt, Leptospira interrogans serovar lai str. 56601
aaucuuagaauguggga

SEQ ID NO: 766969 - RNA, 17 nt, Leptospira interrogans serovar lai str. 56601
aaucuuaauauuucucu

SEQ ID NO: 766970 - RNA, 14 nt, Leptospira interrogans serovar lai str. 56601
aaucuguucuuacu

SEQ ID NO: 766971 - RNA, 19 nt, Leptospira interrogans serovar lai str. 56601
aaucuuauucaauaaaaua

SEQ ID NO: 766972 - RNA, 23 nt, Leptospira interrogans serovar lai str. 56601
aaucuuauucaauaaaauaccau

SEQ ID NO: 766973 - RNA, 18 nt, Leptospira interrogans serovar lai str. 56601
aaucuuccgcauuuuuau

SEQ ID NO: 766974 - RNA, 23 nt, Leptospira interrogans serovar lai str. 56601
aaucuuccugggaaguuguaucc

SEQ ID NO: 766975 - RNA, 22 nt, Leptospira interrogans serovar lai str. 56601
aaucuucgguuuaauauacuaa

SEQ ID NO: 766976 - RNA, 11 nt, Leptospira interrogans serovar lai str. 56601
aaucuacaaaa

SEQ ID NO: 766977 - RNA, 14 nt, Leptospira interrogans serovar lai str. 56601
aaucuaauucuucu

SEQ ID NO: 766978 - RNA, 19 nt, Leptospira interrogans serovar lai str. 56601
aaucuaagaucaacacaaa

SEQ ID NO: 766979 - RNA, 20 nt, Leptospira interrogans serovar lai str. 56601
aaucguguuugagauuaaaa

SEQ ID NO: 766980 - RNA, 21 nt, Leptospira interrogans serovar lai str. 56601
aaucguguuugagauuaaaaa

SEQ ID NO: 766981 - RNA, 15 nt, Leptospira interrogans serovar lai str. 56601
aaucuacuuguaucu

SEQ ID NO: 766982 - RNA, 12 nt, Leptospira interrogans serovar lai str. 56601
aaucucuuaauc

SEQ ID NO: 766983 - RNA, 18 nt, Leptospira interrogans serovar lai str. 56601
aaucucugauaauuuuuu

SEQ ID NO: 766984 - RNA, 20 nt, Leptospira interrogans serovar lai str. 56601
aaucuauuguaauaaaucga

SEQ ID NO: 766985 - RNA, 20 nt, Leptospira interrogans serovar lai str. 56601
aaucuauuuuugauuuuaga

SEQ ID NO: 766986 - RNA, 19 nt, Leptospira interrogans serovar lai str. 56601
aaucucaauucaguaaauu

SEQ ID NO: 766987 - RNA, 15 nt, Leptospira interrogans serovar lai str. 56601
aaaaauuguugaaga

SEQ ID NO: 766988 - RNA, 19 nt, Leptospira interrogans serovar lai str. 56601
aaaaauuguugaagaauua

SEQ ID NO: 766989 - RNA, 16 nt, Leptospira interrogans serovar lai str. 56601
aaaaauuguaaacuuc

SEQ ID NO: 766990 - RNA, 14 nt, Leptospira interrogans serovar lai str. 56601
aaaaauugucuuuc

SEQ ID NO: 766991 - RNA, 13 nt, Leptospira interrogans serovar lai str. 56601
aaaaauuuaauuu

SEQ ID NO: 766992 - RNA, 22 nt, Leptospira interrogans serovar lai str. 56601
aaaaauuuauaaagacuuuaaa

SEQ ID NO: 766993 - RNA, 15 nt, Leptospira interrogans serovar lai str. 56601
aaaaauuuauucucu

SEQ ID NO: 766994 - RNA, 18 nt, Leptospira interrogans serovar lai str. 56601
aaucgucgcucaaucaaa

SEQ ID NO: 766995 - RNA, 18 nt, Leptospira interrogans serovar lai str. 56601
aaucguccaaucucuuuc

SEQ ID NO: 766996 - RNA, 16 nt, Leptospira interrogans serovar lai str. 56601
aaaaauugagauaggu

SEQ ID NO: 766997 - RNA, 21 nt, Leptospira interrogans serovar lai str. 56601
aaaaauucugucguaaaaagu

SEQ ID NO: 766998 - RNA, 20 nt, Leptospira interrogans serovar lai str. 56601
aaucgcagguugcaauccaa

SEQ ID NO: 766999 - RNA, 13 nt, Leptospira interrogans serovar lai str. 56601
aaucgauuugauc

SEQ ID NO: 767000 - RNA, 21 nt, Leptospira interrogans serovar lai str. 56601
aaucgauuucuaaauugugag

SEQ ID NO: 767001 - RNA, 19 nt, Leptospira interrogans serovar lai str. 56601
aaucgauuacucuuugaga

SEQ ID NO: 767002 - RNA, 14 nt, Leptospira interrogans serovar lai str. 56601
aauauucaaauuuu

SEQ ID NO: 767003 - RNA, 14 nt, Leptospira interrogans serovar lai str. 56601
aauauuauuuuaac

SEQ ID NO: 767004 - RNA, 16 nt, Leptospira interrogans serovar lai str. 56601
aauauuauuaaauuuu

SEQ ID NO: 767005 - RNA, 18 nt, Leptospira interrogans serovar lai str. 56601
aauauuauuaaauuuuua

SEQ ID NO: 767006 - RNA, 14 nt, Leptospira interrogans serovar lai str. 56601
aauauucaacuuuu

SEQ ID NO: 767007 - RNA, 20 nt, Leptospira interrogans serovar lai str. 56601
aauauucaacuuuuugaaga

SEQ ID NO: 767008 - RNA, 22 nt, Leptospira interrogans serovar lai str. 56601
aauauucaacuuuuugaagaaa

SEQ ID NO: 767009 - RNA, 13 nt, Leptospira interrogans serovar lai str. 56601
aauauucacuuuu

SEQ ID NO: 767010 - RNA, 20 nt, Leptospira interrogans serovar lai str. 56601
aauauucuaauuuuauaaau

SEQ ID NO: 767011 - RNA, 14 nt, Leptospira interrogans serovar lai str. 56601
aauauucuugauug

SEQ ID NO: 767012 - RNA, 14 nt, Leptospira interrogans serovar lai str. 56601
aauauucuuuuuag

SEQ ID NO: 767013 - RNA, 20 nt, Leptospira interrogans serovar lai str. 56601
aauauugagcuaauucuuaa

SEQ ID NO: 767014 - RNA, 12 nt, Leptospira interrogans serovar lai str. 56601
aauauucuuuua

SEQ ID NO: 767015 - RNA, 22 nt, Leptospira interrogans serovar lai str. 56601
aauauuguauuacacuucuuuu

SEQ ID NO: 767016 - RNA, 22 nt, Leptospira interrogans serovar lai str. 56601
aauauuggguauuuauuauaua

SEQ ID NO: 767017 - RNA, 18 nt, Leptospira interrogans serovar lai str. 56601
aauauuugcauaaacuuc

SEQ ID NO: 767018 - RNA, 17 nt, Leptospira interrogans serovar lai str. 56601
aauauuuuaaagaaacu

SEQ ID NO: 767019 - RNA, 16 nt, Leptospira interrogans serovar lai str. 56601
aauauuuuguuuugaa

SEQ ID NO: 767020 - RNA, 20 nt, Leptospira interrogans serovar lai str. 56601
aauauuuuuauguauuuuaa

SEQ ID NO: 767021 - RNA, 22 nt, Leptospira interrogans serovar lai str. 56601
aauauuuuuuccaaaaagaaaa

SEQ ID NO: 767022 - RNA, 13 nt, Leptospira interrogans serovar lai str. 56601
aaucaaaaaaguc

SEQ ID NO: 767023 - RNA, 16 nt, Leptospira interrogans serovar lai str. 56601
aauauuuauuacaaag

SEQ ID NO: 767024 - RNA, 22 nt, Leptospira interrogans serovar lai str. 56601
aauauuuagaauaaaauuugau

SEQ ID NO: 767025 - RNA, 11 nt, Leptospira interrogans serovar lai str. 56601
aauauuuaaaa

SEQ ID NO: 767026 - RNA, 13 nt, Leptospira interrogans serovar lai str. 56601
aauauuucaaaaa

SEQ ID NO: 767027 - RNA, 14 nt, Leptospira interrogans serovar lai str. 56601
aauauuucaaaaau

SEQ ID NO: 767028 - RNA, 15 nt, Leptospira interrogans serovar lai str. 56601
aauauuucaaaaauu

SEQ ID NO: 767029 - RNA, 18 nt, Leptospira interrogans serovar lai str. 56601
aauauuaauuuaaaaaca

SEQ ID NO: 767030 - RNA, 13 nt, Leptospira interrogans serovar lai str. 56601
aauauuagaauug

SEQ ID NO: 767031 - RNA, 14 nt, Leptospira interrogans serovar lai str. 56601
aauauuaugaaaua

SEQ ID NO: 767032 - RNA, 15 nt, Leptospira interrogans serovar lai str. 56601
aauauuaugaaauaa

SEQ ID NO: 767033 - RNA, 13 nt, Leptospira interrogans serovar lai str. 56601
aauauuauaaaua

SEQ ID NO: 767034 - RNA, 21 nt, Leptospira interrogans serovar lai str. 56601
aauauuauaaauuuaaaaaac

SEQ ID NO: 767035 - RNA, 22 nt, Leptospira interrogans serovar lai str. 56601
aauauuauaaauuuaaaaaacc

SEQ ID NO: 767036 - RNA, 14 nt, Leptospira interrogans serovar lai str. 56601
aauauuauuauauu

SEQ ID NO: 767037 - RNA, 15 nt, Leptospira interrogans serovar lai str. 56601
aauauuauuauauuu

SEQ ID NO: 767038 - RNA, 18 nt, Leptospira interrogans serovar lai str. 56601
aauauuauuauauuuaaa

SEQ ID NO: 767039 - RNA, 24 nt, Leptospira interrogans serovar lai str. 56601
aauauuauuauauuuaaauguuau

SEQ ID NO: 767040 - RNA, 21 nt, Leptospira interrogans serovar lai str. 56601
aauauuauauuuuuaaaaagu

SEQ ID NO: 767041 - RNA, 20 nt, Leptospira interrogans serovar lai str. 56601
aauauuaaauuuuauuuaua

SEQ ID NO: 767042 - RNA, 21 nt, Leptospira interrogans serovar lai str. 56601
aauauuaaauuuuauuuauau

SEQ ID NO: 767043 - RNA, 23 nt, Leptospira interrogans serovar lai str. 56601
aauauuaaguuuuuuaaauuuac

SEQ ID NO: 767044 - RNA, 22 nt, Leptospira interrogans serovar lai str. 56601
aauauguuuagaguauuauaaa

SEQ ID NO: 767045 - RNA, 11 nt, Leptospira interrogans serovar lai str. 56601
aauauuaaaaa

SEQ ID NO: 767046 - RNA, 13 nt, Leptospira interrogans serovar lai str. 56601
aauauuaaaaaca

SEQ ID NO: 767047 - RNA, 15 nt, Leptospira interrogans serovar lai str. 56601
aauauuaaaaacaca

SEQ ID NO: 767048 - RNA, 15 nt, Leptospira interrogans serovar lai str. 56601
aauauuaaaacacuu

SEQ ID NO: 767049 - RNA, 20 nt, Leptospira interrogans serovar lai str. 56601
aauagaguuacagaaaaaau

SEQ ID NO: 767050 - RNA, 16 nt, Leptospira interrogans serovar lai str. 56601
aaucaaauuucugcau

SEQ ID NO: 767051 - RNA, 17 nt, Leptospira interrogans serovar lai str. 56601
aaucaaauuucugcauc

SEQ ID NO: 767052 - RNA, 20 nt, Leptospira interrogans serovar lai str. 56601
aaucaaauuucugcaucaaa

SEQ ID NO: 767053 - RNA, 22 nt, Leptospira interrogans serovar lai str. 56601
aaucaaauuucugcaugaaauu

SEQ ID NO: 767054 - RNA, 13 nt, Leptospira interrogans serovar lai str. 56601
aaucaaauuuuug

SEQ ID NO: 767055 - RNA, 14 nt, Leptospira interrogans serovar lai str. 56601
aaucaaauuuuugc

SEQ ID NO: 767056 - RNA, 20 nt, Leptospira interrogans serovar lai str. 56601
aaucaaaagguauaaaauaa

SEQ ID NO: 767057 - RNA, 17 nt, Leptospira interrogans serovar lai str. 56601
aaucaaaaggaauacaa

SEQ ID NO: 767058 - RNA, 14 nt, Leptospira interrogans serovar lai str. 56601
aaucaaaaugaacu

SEQ ID NO: 767059 - RNA, 18 nt, Leptospira interrogans serovar lai str. 56601
aaucaaaaugaacucaac

SEQ ID NO: 767060 - RNA, 24 nt, Leptospira interrogans serovar lai str. 56601
aaucaaagauauuucaauauaaaa

SEQ ID NO: 767061 - RNA, 13 nt, Leptospira interrogans serovar lai str. 56601
aaucaaaggaaau

SEQ ID NO: 767062 - RNA, 13 nt, Leptospira interrogans serovar lai str. 56601
aaucaaauacaaa

SEQ ID NO: 767063 - RNA, 16 nt, Leptospira interrogans serovar lai str. 56601
aaucaaauacaaaaac

SEQ ID NO: 767064 - RNA, 19 nt, Leptospira interrogans serovar lai str. 56601
aaucaaauacaaaaacgau

SEQ ID NO: 767065 - RNA, 18 nt, Leptospira interrogans serovar lai str. 56601
aaucaagagaacucauua

SEQ ID NO: 767066 - RNA, 12 nt, Leptospira interrogans serovar lai str. 56601
aaucaagagcug

SEQ ID NO: 767067 - RNA, 13 nt, Leptospira interrogans serovar lai str. 56601
aaucaacuuuucc

SEQ ID NO: 767068 - RNA, 14 nt, Leptospira interrogans serovar lai str. 56601
aaucaauuuuaaau

SEQ ID NO: 767069 - RNA, 12 nt, Leptospira interrogans serovar lai str. 56601
aaucacaaaaaa

SEQ ID NO: 767070 - RNA, 17 nt, Leptospira interrogans serovar lai str. 56601
aaucaaucauauuuuaa

SEQ ID NO: 767071 - RNA, 14 nt, Leptospira interrogans serovar lai str. 56601
aaucaauaggaaag

SEQ ID NO: 767072 - RNA, 23 nt, Leptospira interrogans serovar lai str. 56601
aaucacaauuuuacaaacaaauu

SEQ ID NO: 767073 - RNA, 19 nt, Leptospira interrogans serovar lai str. 56601
aaucacauccaacccaaac

SEQ ID NO: 767074 - RNA, 22 nt, Leptospira interrogans serovar lai str. 56601
aaucacauccaacccaaacaca

SEQ ID NO: 767075 - RNA, 20 nt, Leptospira interrogans serovar lai str. 56601
aaucaccuuuuacuucauau

SEQ ID NO: 767076 - RNA, 16 nt, Leptospira interrogans serovar lai str. 56601
aaucacgaaaaaugaa

SEQ ID NO: 767077 - RNA, 21 nt, Leptospira interrogans serovar lai str. 56601
aaucacgauuuuacaaacaaa

SEQ ID NO: 767078 - RNA, 19 nt, Leptospira interrogans serovar lai str. 56601
aaucagaaugaacucaaca

SEQ ID NO: 767079 - RNA, 19 nt, Leptospira interrogans serovar lai str. 56601
aauuauaguuuuauuagaa

SEQ ID NO: 767080 - RNA, 14 nt, Leptospira interrogans serovar lai str. 56601
aauuauauuaaauu

SEQ ID NO: 767081 - RNA, 16 nt, Leptospira interrogans serovar lai str. 56601
aauuauauucuuauau

SEQ ID NO: 767082 - RNA, 14 nt, Leptospira interrogans serovar lai str. 56601
aauuauauuuugag

SEQ ID NO: 767083 - RNA, 22 nt, Leptospira interrogans serovar lai str. 56601
aauuaucguguaaaauuuuuug

SEQ ID NO: 767084 - RNA, 15 nt, Leptospira interrogans serovar lai str. 56601
aauuauccuuaaaau

SEQ ID NO: 767085 - RNA, 16 nt, Leptospira interrogans serovar lai str. 56601
aauuauccuuaaaaug

SEQ ID NO: 767086 - RNA, 18 nt, Leptospira interrogans serovar lai str. 56601
aauuaacggucaauuuua

SEQ ID NO: 767087 - RNA, 18 nt, Leptospira interrogans serovar lai str. 56601
aauuauagauaauuuuua

SEQ ID NO: 767088 - RNA, 16 nt, Leptospira interrogans serovar lai str. 56601
aauuauaaaauuuuuc

SEQ ID NO: 767089 - RNA, 18 nt, Leptospira interrogans serovar lai str. 56601
aauuauaaaauuuuucuc

SEQ ID NO: 767090 - RNA, 23 nt, Leptospira interrogans serovar lai str. 56601
aauuaagcagaagcuuuauuaaa

SEQ ID NO: 767091 - RNA, 21 nt, Leptospira interrogans serovar lai str. 56601
aauuauuuacuuuuuccaaaa

SEQ ID NO: 767092 - RNA, 18 nt, Leptospira interrogans serovar lai str. 56601
aauuauugauaaaaaaau

SEQ ID NO: 767093 - RNA, 19 nt, Leptospira interrogans serovar lai str. 56601
aauuauugauaaaaaaaug

SEQ ID NO: 767094 - RNA, 21 nt, Leptospira interrogans serovar lai str. 56601
aauuauugauaaaaaaauguu

SEQ ID NO: 767095 - RNA, 14 nt, Leptospira interrogans serovar lai str. 56601
aauuauugauauua

SEQ ID NO: 767096 - RNA, 18 nt, Leptospira interrogans serovar lai str. 56601
aauucacucuuaaauacu

SEQ ID NO: 767097 - RNA, 19 nt, Leptospira interrogans serovar lai str. 56601
aauucagaaaaaaaaagaa

SEQ ID NO: 767098 - RNA, 22 nt, Leptospira interrogans serovar lai str. 56601
aauucagaaaaaaaaagaauuu

SEQ ID NO: 767099 - RNA, 18 nt, Leptospira interrogans serovar lai str. 56601
aauucacgaccuuaaaua

SEQ ID NO: 767100 - RNA, 21 nt, Leptospira interrogans serovar lai str. 56601
aauucacgaccuuaaauaaua

SEQ ID NO: 767101 - RNA, 21 nt, Leptospira interrogans serovar lai str. 56601
aauuauuuauuucaauacaac

SEQ ID NO: 767102 - RNA, 23 nt, Leptospira interrogans serovar lai str. 56601
aauucagauuucagcuccaaaaa

SEQ ID NO: 767103 - RNA, 18 nt, Leptospira interrogans serovar lai str. 56601
aauucuccaauagaauug

SEQ ID NO: 767104 - RNA, 15 nt, Leptospira interrogans serovar lai str. 56601
aauucuccaucuguu

SEQ ID NO: 767105 - RNA, 19 nt, Leptospira interrogans serovar lai str. 56601
aauucuccauuuguuucua

SEQ ID NO: 767106 - RNA, 23 nt, Leptospira interrogans serovar lai str. 56601
aauucuccguuaugcaugaauuu

SEQ ID NO: 767107 - RNA, 19 nt, Leptospira interrogans serovar lai str. 56601
aauucuccuccugaaaauu

SEQ ID NO: 767108 - RNA, 21 nt, Leptospira interrogans serovar lai str. 56601
aauucuccuccugaaaauuuu

SEQ ID NO: 767109 - RNA, 13 nt, Leptospira interrogans serovar lai str. 56601
aauucucuucguu

SEQ ID NO: 767110 - RNA, 14 nt, Leptospira interrogans serovar lai str. 56601
aauucucuuuugac

SEQ ID NO: 767111 - RNA, 19 nt, Leptospira interrogans serovar lai str. 56601
aauucucuuuuugggaauu

SEQ ID NO: 767112 - RNA, 16 nt, Leptospira interrogans serovar lai str. 56601
aauucugaaagaguua

SEQ ID NO: 767113 - RNA, 19 nt, Leptospira interrogans serovar lai str. 56601
aauuccuuccaaguuuuug

SEQ ID NO: 767114 - RNA, 22 nt, Leptospira interrogans serovar lai str. 56601
aauuccuucguuuuguugugaa

SEQ ID NO: 767115 - RNA, 19 nt, Leptospira interrogans serovar lai str. 56601
aauuccuguaguauuucca

SEQ ID NO: 767116 - RNA, 21 nt, Leptospira interrogans serovar lai str. 56601
aauucuagaaagaauuuaaua

SEQ ID NO: 767117 - RNA, 16 nt, Leptospira interrogans serovar lai str. 56601
aauucgaguaguuaau

SEQ ID NO: 767118 - RNA, 19 nt, Leptospira interrogans serovar lai str. 56601
aauucgaauuccuauucag

SEQ ID NO: 767119 - RNA, 18 nt, Leptospira interrogans serovar lai str. 56601
aauuccacuucucacaaa

SEQ ID NO: 767120 - RNA, 20 nt, Leptospira interrogans serovar lai str. 56601
aauucauuguaagaaauaug

SEQ ID NO: 767121 - RNA, 13 nt, Leptospira interrogans serovar lai str. 56601
aauucauuuuucu

SEQ ID NO: 767122 - RNA, 20 nt, Leptospira interrogans serovar lai str. 56601
aauucauuuuucugaaaaaa

SEQ ID NO: 767123 - RNA, 20 nt, Leptospira interrogans serovar lai str. 56601
aauuccaccuuggaaagaaa

SEQ ID NO: 767124 - RNA, 14 nt, Leptospira interrogans serovar lai str. 56601
aauuccccaaaaug

SEQ ID NO: 767125 - RNA, 13 nt, Leptospira interrogans serovar lai str. 56601
aauucaguaaauu

SEQ ID NO: 767126 - RNA, 15 nt, Leptospira interrogans serovar lai str. 56601
aauucaucuaaaaaa

SEQ ID NO: 767127 - RNA, 20 nt, Leptospira interrogans serovar lai str. 56601
aauucaucaaauuugcuuca

SEQ ID NO: 767128 - RNA, 13 nt, Leptospira interrogans serovar lai str. 56601
aauucauaauaaa

SEQ ID NO: 767129 - RNA, 17 nt, Leptospira interrogans serovar lai str. 56601
aauucauaauaaaacua

SEQ ID NO: 767130 - RNA, 14 nt, Leptospira interrogans serovar lai str. 56601
aauucauacuuuua

SEQ ID NO: 767131 - RNA, 16 nt, Leptospira interrogans serovar lai str. 56601
aauucauacuuuuaaa

SEQ ID NO: 767132 - RNA, 17 nt, Leptospira interrogans serovar lai str. 56601
aauucaugauaguuaau

SEQ ID NO: 767133 - RNA, 18 nt, Leptospira interrogans serovar lai str. 56601
aauucauuuaccuaaaau

SEQ ID NO: 767134 - RNA, 19 nt, Leptospira interrogans serovar lai str. 56601
aauucauuuggaucuguaa

SEQ ID NO: 767135 - RNA, 23 nt, Leptospira interrogans serovar lai str. 56601
aauucauuuuacagaauauuaaa

SEQ ID NO: 767136 - RNA, 17 nt, Leptospira interrogans serovar lai str. 56601
aauucauuccuauaaau

SEQ ID NO: 767137 - RNA, 12 nt, Leptospira interrogans serovar lai str. 56601
aauuuaaguauu

SEQ ID NO: 767138 - RNA, 15 nt, Leptospira interrogans serovar lai str. 56601
aauuuaaguauuaua

SEQ ID NO: 767139 - RNA, 18 nt, Leptospira interrogans serovar lai str. 56601
aauuuaagauuacucuac

SEQ ID NO: 767140 - RNA, 16 nt, Leptospira interrogans serovar lai str. 56601
aauuuaauaaaaaaau

SEQ ID NO: 767141 - RNA, 16 nt, Leptospira interrogans serovar lai str. 56601
aauuuaauacaauauu

SEQ ID NO: 767142 - RNA, 15 nt, Leptospira interrogans serovar lai str. 56601
aauuuaccaguuaaa

SEQ ID NO: 767143 - RNA, 18 nt, Leptospira interrogans serovar lai str. 56601
aauuuaggaagcguuuua

SEQ ID NO: 767144 - RNA, 16 nt, Leptospira interrogans serovar lai str. 56601
aauuuaauuugaucau

SEQ ID NO: 767145 - RNA, 14 nt, Leptospira interrogans serovar lai str. 56601
aauuuaauuuuuua

SEQ ID NO: 767146 - RNA, 22 nt, Leptospira interrogans serovar lai str. 56601
aauuuacaguuaaacuuugaaa

SEQ ID NO: 767147 - RNA, 20 nt, Leptospira interrogans serovar lai str. 56601
aauuuacaucauguaauaua

SEQ ID NO: 767148 - RNA, 21 nt, Leptospira interrogans serovar lai str. 56601
aauuuacaucauguaauauaa

SEQ ID NO: 767149 - RNA, 17 nt, Leptospira interrogans serovar lai str. 56601
aauuguuguuauggaau

SEQ ID NO: 767150 - RNA, 22 nt, Leptospira interrogans serovar lai str. 56601
aauuguuguuauggaauuuuuc

SEQ ID NO: 767151 - RNA, 23 nt, Leptospira interrogans serovar lai str. 56601
aauuguuguuauggaauuuuuca

SEQ ID NO: 767152 - RNA, 22 nt, Leptospira interrogans serovar lai str. 56601
aauuguugcuauggaauuuuuc

SEQ ID NO: 767153 - RNA, 14 nt, Leptospira interrogans serovar lai str. 56601
aauuguugaaaaau

SEQ ID NO: 767154 - RNA, 15 nt, Leptospira interrogans serovar lai str. 56601
aauuguugaaaaauu

SEQ ID NO: 767155 - RNA, 18 nt, Leptospira interrogans serovar lai str. 56601
aauuguugaaaaauuaau

SEQ ID NO: 767156 - RNA, 16 nt, Leptospira interrogans serovar lai str. 56601
aauuguugaagaauua

SEQ ID NO: 767157 - RNA, 15 nt, Leptospira interrogans serovar lai str. 56601
aauuguuugaaaguu

SEQ ID NO: 767158 - RNA, 11 nt, Leptospira interrogans serovar lai str. 56601
aauuguuugau

SEQ ID NO: 767159 - RNA, 16 nt, Leptospira interrogans serovar lai str. 56601
aauuguuuuaaaacuu

SEQ ID NO: 767160 - RNA, 14 nt, Leptospira interrogans serovar lai str. 56601
aauuuaaaaaugaa

SEQ ID NO: 767161 - RNA, 13 nt, Leptospira interrogans serovar lai str. 56601
aauuguuuuuaaa

SEQ ID NO: 767162 - RNA, 17 nt, Leptospira interrogans serovar lai str. 56601
aauuguuuuuaaauacu

SEQ ID NO: 767163 - RNA, 11 nt, Leptospira interrogans serovar lai str. 56601
aauuuaaaaaa

SEQ ID NO: 767164 - RNA, 17 nt, Leptospira interrogans serovar lai str. 56601
aauuuaaaaaaaucacu

SEQ ID NO: 767165 - RNA, 16 nt, Leptospira interrogans serovar lai str. 56601
aauuuaaaaaagaaga

SEQ ID NO: 767166 - RNA, 16 nt, Leptospira interrogans serovar lai str. 56601
aauuuaaacaacagua

SEQ ID NO: 767167 - RNA, 17 nt, Leptospira interrogans serovar lai str. 56601
aauuuaaaauaauugau

SEQ ID NO: 767168 - RNA, 21 nt, Leptospira interrogans serovar lai str. 56601
aauuuaaaauaauugauuaga

SEQ ID NO: 767169 - RNA, 13 nt, Leptospira interrogans serovar lai str. 56601
aauuuaaaauaua

SEQ ID NO: 767170 - RNA, 20 nt, Leptospira interrogans serovar lai str. 56601
aauuuaaaaucguaaaaaag

SEQ ID NO: 767171 - RNA, 15 nt, Leptospira interrogans serovar lai str. 56601
aauugugagaacuac

SEQ ID NO: 767172 - RNA, 17 nt, Leptospira interrogans serovar lai str. 56601
aauugugagaacuacuu

SEQ ID NO: 767173 - RNA, 22 nt, Leptospira interrogans serovar lai str. 56601
aauuguccauuuccauaaaaua

SEQ ID NO: 767174 - RNA, 19 nt, Leptospira interrogans serovar lai str. 56601
aauuguccguuucaauaca

SEQ ID NO: 767175 - RNA, 23 nt, Leptospira interrogans serovar lai str. 56601
aauugucaugauucauuuuuuga

SEQ ID NO: 767176 - RNA, 17 nt, Leptospira interrogans serovar lai str. 56601
aauuguguuaguuccca

SEQ ID NO: 767177 - RNA, 22 nt, Leptospira interrogans serovar lai str. 56601
aauugugggaacuauuacaaaa

SEQ ID NO: 767178 - RNA, 20 nt, Leptospira interrogans serovar lai str. 56601
aauugugggaacuauuauaa

SEQ ID NO: 767179 - RNA, 16 nt, Leptospira interrogans serovar lai str. 56601
aauuguggguuguaua

SEQ ID NO: 767180 - RNA, 14 nt, Leptospira interrogans serovar lai str. 56601
aauuguguaugagu

SEQ ID NO: 767181 - RNA, 15 nt, Leptospira interrogans serovar lai str. 56601
aauuguguaugaguu

SEQ ID NO: 767182 - RNA, 20 nt, Leptospira interrogans serovar lai str. 56601
aauuguuccgaauuaaaaau

SEQ ID NO: 767183 - RNA, 19 nt, Leptospira interrogans serovar lai str. 56601
aauuguucguuucuuaauu

SEQ ID NO: 767184 - RNA, 23 nt, Leptospira interrogans serovar lai str. 56601
aauuguucguuucuuaauuuuac

SEQ ID NO: 767185 - RNA, 22 nt, Leptospira interrogans serovar lai str. 56601
aauuguuaucgcuaauacaaaa

SEQ ID NO: 767186 - RNA, 17 nt, Leptospira interrogans serovar lai str. 56601
aauuguaaaaggagaau

SEQ ID NO: 767187 - RNA, 14 nt, Leptospira interrogans serovar lai str. 56601
aauuguaaaaaacc

SEQ ID NO: 767188 - RNA, 23 nt, Leptospira interrogans serovar lai str. 56601
aauuguaaaaaaccgucccaaaa

SEQ ID NO: 767189 - RNA, 18 nt, Leptospira interrogans serovar lai str. 56601
aauuguagaaacuuauac

SEQ ID NO: 767190 - RNA, 17 nt, Leptospira interrogans serovar lai str. 56601
aauuguaggaacuacua

SEQ ID NO: 767191 - RNA, 15 nt, Leptospira interrogans serovar lai str. 56601
aauuguauccgaaaa

SEQ ID NO: 767192 - RNA, 16 nt, Leptospira interrogans serovar lai str. 56601
aauuguauccgaaaaa

SEQ ID NO: 767193 - RNA, 22 nt, Leptospira interrogans serovar lai str. 56601
aauuguaugaaagaaacauaau

SEQ ID NO: 767194 - RNA, 14 nt, Leptospira interrogans serovar lai str. 56601
aauuguauuuuccc

SEQ ID NO: 767195 - RNA, 16 nt, Leptospira interrogans serovar lai str. 56601
aauugaacauuuuuaa

SEQ ID NO: 767196 - RNA, 19 nt, Leptospira interrogans serovar lai str. 56601
aauugaaaguaaagaugau

SEQ ID NO: 767197 - RNA, 18 nt, Leptospira interrogans serovar lai str. 56601
aauucuuuuccaaaaacu

SEQ ID NO: 767198 - RNA, 23 nt, Leptospira interrogans serovar lai str. 56601
aauucuuuugcauaguuuuaugu

SEQ ID NO: 767199 - RNA, 18 nt, Leptospira interrogans serovar lai str. 56601
aauucuuuuuauuuuuac

SEQ ID NO: 767200 - RNA, 12 nt, Leptospira interrogans serovar lai str. 56601
aaaacaaauuaa

SEQ ID NO: 767201 - RNA, 23 nt, Leptospira interrogans serovar lai str. 56601
aaaacaaauuaaguuuaaaaaca

SEQ ID NO: 767202 - RNA, 20 nt, Leptospira interrogans serovar lai str. 56601
aaaacaagcucaauuuugaa

SEQ ID NO: 767203 - RNA, 21 nt, Leptospira interrogans serovar lai str. 56601
aauuggguauaagaagauuuu

SEQ ID NO: 767204 - RNA, 19 nt, Leptospira interrogans serovar lai str. 56601
aauguuuuccagaaaccau

SEQ ID NO: 767205 - RNA, 11 nt, Leptospira interrogans serovar lai str. 56601
aauuaaaaaac

SEQ ID NO: 767206 - RNA, 23 nt, Leptospira interrogans serovar lai str. 56601
aauguuuuuauaucuuaauuaaa

SEQ ID NO: 767207 - RNA, 12 nt, Leptospira interrogans serovar lai str. 56601
aauuaaaaagau

SEQ ID NO: 767208 - RNA, 11 nt, Leptospira interrogans serovar lai str. 56601
aauuaaaaauu

SEQ ID NO: 767209 - RNA, 19 nt, Leptospira interrogans serovar lai str. 56601
aauuaaaaaacuuuuuaaa

SEQ ID NO: 767210 - RNA, 17 nt, Leptospira interrogans serovar lai str. 56601
aauuaaaaaagagaaag

SEQ ID NO: 767211 - RNA, 20 nt, Leptospira interrogans serovar lai str. 56601
aauuaaaaaagagaaagaaa

SEQ ID NO: 767212 - RNA, 23 nt, Leptospira interrogans serovar lai str. 56601
aauuaaaaaagagaaagaaaaag

SEQ ID NO: 767213 - RNA, 14 nt, Leptospira interrogans serovar lai str. 56601
aauguuuaaagaau

SEQ ID NO: 767214 - RNA, 19 nt, Leptospira interrogans serovar lai str. 56601
aauguuugagguuuuaaaa

SEQ ID NO: 767215 - RNA, 15 nt, Leptospira interrogans serovar lai str. 56601
aauguugaaugaaac

SEQ ID NO: 767216 - RNA, 18 nt, Leptospira interrogans serovar lai str. 56601
aauguuguuaaauuuuuc

SEQ ID NO: 767217 - RNA, 15 nt, Leptospira interrogans serovar lai str. 56601
aauguugcuccuugc

SEQ ID NO: 767218 - RNA, 22 nt, Leptospira interrogans serovar lai str. 56601
aauuaaauucuacauuugauau

SEQ ID NO: 767219 - RNA, 16 nt, Leptospira interrogans serovar lai str. 56601
aauuaaacuuuuauaa

SEQ ID NO: 767220 - RNA, 20 nt, Leptospira interrogans serovar lai str. 56601
aauuaaacuuuuauaaaauc

SEQ ID NO: 767221 - RNA, 19 nt, Leptospira interrogans serovar lai str. 56601
aauuaaacuucaaaaaaua

SEQ ID NO: 767222 - RNA, 15 nt, Leptospira interrogans serovar lai str. 56601
aauuaaacaaagaau

SEQ ID NO: 767223 - RNA, 12 nt, Leptospira interrogans serovar lai str. 56601
aauuaaaauuua

SEQ ID NO: 767224 - RNA, 16 nt, Leptospira interrogans serovar lai str. 56601
aaugucguuaaauuuu

SEQ ID NO: 767225 - RNA, 23 nt, Leptospira interrogans serovar lai str. 56601
aaugugacggcaaugugcaaagg

SEQ ID NO: 767226 - RNA, 11 nt, Leptospira interrogans serovar lai str. 56601
aaugugagagu

SEQ ID NO: 767227 - RNA, 16 nt, Leptospira interrogans serovar lai str. 56601
aaugugagaguuccca

SEQ ID NO: 767228 - RNA, 13 nt, Leptospira interrogans serovar lai str. 56601
aaugucaaaaaaa

SEQ ID NO: 767229 - RNA, 19 nt, Leptospira interrogans serovar lai str. 56601
aauguauuuaguuuuuuga

SEQ ID NO: 767230 - RNA, 15 nt, Leptospira interrogans serovar lai str. 56601
aauguuaauuuagaa

SEQ ID NO: 767231 - RNA, 21 nt, Leptospira interrogans serovar lai str. 56601
aauguuaauuuagaauaaaaa

SEQ ID NO: 767232 - RNA, 16 nt, Leptospira interrogans serovar lai str. 56601
aauguuccaaagccaa

SEQ ID NO: 767233 - RNA, 15 nt, Leptospira interrogans serovar lai str. 56601
aauguuauaaaaugu

SEQ ID NO: 767234 - RNA, 19 nt, Leptospira interrogans serovar lai str. 56601
aauguuauaaaauguauua

SEQ ID NO: 767235 - RNA, 17 nt, Leptospira interrogans serovar lai str. 56601
aauguuauuuuguauaa

SEQ ID NO: 767236 - RNA, 16 nt, Leptospira interrogans serovar lai str. 56601
aaugugggaacuacuc

SEQ ID NO: 767237 - RNA, 22 nt, Leptospira interrogans serovar lai str. 56601
aauguggaacucuauauaaaga

SEQ ID NO: 767238 - RNA, 15 nt, Leptospira interrogans serovar lai str. 56601
aaugguugcaaaaaa

SEQ ID NO: 767239 - RNA, 15 nt, Leptospira interrogans serovar lai str. 56601
aauguacaacauccu

SEQ ID NO: 767240 - RNA, 18 nt, Leptospira interrogans serovar lai str. 56601
aauggccuucuagggcaa

SEQ ID NO: 767241 - RNA, 12 nt, Leptospira interrogans serovar lai str. 56601
aauggaaaauug

SEQ ID NO: 767242 - RNA, 13 nt, Leptospira interrogans serovar lai str. 56601
aauggaaaauuga

SEQ ID NO: 767243 - RNA, 14 nt, Leptospira interrogans serovar lai str. 56601
aauggaaaaaagau

SEQ ID NO: 767244 - RNA, 17 nt, Leptospira interrogans serovar lai str. 56601
aauggaaaucuuuuaaa

SEQ ID NO: 767245 - RNA, 18 nt, Leptospira interrogans serovar lai str. 56601
aaugauuuuuuaaaauaa

SEQ ID NO: 767246 - RNA, 17 nt, Leptospira interrogans serovar lai str. 56601
aaugcaacgaaaucaau

SEQ ID NO: 767247 - RNA, 15 nt, Leptospira interrogans serovar lai str. 56601
aaugauuucagauuc

SEQ ID NO: 767248 - RNA, 16 nt, Leptospira interrogans serovar lai str. 56601
aaugcaauaguuccug

SEQ ID NO: 767249 - RNA, 15 nt, Leptospira interrogans serovar lai str. 56601
aaugcgaaaauuuaa

SEQ ID NO: 767250 - RNA, 14 nt, Leptospira interrogans serovar lai str. 56601
aaugcgauuccagu

SEQ ID NO: 767251 - RNA, 21 nt, Leptospira interrogans serovar lai str. 56601
aaugcgauuguucuuguggga

SEQ ID NO: 767252 - RNA, 15 nt, Leptospira interrogans serovar lai str. 56601
aauuuauagauauaa

SEQ ID NO: 767253 - RNA, 24 nt, Leptospira interrogans serovar lai str. 56601
aauuuauaggaucguauuuuagaa

SEQ ID NO: 767254 - RNA, 16 nt, Leptospira interrogans serovar lai str. 56601
aauuuaguuuuuguau

SEQ ID NO: 767255 - RNA, 20 nt, Leptospira interrogans serovar lai str. 56601
aauuuauaaagacuuuaaau

SEQ ID NO: 767256 - RNA, 18 nt, Leptospira interrogans serovar lai str. 56601
aauuuauaaauguaggaa

SEQ ID NO: 767257 - RNA, 22 nt, Leptospira interrogans serovar lai str. 56601
aauuuauacuauaacuuuaaaa

SEQ ID NO: 767258 - RNA, 16 nt, Leptospira interrogans serovar lai str. 56601
aauuuuuuugauucaa

SEQ ID NO: 767259 - RNA, 19 nt, Leptospira interrogans serovar lai str. 56601
aauuuuuuugauucaaaaa

SEQ ID NO: 767260 - RNA, 15 nt, Leptospira interrogans serovar lai str. 56601
aauuuuuuuguaaaa

SEQ ID NO: 767261 - RNA, 13 nt, Leptospira interrogans serovar lai str. 56601
aauuuuuuuguau

SEQ ID NO: 767262 - RNA, 18 nt, Leptospira interrogans serovar lai str. 56601
aauuuuuuuuauuuuuag

SEQ ID NO: 767263 - RNA, 14 nt, Leptospira interrogans serovar lai str. 56601
acaaaaaaauucau

SEQ ID NO: 767264 - RNA, 17 nt, Leptospira interrogans serovar lai str. 56601
acaaaaaauguuuaaag

SEQ ID NO: 767265 - RNA, 16 nt, Leptospira interrogans serovar lai str. 56601
acaaaaaauauacuuu

SEQ ID NO: 767266 - RNA, 19 nt, Leptospira interrogans serovar lai str. 56601
acaaaaacaaauucacguu

SEQ ID NO: 767267 - RNA, 17 nt, Leptospira interrogans serovar lai str. 56601
acaaaaaugaaaaaacu

SEQ ID NO: 767268 - RNA, 17 nt, Leptospira interrogans serovar lai str. 56601
acaaaaucugaauuuua

SEQ ID NO: 767269 - RNA, 21 nt, Leptospira interrogans serovar lai str. 56601
acaaaaucaaagauauuucaa

SEQ ID NO: 767270 - RNA, 13 nt, Leptospira interrogans serovar lai str. 56601
acaaaacuuaaau

SEQ ID NO: 767271 - RNA, 16 nt, Leptospira interrogans serovar lai str. 56601
acaaaaguagaaagau

SEQ ID NO: 767272 - RNA, 20 nt, Leptospira interrogans serovar lai str. 56601
acaaaaggauuccauuucau

SEQ ID NO: 767273 - RNA, 20 nt, Leptospira interrogans serovar lai str. 56601
acaaaggaaucccaaauucu

SEQ ID NO: 767274 - RNA, 17 nt, Leptospira interrogans serovar lai str. 56601
acaaagccguuuucgaa

SEQ ID NO: 767275 - RNA, 19 nt, Leptospira interrogans serovar lai str. 56601
acaaagccgcacaaaccaa

SEQ ID NO: 767276 - RNA, 9 nt, Leptospira interrogans serovar lai str. 56601
acaaagauu

SEQ ID NO: 767277 - RNA, 15 nt, Leptospira interrogans serovar lai str. 56601
acaaagaguuuaaaa

SEQ ID NO: 767278 - RNA, 22 nt, Leptospira interrogans serovar lai str. 56601
acaaacuuuuguaauaaaaauu

SEQ ID NO: 767279 - RNA, 15 nt, Leptospira interrogans serovar lai str. 56601
acaaacuuuuagaua

SEQ ID NO: 767280 - RNA, 15 nt, Leptospira interrogans serovar lai str. 56601
acaaacuuuuaguaa

SEQ ID NO: 767281 - RNA, 21 nt, Leptospira interrogans serovar lai str. 56601
acaaacuuuuaguaacuuuca

SEQ ID NO: 767282 - RNA, 14 nt, Leptospira interrogans serovar lai str. 56601
acaaagaauaccaa

SEQ ID NO: 767283 - RNA, 12 nt, Leptospira interrogans serovar lai str. 56601
acaaaauuuuuu

SEQ ID NO: 767284 - RNA, 19 nt, Leptospira interrogans serovar lai str. 56601
acaaaauuuacgaaaauuu

SEQ ID NO: 767285 - RNA, 11 nt, Leptospira interrogans serovar lai str. 56601
acaaaauuuag

SEQ ID NO: 767286 - RNA, 16 nt, Leptospira interrogans serovar lai str. 56601
acaaaauuacuucaau

SEQ ID NO: 767287 - RNA, 14 nt, Leptospira interrogans serovar lai str. 56601
acaaacuaucuuaa

SEQ ID NO: 767288 - RNA, 19 nt, Leptospira interrogans serovar lai str. 56601
acaaacucuugaacagaaa

SEQ ID NO: 767289 - RNA, 19 nt, Leptospira interrogans serovar lai str. 56601
acaaacgguuuuaguaaaa

SEQ ID NO: 767290 - RNA, 14 nt, Leptospira interrogans serovar lai str. 56601
acaaauaaaacuuc

SEQ ID NO: 767291 - RNA, 19 nt, Leptospira interrogans serovar lai str. 56601
acaaaguagccuuuuuaac

SEQ ID NO: 767292 - RNA, 23 nt, Leptospira interrogans serovar lai str. 56601
acaaagugaugaagagaaaguaa

SEQ ID NO: 767293 - RNA, 21 nt, Leptospira interrogans serovar lai str. 56601
acaaaguaaguucaaauuuau

SEQ ID NO: 767294 - RNA, 14 nt, Leptospira interrogans serovar lai str. 56601
acaaauagaaauaa

SEQ ID NO: 767295 - RNA, 20 nt, Leptospira interrogans serovar lai str. 56601
acaaauagagugccaaaauu

SEQ ID NO: 767296 - RNA, 14 nt, Leptospira interrogans serovar lai str. 56601
acaaauaucaugau

SEQ ID NO: 767297 - RNA, 20 nt, Leptospira interrogans serovar lai str. 56601
acaaauagguuuugaacuac

SEQ ID NO: 767298 - RNA, 23 nt, Leptospira interrogans serovar lai str. 56601
acaaauuccaauuuuucugaaaa

SEQ ID NO: 767299 - RNA, 22 nt, Leptospira interrogans serovar lai str. 56601
acaaauucuacaauuguaggaa

SEQ ID NO: 767300 - RNA, 22 nt, Leptospira interrogans serovar lai str. 56601
acaaauuaguauuuuucuuaau

SEQ ID NO: 767301 - RNA, 17 nt, Leptospira interrogans serovar lai str. 56601
acaaauuaaguuuaaaa

SEQ ID NO: 767302 - RNA, 11 nt, Leptospira interrogans serovar lai str. 56601
acaaauuaaau

SEQ ID NO: 767303 - RNA, 16 nt, Leptospira interrogans serovar lai str. 56601
acaaaucuaaauuuua

SEQ ID NO: 767304 - RNA, 12 nt, Leptospira interrogans serovar lai str. 56601
acaaaucaaauc

SEQ ID NO: 767305 - RNA, 17 nt, Leptospira interrogans serovar lai str. 56601
acaaaucacaauuuuaa

SEQ ID NO: 767306 - RNA, 20 nt, Leptospira interrogans serovar lai str. 56601
acaaaucacauccaacccaa

SEQ ID NO: 767307 - RNA, 22 nt, Leptospira interrogans serovar lai str. 56601
acaaaucacgauuuuacaaaca

SEQ ID NO: 767308 - RNA, 16 nt, Leptospira interrogans serovar lai str. 56601
acaaaucagguuuuua

SEQ ID NO: 767309 - RNA, 20 nt, Leptospira interrogans serovar lai str. 56601
acaaaucuucuguaaaacuu

SEQ ID NO: 767310 - RNA, 16 nt, Leptospira interrogans serovar lai str. 56601
acaaaugacauuuugu

SEQ ID NO: 767311 - RNA, 19 nt, Leptospira interrogans serovar lai str. 56601
acaacccccguuauuaaaa

SEQ ID NO: 767312 - RNA, 20 nt, Leptospira interrogans serovar lai str. 56601
acaacccccguuauuaaaau

SEQ ID NO: 767313 - RNA, 12 nt, Leptospira interrogans serovar lai str. 56601
acaaccaaacag

SEQ ID NO: 767314 - RNA, 16 nt, Leptospira interrogans serovar lai str. 56601
acaaauucuucuuccu

SEQ ID NO: 767315 - RNA, 13 nt, Leptospira interrogans serovar lai str. 56601
acaaauugcaaaa

SEQ ID NO: 767316 - RNA, 22 nt, Leptospira interrogans serovar lai str. 56601
acaaauuggcagaugaaacuaa

SEQ ID NO: 767317 - RNA, 16 nt, Leptospira interrogans serovar lai str. 56601
acaaauugguuuuuau

SEQ ID NO: 767318 - RNA, 22 nt, Leptospira interrogans serovar lai str. 56601
acaaauugguuuuuauuauaua

SEQ ID NO: 767319 - RNA, 13 nt, Leptospira interrogans serovar lai str. 56601
acaaauuuuaaag

SEQ ID NO: 767320 - RNA, 18 nt, Leptospira interrogans serovar lai str. 56601
acaaauuuuaaaguaaau

SEQ ID NO: 767321 - RNA, 19 nt, Leptospira interrogans serovar lai str. 56601
acaacaaaaaauauacuuu

SEQ ID NO: 767322 - RNA, 12 nt, Leptospira interrogans serovar lai str. 56601
acaccguugcua

SEQ ID NO: 767323 - RNA, 22 nt, Leptospira interrogans serovar lai str. 56601
acaccguugcuauaaaaaggau

SEQ ID NO: 767324 - RNA, 15 nt, Leptospira interrogans serovar lai str. 56601
acacgauaauuuuua

SEQ ID NO: 767325 - RNA, 22 nt, Leptospira interrogans serovar lai str. 56601
acaauuuugagaccuuaaguuu

SEQ ID NO: 767326 - RNA, 18 nt, Leptospira interrogans serovar lai str. 56601
acaauuuugccaauucca

SEQ ID NO: 767327 - RNA, 21 nt, Leptospira interrogans serovar lai str. 56601
acaauuuuucucuaucagaaa

SEQ ID NO: 767328 - RNA, 22 nt, Leptospira interrogans serovar lai str. 56601
acaauuuuucucuaucagaaaa

SEQ ID NO: 767329 - RNA, 20 nt, Leptospira interrogans serovar lai str. 56601
acaauuuuuugaaaaagaau

SEQ ID NO: 767330 - RNA, 19 nt, Leptospira interrogans serovar lai str. 56601
acacaacggcucucuccua

SEQ ID NO: 767331 - RNA, 22 nt, Leptospira interrogans serovar lai str. 56601
acacauuuucauucuaaagaag

SEQ ID NO: 767332 - RNA, 21 nt, Leptospira interrogans serovar lai str. 56601
acacauuccgcaaaaauuccu

SEQ ID NO: 767333 - RNA, 15 nt, Leptospira interrogans serovar lai str. 56601
acacauucuaaaauu

SEQ ID NO: 767334 - RNA, 16 nt, Leptospira interrogans serovar lai str. 56601
acacauucuaaaauua

SEQ ID NO: 767335 - RNA, 15 nt, Leptospira interrogans serovar lai str. 56601
acacauucauuuuuu

SEQ ID NO: 767336 - RNA, 19 nt, Leptospira interrogans serovar lai str. 56601
acacauucauuuuuucuaa

SEQ ID NO: 767337 - RNA, 21 nt, Leptospira interrogans serovar lai str. 56601
acaacgauuucuguagaaauu

SEQ ID NO: 767338 - RNA, 13 nt, Leptospira interrogans serovar lai str. 56601
acaagcucuuuaa

SEQ ID NO: 767339 - RNA, 22 nt, Leptospira interrogans serovar lai str. 56601
acaagcucaugauuauuacucg

SEQ ID NO: 767340 - RNA, 21 nt, Leptospira interrogans serovar lai str. 56601
acaaggcuuuguaauaaaaau

SEQ ID NO: 767341 - RNA, 22 nt, Leptospira interrogans serovar lai str. 56601
acaagggcggcuuuuuuuacuu

SEQ ID NO: 767342 - RNA, 13 nt, Leptospira interrogans serovar lai str. 56601
acaagcuuccuuu

SEQ ID NO: 767343 - RNA, 17 nt, Leptospira interrogans serovar lai str. 56601
acaaguuuaaaugaaau

SEQ ID NO: 767344 - RNA, 13 nt, Leptospira interrogans serovar lai str. 56601
acaaguuucuuaa

SEQ ID NO: 767345 - RNA, 19 nt, Leptospira interrogans serovar lai str. 56601
acaaguuucuuaaauuugu

SEQ ID NO: 767346 - RNA, 19 nt, Leptospira interrogans serovar lai str. 56601
acaaguuuggaaauugacu

SEQ ID NO: 767347 - RNA, 21 nt, Leptospira interrogans serovar lai str. 56601
acaaguugaauaggauuuuag

SEQ ID NO: 767348 - RNA, 19 nt, Leptospira interrogans serovar lai str. 56601
acaauauuuugucuuuaau

SEQ ID NO: 767349 - RNA, 13 nt, Leptospira interrogans serovar lai str. 56601
acaaucaaauuuu

SEQ ID NO: 767350 - RNA, 16 nt, Leptospira interrogans serovar lai str. 56601
acaaucggguaaaaaa

SEQ ID NO: 767351 - RNA, 17 nt, Leptospira interrogans serovar lai str. 56601
acaaucggguaaaaaau

SEQ ID NO: 767352 - RNA, 15 nt, Leptospira interrogans serovar lai str. 56601
acaaucgaacggauu

SEQ ID NO: 767353 - RNA, 20 nt, Leptospira interrogans serovar lai str. 56601
acaauucucgauagaacaau

SEQ ID NO: 767354 - RNA, 15 nt, Leptospira interrogans serovar lai str. 56601
acaauucuuccuuuu

SEQ ID NO: 767355 - RNA, 15 nt, Leptospira interrogans serovar lai str. 56601
acaauucuauuagaa

SEQ ID NO: 767356 - RNA, 21 nt, Leptospira interrogans serovar lai str. 56601
acaauugauugcuuuuugaga

SEQ ID NO: 767357 - RNA, 15 nt, Leptospira interrogans serovar lai str. 56601
acaauugauuuaaaa

SEQ ID NO: 767358 - RNA, 18 nt, Leptospira interrogans serovar lai str. 56601
acaauugauuuaaaaacc

SEQ ID NO: 767359 - RNA, 21 nt, Leptospira interrogans serovar lai str. 56601
acaauuuuaucuuaauguaaa

SEQ ID NO: 767360 - RNA, 10 nt, Leptospira interrogans serovar lai str. 56601
acaauuugcu

SEQ ID NO: 767361 - RNA, 17 nt, Leptospira interrogans serovar lai str. 56601
acaauuuuaagaacaau

SEQ ID NO: 767362 - RNA, 15 nt, Leptospira interrogans serovar lai str. 56601
acaauuuuacaaaca

SEQ ID NO: 767363 - RNA, 13 nt, Leptospira interrogans serovar lai str. 56601
acaauuuuagaau

SEQ ID NO: 767364 - RNA, 15 nt, Leptospira interrogans serovar lai str. 56601
acaauuuuagaauuu

SEQ ID NO: 767365 - RNA, 19 nt, Leptospira interrogans serovar lai str. 56601
acaauuuuagaauuuauuc

SEQ ID NO: 767366 - RNA, 23 nt, Leptospira interrogans serovar lai str. 56601
acaaucgucaucucgaagaacaa

SEQ ID NO: 767367 - RNA, 14 nt, Leptospira interrogans serovar lai str. 56601
acaaugaauuuuua

SEQ ID NO: 767368 - RNA, 14 nt, Leptospira interrogans serovar lai str. 56601
acaauucaucacca

SEQ ID NO: 767369 - RNA, 15 nt, Leptospira interrogans serovar lai str. 56601
acacgucaauaaugu

SEQ ID NO: 767370 - RNA, 13 nt, Leptospira interrogans serovar lai str. 56601
acacgucuuaaau

SEQ ID NO: 767371 - RNA, 18 nt, Leptospira interrogans serovar lai str. 56601
acagcaaggagcaacauu

SEQ ID NO: 767372 - RNA, 14 nt, Leptospira interrogans serovar lai str. 56601
acagccaaagaaau

SEQ ID NO: 767373 - RNA, 14 nt, Leptospira interrogans serovar lai str. 56601
acaggaaaauuuaa

SEQ ID NO: 767374 - RNA, 13 nt, Leptospira interrogans serovar lai str. 56601
acagcuugaagau

SEQ ID NO: 767375 - RNA, 16 nt, Leptospira interrogans serovar lai str. 56601
acaguucugaguaaga

SEQ ID NO: 767376 - RNA, 18 nt, Leptospira interrogans serovar lai str. 56601
acaguucugaguaagaua

SEQ ID NO: 767377 - RNA, 17 nt, Leptospira interrogans serovar lai str. 56601
acaguuauuauuuaaca

SEQ ID NO: 767378 - RNA, 17 nt, Leptospira interrogans serovar lai str. 56601
acaguuccacuuuaaaa

SEQ ID NO: 767379 - RNA, 18 nt, Leptospira interrogans serovar lai str. 56601
acaguuccacuuuaaaaa

SEQ ID NO: 767380 - RNA, 21 nt, Leptospira interrogans serovar lai str. 56601
acaguuugaauuuuacuaaaa

SEQ ID NO: 767381 - RNA, 18 nt, Leptospira interrogans serovar lai str. 56601
acauaaaagaccuucgga

SEQ ID NO: 767382 - RNA, 13 nt, Leptospira interrogans serovar lai str. 56601
acauaaaaauuuu

SEQ ID NO: 767383 - RNA, 23 nt, Leptospira interrogans serovar lai str. 56601
acauaaacgauuauuuuuuaaaa

SEQ ID NO: 767384 - RNA, 16 nt, Leptospira interrogans serovar lai str. 56601
acauaaaguuaauaca

SEQ ID NO: 767385 - RNA, 18 nt, Leptospira interrogans serovar lai str. 56601
acaguaaaacuuugguuu

SEQ ID NO: 767386 - RNA, 17 nt, Leptospira interrogans serovar lai str. 56601
acaguaagaagaaaagg

SEQ ID NO: 767387 - RNA, 13 nt, Leptospira interrogans serovar lai str. 56601
acaguacaagaau

SEQ ID NO: 767388 - RNA, 22 nt, Leptospira interrogans serovar lai str. 56601
acaguacaagaaucaaaacggc

SEQ ID NO: 767389 - RNA, 20 nt, Leptospira interrogans serovar lai str. 56601
acaguauauuauaauuuuaa

SEQ ID NO: 767390 - RNA, 18 nt, Leptospira interrogans serovar lai str. 56601
acaguauuuguaaaaaug

SEQ ID NO: 767391 - RNA, 19 nt, Leptospira interrogans serovar lai str. 56601
acaguaucgaaaauuaaca

SEQ ID NO: 767392 - RNA, 23 nt, Leptospira interrogans serovar lai str. 56601
acaucguuuagguaaagauuuuc

SEQ ID NO: 767393 - RNA, 16 nt, Leptospira interrogans serovar lai str. 56601
acaucgucuucuuuuu

SEQ ID NO: 767394 - RNA, 18 nt, Leptospira interrogans serovar lai str. 56601
acaucguuaccagcaagc

SEQ ID NO: 767395 - RNA, 21 nt, Leptospira interrogans serovar lai str. 56601
acaucguuaccagcaagcaca

SEQ ID NO: 767396 - RNA, 14 nt, Leptospira interrogans serovar lai str. 56601
acaucucaaucaaa

SEQ ID NO: 767397 - RNA, 11 nt, Leptospira interrogans serovar lai str. 56601
acaugaagaag

SEQ ID NO: 767398 - RNA, 13 nt, Leptospira interrogans serovar lai str. 56601
acaugaagaagcu

SEQ ID NO: 767399 - RNA, 14 nt, Leptospira interrogans serovar lai str. 56601
acaucuuaaaaacu

SEQ ID NO: 767400 - RNA, 17 nt, Leptospira interrogans serovar lai str. 56601
acauaauaauacagaau

SEQ ID NO: 767401 - RNA, 16 nt, Leptospira interrogans serovar lai str. 56601
acauaacuaauaaaaa

SEQ ID NO: 767402 - RNA, 16 nt, Leptospira interrogans serovar lai str. 56601
acauaaugcugcaauu

SEQ ID NO: 767403 - RNA, 18 nt, Leptospira interrogans serovar lai str. 56601
acaucaauuuuauuucua

SEQ ID NO: 767404 - RNA, 15 nt, Leptospira interrogans serovar lai str. 56601
acauccuucaaacuu

SEQ ID NO: 767405 - RNA, 21 nt, Leptospira interrogans serovar lai str. 56601
acaucauucucauauugaaau

SEQ ID NO: 767406 - RNA, 22 nt, Leptospira interrogans serovar lai str. 56601
acauccaaacucuuaaucugcu

SEQ ID NO: 767407 - RNA, 18 nt, Leptospira interrogans serovar lai str. 56601
acauccaacccaaacaca

SEQ ID NO: 767408 - RNA, 19 nt, Leptospira interrogans serovar lai str. 56601
acauccaacccaaacacau

SEQ ID NO: 767409 - RNA, 22 nt, Leptospira interrogans serovar lai str. 56601
acauccaacccaaacacaugag

SEQ ID NO: 767410 - RNA, 22 nt, Leptospira interrogans serovar lai str. 56601
acauccucaacggguucuucau

SEQ ID NO: 767411 - RNA, 16 nt, Leptospira interrogans serovar lai str. 56601
acauuguuuuacucuu

SEQ ID NO: 767412 - RNA, 23 nt, Leptospira interrogans serovar lai str. 56601
acauuguuuuacucuuauuuaua

SEQ ID NO: 767413 - RNA, 17 nt, Leptospira interrogans serovar lai str. 56601
acauuguguuuuuuaac

SEQ ID NO: 767414 - RNA, 13 nt, Leptospira interrogans serovar lai str. 56601
acauugaagaaaa

SEQ ID NO: 767415 - RNA, 14 nt, Leptospira interrogans serovar lai str. 56601
acauuagaauuuua

SEQ ID NO: 767416 - RNA, 16 nt, Leptospira interrogans serovar lai str. 56601
acauuacgaauuuuua

SEQ ID NO: 767417 - RNA, 16 nt, Leptospira interrogans serovar lai str. 56601
acauuugauuaaaaau

SEQ ID NO: 767418 - RNA, 18 nt, Leptospira interrogans serovar lai str. 56601
acauuugauuaaaaauuu

SEQ ID NO: 767419 - RNA, 20 nt, Leptospira interrogans serovar lai str. 56601
acauuugauuaaaaauuucu

SEQ ID NO: 767420 - RNA, 17 nt, Leptospira interrogans serovar lai str. 56601
acauuugcuuugucauu

SEQ ID NO: 767421 - RNA, 20 nt, Leptospira interrogans serovar lai str. 56601
acauuugcuuugucauuuca

SEQ ID NO: 767422 - RNA, 20 nt, Leptospira interrogans serovar lai str. 56601
acauuugguaauuugugaac

SEQ ID NO: 767423 - RNA, 15 nt, Leptospira interrogans serovar lai str. 56601
acauuuaaauuaauc

SEQ ID NO: 767424 - RNA, 20 nt, Leptospira interrogans serovar lai str. 56601
acauuuuguuuuuuuggaua

SEQ ID NO: 767425 - RNA, 12 nt, Leptospira interrogans serovar lai str. 56601
acauuuuuaaaa

SEQ ID NO: 767426 - RNA, 14 nt, Leptospira interrogans serovar lai str. 56601
acauuuuuaaaaau

SEQ ID NO: 767427 - RNA, 15 nt, Leptospira interrogans serovar lai str. 56601
acauuuuuaaaaauu

SEQ ID NO: 767428 - RNA, 17 nt, Leptospira interrogans serovar lai str. 56601
acauuuuuaaaaguuau

SEQ ID NO: 767429 - RNA, 18 nt, Leptospira interrogans serovar lai str. 56601
acauuuuuaaaaguuauu

SEQ ID NO: 767430 - RNA, 13 nt, Leptospira interrogans serovar lai str. 56601
acauuuugugaaa

SEQ ID NO: 767431 - RNA, 16 nt, Leptospira interrogans serovar lai str. 56601
acauuuuucuaaauua

SEQ ID NO: 767432 - RNA, 18 nt, Leptospira interrogans serovar lai str. 56601
acauuuuucuaaauuaau

SEQ ID NO: 767433 - RNA, 13 nt, Leptospira interrogans serovar lai str. 56601
acauuuucaaaau

SEQ ID NO: 767434 - RNA, 16 nt, Leptospira interrogans serovar lai str. 56601
acauuuuauuuuuuau

SEQ ID NO: 767435 - RNA, 20 nt, Leptospira interrogans serovar lai str. 56601
acauuuuauuauaaauuuau

SEQ ID NO: 767436 - RNA, 21 nt, Leptospira interrogans serovar lai str. 56601
acauuuuaaaguuuugaaaua

SEQ ID NO: 767437 - RNA, 14 nt, Leptospira interrogans serovar lai str. 56601
acauuugauuuuca

SEQ ID NO: 767438 - RNA, 11 nt, Leptospira interrogans serovar lai str. 56601
acauuuuaaag

SEQ ID NO: 767439 - RNA, 13 nt, Leptospira interrogans serovar lai str. 56601
acauuuuaaaaau

SEQ ID NO: 767440 - RNA, 14 nt, Leptospira interrogans serovar lai str. 56601
acauuuuaaaaauu

SEQ ID NO: 767441 - RNA, 22 nt, Leptospira interrogans serovar lai str. 56601
accaaaucgcauuguuuaaaua

SEQ ID NO: 767442 - RNA, 17 nt, Leptospira interrogans serovar lai str. 56601
accaaauugcaacuuug

SEQ ID NO: 767443 - RNA, 21 nt, Leptospira interrogans serovar lai str. 56601
accaaaucuuucacuuuaaaa

SEQ ID NO: 767444 - RNA, 12 nt, Leptospira interrogans serovar lai str. 56601
accaacaacacc

SEQ ID NO: 767445 - RNA, 17 nt, Leptospira interrogans serovar lai str. 56601
accaaaccucucggaau

SEQ ID NO: 767446 - RNA, 19 nt, Leptospira interrogans serovar lai str. 56601
accaaaacggugauuguuu

SEQ ID NO: 767447 - RNA, 12 nt, Leptospira interrogans serovar lai str. 56601
acauuuuuguga

SEQ ID NO: 767448 - RNA, 20 nt, Leptospira interrogans serovar lai str. 56601
acauuuuugugaaacucaau

SEQ ID NO: 767449 - RNA, 17 nt, Leptospira interrogans serovar lai str. 56601
acauuuuugugaaacuu

SEQ ID NO: 767450 - RNA, 20 nt, Leptospira interrogans serovar lai str. 56601
acauuuuuuaucaauuacga

SEQ ID NO: 767451 - RNA, 13 nt, Leptospira interrogans serovar lai str. 56601
accaaaaaucaaa

SEQ ID NO: 767452 - RNA, 20 nt, Leptospira interrogans serovar lai str. 56601
acuugguuggauuccuuucu

SEQ ID NO: 767453 - RNA, 17 nt, Leptospira interrogans serovar lai str. 56601
acuugucccaaaacuuc

SEQ ID NO: 767454 - RNA, 14 nt, Leptospira interrogans serovar lai str. 56601
acuugucccaaaau

SEQ ID NO: 767455 - RNA, 14 nt, Leptospira interrogans serovar lai str. 56601
acuuguaaaacagc

SEQ ID NO: 767456 - RNA, 16 nt, Leptospira interrogans serovar lai str. 56601
acuuauaacugcaaga

SEQ ID NO: 767457 - RNA, 12 nt, Leptospira interrogans serovar lai str. 56601
acuuauaagaca

SEQ ID NO: 767458 - RNA, 20 nt, Leptospira interrogans serovar lai str. 56601
acuuaguucccgccucacaa

SEQ ID NO: 767459 - RNA, 16 nt, Leptospira interrogans serovar lai str. 56601
acuugccauggaaauu

SEQ ID NO: 767460 - RNA, 22 nt, Leptospira interrogans serovar lai str. 56601
acuugccauggaaauuuuuccg

SEQ ID NO: 767461 - RNA, 21 nt, Leptospira interrogans serovar lai str. 56601
acuuaucacgaaaauuaaaaa

SEQ ID NO: 767462 - RNA, 17 nt, Leptospira interrogans serovar lai str. 56601
acuuguuguaccauuuu

SEQ ID NO: 767463 - RNA, 12 nt, Leptospira interrogans serovar lai str. 56601
acuuuaaaaaau

SEQ ID NO: 767464 - RNA, 15 nt, Leptospira interrogans serovar lai str. 56601
acuuuaaaaaauaag

SEQ ID NO: 767465 - RNA, 22 nt, Leptospira interrogans serovar lai str. 56601
acuuuaaaaaauaagaagccaa

SEQ ID NO: 767466 - RNA, 20 nt, Leptospira interrogans serovar lai str. 56601
acuuuaaaguugguuuuguu

SEQ ID NO: 767467 - RNA, 22 nt, Leptospira interrogans serovar lai str. 56601
acuuuaauuuucuuaguuuugu

SEQ ID NO: 767468 - RNA, 23 nt, Leptospira interrogans serovar lai str. 56601
acuuuaauuuucuuaguuuugua

SEQ ID NO: 767469 - RNA, 14 nt, Leptospira interrogans serovar lai str. 56601
acuuuaauuuuagu

SEQ ID NO: 767470 - RNA, 15 nt, Leptospira interrogans serovar lai str. 56601
acuuuaauuuuagua

SEQ ID NO: 767471 - RNA, 16 nt, Leptospira interrogans serovar lai str. 56601
acuuuaaucauuuuca

SEQ ID NO: 767472 - RNA, 18 nt, Leptospira interrogans serovar lai str. 56601
acuuuaaucauuuucaau

SEQ ID NO: 767473 - RNA, 14 nt, Leptospira interrogans serovar lai str. 56601
acuuuaauaauaua

SEQ ID NO: 767474 - RNA, 12 nt, Leptospira interrogans serovar lai str. 56601
acuuuaagaaaa

SEQ ID NO: 767475 - RNA, 15 nt, Leptospira interrogans serovar lai str. 56601
acuuuacauuuuuau

SEQ ID NO: 767476 - RNA, 20 nt, Leptospira interrogans serovar lai str. 56601
acuuuacagaucaauucuuu

SEQ ID NO: 767477 - RNA, 15 nt, Leptospira interrogans serovar lai str. 56601
acuuuacgaguuuaa

SEQ ID NO: 767478 - RNA, 16 nt, Leptospira interrogans serovar lai str. 56601
acuuuagaaaaauauu

SEQ ID NO: 767479 - RNA, 13 nt, Leptospira interrogans serovar lai str. 56601
acuuuauaaaagu

SEQ ID NO: 767480 - RNA, 12 nt, Leptospira interrogans serovar lai str. 56601
acuuuaguucuc

SEQ ID NO: 767481 - RNA, 15 nt, Leptospira interrogans serovar lai str. 56601
acuuuaguucuccua

SEQ ID NO: 767482 - RNA, 16 nt, Leptospira interrogans serovar lai str. 56601
acuuuauuaaaaaguu

SEQ ID NO: 767483 - RNA, 16 nt, Leptospira interrogans serovar lai str. 56601
acuuuauucaaaauag

SEQ ID NO: 767484 - RNA, 23 nt, Leptospira interrogans serovar lai str. 56601
acuuuauuuguauucaagagcaa

SEQ ID NO: 767485 - RNA, 17 nt, Leptospira interrogans serovar lai str. 56601
acuuuauuuuauaauuc

SEQ ID NO: 767486 - RNA, 21 nt, Leptospira interrogans serovar lai str. 56601
acuuuauuuacaguucugagu

SEQ ID NO: 767487 - RNA, 15 nt, Leptospira interrogans serovar lai str. 56601
acuuucagauuaaaa

SEQ ID NO: 767488 - RNA, 12 nt, Leptospira interrogans serovar lai str. 56601
acuuuccacuuu

SEQ ID NO: 767489 - RNA, 15 nt, Leptospira interrogans serovar lai str. 56601
acuuuccagaaagaa

SEQ ID NO: 767490 - RNA, 16 nt, Leptospira interrogans serovar lai str. 56601
acuuuguuuuugcuca

SEQ ID NO: 767491 - RNA, 18 nt, Leptospira interrogans serovar lai str. 56601
acuuuuacuguaaaauuu

SEQ ID NO: 767492 - RNA, 21 nt, Leptospira interrogans serovar lai str. 56601
acuuuuacuguaaaauuuaaa

SEQ ID NO: 767493 - RNA, 15 nt, Leptospira interrogans serovar lai str. 56601
acuuuuagaaaaaau

SEQ ID NO: 767494 - RNA, 20 nt, Leptospira interrogans serovar lai str. 56601
acuuuuagaaaaaauuuuuc

SEQ ID NO: 767495 - RNA, 18 nt, Leptospira interrogans serovar lai str. 56601
acuuuuagaaaauuuuua

SEQ ID NO: 767496 - RNA, 21 nt, Leptospira interrogans serovar lai str. 56601
acuuugauuauaaccugcaac

SEQ ID NO: 767497 - RNA, 22 nt, Leptospira interrogans serovar lai str. 56601
acuuuguaaaauggucuuuuag

SEQ ID NO: 767498 - RNA, 15 nt, Leptospira interrogans serovar lai str. 56601
acuuuguaaaucuau

SEQ ID NO: 767499 - RNA, 16 nt, Leptospira interrogans serovar lai str. 56601
acuuuguaaaucuauu

SEQ ID NO: 767500 - RNA, 21 nt, Leptospira interrogans serovar lai str. 56601
acuuugguuuguaauaguucc

SEQ ID NO: 767501 - RNA, 20 nt, Leptospira interrogans serovar lai str. 56601
acuuugcucucgcaaugaaa

SEQ ID NO: 767502 - RNA, 14 nt, Leptospira interrogans serovar lai str. 56601
acuuucuaaaaaua

SEQ ID NO: 767503 - RNA, 23 nt, Leptospira interrogans serovar lai str. 56601
acuuuccguagaucuuuuauaau

SEQ ID NO: 767504 - RNA, 21 nt, Leptospira interrogans serovar lai str. 56601
acuuucccacuuauaauaaaa

SEQ ID NO: 767505 - RNA, 23 nt, Leptospira interrogans serovar lai str. 56601
acuuuccgaauaggaucagaauu

SEQ ID NO: 767506 - RNA, 16 nt, Leptospira interrogans serovar lai str. 56601
acuuuccgucuuuuag

SEQ ID NO: 767507 - RNA, 17 nt, Leptospira interrogans serovar lai str. 56601
acuuucagcuacaauca

SEQ ID NO: 767508 - RNA, 16 nt, Leptospira interrogans serovar lai str. 56601
acuuugagaaaauuuu

SEQ ID NO: 767509 - RNA, 17 nt, Leptospira interrogans serovar lai str. 56601
acuuugagaaagaacaa

SEQ ID NO: 767510 - RNA, 17 nt, Leptospira interrogans serovar lai str. 56601
acuuugagaugugggaa

SEQ ID NO: 767511 - RNA, 19 nt, Leptospira interrogans serovar lai str. 56601
acuuugagaugugggaacu

SEQ ID NO: 767512 - RNA, 23 nt, Leptospira interrogans serovar lai str. 56601
acuuucuuuuucuuuuuuuaaac

SEQ ID NO: 767513 - RNA, 18 nt, Leptospira interrogans serovar lai str. 56601
acuuugaccauucuuugu

SEQ ID NO: 767514 - RNA, 21 nt, Leptospira interrogans serovar lai str. 56601
acuuugaaaauugugggaacu

SEQ ID NO: 767515 - RNA, 16 nt, Leptospira interrogans serovar lai str. 56601
acuuugaaaauuuuuu

SEQ ID NO: 767516 - RNA, 21 nt, Leptospira interrogans serovar lai str. 56601
acuuugaaaauuuuuuuguaa

SEQ ID NO: 767517 - RNA, 14 nt, Leptospira interrogans serovar lai str. 56601
acuuugaaugaaaa

SEQ ID NO: 767518 - RNA, 23 nt, Leptospira interrogans serovar lai str. 56601
acuuugaaugcaacgaaaucaau

SEQ ID NO: 767519 - RNA, 18 nt, Leptospira interrogans serovar lai str. 56601
acuuucuguauuuuuaag

SEQ ID NO: 767520 - RNA, 23 nt, Leptospira interrogans serovar lai str. 56601
acuuucucgaaaaucucagaaaa

SEQ ID NO: 767521 - RNA, 15 nt, Leptospira interrogans serovar lai str. 56601
acuuuucuauaaaau

SEQ ID NO: 767522 - RNA, 13 nt, Leptospira interrogans serovar lai str. 56601
acuuuucuaaaag

SEQ ID NO: 767523 - RNA, 15 nt, Leptospira interrogans serovar lai str. 56601
acuuuuccuaaaauu

SEQ ID NO: 767524 - RNA, 13 nt, Leptospira interrogans serovar lai str. 56601
acuuuuccaaaua

SEQ ID NO: 767525 - RNA, 15 nt, Leptospira interrogans serovar lai str. 56601
acuuuuccaaauaua

SEQ ID NO: 767526 - RNA, 14 nt, Leptospira interrogans serovar lai str. 56601
acuuuuaucgaaug

SEQ ID NO: 767527 - RNA, 21 nt, Leptospira interrogans serovar lai str. 56601
acuuuuugcaaguaaaaagac

SEQ ID NO: 767528 - RNA, 22 nt, Leptospira interrogans serovar lai str. 56601
acuuuuucagaaaaaugaauca

SEQ ID NO: 767529 - RNA, 17 nt, Leptospira interrogans serovar lai str. 56601
acuuuuuccaaaagcaa

SEQ ID NO: 767530 - RNA, 20 nt, Leptospira interrogans serovar lai str. 56601
acuuuuucguuuuuuagaaa

SEQ ID NO: 767531 - RNA, 17 nt, Leptospira interrogans serovar lai str. 56601
acuuuucugauuuuuau

SEQ ID NO: 767532 - RNA, 13 nt, Leptospira interrogans serovar lai str. 56601
agaaaaaaaaaga

SEQ ID NO: 767533 - RNA, 15 nt, Leptospira interrogans serovar lai str. 56601
agaaaaaaaaagaau

SEQ ID NO: 767534 - RNA, 21 nt, Leptospira interrogans serovar lai str. 56601
acuuuuuuuaaaaaauucauu

SEQ ID NO: 767535 - RNA, 12 nt, Leptospira interrogans serovar lai str. 56601
agaaaaaauuuu

SEQ ID NO: 767536 - RNA, 19 nt, Leptospira interrogans serovar lai str. 56601
agaaaaaaaguauauauua

SEQ ID NO: 767537 - RNA, 12 nt, Leptospira interrogans serovar lai str. 56601
agaaaaaagcag

SEQ ID NO: 767538 - RNA, 21 nt, Leptospira interrogans serovar lai str. 56601
agaaaaaagcagcuaaaaaga

SEQ ID NO: 767539 - RNA, 14 nt, Leptospira interrogans serovar lai str. 56601
agaaaaaauaacaa

SEQ ID NO: 767540 - RNA, 12 nt, Leptospira interrogans serovar lai str. 56601
agaaaauccagu

SEQ ID NO: 767541 - RNA, 17 nt, Leptospira interrogans serovar lai str. 56601
agaaaauuagaaagaau

SEQ ID NO: 767542 - RNA, 16 nt, Leptospira interrogans serovar lai str. 56601
agaaaauuagaaagcg

SEQ ID NO: 767543 - RNA, 10 nt, Leptospira interrogans serovar lai str. 56601
agaaaauuca

SEQ ID NO: 767544 - RNA, 13 nt, Leptospira interrogans serovar lai str. 56601
agaaaauuuaaac

SEQ ID NO: 767545 - RNA, 23 nt, Leptospira interrogans serovar lai str. 56601
agaaaauuuaaacaacaguacaa

SEQ ID NO: 767546 - RNA, 23 nt, Leptospira interrogans serovar lai str. 56601
agaaaauuaauuuuucaacaacu

SEQ ID NO: 767547 - RNA, 11 nt, Leptospira interrogans serovar lai str. 56601
agaaacaaaga

SEQ ID NO: 767548 - RNA, 22 nt, Leptospira interrogans serovar lai str. 56601
agaaacaaagaauaccaaaaaa

SEQ ID NO: 767549 - RNA, 13 nt, Leptospira interrogans serovar lai str. 56601
agaaaauuuuuac

SEQ ID NO: 767550 - RNA, 14 nt, Leptospira interrogans serovar lai str. 56601
agaagccuauauuu

SEQ ID NO: 767551 - RNA, 18 nt, Leptospira interrogans serovar lai str. 56601
agaagccuauauuuugau

SEQ ID NO: 767552 - RNA, 20 nt, Leptospira interrogans serovar lai str. 56601
agaagccuauauuuugauaa

SEQ ID NO: 767553 - RNA, 16 nt, Leptospira interrogans serovar lai str. 56601
agaagagucaaacacu

SEQ ID NO: 767554 - RNA, 18 nt, Leptospira interrogans serovar lai str. 56601
agaagaguugaauauuuu

SEQ ID NO: 767555 - RNA, 14 nt, Leptospira interrogans serovar lai str. 56601
agaagauaaaacuc

SEQ ID NO: 767556 - RNA, 16 nt, Leptospira interrogans serovar lai str. 56601
agaagauaaauauuuc

SEQ ID NO: 767557 - RNA, 22 nt, Leptospira interrogans serovar lai str. 56601
agaagauagauuuauaauaaau

SEQ ID NO: 767558 - RNA, 18 nt, Leptospira interrogans serovar lai str. 56601
agaagugagacgcuuucg

SEQ ID NO: 767559 - RNA, 16 nt, Leptospira interrogans serovar lai str. 56601
agaagugggaaggaau

SEQ ID NO: 767560 - RNA, 23 nt, Leptospira interrogans serovar lai str. 56601
agaaguugaucuuauacucuuaa

SEQ ID NO: 767561 - RNA, 14 nt, Leptospira interrogans serovar lai str. 56601
agaaguuaaaaaau

SEQ ID NO: 767562 - RNA, 15 nt, Leptospira interrogans serovar lai str. 56601
agaaguuaaaaaaug

SEQ ID NO: 767563 - RNA, 21 nt, Leptospira interrogans serovar lai str. 56601
agaauaaauacauacaaugaa

SEQ ID NO: 767564 - RNA, 17 nt, Leptospira interrogans serovar lai str. 56601
agaauaauauuuuaaug

SEQ ID NO: 767565 - RNA, 22 nt, Leptospira interrogans serovar lai str. 56601
agaauaauaauuuuagaauauu

SEQ ID NO: 767566 - RNA, 14 nt, Leptospira interrogans serovar lai str. 56601
agaauaauuuaaac

SEQ ID NO: 767567 - RNA, 18 nt, Leptospira interrogans serovar lai str. 56601
agaauaaauuauacaauu

SEQ ID NO: 767568 - RNA, 13 nt, Leptospira interrogans serovar lai str. 56601
agaauaaagagaa

SEQ ID NO: 767569 - RNA, 12 nt, Leptospira interrogans serovar lai str. 56601
agaauaaaaacu

SEQ ID NO: 767570 - RNA, 13 nt, Leptospira interrogans serovar lai str. 56601
agaauaaaauuug

SEQ ID NO: 767571 - RNA, 17 nt, Leptospira interrogans serovar lai str. 56601
agaauagagucuuuaaa

SEQ ID NO: 767572 - RNA, 15 nt, Leptospira interrogans serovar lai str. 56601
agaauaccaaaaaag

SEQ ID NO: 767573 - RNA, 21 nt, Leptospira interrogans serovar lai str. 56601
agaauguaaaagcuuuugcuu

SEQ ID NO: 767574 - RNA, 20 nt, Leptospira interrogans serovar lai str. 56601
agaauguaaaugaauuggaa

SEQ ID NO: 767575 - RNA, 15 nt, Leptospira interrogans serovar lai str. 56601
agaauuaauuuuuca

SEQ ID NO: 767576 - RNA, 15 nt, Leptospira interrogans serovar lai str. 56601
agaauucauuuuaca

SEQ ID NO: 767577 - RNA, 17 nt, Leptospira interrogans serovar lai str. 56601
agaauucauuuuucuac

SEQ ID NO: 767578 - RNA, 22 nt, Leptospira interrogans serovar lai str. 56601
agaauucauuuuucuacaauua

SEQ ID NO: 767579 - RNA, 18 nt, Leptospira interrogans serovar lai str. 56601
agaauuagauuaaauuuu

SEQ ID NO: 767580 - RNA, 15 nt, Leptospira interrogans serovar lai str. 56601
agaaucuugggguuu

SEQ ID NO: 767581 - RNA, 20 nt, Leptospira interrogans serovar lai str. 56601
agaaucuguuuuguuuccuu

SEQ ID NO: 767582 - RNA, 23 nt, Leptospira interrogans serovar lai str. 56601
agaaucuguuuuguuuccuucuu

SEQ ID NO: 767583 - RNA, 18 nt, Leptospira interrogans serovar lai str. 56601
agaaucugccccaaaauu

SEQ ID NO: 767584 - RNA, 19 nt, Leptospira interrogans serovar lai str. 56601
agaaucaucucaaaaauag

SEQ ID NO: 767585 - RNA, 23 nt, Leptospira interrogans serovar lai str. 56601
agaaucauuaaucagauuuuugc

SEQ ID NO: 767586 - RNA, 23 nt, Leptospira interrogans serovar lai str. 56601
agaaucauuggaguuuuuuaaaa

SEQ ID NO: 767587 - RNA, 17 nt, Leptospira interrogans serovar lai str. 56601
agaaucaucuugcucua

SEQ ID NO: 767588 - RNA, 21 nt, Leptospira interrogans serovar lai str. 56601
agaaucaugaaccauggauuu

SEQ ID NO: 767589 - RNA, 19 nt, Leptospira interrogans serovar lai str. 56601
agaaucaagagaacucauu

SEQ ID NO: 767590 - RNA, 17 nt, Leptospira interrogans serovar lai str. 56601
agaaucaaaaugaacuc

SEQ ID NO: 767591 - RNA, 20 nt, Leptospira interrogans serovar lai str. 56601
agaaucaaaaugaacucaac

SEQ ID NO: 767592 - RNA, 15 nt, Leptospira interrogans serovar lai str. 56601
agaaucaaaggaaau

SEQ ID NO: 767593 - RNA, 12 nt, Leptospira interrogans serovar lai str. 56601
agaauaugaaua

SEQ ID NO: 767594 - RNA, 20 nt, Leptospira interrogans serovar lai str. 56601
agaauaucugcaaaauaaca

SEQ ID NO: 767595 - RNA, 19 nt, Leptospira interrogans serovar lai str. 56601
agaauauaauaauuguuga

SEQ ID NO: 767596 - RNA, 14 nt, Leptospira interrogans serovar lai str. 56601
agaauauaaaaucu

SEQ ID NO: 767597 - RNA, 12 nt, Leptospira interrogans serovar lai str. 56601
agaauauaagau

SEQ ID NO: 767598 - RNA, 18 nt, Leptospira interrogans serovar lai str. 56601
agaauaucuuaauauaau

SEQ ID NO: 767599 - RNA, 22 nt, Leptospira interrogans serovar lai str. 56601
agaaacaaggcuuuguaauaaa

SEQ ID NO: 767600 - RNA, 16 nt, Leptospira interrogans serovar lai str. 56601
agaaacggaagaaaau

SEQ ID NO: 767601 - RNA, 20 nt, Leptospira interrogans serovar lai str. 56601
agaaacggugcauuuaaaaa

SEQ ID NO: 767602 - RNA, 22 nt, Leptospira interrogans serovar lai str. 56601
agaaacggugcauuuaaaaaau

SEQ ID NO: 767603 - RNA, 15 nt, Leptospira interrogans serovar lai str. 56601
agaaaccuuuucuag

SEQ ID NO: 767604 - RNA, 15 nt, Leptospira interrogans serovar lai str. 56601
agaaacuaaugcaag

SEQ ID NO: 767605 - RNA, 19 nt, Leptospira interrogans serovar lai str. 56601
agaaaucaauggaaaauua

SEQ ID NO: 767606 - RNA, 20 nt, Leptospira interrogans serovar lai str. 56601
agaaaucaauggaaaauuaa

SEQ ID NO: 767607 - RNA, 18 nt, Leptospira interrogans serovar lai str. 56601
agaaaucaauucuucuuu

SEQ ID NO: 767608 - RNA, 17 nt, Leptospira interrogans serovar lai str. 56601
agaaaucauuuuuuguu

SEQ ID NO: 767609 - RNA, 17 nt, Leptospira interrogans serovar lai str. 56601
agaaaucgauuuguaaa

SEQ ID NO: 767610 - RNA, 18 nt, Leptospira interrogans serovar lai str. 56601
agaaaucgauuuguaaaa

SEQ ID NO: 767611 - RNA, 22 nt, Leptospira interrogans serovar lai str. 56601
agaaaucgauuuguaaaauuca

SEQ ID NO: 767612 - RNA, 17 nt, Leptospira interrogans serovar lai str. 56601
agaaauuaauuucuaaa

SEQ ID NO: 767613 - RNA, 17 nt, Leptospira interrogans serovar lai str. 56601
agaaauuucuaauaaaa

SEQ ID NO: 767614 - RNA, 21 nt, Leptospira interrogans serovar lai str. 56601
agaaauuuuacacguaauucu

SEQ ID NO: 767615 - RNA, 22 nt, Leptospira interrogans serovar lai str. 56601
agaaauuuucaaaaaauaucau

SEQ ID NO: 767616 - RNA, 13 nt, Leptospira interrogans serovar lai str. 56601
agaaauuugauuu

SEQ ID NO: 767617 - RNA, 17 nt, Leptospira interrogans serovar lai str. 56601
agaaauuuuuaauaaaa

SEQ ID NO: 767618 - RNA, 20 nt, Leptospira interrogans serovar lai str. 56601
agaaauuuuuaauaaaaugc

SEQ ID NO: 767619 - RNA, 18 nt, Leptospira interrogans serovar lai str. 56601
agaaauuuuuaauauacu

SEQ ID NO: 767620 - RNA, 15 nt, Leptospira interrogans serovar lai str. 56601
agaaauuuuuaauca

SEQ ID NO: 767621 - RNA, 17 nt, Leptospira interrogans serovar lai str. 56601
agaaauuuuuaaucaaa

SEQ ID NO: 767622 - RNA, 22 nt, Leptospira interrogans serovar lai str. 56601
agaaaugugggaacucccacuu

SEQ ID NO: 767623 - RNA, 19 nt, Leptospira interrogans serovar lai str. 56601
agaaauuaaaguauccauu

SEQ ID NO: 767624 - RNA, 13 nt, Leptospira interrogans serovar lai str. 56601
agaagaaauaagu

SEQ ID NO: 767625 - RNA, 18 nt, Leptospira interrogans serovar lai str. 56601
agaagagccucaaguaaa

SEQ ID NO: 767626 - RNA, 20 nt, Leptospira interrogans serovar lai str. 56601
agaagagccucaaguaaaac

SEQ ID NO: 767627 - RNA, 22 nt, Leptospira interrogans serovar lai str. 56601
agaagagccucaaguaaaacgu

SEQ ID NO: 767628 - RNA, 16 nt, Leptospira interrogans serovar lai str. 56601
agaacuugucucagaa

SEQ ID NO: 767629 - RNA, 13 nt, Leptospira interrogans serovar lai str. 56601
agaacaaaauuua

SEQ ID NO: 767630 - RNA, 21 nt, Leptospira interrogans serovar lai str. 56601
agaacaacccccguuauuaaa

SEQ ID NO: 767631 - RNA, 22 nt, Leptospira interrogans serovar lai str. 56601
agaacaacccccguuauuaaaa

SEQ ID NO: 767632 - RNA, 23 nt, Leptospira interrogans serovar lai str. 56601
agaacaacccccguuauuaaaau

SEQ ID NO: 767633 - RNA, 21 nt, Leptospira interrogans serovar lai str. 56601
agaacaaauccuggacugaau

SEQ ID NO: 767634 - RNA, 20 nt, Leptospira interrogans serovar lai str. 56601
agaaccaucucaaaaauauc

SEQ ID NO: 767635 - RNA, 15 nt, Leptospira interrogans serovar lai str. 56601
agaaccuggaaaaga

SEQ ID NO: 767636 - RNA, 19 nt, Leptospira interrogans serovar lai str. 56601
agaaccuuuaguuuccaaa

SEQ ID NO: 767637 - RNA, 16 nt, Leptospira interrogans serovar lai str. 56601
agaacgauccguaaaa

SEQ ID NO: 767638 - RNA, 19 nt, Leptospira interrogans serovar lai str. 56601
agaacgauccguaaaaauc

SEQ ID NO: 767639 - RNA, 20 nt, Leptospira interrogans serovar lai str. 56601
agaacgaauugcacauaaaa

SEQ ID NO: 767640 - RNA, 12 nt, Leptospira interrogans serovar lai str. 56601
agauaauuaaac

SEQ ID NO: 767641 - RNA, 21 nt, Leptospira interrogans serovar lai str. 56601
agauaauuaaacaaagaauaa

SEQ ID NO: 767642 - RNA, 23 nt, Leptospira interrogans serovar lai str. 56601
agauaauuaaacaaagaauaaau

SEQ ID NO: 767643 - RNA, 16 nt, Leptospira interrogans serovar lai str. 56601
agauaauuuuuacuca

SEQ ID NO: 767644 - RNA, 22 nt, Leptospira interrogans serovar lai str. 56601
agauaauuuuuacucaaagaau

SEQ ID NO: 767645 - RNA, 14 nt, Leptospira interrogans serovar lai str. 56601
agauaggaauguuu

SEQ ID NO: 767646 - RNA, 21 nt, Leptospira interrogans serovar lai str. 56601
agaucaagaauuaauuuuuca

SEQ ID NO: 767647 - RNA, 23 nt, Leptospira interrogans serovar lai str. 56601
agaucaacacaaauauuaagaau

SEQ ID NO: 767648 - RNA, 17 nt, Leptospira interrogans serovar lai str. 56601
agaucaauucuuaaaau

SEQ ID NO: 767649 - RNA, 19 nt, Leptospira interrogans serovar lai str. 56601
agaucaauuuguuccuaaa

SEQ ID NO: 767650 - RNA, 20 nt, Leptospira interrogans serovar lai str. 56601
agauauagaaauuuucaaaa

SEQ ID NO: 767651 - RNA, 17 nt, Leptospira interrogans serovar lai str. 56601
agauagguuuuguaaga

SEQ ID NO: 767652 - RNA, 22 nt, Leptospira interrogans serovar lai str. 56601
agagucauuuuuaaauacuuuu

SEQ ID NO: 767653 - RNA, 21 nt, Leptospira interrogans serovar lai str. 56601
agaguccuccaaacaauuuuu

SEQ ID NO: 767654 - RNA, 15 nt, Leptospira interrogans serovar lai str. 56601
agagucguugaaaaa

SEQ ID NO: 767655 - RNA, 17 nt, Leptospira interrogans serovar lai str. 56601
agagucguugaaaaauu

SEQ ID NO: 767656 - RNA, 19 nt, Leptospira interrogans serovar lai str. 56601
agagucguugaaaaauuaa

SEQ ID NO: 767657 - RNA, 16 nt, Leptospira interrogans serovar lai str. 56601
agagucuauauguaaa

SEQ ID NO: 767658 - RNA, 19 nt, Leptospira interrogans serovar lai str. 56601
aaaaccagauguaaucuau

SEQ ID NO: 767659 - RNA, 11 nt, Leptospira interrogans serovar lai str. 56601
agaguauuauc

SEQ ID NO: 767660 - RNA, 14 nt, Leptospira interrogans serovar lai str. 56601
aaaaccaauuuuuc

SEQ ID NO: 767661 - RNA, 19 nt, Leptospira interrogans serovar lai str. 56601
aaaaccacccccaccaaaa

SEQ ID NO: 767662 - RNA, 18 nt, Leptospira interrogans serovar lai str. 56601
agauaaaacucaaaggaa

SEQ ID NO: 767663 - RNA, 20 nt, Leptospira interrogans serovar lai str. 56601
agauaaaacucaaaggaaaa

SEQ ID NO: 767664 - RNA, 21 nt, Leptospira interrogans serovar lai str. 56601
agauaaaacucaaaggaaaau

SEQ ID NO: 767665 - RNA, 16 nt, Leptospira interrogans serovar lai str. 56601
agauaaaaaaggaucc

SEQ ID NO: 767666 - RNA, 17 nt, Leptospira interrogans serovar lai str. 56601
agaguuucuaaaaaaau

SEQ ID NO: 767667 - RNA, 19 nt, Leptospira interrogans serovar lai str. 56601
agaguuguccuaaaaccuc

SEQ ID NO: 767668 - RNA, 19 nt, Leptospira interrogans serovar lai str. 56601
agagugguuuucaaauauu

SEQ ID NO: 767669 - RNA, 22 nt, Leptospira interrogans serovar lai str. 56601
agagugguuuucaaauauuuua

SEQ ID NO: 767670 - RNA, 19 nt, Leptospira interrogans serovar lai str. 56601
agaguuguugaaaaauucc

SEQ ID NO: 767671 - RNA, 19 nt, Leptospira interrogans serovar lai str. 56601
agaguuguugaaaaauuuu

SEQ ID NO: 767672 - RNA, 17 nt, Leptospira interrogans serovar lai str. 56601
agaguuguugaaagggg

SEQ ID NO: 767673 - RNA, 13 nt, Leptospira interrogans serovar lai str. 56601
agaguuuaaaaaa

SEQ ID NO: 767674 - RNA, 20 nt, Leptospira interrogans serovar lai str. 56601
agagugccaaaauuuugcuu

SEQ ID NO: 767675 - RNA, 18 nt, Leptospira interrogans serovar lai str. 56601
agagugcagauuaaaaaa

SEQ ID NO: 767676 - RNA, 22 nt, Leptospira interrogans serovar lai str. 56601
agauaacaucuugaaaccccau

SEQ ID NO: 767677 - RNA, 22 nt, Leptospira interrogans serovar lai str. 56601
agauuaaauguauauucguugu

SEQ ID NO: 767678 - RNA, 19 nt, Leptospira interrogans serovar lai str. 56601
agauuaacaaucaauugaa

SEQ ID NO: 767679 - RNA, 17 nt, Leptospira interrogans serovar lai str. 56601
agauuaaccguagauuu

SEQ ID NO: 767680 - RNA, 13 nt, Leptospira interrogans serovar lai str. 56601
agauuaacugcug

SEQ ID NO: 767681 - RNA, 12 nt, Leptospira interrogans serovar lai str. 56601
agauuaaagauu

SEQ ID NO: 767682 - RNA, 14 nt, Leptospira interrogans serovar lai str. 56601
agauuaaagauuug

SEQ ID NO: 767683 - RNA, 13 nt, Leptospira interrogans serovar lai str. 56601
agauuaaaaagaa

SEQ ID NO: 767684 - RNA, 15 nt, Leptospira interrogans serovar lai str. 56601
agauguuuuaaaagu

SEQ ID NO: 767685 - RNA, 11 nt, Leptospira interrogans serovar lai str. 56601
agaugcugaaa

SEQ ID NO: 767686 - RNA, 14 nt, Leptospira interrogans serovar lai str. 56601
agaugcuuucucuu

SEQ ID NO: 767687 - RNA, 17 nt, Leptospira interrogans serovar lai str. 56601
agaugcuuucucuuuuu

SEQ ID NO: 767688 - RNA, 19 nt, Leptospira interrogans serovar lai str. 56601
agaugggcacugaauaaaa

SEQ ID NO: 767689 - RNA, 13 nt, Leptospira interrogans serovar lai str. 56601
agaugaaauuaac

SEQ ID NO: 767690 - RNA, 19 nt, Leptospira interrogans serovar lai str. 56601
agaucuuuuauaauguuug

SEQ ID NO: 767691 - RNA, 18 nt, Leptospira interrogans serovar lai str. 56601
agaucuugagauccaauu

SEQ ID NO: 767692 - RNA, 14 nt, Leptospira interrogans serovar lai str. 56601
agaucugauauuuu

SEQ ID NO: 767693 - RNA, 23 nt, Leptospira interrogans serovar lai str. 56601
agaucugauauuuuaaauugaaa

SEQ ID NO: 767694 - RNA, 20 nt, Leptospira interrogans serovar lai str. 56601
agaucuccacuuaauuuuuc

SEQ ID NO: 767695 - RNA, 16 nt, Leptospira interrogans serovar lai str. 56601
agaucuauuccuaaaa

SEQ ID NO: 767696 - RNA, 18 nt, Leptospira interrogans serovar lai str. 56601
agaucuauuccuaaaaug

SEQ ID NO: 767697 - RNA, 20 nt, Leptospira interrogans serovar lai str. 56601
agaucuauuccuaaaaugug

SEQ ID NO: 767698 - RNA, 16 nt, Leptospira interrogans serovar lai str. 56601
agaucggcauucaggg

SEQ ID NO: 767699 - RNA, 20 nt, Leptospira interrogans serovar lai str. 56601
agaucuacgaaaauucugaa

SEQ ID NO: 767700 - RNA, 22 nt, Leptospira interrogans serovar lai str. 56601
agaucuacggaagcuaaaacua

SEQ ID NO: 767701 - RNA, 21 nt, Leptospira interrogans serovar lai str. 56601
agaucuacuuacauagaacuc

SEQ ID NO: 767702 - RNA, 15 nt, Leptospira interrogans serovar lai str. 56601
agaucuaucucaaaa

SEQ ID NO: 767703 - RNA, 14 nt, Leptospira interrogans serovar lai str. 56601
agauccguaaacca

SEQ ID NO: 767704 - RNA, 19 nt, Leptospira interrogans serovar lai str. 56601
agauccguaaaccaagaau

SEQ ID NO: 767705 - RNA, 22 nt, Leptospira interrogans serovar lai str. 56601
agagcuacucgaaaguuuauaa

SEQ ID NO: 767706 - RNA, 12 nt, Leptospira interrogans serovar lai str. 56601
aaaaccaaaaug

SEQ ID NO: 767707 - RNA, 17 nt, Leptospira interrogans serovar lai str. 56601
aaaaccaaaaugcugaa

SEQ ID NO: 767708 - RNA, 13 nt, Leptospira interrogans serovar lai str. 56601
agagauauagaaa

SEQ ID NO: 767709 - RNA, 14 nt, Leptospira interrogans serovar lai str. 56601
agagauauagaaau

SEQ ID NO: 767710 - RNA, 18 nt, Leptospira interrogans serovar lai str. 56601
agagauuguccuccagaa

SEQ ID NO: 767711 - RNA, 14 nt, Leptospira interrogans serovar lai str. 56601
agagauuucugaga

SEQ ID NO: 767712 - RNA, 15 nt, Leptospira interrogans serovar lai str. 56601
agagagcguucugcu

SEQ ID NO: 767713 - RNA, 13 nt, Leptospira interrogans serovar lai str. 56601
agagagugaaaaa

SEQ ID NO: 767714 - RNA, 12 nt, Leptospira interrogans serovar lai str. 56601
agacuuuuccua

SEQ ID NO: 767715 - RNA, 13 nt, Leptospira interrogans serovar lai str. 56601
agagaaaaauuuu

SEQ ID NO: 767716 - RNA, 14 nt, Leptospira interrogans serovar lai str. 56601
agagaaaguaaaga

SEQ ID NO: 767717 - RNA, 14 nt, Leptospira interrogans serovar lai str. 56601
agagaaagaaaaag

SEQ ID NO: 767718 - RNA, 15 nt, Leptospira interrogans serovar lai str. 56601
agagaaagaaaaaga

SEQ ID NO: 767719 - RNA, 18 nt, Leptospira interrogans serovar lai str. 56601
agagaacgaugcuugagc

SEQ ID NO: 767720 - RNA, 20 nt, Leptospira interrogans serovar lai str. 56601
agagaagccuauauuuugau

SEQ ID NO: 767721 - RNA, 23 nt, Leptospira interrogans serovar lai str. 56601
agagaauaucugaauuuuuauaa

SEQ ID NO: 767722 - RNA, 21 nt, Leptospira interrogans serovar lai str. 56601
agagaaucuguuuuguuuccu

SEQ ID NO: 767723 - RNA, 15 nt, Leptospira interrogans serovar lai str. 56601
agagaaugaucaaua

SEQ ID NO: 767724 - RNA, 19 nt, Leptospira interrogans serovar lai str. 56601
agagaaugaucaauagaau

SEQ ID NO: 767725 - RNA, 17 nt, Leptospira interrogans serovar lai str. 56601
agagacauugaagaaaa

SEQ ID NO: 767726 - RNA, 19 nt, Leptospira interrogans serovar lai str. 56601
agagaauuaauuuuucaac

SEQ ID NO: 767727 - RNA, 17 nt, Leptospira interrogans serovar lai str. 56601
agaauuuguuuguaaaa

SEQ ID NO: 767728 - RNA, 19 nt, Leptospira interrogans serovar lai str. 56601
agaauuuguuuguaaaaua

SEQ ID NO: 767729 - RNA, 22 nt, Leptospira interrogans serovar lai str. 56601
agaauuuguuugucuuuuucua

SEQ ID NO: 767730 - RNA, 15 nt, Leptospira interrogans serovar lai str. 56601
agaauuuguuuuaaa

SEQ ID NO: 767731 - RNA, 16 nt, Leptospira interrogans serovar lai str. 56601
agaauuuguuuuaaaa

SEQ ID NO: 767732 - RNA, 17 nt, Leptospira interrogans serovar lai str. 56601
agaauuuguuuuaaaau

SEQ ID NO: 767733 - RNA, 23 nt, Leptospira interrogans serovar lai str. 56601
agaauuuguuuuaaaauuuauga

SEQ ID NO: 767734 - RNA, 17 nt, Leptospira interrogans serovar lai str. 56601
agaauuuguuuuuaaaa

SEQ ID NO: 767735 - RNA, 13 nt, Leptospira interrogans serovar lai str. 56601
agaauuuuaaaaa

SEQ ID NO: 767736 - RNA, 14 nt, Leptospira interrogans serovar lai str. 56601
agaauuuuaaaaaa

SEQ ID NO: 767737 - RNA, 15 nt, Leptospira interrogans serovar lai str. 56601
agaauuuuaaaaaau

SEQ ID NO: 767738 - RNA, 16 nt, Leptospira interrogans serovar lai str. 56601
agaauuuuaaaaaaug

SEQ ID NO: 767739 - RNA, 21 nt, Leptospira interrogans serovar lai str. 56601
agaauuuguucuuaaaauugu

SEQ ID NO: 767740 - RNA, 13 nt, Leptospira interrogans serovar lai str. 56601
agaauuuuagaau

SEQ ID NO: 767741 - RNA, 20 nt, Leptospira interrogans serovar lai str. 56601
agaauuuuaugauuuucuuu

SEQ ID NO: 767742 - RNA, 23 nt, Leptospira interrogans serovar lai str. 56601
agaauuuuauuguguuuuuucuu

SEQ ID NO: 767743 - RNA, 17 nt, Leptospira interrogans serovar lai str. 56601
agaauuuccuaaaagua

SEQ ID NO: 767744 - RNA, 17 nt, Leptospira interrogans serovar lai str. 56601
agaauuucuaaaauucu

SEQ ID NO: 767745 - RNA, 20 nt, Leptospira interrogans serovar lai str. 56601
agaccuaaaauugcaccccu

SEQ ID NO: 767746 - RNA, 17 nt, Leptospira interrogans serovar lai str. 56601
agaccuaaacccugaga

SEQ ID NO: 767747 - RNA, 15 nt, Leptospira interrogans serovar lai str. 56601
agacccuaaaaaauu

SEQ ID NO: 767748 - RNA, 20 nt, Leptospira interrogans serovar lai str. 56601
agaccuuuuagauaaauaca

SEQ ID NO: 767749 - RNA, 16 nt, Leptospira interrogans serovar lai str. 56601
agacgaaaaacucagu

SEQ ID NO: 767750 - RNA, 16 nt, Leptospira interrogans serovar lai str. 56601
agaccucaaauaacuu

SEQ ID NO: 767751 - RNA, 23 nt, Leptospira interrogans serovar lai str. 56601
agacuucucuuuucgaaaauucu

SEQ ID NO: 767752 - RNA, 20 nt, Leptospira interrogans serovar lai str. 56601
agacugacugaaaaaaacgu

SEQ ID NO: 767753 - RNA, 17 nt, Leptospira interrogans serovar lai str. 56601
agacucuaguaaagaaa

SEQ ID NO: 767754 - RNA, 22 nt, Leptospira interrogans serovar lai str. 56601
agacucggaaauucucaaaaaa

SEQ ID NO: 767755 - RNA, 18 nt, Leptospira interrogans serovar lai str. 56601
agacugauuuuuuaaaug

SEQ ID NO: 767756 - RNA, 22 nt, Leptospira interrogans serovar lai str. 56601
agacugauuuuuuaaauguggg

SEQ ID NO: 767757 - RNA, 20 nt, Leptospira interrogans serovar lai str. 56601
agcgacgauagaagcgagag

SEQ ID NO: 767758 - RNA, 13 nt, Leptospira interrogans serovar lai str. 56601
agcgaccauagaa

SEQ ID NO: 767759 - RNA, 19 nt, Leptospira interrogans serovar lai str. 56601
agcgaccauagaagcgaga

SEQ ID NO: 767760 - RNA, 21 nt, Leptospira interrogans serovar lai str. 56601
agcgcagacucuucucccauc

SEQ ID NO: 767761 - RNA, 18 nt, Leptospira interrogans serovar lai str. 56601
agcggucuugaaaauuca

SEQ ID NO: 767762 - RNA, 16 nt, Leptospira interrogans serovar lai str. 56601
agccuaauccaauaaa

SEQ ID NO: 767763 - RNA, 23 nt, Leptospira interrogans serovar lai str. 56601
agccuaauccaauaaaauuuuau

SEQ ID NO: 767764 - RNA, 13 nt, Leptospira interrogans serovar lai str. 56601
agccuacaaaucg

SEQ ID NO: 767765 - RNA, 22 nt, Leptospira interrogans serovar lai str. 56601
agcgaacggcuuuaguuugaaa

SEQ ID NO: 767766 - RNA, 20 nt, Leptospira interrogans serovar lai str. 56601
agccuuccaucaaauacaaa

SEQ ID NO: 767767 - RNA, 16 nt, Leptospira interrogans serovar lai str. 56601
agccucaaguaaaacg

SEQ ID NO: 767768 - RNA, 23 nt, Leptospira interrogans serovar lai str. 56601
agccgcgcuuuccuuauuaaaac

SEQ ID NO: 767769 - RNA, 15 nt, Leptospira interrogans serovar lai str. 56601
agccaccaucaaaau

SEQ ID NO: 767770 - RNA, 18 nt, Leptospira interrogans serovar lai str. 56601
agccaauuccaaaaaucu

SEQ ID NO: 767771 - RNA, 15 nt, Leptospira interrogans serovar lai str. 56601
agccaacacauucca

SEQ ID NO: 767772 - RNA, 15 nt, Leptospira interrogans serovar lai str. 56601
agcauuaaaaaagau

SEQ ID NO: 767773 - RNA, 22 nt, Leptospira interrogans serovar lai str. 56601
agcauuacuacagacaauccua

SEQ ID NO: 767774 - RNA, 12 nt, Leptospira interrogans serovar lai str. 56601
agccaaaaguuu

SEQ ID NO: 767775 - RNA, 15 nt, Leptospira interrogans serovar lai str. 56601
agccaaaaauuagaa

SEQ ID NO: 767776 - RNA, 11 nt, Leptospira interrogans serovar lai str. 56601
agcaguucuaa

SEQ ID NO: 767777 - RNA, 13 nt, Leptospira interrogans serovar lai str. 56601
agcauaaaaaaau

SEQ ID NO: 767778 - RNA, 14 nt, Leptospira interrogans serovar lai str. 56601
agcaucaacaucac

SEQ ID NO: 767779 - RNA, 16 nt, Leptospira interrogans serovar lai str. 56601
aaaaccuucgugaaau

SEQ ID NO: 767780 - RNA, 18 nt, Leptospira interrogans serovar lai str. 56601
aaaaccuguaaaugaauu

SEQ ID NO: 767781 - RNA, 20 nt, Leptospira interrogans serovar lai str. 56601
aaaaccuuuauuuaauaaaa

SEQ ID NO: 767782 - RNA, 14 nt, Leptospira interrogans serovar lai str. 56601
aaaaccucaaaaaa

SEQ ID NO: 767783 - RNA, 15 nt, Leptospira interrogans serovar lai str. 56601
aaaaccucaaaaaau

SEQ ID NO: 767784 - RNA, 23 nt, Leptospira interrogans serovar lai str. 56601
aaaaccucaaaaaauuuacacga

SEQ ID NO: 767785 - RNA, 17 nt, Leptospira interrogans serovar lai str. 56601
aaaaccguuguuuuaca

SEQ ID NO: 767786 - RNA, 19 nt, Leptospira interrogans serovar lai str. 56601
aaaaccguuguuuuacagc

SEQ ID NO: 767787 - RNA, 14 nt, Leptospira interrogans serovar lai str. 56601
aaaaccguuuguaa

SEQ ID NO: 767788 - RNA, 16 nt, Leptospira interrogans serovar lai str. 56601
aaaaccgucccaaaau

SEQ ID NO: 767789 - RNA, 16 nt, Leptospira interrogans serovar lai str. 56601
agcagaagcuuuauua

SEQ ID NO: 767790 - RNA, 22 nt, Leptospira interrogans serovar lai str. 56601
agcacauccgcauucucacaaa

SEQ ID NO: 767791 - RNA, 13 nt, Leptospira interrogans serovar lai str. 56601
agcacaauauauu

SEQ ID NO: 767792 - RNA, 15 nt, Leptospira interrogans serovar lai str. 56601
agcacaauauauuca

SEQ ID NO: 767793 - RNA, 13 nt, Leptospira interrogans serovar lai str. 56601
agcaauuugugaa

SEQ ID NO: 767794 - RNA, 23 nt, Leptospira interrogans serovar lai str. 56601
agcaauucuaagaccuaaacccu

SEQ ID NO: 767795 - RNA, 13 nt, Leptospira interrogans serovar lai str. 56601
agcaauaaaauca

SEQ ID NO: 767796 - RNA, 23 nt, Leptospira interrogans serovar lai str. 56601
agcaaucuguuuagaauauuuuc

SEQ ID NO: 767797 - RNA, 20 nt, Leptospira interrogans serovar lai str. 56601
agcaaucgaucuguaaaauu

SEQ ID NO: 767798 - RNA, 12 nt, Leptospira interrogans serovar lai str. 56601
agcaaucuuccu

SEQ ID NO: 767799 - RNA, 22 nt, Leptospira interrogans serovar lai str. 56601
agcaagaccuuguguuucagac

SEQ ID NO: 767800 - RNA, 16 nt, Leptospira interrogans serovar lai str. 56601
agauucaaagauaaaa

SEQ ID NO: 767801 - RNA, 22 nt, Leptospira interrogans serovar lai str. 56601
agauucaaagauaaaauauagu

SEQ ID NO: 767802 - RNA, 15 nt, Leptospira interrogans serovar lai str. 56601
agauuaugguaaaau

SEQ ID NO: 767803 - RNA, 16 nt, Leptospira interrogans serovar lai str. 56601
agauuauuuacauaua

SEQ ID NO: 767804 - RNA, 17 nt, Leptospira interrogans serovar lai str. 56601
agauuauuuacauauau

SEQ ID NO: 767805 - RNA, 13 nt, Leptospira interrogans serovar lai str. 56601
agcaacuguggga

SEQ ID NO: 767806 - RNA, 21 nt, Leptospira interrogans serovar lai str. 56601
agcaacggcugaugcauccaa

SEQ ID NO: 767807 - RNA, 22 nt, Leptospira interrogans serovar lai str. 56601
acuuaaugagauuaaaacugcu

SEQ ID NO: 767808 - RNA, 17 nt, Leptospira interrogans serovar lai str. 56601
acuguuuuugaaacauu

SEQ ID NO: 767809 - RNA, 22 nt, Leptospira interrogans serovar lai str. 56601
acuguuucgacguaaaaauauu

SEQ ID NO: 767810 - RNA, 19 nt, Leptospira interrogans serovar lai str. 56601
acuguuuaauaaagauuca

SEQ ID NO: 767811 - RNA, 21 nt, Leptospira interrogans serovar lai str. 56601
acuguaucauagaauaaucgg

SEQ ID NO: 767812 - RNA, 17 nt, Leptospira interrogans serovar lai str. 56601
acuguaaauuagauuau

SEQ ID NO: 767813 - RNA, 13 nt, Leptospira interrogans serovar lai str. 56601
acuguaauuaauu

SEQ ID NO: 767814 - RNA, 20 nt, Leptospira interrogans serovar lai str. 56601
acuguaauuaauucagcauc

SEQ ID NO: 767815 - RNA, 16 nt, Leptospira interrogans serovar lai str. 56601
acuguguucuuuuuga

SEQ ID NO: 767816 - RNA, 11 nt, Leptospira interrogans serovar lai str. 56601
acugguuuugg

SEQ ID NO: 767817 - RNA, 14 nt, Leptospira interrogans serovar lai str. 56601
acugguuuuucuuu

SEQ ID NO: 767818 - RNA, 21 nt, Leptospira interrogans serovar lai str. 56601
acuguaaaaguuuuugaaaug

SEQ ID NO: 767819 - RNA, 13 nt, Leptospira interrogans serovar lai str. 56601
acuguaaaauuua

SEQ ID NO: 767820 - RNA, 16 nt, Leptospira interrogans serovar lai str. 56601
acuguaaaauuuaaau

SEQ ID NO: 767821 - RNA, 23 nt, Leptospira interrogans serovar lai str. 56601
acuguaaaauuuagguuuguggu

SEQ ID NO: 767822 - RNA, 22 nt, Leptospira interrogans serovar lai str. 56601
acuguaaacuugauuaaacagg

SEQ ID NO: 767823 - RNA, 18 nt, Leptospira interrogans serovar lai str. 56601
acugaauaaaaaguacau

SEQ ID NO: 767824 - RNA, 16 nt, Leptospira interrogans serovar lai str. 56601
acucucacaaaucaug

SEQ ID NO: 767825 - RNA, 15 nt, Leptospira interrogans serovar lai str. 56601
acucucacaaaucgu

SEQ ID NO: 767826 - RNA, 13 nt, Leptospira interrogans serovar lai str. 56601
acucuauuauaua

SEQ ID NO: 767827 - RNA, 18 nt, Leptospira interrogans serovar lai str. 56601
acucuaguaaagaaacuc

SEQ ID NO: 767828 - RNA, 14 nt, Leptospira interrogans serovar lai str. 56601
acucuauauaaaga

SEQ ID NO: 767829 - RNA, 19 nt, Leptospira interrogans serovar lai str. 56601
acucuauauaaagaaaaac

SEQ ID NO: 767830 - RNA, 14 nt, Leptospira interrogans serovar lai str. 56601
acugacugaaaaaa

SEQ ID NO: 767831 - RNA, 21 nt, Leptospira interrogans serovar lai str. 56601
acugagagaaaguaaagaugg

SEQ ID NO: 767832 - RNA, 16 nt, Leptospira interrogans serovar lai str. 56601
acugauucuuuaaaug

SEQ ID NO: 767833 - RNA, 13 nt, Leptospira interrogans serovar lai str. 56601
acugcaagaaacc

SEQ ID NO: 767834 - RNA, 22 nt, Leptospira interrogans serovar lai str. 56601
acugcaagaaaccucuauaaau

SEQ ID NO: 767835 - RNA, 19 nt, Leptospira interrogans serovar lai str. 56601
acugcccguuucaauuuuu

SEQ ID NO: 767836 - RNA, 20 nt, Leptospira interrogans serovar lai str. 56601
acugcccguuucaauuuuug

SEQ ID NO: 767837 - RNA, 23 nt, Leptospira interrogans serovar lai str. 56601
acugcccguuucaauuuuugaaa

SEQ ID NO: 767838 - RNA, 16 nt, Leptospira interrogans serovar lai str. 56601
acucccacuuuuaaag

SEQ ID NO: 767839 - RNA, 18 nt, Leptospira interrogans serovar lai str. 56601
acucccacaauuuugaau

SEQ ID NO: 767840 - RNA, 24 nt, Leptospira interrogans serovar lai str. 56601
acucauaaaauaacuuccaucaga

SEQ ID NO: 767841 - RNA, 16 nt, Leptospira interrogans serovar lai str. 56601
acucauauuuuuagaa

SEQ ID NO: 767842 - RNA, 17 nt, Leptospira interrogans serovar lai str. 56601
acucauacuuuuagaag

SEQ ID NO: 767843 - RNA, 14 nt, Leptospira interrogans serovar lai str. 56601
acucagaaaacuca

SEQ ID NO: 767844 - RNA, 21 nt, Leptospira interrogans serovar lai str. 56601
acucagagcgauauaauaaaa

SEQ ID NO: 767845 - RNA, 17 nt, Leptospira interrogans serovar lai str. 56601
acucagcgaaaauacuu

SEQ ID NO: 767846 - RNA, 19 nt, Leptospira interrogans serovar lai str. 56601
acucauuuccaucuuuaua

SEQ ID NO: 767847 - RNA, 22 nt, Leptospira interrogans serovar lai str. 56601
acucauuuugcccuauugcuuu

SEQ ID NO: 767848 - RNA, 18 nt, Leptospira interrogans serovar lai str. 56601
acucauuuuucuaaaaaa

SEQ ID NO: 767849 - RNA, 16 nt, Leptospira interrogans serovar lai str. 56601
acuccagaauuagauu

SEQ ID NO: 767850 - RNA, 20 nt, Leptospira interrogans serovar lai str. 56601
acuccagaauuagauuaaau

SEQ ID NO: 767851 - RNA, 16 nt, Leptospira interrogans serovar lai str. 56601
acucauggagaauaaa

SEQ ID NO: 767852 - RNA, 19 nt, Leptospira interrogans serovar lai str. 56601
acucacaccuucuuuuuug

SEQ ID NO: 767853 - RNA, 16 nt, Leptospira interrogans serovar lai str. 56601
acucacaucucuuuuu

SEQ ID NO: 767854 - RNA, 16 nt, Leptospira interrogans serovar lai str. 56601
acucacauuauuuaau

SEQ ID NO: 767855 - RNA, 22 nt, Leptospira interrogans serovar lai str. 56601
acucaauuugauaugaaucagc

SEQ ID NO: 767856 - RNA, 23 nt, Leptospira interrogans serovar lai str. 56601
acucaauguguugucuacgaucg

SEQ ID NO: 767857 - RNA, 15 nt, Leptospira interrogans serovar lai str. 56601
acucacguuacuacu

SEQ ID NO: 767858 - RNA, 17 nt, Leptospira interrogans serovar lai str. 56601
acucacguuauuuuaac

SEQ ID NO: 767859 - RNA, 23 nt, Leptospira interrogans serovar lai str. 56601
acucaacacaacggcucucuccu

SEQ ID NO: 767860 - RNA, 22 nt, Leptospira interrogans serovar lai str. 56601
acucaaaggaaaaugaagaaac

SEQ ID NO: 767861 - RNA, 20 nt, Leptospira interrogans serovar lai str. 56601
acuauggaauauaaaagaau

SEQ ID NO: 767862 - RNA, 18 nt, Leptospira interrogans serovar lai str. 56601
acuauggaauuuuuuaac

SEQ ID NO: 767863 - RNA, 15 nt, Leptospira interrogans serovar lai str. 56601
acuaugaaauuuuuc

SEQ ID NO: 767864 - RNA, 19 nt, Leptospira interrogans serovar lai str. 56601
acuaugaagucuuaucuca

SEQ ID NO: 767865 - RNA, 14 nt, Leptospira interrogans serovar lai str. 56601
acuacuuuuagaaa

SEQ ID NO: 767866 - RNA, 21 nt, Leptospira interrogans serovar lai str. 56601
acuacuuuuagaaaauuuuua

SEQ ID NO: 767867 - RNA, 15 nt, Leptospira interrogans serovar lai str. 56601
acuacuguaagauuu

SEQ ID NO: 767868 - RNA, 21 nt, Leptospira interrogans serovar lai str. 56601
acuaggaaaauuuaacaacau

SEQ ID NO: 767869 - RNA, 11 nt, Leptospira interrogans serovar lai str. 56601
acuaguuccuu

SEQ ID NO: 767870 - RNA, 23 nt, Leptospira interrogans serovar lai str. 56601
acuaguuccuuaaauauaucuuc

SEQ ID NO: 767871 - RNA, 20 nt, Leptospira interrogans serovar lai str. 56601
acuagggaaaguuuuuuaaa

SEQ ID NO: 767872 - RNA, 15 nt, Leptospira interrogans serovar lai str. 56601
acuagggaauuuuuc

SEQ ID NO: 767873 - RNA, 16 nt, Leptospira interrogans serovar lai str. 56601
acuagggaauuuuuca

SEQ ID NO: 767874 - RNA, 17 nt, Leptospira interrogans serovar lai str. 56601
acuaucuuaaaaugauu

SEQ ID NO: 767875 - RNA, 22 nt, Leptospira interrogans serovar lai str. 56601
acuaccuuuauuccuuuucuuu

SEQ ID NO: 767876 - RNA, 15 nt, Leptospira interrogans serovar lai str. 56601
acuacgaaaauuuaa

SEQ ID NO: 767877 - RNA, 17 nt, Leptospira interrogans serovar lai str. 56601
acuaccucaauuuucca

SEQ ID NO: 767878 - RNA, 17 nt, Leptospira interrogans serovar lai str. 56601
acguuaauugagauuug

SEQ ID NO: 767879 - RNA, 16 nt, Leptospira interrogans serovar lai str. 56601
acuacucacaaauugu

SEQ ID NO: 767880 - RNA, 18 nt, Leptospira interrogans serovar lai str. 56601
acuacucacaaauuguca

SEQ ID NO: 767881 - RNA, 21 nt, Leptospira interrogans serovar lai str. 56601
acuacuccccgaacuauacaa

SEQ ID NO: 767882 - RNA, 17 nt, Leptospira interrogans serovar lai str. 56601
acuacucggacgcauga

SEQ ID NO: 767883 - RNA, 16 nt, Leptospira interrogans serovar lai str. 56601
acuacuaaaucucaau

SEQ ID NO: 767884 - RNA, 18 nt, Leptospira interrogans serovar lai str. 56601
acuacuacaauuaaaaag

SEQ ID NO: 767885 - RNA, 17 nt, Leptospira interrogans serovar lai str. 56601
acuacuacgaaaauuua

SEQ ID NO: 767886 - RNA, 16 nt, Leptospira interrogans serovar lai str. 56601
acuacuacuuuucuga

SEQ ID NO: 767887 - RNA, 20 nt, Leptospira interrogans serovar lai str. 56601
acuacuauguuuuuggguuu

SEQ ID NO: 767888 - RNA, 16 nt, Leptospira interrogans serovar lai str. 56601
acggcacuuugugaua

SEQ ID NO: 767889 - RNA, 21 nt, Leptospira interrogans serovar lai str. 56601
acggucgauugaagcguuuuc

SEQ ID NO: 767890 - RNA, 16 nt, Leptospira interrogans serovar lai str. 56601
acgucuaguccucuuu

SEQ ID NO: 767891 - RNA, 13 nt, Leptospira interrogans serovar lai str. 56601
acgucuauaaagc

SEQ ID NO: 767892 - RNA, 19 nt, Leptospira interrogans serovar lai str. 56601
acgucgcuuacaaagugau

SEQ ID NO: 767893 - RNA, 23 nt, Leptospira interrogans serovar lai str. 56601
acgugaguucggcuuaagaaaau

SEQ ID NO: 767894 - RNA, 19 nt, Leptospira interrogans serovar lai str. 56601
acgucgaacucacauuauu

SEQ ID NO: 767895 - RNA, 13 nt, Leptospira interrogans serovar lai str. 56601
acguggauuuuau

SEQ ID NO: 767896 - RNA, 17 nt, Leptospira interrogans serovar lai str. 56601
acgugguaguucccaca

SEQ ID NO: 767897 - RNA, 18 nt, Leptospira interrogans serovar lai str. 56601
acgugguaguucccacaa

SEQ ID NO: 767898 - RNA, 15 nt, Leptospira interrogans serovar lai str. 56601
acguuaaaaguaaua

SEQ ID NO: 767899 - RNA, 12 nt, Leptospira interrogans serovar lai str. 56601
acguauuuuuaa

SEQ ID NO: 767900 - RNA, 16 nt, Leptospira interrogans serovar lai str. 56601
acguauuuuuaaaugu

SEQ ID NO: 767901 - RNA, 15 nt, Leptospira interrogans serovar lai str. 56601
acguauguguaauga

SEQ ID NO: 767902 - RNA, 21 nt, Leptospira interrogans serovar lai str. 56601
acguauguguaaugauuucag

SEQ ID NO: 767903 - RNA, 15 nt, Leptospira interrogans serovar lai str. 56601
acguauaaaaacagc

SEQ ID NO: 767904 - RNA, 20 nt, Leptospira interrogans serovar lai str. 56601
acgcgccuuccuaauuuuag

SEQ ID NO: 767905 - RNA, 19 nt, Leptospira interrogans serovar lai str. 56601
acgcguaauuuuuuggaaa

SEQ ID NO: 767906 - RNA, 13 nt, Leptospira interrogans serovar lai str. 56601
acgauauuuuguu

SEQ ID NO: 767907 - RNA, 19 nt, Leptospira interrogans serovar lai str. 56601
acgccauguuuuuaaaauc

SEQ ID NO: 767908 - RNA, 16 nt, Leptospira interrogans serovar lai str. 56601
acgaucagaaaaacaa

SEQ ID NO: 767909 - RNA, 22 nt, Leptospira interrogans serovar lai str. 56601
acgacagauucaauuuuuauaa

SEQ ID NO: 767910 - RNA, 14 nt, Leptospira interrogans serovar lai str. 56601
acgaauuuuuaaau

SEQ ID NO: 767911 - RNA, 11 nt, Leptospira interrogans serovar lai str. 56601
acgaauuuuuc

SEQ ID NO: 767912 - RNA, 18 nt, Leptospira interrogans serovar lai str. 56601
acgaauuuuuuagaaacu

SEQ ID NO: 767913 - RNA, 14 nt, Leptospira interrogans serovar lai str. 56601
acgacaaaucuucu

SEQ ID NO: 767914 - RNA, 15 nt, Leptospira interrogans serovar lai str. 56601
acgaauugauaaaac

SEQ ID NO: 767915 - RNA, 18 nt, Leptospira interrogans serovar lai str. 56601
acgaauugauaaaaccgu

SEQ ID NO: 767916 - RNA, 20 nt, Leptospira interrogans serovar lai str. 56601
accuuuucuagacuuucuuu

SEQ ID NO: 767917 - RNA, 14 nt, Leptospira interrogans serovar lai str. 56601
acgaaaauuaaaaa

SEQ ID NO: 767918 - RNA, 15 nt, Leptospira interrogans serovar lai str. 56601
accuuuuaugaguuc

SEQ ID NO: 767919 - RNA, 23 nt, Leptospira interrogans serovar lai str. 56601
acgaaacuuuuagaauucuccac

SEQ ID NO: 767920 - RNA, 23 nt, Leptospira interrogans serovar lai str. 56601
acgaaucacccaaucuuacaagu

SEQ ID NO: 767921 - RNA, 22 nt, Leptospira interrogans serovar lai str. 56601
acgaaucagauccuuauacuuu

SEQ ID NO: 767922 - RNA, 13 nt, Leptospira interrogans serovar lai str. 56601
acgaaucuguucg

SEQ ID NO: 767923 - RNA, 22 nt, Leptospira interrogans serovar lai str. 56601
acgaauccugcuaacugauuau

SEQ ID NO: 767924 - RNA, 20 nt, Leptospira interrogans serovar lai str. 56601
acgagcaucuuuagaaugag

SEQ ID NO: 767925 - RNA, 21 nt, Leptospira interrogans serovar lai str. 56601
acgaguuuuuguuaucaacuu

SEQ ID NO: 767926 - RNA, 22 nt, Leptospira interrogans serovar lai str. 56601
acgagucuuuuguuuaaaauuu

SEQ ID NO: 767927 - RNA, 19 nt, Leptospira interrogans serovar lai str. 56601
accugcuccauaaaagugu

SEQ ID NO: 767928 - RNA, 13 nt, Leptospira interrogans serovar lai str. 56601
accugauuuuucu

SEQ ID NO: 767929 - RNA, 16 nt, Leptospira interrogans serovar lai str. 56601
accugauuuuucugua

SEQ ID NO: 767930 - RNA, 19 nt, Leptospira interrogans serovar lai str. 56601
accugcaacaccaauucgg

SEQ ID NO: 767931 - RNA, 17 nt, Leptospira interrogans serovar lai str. 56601
accuuucuaaaaauuuc

SEQ ID NO: 767932 - RNA, 17 nt, Leptospira interrogans serovar lai str. 56601
accuugaaacuuuuaau

SEQ ID NO: 767933 - RNA, 15 nt, Leptospira interrogans serovar lai str. 56601
accuucucuuuuaaa

SEQ ID NO: 767934 - RNA, 18 nt, Leptospira interrogans serovar lai str. 56601
accuucucuuuuaaaaac

SEQ ID NO: 767935 - RNA, 13 nt, Leptospira interrogans serovar lai str. 56601
accuguaaaugaa

SEQ ID NO: 767936 - RNA, 16 nt, Leptospira interrogans serovar lai str. 56601
accuggcucucagcuc

SEQ ID NO: 767937 - RNA, 17 nt, Leptospira interrogans serovar lai str. 56601
accguugugagaaauac

SEQ ID NO: 767938 - RNA, 15 nt, Leptospira interrogans serovar lai str. 56601
accguuguaugauuu

SEQ ID NO: 767939 - RNA, 14 nt, Leptospira interrogans serovar lai str. 56601
accgucccaaaauc

SEQ ID NO: 767940 - RNA, 13 nt, Leptospira interrogans serovar lai str. 56601
accuacagaacac

SEQ ID NO: 767941 - RNA, 16 nt, Leptospira interrogans serovar lai str. 56601
accucaaaaaauuuua

SEQ ID NO: 767942 - RNA, 14 nt, Leptospira interrogans serovar lai str. 56601
accucaaagaaauu

SEQ ID NO: 767943 - RNA, 21 nt, Leptospira interrogans serovar lai str. 56601
accucaacagaauguucuuag

SEQ ID NO: 767944 - RNA, 15 nt, Leptospira interrogans serovar lai str. 56601
accucaacauaaaaa

SEQ ID NO: 767945 - RNA, 19 nt, Leptospira interrogans serovar lai str. 56601
accuaauguugaaugaaac

SEQ ID NO: 767946 - RNA, 23 nt, Leptospira interrogans serovar lai str. 56601
accuaauguugaaugaaaccuga

SEQ ID NO: 767947 - RNA, 16 nt, Leptospira interrogans serovar lai str. 56601
accuaauguuuuuuau

SEQ ID NO: 767948 - RNA, 16 nt, Leptospira interrogans serovar lai str. 56601
accuaaugcuauugaa

SEQ ID NO: 767949 - RNA, 19 nt, Leptospira interrogans serovar lai str. 56601
accuaaacgaguuuuuguu

SEQ ID NO: 767950 - RNA, 16 nt, Leptospira interrogans serovar lai str. 56601
accuaaaaugaaaaaa

SEQ ID NO: 767951 - RNA, 11 nt, Leptospira interrogans serovar lai str. 56601
accuaaaaaua

SEQ ID NO: 767952 - RNA, 19 nt, Leptospira interrogans serovar lai str. 56601
accuaaauauuuauuacaa

SEQ ID NO: 767953 - RNA, 15 nt, Leptospira interrogans serovar lai str. 56601
accguuuauuuuuau

SEQ ID NO: 767954 - RNA, 15 nt, Leptospira interrogans serovar lai str. 56601
accguuuuauaaaua

SEQ ID NO: 767955 - RNA, 14 nt, Leptospira interrogans serovar lai str. 56601
accguuuuuaaaug

SEQ ID NO: 767956 - RNA, 21 nt, Leptospira interrogans serovar lai str. 56601
accgcuagaaguuauaaugau

SEQ ID NO: 767957 - RNA, 15 nt, Leptospira interrogans serovar lai str. 56601
accgauuucuauuuu

SEQ ID NO: 767958 - RNA, 22 nt, Leptospira interrogans serovar lai str. 56601
accgcaaaucacaauuuuacaa

SEQ ID NO: 767959 - RNA, 13 nt, Leptospira interrogans serovar lai str. 56601
accgcugaaaaaa

SEQ ID NO: 767960 - RNA, 14 nt, Leptospira interrogans serovar lai str. 56601
accgucaauuuuua

SEQ ID NO: 767961 - RNA, 17 nt, Leptospira interrogans serovar lai str. 56601
acccgauauuaaaauga

SEQ ID NO: 767962 - RNA, 17 nt, Leptospira interrogans serovar lai str. 56601
acccccgucuacuuuua

SEQ ID NO: 767963 - RNA, 17 nt, Leptospira interrogans serovar lai str. 56601
accccgaagagcuuuuc

SEQ ID NO: 767964 - RNA, 18 nt, Leptospira interrogans serovar lai str. 56601
acccagucuccauaauac

SEQ ID NO: 767965 - RNA, 13 nt, Leptospira interrogans serovar lai str. 56601
acccauaaaaaua

SEQ ID NO: 767966 - RNA, 15 nt, Leptospira interrogans serovar lai str. 56601
accaucuuugauauu

SEQ ID NO: 767967 - RNA, 16 nt, Leptospira interrogans serovar lai str. 56601
accaugaauaaacaau

SEQ ID NO: 767968 - RNA, 17 nt, Leptospira interrogans serovar lai str. 56601
accaugaauaaacaaua

SEQ ID NO: 767969 - RNA, 20 nt, Leptospira interrogans serovar lai str. 56601
accaucucaaaaauaucuua

SEQ ID NO: 767970 - RNA, 17 nt, Leptospira interrogans serovar lai str. 56601
accaucuacagaaccca

SEQ ID NO: 767971 - RNA, 16 nt, Leptospira interrogans serovar lai str. 56601
accaucuaaagcggga

SEQ ID NO: 767972 - RNA, 14 nt, Leptospira interrogans serovar lai str. 56601
acccugccaaaauc

SEQ ID NO: 767973 - RNA, 18 nt, Leptospira interrogans serovar lai str. 56601
acccuuaacgguuuugau

SEQ ID NO: 767974 - RNA, 20 nt, Leptospira interrogans serovar lai str. 56601
accgaaacagagcuuuacaa

SEQ ID NO: 767975 - RNA, 21 nt, Leptospira interrogans serovar lai str. 56601
accgauaagucuagaaaugua

SEQ ID NO: 767976 - RNA, 21 nt, Leptospira interrogans serovar lai str. 56601
accagugccauuuuucuucuu

SEQ ID NO: 767977 - RNA, 15 nt, Leptospira interrogans serovar lai str. 56601
accaguuaaauucau

SEQ ID NO: 767978 - RNA, 17 nt, Leptospira interrogans serovar lai str. 56601
accaguuuguuuuuuau

SEQ ID NO: 767979 - RNA, 13 nt, Leptospira interrogans serovar lai str. 56601
accauaaauuuua

SEQ ID NO: 767980 - RNA, 14 nt, Leptospira interrogans serovar lai str. 56601
accauaaauuuuaa

SEQ ID NO: 767981 - RNA, 15 nt, Leptospira interrogans serovar lai str. 56601
accauaaauuuugau

SEQ ID NO: 767982 - RNA, 22 nt, Leptospira interrogans serovar lai str. 56601
accaucgauuuacuuuaaaauu

SEQ ID NO: 767983 - RNA, 21 nt, Leptospira interrogans serovar lai str. 56601
accaagaguguucaucuucuc

SEQ ID NO: 767984 - RNA, 14 nt, Leptospira interrogans serovar lai str. 56601
accaaccccacaag

SEQ ID NO: 767985 - RNA, 13 nt, Leptospira interrogans serovar lai str. 56601
accagcaagcaca

SEQ ID NO: 767986 - RNA, 14 nt, Leptospira interrogans serovar lai str. 56601
accagcaagcacau

SEQ ID NO: 767987 - RNA, 17 nt, Leptospira interrogans serovar lai str. 56601
accagauguaaucuaua

SEQ ID NO: 767988 - RNA, 17 nt, Leptospira interrogans serovar lai str. 56601
accagaucaauucuuaa

SEQ ID NO: 767989 - RNA, 22 nt, Leptospira interrogans serovar lai str. 56601
accagagccguaaauauuuuuu

SEQ ID NO: 767990 - RNA, 19 nt, Leptospira interrogans serovar lai str. 56601
accagacuccaagccgcuu

SEQ ID NO: 767991 - RNA, 16 nt, Leptospira interrogans serovar lai str. 56601
aguaaugccuacaaau

SEQ ID NO: 767992 - RNA, 16 nt, Leptospira interrogans serovar lai str. 56601
aguaaucuuuuuaaaa

SEQ ID NO: 767993 - RNA, 18 nt, Leptospira interrogans serovar lai str. 56601
aguaaucuuuuuaaaagu

SEQ ID NO: 767994 - RNA, 15 nt, Leptospira interrogans serovar lai str. 56601
aguaaauaaaaaacg

SEQ ID NO: 767995 - RNA, 21 nt, Leptospira interrogans serovar lai str. 56601
aguaaaucgaugguuucaauu

SEQ ID NO: 767996 - RNA, 17 nt, Leptospira interrogans serovar lai str. 56601
aguaaaucugaggauuu

SEQ ID NO: 767997 - RNA, 19 nt, Leptospira interrogans serovar lai str. 56601
aguaacgaguagaauucuc

SEQ ID NO: 767998 - RNA, 15 nt, Leptospira interrogans serovar lai str. 56601
aguaacgauuucuau

SEQ ID NO: 767999 - RNA, 16 nt, Leptospira interrogans serovar lai str. 56601
aguaaauccacaaguu

SEQ ID NO: 768000 - RNA, 11 nt, Leptospira interrogans serovar lai str. 56601
aguaaauaaac

SEQ ID NO: 768001 - RNA, 15 nt, Leptospira interrogans serovar lai str. 56601
agguuuugagacaaa

SEQ ID NO: 768002 - RNA, 23 nt, Leptospira interrogans serovar lai str. 56601
agguucuugcaaaaauagaauuu

SEQ ID NO: 768003 - RNA, 14 nt, Leptospira interrogans serovar lai str. 56601
agguuuuauaaaau

SEQ ID NO: 768004 - RNA, 20 nt, Leptospira interrogans serovar lai str. 56601
agguuuuucgaaaagaaaua

SEQ ID NO: 768005 - RNA, 20 nt, Leptospira interrogans serovar lai str. 56601
agguuauuuacgccgaauuc

SEQ ID NO: 768006 - RNA, 22 nt, Leptospira interrogans serovar lai str. 56601
agguuccgggagcgcuugaaaa

SEQ ID NO: 768007 - RNA, 21 nt, Leptospira interrogans serovar lai str. 56601
agguucuuaugagauuuuugg

SEQ ID NO: 768008 - RNA, 16 nt, Leptospira interrogans serovar lai str. 56601
aggugguugggaacaa

SEQ ID NO: 768009 - RNA, 16 nt, Leptospira interrogans serovar lai str. 56601
agguuauaauuucuuu

SEQ ID NO: 768010 - RNA, 21 nt, Leptospira interrogans serovar lai str. 56601
agguuaaaaauuuaauuuuuu

SEQ ID NO: 768011 - RNA, 17 nt, Leptospira interrogans serovar lai str. 56601
agguauuuuagagaaac

SEQ ID NO: 768012 - RNA, 23 nt, Leptospira interrogans serovar lai str. 56601
aggucugaaggaauauucauuca

SEQ ID NO: 768013 - RNA, 23 nt, Leptospira interrogans serovar lai str. 56601
aggguuuuuacaauuaaauccac

SEQ ID NO: 768014 - RNA, 21 nt, Leptospira interrogans serovar lai str. 56601
agggucuuucgagauuaaaau

SEQ ID NO: 768015 - RNA, 21 nt, Leptospira interrogans serovar lai str. 56601
agggaucgaucuguaaaaugu

SEQ ID NO: 768016 - RNA, 16 nt, Leptospira interrogans serovar lai str. 56601
aggcuuaucuguaaaa

SEQ ID NO: 768017 - RNA, 21 nt, Leptospira interrogans serovar lai str. 56601
aggcgguaaaacaaaaaaaca

SEQ ID NO: 768018 - RNA, 17 nt, Leptospira interrogans serovar lai str. 56601
aggcguugagcacagca

SEQ ID NO: 768019 - RNA, 13 nt, Leptospira interrogans serovar lai str. 56601
aggcucaauauuu

SEQ ID NO: 768020 - RNA, 20 nt, Leptospira interrogans serovar lai str. 56601
aggcucaauauuuaaaaauu

SEQ ID NO: 768021 - RNA, 21 nt, Leptospira interrogans serovar lai str. 56601
aggcugcgaccuguagagaag

SEQ ID NO: 768022 - RNA, 19 nt, Leptospira interrogans serovar lai str. 56601
aggcugucuucagcagucu

SEQ ID NO: 768023 - RNA, 15 nt, Leptospira interrogans serovar lai str. 56601
aggcaauauuauuuu

SEQ ID NO: 768024 - RNA, 15 nt, Leptospira interrogans serovar lai str. 56601
aggcagcuaagaaaa

SEQ ID NO: 768025 - RNA, 13 nt, Leptospira interrogans serovar lai str. 56601
aggauuaauuccc

SEQ ID NO: 768026 - RNA, 22 nt, Leptospira interrogans serovar lai str. 56601
aggcaaacuuuuuuagcaaaua

SEQ ID NO: 768027 - RNA, 14 nt, Leptospira interrogans serovar lai str. 56601
aggcaucauucuuu

SEQ ID NO: 768028 - RNA, 18 nt, Leptospira interrogans serovar lai str. 56601
aggcauaugaaaauaaua

SEQ ID NO: 768029 - RNA, 22 nt, Leptospira interrogans serovar lai str. 56601
aggagguggaaaaguuuucuuu

SEQ ID NO: 768030 - RNA, 13 nt, Leptospira interrogans serovar lai str. 56601
aggaguaucaaua

SEQ ID NO: 768031 - RNA, 20 nt, Leptospira interrogans serovar lai str. 56601
aggaguaucaauagaaauac

SEQ ID NO: 768032 - RNA, 23 nt, Leptospira interrogans serovar lai str. 56601
aggauaacccucaucagucauua

SEQ ID NO: 768033 - RNA, 16 nt, Leptospira interrogans serovar lai str. 56601
aggauaaccuaaaauu

SEQ ID NO: 768034 - RNA, 11 nt, Leptospira interrogans serovar lai str. 56601
aggaguuccua

SEQ ID NO: 768035 - RNA, 15 nt, Leptospira interrogans serovar lai str. 56601
aggaauacaauugau

SEQ ID NO: 768036 - RNA, 21 nt, Leptospira interrogans serovar lai str. 56601
aggaauacaauugauuuaaaa

SEQ ID NO: 768037 - RNA, 14 nt, Leptospira interrogans serovar lai str. 56601
aggaaacguauuuu

SEQ ID NO: 768038 - RNA, 16 nt, Leptospira interrogans serovar lai str. 56601
aggaccugcuuugguu

SEQ ID NO: 768039 - RNA, 15 nt, Leptospira interrogans serovar lai str. 56601
aggacggauuuuaga

SEQ ID NO: 768040 - RNA, 15 nt, Leptospira interrogans serovar lai str. 56601
aggaauauucauuca

SEQ ID NO: 768041 - RNA, 22 nt, Leptospira interrogans serovar lai str. 56601
aggaaucguuuguaaaaucgua

SEQ ID NO: 768042 - RNA, 14 nt, Leptospira interrogans serovar lai str. 56601
agcuuguuuuuaaa

SEQ ID NO: 768043 - RNA, 14 nt, Leptospira interrogans serovar lai str. 56601
agcuuuagaaaaua

SEQ ID NO: 768044 - RNA, 20 nt, Leptospira interrogans serovar lai str. 56601
agcuuuugagcaguaaaaaa

SEQ ID NO: 768045 - RNA, 16 nt, Leptospira interrogans serovar lai str. 56601
agcuuuuuucagaauc

SEQ ID NO: 768046 - RNA, 18 nt, Leptospira interrogans serovar lai str. 56601
agcuuuuuuaaauuuuua

SEQ ID NO: 768047 - RNA, 19 nt, Leptospira interrogans serovar lai str. 56601
agcuuuuuuaaauuuuuau

SEQ ID NO: 768048 - RNA, 16 nt, Leptospira interrogans serovar lai str. 56601
agcuuuuuuagaaaaa

SEQ ID NO: 768049 - RNA, 18 nt, Leptospira interrogans serovar lai str. 56601
agcuuauugaugauugaa

SEQ ID NO: 768050 - RNA, 11 nt, Leptospira interrogans serovar lai str. 56601
agcuucuucca

SEQ ID NO: 768051 - RNA, 16 nt, Leptospira interrogans serovar lai str. 56601
agcuucuuccaaaguc

SEQ ID NO: 768052 - RNA, 21 nt, Leptospira interrogans serovar lai str. 56601
agcuguuguuauagaugaaau

SEQ ID NO: 768053 - RNA, 16 nt, Leptospira interrogans serovar lai str. 56601
agcuggaugaagcuau

SEQ ID NO: 768054 - RNA, 13 nt, Leptospira interrogans serovar lai str. 56601
agcugaaacuaau

SEQ ID NO: 768055 - RNA, 16 nt, Leptospira interrogans serovar lai str. 56601
agcucuggucaaguua

SEQ ID NO: 768056 - RNA, 23 nt, Leptospira interrogans serovar lai str. 56601
agcucucguaauaucuaaaaccu

SEQ ID NO: 768057 - RNA, 15 nt, Leptospira interrogans serovar lai str. 56601
agcucgaauaaaaac

SEQ ID NO: 768058 - RNA, 19 nt, Leptospira interrogans serovar lai str. 56601
agcucgaauaaaaacaaac

SEQ ID NO: 768059 - RNA, 13 nt, Leptospira interrogans serovar lai str. 56601
agcucccucacgu

SEQ ID NO: 768060 - RNA, 15 nt, Leptospira interrogans serovar lai str. 56601
agcgucaacugaaac

SEQ ID NO: 768061 - RNA, 18 nt, Leptospira interrogans serovar lai str. 56601
auaagacauuggcaaaug

SEQ ID NO: 768062 - RNA, 14 nt, Leptospira interrogans serovar lai str. 56601
auaagaaagaauuu

SEQ ID NO: 768063 - RNA, 19 nt, Leptospira interrogans serovar lai str. 56601
auaagagugcagauuaaaa

SEQ ID NO: 768064 - RNA, 20 nt, Leptospira interrogans serovar lai str. 56601
auaagagugcagauuaaaaa

SEQ ID NO: 768065 - RNA, 21 nt, Leptospira interrogans serovar lai str. 56601
auaagacuucauuguuugaaa

SEQ ID NO: 768066 - RNA, 14 nt, Leptospira interrogans serovar lai str. 56601
auaacucaguuguu

SEQ ID NO: 768067 - RNA, 13 nt, Leptospira interrogans serovar lai str. 56601
auaacuuuacaaa

SEQ ID NO: 768068 - RNA, 16 nt, Leptospira interrogans serovar lai str. 56601
auaacuuuacaaaaau

SEQ ID NO: 768069 - RNA, 17 nt, Leptospira interrogans serovar lai str. 56601
auaacuugacucugcau

SEQ ID NO: 768070 - RNA, 13 nt, Leptospira interrogans serovar lai str. 56601
auaacuuuaaaaa

SEQ ID NO: 768071 - RNA, 15 nt, Leptospira interrogans serovar lai str. 56601
auaacuuuaaaaaau

SEQ ID NO: 768072 - RNA, 17 nt, Leptospira interrogans serovar lai str. 56601
auaacuuuaaaaaauaa

SEQ ID NO: 768073 - RNA, 18 nt, Leptospira interrogans serovar lai str. 56601
auaacuuuaaaaaauaag

SEQ ID NO: 768074 - RNA, 15 nt, Leptospira interrogans serovar lai str. 56601
auaaauuuuagaaua

SEQ ID NO: 768075 - RNA, 17 nt, Leptospira interrogans serovar lai str. 56601
auaaccuuugauagaac

SEQ ID NO: 768076 - RNA, 20 nt, Leptospira interrogans serovar lai str. 56601
auaaauuucauaucuaaaau

SEQ ID NO: 768077 - RNA, 13 nt, Leptospira interrogans serovar lai str. 56601
auaaauuuauaaa

SEQ ID NO: 768078 - RNA, 13 nt, Leptospira interrogans serovar lai str. 56601
auaaauuuauaau

SEQ ID NO: 768079 - RNA, 14 nt, Leptospira interrogans serovar lai str. 56601
auaaauuuaaaugu

SEQ ID NO: 768080 - RNA, 22 nt, Leptospira interrogans serovar lai str. 56601
auaaauugugguaguuccuaca

SEQ ID NO: 768081 - RNA, 22 nt, Leptospira interrogans serovar lai str. 56601
auaaauuguuucauaaaauucu

SEQ ID NO: 768082 - RNA, 14 nt, Leptospira interrogans serovar lai str. 56601
auaacgauccuaaa

SEQ ID NO: 768083 - RNA, 15 nt, Leptospira interrogans serovar lai str. 56601
auaacgauuccauuu

SEQ ID NO: 768084 - RNA, 17 nt, Leptospira interrogans serovar lai str. 56601
auaacuauauaauaucu

SEQ ID NO: 768085 - RNA, 15 nt, Leptospira interrogans serovar lai str. 56601
auaaggcaaaagacu

SEQ ID NO: 768086 - RNA, 22 nt, Leptospira interrogans serovar lai str. 56601
auaaggcgguaaaacaaaaaaa

SEQ ID NO: 768087 - RNA, 21 nt, Leptospira interrogans serovar lai str. 56601
auaagaucuaucucaaaaccu

SEQ ID NO: 768088 - RNA, 15 nt, Leptospira interrogans serovar lai str. 56601
auaagagacaaauau

SEQ ID NO: 768089 - RNA, 15 nt, Leptospira interrogans serovar lai str. 56601
auaagauuuguugaa

SEQ ID NO: 768090 - RNA, 22 nt, Leptospira interrogans serovar lai str. 56601
auaagauuuguugaaaagugag

SEQ ID NO: 768091 - RNA, 15 nt, Leptospira interrogans serovar lai str. 56601
auaagauuuuagaau

SEQ ID NO: 768092 - RNA, 14 nt, Leptospira interrogans serovar lai str. 56601
auaagcaaaaauaa

SEQ ID NO: 768093 - RNA, 13 nt, Leptospira interrogans serovar lai str. 56601
auaauauuauaaa

SEQ ID NO: 768094 - RNA, 15 nt, Leptospira interrogans serovar lai str. 56601
auaauaugauguaaa

SEQ ID NO: 768095 - RNA, 18 nt, Leptospira interrogans serovar lai str. 56601
auaauaugauguaaauuu

SEQ ID NO: 768096 - RNA, 13 nt, Leptospira interrogans serovar lai str. 56601
auaauauucuuau

SEQ ID NO: 768097 - RNA, 14 nt, Leptospira interrogans serovar lai str. 56601
auaagguuuuauaa

SEQ ID NO: 768098 - RNA, 16 nt, Leptospira interrogans serovar lai str. 56601
auaagguuuuauaaaa

SEQ ID NO: 768099 - RNA, 21 nt, Leptospira interrogans serovar lai str. 56601
auaaguaaguugagaauauaa

SEQ ID NO: 768100 - RNA, 23 nt, Leptospira interrogans serovar lai str. 56601
auaaguaauuuguggaaacuauu

SEQ ID NO: 768101 - RNA, 15 nt, Leptospira interrogans serovar lai str. 56601
auaauaucaaaauga

SEQ ID NO: 768102 - RNA, 17 nt, Leptospira interrogans serovar lai str. 56601
auaauagaguuacagaa

SEQ ID NO: 768103 - RNA, 22 nt, Leptospira interrogans serovar lai str. 56601
auaauagaguuacagaaaaaau

SEQ ID NO: 768104 - RNA, 15 nt, Leptospira interrogans serovar lai str. 56601
auaauuagaaaaaua

SEQ ID NO: 768105 - RNA, 19 nt, Leptospira interrogans serovar lai str. 56601
auaauuagcucuuguuaaa

SEQ ID NO: 768106 - RNA, 22 nt, Leptospira interrogans serovar lai str. 56601
auaauuagcucuuguuaaaaua

SEQ ID NO: 768107 - RNA, 23 nt, Leptospira interrogans serovar lai str. 56601
auaauuauccuuaaaaugaaaau

SEQ ID NO: 768108 - RNA, 21 nt, Leptospira interrogans serovar lai str. 56601
auaauguuugaauuuuuaaga

SEQ ID NO: 768109 - RNA, 22 nt, Leptospira interrogans serovar lai str. 56601
auaauguuugaauuuuuaagaa

SEQ ID NO: 768110 - RNA, 17 nt, Leptospira interrogans serovar lai str. 56601
auaauguccgaaauuuu

SEQ ID NO: 768111 - RNA, 23 nt, Leptospira interrogans serovar lai str. 56601
auaauguccgaaauuuuuuuaaa

SEQ ID NO: 768112 - RNA, 18 nt, Leptospira interrogans serovar lai str. 56601
auaaugucggaucauaau

SEQ ID NO: 768113 - RNA, 19 nt, Leptospira interrogans serovar lai str. 56601
auaaucuaccccaucucuu

SEQ ID NO: 768114 - RNA, 16 nt, Leptospira interrogans serovar lai str. 56601
auaaaagaccuucgga

SEQ ID NO: 768115 - RNA, 14 nt, Leptospira interrogans serovar lai str. 56601
auaaaacucuaaau

SEQ ID NO: 768116 - RNA, 16 nt, Leptospira interrogans serovar lai str. 56601
auaaaacucuaaauuc

SEQ ID NO: 768117 - RNA, 21 nt, Leptospira interrogans serovar lai str. 56601
auaaaacucaaaggaaaauga

SEQ ID NO: 768118 - RNA, 18 nt, Leptospira interrogans serovar lai str. 56601
auaaaaccugauuuuucu

SEQ ID NO: 768119 - RNA, 16 nt, Leptospira interrogans serovar lai str. 56601
auaaaaccuuuauuua

SEQ ID NO: 768120 - RNA, 18 nt, Leptospira interrogans serovar lai str. 56601
auaaaaccuuuauuuaau

SEQ ID NO: 768121 - RNA, 17 nt, Leptospira interrogans serovar lai str. 56601
auaaaacguggauuuua

SEQ ID NO: 768122 - RNA, 16 nt, Leptospira interrogans serovar lai str. 56601
auaaaaguauaauauu

SEQ ID NO: 768123 - RNA, 20 nt, Leptospira interrogans serovar lai str. 56601
auaaaagauucguuuuauaa

SEQ ID NO: 768124 - RNA, 21 nt, Leptospira interrogans serovar lai str. 56601
auaaaagauucguuuuauaaa

SEQ ID NO: 768125 - RNA, 14 nt, Leptospira interrogans serovar lai str. 56601
auaaaaaaugaaug

SEQ ID NO: 768126 - RNA, 21 nt, Leptospira interrogans serovar lai str. 56601
auaaaaaaugaauguuuaaaa

SEQ ID NO: 768127 - RNA, 12 nt, Leptospira interrogans serovar lai str. 56601
auaaaaaauuuu

SEQ ID NO: 768128 - RNA, 12 nt, Leptospira interrogans serovar lai str. 56601
auaaaaacaaaa

SEQ ID NO: 768129 - RNA, 13 nt, Leptospira interrogans serovar lai str. 56601
auaaaaacaaaau

SEQ ID NO: 768130 - RNA, 23 nt, Leptospira interrogans serovar lai str. 56601
auaaaaacaaguuuaaaugaaau

SEQ ID NO: 768131 - RNA, 19 nt, Leptospira interrogans serovar lai str. 56601
auaaaaacgguauuuaaaa

SEQ ID NO: 768132 - RNA, 20 nt, Leptospira interrogans serovar lai str. 56601
auaaaaaguuuguuuguaaa

SEQ ID NO: 768133 - RNA, 15 nt, Leptospira interrogans serovar lai str. 56601
auaaaaaucuaggaa

SEQ ID NO: 768134 - RNA, 14 nt, Leptospira interrogans serovar lai str. 56601
auaaaaauuuaaaa

SEQ ID NO: 768135 - RNA, 13 nt, Leptospira interrogans serovar lai str. 56601
auaaaacaaaaua

SEQ ID NO: 768136 - RNA, 15 nt, Leptospira interrogans serovar lai str. 56601
auaaaacaaaauaga

SEQ ID NO: 768137 - RNA, 16 nt, Leptospira interrogans serovar lai str. 56601
auaaaaauuuuuuaaa

SEQ ID NO: 768138 - RNA, 15 nt, Leptospira interrogans serovar lai str. 56601
aguuuuucuaaauuu

SEQ ID NO: 768139 - RNA, 14 nt, Leptospira interrogans serovar lai str. 56601
aguuuuuaaaucca

SEQ ID NO: 768140 - RNA, 14 nt, Leptospira interrogans serovar lai str. 56601
aguuuuuauaaaau

SEQ ID NO: 768141 - RNA, 15 nt, Leptospira interrogans serovar lai str. 56601
aguuuuguuaaccaa

SEQ ID NO: 768142 - RNA, 20 nt, Leptospira interrogans serovar lai str. 56601
aguuuuguuaaccaaaaauu

SEQ ID NO: 768143 - RNA, 13 nt, Leptospira interrogans serovar lai str. 56601
aguuuuuaaaaau

SEQ ID NO: 768144 - RNA, 16 nt, Leptospira interrogans serovar lai str. 56601
aguuuuuaaaaauuuc

SEQ ID NO: 768145 - RNA, 17 nt, Leptospira interrogans serovar lai str. 56601
aguuuuuuaaaauuaga

SEQ ID NO: 768146 - RNA, 14 nt, Leptospira interrogans serovar lai str. 56601
aguuuuuguuugaa

SEQ ID NO: 768147 - RNA, 13 nt, Leptospira interrogans serovar lai str. 56601
aguuuuuuagcca

SEQ ID NO: 768148 - RNA, 16 nt, Leptospira interrogans serovar lai str. 56601
aguuuuucuuuuuaag

SEQ ID NO: 768149 - RNA, 19 nt, Leptospira interrogans serovar lai str. 56601
aguuuuuugagaaacaacg

SEQ ID NO: 768150 - RNA, 13 nt, Leptospira interrogans serovar lai str. 56601
aguuuuuugagau

SEQ ID NO: 768151 - RNA, 20 nt, Leptospira interrogans serovar lai str. 56601
aguuuuuuuauaaaauuaga

SEQ ID NO: 768152 - RNA, 13 nt, Leptospira interrogans serovar lai str. 56601
auaaaaaauaaua

SEQ ID NO: 768153 - RNA, 13 nt, Leptospira interrogans serovar lai str. 56601
auaaaaaacucaa

SEQ ID NO: 768154 - RNA, 22 nt, Leptospira interrogans serovar lai str. 56601
auaaaaaaaucaagagccaagu

SEQ ID NO: 768155 - RNA, 11 nt, Leptospira interrogans serovar lai str. 56601
auaaaaaaauu

SEQ ID NO: 768156 - RNA, 15 nt, Leptospira interrogans serovar lai str. 56601
auaaaaaaauuaaaa

SEQ ID NO: 768157 - RNA, 20 nt, Leptospira interrogans serovar lai str. 56601
aguuuugcuguaaaauuuag

SEQ ID NO: 768158 - RNA, 22 nt, Leptospira interrogans serovar lai str. 56601
aguuuugcuguaaaauuuagau

SEQ ID NO: 768159 - RNA, 22 nt, Leptospira interrogans serovar lai str. 56601
aguuuuguaccguaaagaagag

SEQ ID NO: 768160 - RNA, 18 nt, Leptospira interrogans serovar lai str. 56601
aguuuugagcauaaaaaa

SEQ ID NO: 768161 - RNA, 23 nt, Leptospira interrogans serovar lai str. 56601
aguuuugagcauaaaaaaauauu

SEQ ID NO: 768162 - RNA, 16 nt, Leptospira interrogans serovar lai str. 56601
aguuuucuuuuuuucu

SEQ ID NO: 768163 - RNA, 22 nt, Leptospira interrogans serovar lai str. 56601
aguuuugcgggaacucccacaa

SEQ ID NO: 768164 - RNA, 18 nt, Leptospira interrogans serovar lai str. 56601
aguuuugauguuuuucgu

SEQ ID NO: 768165 - RNA, 21 nt, Leptospira interrogans serovar lai str. 56601
aguuuucguuaucuaggguuu

SEQ ID NO: 768166 - RNA, 21 nt, Leptospira interrogans serovar lai str. 56601
aguuguacaaaaaugugggaa

SEQ ID NO: 768167 - RNA, 23 nt, Leptospira interrogans serovar lai str. 56601
aguuuuccgguucgaaucauuac

SEQ ID NO: 768168 - RNA, 16 nt, Leptospira interrogans serovar lai str. 56601
auaaaugaauuuuaaa

SEQ ID NO: 768169 - RNA, 11 nt, Leptospira interrogans serovar lai str. 56601
auaaaucaauc

SEQ ID NO: 768170 - RNA, 14 nt, Leptospira interrogans serovar lai str. 56601
auaaaucaaucuac

SEQ ID NO: 768171 - RNA, 13 nt, Leptospira interrogans serovar lai str. 56601
auaaauauuaauu

SEQ ID NO: 768172 - RNA, 16 nt, Leptospira interrogans serovar lai str. 56601
auaaauauucucuaug

SEQ ID NO: 768173 - RNA, 20 nt, Leptospira interrogans serovar lai str. 56601
auaaauauuuccaaauugua

SEQ ID NO: 768174 - RNA, 12 nt, Leptospira interrogans serovar lai str. 56601
auaaaguuuuau

SEQ ID NO: 768175 - RNA, 14 nt, Leptospira interrogans serovar lai str. 56601
auaaaguuaauaca

SEQ ID NO: 768176 - RNA, 20 nt, Leptospira interrogans serovar lai str. 56601
auaaaggcccuuuguagaaa

SEQ ID NO: 768177 - RNA, 19 nt, Leptospira interrogans serovar lai str. 56601
auaaauuauacaauuuaau

SEQ ID NO: 768178 - RNA, 22 nt, Leptospira interrogans serovar lai str. 56601
auaaauuauacaauuuaauagu

SEQ ID NO: 768179 - RNA, 11 nt, Leptospira interrogans serovar lai str. 56601
auaaauuauuu

SEQ ID NO: 768180 - RNA, 13 nt, Leptospira interrogans serovar lai str. 56601
auaaauuacugau

SEQ ID NO: 768181 - RNA, 18 nt, Leptospira interrogans serovar lai str. 56601
auaaauuagaaaauuaua

SEQ ID NO: 768182 - RNA, 15 nt, Leptospira interrogans serovar lai str. 56601
auaaauucuuacuaa

SEQ ID NO: 768183 - RNA, 24 nt, Leptospira interrogans serovar lai str. 56601
auaaauugaacguaauacaaaaua

SEQ ID NO: 768184 - RNA, 12 nt, Leptospira interrogans serovar lai str. 56601
auaaauucuaca

SEQ ID NO: 768185 - RNA, 18 nt, Leptospira interrogans serovar lai str. 56601
auaaauucgcaaaaaaaa

SEQ ID NO: 768186 - RNA, 21 nt, Leptospira interrogans serovar lai str. 56601
auaaauucgccguaaaaaauc

SEQ ID NO: 768187 - RNA, 17 nt, Leptospira interrogans serovar lai str. 56601
auaaauguaggaacuac

SEQ ID NO: 768188 - RNA, 20 nt, Leptospira interrogans serovar lai str. 56601
auaaaugauacuuuguaaaa

SEQ ID NO: 768189 - RNA, 10 nt, Leptospira interrogans serovar lai str. 56601
auaaaucaau

SEQ ID NO: 768190 - RNA, 13 nt, Leptospira interrogans serovar lai str. 56601
auaaagacuuuaa

SEQ ID NO: 768191 - RNA, 15 nt, Leptospira interrogans serovar lai str. 56601
auaaagaaacuguuu

SEQ ID NO: 768192 - RNA, 13 nt, Leptospira interrogans serovar lai str. 56601
auaaagaaaacca

SEQ ID NO: 768193 - RNA, 14 nt, Leptospira interrogans serovar lai str. 56601
auaaagaaaaccac

SEQ ID NO: 768194 - RNA, 13 nt, Leptospira interrogans serovar lai str. 56601
auaaagaaaaccu

SEQ ID NO: 768195 - RNA, 11 nt, Leptospira interrogans serovar lai str. 56601
auaaagaaaag

SEQ ID NO: 768196 - RNA, 14 nt, Leptospira interrogans serovar lai str. 56601
auaaagaaaaggaa

SEQ ID NO: 768197 - RNA, 15 nt, Leptospira interrogans serovar lai str. 56601
auaaacugucggaau

SEQ ID NO: 768198 - RNA, 19 nt, Leptospira interrogans serovar lai str. 56601
auaaacuucuauuuuauaa

SEQ ID NO: 768199 - RNA, 20 nt, Leptospira interrogans serovar lai str. 56601
auaaacuucucuuaaaauuu

SEQ ID NO: 768200 - RNA, 18 nt, Leptospira interrogans serovar lai str. 56601
auaaacguggaaauuacc

SEQ ID NO: 768201 - RNA, 21 nt, Leptospira interrogans serovar lai str. 56601
auaaaagugaacagucuuuuu

SEQ ID NO: 768202 - RNA, 14 nt, Leptospira interrogans serovar lai str. 56601
auaaaagugaauuu

SEQ ID NO: 768203 - RNA, 13 nt, Leptospira interrogans serovar lai str. 56601
auaaaauaaaaaa

SEQ ID NO: 768204 - RNA, 14 nt, Leptospira interrogans serovar lai str. 56601
auaaaauaaaaaaa

SEQ ID NO: 768205 - RNA, 16 nt, Leptospira interrogans serovar lai str. 56601
auaaaauaaaaaaauu

SEQ ID NO: 768206 - RNA, 16 nt, Leptospira interrogans serovar lai str. 56601
aguuauuucuuucaaa

SEQ ID NO: 768207 - RNA, 20 nt, Leptospira interrogans serovar lai str. 56601
aguuauuucgaagcccauaa

SEQ ID NO: 768208 - RNA, 14 nt, Leptospira interrogans serovar lai str. 56601
aguuauugaaaaau

SEQ ID NO: 768209 - RNA, 18 nt, Leptospira interrogans serovar lai str. 56601
aguuauugaauagaauuu

SEQ ID NO: 768210 - RNA, 16 nt, Leptospira interrogans serovar lai str. 56601
aguuauacaguuugau

SEQ ID NO: 768211 - RNA, 13 nt, Leptospira interrogans serovar lai str. 56601
aguucaauuuuug

SEQ ID NO: 768212 - RNA, 17 nt, Leptospira interrogans serovar lai str. 56601
aguucaauuaacaaaac

SEQ ID NO: 768213 - RNA, 20 nt, Leptospira interrogans serovar lai str. 56601
aguucaacuuaaggaaauuc

SEQ ID NO: 768214 - RNA, 22 nt, Leptospira interrogans serovar lai str. 56601
aguucaacguaagaaaauuugg

SEQ ID NO: 768215 - RNA, 20 nt, Leptospira interrogans serovar lai str. 56601
aguuaguuuuucaacaacuc

SEQ ID NO: 768216 - RNA, 16 nt, Leptospira interrogans serovar lai str. 56601
aguuaauaaauuuuug

SEQ ID NO: 768217 - RNA, 18 nt, Leptospira interrogans serovar lai str. 56601
aguuaauagaguuguuga

SEQ ID NO: 768218 - RNA, 15 nt, Leptospira interrogans serovar lai str. 56601
aguuaauaggauuuu

SEQ ID NO: 768219 - RNA, 23 nt, Leptospira interrogans serovar lai str. 56601
aguuaagcugaaaauuuucccua

SEQ ID NO: 768220 - RNA, 19 nt, Leptospira interrogans serovar lai str. 56601
aguuaagugaaaauuacaa

SEQ ID NO: 768221 - RNA, 16 nt, Leptospira interrogans serovar lai str. 56601
aguucauauuuuaacg

SEQ ID NO: 768222 - RNA, 16 nt, Leptospira interrogans serovar lai str. 56601
aguucccacauuugau

SEQ ID NO: 768223 - RNA, 18 nt, Leptospira interrogans serovar lai str. 56601
aguucccacauuuuagaa

SEQ ID NO: 768224 - RNA, 21 nt, Leptospira interrogans serovar lai str. 56601
aguucccacauuuugaagguu

SEQ ID NO: 768225 - RNA, 16 nt, Leptospira interrogans serovar lai str. 56601
aguucccacauuuugu

SEQ ID NO: 768226 - RNA, 22 nt, Leptospira interrogans serovar lai str. 56601
aguucccacauuuugugaaacu

SEQ ID NO: 768227 - RNA, 17 nt, Leptospira interrogans serovar lai str. 56601
aguucccacauuuuuca

SEQ ID NO: 768228 - RNA, 21 nt, Leptospira interrogans serovar lai str. 56601
aguucccaccuuuuuuuauga

SEQ ID NO: 768229 - RNA, 21 nt, Leptospira interrogans serovar lai str. 56601
aguucccacguuuuaaagguu

SEQ ID NO: 768230 - RNA, 21 nt, Leptospira interrogans serovar lai str. 56601
aguucccacguuuugaagguu

SEQ ID NO: 768231 - RNA, 16 nt, Leptospira interrogans serovar lai str. 56601
aguucccgccucacaa

SEQ ID NO: 768232 - RNA, 20 nt, Leptospira interrogans serovar lai str. 56601
aguuccuacaauucaucacc

SEQ ID NO: 768233 - RNA, 22 nt, Leptospira interrogans serovar lai str. 56601
aguuccuacaauuuuagaauuu

SEQ ID NO: 768234 - RNA, 20 nt, Leptospira interrogans serovar lai str. 56601
aguuccuacauuuuaaaaau

SEQ ID NO: 768235 - RNA, 21 nt, Leptospira interrogans serovar lai str. 56601
aguuccuaaaauuacgcugau

SEQ ID NO: 768236 - RNA, 17 nt, Leptospira interrogans serovar lai str. 56601
aguuccuaacuuugaaa

SEQ ID NO: 768237 - RNA, 21 nt, Leptospira interrogans serovar lai str. 56601
aguuccuaacuuugaaaauuu

SEQ ID NO: 768238 - RNA, 15 nt, Leptospira interrogans serovar lai str. 56601
aguugaaucuauuaa

SEQ ID NO: 768239 - RNA, 21 nt, Leptospira interrogans serovar lai str. 56601
aguugcuaagaaaaaagcagc

SEQ ID NO: 768240 - RNA, 22 nt, Leptospira interrogans serovar lai str. 56601
aguugcuaagaaaaaagcagcu

SEQ ID NO: 768241 - RNA, 14 nt, Leptospira interrogans serovar lai str. 56601
aguugaguucuucu

SEQ ID NO: 768242 - RNA, 12 nt, Leptospira interrogans serovar lai str. 56601
aguuggaauuug

SEQ ID NO: 768243 - RNA, 18 nt, Leptospira interrogans serovar lai str. 56601
aguucuuuucuuaaaaaa

SEQ ID NO: 768244 - RNA, 18 nt, Leptospira interrogans serovar lai str. 56601
aguugaauaggauuuuag

SEQ ID NO: 768245 - RNA, 12 nt, Leptospira interrogans serovar lai str. 56601
aguugaaaucug

SEQ ID NO: 768246 - RNA, 18 nt, Leptospira interrogans serovar lai str. 56601
aguugaaaguuuuucuuu

SEQ ID NO: 768247 - RNA, 14 nt, Leptospira interrogans serovar lai str. 56601
aguucgauuaaaau

SEQ ID NO: 768248 - RNA, 16 nt, Leptospira interrogans serovar lai str. 56601
aguucgauuaaaauaa

SEQ ID NO: 768249 - RNA, 21 nt, Leptospira interrogans serovar lai str. 56601
aguuccuuaaaaguauccauc

SEQ ID NO: 768250 - RNA, 17 nt, Leptospira interrogans serovar lai str. 56601
aguucgacauaagaaag

SEQ ID NO: 768251 - RNA, 20 nt, Leptospira interrogans serovar lai str. 56601
aguucgacguaaagaauuca

SEQ ID NO: 768252 - RNA, 22 nt, Leptospira interrogans serovar lai str. 56601
aguucgacguaaagaauucauu

SEQ ID NO: 768253 - RNA, 16 nt, Leptospira interrogans serovar lai str. 56601
aguucgacguaaguaa

SEQ ID NO: 768254 - RNA, 14 nt, Leptospira interrogans serovar lai str. 56601
aguguuaguuccca

SEQ ID NO: 768255 - RNA, 18 nt, Leptospira interrogans serovar lai str. 56601
aguguuaguucccacauu

SEQ ID NO: 768256 - RNA, 18 nt, Leptospira interrogans serovar lai str. 56601
aguguuuugugauaaaau

SEQ ID NO: 768257 - RNA, 20 nt, Leptospira interrogans serovar lai str. 56601
aguuaaaaaaugaauuuuuc

SEQ ID NO: 768258 - RNA, 21 nt, Leptospira interrogans serovar lai str. 56601
aguuaaaaaaugaauuuuuca

SEQ ID NO: 768259 - RNA, 16 nt, Leptospira interrogans serovar lai str. 56601
aguuaaauauaaaaga

SEQ ID NO: 768260 - RNA, 16 nt, Leptospira interrogans serovar lai str. 56601
aguuaaacuuuguaaa

SEQ ID NO: 768261 - RNA, 15 nt, Leptospira interrogans serovar lai str. 56601
aguuaagaagauaaa

SEQ ID NO: 768262 - RNA, 22 nt, Leptospira interrogans serovar lai str. 56601
aguuaagagaauuucuauaaaa

SEQ ID NO: 768263 - RNA, 22 nt, Leptospira interrogans serovar lai str. 56601
aguuaagagaugugaguuuuaa

SEQ ID NO: 768264 - RNA, 17 nt, Leptospira interrogans serovar lai str. 56601
aguuaagaguuuguucc

SEQ ID NO: 768265 - RNA, 13 nt, Leptospira interrogans serovar lai str. 56601
aguuaaauuuuuu

SEQ ID NO: 768266 - RNA, 13 nt, Leptospira interrogans serovar lai str. 56601
agugguuuucaaa

SEQ ID NO: 768267 - RNA, 19 nt, Leptospira interrogans serovar lai str. 56601
agugguuuucaaauauuuu

SEQ ID NO: 768268 - RNA, 15 nt, Leptospira interrogans serovar lai str. 56601
aguguaaaauuaaaa

SEQ ID NO: 768269 - RNA, 16 nt, Leptospira interrogans serovar lai str. 56601
agugggaaggaauuuc

SEQ ID NO: 768270 - RNA, 18 nt, Leptospira interrogans serovar lai str. 56601
aguggaguggagauuuug

SEQ ID NO: 768271 - RNA, 17 nt, Leptospira interrogans serovar lai str. 56601
agugauaagaaaaauug

SEQ ID NO: 768272 - RNA, 13 nt, Leptospira interrogans serovar lai str. 56601
agugagguuuugg

SEQ ID NO: 768273 - RNA, 17 nt, Leptospira interrogans serovar lai str. 56601
agugaaaguaaucuuuu

SEQ ID NO: 768274 - RNA, 22 nt, Leptospira interrogans serovar lai str. 56601
agugaaccucuguaaauacaaa

SEQ ID NO: 768275 - RNA, 16 nt, Leptospira interrogans serovar lai str. 56601
agugaauuuguaauuc

SEQ ID NO: 768276 - RNA, 12 nt, Leptospira interrogans serovar lai str. 56601
agugaacuccau

SEQ ID NO: 768277 - RNA, 21 nt, Leptospira interrogans serovar lai str. 56601
agucugugauugccuucggcu

SEQ ID NO: 768278 - RNA, 19 nt, Leptospira interrogans serovar lai str. 56601
agucuucuuguaauuuguu

SEQ ID NO: 768279 - RNA, 13 nt, Leptospira interrogans serovar lai str. 56601
agucuauaaaaua

SEQ ID NO: 768280 - RNA, 22 nt, Leptospira interrogans serovar lai str. 56601
agucuauaaauugcaucaaaga

SEQ ID NO: 768281 - RNA, 17 nt, Leptospira interrogans serovar lai str. 56601
agucuagaauucuuuga

SEQ ID NO: 768282 - RNA, 19 nt, Leptospira interrogans serovar lai str. 56601
agucucaaaaccuguaaau

SEQ ID NO: 768283 - RNA, 22 nt, Leptospira interrogans serovar lai str. 56601
agucucaaaaccuguaaaugaa

SEQ ID NO: 768284 - RNA, 14 nt, Leptospira interrogans serovar lai str. 56601
agucuauuucuaaa

SEQ ID NO: 768285 - RNA, 23 nt, Leptospira interrogans serovar lai str. 56601
agucuaacaguaaaacuuugguu

SEQ ID NO: 768286 - RNA, 17 nt, Leptospira interrogans serovar lai str. 56601
agucuaaaaacaacuca

SEQ ID NO: 768287 - RNA, 19 nt, Leptospira interrogans serovar lai str. 56601
agucguuguauuuuaaaca

SEQ ID NO: 768288 - RNA, 17 nt, Leptospira interrogans serovar lai str. 56601
agucgcccaaaccccag

SEQ ID NO: 768289 - RNA, 22 nt, Leptospira interrogans serovar lai str. 56601
agucgcacccccgucuacuuuu

SEQ ID NO: 768290 - RNA, 14 nt, Leptospira interrogans serovar lai str. 56601
agucgaaagaauuu

SEQ ID NO: 768291 - RNA, 21 nt, Leptospira interrogans serovar lai str. 56601
agucgaaagaauuuuuggaac

SEQ ID NO: 768292 - RNA, 13 nt, Leptospira interrogans serovar lai str. 56601
aguccuuuucuua

SEQ ID NO: 768293 - RNA, 14 nt, Leptospira interrogans serovar lai str. 56601
aguccuuuucuuau

SEQ ID NO: 768294 - RNA, 20 nt, Leptospira interrogans serovar lai str. 56601
agucccauuuagcaauuugu

SEQ ID NO: 768295 - RNA, 20 nt, Leptospira interrogans serovar lai str. 56601
agucagguuuuaucaaauaa

SEQ ID NO: 768296 - RNA, 21 nt, Leptospira interrogans serovar lai str. 56601
agucagguuuuaucaaauaaa

SEQ ID NO: 768297 - RNA, 22 nt, Leptospira interrogans serovar lai str. 56601
agucagguuuuaucaaauaaag

SEQ ID NO: 768298 - RNA, 12 nt, Leptospira interrogans serovar lai str. 56601
agucaguuuuuu

SEQ ID NO: 768299 - RNA, 19 nt, Leptospira interrogans serovar lai str. 56601
aguccagagcgguuucaua

SEQ ID NO: 768300 - RNA, 19 nt, Leptospira interrogans serovar lai str. 56601
agucccacauuuuugugaa

SEQ ID NO: 768301 - RNA, 13 nt, Leptospira interrogans serovar lai str. 56601
aguccaaaacaaa

SEQ ID NO: 768302 - RNA, 12 nt, Leptospira interrogans serovar lai str. 56601
agucaauugaag

SEQ ID NO: 768303 - RNA, 23 nt, Leptospira interrogans serovar lai str. 56601
agucacauuacgaauuuuuaaau

SEQ ID NO: 768304 - RNA, 19 nt, Leptospira interrogans serovar lai str. 56601
agucacauuguguuuuuua

SEQ ID NO: 768305 - RNA, 16 nt, Leptospira interrogans serovar lai str. 56601
agucaccucuauaaaa

SEQ ID NO: 768306 - RNA, 23 nt, Leptospira interrogans serovar lai str. 56601
agucaaugguugcaaaaaagaaa

SEQ ID NO: 768307 - RNA, 13 nt, Leptospira interrogans serovar lai str. 56601
agucaauuaaauu

SEQ ID NO: 768308 - RNA, 16 nt, Leptospira interrogans serovar lai str. 56601
agucaagcagauuugu

SEQ ID NO: 768309 - RNA, 20 nt, Leptospira interrogans serovar lai str. 56601
agucaauaaauuguauaaaa

SEQ ID NO: 768310 - RNA, 13 nt, Leptospira interrogans serovar lai str. 56601
aguagaagccaau

SEQ ID NO: 768311 - RNA, 19 nt, Leptospira interrogans serovar lai str. 56601
aguagacauuuaaaugucu

SEQ ID NO: 768312 - RNA, 15 nt, Leptospira interrogans serovar lai str. 56601
aguacuucuaccuga

SEQ ID NO: 768313 - RNA, 15 nt, Leptospira interrogans serovar lai str. 56601
auaguauccaaaauu

SEQ ID NO: 768314 - RNA, 15 nt, Leptospira interrogans serovar lai str. 56601
auaguauauaauggc

SEQ ID NO: 768315 - RNA, 16 nt, Leptospira interrogans serovar lai str. 56601
auaguauauuaacuuu

SEQ ID NO: 768316 - RNA, 12 nt, Leptospira interrogans serovar lai str. 56601
auaguaguuccc

SEQ ID NO: 768317 - RNA, 15 nt, Leptospira interrogans serovar lai str. 56601
auaguaguucccgca

SEQ ID NO: 768318 - RNA, 19 nt, Leptospira interrogans serovar lai str. 56601
auagucaaugguugcaaaa

SEQ ID NO: 768319 - RNA, 13 nt, Leptospira interrogans serovar lai str. 56601
auaguauuuugug

SEQ ID NO: 768320 - RNA, 12 nt, Leptospira interrogans serovar lai str. 56601
auagggguuuua

SEQ ID NO: 768321 - RNA, 17 nt, Leptospira interrogans serovar lai str. 56601
auagguuuuguaagaau

SEQ ID NO: 768322 - RNA, 19 nt, Leptospira interrogans serovar lai str. 56601
auagguucuugcaaaaaua

SEQ ID NO: 768323 - RNA, 21 nt, Leptospira interrogans serovar lai str. 56601
auagguuccaauuccauuucu

SEQ ID NO: 768324 - RNA, 13 nt, Leptospira interrogans serovar lai str. 56601
auagguucaaaaa

SEQ ID NO: 768325 - RNA, 18 nt, Leptospira interrogans serovar lai str. 56601
auaggcuaaucaaauuuc

SEQ ID NO: 768326 - RNA, 16 nt, Leptospira interrogans serovar lai str. 56601
auagagagcguucugc

SEQ ID NO: 768327 - RNA, 16 nt, Leptospira interrogans serovar lai str. 56601
auagccgcuauggaag

SEQ ID NO: 768328 - RNA, 15 nt, Leptospira interrogans serovar lai str. 56601
auagcuucuuuaaaa

SEQ ID NO: 768329 - RNA, 17 nt, Leptospira interrogans serovar lai str. 56601
auagcuucuuuaaaaac

SEQ ID NO: 768330 - RNA, 20 nt, Leptospira interrogans serovar lai str. 56601
auaggaaagcguuguguuga

SEQ ID NO: 768331 - RNA, 19 nt, Leptospira interrogans serovar lai str. 56601
auaggaaauucuuuuccaa

SEQ ID NO: 768332 - RNA, 14 nt, Leptospira interrogans serovar lai str. 56601
auaggauuuaaauu

SEQ ID NO: 768333 - RNA, 15 nt, Leptospira interrogans serovar lai str. 56601
auaggaucagaauuu

SEQ ID NO: 768334 - RNA, 18 nt, Leptospira interrogans serovar lai str. 56601
auaggaucaguaguucuc

SEQ ID NO: 768335 - RNA, 21 nt, Leptospira interrogans serovar lai str. 56601
auaggaucguauuuuagaaau

SEQ ID NO: 768336 - RNA, 21 nt, Leptospira interrogans serovar lai str. 56601
auaggauuuuagaaucaaaau

SEQ ID NO: 768337 - RNA, 14 nt, Leptospira interrogans serovar lai str. 56601
auaucacaaauuuu

SEQ ID NO: 768338 - RNA, 15 nt, Leptospira interrogans serovar lai str. 56601
auaucagaucuauuu

SEQ ID NO: 768339 - RNA, 16 nt, Leptospira interrogans serovar lai str. 56601
auaucagaucuauuuc

SEQ ID NO: 768340 - RNA, 19 nt, Leptospira interrogans serovar lai str. 56601
auaucagauugauacugca

SEQ ID NO: 768341 - RNA, 13 nt, Leptospira interrogans serovar lai str. 56601
auauccaauuuca

SEQ ID NO: 768342 - RNA, 14 nt, Leptospira interrogans serovar lai str. 56601
auauaguuuugaga

SEQ ID NO: 768343 - RNA, 15 nt, Leptospira interrogans serovar lai str. 56601
auauauuaaaguauu

SEQ ID NO: 768344 - RNA, 18 nt, Leptospira interrogans serovar lai str. 56601
auauauuagaauauacaa

SEQ ID NO: 768345 - RNA, 17 nt, Leptospira interrogans serovar lai str. 56601
auauauucacaaaaaaa

SEQ ID NO: 768346 - RNA, 13 nt, Leptospira interrogans serovar lai str. 56601
auauauucaguau

SEQ ID NO: 768347 - RNA, 16 nt, Leptospira interrogans serovar lai str. 56601
auaucaacaaucggag

SEQ ID NO: 768348 - RNA, 15 nt, Leptospira interrogans serovar lai str. 56601
auaucaaacuuauaa

SEQ ID NO: 768349 - RNA, 12 nt, Leptospira interrogans serovar lai str. 56601
auaucaaauuca

SEQ ID NO: 768350 - RNA, 18 nt, Leptospira interrogans serovar lai str. 56601
auauaaccucaacauaaa

SEQ ID NO: 768351 - RNA, 12 nt, Leptospira interrogans serovar lai str. 56601
auauaaauuuau

SEQ ID NO: 768352 - RNA, 20 nt, Leptospira interrogans serovar lai str. 56601
auauaaauucgccguaaaaa

SEQ ID NO: 768353 - RNA, 21 nt, Leptospira interrogans serovar lai str. 56601
auauaaauucgccguaaaaaa

SEQ ID NO: 768354 - RNA, 20 nt, Leptospira interrogans serovar lai str. 56601
auaguuacgacauuuuaaua

SEQ ID NO: 768355 - RNA, 21 nt, Leptospira interrogans serovar lai str. 56601
auaguuacgacauuuuaauaa

SEQ ID NO: 768356 - RNA, 13 nt, Leptospira interrogans serovar lai str. 56601
auaguuaugaaua

SEQ ID NO: 768357 - RNA, 12 nt, Leptospira interrogans serovar lai str. 56601
auauaaaucaau

SEQ ID NO: 768358 - RNA, 13 nt, Leptospira interrogans serovar lai str. 56601
auauaaaucaauc

SEQ ID NO: 768359 - RNA, 17 nt, Leptospira interrogans serovar lai str. 56601
auauacaaaacauucca

SEQ ID NO: 768360 - RNA, 19 nt, Leptospira interrogans serovar lai str. 56601
auauacaaaguuuauaaga

SEQ ID NO: 768361 - RNA, 13 nt, Leptospira interrogans serovar lai str. 56601
auauaauuuuuaa

SEQ ID NO: 768362 - RNA, 14 nt, Leptospira interrogans serovar lai str. 56601
auauaauuuuuaac

SEQ ID NO: 768363 - RNA, 21 nt, Leptospira interrogans serovar lai str. 56601
auauaauuuuauccauaaauc

SEQ ID NO: 768364 - RNA, 19 nt, Leptospira interrogans serovar lai str. 56601
auauacaacuuuuuuaauu

SEQ ID NO: 768365 - RNA, 19 nt, Leptospira interrogans serovar lai str. 56601
auauacaauaaauagaaua

SEQ ID NO: 768366 - RNA, 14 nt, Leptospira interrogans serovar lai str. 56601
auauacaauaaauc

SEQ ID NO: 768367 - RNA, 23 nt, Leptospira interrogans serovar lai str. 56601
auauagucguauauuagauuuau

SEQ ID NO: 768368 - RNA, 13 nt, Leptospira interrogans serovar lai str. 56601
auauaguuaaauu

SEQ ID NO: 768369 - RNA, 15 nt, Leptospira interrogans serovar lai str. 56601
auauaguuaaauuuu

SEQ ID NO: 768370 - RNA, 19 nt, Leptospira interrogans serovar lai str. 56601
auauaguuaugaauaaaaa

SEQ ID NO: 768371 - RNA, 20 nt, Leptospira interrogans serovar lai str. 56601
auauaguuaugaauaaaaaa

SEQ ID NO: 768372 - RNA, 15 nt, Leptospira interrogans serovar lai str. 56601
auauagcucuugaau

SEQ ID NO: 768373 - RNA, 14 nt, Leptospira interrogans serovar lai str. 56601
auauaggaauuuau

SEQ ID NO: 768374 - RNA, 23 nt, Leptospira interrogans serovar lai str. 56601
auacuaaauuauuuucaaguaaa

SEQ ID NO: 768375 - RNA, 13 nt, Leptospira interrogans serovar lai str. 56601
auacuaaaauuau

SEQ ID NO: 768376 - RNA, 15 nt, Leptospira interrogans serovar lai str. 56601
auacuaaaauuauuc

SEQ ID NO: 768377 - RNA, 20 nt, Leptospira interrogans serovar lai str. 56601
auacuaaaauuauucugaau

SEQ ID NO: 768378 - RNA, 14 nt, Leptospira interrogans serovar lai str. 56601
auacggcacucaau

SEQ ID NO: 768379 - RNA, 23 nt, Leptospira interrogans serovar lai str. 56601
auaccgggccuuuuuuauuucug

SEQ ID NO: 768380 - RNA, 13 nt, Leptospira interrogans serovar lai str. 56601
auacuuaaaaaua

SEQ ID NO: 768381 - RNA, 12 nt, Leptospira interrogans serovar lai str. 56601
auagaaaguaaa

SEQ ID NO: 768382 - RNA, 15 nt, Leptospira interrogans serovar lai str. 56601
auagaacgcgauuug

SEQ ID NO: 768383 - RNA, 18 nt, Leptospira interrogans serovar lai str. 56601
auagaaccuuuugaagua

SEQ ID NO: 768384 - RNA, 22 nt, Leptospira interrogans serovar lai str. 56601
auagaacucuuuuaccuuacca

SEQ ID NO: 768385 - RNA, 23 nt, Leptospira interrogans serovar lai str. 56601
auagaacucuuuuaccuuaccac

SEQ ID NO: 768386 - RNA, 20 nt, Leptospira interrogans serovar lai str. 56601
auagaagcaauaaaaucaau

SEQ ID NO: 768387 - RNA, 21 nt, Leptospira interrogans serovar lai str. 56601
auagaagcgagacgaaaaacu

SEQ ID NO: 768388 - RNA, 20 nt, Leptospira interrogans serovar lai str. 56601
auagaagcgagagacgcuga

SEQ ID NO: 768389 - RNA, 13 nt, Leptospira interrogans serovar lai str. 56601
auagaaauaacuu

SEQ ID NO: 768390 - RNA, 13 nt, Leptospira interrogans serovar lai str. 56601
auagaaauaccau

SEQ ID NO: 768391 - RNA, 17 nt, Leptospira interrogans serovar lai str. 56601
auagaaauacuucucca

SEQ ID NO: 768392 - RNA, 16 nt, Leptospira interrogans serovar lai str. 56601
auagaaauauuuagaa

SEQ ID NO: 768393 - RNA, 17 nt, Leptospira interrogans serovar lai str. 56601
auagaaauuuucaaaaa

SEQ ID NO: 768394 - RNA, 13 nt, Leptospira interrogans serovar lai str. 56601
auagaauuuuugu

SEQ ID NO: 768395 - RNA, 17 nt, Leptospira interrogans serovar lai str. 56601
auagaauuuuuguagaa

SEQ ID NO: 768396 - RNA, 19 nt, Leptospira interrogans serovar lai str. 56601
auagaauuuuuguagaauu

SEQ ID NO: 768397 - RNA, 14 nt, Leptospira interrogans serovar lai str. 56601
auagagaauuaauu

SEQ ID NO: 768398 - RNA, 19 nt, Leptospira interrogans serovar lai str. 56601
auagaaguggguuguuaug

SEQ ID NO: 768399 - RNA, 20 nt, Leptospira interrogans serovar lai str. 56601
auagaauaaauuauacaauu

SEQ ID NO: 768400 - RNA, 22 nt, Leptospira interrogans serovar lai str. 56601
auagaauaaauuauacaauuua

SEQ ID NO: 768401 - RNA, 21 nt, Leptospira interrogans serovar lai str. 56601
auagaauaagguuagauuauu

SEQ ID NO: 768402 - RNA, 17 nt, Leptospira interrogans serovar lai str. 56601
auagaauaaucggaaau

SEQ ID NO: 768403 - RNA, 19 nt, Leptospira interrogans serovar lai str. 56601
auagaauuguguuaguucc

SEQ ID NO: 768404 - RNA, 13 nt, Leptospira interrogans serovar lai str. 56601
auagaauuguuga

SEQ ID NO: 768405 - RNA, 14 nt, Leptospira interrogans serovar lai str. 56601
auagaauuguugaa

SEQ ID NO: 768406 - RNA, 17 nt, Leptospira interrogans serovar lai str. 56601
auagaauuguugaaaaa

SEQ ID NO: 768407 - RNA, 19 nt, Leptospira interrogans serovar lai str. 56601
auagaauuuugcaaaaaaa

SEQ ID NO: 768408 - RNA, 14 nt, Leptospira interrogans serovar lai str. 56601
auagaauccaaugc

SEQ ID NO: 768409 - RNA, 21 nt, Leptospira interrogans serovar lai str. 56601
auaccaaguucgauuaaaaua

SEQ ID NO: 768410 - RNA, 22 nt, Leptospira interrogans serovar lai str. 56601
auaccaaguucgauuaaaauaa

SEQ ID NO: 768411 - RNA, 23 nt, Leptospira interrogans serovar lai str. 56601
auaccaaguucgauuaaaauaaa

SEQ ID NO: 768412 - RNA, 15 nt, Leptospira interrogans serovar lai str. 56601
auaccaauaacuuaa

SEQ ID NO: 768413 - RNA, 18 nt, Leptospira interrogans serovar lai str. 56601
auacauuuaaacuuuuca

SEQ ID NO: 768414 - RNA, 14 nt, Leptospira interrogans serovar lai str. 56601
auacauuuuuagaa

SEQ ID NO: 768415 - RNA, 12 nt, Leptospira interrogans serovar lai str. 56601
auaccaaaaaag

SEQ ID NO: 768416 - RNA, 21 nt, Leptospira interrogans serovar lai str. 56601
auacauaaacgauuauuuuuu

SEQ ID NO: 768417 - RNA, 21 nt, Leptospira interrogans serovar lai str. 56601
auacaucgcuuccugaaugca

SEQ ID NO: 768418 - RNA, 17 nt, Leptospira interrogans serovar lai str. 56601
auacagugucuugaaau

SEQ ID NO: 768419 - RNA, 19 nt, Leptospira interrogans serovar lai str. 56601
auacaguuugaucuuuuug

SEQ ID NO: 768420 - RNA, 17 nt, Leptospira interrogans serovar lai str. 56601
auacauagauaaauccg

SEQ ID NO: 768421 - RNA, 13 nt, Leptospira interrogans serovar lai str. 56601
auaauuccuccau

SEQ ID NO: 768422 - RNA, 15 nt, Leptospira interrogans serovar lai str. 56601
auaauuccuccauga

SEQ ID NO: 768423 - RNA, 19 nt, Leptospira interrogans serovar lai str. 56601
auacaguacuauauuuuug

SEQ ID NO: 768424 - RNA, 17 nt, Leptospira interrogans serovar lai str. 56601
auaauucguuuuuuaaa

SEQ ID NO: 768425 - RNA, 21 nt, Leptospira interrogans serovar lai str. 56601
auaauucguuuuuuaaaaugu

SEQ ID NO: 768426 - RNA, 13 nt, Leptospira interrogans serovar lai str. 56601
auaauucucuuuu

SEQ ID NO: 768427 - RNA, 16 nt, Leptospira interrogans serovar lai str. 56601
auaauucugaauaauu

SEQ ID NO: 768428 - RNA, 23 nt, Leptospira interrogans serovar lai str. 56601
auaauucaaagaugguggaauaa

SEQ ID NO: 768429 - RNA, 12 nt, Leptospira interrogans serovar lai str. 56601
auaauucaagac

SEQ ID NO: 768430 - RNA, 23 nt, Leptospira interrogans serovar lai str. 56601
auaauucaagacuuuauagucaa

SEQ ID NO: 768431 - RNA, 17 nt, Leptospira interrogans serovar lai str. 56601
aucaacuuggaaucuua

SEQ ID NO: 768432 - RNA, 21 nt, Leptospira interrogans serovar lai str. 56601
aucaacuuggaaucuuaaaaa

SEQ ID NO: 768433 - RNA, 14 nt, Leptospira interrogans serovar lai str. 56601
aucaauucuuaaaa

SEQ ID NO: 768434 - RNA, 23 nt, Leptospira interrogans serovar lai str. 56601
aucaauucuucuuucguuugagg

SEQ ID NO: 768435 - RNA, 15 nt, Leptospira interrogans serovar lai str. 56601
aucaauucuuuaaau

SEQ ID NO: 768436 - RNA, 21 nt, Leptospira interrogans serovar lai str. 56601
aucaauuuguuccuaaaaaau

SEQ ID NO: 768437 - RNA, 23 nt, Leptospira interrogans serovar lai str. 56601
aucaauuuguuccuaaaaaauaa

SEQ ID NO: 768438 - RNA, 12 nt, Leptospira interrogans serovar lai str. 56601
aucaauuuugga

SEQ ID NO: 768439 - RNA, 23 nt, Leptospira interrogans serovar lai str. 56601
aucacaauuuuuuuagaaucaug

SEQ ID NO: 768440 - RNA, 16 nt, Leptospira interrogans serovar lai str. 56601
aucacaauuuuaagaa

SEQ ID NO: 768441 - RNA, 16 nt, Leptospira interrogans serovar lai str. 56601
aucacaauuuuacaaa

SEQ ID NO: 768442 - RNA, 18 nt, Leptospira interrogans serovar lai str. 56601
aucacaaggguuguuuca

SEQ ID NO: 768443 - RNA, 22 nt, Leptospira interrogans serovar lai str. 56601
aucacaaggguuguuucaguaa

SEQ ID NO: 768444 - RNA, 13 nt, Leptospira interrogans serovar lai str. 56601
aucacaaaucaca

SEQ ID NO: 768445 - RNA, 15 nt, Leptospira interrogans serovar lai str. 56601
aucacaaaucacaau

SEQ ID NO: 768446 - RNA, 20 nt, Leptospira interrogans serovar lai str. 56601
aucacaaaaaagauaaaaag

SEQ ID NO: 768447 - RNA, 17 nt, Leptospira interrogans serovar lai str. 56601
aucacauccaacccaaa

SEQ ID NO: 768448 - RNA, 19 nt, Leptospira interrogans serovar lai str. 56601
aucacauccaacccaaaca

SEQ ID NO: 768449 - RNA, 15 nt, Leptospira interrogans serovar lai str. 56601
aucacguucaacguu

SEQ ID NO: 768450 - RNA, 12 nt, Leptospira interrogans serovar lai str. 56601
aucacguucuua

SEQ ID NO: 768451 - RNA, 18 nt, Leptospira interrogans serovar lai str. 56601
aucacgaaaauuaaaaaa

SEQ ID NO: 768452 - RNA, 21 nt, Leptospira interrogans serovar lai str. 56601
aaaacggaauuuuguuugaau

SEQ ID NO: 768453 - RNA, 23 nt, Leptospira interrogans serovar lai str. 56601
aaaacgaaauuauacaaaacucu

SEQ ID NO: 768454 - RNA, 23 nt, Leptospira interrogans serovar lai str. 56601
aaaacgguaauuucauaaaauuc

SEQ ID NO: 768455 - RNA, 23 nt, Leptospira interrogans serovar lai str. 56601
aaaacgguaauuuuauguagaaa

SEQ ID NO: 768456 - RNA, 21 nt, Leptospira interrogans serovar lai str. 56601
aaaacgagaaagaauuuccua

SEQ ID NO: 768457 - RNA, 18 nt, Leptospira interrogans serovar lai str. 56601
aaaacgagacguugaguu

SEQ ID NO: 768458 - RNA, 19 nt, Leptospira interrogans serovar lai str. 56601
aucaguaguuauauuaaua

SEQ ID NO: 768459 - RNA, 13 nt, Leptospira interrogans serovar lai str. 56601
aucaguaguucuc

SEQ ID NO: 768460 - RNA, 14 nt, Leptospira interrogans serovar lai str. 56601
aucagguuuuauaa

SEQ ID NO: 768461 - RNA, 15 nt, Leptospira interrogans serovar lai str. 56601
aucagguuuuauaaa

SEQ ID NO: 768462 - RNA, 17 nt, Leptospira interrogans serovar lai str. 56601
aucagggccggagaaaa

SEQ ID NO: 768463 - RNA, 19 nt, Leptospira interrogans serovar lai str. 56601
aucagggccggagaaaauu

SEQ ID NO: 768464 - RNA, 15 nt, Leptospira interrogans serovar lai str. 56601
aucagcauaaguauu

SEQ ID NO: 768465 - RNA, 18 nt, Leptospira interrogans serovar lai str. 56601
aucaggauaaccuaaaau

SEQ ID NO: 768466 - RNA, 13 nt, Leptospira interrogans serovar lai str. 56601
aucagaauaaucu

SEQ ID NO: 768467 - RNA, 19 nt, Leptospira interrogans serovar lai str. 56601
auauuucuuaaauucuaaa

SEQ ID NO: 768468 - RNA, 20 nt, Leptospira interrogans serovar lai str. 56601
auauuucuuucgauuuuucg

SEQ ID NO: 768469 - RNA, 22 nt, Leptospira interrogans serovar lai str. 56601
auauuuuuagaaaauuuuuacu

SEQ ID NO: 768470 - RNA, 15 nt, Leptospira interrogans serovar lai str. 56601
aucaaaaaaaugaua

SEQ ID NO: 768471 - RNA, 15 nt, Leptospira interrogans serovar lai str. 56601
auauuuuuuccaaaa

SEQ ID NO: 768472 - RNA, 17 nt, Leptospira interrogans serovar lai str. 56601
auauuuuuuccaaaaag

SEQ ID NO: 768473 - RNA, 20 nt, Leptospira interrogans serovar lai str. 56601
auauuuuugugaaacucaau

SEQ ID NO: 768474 - RNA, 16 nt, Leptospira interrogans serovar lai str. 56601
auauuuuuuaaaaaua

SEQ ID NO: 768475 - RNA, 19 nt, Leptospira interrogans serovar lai str. 56601
auauuuuuuaaaaauauaa

SEQ ID NO: 768476 - RNA, 16 nt, Leptospira interrogans serovar lai str. 56601
auauuuuuugaaauca

SEQ ID NO: 768477 - RNA, 13 nt, Leptospira interrogans serovar lai str. 56601
auauuuuuuuaau

SEQ ID NO: 768478 - RNA, 16 nt, Leptospira interrogans serovar lai str. 56601
auauuuauaaaacaau

SEQ ID NO: 768479 - RNA, 15 nt, Leptospira interrogans serovar lai str. 56601
auauuuaguauuuua

SEQ ID NO: 768480 - RNA, 23 nt, Leptospira interrogans serovar lai str. 56601
auauuucguaagauaugaauuaa

SEQ ID NO: 768481 - RNA, 21 nt, Leptospira interrogans serovar lai str. 56601
auauuucucucaaauucuuca

SEQ ID NO: 768482 - RNA, 15 nt, Leptospira interrogans serovar lai str. 56601
auauuucuaaaagaa

SEQ ID NO: 768483 - RNA, 18 nt, Leptospira interrogans serovar lai str. 56601
auauuucuaaaagaagau

SEQ ID NO: 768484 - RNA, 15 nt, Leptospira interrogans serovar lai str. 56601
auauucuauuauaua

SEQ ID NO: 768485 - RNA, 18 nt, Leptospira interrogans serovar lai str. 56601
auauucuaauuuuauaaa

SEQ ID NO: 768486 - RNA, 15 nt, Leptospira interrogans serovar lai str. 56601
auauucuaauuuuua

SEQ ID NO: 768487 - RNA, 16 nt, Leptospira interrogans serovar lai str. 56601
auauucuaauuuuuau

SEQ ID NO: 768488 - RNA, 19 nt, Leptospira interrogans serovar lai str. 56601
auauucuucgcuuaacaaa

SEQ ID NO: 768489 - RNA, 15 nt, Leptospira interrogans serovar lai str. 56601
auauucuuauauauc

SEQ ID NO: 768490 - RNA, 20 nt, Leptospira interrogans serovar lai str. 56601
auauucuuauauaucuuugg

SEQ ID NO: 768491 - RNA, 22 nt, Leptospira interrogans serovar lai str. 56601
auauucuuauauuauaauucuc

SEQ ID NO: 768492 - RNA, 15 nt, Leptospira interrogans serovar lai str. 56601
aucaaaggaaauaaa

SEQ ID NO: 768493 - RNA, 17 nt, Leptospira interrogans serovar lai str. 56601
aucaaaggaaauaaaaa

SEQ ID NO: 768494 - RNA, 23 nt, Leptospira interrogans serovar lai str. 56601
aucaaagauauuucaauauaaaa

SEQ ID NO: 768495 - RNA, 21 nt, Leptospira interrogans serovar lai str. 56601
aucaaauagaguaccauaaau

SEQ ID NO: 768496 - RNA, 13 nt, Leptospira interrogans serovar lai str. 56601
aucaaaguuauuu

SEQ ID NO: 768497 - RNA, 14 nt, Leptospira interrogans serovar lai str. 56601
aucaaauaaaguuu

SEQ ID NO: 768498 - RNA, 22 nt, Leptospira interrogans serovar lai str. 56601
aucaaauaagcgcggauuuauu

SEQ ID NO: 768499 - RNA, 20 nt, Leptospira interrogans serovar lai str. 56601
aucaaauauacaaaguuuau

SEQ ID NO: 768500 - RNA, 23 nt, Leptospira interrogans serovar lai str. 56601
aucaaauaccgcgaaauaaaaac

SEQ ID NO: 768501 - RNA, 16 nt, Leptospira interrogans serovar lai str. 56601
aucaacaucacgcaca

SEQ ID NO: 768502 - RNA, 22 nt, Leptospira interrogans serovar lai str. 56601
aucaaauucacauaaaguuaau

SEQ ID NO: 768503 - RNA, 13 nt, Leptospira interrogans serovar lai str. 56601
aucaaauuucugc

SEQ ID NO: 768504 - RNA, 14 nt, Leptospira interrogans serovar lai str. 56601
aucaaauuucugca

SEQ ID NO: 768505 - RNA, 15 nt, Leptospira interrogans serovar lai str. 56601
aucaaauuucugcau

SEQ ID NO: 768506 - RNA, 22 nt, Leptospira interrogans serovar lai str. 56601
aucaaaucugaaauucaucaaa

SEQ ID NO: 768507 - RNA, 15 nt, Leptospira interrogans serovar lai str. 56601
aucaacuacuaaucu

SEQ ID NO: 768508 - RNA, 12 nt, Leptospira interrogans serovar lai str. 56601
aucaacucaucu

SEQ ID NO: 768509 - RNA, 12 nt, Leptospira interrogans serovar lai str. 56601
auauucaaauuu

SEQ ID NO: 768510 - RNA, 13 nt, Leptospira interrogans serovar lai str. 56601
auauucaaaaaau

SEQ ID NO: 768511 - RNA, 12 nt, Leptospira interrogans serovar lai str. 56601
auauucaaaaga

SEQ ID NO: 768512 - RNA, 15 nt, Leptospira interrogans serovar lai str. 56601
auauuauuuuaacuu

SEQ ID NO: 768513 - RNA, 16 nt, Leptospira interrogans serovar lai str. 56601
auauuauuuuaacuug

SEQ ID NO: 768514 - RNA, 12 nt, Leptospira interrogans serovar lai str. 56601
auauuauuuuca

SEQ ID NO: 768515 - RNA, 17 nt, Leptospira interrogans serovar lai str. 56601
auauuccuugagaaaag

SEQ ID NO: 768516 - RNA, 13 nt, Leptospira interrogans serovar lai str. 56601
auauuauaaaauu

SEQ ID NO: 768517 - RNA, 14 nt, Leptospira interrogans serovar lai str. 56601
auauuauaaauauu

SEQ ID NO: 768518 - RNA, 16 nt, Leptospira interrogans serovar lai str. 56601
auauuauaauuuuaaa

SEQ ID NO: 768519 - RNA, 12 nt, Leptospira interrogans serovar lai str. 56601
auauuauauuuu

SEQ ID NO: 768520 - RNA, 16 nt, Leptospira interrogans serovar lai str. 56601
auauuacauucaauaa

SEQ ID NO: 768521 - RNA, 21 nt, Leptospira interrogans serovar lai str. 56601
auauuagaauuguugaaaaac

SEQ ID NO: 768522 - RNA, 21 nt, Leptospira interrogans serovar lai str. 56601
auauuagaauuguugaaaaau

SEQ ID NO: 768523 - RNA, 20 nt, Leptospira interrogans serovar lai str. 56601
auauuagaguuuuugaaaaa

SEQ ID NO: 768524 - RNA, 19 nt, Leptospira interrogans serovar lai str. 56601
auauuaaaguauuaauuua

SEQ ID NO: 768525 - RNA, 20 nt, Leptospira interrogans serovar lai str. 56601
auauuaaagaauaauauuuu

SEQ ID NO: 768526 - RNA, 13 nt, Leptospira interrogans serovar lai str. 56601
auauuaaauuuua

SEQ ID NO: 768527 - RNA, 17 nt, Leptospira interrogans serovar lai str. 56601
auauuaaauuuuauuua

SEQ ID NO: 768528 - RNA, 15 nt, Leptospira interrogans serovar lai str. 56601
auauuaacaaauuua

SEQ ID NO: 768529 - RNA, 17 nt, Leptospira interrogans serovar lai str. 56601
auauuaacuuucauuga

SEQ ID NO: 768530 - RNA, 18 nt, Leptospira interrogans serovar lai str. 56601
auauuaaguuuuuuaaau

SEQ ID NO: 768531 - RNA, 22 nt, Leptospira interrogans serovar lai str. 56601
auauuaaguuuuuuaaauuuac

SEQ ID NO: 768532 - RNA, 17 nt, Leptospira interrogans serovar lai str. 56601
auaugucguuguauaua

SEQ ID NO: 768533 - RNA, 19 nt, Leptospira interrogans serovar lai str. 56601
auauguuuagaguauuaua

SEQ ID NO: 768534 - RNA, 13 nt, Leptospira interrogans serovar lai str. 56601
auauuaaaaaaau

SEQ ID NO: 768535 - RNA, 16 nt, Leptospira interrogans serovar lai str. 56601
auauuaaaaaaauaau

SEQ ID NO: 768536 - RNA, 18 nt, Leptospira interrogans serovar lai str. 56601
auauuaaaacacuuuaca

SEQ ID NO: 768537 - RNA, 12 nt, Leptospira interrogans serovar lai str. 56601
auauuaaaauga

SEQ ID NO: 768538 - RNA, 21 nt, Leptospira interrogans serovar lai str. 56601
auauguauuuauucaaaauau

SEQ ID NO: 768539 - RNA, 13 nt, Leptospira interrogans serovar lai str. 56601
auauggaaacuac

SEQ ID NO: 768540 - RNA, 19 nt, Leptospira interrogans serovar lai str. 56601
auauggaguucuaaauuau

SEQ ID NO: 768541 - RNA, 18 nt, Leptospira interrogans serovar lai str. 56601
augagaaagaauuucuaa

SEQ ID NO: 768542 - RNA, 13 nt, Leptospira interrogans serovar lai str. 56601
augagaaacaaag

SEQ ID NO: 768543 - RNA, 17 nt, Leptospira interrogans serovar lai str. 56601
augagaguucgugaaga

SEQ ID NO: 768544 - RNA, 19 nt, Leptospira interrogans serovar lai str. 56601
augagauaucacaaauuuu

SEQ ID NO: 768545 - RNA, 12 nt, Leptospira interrogans serovar lai str. 56601
augagaaucagu

SEQ ID NO: 768546 - RNA, 12 nt, Leptospira interrogans serovar lai str. 56601
augaaaauuccc

SEQ ID NO: 768547 - RNA, 12 nt, Leptospira interrogans serovar lai str. 56601
augaaaaaacuu

SEQ ID NO: 768548 - RNA, 20 nt, Leptospira interrogans serovar lai str. 56601
augaaaaaacuuuuuauaaa

SEQ ID NO: 768549 - RNA, 12 nt, Leptospira interrogans serovar lai str. 56601
augaaaaagaaa

SEQ ID NO: 768550 - RNA, 13 nt, Leptospira interrogans serovar lai str. 56601
augaaaaagaaac

SEQ ID NO: 768551 - RNA, 13 nt, Leptospira interrogans serovar lai str. 56601
aucuuuuuuucua

SEQ ID NO: 768552 - RNA, 13 nt, Leptospira interrogans serovar lai str. 56601
aucuuuuuuuucu

SEQ ID NO: 768553 - RNA, 19 nt, Leptospira interrogans serovar lai str. 56601
aucuuuuuuuucuaaaaua

SEQ ID NO: 768554 - RNA, 23 nt, Leptospira interrogans serovar lai str. 56601
aucuuuuuuuucuaaaauauuug

SEQ ID NO: 768555 - RNA, 17 nt, Leptospira interrogans serovar lai str. 56601
augaaaaaaaacaaaga

SEQ ID NO: 768556 - RNA, 16 nt, Leptospira interrogans serovar lai str. 56601
augaagaagcuaaaau

SEQ ID NO: 768557 - RNA, 16 nt, Leptospira interrogans serovar lai str. 56601
augaacuuuuuuauau

SEQ ID NO: 768558 - RNA, 19 nt, Leptospira interrogans serovar lai str. 56601
augaacuucuuccauucua

SEQ ID NO: 768559 - RNA, 16 nt, Leptospira interrogans serovar lai str. 56601
augaauugaauuuuuu

SEQ ID NO: 768560 - RNA, 14 nt, Leptospira interrogans serovar lai str. 56601
augaauguuuaaaa

SEQ ID NO: 768561 - RNA, 16 nt, Leptospira interrogans serovar lai str. 56601
augaauugcuaaaaaa

SEQ ID NO: 768562 - RNA, 15 nt, Leptospira interrogans serovar lai str. 56601
augaauuguaaaaaa

SEQ ID NO: 768563 - RNA, 16 nt, Leptospira interrogans serovar lai str. 56601
augaauuguaaaaaac

SEQ ID NO: 768564 - RNA, 20 nt, Leptospira interrogans serovar lai str. 56601
augaauaacuuuacaaaaau

SEQ ID NO: 768565 - RNA, 13 nt, Leptospira interrogans serovar lai str. 56601
augaagagaaagu

SEQ ID NO: 768566 - RNA, 19 nt, Leptospira interrogans serovar lai str. 56601
augaauaggcgauuuuaca

SEQ ID NO: 768567 - RNA, 20 nt, Leptospira interrogans serovar lai str. 56601
augaauaggcgauuuuacaa

SEQ ID NO: 768568 - RNA, 21 nt, Leptospira interrogans serovar lai str. 56601
augaauaggcgauuuuacaaa

SEQ ID NO: 768569 - RNA, 14 nt, Leptospira interrogans serovar lai str. 56601
aucuuggaucaucc

SEQ ID NO: 768570 - RNA, 19 nt, Leptospira interrogans serovar lai str. 56601
aucuuggcgacaaaaggau

SEQ ID NO: 768571 - RNA, 16 nt, Leptospira interrogans serovar lai str. 56601
aucuuuagaauuuuuc

SEQ ID NO: 768572 - RNA, 17 nt, Leptospira interrogans serovar lai str. 56601
aucuuuagaauuuuucg

SEQ ID NO: 768573 - RNA, 19 nt, Leptospira interrogans serovar lai str. 56601
aucuuuaagagccuuucac

SEQ ID NO: 768574 - RNA, 22 nt, Leptospira interrogans serovar lai str. 56601
aucuuuuuaacgcagauuugau

SEQ ID NO: 768575 - RNA, 23 nt, Leptospira interrogans serovar lai str. 56601
aucuuuuugauaaaauauaguua

SEQ ID NO: 768576 - RNA, 12 nt, Leptospira interrogans serovar lai str. 56601
aucuuuuuuaau

SEQ ID NO: 768577 - RNA, 17 nt, Leptospira interrogans serovar lai str. 56601
aucuuuugaaaguuuuu

SEQ ID NO: 768578 - RNA, 19 nt, Leptospira interrogans serovar lai str. 56601
aucuuuauaucuugaacuu

SEQ ID NO: 768579 - RNA, 16 nt, Leptospira interrogans serovar lai str. 56601
aucuuuauauuauaua

SEQ ID NO: 768580 - RNA, 18 nt, Leptospira interrogans serovar lai str. 56601
aucuuugcgauuuuuccg

SEQ ID NO: 768581 - RNA, 13 nt, Leptospira interrogans serovar lai str. 56601
aucuuuuccauug

SEQ ID NO: 768582 - RNA, 14 nt, Leptospira interrogans serovar lai str. 56601
aucuguggagaaaa

SEQ ID NO: 768583 - RNA, 14 nt, Leptospira interrogans serovar lai str. 56601
aucugugggaacua

SEQ ID NO: 768584 - RNA, 15 nt, Leptospira interrogans serovar lai str. 56601
aucugugggaacuac

SEQ ID NO: 768585 - RNA, 21 nt, Leptospira interrogans serovar lai str. 56601
aucugugggaacuaccacaaa

SEQ ID NO: 768586 - RNA, 22 nt, Leptospira interrogans serovar lai str. 56601
aucugugggaacucucacaaau

SEQ ID NO: 768587 - RNA, 21 nt, Leptospira interrogans serovar lai str. 56601
aucugucggaauuacgacaaa

SEQ ID NO: 768588 - RNA, 15 nt, Leptospira interrogans serovar lai str. 56601
aucuguaaaauucag

SEQ ID NO: 768589 - RNA, 16 nt, Leptospira interrogans serovar lai str. 56601
aucuguaaaauucaga

SEQ ID NO: 768590 - RNA, 20 nt, Leptospira interrogans serovar lai str. 56601
aucugucgagcguccauaga

SEQ ID NO: 768591 - RNA, 17 nt, Leptospira interrogans serovar lai str. 56601
aucuugcguuaaaacgg

SEQ ID NO: 768592 - RNA, 13 nt, Leptospira interrogans serovar lai str. 56601
aucuugaauacua

SEQ ID NO: 768593 - RNA, 15 nt, Leptospira interrogans serovar lai str. 56601
aucuucucuagaaac

SEQ ID NO: 768594 - RNA, 19 nt, Leptospira interrogans serovar lai str. 56601
aucucuucgucucaccaac

SEQ ID NO: 768595 - RNA, 20 nt, Leptospira interrogans serovar lai str. 56601
aucucuucgucucaccaaca

SEQ ID NO: 768596 - RNA, 14 nt, Leptospira interrogans serovar lai str. 56601
aucugcaucuuuuc

SEQ ID NO: 768597 - RNA, 15 nt, Leptospira interrogans serovar lai str. 56601
aucugcuuuuuuaaa

SEQ ID NO: 768598 - RNA, 16 nt, Leptospira interrogans serovar lai str. 56601
aucugcuuuuuuaaac

SEQ ID NO: 768599 - RNA, 20 nt, Leptospira interrogans serovar lai str. 56601
aucugcuuuuuuaaaccuuc

SEQ ID NO: 768600 - RNA, 21 nt, Leptospira interrogans serovar lai str. 56601
aucuggaagccaaaaccaauu

SEQ ID NO: 768601 - RNA, 19 nt, Leptospira interrogans serovar lai str. 56601
aucuccgcucuauuuccac

SEQ ID NO: 768602 - RNA, 21 nt, Leptospira interrogans serovar lai str. 56601
aucuauuuuugauuuuagaaa

SEQ ID NO: 768603 - RNA, 15 nt, Leptospira interrogans serovar lai str. 56601
aucucaaaaauacuu

SEQ ID NO: 768604 - RNA, 15 nt, Leptospira interrogans serovar lai str. 56601
aucucaaaaauagca

SEQ ID NO: 768605 - RNA, 14 nt, Leptospira interrogans serovar lai str. 56601
aucucaaaaacacu

SEQ ID NO: 768606 - RNA, 19 nt, Leptospira interrogans serovar lai str. 56601
aucuauuuccguuauauua

SEQ ID NO: 768607 - RNA, 21 nt, Leptospira interrogans serovar lai str. 56601
aucuauuuccguuauauuaaa

SEQ ID NO: 768608 - RNA, 19 nt, Leptospira interrogans serovar lai str. 56601
aucucaaauucgucaaaac

SEQ ID NO: 768609 - RNA, 19 nt, Leptospira interrogans serovar lai str. 56601
aucucaaucaaaauuuuuu

SEQ ID NO: 768610 - RNA, 21 nt, Leptospira interrogans serovar lai str. 56601
aucucaagauuaaucuggucg

SEQ ID NO: 768611 - RNA, 22 nt, Leptospira interrogans serovar lai str. 56601
aucucuaacaaaaaguguuuau

SEQ ID NO: 768612 - RNA, 14 nt, Leptospira interrogans serovar lai str. 56601
aucucuauaaaauc

SEQ ID NO: 768613 - RNA, 22 nt, Leptospira interrogans serovar lai str. 56601
aucuauucuuaaaauguaggaa

SEQ ID NO: 768614 - RNA, 17 nt, Leptospira interrogans serovar lai str. 56601
aucuauugaaacaaaaa

SEQ ID NO: 768615 - RNA, 13 nt, Leptospira interrogans serovar lai str. 56601
aucuauuccuaaa

SEQ ID NO: 768616 - RNA, 19 nt, Leptospira interrogans serovar lai str. 56601
aucuauguccuuuuuuucu

SEQ ID NO: 768617 - RNA, 16 nt, Leptospira interrogans serovar lai str. 56601
aucuauguuuuuuccg

SEQ ID NO: 768618 - RNA, 19 nt, Leptospira interrogans serovar lai str. 56601
aucuauuagaacaucaauu

SEQ ID NO: 768619 - RNA, 17 nt, Leptospira interrogans serovar lai str. 56601
aucuacuuuauuucgga

SEQ ID NO: 768620 - RNA, 20 nt, Leptospira interrogans serovar lai str. 56601
aucuacggaagcuaaaacua

SEQ ID NO: 768621 - RNA, 15 nt, Leptospira interrogans serovar lai str. 56601
aucuaauauuuuucc

SEQ ID NO: 768622 - RNA, 17 nt, Leptospira interrogans serovar lai str. 56601
aucuaaucgaaacuaua

SEQ ID NO: 768623 - RNA, 20 nt, Leptospira interrogans serovar lai str. 56601
aucuaagauuuucuuugauu

SEQ ID NO: 768624 - RNA, 17 nt, Leptospira interrogans serovar lai str. 56601
aucuaagauugaaugaa

SEQ ID NO: 768625 - RNA, 21 nt, Leptospira interrogans serovar lai str. 56601
aucuaagauccaaauuuuuua

SEQ ID NO: 768626 - RNA, 14 nt, Leptospira interrogans serovar lai str. 56601
aucguuuuuauuca

SEQ ID NO: 768627 - RNA, 13 nt, Leptospira interrogans serovar lai str. 56601
aucuaaaaaaaau

SEQ ID NO: 768628 - RNA, 15 nt, Leptospira interrogans serovar lai str. 56601
aucuaaaaagaauca

SEQ ID NO: 768629 - RNA, 15 nt, Leptospira interrogans serovar lai str. 56601
aucguuuauuuuucu

SEQ ID NO: 768630 - RNA, 21 nt, Leptospira interrogans serovar lai str. 56601
aucguuuauuuuucuaaaaaa

SEQ ID NO: 768631 - RNA, 22 nt, Leptospira interrogans serovar lai str. 56601
aucguuuauuuuucuaaaaaaa

SEQ ID NO: 768632 - RNA, 12 nt, Leptospira interrogans serovar lai str. 56601
aucguuuuaaaa

SEQ ID NO: 768633 - RNA, 12 nt, Leptospira interrogans serovar lai str. 56601
aucguucuagaa

SEQ ID NO: 768634 - RNA, 22 nt, Leptospira interrogans serovar lai str. 56601
aucuaaauuuguaauaguuccc

SEQ ID NO: 768635 - RNA, 16 nt, Leptospira interrogans serovar lai str. 56601
aucuaaauuuguugca

SEQ ID NO: 768636 - RNA, 18 nt, Leptospira interrogans serovar lai str. 56601
aucuaaauauugaucuaa

SEQ ID NO: 768637 - RNA, 12 nt, Leptospira interrogans serovar lai str. 56601
aucuaaaagaaa

SEQ ID NO: 768638 - RNA, 16 nt, Leptospira interrogans serovar lai str. 56601
aucuaaagacuaaaaa

SEQ ID NO: 768639 - RNA, 17 nt, Leptospira interrogans serovar lai str. 56601
aucuaaagacuaaaaag

SEQ ID NO: 768640 - RNA, 18 nt, Leptospira interrogans serovar lai str. 56601
aucuaaagacuaaaaagu

SEQ ID NO: 768641 - RNA, 12 nt, Leptospira interrogans serovar lai str. 56601
aucuaaaaggac

SEQ ID NO: 768642 - RNA, 20 nt, Leptospira interrogans serovar lai str. 56601
aucuaaaacacaucuuaaaa

SEQ ID NO: 768643 - RNA, 20 nt, Leptospira interrogans serovar lai str. 56601
aucgugaauuuacaguuaaa

SEQ ID NO: 768644 - RNA, 18 nt, Leptospira interrogans serovar lai str. 56601
aucguuaccagcaagcac

SEQ ID NO: 768645 - RNA, 14 nt, Leptospira interrogans serovar lai str. 56601
aucguuccaaaccc

SEQ ID NO: 768646 - RNA, 15 nt, Leptospira interrogans serovar lai str. 56601
aucguuccaaacccu

SEQ ID NO: 768647 - RNA, 16 nt, Leptospira interrogans serovar lai str. 56601
aucguuccaaacccug

SEQ ID NO: 768648 - RNA, 14 nt, Leptospira interrogans serovar lai str. 56601
aucgcuguuuugug

SEQ ID NO: 768649 - RNA, 18 nt, Leptospira interrogans serovar lai str. 56601
aucggagaauaaggcaaa

SEQ ID NO: 768650 - RNA, 14 nt, Leptospira interrogans serovar lai str. 56601
aucggagaauuuaa

SEQ ID NO: 768651 - RNA, 17 nt, Leptospira interrogans serovar lai str. 56601
aucggcaauugaagcag

SEQ ID NO: 768652 - RNA, 18 nt, Leptospira interrogans serovar lai str. 56601
aucgcguuugaaacucag

SEQ ID NO: 768653 - RNA, 14 nt, Leptospira interrogans serovar lai str. 56601
aucgcgaagaaagg

SEQ ID NO: 768654 - RNA, 17 nt, Leptospira interrogans serovar lai str. 56601
aucgcacgucccacaaa

SEQ ID NO: 768655 - RNA, 14 nt, Leptospira interrogans serovar lai str. 56601
aucgcaaauacagu

SEQ ID NO: 768656 - RNA, 21 nt, Leptospira interrogans serovar lai str. 56601
aucgcauaaaauucuuugaga

SEQ ID NO: 768657 - RNA, 14 nt, Leptospira interrogans serovar lai str. 56601
aucgaaaaaacaaa

SEQ ID NO: 768658 - RNA, 16 nt, Leptospira interrogans serovar lai str. 56601
aucgaucuguaaaauu

SEQ ID NO: 768659 - RNA, 15 nt, Leptospira interrogans serovar lai str. 56601
aucgaucuguaaagu

SEQ ID NO: 768660 - RNA, 14 nt, Leptospira interrogans serovar lai str. 56601
aucgauucagagug

SEQ ID NO: 768661 - RNA, 19 nt, Leptospira interrogans serovar lai str. 56601
aucgauuuacuuuaaaauu

SEQ ID NO: 768662 - RNA, 14 nt, Leptospira interrogans serovar lai str. 56601
aucgauuucuaaau

SEQ ID NO: 768663 - RNA, 11 nt, Leptospira interrogans serovar lai str. 56601
aucgauuuuac

SEQ ID NO: 768664 - RNA, 22 nt, Leptospira interrogans serovar lai str. 56601
aucgauuacucuuugagaaacg

SEQ ID NO: 768665 - RNA, 18 nt, Leptospira interrogans serovar lai str. 56601
aucgaugugauagaaagg

SEQ ID NO: 768666 - RNA, 15 nt, Leptospira interrogans serovar lai str. 56601
auccuuauacuuucc

SEQ ID NO: 768667 - RNA, 22 nt, Leptospira interrogans serovar lai str. 56601
auccuuacgaugucuuuucaau

SEQ ID NO: 768668 - RNA, 21 nt, Leptospira interrogans serovar lai str. 56601
auccuucaaacuuuucggaac

SEQ ID NO: 768669 - RNA, 13 nt, Leptospira interrogans serovar lai str. 56601
auccuuuuucuuc

SEQ ID NO: 768670 - RNA, 23 nt, Leptospira interrogans serovar lai str. 56601
auccucugaacuucaucaauggu

SEQ ID NO: 768671 - RNA, 16 nt, Leptospira interrogans serovar lai str. 56601
auccuauucaacuugu

SEQ ID NO: 768672 - RNA, 15 nt, Leptospira interrogans serovar lai str. 56601
auccuauaauaaaau

SEQ ID NO: 768673 - RNA, 17 nt, Leptospira interrogans serovar lai str. 56601
auccuauaauaaaauua

SEQ ID NO: 768674 - RNA, 16 nt, Leptospira interrogans serovar lai str. 56601
auccuaaugaaaaaga

SEQ ID NO: 768675 - RNA, 21 nt, Leptospira interrogans serovar lai str. 56601
auccguaaaaaacguuuuguu

SEQ ID NO: 768676 - RNA, 18 nt, Leptospira interrogans serovar lai str. 56601
aucccgauacagaauaaa

SEQ ID NO: 768677 - RNA, 20 nt, Leptospira interrogans serovar lai str. 56601
aucccaugauagaguucuga

SEQ ID NO: 768678 - RNA, 18 nt, Leptospira interrogans serovar lai str. 56601
aucccaaauucuuuccuu

SEQ ID NO: 768679 - RNA, 22 nt, Leptospira interrogans serovar lai str. 56601
auccaugauuuguaauaguucc

SEQ ID NO: 768680 - RNA, 21 nt, Leptospira interrogans serovar lai str. 56601
auccaucugagaauuucugca

SEQ ID NO: 768681 - RNA, 17 nt, Leptospira interrogans serovar lai str. 56601
auccaucguaucuuuca

SEQ ID NO: 768682 - RNA, 13 nt, Leptospira interrogans serovar lai str. 56601
auccauaaguucc

SEQ ID NO: 768683 - RNA, 18 nt, Leptospira interrogans serovar lai str. 56601
auccauaaguuccuuaaa

SEQ ID NO: 768684 - RNA, 22 nt, Leptospira interrogans serovar lai str. 56601
auccauaaguuccuuaaaagua

SEQ ID NO: 768685 - RNA, 16 nt, Leptospira interrogans serovar lai str. 56601
auccauaaauucuaca

SEQ ID NO: 768686 - RNA, 19 nt, Leptospira interrogans serovar lai str. 56601
aucauuggaguuuuuuaaa

SEQ ID NO: 768687 - RNA, 23 nt, Leptospira interrogans serovar lai str. 56601
aucauuggaguuuuuuaaaauua

SEQ ID NO: 768688 - RNA, 18 nt, Leptospira interrogans serovar lai str. 56601
auccaaagaaagaaaaua

SEQ ID NO: 768689 - RNA, 20 nt, Leptospira interrogans serovar lai str. 56601
auccaaagaaagaaaauaca

SEQ ID NO: 768690 - RNA, 16 nt, Leptospira interrogans serovar lai str. 56601
auccacaaagucucca

SEQ ID NO: 768691 - RNA, 15 nt, Leptospira interrogans serovar lai str. 56601
auccacuaaaauacu

SEQ ID NO: 768692 - RNA, 15 nt, Leptospira interrogans serovar lai str. 56601
aucauucuuuagaaa

SEQ ID NO: 768693 - RNA, 17 nt, Leptospira interrogans serovar lai str. 56601
aucauucuuuagaaauu

SEQ ID NO: 768694 - RNA, 23 nt, Leptospira interrogans serovar lai str. 56601
aucauucuuuagaaauuuuuaau

SEQ ID NO: 768695 - RNA, 16 nt, Leptospira interrogans serovar lai str. 56601
aucauucugaaaaaag

SEQ ID NO: 768696 - RNA, 16 nt, Leptospira interrogans serovar lai str. 56601
aaaagaauauuucuaa

SEQ ID NO: 768697 - RNA, 21 nt, Leptospira interrogans serovar lai str. 56601
aaaagaaucauacaaucaaau

SEQ ID NO: 768698 - RNA, 13 nt, Leptospira interrogans serovar lai str. 56601
aaaagaagaugcu

SEQ ID NO: 768699 - RNA, 23 nt, Leptospira interrogans serovar lai str. 56601
aaaagaauauuauuauauuuaaa

SEQ ID NO: 768700 - RNA, 12 nt, Leptospira interrogans serovar lai str. 56601
aaaagaauugaa

SEQ ID NO: 768701 - RNA, 17 nt, Leptospira interrogans serovar lai str. 56601
aaaagaauuucuaaaau

SEQ ID NO: 768702 - RNA, 15 nt, Leptospira interrogans serovar lai str. 56601
aaaagaauuuuuaaa

SEQ ID NO: 768703 - RNA, 17 nt, Leptospira interrogans serovar lai str. 56601
aaaagaauuuuuaaaaa

SEQ ID NO: 768704 - RNA, 18 nt, Leptospira interrogans serovar lai str. 56601
aaaagaauuuuuaaaaau

SEQ ID NO: 768705 - RNA, 15 nt, Leptospira interrogans serovar lai str. 56601
aaaacuguaaauuag

SEQ ID NO: 768706 - RNA, 16 nt, Leptospira interrogans serovar lai str. 56601
aaaacuguaaauuaga

SEQ ID NO: 768707 - RNA, 20 nt, Leptospira interrogans serovar lai str. 56601
aaaacugauuuaauuauuua

SEQ ID NO: 768708 - RNA, 13 nt, Leptospira interrogans serovar lai str. 56601
aaaacugauuaaa

SEQ ID NO: 768709 - RNA, 15 nt, Leptospira interrogans serovar lai str. 56601
aaaacugauuaaaau

SEQ ID NO: 768710 - RNA, 19 nt, Leptospira interrogans serovar lai str. 56601
aaaagaacuuugagaugag

SEQ ID NO: 768711 - RNA, 22 nt, Leptospira interrogans serovar lai str. 56601
aucaugucucaguucaaaauau

SEQ ID NO: 768712 - RNA, 16 nt, Leptospira interrogans serovar lai str. 56601
aucaugugaauucaga

SEQ ID NO: 768713 - RNA, 15 nt, Leptospira interrogans serovar lai str. 56601
aaaacucuuuaaaaa

SEQ ID NO: 768714 - RNA, 12 nt, Leptospira interrogans serovar lai str. 56601
aaaacucuaaau

SEQ ID NO: 768715 - RNA, 19 nt, Leptospira interrogans serovar lai str. 56601
aaaacucuaaauucagaaa

SEQ ID NO: 768716 - RNA, 22 nt, Leptospira interrogans serovar lai str. 56601
aaaacucuaccuuuauuuaaaa

SEQ ID NO: 768717 - RNA, 22 nt, Leptospira interrogans serovar lai str. 56601
aaaacucuguucaguguaagau

SEQ ID NO: 768718 - RNA, 15 nt, Leptospira interrogans serovar lai str. 56601
aucauggccuucugg

SEQ ID NO: 768719 - RNA, 13 nt, Leptospira interrogans serovar lai str. 56601
aaaacguggauuu

SEQ ID NO: 768720 - RNA, 13 nt, Leptospira interrogans serovar lai str. 56601
aaaacgucuuuau

SEQ ID NO: 768721 - RNA, 23 nt, Leptospira interrogans serovar lai str. 56601
aaaacgucuuuauccauccauac

SEQ ID NO: 768722 - RNA, 23 nt, Leptospira interrogans serovar lai str. 56601
aaaacuagggaaaguuuuuuaaa

SEQ ID NO: 768723 - RNA, 17 nt, Leptospira interrogans serovar lai str. 56601
aucauacuuuuaaaaaa

SEQ ID NO: 768724 - RNA, 18 nt, Leptospira interrogans serovar lai str. 56601
aucauacuuuuaaaaaau

SEQ ID NO: 768725 - RNA, 19 nt, Leptospira interrogans serovar lai str. 56601
aaaacuaucaguuuucaga

SEQ ID NO: 768726 - RNA, 13 nt, Leptospira interrogans serovar lai str. 56601
aaaacucaaagaa

SEQ ID NO: 768727 - RNA, 15 nt, Leptospira interrogans serovar lai str. 56601
aaaacucagcgaaua

SEQ ID NO: 768728 - RNA, 13 nt, Leptospira interrogans serovar lai str. 56601
aaaacucaucaca

SEQ ID NO: 768729 - RNA, 14 nt, Leptospira interrogans serovar lai str. 56601
aaaacucaucacaa

SEQ ID NO: 768730 - RNA, 15 nt, Leptospira interrogans serovar lai str. 56601
aaaacucaucacaac

SEQ ID NO: 768731 - RNA, 13 nt, Leptospira interrogans serovar lai str. 56601
aucaucuuacaca

SEQ ID NO: 768732 - RNA, 21 nt, Leptospira interrogans serovar lai str. 56601
aucaugaucaaauucacauaa

SEQ ID NO: 768733 - RNA, 21 nt, Leptospira interrogans serovar lai str. 56601
aucaugauucauuuuucugaa

SEQ ID NO: 768734 - RNA, 20 nt, Leptospira interrogans serovar lai str. 56601
aucaugaauauuuuccaaaa

SEQ ID NO: 768735 - RNA, 14 nt, Leptospira interrogans serovar lai str. 56601
caaaagaggucuau

SEQ ID NO: 768736 - RNA, 15 nt, Leptospira interrogans serovar lai str. 56601
caaaacuucaaagaa

SEQ ID NO: 768737 - RNA, 12 nt, Leptospira interrogans serovar lai str. 56601
caaaacuuuacg

SEQ ID NO: 768738 - RNA, 14 nt, Leptospira interrogans serovar lai str. 56601
caaaacuaggaucu

SEQ ID NO: 768739 - RNA, 12 nt, Leptospira interrogans serovar lai str. 56601
caaaacuaaaac

SEQ ID NO: 768740 - RNA, 20 nt, Leptospira interrogans serovar lai str. 56601
caaaacuaccucaauuuucc

SEQ ID NO: 768741 - RNA, 11 nt, Leptospira interrogans serovar lai str. 56601
caaaacuuaaa

SEQ ID NO: 768742 - RNA, 15 nt, Leptospira interrogans serovar lai str. 56601
caaaacuuaaaaaug

SEQ ID NO: 768743 - RNA, 14 nt, Leptospira interrogans serovar lai str. 56601
caaaacuuaaauuc

SEQ ID NO: 768744 - RNA, 16 nt, Leptospira interrogans serovar lai str. 56601
caaaacuuaaguuugu

SEQ ID NO: 768745 - RNA, 17 nt, Leptospira interrogans serovar lai str. 56601
caaaacucuuuaaaaac

SEQ ID NO: 768746 - RNA, 17 nt, Leptospira interrogans serovar lai str. 56601
caaaaagacuauauucu

SEQ ID NO: 768747 - RNA, 15 nt, Leptospira interrogans serovar lai str. 56601
caaaaacuaaaauac

SEQ ID NO: 768748 - RNA, 12 nt, Leptospira interrogans serovar lai str. 56601
caaaaagaaaaa

SEQ ID NO: 768749 - RNA, 12 nt, Leptospira interrogans serovar lai str. 56601
caaaaacucaaa

SEQ ID NO: 768750 - RNA, 20 nt, Leptospira interrogans serovar lai str. 56601
caaaaacucaaagaaauuuu

SEQ ID NO: 768751 - RNA, 13 nt, Leptospira interrogans serovar lai str. 56601
caaaaccucaaaa

SEQ ID NO: 768752 - RNA, 19 nt, Leptospira interrogans serovar lai str. 56601
caaaaccucaaaaaauuua

SEQ ID NO: 768753 - RNA, 23 nt, Leptospira interrogans serovar lai str. 56601
caaaacgauauuuuuuaaaaaua

SEQ ID NO: 768754 - RNA, 21 nt, Leptospira interrogans serovar lai str. 56601
caaaacgcgauccguaaaaaa

SEQ ID NO: 768755 - RNA, 22 nt, Leptospira interrogans serovar lai str. 56601
caaaacgcgauccguaaaaaac

SEQ ID NO: 768756 - RNA, 14 nt, Leptospira interrogans serovar lai str. 56601
caaaacgguaauuu

SEQ ID NO: 768757 - RNA, 18 nt, Leptospira interrogans serovar lai str. 56601
caaaacgguaauuuuaug

SEQ ID NO: 768758 - RNA, 22 nt, Leptospira interrogans serovar lai str. 56601
caaaacgguuuucuaauuuaug

SEQ ID NO: 768759 - RNA, 17 nt, Leptospira interrogans serovar lai str. 56601
caaaauuaagaaucaau

SEQ ID NO: 768760 - RNA, 21 nt, Leptospira interrogans serovar lai str. 56601
caaaauuuuuguguaaaauua

SEQ ID NO: 768761 - RNA, 17 nt, Leptospira interrogans serovar lai str. 56601
caaaauuuuuuccuuua

SEQ ID NO: 768762 - RNA, 14 nt, Leptospira interrogans serovar lai str. 56601
caaaauuuuuuuaa

SEQ ID NO: 768763 - RNA, 23 nt, Leptospira interrogans serovar lai str. 56601
caaaauuaggcuuaucuguaaaa

SEQ ID NO: 768764 - RNA, 20 nt, Leptospira interrogans serovar lai str. 56601
caaaaucguccaauguggca

SEQ ID NO: 768765 - RNA, 22 nt, Leptospira interrogans serovar lai str. 56601
caaaaucgauugaucuaucuuu

SEQ ID NO: 768766 - RNA, 16 nt, Leptospira interrogans serovar lai str. 56601
caaaauaggaaccauc

SEQ ID NO: 768767 - RNA, 19 nt, Leptospira interrogans serovar lai str. 56601
caaaaucccagaaaggaac

SEQ ID NO: 768768 - RNA, 19 nt, Leptospira interrogans serovar lai str. 56601
caaaaguccaauuuuaaaa

SEQ ID NO: 768769 - RNA, 23 nt, Leptospira interrogans serovar lai str. 56601
caaaaguccaauuuuaaaaccaa

SEQ ID NO: 768770 - RNA, 13 nt, Leptospira interrogans serovar lai str. 56601
caaaagucuauuu

SEQ ID NO: 768771 - RNA, 19 nt, Leptospira interrogans serovar lai str. 56601
caaaagucuauuucuaaac

SEQ ID NO: 768772 - RNA, 20 nt, Leptospira interrogans serovar lai str. 56601
caaaauacgaucuaauuugu

SEQ ID NO: 768773 - RNA, 12 nt, Leptospira interrogans serovar lai str. 56601
caaaauacuuua

SEQ ID NO: 768774 - RNA, 22 nt, Leptospira interrogans serovar lai str. 56601
caaaauacuuuaucuuuacuua

SEQ ID NO: 768775 - RNA, 16 nt, Leptospira interrogans serovar lai str. 56601
caaaagcguuguauaa

SEQ ID NO: 768776 - RNA, 15 nt, Leptospira interrogans serovar lai str. 56601
caaaagguauaaaau

SEQ ID NO: 768777 - RNA, 16 nt, Leptospira interrogans serovar lai str. 56601
caaaagguauaaaaua

SEQ ID NO: 768778 - RNA, 14 nt, Leptospira interrogans serovar lai str. 56601
caaagauuuuaaaa

SEQ ID NO: 768779 - RNA, 21 nt, Leptospira interrogans serovar lai str. 56601
caaagauuucuauauucaaaa

SEQ ID NO: 768780 - RNA, 18 nt, Leptospira interrogans serovar lai str. 56601
caaaggccgcuucuuuau

SEQ ID NO: 768781 - RNA, 16 nt, Leptospira interrogans serovar lai str. 56601
caaaggcgggaauaaa

SEQ ID NO: 768782 - RNA, 17 nt, Leptospira interrogans serovar lai str. 56601
caaagccuuaaaucaau

SEQ ID NO: 768783 - RNA, 15 nt, Leptospira interrogans serovar lai str. 56601
caaagauuacauaau

SEQ ID NO: 768784 - RNA, 21 nt, Leptospira interrogans serovar lai str. 56601
caaagauauuucaauauaaaa

SEQ ID NO: 768785 - RNA, 22 nt, Leptospira interrogans serovar lai str. 56601
caaagauauuucaauauaaaaa

SEQ ID NO: 768786 - RNA, 15 nt, Leptospira interrogans serovar lai str. 56601
caaagacaaaguauu

SEQ ID NO: 768787 - RNA, 15 nt, Leptospira interrogans serovar lai str. 56601
caaagaauauaaaau

SEQ ID NO: 768788 - RNA, 13 nt, Leptospira interrogans serovar lai str. 56601
caaagaaucgaga

SEQ ID NO: 768789 - RNA, 17 nt, Leptospira interrogans serovar lai str. 56601
caaacuuuuaucgaaug

SEQ ID NO: 768790 - RNA, 21 nt, Leptospira interrogans serovar lai str. 56601
caaacuuuuguaauaaaaauu

SEQ ID NO: 768791 - RNA, 16 nt, Leptospira interrogans serovar lai str. 56601
caaacuuuuuauaaaa

SEQ ID NO: 768792 - RNA, 20 nt, Leptospira interrogans serovar lai str. 56601
caaacuuuuuauaaaaagcu

SEQ ID NO: 768793 - RNA, 14 nt, Leptospira interrogans serovar lai str. 56601
caaacuuuuuuagc

SEQ ID NO: 768794 - RNA, 18 nt, Leptospira interrogans serovar lai str. 56601
caaacgcuuucguaaaaa

SEQ ID NO: 768795 - RNA, 16 nt, Leptospira interrogans serovar lai str. 56601
caaacuuacaaaaauc

SEQ ID NO: 768796 - RNA, 17 nt, Leptospira interrogans serovar lai str. 56601
caaacuugcaauuuuac

SEQ ID NO: 768797 - RNA, 13 nt, Leptospira interrogans serovar lai str. 56601
caaacuuuaauua

SEQ ID NO: 768798 - RNA, 19 nt, Leptospira interrogans serovar lai str. 56601
caaacuuuaauuauugaua

SEQ ID NO: 768799 - RNA, 16 nt, Leptospira interrogans serovar lai str. 56601
caaacaacaaaaaaua

SEQ ID NO: 768800 - RNA, 17 nt, Leptospira interrogans serovar lai str. 56601
caaacaacaaaaaauau

SEQ ID NO: 768801 - RNA, 14 nt, Leptospira interrogans serovar lai str. 56601
caaacaaauucuaa

SEQ ID NO: 768802 - RNA, 15 nt, Leptospira interrogans serovar lai str. 56601
caacaguacaagaau

SEQ ID NO: 768803 - RNA, 19 nt, Leptospira interrogans serovar lai str. 56601
caacaguacaagaaucaaa

SEQ ID NO: 768804 - RNA, 14 nt, Leptospira interrogans serovar lai str. 56601
caacaucacgcaca

SEQ ID NO: 768805 - RNA, 12 nt, Leptospira interrogans serovar lai str. 56601
caacauccuuca

SEQ ID NO: 768806 - RNA, 17 nt, Leptospira interrogans serovar lai str. 56601
caacaacaccaccaaca

SEQ ID NO: 768807 - RNA, 16 nt, Leptospira interrogans serovar lai str. 56601
caacaccaccaacagc

SEQ ID NO: 768808 - RNA, 18 nt, Leptospira interrogans serovar lai str. 56601
caacauugcgagauuuua

SEQ ID NO: 768809 - RNA, 23 nt, Leptospira interrogans serovar lai str. 56601
caacauugcgagauuuuaagaca

SEQ ID NO: 768810 - RNA, 13 nt, Leptospira interrogans serovar lai str. 56601
caacccaaacaca

SEQ ID NO: 768811 - RNA, 19 nt, Leptospira interrogans serovar lai str. 56601
caaaguauuuaauuuuaag

SEQ ID NO: 768812 - RNA, 14 nt, Leptospira interrogans serovar lai str. 56601
caaagucaaaggag

SEQ ID NO: 768813 - RNA, 22 nt, Leptospira interrogans serovar lai str. 56601
caaagucaaaggagaaggauaa

SEQ ID NO: 768814 - RNA, 20 nt, Leptospira interrogans serovar lai str. 56601
caaauauuaagaauucuaaa

SEQ ID NO: 768815 - RNA, 19 nt, Leptospira interrogans serovar lai str. 56601
caaaucgauccuguuuaua

SEQ ID NO: 768816 - RNA, 22 nt, Leptospira interrogans serovar lai str. 56601
caaaucgaagaugguacuuuac

SEQ ID NO: 768817 - RNA, 12 nt, Leptospira interrogans serovar lai str. 56601
caaaucaaaucg

SEQ ID NO: 768818 - RNA, 16 nt, Leptospira interrogans serovar lai str. 56601
caaaucacaauuuuaa

SEQ ID NO: 768819 - RNA, 23 nt, Leptospira interrogans serovar lai str. 56601
caaaucacaauuuuaagaacaau

SEQ ID NO: 768820 - RNA, 19 nt, Leptospira interrogans serovar lai str. 56601
caaaucacauccaacccaa

SEQ ID NO: 768821 - RNA, 16 nt, Leptospira interrogans serovar lai str. 56601
caaaucaucuaucuuu

SEQ ID NO: 768822 - RNA, 19 nt, Leptospira interrogans serovar lai str. 56601
caaaucaucuaucuuuuca

SEQ ID NO: 768823 - RNA, 19 nt, Leptospira interrogans serovar lai str. 56601
caaaucauaggauacaaaa

SEQ ID NO: 768824 - RNA, 22 nt, Leptospira interrogans serovar lai str. 56601
caaaucauaggauacaaaacuu

SEQ ID NO: 768825 - RNA, 15 nt, Leptospira interrogans serovar lai str. 56601
caaaugauagaaacu

SEQ ID NO: 768826 - RNA, 18 nt, Leptospira interrogans serovar lai str. 56601
caaaugagagcgaaugca

SEQ ID NO: 768827 - RNA, 13 nt, Leptospira interrogans serovar lai str. 56601
caaaugugagagu

SEQ ID NO: 768828 - RNA, 19 nt, Leptospira interrogans serovar lai str. 56601
caaaucuuucacuuuaaaa

SEQ ID NO: 768829 - RNA, 15 nt, Leptospira interrogans serovar lai str. 56601
caaaucuucgguuua

SEQ ID NO: 768830 - RNA, 21 nt, Leptospira interrogans serovar lai str. 56601
caaaucugaaauucaucaaau

SEQ ID NO: 768831 - RNA, 14 nt, Leptospira interrogans serovar lai str. 56601
caaaucugaaucuc

SEQ ID NO: 768832 - RNA, 17 nt, Leptospira interrogans serovar lai str. 56601
caaaucugaaucucuuu

SEQ ID NO: 768833 - RNA, 17 nt, Leptospira interrogans serovar lai str. 56601
caaaucgugaauuuaca

SEQ ID NO: 768834 - RNA, 20 nt, Leptospira interrogans serovar lai str. 56601
caaaucgcugguuuuauuuc

SEQ ID NO: 768835 - RNA, 17 nt, Leptospira interrogans serovar lai str. 56601
caaauuaaguuuaaaaa

SEQ ID NO: 768836 - RNA, 21 nt, Leptospira interrogans serovar lai str. 56601
caaauuaaguuuaaaaacagu

SEQ ID NO: 768837 - RNA, 17 nt, Leptospira interrogans serovar lai str. 56601
caaauuccaauuuuucu

SEQ ID NO: 768838 - RNA, 20 nt, Leptospira interrogans serovar lai str. 56601
caaauucacgaccuuaaaua

SEQ ID NO: 768839 - RNA, 22 nt, Leptospira interrogans serovar lai str. 56601
caaauucacguucaacaaacaa

SEQ ID NO: 768840 - RNA, 20 nt, Leptospira interrogans serovar lai str. 56601
caaauucgucaaaaccaaaa

SEQ ID NO: 768841 - RNA, 16 nt, Leptospira interrogans serovar lai str. 56601
caaauuuauguacuuu

SEQ ID NO: 768842 - RNA, 21 nt, Leptospira interrogans serovar lai str. 56601
caaauuuauguacuuuuaaga

SEQ ID NO: 768843 - RNA, 15 nt, Leptospira interrogans serovar lai str. 56601
caaauuuaaaauaac

SEQ ID NO: 768844 - RNA, 14 nt, Leptospira interrogans serovar lai str. 56601
caaauuguuuucua

SEQ ID NO: 768845 - RNA, 19 nt, Leptospira interrogans serovar lai str. 56601
caaauuguuuucuaaagga

SEQ ID NO: 768846 - RNA, 19 nt, Leptospira interrogans serovar lai str. 56601
caaauuggcagaugaaacu

SEQ ID NO: 768847 - RNA, 16 nt, Leptospira interrogans serovar lai str. 56601
caacggauuccuccag

SEQ ID NO: 768848 - RNA, 18 nt, Leptospira interrogans serovar lai str. 56601
caacggauuccuccagug

SEQ ID NO: 768849 - RNA, 16 nt, Leptospira interrogans serovar lai str. 56601
caacguaccaaaaccc

SEQ ID NO: 768850 - RNA, 18 nt, Leptospira interrogans serovar lai str. 56601
caacgguaacgagcaucu

SEQ ID NO: 768851 - RNA, 13 nt, Leptospira interrogans serovar lai str. 56601
caacucagaugaa

SEQ ID NO: 768852 - RNA, 16 nt, Leptospira interrogans serovar lai str. 56601
caacucagaugaaagu

SEQ ID NO: 768853 - RNA, 16 nt, Leptospira interrogans serovar lai str. 56601
caacuuacauuaaaua

SEQ ID NO: 768854 - RNA, 21 nt, Leptospira interrogans serovar lai str. 56601
caacuuagaacuugucccaaa

SEQ ID NO: 768855 - RNA, 19 nt, Leptospira interrogans serovar lai str. 56601
caacuuauaauuuucuuaa

SEQ ID NO: 768856 - RNA, 17 nt, Leptospira interrogans serovar lai str. 56601
caacucuaauacaaaaa

SEQ ID NO: 768857 - RNA, 22 nt, Leptospira interrogans serovar lai str. 56601
caacucuaauguaggaacuauu

SEQ ID NO: 768858 - RNA, 17 nt, Leptospira interrogans serovar lai str. 56601
caacucuauuacuaaac

SEQ ID NO: 768859 - RNA, 17 nt, Leptospira interrogans serovar lai str. 56601
caacucuauuucaguuc

SEQ ID NO: 768860 - RNA, 14 nt, Leptospira interrogans serovar lai str. 56601
caacucuucuucua

SEQ ID NO: 768861 - RNA, 13 nt, Leptospira interrogans serovar lai str. 56601
caagaucauucua

SEQ ID NO: 768862 - RNA, 17 nt, Leptospira interrogans serovar lai str. 56601
caagaaugaaaaaacua

SEQ ID NO: 768863 - RNA, 19 nt, Leptospira interrogans serovar lai str. 56601
caagacaaacaaacaugca

SEQ ID NO: 768864 - RNA, 21 nt, Leptospira interrogans serovar lai str. 56601
caaucccggcggaaaauccua

SEQ ID NO: 768865 - RNA, 15 nt, Leptospira interrogans serovar lai str. 56601
caaucgaaguugauu

SEQ ID NO: 768866 - RNA, 18 nt, Leptospira interrogans serovar lai str. 56601
caaucuauuaacuuuaca

SEQ ID NO: 768867 - RNA, 20 nt, Leptospira interrogans serovar lai str. 56601
caauauuuugucuuuaauuu

SEQ ID NO: 768868 - RNA, 23 nt, Leptospira interrogans serovar lai str. 56601
caauauuuugucuuuaauuucaa

SEQ ID NO: 768869 - RNA, 15 nt, Leptospira interrogans serovar lai str. 56601
caaucaaauuuuuga

SEQ ID NO: 768870 - RNA, 15 nt, Leptospira interrogans serovar lai str. 56601
caaucaauugaaagu

SEQ ID NO: 768871 - RNA, 23 nt, Leptospira interrogans serovar lai str. 56601
caaguguggucuauuacaaaacu

SEQ ID NO: 768872 - RNA, 15 nt, Leptospira interrogans serovar lai str. 56601
caaguagagagugaa

SEQ ID NO: 768873 - RNA, 18 nt, Leptospira interrogans serovar lai str. 56601
caaguagagagugaaaaa

SEQ ID NO: 768874 - RNA, 14 nt, Leptospira interrogans serovar lai str. 56601
caagcuuccuuuuu

SEQ ID NO: 768875 - RNA, 16 nt, Leptospira interrogans serovar lai str. 56601
caagcuuccuuuuuua

SEQ ID NO: 768876 - RNA, 15 nt, Leptospira interrogans serovar lai str. 56601
caaguuugugagagu

SEQ ID NO: 768877 - RNA, 19 nt, Leptospira interrogans serovar lai str. 56601
caaguucuggguaaaaaaa

SEQ ID NO: 768878 - RNA, 11 nt, Leptospira interrogans serovar lai str. 56601
caaguuaaauu

SEQ ID NO: 768879 - RNA, 22 nt, Leptospira interrogans serovar lai str. 56601
caaguuaagaguuuguuccaaa

SEQ ID NO: 768880 - RNA, 15 nt, Leptospira interrogans serovar lai str. 56601
caaguuaauagaguu

SEQ ID NO: 768881 - RNA, 18 nt, Leptospira interrogans serovar lai str. 56601
caaguuauuguaaaacuc

SEQ ID NO: 768882 - RNA, 19 nt, Leptospira interrogans serovar lai str. 56601
caaguucgguagaaagaau

SEQ ID NO: 768883 - RNA, 23 nt, Leptospira interrogans serovar lai str. 56601
caaguucgguagaaagaauuuuc

SEQ ID NO: 768884 - RNA, 17 nt, Leptospira interrogans serovar lai str. 56601
caaguucgauuaaaaua

SEQ ID NO: 768885 - RNA, 19 nt, Leptospira interrogans serovar lai str. 56601
caaguucgauuaaaauaaa

SEQ ID NO: 768886 - RNA, 19 nt, Leptospira interrogans serovar lai str. 56601
caauaaaggaaaguucuau

SEQ ID NO: 768887 - RNA, 12 nt, Leptospira interrogans serovar lai str. 56601
caauaaaauacc

SEQ ID NO: 768888 - RNA, 15 nt, Leptospira interrogans serovar lai str. 56601
caauaaggagcaccu

SEQ ID NO: 768889 - RNA, 19 nt, Leptospira interrogans serovar lai str. 56601
caauaauuuuaauauuucg

SEQ ID NO: 768890 - RNA, 17 nt, Leptospira interrogans serovar lai str. 56601
aaaauaguauccaaaau

SEQ ID NO: 768891 - RNA, 16 nt, Leptospira interrogans serovar lai str. 56601
aaaauaggaauucgaa

SEQ ID NO: 768892 - RNA, 21 nt, Leptospira interrogans serovar lai str. 56601
aaaauaggaguuccuacauuu

SEQ ID NO: 768893 - RNA, 17 nt, Leptospira interrogans serovar lai str. 56601
aaaauagggaaaacuca

SEQ ID NO: 768894 - RNA, 18 nt, Leptospira interrogans serovar lai str. 56601
aaaauagggaaaacucaa

SEQ ID NO: 768895 - RNA, 20 nt, Leptospira interrogans serovar lai str. 56601
aaaauagggaaaacucaaca

SEQ ID NO: 768896 - RNA, 13 nt, Leptospira interrogans serovar lai str. 56601
cacgcuaaaauaa

SEQ ID NO: 768897 - RNA, 20 nt, Leptospira interrogans serovar lai str. 56601
cacgauuuuacgaacaaauu

SEQ ID NO: 768898 - RNA, 22 nt, Leptospira interrogans serovar lai str. 56601
cacgauuuuacgaacacauucu

SEQ ID NO: 768899 - RNA, 22 nt, Leptospira interrogans serovar lai str. 56601
cacgauugauuuuggaaagaau

SEQ ID NO: 768900 - RNA, 17 nt, Leptospira interrogans serovar lai str. 56601
aaaauagccuucaauua

SEQ ID NO: 768901 - RNA, 19 nt, Leptospira interrogans serovar lai str. 56601
aaaauagcgauacuuaaaa

SEQ ID NO: 768902 - RNA, 18 nt, Leptospira interrogans serovar lai str. 56601
aaaauagauagagaauua

SEQ ID NO: 768903 - RNA, 19 nt, Leptospira interrogans serovar lai str. 56601
aaaauagaauuguugaaaa

SEQ ID NO: 768904 - RNA, 22 nt, Leptospira interrogans serovar lai str. 56601
aaaauagaauuguugaaaaauu

SEQ ID NO: 768905 - RNA, 12 nt, Leptospira interrogans serovar lai str. 56601
aaaauagaauuu

SEQ ID NO: 768906 - RNA, 16 nt, Leptospira interrogans serovar lai str. 56601
aaaauagaauaaauua

SEQ ID NO: 768907 - RNA, 14 nt, Leptospira interrogans serovar lai str. 56601
aaaauagaaacaaa

SEQ ID NO: 768908 - RNA, 15 nt, Leptospira interrogans serovar lai str. 56601
aaaauagaaacagau

SEQ ID NO: 768909 - RNA, 14 nt, Leptospira interrogans serovar lai str. 56601
cacgaaaaaugaau

SEQ ID NO: 768910 - RNA, 18 nt, Leptospira interrogans serovar lai str. 56601
cacgaaaauuaaaaaauc

SEQ ID NO: 768911 - RNA, 21 nt, Leptospira interrogans serovar lai str. 56601
aaaauacuucucuaaagaucg

SEQ ID NO: 768912 - RNA, 15 nt, Leptospira interrogans serovar lai str. 56601
aaaauacuuuuagaa

SEQ ID NO: 768913 - RNA, 18 nt, Leptospira interrogans serovar lai str. 56601
aaaauacuuuuagaaaau

SEQ ID NO: 768914 - RNA, 19 nt, Leptospira interrogans serovar lai str. 56601
aaaauacaguacuauauuu

SEQ ID NO: 768915 - RNA, 16 nt, Leptospira interrogans serovar lai str. 56601
aaaauacaaaguuugu

SEQ ID NO: 768916 - RNA, 16 nt, Leptospira interrogans serovar lai str. 56601
aaaauacauaaaaaaa

SEQ ID NO: 768917 - RNA, 15 nt, Leptospira interrogans serovar lai str. 56601
caccugguuuuuugu

SEQ ID NO: 768918 - RNA, 18 nt, Leptospira interrogans serovar lai str. 56601
aaaauacgcuucucuugc

SEQ ID NO: 768919 - RNA, 23 nt, Leptospira interrogans serovar lai str. 56601
aaaauacggcacucaauuuuaua

SEQ ID NO: 768920 - RNA, 14 nt, Leptospira interrogans serovar lai str. 56601
aaaauacuaaauua

SEQ ID NO: 768921 - RNA, 15 nt, Leptospira interrogans serovar lai str. 56601
aaaauaccauaaauu

SEQ ID NO: 768922 - RNA, 21 nt, Leptospira interrogans serovar lai str. 56601
aaaauacauaggaaccugauu

SEQ ID NO: 768923 - RNA, 13 nt, Leptospira interrogans serovar lai str. 56601
aaaauaaagaaac

SEQ ID NO: 768924 - RNA, 15 nt, Leptospira interrogans serovar lai str. 56601
aaaauaaauuuauaa

SEQ ID NO: 768925 - RNA, 12 nt, Leptospira interrogans serovar lai str. 56601
aaaauaaaucau

SEQ ID NO: 768926 - RNA, 17 nt, Leptospira interrogans serovar lai str. 56601
caccggcuacaggugga

SEQ ID NO: 768927 - RNA, 17 nt, Leptospira interrogans serovar lai str. 56601
caccuaaaaugaaaaaa

SEQ ID NO: 768928 - RNA, 13 nt, Leptospira interrogans serovar lai str. 56601
aaaaguuagaaua

SEQ ID NO: 768929 - RNA, 13 nt, Leptospira interrogans serovar lai str. 56601
aaaaguguuuuug

SEQ ID NO: 768930 - RNA, 14 nt, Leptospira interrogans serovar lai str. 56601
aaaauaaaaaucau

SEQ ID NO: 768931 - RNA, 14 nt, Leptospira interrogans serovar lai str. 56601
aaaauaaaaaauuu

SEQ ID NO: 768932 - RNA, 17 nt, Leptospira interrogans serovar lai str. 56601
cacauucauuuuuucua

SEQ ID NO: 768933 - RNA, 17 nt, Leptospira interrogans serovar lai str. 56601
cacauuugaauacgaca

SEQ ID NO: 768934 - RNA, 13 nt, Leptospira interrogans serovar lai str. 56601
cacauuuuaaagg

SEQ ID NO: 768935 - RNA, 13 nt, Leptospira interrogans serovar lai str. 56601
cacauuuuaggaa

SEQ ID NO: 768936 - RNA, 13 nt, Leptospira interrogans serovar lai str. 56601
cacauuuucaaaa

SEQ ID NO: 768937 - RNA, 14 nt, Leptospira interrogans serovar lai str. 56601
cacauuuuucaaau

SEQ ID NO: 768938 - RNA, 18 nt, Leptospira interrogans serovar lai str. 56601
cacauuuuucaaauuugg

SEQ ID NO: 768939 - RNA, 14 nt, Leptospira interrogans serovar lai str. 56601
cacauuuuucaagu

SEQ ID NO: 768940 - RNA, 21 nt, Leptospira interrogans serovar lai str. 56601
cacauuuuugugaaacuuaau

SEQ ID NO: 768941 - RNA, 18 nt, Leptospira interrogans serovar lai str. 56601
cacauuaaaauaggauuu

SEQ ID NO: 768942 - RNA, 21 nt, Leptospira interrogans serovar lai str. 56601
cacauuaaaauaggauuuaaa

SEQ ID NO: 768943 - RNA, 22 nt, Leptospira interrogans serovar lai str. 56601
cacauuaaaauaggauuuaaau

SEQ ID NO: 768944 - RNA, 19 nt, Leptospira interrogans serovar lai str. 56601
cacaucgaaaaaacaaaua

SEQ ID NO: 768945 - RNA, 13 nt, Leptospira interrogans serovar lai str. 56601
cacauccaaccca

SEQ ID NO: 768946 - RNA, 19 nt, Leptospira interrogans serovar lai str. 56601
cacauccaacccaaacaca

SEQ ID NO: 768947 - RNA, 13 nt, Leptospira interrogans serovar lai str. 56601
caauuucuuuaau

SEQ ID NO: 768948 - RNA, 15 nt, Leptospira interrogans serovar lai str. 56601
cacaacauuaugaau

SEQ ID NO: 768949 - RNA, 14 nt, Leptospira interrogans serovar lai str. 56601
cacaacgcgaccca

SEQ ID NO: 768950 - RNA, 20 nt, Leptospira interrogans serovar lai str. 56601
cacaacggcucucuccuaug

SEQ ID NO: 768951 - RNA, 22 nt, Leptospira interrogans serovar lai str. 56601
cacaacggcucucuccuauguu

SEQ ID NO: 768952 - RNA, 19 nt, Leptospira interrogans serovar lai str. 56601
cacaaguugaauaggauuu

SEQ ID NO: 768953 - RNA, 20 nt, Leptospira interrogans serovar lai str. 56601
cacaaguucgccuacacugu

SEQ ID NO: 768954 - RNA, 20 nt, Leptospira interrogans serovar lai str. 56601
cacaaguuuggaaauugacu

SEQ ID NO: 768955 - RNA, 18 nt, Leptospira interrogans serovar lai str. 56601
cacaaguauuugaucuca

SEQ ID NO: 768956 - RNA, 14 nt, Leptospira interrogans serovar lai str. 56601
cacaagcuuccuuu

SEQ ID NO: 768957 - RNA, 15 nt, Leptospira interrogans serovar lai str. 56601
cacaagcuuccuuuu

SEQ ID NO: 768958 - RNA, 17 nt, Leptospira interrogans serovar lai str. 56601
cacacguugaauaagau

SEQ ID NO: 768959 - RNA, 22 nt, Leptospira interrogans serovar lai str. 56601
cacacguugaauaagauuuuag

SEQ ID NO: 768960 - RNA, 21 nt, Leptospira interrogans serovar lai str. 56601
cacacuuugcaccgcauugau

SEQ ID NO: 768961 - RNA, 20 nt, Leptospira interrogans serovar lai str. 56601
caaugguucacucaaaauac

SEQ ID NO: 768962 - RNA, 20 nt, Leptospira interrogans serovar lai str. 56601
caaugcuuuccaaaaggaaa

SEQ ID NO: 768963 - RNA, 21 nt, Leptospira interrogans serovar lai str. 56601
caaugcuuuccaaaaggaaag

SEQ ID NO: 768964 - RNA, 18 nt, Leptospira interrogans serovar lai str. 56601
caaugaauuuuuauaaaa

SEQ ID NO: 768965 - RNA, 21 nt, Leptospira interrogans serovar lai str. 56601
caaugaauuuuuauaaaaaua

SEQ ID NO: 768966 - RNA, 17 nt, Leptospira interrogans serovar lai str. 56601
caaucuguuuagaauau

SEQ ID NO: 768967 - RNA, 13 nt, Leptospira interrogans serovar lai str. 56601
caaucuucaaauu

SEQ ID NO: 768968 - RNA, 22 nt, Leptospira interrogans serovar lai str. 56601
caaucuuagaaugugggaacua

SEQ ID NO: 768969 - RNA, 19 nt, Leptospira interrogans serovar lai str. 56601
caauuuaucuaaaacacau

SEQ ID NO: 768970 - RNA, 14 nt, Leptospira interrogans serovar lai str. 56601
caauuucuucuuuu

SEQ ID NO: 768971 - RNA, 22 nt, Leptospira interrogans serovar lai str. 56601
caauuucuucuuuuguuuuuau

SEQ ID NO: 768972 - RNA, 18 nt, Leptospira interrogans serovar lai str. 56601
caauuuauugaccagagc

SEQ ID NO: 768973 - RNA, 13 nt, Leptospira interrogans serovar lai str. 56601
caauuucagaaac

SEQ ID NO: 768974 - RNA, 22 nt, Leptospira interrogans serovar lai str. 56601
caauuucagaaacauuggaacu

SEQ ID NO: 768975 - RNA, 13 nt, Leptospira interrogans serovar lai str. 56601
caauucuuccuuu

SEQ ID NO: 768976 - RNA, 14 nt, Leptospira interrogans serovar lai str. 56601
caauucuaauuuuu

SEQ ID NO: 768977 - RNA, 22 nt, Leptospira interrogans serovar lai str. 56601
caauucuauugugggaacuacu

SEQ ID NO: 768978 - RNA, 18 nt, Leptospira interrogans serovar lai str. 56601
caauucugaaaauguaaa

SEQ ID NO: 768979 - RNA, 21 nt, Leptospira interrogans serovar lai str. 56601
caauuccacuaugaaaguuuu

SEQ ID NO: 768980 - RNA, 15 nt, Leptospira interrogans serovar lai str. 56601
caauuccauuucugu

SEQ ID NO: 768981 - RNA, 20 nt, Leptospira interrogans serovar lai str. 56601
caaugugccuucguuuaaaa

SEQ ID NO: 768982 - RNA, 14 nt, Leptospira interrogans serovar lai str. 56601
caauguuauaaaau

SEQ ID NO: 768983 - RNA, 22 nt, Leptospira interrogans serovar lai str. 56601
auuuugucuccugucaauuuuc

SEQ ID NO: 768984 - RNA, 23 nt, Leptospira interrogans serovar lai str. 56601
auuuugugaaacuuaaaucucac

SEQ ID NO: 768985 - RNA, 22 nt, Leptospira interrogans serovar lai str. 56601
auuuugggacaagcuuuaaauu

SEQ ID NO: 768986 - RNA, 14 nt, Leptospira interrogans serovar lai str. 56601
auuuugggauuuua

SEQ ID NO: 768987 - RNA, 15 nt, Leptospira interrogans serovar lai str. 56601
auuuugggauuuuau

SEQ ID NO: 768988 - RNA, 22 nt, Leptospira interrogans serovar lai str. 56601
auuuugggcgugccucucgcca

SEQ ID NO: 768989 - RNA, 15 nt, Leptospira interrogans serovar lai str. 56601
auuuuggaaagaaua

SEQ ID NO: 768990 - RNA, 21 nt, Leptospira interrogans serovar lai str. 56601
auuuuggauagcaaaaaaauc

SEQ ID NO: 768991 - RNA, 15 nt, Leptospira interrogans serovar lai str. 56601
auuuucuaaaaguag

SEQ ID NO: 768992 - RNA, 16 nt, Leptospira interrogans serovar lai str. 56601
auuuucuauuuuaaua

SEQ ID NO: 768993 - RNA, 14 nt, Leptospira interrogans serovar lai str. 56601
auuuuccuuuaaau

SEQ ID NO: 768994 - RNA, 14 nt, Leptospira interrogans serovar lai str. 56601
auuuucauucuaaa

SEQ ID NO: 768995 - RNA, 18 nt, Leptospira interrogans serovar lai str. 56601
auuuucauucuaaagaag

SEQ ID NO: 768996 - RNA, 15 nt, Leptospira interrogans serovar lai str. 56601
auuuuccuuuuuccg

SEQ ID NO: 768997 - RNA, 16 nt, Leptospira interrogans serovar lai str. 56601
auuuuuccauaaaaaa

SEQ ID NO: 768998 - RNA, 23 nt, Leptospira interrogans serovar lai str. 56601
auuuuucaacaacucuaaugaau

SEQ ID NO: 768999 - RNA, 14 nt, Leptospira interrogans serovar lai str. 56601
auuuuucaauaauu

SEQ ID NO: 769000 - RNA, 22 nt, Leptospira interrogans serovar lai str. 56601
auuuuucaauaauucuauuuua

SEQ ID NO: 769001 - RNA, 23 nt, Leptospira interrogans serovar lai str. 56601
auuuuucaagagugguuuucaaa

SEQ ID NO: 769002 - RNA, 15 nt, Leptospira interrogans serovar lai str. 56601
auuuuuaaucaaaug

SEQ ID NO: 769003 - RNA, 13 nt, Leptospira interrogans serovar lai str. 56601
auuuuuaagaaua

SEQ ID NO: 769004 - RNA, 15 nt, Leptospira interrogans serovar lai str. 56601
auuuuuaagauuaca

SEQ ID NO: 769005 - RNA, 22 nt, Leptospira interrogans serovar lai str. 56601
auuuuuaaacauuuauuuuucg

SEQ ID NO: 769006 - RNA, 21 nt, Leptospira interrogans serovar lai str. 56601
auuuuuaaaaaauuaauucuc

SEQ ID NO: 769007 - RNA, 22 nt, Leptospira interrogans serovar lai str. 56601
auuuuuaaaaauauaguuccua

SEQ ID NO: 769008 - RNA, 16 nt, Leptospira interrogans serovar lai str. 56601
auuuuuaaaaauuaga

SEQ ID NO: 769009 - RNA, 19 nt, Leptospira interrogans serovar lai str. 56601
auuuuuaaaaguagaauca

SEQ ID NO: 769010 - RNA, 15 nt, Leptospira interrogans serovar lai str. 56601
auuuuguuucuaaaa

SEQ ID NO: 769011 - RNA, 12 nt, Leptospira interrogans serovar lai str. 56601
auuuuguuugaa

SEQ ID NO: 769012 - RNA, 19 nt, Leptospira interrogans serovar lai str. 56601
auuuuguugcguuuaaaaa

SEQ ID NO: 769013 - RNA, 15 nt, Leptospira interrogans serovar lai str. 56601
auuuuugaauuuuuu

SEQ ID NO: 769014 - RNA, 22 nt, Leptospira interrogans serovar lai str. 56601
auuuuugacuaccuuuauuccu

SEQ ID NO: 769015 - RNA, 12 nt, Leptospira interrogans serovar lai str. 56601
auuuuucuuugc

SEQ ID NO: 769016 - RNA, 15 nt, Leptospira interrogans serovar lai str. 56601
auuuuuuagaaacua

SEQ ID NO: 769017 - RNA, 19 nt, Leptospira interrogans serovar lai str. 56601
auuuuuuagaucuaaauuu

SEQ ID NO: 769018 - RNA, 20 nt, Leptospira interrogans serovar lai str. 56601
auuuuugaaucuauuuuuga

SEQ ID NO: 769019 - RNA, 14 nt, Leptospira interrogans serovar lai str. 56601
auuuuugauuuuag

SEQ ID NO: 769020 - RNA, 19 nt, Leptospira interrogans serovar lai str. 56601
auuuuucgaaacaaaauca

SEQ ID NO: 769021 - RNA, 16 nt, Leptospira interrogans serovar lai str. 56601
auuuuucgaacgugaa

SEQ ID NO: 769022 - RNA, 19 nt, Leptospira interrogans serovar lai str. 56601
auuuuuccguaaaaaguua

SEQ ID NO: 769023 - RNA, 22 nt, Leptospira interrogans serovar lai str. 56601
auuuuuccguaaauaucaaaug

SEQ ID NO: 769024 - RNA, 18 nt, Leptospira interrogans serovar lai str. 56601
auuuuucugaaaaaguug

SEQ ID NO: 769025 - RNA, 20 nt, Leptospira interrogans serovar lai str. 56601
auuuuucugaaaaaguugga

SEQ ID NO: 769026 - RNA, 12 nt, Leptospira interrogans serovar lai str. 56601
auuuuucuucuu

SEQ ID NO: 769027 - RNA, 20 nt, Leptospira interrogans serovar lai str. 56601
auuuuucuucuucaugauuu

SEQ ID NO: 769028 - RNA, 14 nt, Leptospira interrogans serovar lai str. 56601
auuuuucuucuuug

SEQ ID NO: 769029 - RNA, 19 nt, Leptospira interrogans serovar lai str. 56601
auuuuucguucuaagaauc

SEQ ID NO: 769030 - RNA, 14 nt, Leptospira interrogans serovar lai str. 56601
auuuuucuaaaaaa

SEQ ID NO: 769031 - RNA, 22 nt, Leptospira interrogans serovar lai str. 56601
auuuuucuaaaaaaaauguaau

SEQ ID NO: 769032 - RNA, 18 nt, Leptospira interrogans serovar lai str. 56601
auuuuucuacaauuauau

SEQ ID NO: 769033 - RNA, 19 nt, Leptospira interrogans serovar lai str. 56601
caaaaaaguccaaaacaaa

SEQ ID NO: 769034 - RNA, 10 nt, Leptospira interrogans serovar lai str. 56601
caaaaaaaua

SEQ ID NO: 769035 - RNA, 12 nt, Leptospira interrogans serovar lai str. 56601
caaaaaaauaaa

SEQ ID NO: 769036 - RNA, 23 nt, Leptospira interrogans serovar lai str. 56601
caaaaaaauaaaauguaaaaacu

SEQ ID NO: 769037 - RNA, 19 nt, Leptospira interrogans serovar lai str. 56601
caaaaaaauaaaucaugau

SEQ ID NO: 769038 - RNA, 20 nt, Leptospira interrogans serovar lai str. 56601
caaaaaaaucaggcuuuaua

SEQ ID NO: 769039 - RNA, 18 nt, Leptospira interrogans serovar lai str. 56601
caaaaaaauucuccucuu

SEQ ID NO: 769040 - RNA, 20 nt, Leptospira interrogans serovar lai str. 56601
caaaaaauuauaucuuauuu

SEQ ID NO: 769041 - RNA, 20 nt, Leptospira interrogans serovar lai str. 56601
caaaaaaugcucaaaaauua

SEQ ID NO: 769042 - RNA, 11 nt, Leptospira interrogans serovar lai str. 56601
caaaaaauggu

SEQ ID NO: 769043 - RNA, 23 nt, Leptospira interrogans serovar lai str. 56601
auuuuuuuugagaaaagagauuu

SEQ ID NO: 769044 - RNA, 11 nt, Leptospira interrogans serovar lai str. 56601
caaaaaaaaua

SEQ ID NO: 769045 - RNA, 11 nt, Leptospira interrogans serovar lai str. 56601
caaaaaaaauu

SEQ ID NO: 769046 - RNA, 13 nt, Leptospira interrogans serovar lai str. 56601
caaaaaaaauucg

SEQ ID NO: 769047 - RNA, 14 nt, Leptospira interrogans serovar lai str. 56601
caaaaaaaauucgu

SEQ ID NO: 769048 - RNA, 18 nt, Leptospira interrogans serovar lai str. 56601
auuuuuuauguugaguuu

SEQ ID NO: 769049 - RNA, 19 nt, Leptospira interrogans serovar lai str. 56601
auuuuuuccugauuuucau

SEQ ID NO: 769050 - RNA, 15 nt, Leptospira interrogans serovar lai str. 56601
auuuuuuuuacauaa

SEQ ID NO: 769051 - RNA, 13 nt, Leptospira interrogans serovar lai str. 56601
auuuuuuccaaaa

SEQ ID NO: 769052 - RNA, 17 nt, Leptospira interrogans serovar lai str. 56601
auuuuuuccaaaaagaa

SEQ ID NO: 769053 - RNA, 20 nt, Leptospira interrogans serovar lai str. 56601
auuuuuucaaaaacucuauu

SEQ ID NO: 769054 - RNA, 12 nt, Leptospira interrogans serovar lai str. 56601
auuuuuuauuaa

SEQ ID NO: 769055 - RNA, 18 nt, Leptospira interrogans serovar lai str. 56601
auuuuuuauuaagaacuu

SEQ ID NO: 769056 - RNA, 18 nt, Leptospira interrogans serovar lai str. 56601
auuuuuucacaaaaccac

SEQ ID NO: 769057 - RNA, 13 nt, Leptospira interrogans serovar lai str. 56601
auuuucaaguaaa

SEQ ID NO: 769058 - RNA, 13 nt, Leptospira interrogans serovar lai str. 56601
auuuuauuuuucu

SEQ ID NO: 769059 - RNA, 13 nt, Leptospira interrogans serovar lai str. 56601
auuuuauuuuugg

SEQ ID NO: 769060 - RNA, 12 nt, Leptospira interrogans serovar lai str. 56601
auuuuauuucua

SEQ ID NO: 769061 - RNA, 13 nt, Leptospira interrogans serovar lai str. 56601
auuuucaaaaaau

SEQ ID NO: 769062 - RNA, 23 nt, Leptospira interrogans serovar lai str. 56601
auuuucaaaaaauaaaauuuuau

SEQ ID NO: 769063 - RNA, 16 nt, Leptospira interrogans serovar lai str. 56601
auuuucaaaaaauauc

SEQ ID NO: 769064 - RNA, 19 nt, Leptospira interrogans serovar lai str. 56601
auuuuauuuuuuaugaaaa

SEQ ID NO: 769065 - RNA, 11 nt, Leptospira interrogans serovar lai str. 56601
auuuucaaaaa

SEQ ID NO: 769066 - RNA, 20 nt, Leptospira interrogans serovar lai str. 56601
auuuucauaauaaauuuuuc

SEQ ID NO: 769067 - RNA, 13 nt, Leptospira interrogans serovar lai str. 56601
auuuucauauaua

SEQ ID NO: 769068 - RNA, 14 nt, Leptospira interrogans serovar lai str. 56601
auuuucauagaaaa

SEQ ID NO: 769069 - RNA, 21 nt, Leptospira interrogans serovar lai str. 56601
auuuucauagaaaaaauacau

SEQ ID NO: 769070 - RNA, 20 nt, Leptospira interrogans serovar lai str. 56601
auuuucauaggaaauucuuu

SEQ ID NO: 769071 - RNA, 18 nt, Leptospira interrogans serovar lai str. 56601
auuuucaucuuuuccauu

SEQ ID NO: 769072 - RNA, 21 nt, Leptospira interrogans serovar lai str. 56601
auuuucaugaacgaauuuuuc

SEQ ID NO: 769073 - RNA, 20 nt, Leptospira interrogans serovar lai str. 56601
auuuucaugaauuaaagaag

SEQ ID NO: 769074 - RNA, 17 nt, Leptospira interrogans serovar lai str. 56601
auuuuauaaauuauuuu

SEQ ID NO: 769075 - RNA, 14 nt, Leptospira interrogans serovar lai str. 56601
auuuuauaaaaauc

SEQ ID NO: 769076 - RNA, 18 nt, Leptospira interrogans serovar lai str. 56601
auuuuauaaaaaucuagg

SEQ ID NO: 769077 - RNA, 16 nt, Leptospira interrogans serovar lai str. 56601
auuuuauaauucugaa

SEQ ID NO: 769078 - RNA, 20 nt, Leptospira interrogans serovar lai str. 56601
auuuuauaaucgaauuucca

SEQ ID NO: 769079 - RNA, 14 nt, Leptospira interrogans serovar lai str. 56601
auuuuauagaaaua

SEQ ID NO: 769080 - RNA, 19 nt, Leptospira interrogans serovar lai str. 56601
auuuuaucgaauaagaaau

SEQ ID NO: 769081 - RNA, 13 nt, Leptospira interrogans serovar lai str. 56601
auuuuagaauuua

SEQ ID NO: 769082 - RNA, 14 nt, Leptospira interrogans serovar lai str. 56601
auuuuagaauuuau

SEQ ID NO: 769083 - RNA, 23 nt, Leptospira interrogans serovar lai str. 56601
auuuuagaauuuguucuuaaaau

SEQ ID NO: 769084 - RNA, 15 nt, Leptospira interrogans serovar lai str. 56601
auuuuagagaaacuu

SEQ ID NO: 769085 - RNA, 20 nt, Leptospira interrogans serovar lai str. 56601
auuuuagagaaacuuuaaau

SEQ ID NO: 769086 - RNA, 23 nt, Leptospira interrogans serovar lai str. 56601
auuuuagagaaacuuuaaauacu

SEQ ID NO: 769087 - RNA, 16 nt, Leptospira interrogans serovar lai str. 56601
auuuuagaaaucgauu

SEQ ID NO: 769088 - RNA, 14 nt, Leptospira interrogans serovar lai str. 56601
auuuuagaauaucu

SEQ ID NO: 769089 - RNA, 17 nt, Leptospira interrogans serovar lai str. 56601
auuuuagaaucaaaaug

SEQ ID NO: 769090 - RNA, 18 nt, Leptospira interrogans serovar lai str. 56601
auuuuagaaucaaaauga

SEQ ID NO: 769091 - RNA, 17 nt, Leptospira interrogans serovar lai str. 56601
auuuuagaaucagaaug

SEQ ID NO: 769092 - RNA, 21 nt, Leptospira interrogans serovar lai str. 56601
auuuuagaaucagaaugaacu

SEQ ID NO: 769093 - RNA, 22 nt, Leptospira interrogans serovar lai str. 56601
auuuuagauaaggcuaaagaau

SEQ ID NO: 769094 - RNA, 18 nt, Leptospira interrogans serovar lai str. 56601
auuuuaguuuauuuuaaa

SEQ ID NO: 769095 - RNA, 17 nt, Leptospira interrogans serovar lai str. 56601
auuuuagggaucaaucu

SEQ ID NO: 769096 - RNA, 21 nt, Leptospira interrogans serovar lai str. 56601
auuuuagggaucgaucuguaa

SEQ ID NO: 769097 - RNA, 23 nt, Leptospira interrogans serovar lai str. 56601
auuuuagggccgucuauaaaauu

SEQ ID NO: 769098 - RNA, 13 nt, Leptospira interrogans serovar lai str. 56601
auuuuaggaauca

SEQ ID NO: 769099 - RNA, 18 nt, Leptospira interrogans serovar lai str. 56601
auuugaucucaauauaaa

SEQ ID NO: 769100 - RNA, 19 nt, Leptospira interrogans serovar lai str. 56601
auuugauauauuuuuaaag

SEQ ID NO: 769101 - RNA, 19 nt, Leptospira interrogans serovar lai str. 56601
auuuguuuaggaauuuuuu

SEQ ID NO: 769102 - RNA, 20 nt, Leptospira interrogans serovar lai str. 56601
auuuguuuaggaauuuuuua

SEQ ID NO: 769103 - RNA, 14 nt, Leptospira interrogans serovar lai str. 56601
auuuguuuguaaaa

SEQ ID NO: 769104 - RNA, 22 nt, Leptospira interrogans serovar lai str. 56601
auuuguuuguuauaagaauuuu

SEQ ID NO: 769105 - RNA, 19 nt, Leptospira interrogans serovar lai str. 56601
auuuguuucuauuuuaugg

SEQ ID NO: 769106 - RNA, 21 nt, Leptospira interrogans serovar lai str. 56601
auuuguuuuuaaaauugugau

SEQ ID NO: 769107 - RNA, 13 nt, Leptospira interrogans serovar lai str. 56601
auuuguuuuauaa

SEQ ID NO: 769108 - RNA, 16 nt, Leptospira interrogans serovar lai str. 56601
auuuguuuuauaaaac

SEQ ID NO: 769109 - RNA, 18 nt, Leptospira interrogans serovar lai str. 56601
auuuuaaaaaaauuuuua

SEQ ID NO: 769110 - RNA, 14 nt, Leptospira interrogans serovar lai str. 56601
auuuuaaaaauuca

SEQ ID NO: 769111 - RNA, 22 nt, Leptospira interrogans serovar lai str. 56601
auuuuaaaaggcucucuuuuga

SEQ ID NO: 769112 - RNA, 13 nt, Leptospira interrogans serovar lai str. 56601
auuuuaacgugag

SEQ ID NO: 769113 - RNA, 22 nt, Leptospira interrogans serovar lai str. 56601
auuuuaacaaucguacgaauca

SEQ ID NO: 769114 - RNA, 18 nt, Leptospira interrogans serovar lai str. 56601
auuuuaacuuuuuuuaaa

SEQ ID NO: 769115 - RNA, 22 nt, Leptospira interrogans serovar lai str. 56601
auuuuaagaucuauuccuaaaa

SEQ ID NO: 769116 - RNA, 13 nt, Leptospira interrogans serovar lai str. 56601
auuuuaaaaauuu

SEQ ID NO: 769117 - RNA, 20 nt, Leptospira interrogans serovar lai str. 56601
auuuuacacgaucauucuuu

SEQ ID NO: 769118 - RNA, 23 nt, Leptospira interrogans serovar lai str. 56601
auuuuacagacguauuuuuaaau

SEQ ID NO: 769119 - RNA, 20 nt, Leptospira interrogans serovar lai str. 56601
auuuuacagagauauagaaa

SEQ ID NO: 769120 - RNA, 17 nt, Leptospira interrogans serovar lai str. 56601
auuuuacagagaucauu

SEQ ID NO: 769121 - RNA, 19 nt, Leptospira interrogans serovar lai str. 56601
auuuuacagauugauucuu

SEQ ID NO: 769122 - RNA, 14 nt, Leptospira interrogans serovar lai str. 56601
auuuuaauggaaau

SEQ ID NO: 769123 - RNA, 22 nt, Leptospira interrogans serovar lai str. 56601
auuuuaauauuauuaaauuuuu

SEQ ID NO: 769124 - RNA, 20 nt, Leptospira interrogans serovar lai str. 56601
auuuuaagaacaauuuaaaa

SEQ ID NO: 769125 - RNA, 22 nt, Leptospira interrogans serovar lai str. 56601
auuuuaagaacaauuuaaaaua

SEQ ID NO: 769126 - RNA, 20 nt, Leptospira interrogans serovar lai str. 56601
auuuuaagcucgaauaaaaa

SEQ ID NO: 769127 - RNA, 13 nt, Leptospira interrogans serovar lai str. 56601
auuuuaaucuucu

SEQ ID NO: 769128 - RNA, 21 nt, Leptospira interrogans serovar lai str. 56601
auuuuacgaaccaauucuaaa

SEQ ID NO: 769129 - RNA, 20 nt, Leptospira interrogans serovar lai str. 56601
auuuuacgaaucuaauuuau

SEQ ID NO: 769130 - RNA, 21 nt, Leptospira interrogans serovar lai str. 56601
auuuuacguuauaauucuuua

SEQ ID NO: 769131 - RNA, 22 nt, Leptospira interrogans serovar lai str. 56601
auuuuacgauuaaauuuugaaa

SEQ ID NO: 769132 - RNA, 12 nt, Leptospira interrogans serovar lai str. 56601
auuuuacgcaau

SEQ ID NO: 769133 - RNA, 22 nt, Leptospira interrogans serovar lai str. 56601
auuuuacgcaggcuuguuugaa

SEQ ID NO: 769134 - RNA, 22 nt, Leptospira interrogans serovar lai str. 56601
auuuuacgcuuaaauagagcuu

SEQ ID NO: 769135 - RNA, 20 nt, Leptospira interrogans serovar lai str. 56601
auuuuacccugguuucaaaa

SEQ ID NO: 769136 - RNA, 21 nt, Leptospira interrogans serovar lai str. 56601
auuuuacccugguuucaaaaa

SEQ ID NO: 769137 - RNA, 18 nt, Leptospira interrogans serovar lai str. 56601
auuucagcgcauuuagaa

SEQ ID NO: 769138 - RNA, 21 nt, Leptospira interrogans serovar lai str. 56601
auuucagcuccaaaaaaauaa

SEQ ID NO: 769139 - RNA, 22 nt, Leptospira interrogans serovar lai str. 56601
auuucagcuccaaaaaaauaaa

SEQ ID NO: 769140 - RNA, 19 nt, Leptospira interrogans serovar lai str. 56601
auuuccauuaauuacagaa

SEQ ID NO: 769141 - RNA, 19 nt, Leptospira interrogans serovar lai str. 56601
auuucggauucuuccccac

SEQ ID NO: 769142 - RNA, 18 nt, Leptospira interrogans serovar lai str. 56601
auuuccgucguuugcauc

SEQ ID NO: 769143 - RNA, 15 nt, Leptospira interrogans serovar lai str. 56601
auuuccggaaaacga

SEQ ID NO: 769144 - RNA, 21 nt, Leptospira interrogans serovar lai str. 56601
auuuccggaaaacgaauauca

SEQ ID NO: 769145 - RNA, 17 nt, Leptospira interrogans serovar lai str. 56601
auuucccauaaaaagag

SEQ ID NO: 769146 - RNA, 21 nt, Leptospira interrogans serovar lai str. 56601
auuucccauaaaaagagccau

SEQ ID NO: 769147 - RNA, 23 nt, Leptospira interrogans serovar lai str. 56601
auuuccaucuuuauaucuugaac

SEQ ID NO: 769148 - RNA, 13 nt, Leptospira interrogans serovar lai str. 56601
auuucccaaaauu

SEQ ID NO: 769149 - RNA, 14 nt, Leptospira interrogans serovar lai str. 56601
auuucccaaaauuu

SEQ ID NO: 769150 - RNA, 19 nt, Leptospira interrogans serovar lai str. 56601
auuucuaaaauguagcaac

SEQ ID NO: 769151 - RNA, 17 nt, Leptospira interrogans serovar lai str. 56601
auuucuaaaauucuucc

SEQ ID NO: 769152 - RNA, 18 nt, Leptospira interrogans serovar lai str. 56601
auuucuaaaauucuuccg

SEQ ID NO: 769153 - RNA, 17 nt, Leptospira interrogans serovar lai str. 56601
auuucuaaacaauuuua

SEQ ID NO: 769154 - RNA, 17 nt, Leptospira interrogans serovar lai str. 56601
auuucuaaagaauuauc

SEQ ID NO: 769155 - RNA, 15 nt, Leptospira interrogans serovar lai str. 56601
auuucuaaauuguga

SEQ ID NO: 769156 - RNA, 11 nt, Leptospira interrogans serovar lai str. 56601
auuucuaaaag

SEQ ID NO: 769157 - RNA, 14 nt, Leptospira interrogans serovar lai str. 56601
auuucuaaaagaag

SEQ ID NO: 769158 - RNA, 16 nt, Leptospira interrogans serovar lai str. 56601
auuucguuucguacau

SEQ ID NO: 769159 - RNA, 10 nt, Leptospira interrogans serovar lai str. 56601
auuucuaaaa

SEQ ID NO: 769160 - RNA, 21 nt, Leptospira interrogans serovar lai str. 56601
auuucguaaaauccaugauuu

SEQ ID NO: 769161 - RNA, 19 nt, Leptospira interrogans serovar lai str. 56601
auuucguucggaaaaagua

SEQ ID NO: 769162 - RNA, 22 nt, Leptospira interrogans serovar lai str. 56601
auuucguucggaaaaaguauaa

SEQ ID NO: 769163 - RNA, 12 nt, Leptospira interrogans serovar lai str. 56601
auuucugcugcu

SEQ ID NO: 769164 - RNA, 18 nt, Leptospira interrogans serovar lai str. 56601
auuucuguaaaaaauaaa

SEQ ID NO: 769165 - RNA, 19 nt, Leptospira interrogans serovar lai str. 56601
auuucugcuucuaagugga

SEQ ID NO: 769166 - RNA, 19 nt, Leptospira interrogans serovar lai str. 56601
auuucugcaaaaaccguuc

SEQ ID NO: 769167 - RNA, 21 nt, Leptospira interrogans serovar lai str. 56601
auuucuugagggguuuuuccu

SEQ ID NO: 769168 - RNA, 22 nt, Leptospira interrogans serovar lai str. 56601
auuucuugagggguuuuuccuu

SEQ ID NO: 769169 - RNA, 13 nt, Leptospira interrogans serovar lai str. 56601
auuucuuuuugaa

SEQ ID NO: 769170 - RNA, 12 nt, Leptospira interrogans serovar lai str. 56601
auuucuuuuuau

SEQ ID NO: 769171 - RNA, 21 nt, Leptospira interrogans serovar lai str. 56601
auuucuuuuuuguuuuguguc

SEQ ID NO: 769172 - RNA, 21 nt, Leptospira interrogans serovar lai str. 56601
auuugaaaauugaauuuaaaa

SEQ ID NO: 769173 - RNA, 21 nt, Leptospira interrogans serovar lai str. 56601
auuugaaaaagggauucuauu

SEQ ID NO: 769174 - RNA, 22 nt, Leptospira interrogans serovar lai str. 56601
auuugaaaaagggauucuauuc

SEQ ID NO: 769175 - RNA, 19 nt, Leptospira interrogans serovar lai str. 56601
auuugaaaagaaaccaauc

SEQ ID NO: 769176 - RNA, 15 nt, Leptospira interrogans serovar lai str. 56601
auuugaaaguaaaaa

SEQ ID NO: 769177 - RNA, 16 nt, Leptospira interrogans serovar lai str. 56601
auuugaaaguaaaaaa

SEQ ID NO: 769178 - RNA, 18 nt, Leptospira interrogans serovar lai str. 56601
auuucuucguuauuuuua

SEQ ID NO: 769179 - RNA, 13 nt, Leptospira interrogans serovar lai str. 56601
auuucugugggaa

SEQ ID NO: 769180 - RNA, 14 nt, Leptospira interrogans serovar lai str. 56601
auuucugugggaac

SEQ ID NO: 769181 - RNA, 14 nt, Leptospira interrogans serovar lai str. 56601
auuucuguuuuaua

SEQ ID NO: 769182 - RNA, 14 nt, Leptospira interrogans serovar lai str. 56601
auuucuuaaaagau

SEQ ID NO: 769183 - RNA, 23 nt, Leptospira interrogans serovar lai str. 56601
auuucuuaaaagauucuauuuug

SEQ ID NO: 769184 - RNA, 21 nt, Leptospira interrogans serovar lai str. 56601
auuuauuuuuuacgaaaaaau

SEQ ID NO: 769185 - RNA, 13 nt, Leptospira interrogans serovar lai str. 56601
auuucaaaaauaa

SEQ ID NO: 769186 - RNA, 14 nt, Leptospira interrogans serovar lai str. 56601
auuucaaaaauaaa

SEQ ID NO: 769187 - RNA, 16 nt, Leptospira interrogans serovar lai str. 56601
auuucaaaaauauauu

SEQ ID NO: 769188 - RNA, 17 nt, Leptospira interrogans serovar lai str. 56601
auuucaaaaauauauua

SEQ ID NO: 769189 - RNA, 19 nt, Leptospira interrogans serovar lai str. 56601
auuucaaaaauauauuaua

SEQ ID NO: 769190 - RNA, 23 nt, Leptospira interrogans serovar lai str. 56601
auuucaaaaauauauuauaauaa

SEQ ID NO: 769191 - RNA, 19 nt, Leptospira interrogans serovar lai str. 56601
auuucaaaaauuuucuguu

SEQ ID NO: 769192 - RNA, 14 nt, Leptospira interrogans serovar lai str. 56601
auuuauuuuaaaau

SEQ ID NO: 769193 - RNA, 13 nt, Leptospira interrogans serovar lai str. 56601
auuuauuuuaaag

SEQ ID NO: 769194 - RNA, 16 nt, Leptospira interrogans serovar lai str. 56601
auuucaaugcaaaaaa

SEQ ID NO: 769195 - RNA, 12 nt, Leptospira interrogans serovar lai str. 56601
auuucaaaauuu

SEQ ID NO: 769196 - RNA, 18 nt, Leptospira interrogans serovar lai str. 56601
auuucaaaauuuauggua

SEQ ID NO: 769197 - RNA, 15 nt, Leptospira interrogans serovar lai str. 56601
auuucaaaauuuuuu

SEQ ID NO: 769198 - RNA, 13 nt, Leptospira interrogans serovar lai str. 56601
auuucaauauaaa

SEQ ID NO: 769199 - RNA, 17 nt, Leptospira interrogans serovar lai str. 56601
auuucaauauaaaaauu

SEQ ID NO: 769200 - RNA, 12 nt, Leptospira interrogans serovar lai str. 56601
auuuauucaaaa

SEQ ID NO: 769201 - RNA, 19 nt, Leptospira interrogans serovar lai str. 56601
auuuauuaugugacuuaau

SEQ ID NO: 769202 - RNA, 14 nt, Leptospira interrogans serovar lai str. 56601
auuuauugaaaaau

SEQ ID NO: 769203 - RNA, 16 nt, Leptospira interrogans serovar lai str. 56601
auuuauugaaaaauag

SEQ ID NO: 769204 - RNA, 17 nt, Leptospira interrogans serovar lai str. 56601
aaaagucuauuucuaaa

SEQ ID NO: 769205 - RNA, 23 nt, Leptospira interrogans serovar lai str. 56601
aaaagucugucuuaaaauuugaa

SEQ ID NO: 769206 - RNA, 15 nt, Leptospira interrogans serovar lai str. 56601
aaaagucgaaagaau

SEQ ID NO: 769207 - RNA, 12 nt, Leptospira interrogans serovar lai str. 56601
aaaagugaauua

SEQ ID NO: 769208 - RNA, 21 nt, Leptospira interrogans serovar lai str. 56601
aaaagugaguuuucuuccguu

SEQ ID NO: 769209 - RNA, 19 nt, Leptospira interrogans serovar lai str. 56601
auuuauguacuuuuaagaa

SEQ ID NO: 769210 - RNA, 19 nt, Leptospira interrogans serovar lai str. 56601
auuuauaggaucguauuuu

SEQ ID NO: 769211 - RNA, 13 nt, Leptospira interrogans serovar lai str. 56601
auuuauagauaua

SEQ ID NO: 769212 - RNA, 19 nt, Leptospira interrogans serovar lai str. 56601
auuuauagauauaacuuag

SEQ ID NO: 769213 - RNA, 16 nt, Leptospira interrogans serovar lai str. 56601
auuuauaugauuuuau

SEQ ID NO: 769214 - RNA, 21 nt, Leptospira interrogans serovar lai str. 56601
auuuauacuauaacuuuaaaa

SEQ ID NO: 769215 - RNA, 22 nt, Leptospira interrogans serovar lai str. 56601
auuuauacuauaacuuuaaaaa

SEQ ID NO: 769216 - RNA, 13 nt, Leptospira interrogans serovar lai str. 56601
auuuauaauaaau

SEQ ID NO: 769217 - RNA, 14 nt, Leptospira interrogans serovar lai str. 56601
auuuauaauaaauc

SEQ ID NO: 769218 - RNA, 16 nt, Leptospira interrogans serovar lai str. 56601
auuuauaauaaaucaa

SEQ ID NO: 769219 - RNA, 22 nt, Leptospira interrogans serovar lai str. 56601
auuuauaaugaaucguaaaaaa

SEQ ID NO: 769220 - RNA, 12 nt, Leptospira interrogans serovar lai str. 56601
auuuaauauauu

SEQ ID NO: 769221 - RNA, 16 nt, Leptospira interrogans serovar lai str. 56601
auuuaauauauuaaaa

SEQ ID NO: 769222 - RNA, 16 nt, Leptospira interrogans serovar lai str. 56601
auuuaauauauuuuca

SEQ ID NO: 769223 - RNA, 16 nt, Leptospira interrogans serovar lai str. 56601
auuuaauaaaauuuuu

SEQ ID NO: 769224 - RNA, 17 nt, Leptospira interrogans serovar lai str. 56601
auuuaauaaaauuuuua

SEQ ID NO: 769225 - RNA, 17 nt, Leptospira interrogans serovar lai str. 56601
auuuauauuucuaaaag

SEQ ID NO: 769226 - RNA, 16 nt, Leptospira interrogans serovar lai str. 56601
auuuaucgauuuaaaa

SEQ ID NO: 769227 - RNA, 13 nt, Leptospira interrogans serovar lai str. 56601
aaaaguagaauca

SEQ ID NO: 769228 - RNA, 16 nt, Leptospira interrogans serovar lai str. 56601
auuuaucuguaaaauu

SEQ ID NO: 769229 - RNA, 16 nt, Leptospira interrogans serovar lai str. 56601
auuuaucuaaaacaca

SEQ ID NO: 769230 - RNA, 14 nt, Leptospira interrogans serovar lai str. 56601
auuuaucuauaaaa

SEQ ID NO: 769231 - RNA, 23 nt, Leptospira interrogans serovar lai str. 56601
aaaagucccaauuccaccuugga

SEQ ID NO: 769232 - RNA, 18 nt, Leptospira interrogans serovar lai str. 56601
aaaaguccaauuuuaaaa

SEQ ID NO: 769233 - RNA, 22 nt, Leptospira interrogans serovar lai str. 56601
aaaaguccaauuuuaaaaccaa

SEQ ID NO: 769234 - RNA, 13 nt, Leptospira interrogans serovar lai str. 56601
aaaagucaaaaaa

SEQ ID NO: 769235 - RNA, 18 nt, Leptospira interrogans serovar lai str. 56601
aaaagucaaaaaaugguu

SEQ ID NO: 769236 - RNA, 18 nt, Leptospira interrogans serovar lai str. 56601
aaaaguauguuuuucuaa

SEQ ID NO: 769237 - RNA, 18 nt, Leptospira interrogans serovar lai str. 56601
aaaaguauguuuuucuga

SEQ ID NO: 769238 - RNA, 15 nt, Leptospira interrogans serovar lai str. 56601
aaaaguauaauuuaa

SEQ ID NO: 769239 - RNA, 18 nt, Leptospira interrogans serovar lai str. 56601
auuuaaauguuauuuugu

SEQ ID NO: 769240 - RNA, 11 nt, Leptospira interrogans serovar lai str. 56601
auuuaaauccc

SEQ ID NO: 769241 - RNA, 17 nt, Leptospira interrogans serovar lai str. 56601
auuuaaauucccucaau

SEQ ID NO: 769242 - RNA, 16 nt, Leptospira interrogans serovar lai str. 56601
auuuaaauguuuuugu

SEQ ID NO: 769243 - RNA, 14 nt, Leptospira interrogans serovar lai str. 56601
auuuaaacuuuuca

SEQ ID NO: 769244 - RNA, 21 nt, Leptospira interrogans serovar lai str. 56601
auuuaaagacgauuccuaaaa

SEQ ID NO: 769245 - RNA, 22 nt, Leptospira interrogans serovar lai str. 56601
auuuaaagacgauuccuaaaaa

SEQ ID NO: 769246 - RNA, 17 nt, Leptospira interrogans serovar lai str. 56601
auuguuguuauggaauu

SEQ ID NO: 769247 - RNA, 18 nt, Leptospira interrogans serovar lai str. 56601
auuguuuacaaacuuaca

SEQ ID NO: 769248 - RNA, 14 nt, Leptospira interrogans serovar lai str. 56601
auuguuuauaaaac

SEQ ID NO: 769249 - RNA, 19 nt, Leptospira interrogans serovar lai str. 56601
auuguugcuauggaauuuu

SEQ ID NO: 769250 - RNA, 15 nt, Leptospira interrogans serovar lai str. 56601
auugucucaaaauua

SEQ ID NO: 769251 - RNA, 15 nt, Leptospira interrogans serovar lai str. 56601
auugucuauuuuaau

SEQ ID NO: 769252 - RNA, 19 nt, Leptospira interrogans serovar lai str. 56601
auugucuauuuuaauggaa

SEQ ID NO: 769253 - RNA, 20 nt, Leptospira interrogans serovar lai str. 56601
auugucuauuuuaauggaaa

SEQ ID NO: 769254 - RNA, 21 nt, Leptospira interrogans serovar lai str. 56601
auugugggaacuauuauaaaa

SEQ ID NO: 769255 - RNA, 15 nt, Leptospira interrogans serovar lai str. 56601
auugugggaacuuua

SEQ ID NO: 769256 - RNA, 15 nt, Leptospira interrogans serovar lai str. 56601
auugugguaguuccu

SEQ ID NO: 769257 - RNA, 20 nt, Leptospira interrogans serovar lai str. 56601
auuguguuuuuucuuuaaaa

SEQ ID NO: 769258 - RNA, 21 nt, Leptospira interrogans serovar lai str. 56601
auuguguuuuuucuuuaaaau

SEQ ID NO: 769259 - RNA, 22 nt, Leptospira interrogans serovar lai str. 56601
auuguucguuucuuaauuuuac

SEQ ID NO: 769260 - RNA, 13 nt, Leptospira interrogans serovar lai str. 56601
auuguugaaaaac

SEQ ID NO: 769261 - RNA, 14 nt, Leptospira interrogans serovar lai str. 56601
auuguugaaaaacu

SEQ ID NO: 769262 - RNA, 17 nt, Leptospira interrogans serovar lai str. 56601
auuguugaaaaauuuca

SEQ ID NO: 769263 - RNA, 22 nt, Leptospira interrogans serovar lai str. 56601
auuguugaauaucuaauauuuu

SEQ ID NO: 769264 - RNA, 18 nt, Leptospira interrogans serovar lai str. 56601
auuguuaucugugaauuc

SEQ ID NO: 769265 - RNA, 19 nt, Leptospira interrogans serovar lai str. 56601
auuguuauaaacuucuauu

SEQ ID NO: 769266 - RNA, 18 nt, Leptospira interrogans serovar lai str. 56601
auuguuaagauaaauuua

SEQ ID NO: 769267 - RNA, 18 nt, Leptospira interrogans serovar lai str. 56601
auuguaaaaaaacaugaa

SEQ ID NO: 769268 - RNA, 13 nt, Leptospira interrogans serovar lai str. 56601
auuguaagaaaua

SEQ ID NO: 769269 - RNA, 22 nt, Leptospira interrogans serovar lai str. 56601
auugguuguggaugauuuuucu

SEQ ID NO: 769270 - RNA, 19 nt, Leptospira interrogans serovar lai str. 56601
aaaagguauaaaauaaaaa

SEQ ID NO: 769271 - RNA, 16 nt, Leptospira interrogans serovar lai str. 56601
auuguaggaacuacua

SEQ ID NO: 769272 - RNA, 22 nt, Leptospira interrogans serovar lai str. 56601
auuguaggaacucauauuuuua

SEQ ID NO: 769273 - RNA, 13 nt, Leptospira interrogans serovar lai str. 56601
auuguccauuuca

SEQ ID NO: 769274 - RNA, 14 nt, Leptospira interrogans serovar lai str. 56601
auuguccauuucaa

SEQ ID NO: 769275 - RNA, 14 nt, Leptospira interrogans serovar lai str. 56601
auuguagauucuuu

SEQ ID NO: 769276 - RNA, 15 nt, Leptospira interrogans serovar lai str. 56601
aaaaggcucucuuuu

SEQ ID NO: 769277 - RNA, 14 nt, Leptospira interrogans serovar lai str. 56601
auugccauccacaa

SEQ ID NO: 769278 - RNA, 15 nt, Leptospira interrogans serovar lai str. 56601
auugccauccacaaa

SEQ ID NO: 769279 - RNA, 18 nt, Leptospira interrogans serovar lai str. 56601
auugccuaaauuccuucc

SEQ ID NO: 769280 - RNA, 23 nt, Leptospira interrogans serovar lai str. 56601
auugccuaaauuccuuccaaguu

SEQ ID NO: 769281 - RNA, 15 nt, Leptospira interrogans serovar lai str. 56601
auugcauaaaagaaa

SEQ ID NO: 769282 - RNA, 20 nt, Leptospira interrogans serovar lai str. 56601
auugccaaaacuaccucaau

SEQ ID NO: 769283 - RNA, 21 nt, Leptospira interrogans serovar lai str. 56601
auugcacaaaagaaacguaau

SEQ ID NO: 769284 - RNA, 16 nt, Leptospira interrogans serovar lai str. 56601
auucuuuaaauguaga

SEQ ID NO: 769285 - RNA, 19 nt, Leptospira interrogans serovar lai str. 56601
auucuuuaaaugugggaac

SEQ ID NO: 769286 - RNA, 18 nt, Leptospira interrogans serovar lai str. 56601
auucuuuagaaauuuuua

SEQ ID NO: 769287 - RNA, 20 nt, Leptospira interrogans serovar lai str. 56601
auucuuuagaaauuuuuaau

SEQ ID NO: 769288 - RNA, 14 nt, Leptospira interrogans serovar lai str. 56601
auucuuuaaaauuu

SEQ ID NO: 769289 - RNA, 19 nt, Leptospira interrogans serovar lai str. 56601
auucuuuaaaauuuuuaau

SEQ ID NO: 769290 - RNA, 20 nt, Leptospira interrogans serovar lai str. 56601
auucuugucggaacacuuga

SEQ ID NO: 769291 - RNA, 12 nt, Leptospira interrogans serovar lai str. 56601
auugaaacaaaa

SEQ ID NO: 769292 - RNA, 22 nt, Leptospira interrogans serovar lai str. 56601
auugaaaaauagaauuguugaa

SEQ ID NO: 769293 - RNA, 21 nt, Leptospira interrogans serovar lai str. 56601
auugaucucuauaaaaucaag

SEQ ID NO: 769294 - RNA, 21 nt, Leptospira interrogans serovar lai str. 56601
auugaaacuauacuuucaaaa

SEQ ID NO: 769295 - RNA, 18 nt, Leptospira interrogans serovar lai str. 56601
auugaaacguuuucaaaa

SEQ ID NO: 769296 - RNA, 15 nt, Leptospira interrogans serovar lai str. 56601
auugaaagaagauag

SEQ ID NO: 769297 - RNA, 18 nt, Leptospira interrogans serovar lai str. 56601
auucuucuuucguuugag

SEQ ID NO: 769298 - RNA, 15 nt, Leptospira interrogans serovar lai str. 56601
auucuuggguuuuau

SEQ ID NO: 769299 - RNA, 17 nt, Leptospira interrogans serovar lai str. 56601
auucuugauugguugug

SEQ ID NO: 769300 - RNA, 19 nt, Leptospira interrogans serovar lai str. 56601
auucugcucauuuuuucuu

SEQ ID NO: 769301 - RNA, 22 nt, Leptospira interrogans serovar lai str. 56601
auucuuccgggaggaauuuuua

SEQ ID NO: 769302 - RNA, 13 nt, Leptospira interrogans serovar lai str. 56601
auucuuccuucuu

SEQ ID NO: 769303 - RNA, 15 nt, Leptospira interrogans serovar lai str. 56601
auucuuccuucuuga

SEQ ID NO: 769304 - RNA, 21 nt, Leptospira interrogans serovar lai str. 56601
auucucuauggguuuucguug

SEQ ID NO: 769305 - RNA, 14 nt, Leptospira interrogans serovar lai str. 56601
auucugaaaaugua

SEQ ID NO: 769306 - RNA, 13 nt, Leptospira interrogans serovar lai str. 56601
auucucuuuuugg

SEQ ID NO: 769307 - RNA, 12 nt, Leptospira interrogans serovar lai str. 56601
auucugaaaaaa

SEQ ID NO: 769308 - RNA, 16 nt, Leptospira interrogans serovar lai str. 56601
auucugaaauuguuuu

SEQ ID NO: 769309 - RNA, 18 nt, Leptospira interrogans serovar lai str. 56601
auucugauaacuauauaa

SEQ ID NO: 769310 - RNA, 13 nt, Leptospira interrogans serovar lai str. 56601
auucugaauaauu

SEQ ID NO: 769311 - RNA, 16 nt, Leptospira interrogans serovar lai str. 56601
auucugaauauuuuau

SEQ ID NO: 769312 - RNA, 18 nt, Leptospira interrogans serovar lai str. 56601
auuccuuuccgauuucuu

SEQ ID NO: 769313 - RNA, 20 nt, Leptospira interrogans serovar lai str. 56601
auuccuuuucuuuuuuaaac

SEQ ID NO: 769314 - RNA, 12 nt, Leptospira interrogans serovar lai str. 56601
auuccuuucugc

SEQ ID NO: 769315 - RNA, 14 nt, Leptospira interrogans serovar lai str. 56601
auuccuuucugcug

SEQ ID NO: 769316 - RNA, 14 nt, Leptospira interrogans serovar lai str. 56601
auuccuuuuucuaa

SEQ ID NO: 769317 - RNA, 21 nt, Leptospira interrogans serovar lai str. 56601
auucguauuuuauagaaauac

SEQ ID NO: 769318 - RNA, 23 nt, Leptospira interrogans serovar lai str. 56601
auucguaaaaaccgcaaauuuua

SEQ ID NO: 769319 - RNA, 15 nt, Leptospira interrogans serovar lai str. 56601
auucguaagaaaaaa

SEQ ID NO: 769320 - RNA, 19 nt, Leptospira interrogans serovar lai str. 56601
auucguaagaaaaaauuuc

SEQ ID NO: 769321 - RNA, 19 nt, Leptospira interrogans serovar lai str. 56601
auucgcuccgauaauugua

SEQ ID NO: 769322 - RNA, 16 nt, Leptospira interrogans serovar lai str. 56601
auucucgcauuuuccu

SEQ ID NO: 769323 - RNA, 23 nt, Leptospira interrogans serovar lai str. 56601
auucucgcauuuuccuuuuuccg

SEQ ID NO: 769324 - RNA, 23 nt, Leptospira interrogans serovar lai str. 56601
auucucacaaaucacauccaacc

SEQ ID NO: 769325 - RNA, 12 nt, Leptospira interrogans serovar lai str. 56601
auucuccuccug

SEQ ID NO: 769326 - RNA, 19 nt, Leptospira interrogans serovar lai str. 56601
auucuccuccugaaaauuu

SEQ ID NO: 769327 - RNA, 22 nt, Leptospira interrogans serovar lai str. 56601
auucuccuccugaaaauuuucc

SEQ ID NO: 769328 - RNA, 23 nt, Leptospira interrogans serovar lai str. 56601
auucuccuccugaaaauuuuccu

SEQ ID NO: 769329 - RNA, 15 nt, Leptospira interrogans serovar lai str. 56601
auucuccucuucacc

SEQ ID NO: 769330 - RNA, 23 nt, Leptospira interrogans serovar lai str. 56601
auucuauuuuagggaucgaucug

SEQ ID NO: 769331 - RNA, 14 nt, Leptospira interrogans serovar lai str. 56601
auucuauuuucuuu

SEQ ID NO: 769332 - RNA, 13 nt, Leptospira interrogans serovar lai str. 56601
auucuauuuugag

SEQ ID NO: 769333 - RNA, 21 nt, Leptospira interrogans serovar lai str. 56601
auucucaaaaaauuauaucuu

SEQ ID NO: 769334 - RNA, 22 nt, Leptospira interrogans serovar lai str. 56601
auucuauauauugaaauauuau

SEQ ID NO: 769335 - RNA, 13 nt, Leptospira interrogans serovar lai str. 56601
auucuauuaguuu

SEQ ID NO: 769336 - RNA, 19 nt, Leptospira interrogans serovar lai str. 56601
auucuauuaguuuuuaugc

SEQ ID NO: 769337 - RNA, 16 nt, Leptospira interrogans serovar lai str. 56601
auucuauucguauuuu

SEQ ID NO: 769338 - RNA, 23 nt, Leptospira interrogans serovar lai str. 56601
auucuauucguauuuuauagaaa

SEQ ID NO: 769339 - RNA, 22 nt, Leptospira interrogans serovar lai str. 56601
auucuauugugggaacuacuac

SEQ ID NO: 769340 - RNA, 19 nt, Leptospira interrogans serovar lai str. 56601
auucuaugggaauuuuugu

SEQ ID NO: 769341 - RNA, 21 nt, Leptospira interrogans serovar lai str. 56601
auucuaugggaauuuuuguaa

SEQ ID NO: 769342 - RNA, 14 nt, Leptospira interrogans serovar lai str. 56601
auucuauuagaaua

SEQ ID NO: 769343 - RNA, 18 nt, Leptospira interrogans serovar lai str. 56601
auucuacaccuucuaaau

SEQ ID NO: 769344 - RNA, 22 nt, Leptospira interrogans serovar lai str. 56601
auucuacaccuucuaaaucaua

SEQ ID NO: 769345 - RNA, 17 nt, Leptospira interrogans serovar lai str. 56601
auucuacagauaaaaau

SEQ ID NO: 769346 - RNA, 21 nt, Leptospira interrogans serovar lai str. 56601
auucuacagauaaaaauagua

SEQ ID NO: 769347 - RNA, 23 nt, Leptospira interrogans serovar lai str. 56601
auucuaauugugggaacucacac

SEQ ID NO: 769348 - RNA, 13 nt, Leptospira interrogans serovar lai str. 56601
auucuaauuuuau

SEQ ID NO: 769349 - RNA, 22 nt, Leptospira interrogans serovar lai str. 56601
auucuaauuuuauaaauuauuu

SEQ ID NO: 769350 - RNA, 13 nt, Leptospira interrogans serovar lai str. 56601
auucuaauuuuua

SEQ ID NO: 769351 - RNA, 14 nt, Leptospira interrogans serovar lai str. 56601
auucuaauuuuuca

SEQ ID NO: 769352 - RNA, 18 nt, Leptospira interrogans serovar lai str. 56601
auucuacaaauucuucuu

SEQ ID NO: 769353 - RNA, 19 nt, Leptospira interrogans serovar lai str. 56601
auucuacaaauucuucuuc

SEQ ID NO: 769354 - RNA, 16 nt, Leptospira interrogans serovar lai str. 56601
auucuaauauuauuuu

SEQ ID NO: 769355 - RNA, 21 nt, Leptospira interrogans serovar lai str. 56601
auucuaaucacgaaaaaugaa

SEQ ID NO: 769356 - RNA, 19 nt, Leptospira interrogans serovar lai str. 56601
auucuaaguaauuuaaaaa

SEQ ID NO: 769357 - RNA, 17 nt, Leptospira interrogans serovar lai str. 56601
auucguucauagagaua

SEQ ID NO: 769358 - RNA, 13 nt, Leptospira interrogans serovar lai str. 56601
auucguuccaaau

SEQ ID NO: 769359 - RNA, 16 nt, Leptospira interrogans serovar lai str. 56601
auucguugagacgaaa

SEQ ID NO: 769360 - RNA, 18 nt, Leptospira interrogans serovar lai str. 56601
auucuaacugguuuuucu

SEQ ID NO: 769361 - RNA, 19 nt, Leptospira interrogans serovar lai str. 56601
auucuaacugguuuuucuu

SEQ ID NO: 769362 - RNA, 21 nt, Leptospira interrogans serovar lai str. 56601
auuccauuuuuuagaauccca

SEQ ID NO: 769363 - RNA, 11 nt, Leptospira interrogans serovar lai str. 56601
auucccaaaaa

SEQ ID NO: 769364 - RNA, 13 nt, Leptospira interrogans serovar lai str. 56601
auuccauucuuca

SEQ ID NO: 769365 - RNA, 15 nt, Leptospira interrogans serovar lai str. 56601
auuccauugauuuuc

SEQ ID NO: 769366 - RNA, 21 nt, Leptospira interrogans serovar lai str. 56601
auuccaucguuuauuuuucua

SEQ ID NO: 769367 - RNA, 15 nt, Leptospira interrogans serovar lai str. 56601
auuccaugguuuuuu

SEQ ID NO: 769368 - RNA, 22 nt, Leptospira interrogans serovar lai str. 56601
auuccacuaugaaaguuuuuca

SEQ ID NO: 769369 - RNA, 19 nt, Leptospira interrogans serovar lai str. 56601
auuccaccuuggaaagaaa

SEQ ID NO: 769370 - RNA, 13 nt, Leptospira interrogans serovar lai str. 56601
auuccauaaugaa

SEQ ID NO: 769371 - RNA, 14 nt, Leptospira interrogans serovar lai str. 56601
auuccauaaugaag

SEQ ID NO: 769372 - RNA, 18 nt, Leptospira interrogans serovar lai str. 56601
auuccauagugaagauuu

SEQ ID NO: 769373 - RNA, 21 nt, Leptospira interrogans serovar lai str. 56601
auuccauaggcaauugcguuc

SEQ ID NO: 769374 - RNA, 16 nt, Leptospira interrogans serovar lai str. 56601
auuccaauuuuucuga

SEQ ID NO: 769375 - RNA, 16 nt, Leptospira interrogans serovar lai str. 56601
auuccaagauuuuuua

SEQ ID NO: 769376 - RNA, 23 nt, Leptospira interrogans serovar lai str. 56601
auuccaacuuuuucagaaaaaug

SEQ ID NO: 769377 - RNA, 13 nt, Leptospira interrogans serovar lai str. 56601
auuccaaagauaa

SEQ ID NO: 769378 - RNA, 14 nt, Leptospira interrogans serovar lai str. 56601
auuccaaagauaaa

SEQ ID NO: 769379 - RNA, 18 nt, Leptospira interrogans serovar lai str. 56601
auuccaaagauaaaaaag

SEQ ID NO: 769380 - RNA, 17 nt, Leptospira interrogans serovar lai str. 56601
auuccaaaauucguuga

SEQ ID NO: 769381 - RNA, 15 nt, Leptospira interrogans serovar lai str. 56601
auucauuuuuugaaa

SEQ ID NO: 769382 - RNA, 17 nt, Leptospira interrogans serovar lai str. 56601
auucauuuuuauuuuua

SEQ ID NO: 769383 - RNA, 12 nt, Leptospira interrogans serovar lai str. 56601
auucauuuuucu

SEQ ID NO: 769384 - RNA, 17 nt, Leptospira interrogans serovar lai str. 56601
auucauuuuucuaaaaa

SEQ ID NO: 769385 - RNA, 18 nt, Leptospira interrogans serovar lai str. 56601
auucauuuuucuaaaaaa

SEQ ID NO: 769386 - RNA, 13 nt, Leptospira interrogans serovar lai str. 56601
auucauuuuucug

SEQ ID NO: 769387 - RNA, 15 nt, Leptospira interrogans serovar lai str. 56601
auucccacauuuuca

SEQ ID NO: 769388 - RNA, 18 nt, Leptospira interrogans serovar lai str. 56601
auuccgucauaaguguau

SEQ ID NO: 769389 - RNA, 20 nt, Leptospira interrogans serovar lai str. 56601
auuccuccagugcaauacau

SEQ ID NO: 769390 - RNA, 17 nt, Leptospira interrogans serovar lai str. 56601
auuccuaaaauguggga

SEQ ID NO: 769391 - RNA, 14 nt, Leptospira interrogans serovar lai str. 56601
auuccuacauuauu

SEQ ID NO: 769392 - RNA, 16 nt, Leptospira interrogans serovar lai str. 56601
auuccuacauucauuu

SEQ ID NO: 769393 - RNA, 22 nt, Leptospira interrogans serovar lai str. 56601
auuccuaaugcagcuucuucca

SEQ ID NO: 769394 - RNA, 21 nt, Leptospira interrogans serovar lai str. 56601
auuccuaaaugccgccccaua

SEQ ID NO: 769395 - RNA, 20 nt, Leptospira interrogans serovar lai str. 56601
auuccuaacuaauaaauagg

SEQ ID NO: 769396 - RNA, 23 nt, Leptospira interrogans serovar lai str. 56601
auucaucaauuuuggaaagcccc

SEQ ID NO: 769397 - RNA, 19 nt, Leptospira interrogans serovar lai str. 56601
aaaagcuuuugcuuuuaaa

SEQ ID NO: 769398 - RNA, 20 nt, Leptospira interrogans serovar lai str. 56601
aaaagcuuuugcuuuuaaag

SEQ ID NO: 769399 - RNA, 22 nt, Leptospira interrogans serovar lai str. 56601
aaaaggagaauucaauuuauaa

SEQ ID NO: 769400 - RNA, 12 nt, Leptospira interrogans serovar lai str. 56601
aaaaggagccaa

SEQ ID NO: 769401 - RNA, 20 nt, Leptospira interrogans serovar lai str. 56601
aaaaggagccaacacauucc

SEQ ID NO: 769402 - RNA, 14 nt, Leptospira interrogans serovar lai str. 56601
aaaaggaauacaau

SEQ ID NO: 769403 - RNA, 17 nt, Leptospira interrogans serovar lai str. 56601
aaaaggaguaauucuaa

SEQ ID NO: 769404 - RNA, 14 nt, Leptospira interrogans serovar lai str. 56601
aaaaggauuccauu

SEQ ID NO: 769405 - RNA, 21 nt, Leptospira interrogans serovar lai str. 56601
auucauucagaccuuuuuuau

SEQ ID NO: 769406 - RNA, 17 nt, Leptospira interrogans serovar lai str. 56601
auucauuccuauaaaua

SEQ ID NO: 769407 - RNA, 20 nt, Leptospira interrogans serovar lai str. 56601
auucauuccuauaaauaaau

SEQ ID NO: 769408 - RNA, 15 nt, Leptospira interrogans serovar lai str. 56601
auucauuuaaaaauu

SEQ ID NO: 769409 - RNA, 17 nt, Leptospira interrogans serovar lai str. 56601
auucauuuaccuaaaau

SEQ ID NO: 769410 - RNA, 13 nt, Leptospira interrogans serovar lai str. 56601
auucauuuucuau

SEQ ID NO: 769411 - RNA, 13 nt, Leptospira interrogans serovar lai str. 56601
auuaauaaaacug

SEQ ID NO: 769412 - RNA, 19 nt, Leptospira interrogans serovar lai str. 56601
auuaagaaaaauuaaaauu

SEQ ID NO: 769413 - RNA, 15 nt, Leptospira interrogans serovar lai str. 56601
auuaagaaagacuuu

SEQ ID NO: 769414 - RNA, 15 nt, Leptospira interrogans serovar lai str. 56601
auuaagaacuuucuc

SEQ ID NO: 769415 - RNA, 19 nt, Leptospira interrogans serovar lai str. 56601
auuaagaauucuaaacaca

SEQ ID NO: 769416 - RNA, 14 nt, Leptospira interrogans serovar lai str. 56601
auuaacggccaaau

SEQ ID NO: 769417 - RNA, 17 nt, Leptospira interrogans serovar lai str. 56601
auuaacggccaaauuug

SEQ ID NO: 769418 - RNA, 12 nt, Leptospira interrogans serovar lai str. 56601
auuaaauuaacg

SEQ ID NO: 769419 - RNA, 13 nt, Leptospira interrogans serovar lai str. 56601
auuaacuaauuuu

SEQ ID NO: 769420 - RNA, 20 nt, Leptospira interrogans serovar lai str. 56601
auuaacuaauuuuaguuuau

SEQ ID NO: 769421 - RNA, 14 nt, Leptospira interrogans serovar lai str. 56601
auuaacuacccuua

SEQ ID NO: 769422 - RNA, 13 nt, Leptospira interrogans serovar lai str. 56601
auuaacuuucauu

SEQ ID NO: 769423 - RNA, 22 nt, Leptospira interrogans serovar lai str. 56601
auuaacugcuguucuuuuauau

SEQ ID NO: 769424 - RNA, 12 nt, Leptospira interrogans serovar lai str. 56601
auuaaaaagaac

SEQ ID NO: 769425 - RNA, 21 nt, Leptospira interrogans serovar lai str. 56601
auuaaaacgaauugauaaaac

SEQ ID NO: 769426 - RNA, 18 nt, Leptospira interrogans serovar lai str. 56601
auuaaaaccguuccauaa

SEQ ID NO: 769427 - RNA, 21 nt, Leptospira interrogans serovar lai str. 56601
auuaaaaccguuccauaaauu

SEQ ID NO: 769428 - RNA, 19 nt, Leptospira interrogans serovar lai str. 56601
auuaaacuucaaaaaauau

SEQ ID NO: 769429 - RNA, 16 nt, Leptospira interrogans serovar lai str. 56601
auuaaacuuuuauaaa

SEQ ID NO: 769430 - RNA, 19 nt, Leptospira interrogans serovar lai str. 56601
auuaaacuuuuauaaaauc

SEQ ID NO: 769431 - RNA, 20 nt, Leptospira interrogans serovar lai str. 56601
auuaaacuuuuauaaaaucu

SEQ ID NO: 769432 - RNA, 13 nt, Leptospira interrogans serovar lai str. 56601
auuaaaaauuucu

SEQ ID NO: 769433 - RNA, 14 nt, Leptospira interrogans serovar lai str. 56601
auuaaaaauuuuua

SEQ ID NO: 769434 - RNA, 15 nt, Leptospira interrogans serovar lai str. 56601
auuaaaaauuuuuaa

SEQ ID NO: 769435 - RNA, 18 nt, Leptospira interrogans serovar lai str. 56601
auuaaagaauaauauuuu

SEQ ID NO: 769436 - RNA, 15 nt, Leptospira interrogans serovar lai str. 56601
auuaaagauuuuucu

SEQ ID NO: 769437 - RNA, 14 nt, Leptospira interrogans serovar lai str. 56601
auuaaaucuuaugg

SEQ ID NO: 769438 - RNA, 16 nt, Leptospira interrogans serovar lai str. 56601
auuaaagcgucucauu

SEQ ID NO: 769439 - RNA, 22 nt, Leptospira interrogans serovar lai str. 56601
auuaaaucgcauuugacaauuu

SEQ ID NO: 769440 - RNA, 22 nt, Leptospira interrogans serovar lai str. 56601
auguucuuagacucaguauguu

SEQ ID NO: 769441 - RNA, 14 nt, Leptospira interrogans serovar lai str. 56601
auguuuuauauaaa

SEQ ID NO: 769442 - RNA, 22 nt, Leptospira interrogans serovar lai str. 56601
auguuuuccagaaaccauaaaa

SEQ ID NO: 769443 - RNA, 14 nt, Leptospira interrogans serovar lai str. 56601
auguuauaaaaugu

SEQ ID NO: 769444 - RNA, 19 nt, Leptospira interrogans serovar lai str. 56601
auguuauauauuuuuaauu

SEQ ID NO: 769445 - RNA, 11 nt, Leptospira interrogans serovar lai str. 56601
auguuauaucg

SEQ ID NO: 769446 - RNA, 15 nt, Leptospira interrogans serovar lai str. 56601
auguguugucuacga

SEQ ID NO: 769447 - RNA, 15 nt, Leptospira interrogans serovar lai str. 56601
augugggaacuacua

SEQ ID NO: 769448 - RNA, 22 nt, Leptospira interrogans serovar lai str. 56601
augugggaacuacuacaaauca

SEQ ID NO: 769449 - RNA, 23 nt, Leptospira interrogans serovar lai str. 56601
augugggaacuacuacaaaucac

SEQ ID NO: 769450 - RNA, 20 nt, Leptospira interrogans serovar lai str. 56601
augugggaacuacuacaaga

SEQ ID NO: 769451 - RNA, 18 nt, Leptospira interrogans serovar lai str. 56601
augugggaacucccacaa

SEQ ID NO: 769452 - RNA, 16 nt, Leptospira interrogans serovar lai str. 56601
augugggaacucucac

SEQ ID NO: 769453 - RNA, 15 nt, Leptospira interrogans serovar lai str. 56601
augugggaauuacua

SEQ ID NO: 769454 - RNA, 13 nt, Leptospira interrogans serovar lai str. 56601
augugguaacuac

SEQ ID NO: 769455 - RNA, 19 nt, Leptospira interrogans serovar lai str. 56601
augugccuucguuuaaaaa

SEQ ID NO: 769456 - RNA, 23 nt, Leptospira interrogans serovar lai str. 56601
auguggcagcuacuaggaaaauu

SEQ ID NO: 769457 - RNA, 21 nt, Leptospira interrogans serovar lai str. 56601
auguggaugauaaaaaacgaa

SEQ ID NO: 769458 - RNA, 22 nt, Leptospira interrogans serovar lai str. 56601
augucguacuaaaauuaaaaau

SEQ ID NO: 769459 - RNA, 16 nt, Leptospira interrogans serovar lai str. 56601
augugauagaaaggua

SEQ ID NO: 769460 - RNA, 13 nt, Leptospira interrogans serovar lai str. 56601
augugaauucaga

SEQ ID NO: 769461 - RNA, 18 nt, Leptospira interrogans serovar lai str. 56601
augugaauucagaaaaaa

SEQ ID NO: 769462 - RNA, 21 nt, Leptospira interrogans serovar lai str. 56601
augugacuuaaucugugggaa

SEQ ID NO: 769463 - RNA, 22 nt, Leptospira interrogans serovar lai str. 56601
augugacuuuaauuuuaguaaa

SEQ ID NO: 769464 - RNA, 23 nt, Leptospira interrogans serovar lai str. 56601
augugacuuuaauuuuaguaaaa

SEQ ID NO: 769465 - RNA, 15 nt, Leptospira interrogans serovar lai str. 56601
auuagaguuuuugaa

SEQ ID NO: 769466 - RNA, 16 nt, Leptospira interrogans serovar lai str. 56601
auuagaguuucuaaaa

SEQ ID NO: 769467 - RNA, 17 nt, Leptospira interrogans serovar lai str. 56601
auuagaguuucuaaaaa

SEQ ID NO: 769468 - RNA, 20 nt, Leptospira interrogans serovar lai str. 56601
auuagaguuugaguuucuuu

SEQ ID NO: 769469 - RNA, 15 nt, Leptospira interrogans serovar lai str. 56601
auuagcaugaaauuu

SEQ ID NO: 769470 - RNA, 22 nt, Leptospira interrogans serovar lai str. 56601
auuagcaugaaauuuucuuaga

SEQ ID NO: 769471 - RNA, 17 nt, Leptospira interrogans serovar lai str. 56601
aaaagccgcgaucuaac

SEQ ID NO: 769472 - RNA, 22 nt, Leptospira interrogans serovar lai str. 56601
auuagaaaauuauaaacaaauc

SEQ ID NO: 769473 - RNA, 22 nt, Leptospira interrogans serovar lai str. 56601
auuagaaaaaaaguauauauua

SEQ ID NO: 769474 - RNA, 12 nt, Leptospira interrogans serovar lai str. 56601
auuagaacauca

SEQ ID NO: 769475 - RNA, 13 nt, Leptospira interrogans serovar lai str. 56601
auuagaacaucaa

SEQ ID NO: 769476 - RNA, 16 nt, Leptospira interrogans serovar lai str. 56601
auuagaagaauuguau

SEQ ID NO: 769477 - RNA, 13 nt, Leptospira interrogans serovar lai str. 56601
auuagaacuacuc

SEQ ID NO: 769478 - RNA, 16 nt, Leptospira interrogans serovar lai str. 56601
auuagaacuacucaca

SEQ ID NO: 769479 - RNA, 21 nt, Leptospira interrogans serovar lai str. 56601
auuagaacuguugaaaaaauc

SEQ ID NO: 769480 - RNA, 23 nt, Leptospira interrogans serovar lai str. 56601
auuagaauuuuaugauuuucuuu

SEQ ID NO: 769481 - RNA, 15 nt, Leptospira interrogans serovar lai str. 56601
auuagaauuuuauug

SEQ ID NO: 769482 - RNA, 14 nt, Leptospira interrogans serovar lai str. 56601
auuagaauauacaa

SEQ ID NO: 769483 - RNA, 14 nt, Leptospira interrogans serovar lai str. 56601
auuagaauuguuga

SEQ ID NO: 769484 - RNA, 15 nt, Leptospira interrogans serovar lai str. 56601
auuagaauuguugaa

SEQ ID NO: 769485 - RNA, 17 nt, Leptospira interrogans serovar lai str. 56601
auuagagaaguuaaaaa

SEQ ID NO: 769486 - RNA, 20 nt, Leptospira interrogans serovar lai str. 56601
auuacuucaauuguccauuu

SEQ ID NO: 769487 - RNA, 14 nt, Leptospira interrogans serovar lai str. 56601
auuacugauuucaa

SEQ ID NO: 769488 - RNA, 16 nt, Leptospira interrogans serovar lai str. 56601
auuacugauuucaaaa

SEQ ID NO: 769489 - RNA, 19 nt, Leptospira interrogans serovar lai str. 56601
auuacugauuucaaaaaua

SEQ ID NO: 769490 - RNA, 20 nt, Leptospira interrogans serovar lai str. 56601
aaaagccauuucaaaaauau

SEQ ID NO: 769491 - RNA, 23 nt, Leptospira interrogans serovar lai str. 56601
aaaagccauuucaaaaauauauu

SEQ ID NO: 769492 - RNA, 13 nt, Leptospira interrogans serovar lai str. 56601
auuaauauaaaaa

SEQ ID NO: 769493 - RNA, 14 nt, Leptospira interrogans serovar lai str. 56601
auuaauauaaaaaa

SEQ ID NO: 769494 - RNA, 20 nt, Leptospira interrogans serovar lai str. 56601
auuaauagcuugucacuauu

SEQ ID NO: 769495 - RNA, 22 nt, Leptospira interrogans serovar lai str. 56601
auuacauaacuaauaaaaacaa

SEQ ID NO: 769496 - RNA, 23 nt, Leptospira interrogans serovar lai str. 56601
auuacauaacuaauaaaaacaau

SEQ ID NO: 769497 - RNA, 23 nt, Leptospira interrogans serovar lai str. 56601
auuacauaaguucgguguaaaaa

SEQ ID NO: 769498 - RNA, 22 nt, Leptospira interrogans serovar lai str. 56601
auuacauucaauaauuuuaaua

SEQ ID NO: 769499 - RNA, 18 nt, Leptospira interrogans serovar lai str. 56601
auuacucggauguauaaa

SEQ ID NO: 769500 - RNA, 14 nt, Leptospira interrogans serovar lai str. 56601
auuacuaaugcaau

SEQ ID NO: 769501 - RNA, 14 nt, Leptospira interrogans serovar lai str. 56601
auuacuacagacaa

SEQ ID NO: 769502 - RNA, 14 nt, Leptospira interrogans serovar lai str. 56601
auuacggguauuuu

SEQ ID NO: 769503 - RNA, 16 nt, Leptospira interrogans serovar lai str. 56601
auuacguaaagaacuu

SEQ ID NO: 769504 - RNA, 15 nt, Leptospira interrogans serovar lai str. 56601
auucaacuaaauccu

SEQ ID NO: 769505 - RNA, 21 nt, Leptospira interrogans serovar lai str. 56601
auucaacuuuuugaagaaaca

SEQ ID NO: 769506 - RNA, 23 nt, Leptospira interrogans serovar lai str. 56601
aaaagcuuauacuuuaagaaaau

SEQ ID NO: 769507 - RNA, 13 nt, Leptospira interrogans serovar lai str. 56601
auucaauaaaaua

SEQ ID NO: 769508 - RNA, 20 nt, Leptospira interrogans serovar lai str. 56601
auucaauaaaauaccauaaa

SEQ ID NO: 769509 - RNA, 22 nt, Leptospira interrogans serovar lai str. 56601
auucaaaauugagaauagaagc

SEQ ID NO: 769510 - RNA, 19 nt, Leptospira interrogans serovar lai str. 56601
auucaaaauuggaugaauu

SEQ ID NO: 769511 - RNA, 13 nt, Leptospira interrogans serovar lai str. 56601
auucaaagauaaa

SEQ ID NO: 769512 - RNA, 15 nt, Leptospira interrogans serovar lai str. 56601
auucaaaauagaaua

SEQ ID NO: 769513 - RNA, 15 nt, Leptospira interrogans serovar lai str. 56601
auucaaaagauugaa

SEQ ID NO: 769514 - RNA, 19 nt, Leptospira interrogans serovar lai str. 56601
auucaaaauaagaaaauaa

SEQ ID NO: 769515 - RNA, 20 nt, Leptospira interrogans serovar lai str. 56601
auucaaaauaagaaaauaaa

SEQ ID NO: 769516 - RNA, 15 nt, Leptospira interrogans serovar lai str. 56601
auucaaaaacuaaaa

SEQ ID NO: 769517 - RNA, 17 nt, Leptospira interrogans serovar lai str. 56601
auucaaaaacuaaaaua

SEQ ID NO: 769518 - RNA, 19 nt, Leptospira interrogans serovar lai str. 56601
auucaaaaacuaaaauaca

SEQ ID NO: 769519 - RNA, 14 nt, Leptospira interrogans serovar lai str. 56601
auucaaaaagaauc

SEQ ID NO: 769520 - RNA, 13 nt, Leptospira interrogans serovar lai str. 56601
auucaaaauaaau

SEQ ID NO: 769521 - RNA, 21 nt, Leptospira interrogans serovar lai str. 56601
auuauuuuuuguuagauucua

SEQ ID NO: 769522 - RNA, 20 nt, Leptospira interrogans serovar lai str. 56601
auuauuuuuuaaaaaucucu

SEQ ID NO: 769523 - RNA, 11 nt, Leptospira interrogans serovar lai str. 56601
auuauuuuuga

SEQ ID NO: 769524 - RNA, 16 nt, Leptospira interrogans serovar lai str. 56601
auuauuuuaggauuuu

SEQ ID NO: 769525 - RNA, 15 nt, Leptospira interrogans serovar lai str. 56601
auuauuuucaaguaa

SEQ ID NO: 769526 - RNA, 21 nt, Leptospira interrogans serovar lai str. 56601
auuauuuuccuuuaauauuuu

SEQ ID NO: 769527 - RNA, 23 nt, Leptospira interrogans serovar lai str. 56601
auuauuuucguauuguuuacaaa

SEQ ID NO: 769528 - RNA, 14 nt, Leptospira interrogans serovar lai str. 56601
auuauuuucugcgu

SEQ ID NO: 769529 - RNA, 14 nt, Leptospira interrogans serovar lai str. 56601
auuauuucaaaaau

SEQ ID NO: 769530 - RNA, 20 nt, Leptospira interrogans serovar lai str. 56601
auuauuucaaugcaaaaaau

SEQ ID NO: 769531 - RNA, 18 nt, Leptospira interrogans serovar lai str. 56601
auuauuuguaguuucaau

SEQ ID NO: 769532 - RNA, 20 nt, Leptospira interrogans serovar lai str. 56601
auuauuuauuucaauacaac

SEQ ID NO: 769533 - RNA, 12 nt, Leptospira interrogans serovar lai str. 56601
auuauuuacuuu

SEQ ID NO: 769534 - RNA, 21 nt, Leptospira interrogans serovar lai str. 56601
auuauuuacuuuuuccaaaag

SEQ ID NO: 769535 - RNA, 14 nt, Leptospira interrogans serovar lai str. 56601
auuaguaauaugau

SEQ ID NO: 769536 - RNA, 15 nt, Leptospira interrogans serovar lai str. 56601
aaaagcgucaacuga

SEQ ID NO: 769537 - RNA, 16 nt, Leptospira interrogans serovar lai str. 56601
auuaguuuaaaaacuu

SEQ ID NO: 769538 - RNA, 16 nt, Leptospira interrogans serovar lai str. 56601
auuauauaauuuuuaa

SEQ ID NO: 769539 - RNA, 17 nt, Leptospira interrogans serovar lai str. 56601
auuauaguuuuuucaaa

SEQ ID NO: 769540 - RNA, 20 nt, Leptospira interrogans serovar lai str. 56601
auuauaguuuuuucaaaaau

SEQ ID NO: 769541 - RNA, 23 nt, Leptospira interrogans serovar lai str. 56601
auuauaguuuuuucaaaaauucc

SEQ ID NO: 769542 - RNA, 13 nt, Leptospira interrogans serovar lai str. 56601
auuauauucuuau

SEQ ID NO: 769543 - RNA, 15 nt, Leptospira interrogans serovar lai str. 56601
auuauuaaauuuuua

SEQ ID NO: 769544 - RNA, 16 nt, Leptospira interrogans serovar lai str. 56601
auuauuaaauuuuuau

SEQ ID NO: 769545 - RNA, 16 nt, Leptospira interrogans serovar lai str. 56601
auuaugugacuuuaau

SEQ ID NO: 769546 - RNA, 22 nt, Leptospira interrogans serovar lai str. 56601
auguaacaguaagaagaaaagg

SEQ ID NO: 769547 - RNA, 18 nt, Leptospira interrogans serovar lai str. 56601
augguugcaaaaaagaaa

SEQ ID NO: 769548 - RNA, 13 nt, Leptospira interrogans serovar lai str. 56601
auguaaagaaaac

SEQ ID NO: 769549 - RNA, 14 nt, Leptospira interrogans serovar lai str. 56601
auguaaagaaaacc

SEQ ID NO: 769550 - RNA, 23 nt, Leptospira interrogans serovar lai str. 56601
auguaaaguucuuuucuuaaaaa

SEQ ID NO: 769551 - RNA, 12 nt, Leptospira interrogans serovar lai str. 56601
auguaaaauuuu

SEQ ID NO: 769552 - RNA, 22 nt, Leptospira interrogans serovar lai str. 56601
augguacuuuacgaaaguugaa

SEQ ID NO: 769553 - RNA, 16 nt, Leptospira interrogans serovar lai str. 56601
augguacgaccaaaac

SEQ ID NO: 769554 - RNA, 14 nt, Leptospira interrogans serovar lai str. 56601
augguaaggagcuc

SEQ ID NO: 769555 - RNA, 13 nt, Leptospira interrogans serovar lai str. 56601
augguaaaaauau

SEQ ID NO: 769556 - RNA, 22 nt, Leptospira interrogans serovar lai str. 56601
augggcucuaggcgauuuuucg

SEQ ID NO: 769557 - RNA, 18 nt, Leptospira interrogans serovar lai str. 56601
auggcucugaguagaaag

SEQ ID NO: 769558 - RNA, 15 nt, Leptospira interrogans serovar lai str. 56601
auggcucauuuuucu

SEQ ID NO: 769559 - RNA, 19 nt, Leptospira interrogans serovar lai str. 56601
auggcucauuuuucuuaaa

SEQ ID NO: 769560 - RNA, 18 nt, Leptospira interrogans serovar lai str. 56601
auggcauccaggauuuuc

SEQ ID NO: 769561 - RNA, 12 nt, Leptospira interrogans serovar lai str. 56601
auggaucaaaac

SEQ ID NO: 769562 - RNA, 14 nt, Leptospira interrogans serovar lai str. 56601
auggaucaaaacca

SEQ ID NO: 769563 - RNA, 15 nt, Leptospira interrogans serovar lai str. 56601
auggaucaaaaccau

SEQ ID NO: 769564 - RNA, 18 nt, Leptospira interrogans serovar lai str. 56601
auggagauuacuuuuucu

SEQ ID NO: 769565 - RNA, 21 nt, Leptospira interrogans serovar lai str. 56601
auggagaauuaauuuuucaau

SEQ ID NO: 769566 - RNA, 13 nt, Leptospira interrogans serovar lai str. 56601
auggagaauuuau

SEQ ID NO: 769567 - RNA, 16 nt, Leptospira interrogans serovar lai str. 56601
auggagaauuuauuuu

SEQ ID NO: 769568 - RNA, 18 nt, Leptospira interrogans serovar lai str. 56601
auggacagaauccuucca

SEQ ID NO: 769569 - RNA, 20 nt, Leptospira interrogans serovar lai str. 56601
auggacagaauccuuccaaa

SEQ ID NO: 769570 - RNA, 21 nt, Leptospira interrogans serovar lai str. 56601
auggacuauuuuauuacaauu

SEQ ID NO: 769571 - RNA, 12 nt, Leptospira interrogans serovar lai str. 56601
auggaaaaauga

SEQ ID NO: 769572 - RNA, 21 nt, Leptospira interrogans serovar lai str. 56601
auggaaacuacccauuaacua

SEQ ID NO: 769573 - RNA, 15 nt, Leptospira interrogans serovar lai str. 56601
auggaagcuaacaca

SEQ ID NO: 769574 - RNA, 20 nt, Leptospira interrogans serovar lai str. 56601
auggaauuccgacccagaaa

SEQ ID NO: 769575 - RNA, 14 nt, Leptospira interrogans serovar lai str. 56601
auggaauuguugaa

SEQ ID NO: 769576 - RNA, 23 nt, Leptospira interrogans serovar lai str. 56601
auggaauuuuucaacaacucuaa

SEQ ID NO: 769577 - RNA, 17 nt, Leptospira interrogans serovar lai str. 56601
auggaauuuuuuaauaa

SEQ ID NO: 769578 - RNA, 14 nt, Leptospira interrogans serovar lai str. 56601
augcugauuuuucu

SEQ ID NO: 769579 - RNA, 21 nt, Leptospira interrogans serovar lai str. 56601
augcugauuuuucuuuagaca

SEQ ID NO: 769580 - RNA, 21 nt, Leptospira interrogans serovar lai str. 56601
augcugcaaaucccgaauuua

SEQ ID NO: 769581 - RNA, 22 nt, Leptospira interrogans serovar lai str. 56601
augcugccuaugccccauucuu

SEQ ID NO: 769582 - RNA, 20 nt, Leptospira interrogans serovar lai str. 56601
augcuucauauaauaaaaau

SEQ ID NO: 769583 - RNA, 14 nt, Leptospira interrogans serovar lai str. 56601
augcuuucucuuuu

SEQ ID NO: 769584 - RNA, 19 nt, Leptospira interrogans serovar lai str. 56601
augcuuuccaaaaggaaag

SEQ ID NO: 769585 - RNA, 20 nt, Leptospira interrogans serovar lai str. 56601
augccgaauucacguuauuu

SEQ ID NO: 769586 - RNA, 14 nt, Leptospira interrogans serovar lai str. 56601
augcgaguaauauu

SEQ ID NO: 769587 - RNA, 20 nt, Leptospira interrogans serovar lai str. 56601
augagcauucuugagaaagg

SEQ ID NO: 769588 - RNA, 18 nt, Leptospira interrogans serovar lai str. 56601
augauguagaguaaauuu

SEQ ID NO: 769589 - RNA, 16 nt, Leptospira interrogans serovar lai str. 56601
augauguaggaacuac

SEQ ID NO: 769590 - RNA, 16 nt, Leptospira interrogans serovar lai str. 56601
augauguaaggagcca

SEQ ID NO: 769591 - RNA, 15 nt, Leptospira interrogans serovar lai str. 56601
augaugugggaacua

SEQ ID NO: 769592 - RNA, 13 nt, Leptospira interrogans serovar lai str. 56601
augauuauuacuc

SEQ ID NO: 769593 - RNA, 16 nt, Leptospira interrogans serovar lai str. 56601
augauugauuguuaau

SEQ ID NO: 769594 - RNA, 14 nt, Leptospira interrogans serovar lai str. 56601
augauucuauaaua

SEQ ID NO: 769595 - RNA, 16 nt, Leptospira interrogans serovar lai str. 56601
augauucugaaaaaaa

SEQ ID NO: 769596 - RNA, 17 nt, Leptospira interrogans serovar lai str. 56601
augauucugaaaaaaau

SEQ ID NO: 769597 - RNA, 19 nt, Leptospira interrogans serovar lai str. 56601
augauucugaaaaaaguua

SEQ ID NO: 769598 - RNA, 17 nt, Leptospira interrogans serovar lai str. 56601
augauucauuuaaaaau

SEQ ID NO: 769599 - RNA, 20 nt, Leptospira interrogans serovar lai str. 56601
augauucauuuuucuaaaaa

SEQ ID NO: 769600 - RNA, 22 nt, Leptospira interrogans serovar lai str. 56601
augauucauuuuucuaaaaaaa

SEQ ID NO: 769601 - RNA, 23 nt, Leptospira interrogans serovar lai str. 56601
augauucauuuuucugaaaaaag

SEQ ID NO: 769602 - RNA, 17 nt, Leptospira interrogans serovar lai str. 56601
augauuuaguaaaauuu

SEQ ID NO: 769603 - RNA, 17 nt, Leptospira interrogans serovar lai str. 56601
augauuucuugaucgac

SEQ ID NO: 769604 - RNA, 22 nt, Leptospira interrogans serovar lai str. 56601
augauuugcggaucguuuuuau

SEQ ID NO: 769605 - RNA, 23 nt, Leptospira interrogans serovar lai str. 56601
augauuuuacgaaccaauucuaa

SEQ ID NO: 769606 - RNA, 12 nt, Leptospira interrogans serovar lai str. 56601
augauuuucuuu

SEQ ID NO: 769607 - RNA, 14 nt, Leptospira interrogans serovar lai str. 56601
augauuuuucuaau

SEQ ID NO: 769608 - RNA, 17 nt, Leptospira interrogans serovar lai str. 56601
augauuuuuuaaaauaa

SEQ ID NO: 769609 - RNA, 18 nt, Leptospira interrogans serovar lai str. 56601
augauuuuuuaaaauaac

SEQ ID NO: 769610 - RNA, 21 nt, Leptospira interrogans serovar lai str. 56601
augcaaaaguuuucaaaaaug

SEQ ID NO: 769611 - RNA, 17 nt, Leptospira interrogans serovar lai str. 56601
augcaaaaugcucggua

SEQ ID NO: 769612 - RNA, 16 nt, Leptospira interrogans serovar lai str. 56601
augcaacgaaaucaau

SEQ ID NO: 769613 - RNA, 17 nt, Leptospira interrogans serovar lai str. 56601
augcaacgaaaucaaug

SEQ ID NO: 769614 - RNA, 18 nt, Leptospira interrogans serovar lai str. 56601
augcaacgaaaucaaugu

SEQ ID NO: 769615 - RNA, 13 nt, Leptospira interrogans serovar lai str. 56601
augcaaguucugg

SEQ ID NO: 769616 - RNA, 21 nt, Leptospira interrogans serovar lai str. 56601
augcaaguucuggguaaaaaa

SEQ ID NO: 769617 - RNA, 22 nt, Leptospira interrogans serovar lai str. 56601
augcaaguucuggguaaaaaaa

SEQ ID NO: 769618 - RNA, 23 nt, Leptospira interrogans serovar lai str. 56601
aaaauucguugagacgaaaagac

SEQ ID NO: 769619 - RNA, 22 nt, Leptospira interrogans serovar lai str. 56601
aaaauucgauuucuacaaugga

SEQ ID NO: 769620 - RNA, 23 nt, Leptospira interrogans serovar lai str. 56601
aaaauucuucguuagaagacaau

SEQ ID NO: 769621 - RNA, 14 nt, Leptospira interrogans serovar lai str. 56601
aaaauucuuaaaaa

SEQ ID NO: 769622 - RNA, 16 nt, Leptospira interrogans serovar lai str. 56601
aaaauucuuaaaaaau

SEQ ID NO: 769623 - RNA, 20 nt, Leptospira interrogans serovar lai str. 56601
aaaauucuauaguaaagauu

SEQ ID NO: 769624 - RNA, 22 nt, Leptospira interrogans serovar lai str. 56601
aaaauucuccuccugaaaauuu

SEQ ID NO: 769625 - RNA, 19 nt, Leptospira interrogans serovar lai str. 56601
aaaauucuccucuucacca

SEQ ID NO: 769626 - RNA, 22 nt, Leptospira interrogans serovar lai str. 56601
aaaauuccgaauucuaaaauac

SEQ ID NO: 769627 - RNA, 16 nt, Leptospira interrogans serovar lai str. 56601
aaaauuccuaaaacac

SEQ ID NO: 769628 - RNA, 21 nt, Leptospira interrogans serovar lai str. 56601
aaaauuccuaaaacaccuucu

SEQ ID NO: 769629 - RNA, 19 nt, Leptospira interrogans serovar lai str. 56601
aaaauuauagauaauuuuu

SEQ ID NO: 769630 - RNA, 12 nt, Leptospira interrogans serovar lai str. 56601
aaaauuagaauc

SEQ ID NO: 769631 - RNA, 22 nt, Leptospira interrogans serovar lai str. 56601
aaaauuagaauccuguuugaaa

SEQ ID NO: 769632 - RNA, 16 nt, Leptospira interrogans serovar lai str. 56601
aaaauuagaaucugaa

SEQ ID NO: 769633 - RNA, 19 nt, Leptospira interrogans serovar lai str. 56601
aaaauuagauuuauugaaa

SEQ ID NO: 769634 - RNA, 20 nt, Leptospira interrogans serovar lai str. 56601
aaaauuagauuuauugaaaa

SEQ ID NO: 769635 - RNA, 22 nt, Leptospira interrogans serovar lai str. 56601
aaaauuagauuuauugaaaaau

SEQ ID NO: 769636 - RNA, 16 nt, Leptospira interrogans serovar lai str. 56601
aaaauuagagaaguua

SEQ ID NO: 769637 - RNA, 22 nt, Leptospira interrogans serovar lai str. 56601
aaaauuaggcuuaucuguaaaa

SEQ ID NO: 769638 - RNA, 20 nt, Leptospira interrogans serovar lai str. 56601
aaaauucaacuuguaaaaca

SEQ ID NO: 769639 - RNA, 22 nt, Leptospira interrogans serovar lai str. 56601
aaaauucaacuuguaaaacagc

SEQ ID NO: 769640 - RNA, 14 nt, Leptospira interrogans serovar lai str. 56601
aaaauuauuuugaa

SEQ ID NO: 769641 - RNA, 17 nt, Leptospira interrogans serovar lai str. 56601
aaaauuauuuugaacca

SEQ ID NO: 769642 - RNA, 15 nt, Leptospira interrogans serovar lai str. 56601
aaaauuauaaacaaa

SEQ ID NO: 769643 - RNA, 17 nt, Leptospira interrogans serovar lai str. 56601
aaaauucauauugagau

SEQ ID NO: 769644 - RNA, 19 nt, Leptospira interrogans serovar lai str. 56601
aaaauucauauugagauaa

SEQ ID NO: 769645 - RNA, 21 nt, Leptospira interrogans serovar lai str. 56601
aaaauucaguuucaaacugag

SEQ ID NO: 769646 - RNA, 22 nt, Leptospira interrogans serovar lai str. 56601
cagcguaagguguuuauaaaaa

SEQ ID NO: 769647 - RNA, 13 nt, Leptospira interrogans serovar lai str. 56601
aaaauuaaaaauu

SEQ ID NO: 769648 - RNA, 15 nt, Leptospira interrogans serovar lai str. 56601
aaaauuaaaaauuca

SEQ ID NO: 769649 - RNA, 14 nt, Leptospira interrogans serovar lai str. 56601
aaaauuaaaaaaga

SEQ ID NO: 769650 - RNA, 13 nt, Leptospira interrogans serovar lai str. 56601
aaaauuaaaaaau

SEQ ID NO: 769651 - RNA, 11 nt, Leptospira interrogans serovar lai str. 56601
aaaauuaaaaa

SEQ ID NO: 769652 - RNA, 12 nt, Leptospira interrogans serovar lai str. 56601
aaaauuaaaaaa

SEQ ID NO: 769653 - RNA, 14 nt, Leptospira interrogans serovar lai str. 56601
aaaauguuuuauuu

SEQ ID NO: 769654 - RNA, 16 nt, Leptospira interrogans serovar lai str. 56601
aaaauuaagaaucaau

SEQ ID NO: 769655 - RNA, 15 nt, Leptospira interrogans serovar lai str. 56601
aaaauuaaugaauaa

SEQ ID NO: 769656 - RNA, 14 nt, Leptospira interrogans serovar lai str. 56601
aaaauuaaugagga

SEQ ID NO: 769657 - RNA, 22 nt, Leptospira interrogans serovar lai str. 56601
aaaauuaaugaggagaaaaaau

SEQ ID NO: 769658 - RNA, 15 nt, Leptospira interrogans serovar lai str. 56601
aaaauuaauuccuca

SEQ ID NO: 769659 - RNA, 21 nt, Leptospira interrogans serovar lai str. 56601
aaaauuaauuuuucaacaacu

SEQ ID NO: 769660 - RNA, 15 nt, Leptospira interrogans serovar lai str. 56601
cagccaauuccaaac

SEQ ID NO: 769661 - RNA, 18 nt, Leptospira interrogans serovar lai str. 56601
cagcgaucgugauaagag

SEQ ID NO: 769662 - RNA, 23 nt, Leptospira interrogans serovar lai str. 56601
aaacaaaaucggcgccugcauuu

SEQ ID NO: 769663 - RNA, 16 nt, Leptospira interrogans serovar lai str. 56601
aaacaaagaauaaauc

SEQ ID NO: 769664 - RNA, 18 nt, Leptospira interrogans serovar lai str. 56601
aaacaaagacaaaguauu

SEQ ID NO: 769665 - RNA, 21 nt, Leptospira interrogans serovar lai str. 56601
aaaauuuuuucuuuuuaggaa

SEQ ID NO: 769666 - RNA, 16 nt, Leptospira interrogans serovar lai str. 56601
aaaauuuuuugaaguu

SEQ ID NO: 769667 - RNA, 21 nt, Leptospira interrogans serovar lai str. 56601
aaaauuuuuuugauucaaaaa

SEQ ID NO: 769668 - RNA, 15 nt, Leptospira interrogans serovar lai str. 56601
cagguacuuuauuua

SEQ ID NO: 769669 - RNA, 18 nt, Leptospira interrogans serovar lai str. 56601
cagguacuuuauuuacag

SEQ ID NO: 769670 - RNA, 12 nt, Leptospira interrogans serovar lai str. 56601
cagggaaaaaua

SEQ ID NO: 769671 - RNA, 21 nt, Leptospira interrogans serovar lai str. 56601
aaaauuucccgauucucaaaa

SEQ ID NO: 769672 - RNA, 13 nt, Leptospira interrogans serovar lai str. 56601
caggauuacuaau

SEQ ID NO: 769673 - RNA, 14 nt, Leptospira interrogans serovar lai str. 56601
caggaaacauaaua

SEQ ID NO: 769674 - RNA, 15 nt, Leptospira interrogans serovar lai str. 56601
caggaaacauuauau

SEQ ID NO: 769675 - RNA, 12 nt, Leptospira interrogans serovar lai str. 56601
cagcuucuucca

SEQ ID NO: 769676 - RNA, 14 nt, Leptospira interrogans serovar lai str. 56601
aaaauugaaacaau

SEQ ID NO: 769677 - RNA, 17 nt, Leptospira interrogans serovar lai str. 56601
aaaauucuuaauauacu

SEQ ID NO: 769678 - RNA, 15 nt, Leptospira interrogans serovar lai str. 56601
aaaauugaauauuca

SEQ ID NO: 769679 - RNA, 16 nt, Leptospira interrogans serovar lai str. 56601
aaaauugaauuuaaaa

SEQ ID NO: 769680 - RNA, 16 nt, Leptospira interrogans serovar lai str. 56601
aaaauugacaaagagu

SEQ ID NO: 769681 - RNA, 20 nt, Leptospira interrogans serovar lai str. 56601
aaaauucuuagaguaaaacu

SEQ ID NO: 769682 - RNA, 13 nt, Leptospira interrogans serovar lai str. 56601
cagcuaaaaagaa

SEQ ID NO: 769683 - RNA, 14 nt, Leptospira interrogans serovar lai str. 56601
cagcuaaaaagaaa

SEQ ID NO: 769684 - RNA, 14 nt, Leptospira interrogans serovar lai str. 56601
cagcucuuuugcuu

SEQ ID NO: 769685 - RNA, 17 nt, Leptospira interrogans serovar lai str. 56601
cagcucuuuugcuucuu

SEQ ID NO: 769686 - RNA, 23 nt, Leptospira interrogans serovar lai str. 56601
cagcucuuuugcuucuuuuaaac

SEQ ID NO: 769687 - RNA, 23 nt, Leptospira interrogans serovar lai str. 56601
cagcugaggaguuuuuauaaaau

SEQ ID NO: 769688 - RNA, 14 nt, Leptospira interrogans serovar lai str. 56601
aaaaugcaaauugg

SEQ ID NO: 769689 - RNA, 15 nt, Leptospira interrogans serovar lai str. 56601
aaaaugcaaaaguuu

SEQ ID NO: 769690 - RNA, 16 nt, Leptospira interrogans serovar lai str. 56601
aaaaugcagcaaaacc

SEQ ID NO: 769691 - RNA, 17 nt, Leptospira interrogans serovar lai str. 56601
aaaaugcagcaaaaccu

SEQ ID NO: 769692 - RNA, 21 nt, Leptospira interrogans serovar lai str. 56601
aaaaugcagcaaaaccuucgu

SEQ ID NO: 769693 - RNA, 19 nt, Leptospira interrogans serovar lai str. 56601
aaaaugaguuauaguaaaa

SEQ ID NO: 769694 - RNA, 23 nt, Leptospira interrogans serovar lai str. 56601
cagcaaagaaggcagcuaagaaa

SEQ ID NO: 769695 - RNA, 14 nt, Leptospira interrogans serovar lai str. 56601
aaaaugcucaaaaa

SEQ ID NO: 769696 - RNA, 19 nt, Leptospira interrogans serovar lai str. 56601
aaaaugccgcaccuaauac

SEQ ID NO: 769697 - RNA, 16 nt, Leptospira interrogans serovar lai str. 56601
aaaaucggaauuuuaa

SEQ ID NO: 769698 - RNA, 18 nt, Leptospira interrogans serovar lai str. 56601
aaaaucguaaaaaagaua

SEQ ID NO: 769699 - RNA, 18 nt, Leptospira interrogans serovar lai str. 56601
aaaaucggauaguuuaaa

SEQ ID NO: 769700 - RNA, 15 nt, Leptospira interrogans serovar lai str. 56601
aaaaucuaaauuugu

SEQ ID NO: 769701 - RNA, 19 nt, Leptospira interrogans serovar lai str. 56601
aaaaucuaaauuuguaaua

SEQ ID NO: 769702 - RNA, 13 nt, Leptospira interrogans serovar lai str. 56601
aaaaucuaaaaaa

SEQ ID NO: 769703 - RNA, 14 nt, Leptospira interrogans serovar lai str. 56601
aaaaucuaaaaaaa

SEQ ID NO: 769704 - RNA, 16 nt, Leptospira interrogans serovar lai str. 56601
aaaaucuaaaaaaaau

SEQ ID NO: 769705 - RNA, 14 nt, Leptospira interrogans serovar lai str. 56601
aaaaucuaaaaaga

SEQ ID NO: 769706 - RNA, 14 nt, Leptospira interrogans serovar lai str. 56601
aaaaucuaaaaaua

SEQ ID NO: 769707 - RNA, 14 nt, Leptospira interrogans serovar lai str. 56601
aaaaucuaaaagaa

SEQ ID NO: 769708 - RNA, 16 nt, Leptospira interrogans serovar lai str. 56601
aaaaucucagaaaauu

SEQ ID NO: 769709 - RNA, 20 nt, Leptospira interrogans serovar lai str. 56601
aaaaucucagaaaauuuuac

SEQ ID NO: 769710 - RNA, 21 nt, Leptospira interrogans serovar lai str. 56601
aaaaucuaucucaaaaauacu

SEQ ID NO: 769711 - RNA, 15 nt, Leptospira interrogans serovar lai str. 56601
aaaaucguuuuaaaa

SEQ ID NO: 769712 - RNA, 22 nt, Leptospira interrogans serovar lai str. 56601
cagauucagucucauuucaaau

SEQ ID NO: 769713 - RNA, 15 nt, Leptospira interrogans serovar lai str. 56601
cagauucuaaaaaug

SEQ ID NO: 769714 - RNA, 16 nt, Leptospira interrogans serovar lai str. 56601
aaaaucuucaaguuug

SEQ ID NO: 769715 - RNA, 16 nt, Leptospira interrogans serovar lai str. 56601
aaaaucuuaaauuaga

SEQ ID NO: 769716 - RNA, 18 nt, Leptospira interrogans serovar lai str. 56601
aaaaucuuaauaaaauuu

SEQ ID NO: 769717 - RNA, 19 nt, Leptospira interrogans serovar lai str. 56601
aaaaucuuaauuuguaaga

SEQ ID NO: 769718 - RNA, 15 nt, Leptospira interrogans serovar lai str. 56601
aaaaucuuaaaagaa

SEQ ID NO: 769719 - RNA, 19 nt, Leptospira interrogans serovar lai str. 56601
aaaaucuuaaaagaaaauc

SEQ ID NO: 769720 - RNA, 22 nt, Leptospira interrogans serovar lai str. 56601
aaaaucuuaaaagaaaaucaca

SEQ ID NO: 769721 - RNA, 19 nt, Leptospira interrogans serovar lai str. 56601
aaaaucuggauuuugaucu

SEQ ID NO: 769722 - RNA, 17 nt, Leptospira interrogans serovar lai str. 56601
aaaauggguuuucauuu

SEQ ID NO: 769723 - RNA, 18 nt, Leptospira interrogans serovar lai str. 56601
aaaauguaaaaacuacca

SEQ ID NO: 769724 - RNA, 20 nt, Leptospira interrogans serovar lai str. 56601
aaaauguaaaagcuuauacu

SEQ ID NO: 769725 - RNA, 21 nt, Leptospira interrogans serovar lai str. 56601
aaaaugguuuucuauuuuugg

SEQ ID NO: 769726 - RNA, 19 nt, Leptospira interrogans serovar lai str. 56601
aaaaugguuuuuuaaguuc

SEQ ID NO: 769727 - RNA, 19 nt, Leptospira interrogans serovar lai str. 56601
aaaauguagccaaaaauua

SEQ ID NO: 769728 - RNA, 11 nt, Leptospira interrogans serovar lai str. 56601
aaaauguagga

SEQ ID NO: 769729 - RNA, 17 nt, Leptospira interrogans serovar lai str. 56601
aaaauguacaauuaaag

SEQ ID NO: 769730 - RNA, 18 nt, Leptospira interrogans serovar lai str. 56601
aaaauguauccaauccaa

SEQ ID NO: 769731 - RNA, 21 nt, Leptospira interrogans serovar lai str. 56601
aaaauguauccaauccaaaau

SEQ ID NO: 769732 - RNA, 16 nt, Leptospira interrogans serovar lai str. 56601
aaaauguggaaacuau

SEQ ID NO: 769733 - RNA, 17 nt, Leptospira interrogans serovar lai str. 56601
aaaaugugggaacucuu

SEQ ID NO: 769734 - RNA, 22 nt, Leptospira interrogans serovar lai str. 56601
aaaaugugggaauuacuacaaa

SEQ ID NO: 769735 - RNA, 14 nt, Leptospira interrogans serovar lai str. 56601
aaaauguuaaaaaa

SEQ ID NO: 769736 - RNA, 16 nt, Leptospira interrogans serovar lai str. 56601
aaaauccucaacagau

SEQ ID NO: 769737 - RNA, 19 nt, Leptospira interrogans serovar lai str. 56601
aaaauccucaacagauacg

SEQ ID NO: 769738 - RNA, 20 nt, Leptospira interrogans serovar lai str. 56601
aaaauccccuuucuaauccc

SEQ ID NO: 769739 - RNA, 16 nt, Leptospira interrogans serovar lai str. 56601
aaaauccgaaacguuu

SEQ ID NO: 769740 - RNA, 23 nt, Leptospira interrogans serovar lai str. 56601
aaaauccguagccgcuucaaagu

SEQ ID NO: 769741 - RNA, 15 nt, Leptospira interrogans serovar lai str. 56601
cagaucaauucuuaa

SEQ ID NO: 769742 - RNA, 13 nt, Leptospira interrogans serovar lai str. 56601
aaaaucccagaaa

SEQ ID NO: 769743 - RNA, 18 nt, Leptospira interrogans serovar lai str. 56601
aaaaucccagaaaggaac

SEQ ID NO: 769744 - RNA, 19 nt, Leptospira interrogans serovar lai str. 56601
aaaaucccagaaaggaacu

SEQ ID NO: 769745 - RNA, 20 nt, Leptospira interrogans serovar lai str. 56601
aaaauccccaguauuuugca

SEQ ID NO: 769746 - RNA, 23 nt, Leptospira interrogans serovar lai str. 56601
cagauacucaauuugauaugaau

SEQ ID NO: 769747 - RNA, 23 nt, Leptospira interrogans serovar lai str. 56601
cagagauuguccuccagaaccuc

SEQ ID NO: 769748 - RNA, 14 nt, Leptospira interrogans serovar lai str. 56601
cagagaucauuaau

SEQ ID NO: 769749 - RNA, 17 nt, Leptospira interrogans serovar lai str. 56601
cagagcgauauaauaaa

SEQ ID NO: 769750 - RNA, 19 nt, Leptospira interrogans serovar lai str. 56601
cagagcgauauaauaaaau

SEQ ID NO: 769751 - RNA, 15 nt, Leptospira interrogans serovar lai str. 56601
cagacguauuuuuaa

SEQ ID NO: 769752 - RNA, 12 nt, Leptospira interrogans serovar lai str. 56601
cagacugauucu

SEQ ID NO: 769753 - RNA, 15 nt, Leptospira interrogans serovar lai str. 56601
cagaauuuuuuaaca

SEQ ID NO: 769754 - RNA, 12 nt, Leptospira interrogans serovar lai str. 56601
cagaauuuugaa

SEQ ID NO: 769755 - RNA, 11 nt, Leptospira interrogans serovar lai str. 56601
cagaauaaagu

SEQ ID NO: 769756 - RNA, 13 nt, Leptospira interrogans serovar lai str. 56601
cagaauaaauaca

SEQ ID NO: 769757 - RNA, 13 nt, Leptospira interrogans serovar lai str. 56601
cagaauauuaaau

SEQ ID NO: 769758 - RNA, 14 nt, Leptospira interrogans serovar lai str. 56601
cagaaucaaaggaa

SEQ ID NO: 769759 - RNA, 22 nt, Leptospira interrogans serovar lai str. 56601
cagaaucaaaggaaauaaaaau

SEQ ID NO: 769760 - RNA, 15 nt, Leptospira interrogans serovar lai str. 56601
cagaagcuuuauuaa

SEQ ID NO: 769761 - RNA, 16 nt, Leptospira interrogans serovar lai str. 56601
cagaagggagaauauc

SEQ ID NO: 769762 - RNA, 19 nt, Leptospira interrogans serovar lai str. 56601
cagaacccaauaaaaacua

SEQ ID NO: 769763 - RNA, 14 nt, Leptospira interrogans serovar lai str. 56601
cagaacuauuaucu

SEQ ID NO: 769764 - RNA, 21 nt, Leptospira interrogans serovar lai str. 56601
cagaacgggcuuucuauggau

SEQ ID NO: 769765 - RNA, 18 nt, Leptospira interrogans serovar lai str. 56601
cagaaccucaaagaaauu

SEQ ID NO: 769766 - RNA, 20 nt, Leptospira interrogans serovar lai str. 56601
cagaaccucaaagaaauuuu

SEQ ID NO: 769767 - RNA, 16 nt, Leptospira interrogans serovar lai str. 56601
cagaaccguccaaugu

SEQ ID NO: 769768 - RNA, 21 nt, Leptospira interrogans serovar lai str. 56601
cagaaccuuuaguuuccaaaa

SEQ ID NO: 769769 - RNA, 13 nt, Leptospira interrogans serovar lai str. 56601
cagaaaaaugaau

SEQ ID NO: 769770 - RNA, 11 nt, Leptospira interrogans serovar lai str. 56601
cagaaaaagug

SEQ ID NO: 769771 - RNA, 22 nt, Leptospira interrogans serovar lai str. 56601
cagaaaaauguuaaaaaacuau

SEQ ID NO: 769772 - RNA, 15 nt, Leptospira interrogans serovar lai str. 56601
cagaaaaccaaauaa

SEQ ID NO: 769773 - RNA, 19 nt, Leptospira interrogans serovar lai str. 56601
cagaaaaccaaauaauaaa

SEQ ID NO: 769774 - RNA, 13 nt, Leptospira interrogans serovar lai str. 56601
cacuuuaaaaaug

SEQ ID NO: 769775 - RNA, 20 nt, Leptospira interrogans serovar lai str. 56601
aaaauauccguaaaaccucc

SEQ ID NO: 769776 - RNA, 13 nt, Leptospira interrogans serovar lai str. 56601
cacuuuauaaaag

SEQ ID NO: 769777 - RNA, 15 nt, Leptospira interrogans serovar lai str. 56601
aaaauaucauuuaac

SEQ ID NO: 769778 - RNA, 14 nt, Leptospira interrogans serovar lai str. 56601
aaaauaucuuagaa

SEQ ID NO: 769779 - RNA, 16 nt, Leptospira interrogans serovar lai str. 56601
aaaauaucuuagaaua

SEQ ID NO: 769780 - RNA, 13 nt, Leptospira interrogans serovar lai str. 56601
aaaauaucuaaag

SEQ ID NO: 769781 - RNA, 15 nt, Leptospira interrogans serovar lai str. 56601
aaaauaugauuuaaa

SEQ ID NO: 769782 - RNA, 16 nt, Leptospira interrogans serovar lai str. 56601
aaaauaugauuuaaaa

SEQ ID NO: 769783 - RNA, 17 nt, Leptospira interrogans serovar lai str. 56601
aaaauaugauuuaaaau

SEQ ID NO: 769784 - RNA, 14 nt, Leptospira interrogans serovar lai str. 56601
aaaauauuauauuu

SEQ ID NO: 769785 - RNA, 14 nt, Leptospira interrogans serovar lai str. 56601
cacuuuauaaaagu

SEQ ID NO: 769786 - RNA, 20 nt, Leptospira interrogans serovar lai str. 56601
cacuuuauaaaaguauaaua

SEQ ID NO: 769787 - RNA, 20 nt, Leptospira interrogans serovar lai str. 56601
cacuuuaucuuuucuuaaaa

SEQ ID NO: 769788 - RNA, 12 nt, Leptospira interrogans serovar lai str. 56601
cacuugaaaaau

SEQ ID NO: 769789 - RNA, 16 nt, Leptospira interrogans serovar lai str. 56601
cacuucugguuuuuua

SEQ ID NO: 769790 - RNA, 16 nt, Leptospira interrogans serovar lai str. 56601
cacuuccauuggauuc

SEQ ID NO: 769791 - RNA, 14 nt, Leptospira interrogans serovar lai str. 56601
cacuuccauuuuuu

SEQ ID NO: 769792 - RNA, 18 nt, Leptospira interrogans serovar lai str. 56601
cacuguuucgacguaaaa

SEQ ID NO: 769793 - RNA, 20 nt, Leptospira interrogans serovar lai str. 56601
cacuuagaaagauagagaau

SEQ ID NO: 769794 - RNA, 17 nt, Leptospira interrogans serovar lai str. 56601
cacuauggaauuuuuua

SEQ ID NO: 769795 - RNA, 15 nt, Leptospira interrogans serovar lai str. 56601
cacucaauuuuauau

SEQ ID NO: 769796 - RNA, 19 nt, Leptospira interrogans serovar lai str. 56601
cacucaauuuuauaucaau

SEQ ID NO: 769797 - RNA, 18 nt, Leptospira interrogans serovar lai str. 56601
cacguuaaguaggaacua

SEQ ID NO: 769798 - RNA, 14 nt, Leptospira interrogans serovar lai str. 56601
cacguuaaaauaau

SEQ ID NO: 769799 - RNA, 11 nt, Leptospira interrogans serovar lai str. 56601
aaaauauaaau

SEQ ID NO: 769800 - RNA, 15 nt, Leptospira interrogans serovar lai str. 56601
aaaauauaauauacu

SEQ ID NO: 769801 - RNA, 22 nt, Leptospira interrogans serovar lai str. 56601
aaaauauaauucuguaaaauaa

SEQ ID NO: 769802 - RNA, 14 nt, Leptospira interrogans serovar lai str. 56601
cacguugaauaaga

SEQ ID NO: 769803 - RNA, 18 nt, Leptospira interrogans serovar lai str. 56601
cacuaaguaaaaaugcaa

SEQ ID NO: 769804 - RNA, 11 nt, Leptospira interrogans serovar lai str. 56601
cacuaaaauac

SEQ ID NO: 769805 - RNA, 13 nt, Leptospira interrogans serovar lai str. 56601
cacucuuaaauac

SEQ ID NO: 769806 - RNA, 16 nt, Leptospira interrogans serovar lai str. 56601
cacucuuugacuacuu

SEQ ID NO: 769807 - RNA, 19 nt, Leptospira interrogans serovar lai str. 56601
cacugaauaaaaaguacau

SEQ ID NO: 769808 - RNA, 16 nt, Leptospira interrogans serovar lai str. 56601
cacucccccuuccgau

SEQ ID NO: 769809 - RNA, 15 nt, Leptospira interrogans serovar lai str. 56601
cacugagucaacaaa

SEQ ID NO: 769810 - RNA, 13 nt, Leptospira interrogans serovar lai str. 56601
caucuuaaaaaau

SEQ ID NO: 769811 - RNA, 14 nt, Leptospira interrogans serovar lai str. 56601
caucuuaaaaaaua

SEQ ID NO: 769812 - RNA, 23 nt, Leptospira interrogans serovar lai str. 56601
caucguuuaagaauuuuaaaaaa

SEQ ID NO: 769813 - RNA, 23 nt, Leptospira interrogans serovar lai str. 56601
caucuaaaaaaaacaccgugauc

SEQ ID NO: 769814 - RNA, 18 nt, Leptospira interrogans serovar lai str. 56601
caucguaucuugaauacu

SEQ ID NO: 769815 - RNA, 13 nt, Leptospira interrogans serovar lai str. 56601
caucuaucuuuuc

SEQ ID NO: 769816 - RNA, 19 nt, Leptospira interrogans serovar lai str. 56601
caucuaucuuuucaaaagu

SEQ ID NO: 769817 - RNA, 19 nt, Leptospira interrogans serovar lai str. 56601
caucuacauaaaaaaggaa

SEQ ID NO: 769818 - RNA, 21 nt, Leptospira interrogans serovar lai str. 56601
caucuacagaacccaauaaaa

SEQ ID NO: 769819 - RNA, 18 nt, Leptospira interrogans serovar lai str. 56601
caucucaggcaaaguauc

SEQ ID NO: 769820 - RNA, 20 nt, Leptospira interrogans serovar lai str. 56601
caucucauccuucaucucag

SEQ ID NO: 769821 - RNA, 19 nt, Leptospira interrogans serovar lai str. 56601
caucccuaagacuuggagu

SEQ ID NO: 769822 - RNA, 22 nt, Leptospira interrogans serovar lai str. 56601
caucccuuccuuccgaucccaa

SEQ ID NO: 769823 - RNA, 18 nt, Leptospira interrogans serovar lai str. 56601
cauccgaauugaucucau

SEQ ID NO: 769824 - RNA, 16 nt, Leptospira interrogans serovar lai str. 56601
caucgauuuacuuuaa

SEQ ID NO: 769825 - RNA, 19 nt, Leptospira interrogans serovar lai str. 56601
caucgaauauccuugaagu

SEQ ID NO: 769826 - RNA, 13 nt, Leptospira interrogans serovar lai str. 56601
cauccuucaaacu

SEQ ID NO: 769827 - RNA, 14 nt, Leptospira interrogans serovar lai str. 56601
caucauaaaggugc

SEQ ID NO: 769828 - RNA, 12 nt, Leptospira interrogans serovar lai str. 56601
caucaaaaacaa

SEQ ID NO: 769829 - RNA, 17 nt, Leptospira interrogans serovar lai str. 56601
caucaacucuguaaauu

SEQ ID NO: 769830 - RNA, 22 nt, Leptospira interrogans serovar lai str. 56601
cauauggauuauccaaaacaau

SEQ ID NO: 769831 - RNA, 19 nt, Leptospira interrogans serovar lai str. 56601
cauauuauuuguaguuuca

SEQ ID NO: 769832 - RNA, 17 nt, Leptospira interrogans serovar lai str. 56601
cauauccgaaagauaaa

SEQ ID NO: 769833 - RNA, 13 nt, Leptospira interrogans serovar lai str. 56601
cauaucauauugu

SEQ ID NO: 769834 - RNA, 16 nt, Leptospira interrogans serovar lai str. 56601
cauauacguaaaaaua

SEQ ID NO: 769835 - RNA, 18 nt, Leptospira interrogans serovar lai str. 56601
cauauagaaauuauagua

SEQ ID NO: 769836 - RNA, 15 nt, Leptospira interrogans serovar lai str. 56601
cauauaauaaaaaua

SEQ ID NO: 769837 - RNA, 16 nt, Leptospira interrogans serovar lai str. 56601
cauaguucccacaaau

SEQ ID NO: 769838 - RNA, 17 nt, Leptospira interrogans serovar lai str. 56601
cauacaaugaaaaagca

SEQ ID NO: 769839 - RNA, 24 nt, Leptospira interrogans serovar lai str. 56601
cauacaaugaaaaagcauauagga

SEQ ID NO: 769840 - RNA, 18 nt, Leptospira interrogans serovar lai str. 56601
cauacaaucaaauuuuug

SEQ ID NO: 769841 - RNA, 16 nt, Leptospira interrogans serovar lai str. 56601
cauacauagauaaauc

SEQ ID NO: 769842 - RNA, 16 nt, Leptospira interrogans serovar lai str. 56601
cauaccgaacucacgu

SEQ ID NO: 769843 - RNA, 16 nt, Leptospira interrogans serovar lai str. 56601
cauaaucaaccccaca

SEQ ID NO: 769844 - RNA, 17 nt, Leptospira interrogans serovar lai str. 56601
cauaauccuaugaaaau

SEQ ID NO: 769845 - RNA, 13 nt, Leptospira interrogans serovar lai str. 56601
cauaauaaaguac

SEQ ID NO: 769846 - RNA, 22 nt, Leptospira interrogans serovar lai str. 56601
cauaauaaauuuuucuggaaaa

SEQ ID NO: 769847 - RNA, 19 nt, Leptospira interrogans serovar lai str. 56601
cauaaguuccuuaaaagua

SEQ ID NO: 769848 - RNA, 23 nt, Leptospira interrogans serovar lai str. 56601
cauaaguuccuuaaaaguaucca

SEQ ID NO: 769849 - RNA, 14 nt, Leptospira interrogans serovar lai str. 56601
cauacaaaauuuaa

SEQ ID NO: 769850 - RNA, 15 nt, Leptospira interrogans serovar lai str. 56601
cauacaaaauuuaaa

SEQ ID NO: 769851 - RNA, 19 nt, Leptospira interrogans serovar lai str. 56601
cauacaaaauuuaaaaaug

SEQ ID NO: 769852 - RNA, 23 nt, Leptospira interrogans serovar lai str. 56601
cauaaauucuacaaauucuucuu

SEQ ID NO: 769853 - RNA, 13 nt, Leptospira interrogans serovar lai str. 56601
cauaaaugauaau

SEQ ID NO: 769854 - RNA, 16 nt, Leptospira interrogans serovar lai str. 56601
cauaaaugauacuuug

SEQ ID NO: 769855 - RNA, 19 nt, Leptospira interrogans serovar lai str. 56601
cauaaaggugcaugaaaau

SEQ ID NO: 769856 - RNA, 23 nt, Leptospira interrogans serovar lai str. 56601
cauaaaggugcaugaaaauaaua

SEQ ID NO: 769857 - RNA, 21 nt, Leptospira interrogans serovar lai str. 56601
cauaaaaucguaguuuuacag

SEQ ID NO: 769858 - RNA, 12 nt, Leptospira interrogans serovar lai str. 56601
cauaaaaauaaa

SEQ ID NO: 769859 - RNA, 16 nt, Leptospira interrogans serovar lai str. 56601
cauaaaaauaaagaaa

SEQ ID NO: 769860 - RNA, 18 nt, Leptospira interrogans serovar lai str. 56601
cauaaaacucuaaauuca

SEQ ID NO: 769861 - RNA, 15 nt, Leptospira interrogans serovar lai str. 56601
cauaaaauaaaaaac

SEQ ID NO: 769862 - RNA, 13 nt, Leptospira interrogans serovar lai str. 56601
cauaaaagaaaca

SEQ ID NO: 769863 - RNA, 22 nt, Leptospira interrogans serovar lai str. 56601
cauaacauuuugcuaauaaaua

SEQ ID NO: 769864 - RNA, 13 nt, Leptospira interrogans serovar lai str. 56601
cauaacaaaaaua

SEQ ID NO: 769865 - RNA, 11 nt, Leptospira interrogans serovar lai str. 56601
cauaaauuuug

SEQ ID NO: 769866 - RNA, 13 nt, Leptospira interrogans serovar lai str. 56601
cauaaauuuugug

SEQ ID NO: 769867 - RNA, 15 nt, Leptospira interrogans serovar lai str. 56601
cauaaauuuuuugga

SEQ ID NO: 769868 - RNA, 23 nt, Leptospira interrogans serovar lai str. 56601
cauaaccuuacccacaaauaauu

SEQ ID NO: 769869 - RNA, 20 nt, Leptospira interrogans serovar lai str. 56601
cauaacgugacaaacuaaau

SEQ ID NO: 769870 - RNA, 16 nt, Leptospira interrogans serovar lai str. 56601
cauaacuaauaaaaac

SEQ ID NO: 769871 - RNA, 17 nt, Leptospira interrogans serovar lai str. 56601
cauaacuaauaaaaaca

SEQ ID NO: 769872 - RNA, 16 nt, Leptospira interrogans serovar lai str. 56601
cauaagaccauauuga

SEQ ID NO: 769873 - RNA, 14 nt, Leptospira interrogans serovar lai str. 56601
cauaagcaaaaaua

SEQ ID NO: 769874 - RNA, 15 nt, Leptospira interrogans serovar lai str. 56601
cauaagcaaaaauaa

SEQ ID NO: 769875 - RNA, 15 nt, Leptospira interrogans serovar lai str. 56601
caguuccuaacaauu

SEQ ID NO: 769876 - RNA, 17 nt, Leptospira interrogans serovar lai str. 56601
caguuccuaacaauuuu

SEQ ID NO: 769877 - RNA, 12 nt, Leptospira interrogans serovar lai str. 56601
caguucuacuuu

SEQ ID NO: 769878 - RNA, 14 nt, Leptospira interrogans serovar lai str. 56601
caguucuacuuuau

SEQ ID NO: 769879 - RNA, 19 nt, Leptospira interrogans serovar lai str. 56601
caguucuacuuuauuaaaa

SEQ ID NO: 769880 - RNA, 21 nt, Leptospira interrogans serovar lai str. 56601
caguucuacuuuauuaaaaag

SEQ ID NO: 769881 - RNA, 22 nt, Leptospira interrogans serovar lai str. 56601
caguucuacuuuauuaaaaagu

SEQ ID NO: 769882 - RNA, 11 nt, Leptospira interrogans serovar lai str. 56601
caguucugaga

SEQ ID NO: 769883 - RNA, 19 nt, Leptospira interrogans serovar lai str. 56601
caguuucaaacugagauuu

SEQ ID NO: 769884 - RNA, 14 nt, Leptospira interrogans serovar lai str. 56601
caguuuguuagagu

SEQ ID NO: 769885 - RNA, 21 nt, Leptospira interrogans serovar lai str. 56601
caguuugaauuuuacuaaaaa

SEQ ID NO: 769886 - RNA, 11 nt, Leptospira interrogans serovar lai str. 56601
caguuucuccg

SEQ ID NO: 769887 - RNA, 19 nt, Leptospira interrogans serovar lai str. 56601
cauaaaaaacauaagaaua

SEQ ID NO: 769888 - RNA, 15 nt, Leptospira interrogans serovar lai str. 56601
caguuuuuucguaaa

SEQ ID NO: 769889 - RNA, 18 nt, Leptospira interrogans serovar lai str. 56601
caguuuuuucguaaaaaa

SEQ ID NO: 769890 - RNA, 19 nt, Leptospira interrogans serovar lai str. 56601
caguuuuuucguaaaaaau

SEQ ID NO: 769891 - RNA, 20 nt, Leptospira interrogans serovar lai str. 56601
caguuuuuucguaaaaaaua

SEQ ID NO: 769892 - RNA, 16 nt, Leptospira interrogans serovar lai str. 56601
caguuuuuugagaaac

SEQ ID NO: 769893 - RNA, 18 nt, Leptospira interrogans serovar lai str. 56601
caguuuuuugagaaacaa

SEQ ID NO: 769894 - RNA, 20 nt, Leptospira interrogans serovar lai str. 56601
caguguuuugugauaaaauu

SEQ ID NO: 769895 - RNA, 21 nt, Leptospira interrogans serovar lai str. 56601
caguguuuugugauaaaauua

SEQ ID NO: 769896 - RNA, 18 nt, Leptospira interrogans serovar lai str. 56601
caguguccauuucaauac

SEQ ID NO: 769897 - RNA, 17 nt, Leptospira interrogans serovar lai str. 56601
caguuaauacaaaacuu

SEQ ID NO: 769898 - RNA, 14 nt, Leptospira interrogans serovar lai str. 56601
caguuaauaaauug

SEQ ID NO: 769899 - RNA, 12 nt, Leptospira interrogans serovar lai str. 56601
caguuaaaucac

SEQ ID NO: 769900 - RNA, 16 nt, Leptospira interrogans serovar lai str. 56601
caguuaaauucaucaa

SEQ ID NO: 769901 - RNA, 23 nt, Leptospira interrogans serovar lai str. 56601
caguuaaauucaucaaugaauau

SEQ ID NO: 769902 - RNA, 17 nt, Leptospira interrogans serovar lai str. 56601
caguuaaacuuugaaaa

SEQ ID NO: 769903 - RNA, 22 nt, Leptospira interrogans serovar lai str. 56601
caguuaaacuuugaaaauugug

SEQ ID NO: 769904 - RNA, 16 nt, Leptospira interrogans serovar lai str. 56601
cagugccauuuuucuu

SEQ ID NO: 769905 - RNA, 18 nt, Leptospira interrogans serovar lai str. 56601
ccacuacggaaggaaaaa

SEQ ID NO: 769906 - RNA, 13 nt, Leptospira interrogans serovar lai str. 56601
ccacuauggaauu

SEQ ID NO: 769907 - RNA, 14 nt, Leptospira interrogans serovar lai str. 56601
ccacccaaaaauag

SEQ ID NO: 769908 - RNA, 12 nt, Leptospira interrogans serovar lai str. 56601
ccacccaaaccg

SEQ ID NO: 769909 - RNA, 22 nt, Leptospira interrogans serovar lai str. 56601
ccaauuuugcuucuaaaaagga

SEQ ID NO: 769910 - RNA, 21 nt, Leptospira interrogans serovar lai str. 56601
ccaauuuuuuuguaaaaaaau

SEQ ID NO: 769911 - RNA, 17 nt, Leptospira interrogans serovar lai str. 56601
ccaauguaacggaaaua

SEQ ID NO: 769912 - RNA, 14 nt, Leptospira interrogans serovar lai str. 56601
ccaauauuuaugcu

SEQ ID NO: 769913 - RNA, 20 nt, Leptospira interrogans serovar lai str. 56601
ccaaucauagucauuuugau

SEQ ID NO: 769914 - RNA, 20 nt, Leptospira interrogans serovar lai str. 56601
ccaaucaugaauauuuucca

SEQ ID NO: 769915 - RNA, 23 nt, Leptospira interrogans serovar lai str. 56601
ccaaucaugaauauuuuccaaaa

SEQ ID NO: 769916 - RNA, 15 nt, Leptospira interrogans serovar lai str. 56601
ccaauacaaaacaag

SEQ ID NO: 769917 - RNA, 20 nt, Leptospira interrogans serovar lai str. 56601
ccaaguucgauuaaaauaaa

SEQ ID NO: 769918 - RNA, 13 nt, Leptospira interrogans serovar lai str. 56601
ccaacguaccaaa

SEQ ID NO: 769919 - RNA, 14 nt, Leptospira interrogans serovar lai str. 56601
ccaacguaccaaaa

SEQ ID NO: 769920 - RNA, 15 nt, Leptospira interrogans serovar lai str. 56601
ccaaggauaacccuc

SEQ ID NO: 769921 - RNA, 14 nt, Leptospira interrogans serovar lai str. 56601
ccaagcaauucuaa

SEQ ID NO: 769922 - RNA, 16 nt, Leptospira interrogans serovar lai str. 56601
ccaagcaauucuaaga

SEQ ID NO: 769923 - RNA, 21 nt, Leptospira interrogans serovar lai str. 56601
ccaagcaauucuaagaccuaa

SEQ ID NO: 769924 - RNA, 21 nt, Leptospira interrogans serovar lai str. 56601
ccaagaguguucaucuucucg

SEQ ID NO: 769925 - RNA, 12 nt, Leptospira interrogans serovar lai str. 56601
ccaagacgucua

SEQ ID NO: 769926 - RNA, 16 nt, Leptospira interrogans serovar lai str. 56601
ccaacuuacauuaaau

SEQ ID NO: 769927 - RNA, 18 nt, Leptospira interrogans serovar lai str. 56601
ccaacuuacauuaaauaa

SEQ ID NO: 769928 - RNA, 23 nt, Leptospira interrogans serovar lai str. 56601
ccaaaucgcugguuuuauuucug

SEQ ID NO: 769929 - RNA, 20 nt, Leptospira interrogans serovar lai str. 56601
ccaaauuugcgaaaaaaaua

SEQ ID NO: 769930 - RNA, 21 nt, Leptospira interrogans serovar lai str. 56601
ccaaauuugcgaaaaaaauaa

SEQ ID NO: 769931 - RNA, 13 nt, Leptospira interrogans serovar lai str. 56601
ccaaauuuuuaga

SEQ ID NO: 769932 - RNA, 16 nt, Leptospira interrogans serovar lai str. 56601
ccaacagcuauaaucu

SEQ ID NO: 769933 - RNA, 16 nt, Leptospira interrogans serovar lai str. 56601
ccaaagcuuguuucaa

SEQ ID NO: 769934 - RNA, 23 nt, Leptospira interrogans serovar lai str. 56601
ccaaagcuuguuucaaaaguuag

SEQ ID NO: 769935 - RNA, 22 nt, Leptospira interrogans serovar lai str. 56601
ccaaaggauaaucuaccccauc

SEQ ID NO: 769936 - RNA, 22 nt, Leptospira interrogans serovar lai str. 56601
ccaaagucgcccaaaccccagu

SEQ ID NO: 769937 - RNA, 20 nt, Leptospira interrogans serovar lai str. 56601
cauuuuauuuuuacaaaaaa

SEQ ID NO: 769938 - RNA, 20 nt, Leptospira interrogans serovar lai str. 56601
cauuuuauuuuuuaugaaaa

SEQ ID NO: 769939 - RNA, 13 nt, Leptospira interrogans serovar lai str. 56601
cauuuuauuaaaa

SEQ ID NO: 769940 - RNA, 16 nt, Leptospira interrogans serovar lai str. 56601
cauuuuauuaaaaaua

SEQ ID NO: 769941 - RNA, 17 nt, Leptospira interrogans serovar lai str. 56601
cauuuuauuauaaauuu

SEQ ID NO: 769942 - RNA, 19 nt, Leptospira interrogans serovar lai str. 56601
cauuuuauuauaaauuuau

SEQ ID NO: 769943 - RNA, 22 nt, Leptospira interrogans serovar lai str. 56601
cauuuuauuauaaauuuauaaa

SEQ ID NO: 769944 - RNA, 20 nt, Leptospira interrogans serovar lai str. 56601
cauuuucauaauaaauuuuu

SEQ ID NO: 769945 - RNA, 22 nt, Leptospira interrogans serovar lai str. 56601
cauuuucauaauaaauuuuucu

SEQ ID NO: 769946 - RNA, 18 nt, Leptospira interrogans serovar lai str. 56601
cauuuucauauauaguuu

SEQ ID NO: 769947 - RNA, 12 nt, Leptospira interrogans serovar lai str. 56601
cauuuuccuuuu

SEQ ID NO: 769948 - RNA, 15 nt, Leptospira interrogans serovar lai str. 56601
cauuuuccuuuuucc

SEQ ID NO: 769949 - RNA, 23 nt, Leptospira interrogans serovar lai str. 56601
cauuuucgaaauuuuacaguaaa

SEQ ID NO: 769950 - RNA, 14 nt, Leptospira interrogans serovar lai str. 56601
cauuuccacauucc

SEQ ID NO: 769951 - RNA, 18 nt, Leptospira interrogans serovar lai str. 56601
cauuuccacauuccguca

SEQ ID NO: 769952 - RNA, 12 nt, Leptospira interrogans serovar lai str. 56601
cauuuccaucuu

SEQ ID NO: 769953 - RNA, 14 nt, Leptospira interrogans serovar lai str. 56601
cauuuccaucuuua

SEQ ID NO: 769954 - RNA, 18 nt, Leptospira interrogans serovar lai str. 56601
cauuuccauaacagaauu

SEQ ID NO: 769955 - RNA, 17 nt, Leptospira interrogans serovar lai str. 56601
cauuucauauccaaaac

SEQ ID NO: 769956 - RNA, 13 nt, Leptospira interrogans serovar lai str. 56601
cauuuauuuuuua

SEQ ID NO: 769957 - RNA, 20 nt, Leptospira interrogans serovar lai str. 56601
cauuuauuuuuuacgaaaaa

SEQ ID NO: 769958 - RNA, 14 nt, Leptospira interrogans serovar lai str. 56601
cauuucaaauuuau

SEQ ID NO: 769959 - RNA, 16 nt, Leptospira interrogans serovar lai str. 56601
cauuucaaguuuucuu

SEQ ID NO: 769960 - RNA, 22 nt, Leptospira interrogans serovar lai str. 56601
cauuuacgggagaccucuaacu

SEQ ID NO: 769961 - RNA, 18 nt, Leptospira interrogans serovar lai str. 56601
cauuuacucaaauuaacu

SEQ ID NO: 769962 - RNA, 19 nt, Leptospira interrogans serovar lai str. 56601
cauuuagagacgaauuuuu

SEQ ID NO: 769963 - RNA, 18 nt, Leptospira interrogans serovar lai str. 56601
cauuuagcaauuugugaa

SEQ ID NO: 769964 - RNA, 19 nt, Leptospira interrogans serovar lai str. 56601
cauuuagaagauugaggau

SEQ ID NO: 769965 - RNA, 14 nt, Leptospira interrogans serovar lai str. 56601
cauuuguagagauu

SEQ ID NO: 769966 - RNA, 22 nt, Leptospira interrogans serovar lai str. 56601
cauuugugcuauauucaaaaaa

SEQ ID NO: 769967 - RNA, 18 nt, Leptospira interrogans serovar lai str. 56601
cauuugguaauuugugaa

SEQ ID NO: 769968 - RNA, 16 nt, Leptospira interrogans serovar lai str. 56601
cauuuguuucuauuuu

SEQ ID NO: 769969 - RNA, 18 nt, Leptospira interrogans serovar lai str. 56601
cauuuguuucuauuuuau

SEQ ID NO: 769970 - RNA, 21 nt, Leptospira interrogans serovar lai str. 56601
cauuuguuucuauuuuaugga

SEQ ID NO: 769971 - RNA, 13 nt, Leptospira interrogans serovar lai str. 56601
cauuuguuuuuua

SEQ ID NO: 769972 - RNA, 19 nt, Leptospira interrogans serovar lai str. 56601
cauuuuacagaauauuaaa

SEQ ID NO: 769973 - RNA, 16 nt, Leptospira interrogans serovar lai str. 56601
cauuuuagagcagaac

SEQ ID NO: 769974 - RNA, 17 nt, Leptospira interrogans serovar lai str. 56601
cauuuuaggaaucaaga

SEQ ID NO: 769975 - RNA, 12 nt, Leptospira interrogans serovar lai str. 56601
cauuucuaaaau

SEQ ID NO: 769976 - RNA, 15 nt, Leptospira interrogans serovar lai str. 56601
cauuuccuccaaaca

SEQ ID NO: 769977 - RNA, 14 nt, Leptospira interrogans serovar lai str. 56601
cauuugauuaaaaa

SEQ ID NO: 769978 - RNA, 17 nt, Leptospira interrogans serovar lai str. 56601
cauuugauuaaaaauuu

SEQ ID NO: 769979 - RNA, 19 nt, Leptospira interrogans serovar lai str. 56601
cauuggauucugcucuucu

SEQ ID NO: 769980 - RNA, 14 nt, Leptospira interrogans serovar lai str. 56601
cauuggaguuuuuu

SEQ ID NO: 769981 - RNA, 17 nt, Leptospira interrogans serovar lai str. 56601
cauuggaguuuuuuaaa

SEQ ID NO: 769982 - RNA, 18 nt, Leptospira interrogans serovar lai str. 56601
cauuuaacccggauuugu

SEQ ID NO: 769983 - RNA, 12 nt, Leptospira interrogans serovar lai str. 56601
cauuuaaaacuc

SEQ ID NO: 769984 - RNA, 13 nt, Leptospira interrogans serovar lai str. 56601
cauuuaaacuuuu

SEQ ID NO: 769985 - RNA, 13 nt, Leptospira interrogans serovar lai str. 56601
cauugucuauuuu

SEQ ID NO: 769986 - RNA, 19 nt, Leptospira interrogans serovar lai str. 56601
cauugugaauguauauuuu

SEQ ID NO: 769987 - RNA, 17 nt, Leptospira interrogans serovar lai str. 56601
cauuguguuuuuuaaca

SEQ ID NO: 769988 - RNA, 13 nt, Leptospira interrogans serovar lai str. 56601
cauucuaagaucu

SEQ ID NO: 769989 - RNA, 16 nt, Leptospira interrogans serovar lai str. 56601
cauugauuuucauuuu

SEQ ID NO: 769990 - RNA, 18 nt, Leptospira interrogans serovar lai str. 56601
cauucaaaauaaauaaua

SEQ ID NO: 769991 - RNA, 19 nt, Leptospira interrogans serovar lai str. 56601
cauuauuuauaauuuuaua

SEQ ID NO: 769992 - RNA, 13 nt, Leptospira interrogans serovar lai str. 56601
cauucaagguaau

SEQ ID NO: 769993 - RNA, 18 nt, Leptospira interrogans serovar lai str. 56601
cauucaaaaaguuuuaua

SEQ ID NO: 769994 - RNA, 22 nt, Leptospira interrogans serovar lai str. 56601
cauucauccuaagaaucaaauc

SEQ ID NO: 769995 - RNA, 19 nt, Leptospira interrogans serovar lai str. 56601
cauuccgcaaaaauuccuu

SEQ ID NO: 769996 - RNA, 17 nt, Leptospira interrogans serovar lai str. 56601
cauuccuauaaauaaau

SEQ ID NO: 769997 - RNA, 22 nt, Leptospira interrogans serovar lai str. 56601
cauucgauacugcgauuucugu

SEQ ID NO: 769998 - RNA, 21 nt, Leptospira interrogans serovar lai str. 56601
caugucuucuaaaucuaauuc

SEQ ID NO: 769999 - RNA, 17 nt, Leptospira interrogans serovar lai str. 56601
cauggcuuugaaaaagg

SEQ ID NO: 770000 - RNA, 21 nt, Leptospira interrogans serovar lai str. 56601
caugcuguaguuuauuuuucu

SEQ ID NO: 770001 - RNA, 14 nt, Leptospira interrogans serovar lai str. 56601
cgaauaagaaauuc

SEQ ID NO: 770002 - RNA, 19 nt, Leptospira interrogans serovar lai str. 56601
cgaaccaauucuaaaauca

SEQ ID NO: 770003 - RNA, 19 nt, Leptospira interrogans serovar lai str. 56601
cgaacccagucuucuugua

SEQ ID NO: 770004 - RNA, 22 nt, Leptospira interrogans serovar lai str. 56601
cgaacacaaauucuaaaguugu

SEQ ID NO: 770005 - RNA, 16 nt, Leptospira interrogans serovar lai str. 56601
cgaacacauucuaaaa

SEQ ID NO: 770006 - RNA, 19 nt, Leptospira interrogans serovar lai str. 56601
cgaacacauucuaaaauua

SEQ ID NO: 770007 - RNA, 16 nt, Leptospira interrogans serovar lai str. 56601
cgaaauuuuacaguaa

SEQ ID NO: 770008 - RNA, 16 nt, Leptospira interrogans serovar lai str. 56601
cgaaauuuuuuuaaaa

SEQ ID NO: 770009 - RNA, 13 nt, Leptospira interrogans serovar lai str. 56601
cgaacaaauucua

SEQ ID NO: 770010 - RNA, 12 nt, Leptospira interrogans serovar lai str. 56601
cgaaauauauua

SEQ ID NO: 770011 - RNA, 20 nt, Leptospira interrogans serovar lai str. 56601
cgaaaguaaauggauaaauu

SEQ ID NO: 770012 - RNA, 17 nt, Leptospira interrogans serovar lai str. 56601
cgaaaguuuacacaaca

SEQ ID NO: 770013 - RNA, 15 nt, Leptospira interrogans serovar lai str. 56601
cgaaauuauacaaaa

SEQ ID NO: 770014 - RNA, 16 nt, Leptospira interrogans serovar lai str. 56601
cgaaauuauacaaaac

SEQ ID NO: 770015 - RNA, 15 nt, Leptospira interrogans serovar lai str. 56601
cgaaauaucguucua

SEQ ID NO: 770016 - RNA, 21 nt, Leptospira interrogans serovar lai str. 56601
cgaaaauguagccaaaaauua

SEQ ID NO: 770017 - RNA, 13 nt, Leptospira interrogans serovar lai str. 56601
cgaaaauucugaa

SEQ ID NO: 770018 - RNA, 17 nt, Leptospira interrogans serovar lai str. 56601
cgaaaauucugaaagag

SEQ ID NO: 770019 - RNA, 19 nt, Leptospira interrogans serovar lai str. 56601
cgaaaaugcagcaaaaccu

SEQ ID NO: 770020 - RNA, 20 nt, Leptospira interrogans serovar lai str. 56601
cgaaaaucucagaaaauuuu

SEQ ID NO: 770021 - RNA, 13 nt, Leptospira interrogans serovar lai str. 56601
cgaaacaaaauca

SEQ ID NO: 770022 - RNA, 14 nt, Leptospira interrogans serovar lai str. 56601
cgaaacaaaaucaa

SEQ ID NO: 770023 - RNA, 14 nt, Leptospira interrogans serovar lai str. 56601
cgaaacuuuaauuu

SEQ ID NO: 770024 - RNA, 15 nt, Leptospira interrogans serovar lai str. 56601
cgaaagaauuuuugg

SEQ ID NO: 770025 - RNA, 16 nt, Leptospira interrogans serovar lai str. 56601
cgaaagagggaaugua

SEQ ID NO: 770026 - RNA, 15 nt, Leptospira interrogans serovar lai str. 56601
cgaaaccucaaaaaa

SEQ ID NO: 770027 - RNA, 15 nt, Leptospira interrogans serovar lai str. 56601
ccuuuguuuccucuu

SEQ ID NO: 770028 - RNA, 22 nt, Leptospira interrogans serovar lai str. 56601
ccuuugugacacugaaaacauu

SEQ ID NO: 770029 - RNA, 16 nt, Leptospira interrogans serovar lai str. 56601
ccuuugaauaaaaccg

SEQ ID NO: 770030 - RNA, 19 nt, Leptospira interrogans serovar lai str. 56601
ccuuuuagauaaauacauc

SEQ ID NO: 770031 - RNA, 17 nt, Leptospira interrogans serovar lai str. 56601
cgaaaacgauuuuucaa

SEQ ID NO: 770032 - RNA, 17 nt, Leptospira interrogans serovar lai str. 56601
cgaaaagguuaaaaauu

SEQ ID NO: 770033 - RNA, 19 nt, Leptospira interrogans serovar lai str. 56601
cgaaaagguuaaaaauuua

SEQ ID NO: 770034 - RNA, 19 nt, Leptospira interrogans serovar lai str. 56601
cgaaaaguuugguccuuug

SEQ ID NO: 770035 - RNA, 13 nt, Leptospira interrogans serovar lai str. 56601
cgaaaaaaauaac

SEQ ID NO: 770036 - RNA, 15 nt, Leptospira interrogans serovar lai str. 56601
cgaaaaauuccacuu

SEQ ID NO: 770037 - RNA, 23 nt, Leptospira interrogans serovar lai str. 56601
cgaaaacagaucaagaauuaauu

SEQ ID NO: 770038 - RNA, 19 nt, Leptospira interrogans serovar lai str. 56601
cgaaaaccaaccucucacu

SEQ ID NO: 770039 - RNA, 23 nt, Leptospira interrogans serovar lai str. 56601
cgaaaaccaaccucucacuucuu

SEQ ID NO: 770040 - RNA, 21 nt, Leptospira interrogans serovar lai str. 56601
ccuuuucgacuauuucuucca

SEQ ID NO: 770041 - RNA, 17 nt, Leptospira interrogans serovar lai str. 56601
ccuuuucuagacuuucu

SEQ ID NO: 770042 - RNA, 17 nt, Leptospira interrogans serovar lai str. 56601
ccuuuuuccggaauacu

SEQ ID NO: 770043 - RNA, 21 nt, Leptospira interrogans serovar lai str. 56601
ccuuuuuccggaauacuuuuc

SEQ ID NO: 770044 - RNA, 16 nt, Leptospira interrogans serovar lai str. 56601
ccuuuuuuacugaucu

SEQ ID NO: 770045 - RNA, 18 nt, Leptospira interrogans serovar lai str. 56601
ccuuuuuuucuuuuaaaa

SEQ ID NO: 770046 - RNA, 23 nt, Leptospira interrogans serovar lai str. 56601
ccuuuuuuguaaaggaagauaaa

SEQ ID NO: 770047 - RNA, 13 nt, Leptospira interrogans serovar lai str. 56601
ccuucucuuuuaa

SEQ ID NO: 770048 - RNA, 17 nt, Leptospira interrogans serovar lai str. 56601
ccuucucgcaacggauu

SEQ ID NO: 770049 - RNA, 19 nt, Leptospira interrogans serovar lai str. 56601
ccuucguuuuuguuuucuu

SEQ ID NO: 770050 - RNA, 20 nt, Leptospira interrogans serovar lai str. 56601
ccuuccgauucacuuccauu

SEQ ID NO: 770051 - RNA, 15 nt, Leptospira interrogans serovar lai str. 56601
ccuuccaaguuuuug

SEQ ID NO: 770052 - RNA, 16 nt, Leptospira interrogans serovar lai str. 56601
ccuuccaaguuuuugu

SEQ ID NO: 770053 - RNA, 19 nt, Leptospira interrogans serovar lai str. 56601
ccuuccaaagauuuuaaaa

SEQ ID NO: 770054 - RNA, 20 nt, Leptospira interrogans serovar lai str. 56601
ccuuccaaagauuuuaaaaa

SEQ ID NO: 770055 - RNA, 16 nt, Leptospira interrogans serovar lai str. 56601
ccuuagucugaaauaa

SEQ ID NO: 770056 - RNA, 20 nt, Leptospira interrogans serovar lai str. 56601
ccuuaaauauaucuucuuug

SEQ ID NO: 770057 - RNA, 20 nt, Leptospira interrogans serovar lai str. 56601
ccuuaagacccuaaaaaauu

SEQ ID NO: 770058 - RNA, 21 nt, Leptospira interrogans serovar lai str. 56601
ccuuagacgccauguuuuuaa

SEQ ID NO: 770059 - RNA, 17 nt, Leptospira interrogans serovar lai str. 56601
ccugguuucaaaaaauc

SEQ ID NO: 770060 - RNA, 21 nt, Leptospira interrogans serovar lai str. 56601
ccugcuaacugauuauaaaaa

SEQ ID NO: 770061 - RNA, 18 nt, Leptospira interrogans serovar lai str. 56601
ccugcaaauuuuuuucua

SEQ ID NO: 770062 - RNA, 21 nt, Leptospira interrogans serovar lai str. 56601
ccugauuuggaaucugcaucu

SEQ ID NO: 770063 - RNA, 12 nt, Leptospira interrogans serovar lai str. 56601
ccugauuuuucc

SEQ ID NO: 770064 - RNA, 18 nt, Leptospira interrogans serovar lai str. 56601
ccugauuuuuccauaaaa

SEQ ID NO: 770065 - RNA, 19 nt, Leptospira interrogans serovar lai str. 56601
ccugauuuuuccauaaaaa

SEQ ID NO: 770066 - RNA, 22 nt, Leptospira interrogans serovar lai str. 56601
ccugauuuuucuguaaaaauaa

SEQ ID NO: 770067 - RNA, 17 nt, Leptospira interrogans serovar lai str. 56601
ccucuucuagcaaucuu

SEQ ID NO: 770068 - RNA, 16 nt, Leptospira interrogans serovar lai str. 56601
ccucuucugauuguaa

SEQ ID NO: 770069 - RNA, 18 nt, Leptospira interrogans serovar lai str. 56601
ccucuucugauuguaaca

SEQ ID NO: 770070 - RNA, 17 nt, Leptospira interrogans serovar lai str. 56601
ccugaaaauuuuccuuu

SEQ ID NO: 770071 - RNA, 21 nt, Leptospira interrogans serovar lai str. 56601
ccugauaaauuccguaaaauu

SEQ ID NO: 770072 - RNA, 19 nt, Leptospira interrogans serovar lai str. 56601
ccugacugcccguuucaau

SEQ ID NO: 770073 - RNA, 16 nt, Leptospira interrogans serovar lai str. 56601
ccucucgccaaaauau

SEQ ID NO: 770074 - RNA, 18 nt, Leptospira interrogans serovar lai str. 56601
ccucucuuuuaauuucag

SEQ ID NO: 770075 - RNA, 15 nt, Leptospira interrogans serovar lai str. 56601
ccucugauaaaauca

SEQ ID NO: 770076 - RNA, 18 nt, Leptospira interrogans serovar lai str. 56601
ccucuaugaaacuuaguu

SEQ ID NO: 770077 - RNA, 14 nt, Leptospira interrogans serovar lai str. 56601
ccucuauggaauuu

SEQ ID NO: 770078 - RNA, 23 nt, Leptospira interrogans serovar lai str. 56601
ccucuacaaguucauaagauugg

SEQ ID NO: 770079 - RNA, 14 nt, Leptospira interrogans serovar lai str. 56601
ccucuauaaaugaa

SEQ ID NO: 770080 - RNA, 12 nt, Leptospira interrogans serovar lai str. 56601
ccucuauaaaau

SEQ ID NO: 770081 - RNA, 14 nt, Leptospira interrogans serovar lai str. 56601
ccucuauaaaaucu

SEQ ID NO: 770082 - RNA, 19 nt, Leptospira interrogans serovar lai str. 56601
ccucuauaaaaucuaaaaa

SEQ ID NO: 770083 - RNA, 20 nt, Leptospira interrogans serovar lai str. 56601
ccucuauaaaaucuaaaaaa

SEQ ID NO: 770084 - RNA, 12 nt, Leptospira interrogans serovar lai str. 56601
ccuccuccuucu

SEQ ID NO: 770085 - RNA, 13 nt, Leptospira interrogans serovar lai str. 56601
ccuccucuaaaau

SEQ ID NO: 770086 - RNA, 18 nt, Leptospira interrogans serovar lai str. 56601
ccucguacuaauucuuuu

SEQ ID NO: 770087 - RNA, 16 nt, Leptospira interrogans serovar lai str. 56601
ccucauaucaaaaauu

SEQ ID NO: 770088 - RNA, 17 nt, Leptospira interrogans serovar lai str. 56601
ccucauaucaaaaauug

SEQ ID NO: 770089 - RNA, 19 nt, Leptospira interrogans serovar lai str. 56601
ccuauucaguuuccacucu

SEQ ID NO: 770090 - RNA, 12 nt, Leptospira interrogans serovar lai str. 56601
ccuauguuucuu

SEQ ID NO: 770091 - RNA, 15 nt, Leptospira interrogans serovar lai str. 56601
aaacgauuaauccau

SEQ ID NO: 770092 - RNA, 17 nt, Leptospira interrogans serovar lai str. 56601
aaacgauuaauccauuc

SEQ ID NO: 770093 - RNA, 13 nt, Leptospira interrogans serovar lai str. 56601
aaacgauuuuuca

SEQ ID NO: 770094 - RNA, 21 nt, Leptospira interrogans serovar lai str. 56601
aaacgauugauugaagcaguu

SEQ ID NO: 770095 - RNA, 20 nt, Leptospira interrogans serovar lai str. 56601
aaacgaaauuauacaaaacu

SEQ ID NO: 770096 - RNA, 13 nt, Leptospira interrogans serovar lai str. 56601
aaaccuuccuuug

SEQ ID NO: 770097 - RNA, 23 nt, Leptospira interrogans serovar lai str. 56601
aaaccuuuauuuaauaaaauuuu

SEQ ID NO: 770098 - RNA, 22 nt, Leptospira interrogans serovar lai str. 56601
aaaccuuuccccccacccaaaa

SEQ ID NO: 770099 - RNA, 13 nt, Leptospira interrogans serovar lai str. 56601
ccgucauuuacuc

SEQ ID NO: 770100 - RNA, 18 nt, Leptospira interrogans serovar lai str. 56601
ccguauccuuaaaaugac

SEQ ID NO: 770101 - RNA, 13 nt, Leptospira interrogans serovar lai str. 56601
ccguaauaaauuc

SEQ ID NO: 770102 - RNA, 13 nt, Leptospira interrogans serovar lai str. 56601
ccguaaaauucaa

SEQ ID NO: 770103 - RNA, 16 nt, Leptospira interrogans serovar lai str. 56601
ccguaaauauuuuuuu

SEQ ID NO: 770104 - RNA, 19 nt, Leptospira interrogans serovar lai str. 56601
ccguaaauauuuuuuuuaa

SEQ ID NO: 770105 - RNA, 22 nt, Leptospira interrogans serovar lai str. 56601
ccguaaauauuuuuuuuaauca

SEQ ID NO: 770106 - RNA, 18 nt, Leptospira interrogans serovar lai str. 56601
ccggucucgaauuguuuu

SEQ ID NO: 770107 - RNA, 17 nt, Leptospira interrogans serovar lai str. 56601
aaaccucgucuaucuuu

SEQ ID NO: 770108 - RNA, 14 nt, Leptospira interrogans serovar lai str. 56601
aaaccucaaaaaau

SEQ ID NO: 770109 - RNA, 18 nt, Leptospira interrogans serovar lai str. 56601
aaaccuggauuugucucu

SEQ ID NO: 770110 - RNA, 22 nt, Leptospira interrogans serovar lai str. 56601
aaaccgcuuuuaguuuuuccug

SEQ ID NO: 770111 - RNA, 18 nt, Leptospira interrogans serovar lai str. 56601
aaaccgguaaaaaguaaa

SEQ ID NO: 770112 - RNA, 15 nt, Leptospira interrogans serovar lai str. 56601
ccggcgcuguaauga

SEQ ID NO: 770113 - RNA, 12 nt, Leptospira interrogans serovar lai str. 56601
ccgcugaaaaaa

SEQ ID NO: 770114 - RNA, 17 nt, Leptospira interrogans serovar lai str. 56601
ccgcugaaaaaaaaauu

SEQ ID NO: 770115 - RNA, 21 nt, Leptospira interrogans serovar lai str. 56601
ccggaauacuuuucuucccag

SEQ ID NO: 770116 - RNA, 15 nt, Leptospira interrogans serovar lai str. 56601
ccggaauuuccaaac

SEQ ID NO: 770117 - RNA, 19 nt, Leptospira interrogans serovar lai str. 56601
ccgcuauggaauuuuucaa

SEQ ID NO: 770118 - RNA, 11 nt, Leptospira interrogans serovar lai str. 56601
ccgccuuucca

SEQ ID NO: 770119 - RNA, 19 nt, Leptospira interrogans serovar lai str. 56601
aaacccuuucuuugaagaa

SEQ ID NO: 770120 - RNA, 19 nt, Leptospira interrogans serovar lai str. 56601
aaacccugccaaaauccca

SEQ ID NO: 770121 - RNA, 15 nt, Leptospira interrogans serovar lai str. 56601
aaaccgaucuuaaaa

SEQ ID NO: 770122 - RNA, 14 nt, Leptospira interrogans serovar lai str. 56601
aaaccgauuuuaau

SEQ ID NO: 770123 - RNA, 14 nt, Leptospira interrogans serovar lai str. 56601
aaaccgauuuuccc

SEQ ID NO: 770124 - RNA, 15 nt, Leptospira interrogans serovar lai str. 56601
ccgaugcauugaguu

SEQ ID NO: 770125 - RNA, 16 nt, Leptospira interrogans serovar lai str. 56601
ccgaucugugauugaa

SEQ ID NO: 770126 - RNA, 13 nt, Leptospira interrogans serovar lai str. 56601
ccgcaccuaauac

SEQ ID NO: 770127 - RNA, 22 nt, Leptospira interrogans serovar lai str. 56601
ccgauaaagaaaguaauuuuga

SEQ ID NO: 770128 - RNA, 20 nt, Leptospira interrogans serovar lai str. 56601
aaaccacccccaccaaaaau

SEQ ID NO: 770129 - RNA, 14 nt, Leptospira interrogans serovar lai str. 56601
ccgacggcuucaau

SEQ ID NO: 770130 - RNA, 17 nt, Leptospira interrogans serovar lai str. 56601
ccgaauucuaaaauacu

SEQ ID NO: 770131 - RNA, 11 nt, Leptospira interrogans serovar lai str. 56601
ccgaaggaauu

SEQ ID NO: 770132 - RNA, 16 nt, Leptospira interrogans serovar lai str. 56601
aaaccaagaauagauu

SEQ ID NO: 770133 - RNA, 12 nt, Leptospira interrogans serovar lai str. 56601
aaaccaauuccg

SEQ ID NO: 770134 - RNA, 14 nt, Leptospira interrogans serovar lai str. 56601
aaacauuuugccuu

SEQ ID NO: 770135 - RNA, 21 nt, Leptospira interrogans serovar lai str. 56601
aaacaguauauuauaauuuua

SEQ ID NO: 770136 - RNA, 18 nt, Leptospira interrogans serovar lai str. 56601
aaacagucgcuaaacuca

SEQ ID NO: 770137 - RNA, 16 nt, Leptospira interrogans serovar lai str. 56601
aaacaugaagaagcua

SEQ ID NO: 770138 - RNA, 12 nt, Leptospira interrogans serovar lai str. 56601
ccgaaccuuacc

SEQ ID NO: 770139 - RNA, 14 nt, Leptospira interrogans serovar lai str. 56601
ccgaaccuuaccac

SEQ ID NO: 770140 - RNA, 20 nt, Leptospira interrogans serovar lai str. 56601
aaacagagauaggaauguuu

SEQ ID NO: 770141 - RNA, 23 nt, Leptospira interrogans serovar lai str. 56601
aaacagagcuuuacaauaaaaau

SEQ ID NO: 770142 - RNA, 13 nt, Leptospira interrogans serovar lai str. 56601
ccgaaauagaaau

SEQ ID NO: 770143 - RNA, 15 nt, Leptospira interrogans serovar lai str. 56601
ccgaaauuuuuuuaa

SEQ ID NO: 770144 - RNA, 13 nt, Leptospira interrogans serovar lai str. 56601
cccuucuccugca

SEQ ID NO: 770145 - RNA, 14 nt, Leptospira interrogans serovar lai str. 56601
aaacacuuugagaa

SEQ ID NO: 770146 - RNA, 20 nt, Leptospira interrogans serovar lai str. 56601
aaacacuuugagaaagaaca

SEQ ID NO: 770147 - RNA, 22 nt, Leptospira interrogans serovar lai str. 56601
aaacacuuugagaaagaacaag

SEQ ID NO: 770148 - RNA, 15 nt, Leptospira interrogans serovar lai str. 56601
aaacacucuaaaucu

SEQ ID NO: 770149 - RNA, 17 nt, Leptospira interrogans serovar lai str. 56601
aaacacucuaaaucuua

SEQ ID NO: 770150 - RNA, 17 nt, Leptospira interrogans serovar lai str. 56601
aaacacgggaauaaaaa

SEQ ID NO: 770151 - RNA, 21 nt, Leptospira interrogans serovar lai str. 56601
aaacaccuucucuuuuaaaaa

SEQ ID NO: 770152 - RNA, 18 nt, Leptospira interrogans serovar lai str. 56601
cccgauacagaauaaaua

SEQ ID NO: 770153 - RNA, 17 nt, Leptospira interrogans serovar lai str. 56601
ccccgaaauacauaaac

SEQ ID NO: 770154 - RNA, 18 nt, Leptospira interrogans serovar lai str. 56601
cccacaucgaaaaaacaa

SEQ ID NO: 770155 - RNA, 21 nt, Leptospira interrogans serovar lai str. 56601
cccacaucgaaaaaacaaaua

SEQ ID NO: 770156 - RNA, 18 nt, Leptospira interrogans serovar lai str. 56601
cccacaucuuauuuuuac

SEQ ID NO: 770157 - RNA, 21 nt, Leptospira interrogans serovar lai str. 56601
cccacauuucaaaguuuugcu

SEQ ID NO: 770158 - RNA, 11 nt, Leptospira interrogans serovar lai str. 56601
cccacauuuug

SEQ ID NO: 770159 - RNA, 11 nt, Leptospira interrogans serovar lai str. 56601
cccacauuuuu

SEQ ID NO: 770160 - RNA, 13 nt, Leptospira interrogans serovar lai str. 56601
cccacauuuuugu

SEQ ID NO: 770161 - RNA, 13 nt, Leptospira interrogans serovar lai str. 56601
cccacuuauaaua

SEQ ID NO: 770162 - RNA, 20 nt, Leptospira interrogans serovar lai str. 56601
cccacuucugguuuuuuaau

SEQ ID NO: 770163 - RNA, 20 nt, Leptospira interrogans serovar lai str. 56601
cccacugaucaaagcgggaa

SEQ ID NO: 770164 - RNA, 19 nt, Leptospira interrogans serovar lai str. 56601
cccacguuuuaaagguuga

SEQ ID NO: 770165 - RNA, 19 nt, Leptospira interrogans serovar lai str. 56601
cccacguuuugaagguuga

SEQ ID NO: 770166 - RNA, 21 nt, Leptospira interrogans serovar lai str. 56601
cccacguuuugaagguugagc

SEQ ID NO: 770167 - RNA, 17 nt, Leptospira interrogans serovar lai str. 56601
ccauugucuauuuuaau

SEQ ID NO: 770168 - RNA, 18 nt, Leptospira interrogans serovar lai str. 56601
ccauucuuuuugccaauu

SEQ ID NO: 770169 - RNA, 12 nt, Leptospira interrogans serovar lai str. 56601
ccauugauuuuc

SEQ ID NO: 770170 - RNA, 23 nt, Leptospira interrogans serovar lai str. 56601
ccauucaaaaaaucaaauauaca

SEQ ID NO: 770171 - RNA, 23 nt, Leptospira interrogans serovar lai str. 56601
cccaaacacaugagcauucuuga

SEQ ID NO: 770172 - RNA, 11 nt, Leptospira interrogans serovar lai str. 56601
cccaaaaugaa

SEQ ID NO: 770173 - RNA, 19 nt, Leptospira interrogans serovar lai str. 56601
cccaaaaccgaaucuggaa

SEQ ID NO: 770174 - RNA, 15 nt, Leptospira interrogans serovar lai str. 56601
cccaaagauuucuau

SEQ ID NO: 770175 - RNA, 19 nt, Leptospira interrogans serovar lai str. 56601
ccauuuagcaauuugugaa

SEQ ID NO: 770176 - RNA, 22 nt, Leptospira interrogans serovar lai str. 56601
ccaucagaauagauucuuaaug

SEQ ID NO: 770177 - RNA, 20 nt, Leptospira interrogans serovar lai str. 56601
aaacaagcucaauuuugaag

SEQ ID NO: 770178 - RNA, 21 nt, Leptospira interrogans serovar lai str. 56601
aaacaaggcuuuguaauaaaa

SEQ ID NO: 770179 - RNA, 16 nt, Leptospira interrogans serovar lai str. 56601
aaacaauaugaaagga

SEQ ID NO: 770180 - RNA, 15 nt, Leptospira interrogans serovar lai str. 56601
ccaucaucuuacaca

SEQ ID NO: 770181 - RNA, 23 nt, Leptospira interrogans serovar lai str. 56601
ccaucuauuuccguuauauuaaa

SEQ ID NO: 770182 - RNA, 14 nt, Leptospira interrogans serovar lai str. 56601
ccaucgauuuacuu

SEQ ID NO: 770183 - RNA, 19 nt, Leptospira interrogans serovar lai str. 56601
ccaucgauuuacuuuaaaa

SEQ ID NO: 770184 - RNA, 20 nt, Leptospira interrogans serovar lai str. 56601
ccaucgauuuacuuuaaaau

SEQ ID NO: 770185 - RNA, 15 nt, Leptospira interrogans serovar lai str. 56601
ccauccgaaauccca

SEQ ID NO: 770186 - RNA, 18 nt, Leptospira interrogans serovar lai str. 56601
ccauccgaaaucccaaaa

SEQ ID NO: 770187 - RNA, 15 nt, Leptospira interrogans serovar lai str. 56601
ccaucuguuuucuuu

SEQ ID NO: 770188 - RNA, 20 nt, Leptospira interrogans serovar lai str. 56601
ccaguucuuaaauaaaauuu

SEQ ID NO: 770189 - RNA, 14 nt, Leptospira interrogans serovar lai str. 56601
ccauaaauuuugau

SEQ ID NO: 770190 - RNA, 13 nt, Leptospira interrogans serovar lai str. 56601
ccauaaauuuuua

SEQ ID NO: 770191 - RNA, 14 nt, Leptospira interrogans serovar lai str. 56601
ccauaaauuuuuau

SEQ ID NO: 770192 - RNA, 16 nt, Leptospira interrogans serovar lai str. 56601
ccauaaauucuacaaa

SEQ ID NO: 770193 - RNA, 17 nt, Leptospira interrogans serovar lai str. 56601
ccauaaauucuacaaau

SEQ ID NO: 770194 - RNA, 18 nt, Leptospira interrogans serovar lai str. 56601
ccauaaauucuacaaauu

SEQ ID NO: 770195 - RNA, 22 nt, Leptospira interrogans serovar lai str. 56601
ccaguuaaaucaccuuuuacuu

SEQ ID NO: 770196 - RNA, 21 nt, Leptospira interrogans serovar lai str. 56601
ccaucaaauacaaaauuuuuu

SEQ ID NO: 770197 - RNA, 22 nt, Leptospira interrogans serovar lai str. 56601
ccauagagaacgcgaacuuuuu

SEQ ID NO: 770198 - RNA, 22 nt, Leptospira interrogans serovar lai str. 56601
ccauaaguuccuuaaaaguauc

SEQ ID NO: 770199 - RNA, 21 nt, Leptospira interrogans serovar lai str. 56601
ccagcuuuuuuaaauuuuuau

SEQ ID NO: 770200 - RNA, 17 nt, Leptospira interrogans serovar lai str. 56601
aaacgcugaguuugaaa

SEQ ID NO: 770201 - RNA, 22 nt, Leptospira interrogans serovar lai str. 56601
cgauaauuuuuagaaauuuuua

SEQ ID NO: 770202 - RNA, 15 nt, Leptospira interrogans serovar lai str. 56601
cgaguagaauucuca

SEQ ID NO: 770203 - RNA, 21 nt, Leptospira interrogans serovar lai str. 56601
cgagcgaaagccgccuuucca

SEQ ID NO: 770204 - RNA, 20 nt, Leptospira interrogans serovar lai str. 56601
cgagcaucuuuagaaugagc

SEQ ID NO: 770205 - RNA, 21 nt, Leptospira interrogans serovar lai str. 56601
cgagaucugucgagcucccug

SEQ ID NO: 770206 - RNA, 19 nt, Leptospira interrogans serovar lai str. 56601
cgaauaggaucagaauuuc

SEQ ID NO: 770207 - RNA, 14 nt, Leptospira interrogans serovar lai str. 56601
cgaauacaaagaac

SEQ ID NO: 770208 - RNA, 16 nt, Leptospira interrogans serovar lai str. 56601
cgacucagaaaacuca

SEQ ID NO: 770209 - RNA, 18 nt, Leptospira interrogans serovar lai str. 56601
cgacucauggagaauaaa

SEQ ID NO: 770210 - RNA, 15 nt, Leptospira interrogans serovar lai str. 56601
cgacuauuucuucca

SEQ ID NO: 770211 - RNA, 15 nt, Leptospira interrogans serovar lai str. 56601
cgacuuugacuugaa

SEQ ID NO: 770212 - RNA, 14 nt, Leptospira interrogans serovar lai str. 56601
cgacuuuaguucuc

SEQ ID NO: 770213 - RNA, 18 nt, Leptospira interrogans serovar lai str. 56601
cgacuugagauuccuuuu

SEQ ID NO: 770214 - RNA, 12 nt, Leptospira interrogans serovar lai str. 56601
cgacuucuuuuu

SEQ ID NO: 770215 - RNA, 13 nt, Leptospira interrogans serovar lai str. 56601
cgacuucuuuuuu

SEQ ID NO: 770216 - RNA, 12 nt, Leptospira interrogans serovar lai str. 56601
cgcauuuuccuu

SEQ ID NO: 770217 - RNA, 23 nt, Leptospira interrogans serovar lai str. 56601
aaacgggcccaaauaaaaacacu

SEQ ID NO: 770218 - RNA, 15 nt, Leptospira interrogans serovar lai str. 56601
aaacgguaauuuuau

SEQ ID NO: 770219 - RNA, 18 nt, Leptospira interrogans serovar lai str. 56601
aaacgguaaaaggagcca

SEQ ID NO: 770220 - RNA, 21 nt, Leptospira interrogans serovar lai str. 56601
cgcagaacuauuaucuuucga

SEQ ID NO: 770221 - RNA, 21 nt, Leptospira interrogans serovar lai str. 56601
cgcaaaucacgauuuuacgaa

SEQ ID NO: 770222 - RNA, 14 nt, Leptospira interrogans serovar lai str. 56601
cgcaaauucuacua

SEQ ID NO: 770223 - RNA, 12 nt, Leptospira interrogans serovar lai str. 56601
cgcaacauaaug

SEQ ID NO: 770224 - RNA, 17 nt, Leptospira interrogans serovar lai str. 56601
cgcaacauaauguuuca

SEQ ID NO: 770225 - RNA, 22 nt, Leptospira interrogans serovar lai str. 56601
cgcaacauaauguuucaauucc

SEQ ID NO: 770226 - RNA, 13 nt, Leptospira interrogans serovar lai str. 56601
cgcacaaaccaaa

SEQ ID NO: 770227 - RNA, 12 nt, Leptospira interrogans serovar lai str. 56601
cgauauuuuuua

SEQ ID NO: 770228 - RNA, 15 nt, Leptospira interrogans serovar lai str. 56601
cgauauuaaaaugag

SEQ ID NO: 770229 - RNA, 17 nt, Leptospira interrogans serovar lai str. 56601
cgaugcgaggucaauaa

SEQ ID NO: 770230 - RNA, 20 nt, Leptospira interrogans serovar lai str. 56601
cgauuuuacaaacaaauucu

SEQ ID NO: 770231 - RNA, 22 nt, Leptospira interrogans serovar lai str. 56601
cgauuuuaccaaggauguggaa

SEQ ID NO: 770232 - RNA, 23 nt, Leptospira interrogans serovar lai str. 56601
cgauuuguuuuuuugcagaagua

SEQ ID NO: 770233 - RNA, 19 nt, Leptospira interrogans serovar lai str. 56601
cgauuuuggguuuggagua

SEQ ID NO: 770234 - RNA, 11 nt, Leptospira interrogans serovar lai str. 56601
cgcaaaaaaaa

SEQ ID NO: 770235 - RNA, 15 nt, Leptospira interrogans serovar lai str. 56601
cgcaaaaaaaauucg

SEQ ID NO: 770236 - RNA, 21 nt, Leptospira interrogans serovar lai str. 56601
cgauuuuuugauucauucagg

SEQ ID NO: 770237 - RNA, 16 nt, Leptospira interrogans serovar lai str. 56601
cgcaaaaauuccuuuu

SEQ ID NO: 770238 - RNA, 19 nt, Leptospira interrogans serovar lai str. 56601
cgauugaucuaucuuucca

SEQ ID NO: 770239 - RNA, 12 nt, Leptospira interrogans serovar lai str. 56601
cgauuucuuuca

SEQ ID NO: 770240 - RNA, 12 nt, Leptospira interrogans serovar lai str. 56601
cgauuuguaaaa

SEQ ID NO: 770241 - RNA, 12 nt, Leptospira interrogans serovar lai str. 56601
cgauuuggaaua

SEQ ID NO: 770242 - RNA, 15 nt, Leptospira interrogans serovar lai str. 56601
cgaugucguuuaaca

SEQ ID NO: 770243 - RNA, 22 nt, Leptospira interrogans serovar lai str. 56601
aaacgucauaguucccacaaau

SEQ ID NO: 770244 - RNA, 23 nt, Leptospira interrogans serovar lai str. 56601
aaacgucauaguucccacaaauu

SEQ ID NO: 770245 - RNA, 21 nt, Leptospira interrogans serovar lai str. 56601
aaacguuuauuucaaaauuuu

SEQ ID NO: 770246 - RNA, 17 nt, Leptospira interrogans serovar lai str. 56601
aaacguauaaaaacagc

SEQ ID NO: 770247 - RNA, 17 nt, Leptospira interrogans serovar lai str. 56601
aaacguacuuacugaaa

SEQ ID NO: 770248 - RNA, 16 nt, Leptospira interrogans serovar lai str. 56601
aaacguacauuuuuca

SEQ ID NO: 770249 - RNA, 19 nt, Leptospira interrogans serovar lai str. 56601
cgcgaucugucgagcgcuc

SEQ ID NO: 770250 - RNA, 18 nt, Leptospira interrogans serovar lai str. 56601
cggauuuuagauuucgaa

SEQ ID NO: 770251 - RNA, 13 nt, Leptospira interrogans serovar lai str. 56601
cggauaguuuaaa

SEQ ID NO: 770252 - RNA, 19 nt, Leptospira interrogans serovar lai str. 56601
cggauucucgcauuuuccu

SEQ ID NO: 770253 - RNA, 16 nt, Leptospira interrogans serovar lai str. 56601
cggaugauccgcuuca

SEQ ID NO: 770254 - RNA, 22 nt, Leptospira interrogans serovar lai str. 56601
cggaugcgaguaauauuuuuug

SEQ ID NO: 770255 - RNA, 21 nt, Leptospira interrogans serovar lai str. 56601
cggagaaauuaauuucuaaac

SEQ ID NO: 770256 - RNA, 16 nt, Leptospira interrogans serovar lai str. 56601
cggagaaaauuuaaac

SEQ ID NO: 770257 - RNA, 20 nt, Leptospira interrogans serovar lai str. 56601
cggagaaagcgcagacucuu

SEQ ID NO: 770258 - RNA, 23 nt, Leptospira interrogans serovar lai str. 56601
cggaaucuuuuugggaaauuuga

SEQ ID NO: 770259 - RNA, 18 nt, Leptospira interrogans serovar lai str. 56601
cggaauacuuuucuuccc

SEQ ID NO: 770260 - RNA, 19 nt, Leptospira interrogans serovar lai str. 56601
cggaauuuccaaacucaau

SEQ ID NO: 770261 - RNA, 20 nt, Leptospira interrogans serovar lai str. 56601
cggaacaauuacagaaggga

SEQ ID NO: 770262 - RNA, 14 nt, Leptospira interrogans serovar lai str. 56601
cggaauaaaacccu

SEQ ID NO: 770263 - RNA, 18 nt, Leptospira interrogans serovar lai str. 56601
cggaacuuaauuuuauag

SEQ ID NO: 770264 - RNA, 17 nt, Leptospira interrogans serovar lai str. 56601
cggaacuagggaauuuu

SEQ ID NO: 770265 - RNA, 18 nt, Leptospira interrogans serovar lai str. 56601
cgcuuuggaauuggcuuc

SEQ ID NO: 770266 - RNA, 18 nt, Leptospira interrogans serovar lai str. 56601
cgcuuuuaaauuguaugc

SEQ ID NO: 770267 - RNA, 19 nt, Leptospira interrogans serovar lai str. 56601
cgcuuuuaaauuguaugca

SEQ ID NO: 770268 - RNA, 22 nt, Leptospira interrogans serovar lai str. 56601
cgcuuuggucgaucguuuuuug

SEQ ID NO: 770269 - RNA, 14 nt, Leptospira interrogans serovar lai str. 56601
cgcuacaaauucau

SEQ ID NO: 770270 - RNA, 20 nt, Leptospira interrogans serovar lai str. 56601
cggcgaccuuucuaaaaauu

SEQ ID NO: 770271 - RNA, 23 nt, Human
uggacgagaaaacaauaacgaua

SEQ ID NO: 770272 - RNA, 17 nt, Human
uaaauguugacauggga

SEQ ID NO: 770273 - RNA, 23 nt, Human
uacuguaagaaaauaucacuugu

SEQ ID NO: 770274 - RNA, 21 nt, Human
ccuugaugaagaaguugauau

SEQ ID NO: 770275 - RNA, 18 nt, Human
uuauaauuuaaaauaugc

SEQ ID NO: 770276 - RNA, 16 nt, Human
uuaaauuguaauaggc

SEQ ID NO: 770277 - RNA, 15 nt, Human
uugaguuuaaauugu

SEQ ID NO: 770278 - RNA, 18 nt, Human
cucacagaccuuugaacu

SEQ ID NO: 770279 - RNA, 21 nt, Human
gaaaacccuugccaugugcua

SEQ ID NO: 770280 - RNA, 22 nt, Human
aaguugauaugccuuuucccaa

SEQ ID NO: 770281 - RNA, 18 nt, Human
aacgauaaaagacaguga

SEQ ID NO: 770282 - RNA, 17 nt, Human
aacuaucucauuuccaa

SEQ ID NO: 770283 - RNA, 15 nt, Human
acaaauccaaugaaa

SEQ ID NO: 770284 - RNA, 15 nt, Human
aauuuaaaaauccua

SEQ ID NO: 770285 - RNA, 15 nt, Human
acuucaaauccuuga

SEQ ID NO: 770286 - RNA, 23 nt, Human
augguaccaccagucugacuguu

SEQ ID NO: 770287 - RNA, 16 nt, Human
auguugacaugggaca

SEQ ID NO: 770288 - RNA, 18 nt, Human
uaaaacugggacagggga

SEQ ID NO: 770289 - RNA, 11 nt, Human
uuugaaauugu

SEQ ID NO: 770290 - RNA, 15 nt, Human
uuugaagggaaauuu

SEQ ID NO: 770291 - RNA, 19 nt, Human
gugaaagaaaauaacgaua

SEQ ID NO: 770292 - RNA, 15 nt, Human
aaaauaacaaugaaa

SEQ ID NO: 770293 - RNA, 13 nt, Human
acaauaacgauaa

SEQ ID NO: 770294 - RNA, 15 nt, Human
acaauacaucccuua

SEQ ID NO: 770295 - RNA, 13 nt, Human
aaaauaacgauaa

SEQ ID NO: 770296 - RNA, 16 nt, Human
aaacucguuaauuugu

SEQ ID NO: 770297 - RNA, 14 nt, Human
aauaauguuucaaa

SEQ ID NO: 770298 - RNA, 18 nt, Human
acaggaugguucccuuga

SEQ ID NO: 770299 - RNA, 18 nt, Human
auuugaaauauugacuuu

SEQ ID NO: 770300 - RNA, 19 nt, Human
gaaaaguauguuagugcaa

SEQ ID NO: 770301 - RNA, 14 nt, Human
gcauuuaauaugga

SEQ ID NO: 770302 - RNA, 14 nt, Human
uuuaauuauauggc

SEQ ID NO: 770303 - RNA, 22 nt, Human
agucaggaaagagaacuuccag

SEQ ID NO: 770304 - RNA, 17 nt, Human
auguuaaaacugggaca

SEQ ID NO: 770305 - RNA, 15 nt, Human
aucucaauauuucag

SEQ ID NO: 770306 - RNA, 13 nt, Human
aucucauuuccaa

SEQ ID NO: 770307 - RNA, 14 nt, Human
auauuggacaguaa

SEQ ID NO: 770308 - RNA, 22 nt, Human
aguuuuauaugcuucuguuuua

SEQ ID NO: 770309 - RNA, 20 nt, Human
auaauccuaaacauaugaau

SEQ ID NO: 770310 - RNA, 17 nt, Human
auuuuaauaauguuuca

SEQ ID NO: 770311 - RNA, 18 nt, Human
auuaugaauuacauuugu

SEQ ID NO: 770312 - RNA, 23 nt, Human
cagucaggaaagagaacuuccag

SEQ ID NO: 770313 - RNA, 18 nt, Human
uuuucucuccucucccca

SEQ ID NO: 770314 - RNA, 13 nt, Human
acaaggaaaaaau

SEQ ID NO: 770315 - RNA, 21 nt, Human
ugaaacgaggauugggaaaaa

SEQ ID NO: 770316 - RNA, 19 nt, Human
aaaauaacaauaaaagaca

SEQ ID NO: 770317 - RNA, 16 nt, Human
acaugaaguccaagca

SEQ ID NO: 770318 - RNA, 16 nt, Human
uuuauauuugaaauau

SEQ ID NO: 770319 - RNA, 15 nt, Human
acugaagaagcacca

SEQ ID NO: 770320 - RNA, 10 nt, Human
auguuuucag

SEQ ID NO: 770321 - RNA, 17 nt, Human
aaauauaaauaaaaaua

SEQ ID NO: 770322 - RNA, 13 nt, Human
ccuccuuuuaaag

SEQ ID NO: 770323 - RNA, 17 nt, Human
ucuauaauguguucauu

SEQ ID NO: 770324 - RNA, 14 nt, Human
gugagcuacaaaug

SEQ ID NO: 770325 - RNA, 21 nt, Human
gcaaaauuuuuucucuaggaa

SEQ ID NO: 770326 - RNA, 12 nt, Human
auauaaauaaaa

SEQ ID NO: 770327 - RNA, 12 nt, Human
cauagaaguaaa

SEQ ID NO: 770328 - RNA, 15 nt, Human
guuuuucuuuucauu

SEQ ID NO: 770329 - RNA, 16 nt, Human
acaaggaugaauuaag

SEQ ID NO: 770330 - RNA, 16 nt, Human
uucuauaauuuaaaua

SEQ ID NO: 770331 - RNA, 13 nt, Human
gacaaggaaaaaa

SEQ ID NO: 770332 - RNA, 17 nt, Human
uucacuguaaaauaaua

SEQ ID NO: 770333 - RNA, 19 nt, Human
uggugaacuugguuuuaau

SEQ ID NO: 770334 - RNA, 17 nt, Human
ccaaaaaucucaauauu

SEQ ID NO: 770335 - RNA, 16 nt, Human
gacaaggaaaaaauaa

SEQ ID NO: 770336 - RNA, 11 nt, Human
uuauauuuauu

SEQ ID NO: 770337 - RNA, 18 nt, Human
uggagggaagccuugggg

SEQ ID NO: 770338 - RNA, 20 nt, Human
auucccagccagcacagccu

SEQ ID NO: 770339 - RNA, 15 nt, Human
caaggaaaaaauaac

SEQ ID NO: 770340 - RNA, 21 nt, Human
gacagucaccucauggaauug

SEQ ID NO: 770341 - RNA, 20 nt, Human
acuucuuaggguuaugauua

SEQ ID NO: 770342 - RNA, 22 nt, Human
aauuuuuucucuaggaaauauu

SEQ ID NO: 770343 - RNA, 15 nt, Human
aguucugaagaagau

SEQ ID NO: 770344 - RNA, 15 nt, Human
aagaaaauaacaaua

SEQ ID NO: 770345 - RNA, 19 nt, Human
cucugccucagaaaacaag

SEQ ID NO: 770346 - RNA, 16 nt, Human
ugacaagcucacagac

SEQ ID NO: 770347 - RNA, 13 nt, Human
aguguuugaaagc

SEQ ID NO: 770348 - RNA, 18 nt, Human
acaugaacuuguaaagga

SEQ ID NO: 770349 - RNA, 19 nt, Human
aaaaucuuauaauuuaaaa

SEQ ID NO: 770350 - RNA, 19 nt, Human
aaauaugccccauucaaca

SEQ ID NO: 770351 - RNA, 17 nt, Human
auuuucuauaauuuaaa

SEQ ID NO: 770352 - RNA, 18 nt, Human
gccuuggggcugaugcag

SEQ ID NO: 770353 - RNA, 16 nt, Human
gcuucacuguaaaaua

SEQ ID NO: 770354 - RNA, 23 nt, Human
uguugcccacagcuguaugauuc

SEQ ID NO: 770355 - RNA, 12 nt, Human
cuccauuuuuag

SEQ ID NO: 770356 - RNA, 22 nt, Human
uguugcccacagcuguaugauu

SEQ ID NO: 770357 - RNA, 15 nt, Human
uagggugauauuaac

SEQ ID NO: 770358 - RNA, 18 nt, Human
uuacaaaugggaaacaaa

SEQ ID NO: 770359 - RNA, 17 nt, Human
agacagugaaagaaaau

SEQ ID NO: 770360 - RNA, 21 nt, Human
aaaauuuuuucucuaggaaau

SEQ ID NO: 770361 - RNA, 14 nt, Human
guauuuuaaaagaa

SEQ ID NO: 770362 - RNA, 14 nt, Human
uggcuugaguuuaa

SEQ ID NO: 770363 - RNA, 18 nt, Human
aacaaugcuguauuuuaa

SEQ ID NO: 770364 - RNA, 15 nt, Human
aaucucaauauuuca

SEQ ID NO: 770365 - RNA, 15 nt, Human
cucgugggacaguca

SEQ ID NO: 770366 - RNA, 18 nt, Human
guauuauuuuuuaaaaaa

SEQ ID NO: 770367 - RNA, 17 nt, Human
ugaaggauuuauguuua

SEQ ID NO: 770368 - RNA, 21 nt, Human
augcuacaggauuugaaauug

SEQ ID NO: 770369 - RNA, 21 nt, Human
aaauaauuuuuauauuugaaa

SEQ ID NO: 770370 - RNA, 21 nt, Human
auuuuuucucuaggaaauauu

SEQ ID NO: 770371 - RNA, 23 nt, Human
cuuaagaagacugcauuauauuu

SEQ ID NO: 770372 - RNA, 19 nt, Human
ucaguuauuauauuuacaa

SEQ ID NO: 770373 - RNA, 19 nt, Human
augaauuacauuuguauaa

SEQ ID NO: 770374 - RNA, 13 nt, Human
aaaauaacgauaa

SEQ ID NO: 770375 - RNA, 21 nt, Human
uuuuauggcacuaguauuucu

SEQ ID NO: 770376 - RNA, 17 nt, Human
aagcuuuuuuugaauca

SEQ ID NO: 770377 - RNA, 13 nt, Human
aggaaaaaauaac

SEQ ID NO: 770378 - RNA, 19 nt, Human
aauuuuuauauuugaaaua

SEQ ID NO: 770379 - RNA, 18 nt, Human
ugaacuugguuuuaauua

SEQ ID NO: 770380 - RNA, 17 nt, Human
aggguguguaaguagau

SEQ ID NO: 770381 - RNA, 23 nt, Human
gaaaaucuuauaauuuaaaauau

SEQ ID NO: 770382 - RNA, 23 nt, Human
uuuccaucaaggguacacugccu

SEQ ID NO: 770383 - RNA, 14 nt, Human
auccaaugaaauga

SEQ ID NO: 770384 - RNA, 15 nt, Human
agaauaccacaggaa

SEQ ID NO: 770385 - RNA, 21 nt, Human
cuaccaaaaaucucaauauuu

SEQ ID NO: 770386 - RNA, 14 nt, Human
aaauauuauuuuau

SEQ ID NO: 770387 - RNA, 17 nt, Human
aaauccuacuuucauaa

SEQ ID NO: 770388 - RNA, 12 nt, Human
gaagaccucauu

SEQ ID NO: 770389 - RNA, 18 nt, Human
cugagggcauagaaguaa

SEQ ID NO: 770390 - RNA, 19 nt, Human
uuugccaaguucuccacua

SEQ ID NO: 770391 - RNA, 18 nt, Human
auguuaaaacugggacag

SEQ ID NO: 770392 - RNA, 20 nt, Human
uaaaagacagugaaagaaaa

SEQ ID NO: 770393 - RNA, 18 nt, Human
agagaaugagagacacac

SEQ ID NO: 770394 - RNA, 16 nt, Human
aaaguguuugaaagcu

SEQ ID NO: 770395 - RNA, 23 nt, Human
gauauuaaccaggggccaugaau

SEQ ID NO: 770396 - RNA, 23 nt, Human
uagauguauagguugaugguggu

SEQ ID NO: 770397 - RNA, 22 nt, Human
gaaaaucuuauaauuuaaaaua

SEQ ID NO: 770398 - RNA, 13 nt, Human
cacuguaaaauaa

SEQ ID NO: 770399 - RNA, 22 nt, Human
agugagcagucaggaaagagaa

SEQ ID NO: 770400 - RNA, 16 nt, Human
uuuuagugaaauauua

SEQ ID NO: 770401 - RNA, 22 nt, Human
gaugcaguucugaagaagaugg

SEQ ID NO: 770402 - RNA, 12 nt, Human
aauaauuuuuaa

SEQ ID NO: 770403 - RNA, 17 nt, Human
auuauuuuuuaaaaaaa

SEQ ID NO: 770404 - RNA, 15 nt, Human
uucacuguaaaauaa

SEQ ID NO: 770405 - RNA, 17 nt, Human
gacgagaaaacaauaac

SEQ ID NO: 770406 - RNA, 15 nt, Human
uuaauuuguaguguu

SEQ ID NO: 770407 - RNA, 23 nt, Human
gauagauaggucagugcaaauac

SEQ ID NO: 770408 - RNA, 16 nt, Human
uaaugaauacuuuaua

SEQ ID NO: 770409 - RNA, 21 nt, Human
gccaaauauaaauaaaaauaa

SEQ ID NO: 770410 - RNA, 19 nt, Human
aagcauuccaacuaucuca

SEQ ID NO: 770411 - RNA, 14 nt, Human
uugggaaaaaguaa

SEQ ID NO: 770412 - RNA, 23 nt, Human
uggcuugaguuuaaauuguaaua

SEQ ID NO: 770413 - RNA, 17 nt, Human
ugaaauauuauuuuaua

SEQ ID NO: 770414 - RNA, 13 nt, Human
ucuauaauuuaaa

SEQ ID NO: 770415 - RNA, 16 nt, Human
uuaauaauuuuuaauu

SEQ ID NO: 770416 - RNA, 14 nt, Human
guaacuaauuuuaa

SEQ ID NO: 770417 - RNA, 14 nt, Human
aaugauuaugaauu

SEQ ID NO: 770418 - RNA, 18 nt, Human
aggaaaaaauaacaauga

SEQ ID NO: 770419 - RNA, 16 nt, Human
uucacauuuaaauaaa

SEQ ID NO: 770420 - RNA, 17 nt, Human
uaaaagacaaggaaaaa

SEQ ID NO: 770421 - RNA, 20 nt, Human
auuacauuuguauaaaauaa

SEQ ID NO: 770422 - RNA, 19 nt, Human
uaucacuugucaauaaaau

SEQ ID NO: 770423 - RNA, 21 nt, Human
auuuuccugaaaacccuugcc

SEQ ID NO: 770424 - RNA, 17 nt, Human
caaauccaaugaaauga

SEQ ID NO: 770425 - RNA, 13 nt, Human
uuuuaaaaaagaa

SEQ ID NO: 770426 - RNA, 15 nt, Human
aaaaaagaaacauuu

SEQ ID NO: 770427 - RNA, 20 nt, Human
aguuguuucuacuacaugga

SEQ ID NO: 770428 - RNA, 14 nt, Human
ugcucauggaauug

SEQ ID NO: 770429 - RNA, 21 nt, Human
gaaaugaguuuuucuuuucau

SEQ ID NO: 770430 - RNA, 22 nt, Human
agaaugagagacacacugaaga

SEQ ID NO: 770431 - RNA, 21 nt, Human
uuuguauaaaauaauuuuuau

SEQ ID NO: 770432 - RNA, 22 nt, Human
gauaaaagacagugaaagaaaa

SEQ ID NO: 770433 - RNA, 19 nt, Human
uauauuuuugugauuuugu

SEQ ID NO: 770434 - RNA, 13 nt, Human
acuguaaaauaau

SEQ ID NO: 770435 - RNA, 17 nt, Human
cugccucagaaaacaag

SEQ ID NO: 770436 - RNA, 20 nt, Human
aauuuuuucucuaggaaaua

SEQ ID NO: 770437 - RNA, 20 nt, Human
aagggcuguuauaaucuuuc

SEQ ID NO: 770438 - RNA, 14 nt, Human
uaaaagacaaggaa

SEQ ID NO: 770439 - RNA, 23 nt, Human
gaaaacaauaacgauaaaagaca

SEQ ID NO: 770440 - RNA, 20 nt, Human
uacaucccuuaccugggaaa

SEQ ID NO: 770441 - RNA, 17 nt, Human
gacaaggaaaaaauaac

SEQ ID NO: 770442 - RNA, 15 nt, Human
auauaaauaaaaaua

SEQ ID NO: 770443 - RNA, 20 nt, Human
ugguuguauuauuuuuuaaa

SEQ ID NO: 770444 - RNA, 12 nt, Human
aauuuuaaaaug

SEQ ID NO: 770445 - RNA, 17 nt, Human
auauuugaaauauugac

SEQ ID NO: 770446 - RNA, 14 nt, Human
cuaaacauaugaau

SEQ ID NO: 770447 - RNA, 17 nt, Human
cgauaaaagacagugaa

SEQ ID NO: 770448 - RNA, 19 nt, Human
guuguauuauuuuuuaaaa

SEQ ID NO: 770449 - RNA, 20 nt, Human
acuagaguuuagcuggaaaa

SEQ ID NO: 770450 - RNA, 20 nt, Human
uguaauaggcguaacuaauu

SEQ ID NO: 770451 - RNA, 16 nt, Human
ucuuauaauuuaaaau

SEQ ID NO: 770452 - RNA, 15 nt, Human
ugcuguauuuuaaaa

SEQ ID NO: 770453 - RNA, 13 nt, Human
cacauuuaaauaa

SEQ ID NO: 770454 - RNA, 12 nt, Human
cauuauauuuau

SEQ ID NO: 770455 - RNA, 13 nt, Human
aagaaaauaacga

SEQ ID NO: 770456 - RNA, 19 nt, Human
gguuuaauaauuuuuaauu

SEQ ID NO: 770457 - RNA, 12 nt, Human
gauaaaagacag

SEQ ID NO: 770458 - RNA, 13 nt, Human
auuuuaaaagaau

SEQ ID NO: 770459 - RNA, 16 nt, Human
aagcauuuagauguau

SEQ ID NO: 770460 - RNA, 18 nt, Human
cagccucuuagaugcagu

SEQ ID NO: 770461 - RNA, 16 nt, Human
cacuaguauuucuaug

SEQ ID NO: 770462 - RNA, 19 nt, Human
auuguaguccuguaaugga

SEQ ID NO: 770463 - RNA, 13 nt, Human
cugccuucucaac

SEQ ID NO: 770464 - RNA, 19 nt, Human
acauuuguauaaaauaauu

SEQ ID NO: 770465 - RNA, 13 nt, Human
uuuucuuuucauu

SEQ ID NO: 770466 - RNA, 17 nt, Human
aauaugcucuaaacaug

SEQ ID NO: 770467 - RNA, 12 nt, Human
uuuuauauuuga

SEQ ID NO: 770468 - RNA, 23 nt, Human
aauauuuauuuuaauaauguuuc

SEQ ID NO: 770469 - RNA, 18 nt, Human
uaauaauguuucaaacau

SEQ ID NO: 770470 - RNA, 14 nt, Human
aauuguauuacaaa

SEQ ID NO: 770471 - RNA, 14 nt, Human
aaagagaacuucca

SEQ ID NO: 770472 - RNA, 16 nt, Human
uuauaauuuaaaauau

SEQ ID NO: 770473 - RNA, 18 nt, Human
uuuauguuuaauucugaa

SEQ ID NO: 770474 - RNA, 20 nt, Human
accucauggaauuggagcuc

SEQ ID NO: 770475 - RNA, 17 nt, Human
uaacugauuuguaacaa

SEQ ID NO: 770476 - RNA, 17 nt, Human
uguaaaggaauuuaaaa

SEQ ID NO: 770477 - RNA, 18 nt, Human
uguaaaggaauuuaaaaa

SEQ ID NO: 770478 - RNA, 18 nt, Human
uagugaaauauuauuuua

SEQ ID NO: 770479 - RNA, 16 nt, Human
ucaguuuuugugaaaa

SEQ ID NO: 770480 - RNA, 19 nt, Human
agaguuuagcuggaaaagu

SEQ ID NO: 770481 - RNA, 14 nt, Human
agcucguggaacag

SEQ ID NO: 770482 - RNA, 16 nt, Human
aaaauccauacauuug

SEQ ID NO: 770483 - RNA, 21 nt, Human
uuuucaggcuagauguaugua

SEQ ID NO: 770484 - RNA, 16 nt, Human
uucucuaggaaauauu

SEQ ID NO: 770485 - RNA, 16 nt, Human
uuaaauuguaauaggc

SEQ ID NO: 770486 - RNA, 23 nt, Human
uuguaacaagccuccuuuuaaag

SEQ ID NO: 770487 - RNA, 16 nt, Human
uaaaggaauuuaaaaa

SEQ ID NO: 770488 - RNA, 19 nt, Human
gugaacuugguuuuaauua

SEQ ID NO: 770489 - RNA, 23 nt, Human
uuuuauagcuacuaauuuuaaaa

SEQ ID NO: 770490 - RNA, 20 nt, Human
aaagacagugaaagaaaaua

SEQ ID NO: 770491 - RNA, 21 nt, Human
cuucucacauuuauauuuuug

SEQ ID NO: 770492 - RNA, 20 nt, Human
aaauaauuuuuauauuugaa

SEQ ID NO: 770493 - RNA, 22 nt, Human
uucauucacucaacaaacauaa

SEQ ID NO: 770494 - RNA, 23 nt, Human
auguuaaaacugggacaggggag

SEQ ID NO: 770495 - RNA, 18 nt, Human
cagcuuauugucuaguga

SEQ ID NO: 770496 - RNA, 17 nt, Human
aaaaauccuacuuucau

SEQ ID NO: 770497 - RNA, 17 nt, Human
caaauauaaauaaaaau

SEQ ID NO: 770498 - RNA, 18 nt, Human
uaaguuuuuuuuuaaaaa

SEQ ID NO: 770499 - RNA, 20 nt, Human
aaaagacagugaaagaaaau

SEQ ID NO: 770500 - RNA, 15 nt, Human
aaaaauaacaaugaa

SEQ ID NO: 770501 - RNA, 17 nt, Human
uaauuuuuauauuugaa

SEQ ID NO: 770502 - RNA, 18 nt, Human
aucuuauaauuuaaaaua

SEQ ID NO: 770503 - RNA, 19 nt, Human
guuauuauauuuacaaaug

SEQ ID NO: 770504 - RNA, 14 nt, Human
uuaugauuaaguaa

SEQ ID NO: 770505 - RNA, 15 nt, Human
aaggaauuuaaaaau

SEQ ID NO: 770506 - RNA, 13 nt, Human
uuaaaaaagaaac

SEQ ID NO: 770507 - RNA, 17 nt, Human
acaaaugcauuucuaaa

SEQ ID NO: 770508 - RNA, 21 nt, Human
aggcucuuuugggauuuuuga

SEQ ID NO: 770509 - RNA, 21 nt, Human
aaguuuaugguuguauuauuu

SEQ ID NO: 770510 - RNA, 19 nt, Human
agcuacuaauuuuaaaaug

SEQ ID NO: 770511 - RNA, 13 nt, Human
aaauaaaaauaau

SEQ ID NO: 770512 - RNA, 15 nt, Human
ccagcacagccucuu

SEQ ID NO: 770513 - RNA, 16 nt, Human
gacauuugcucaugga

SEQ ID NO: 770514 - RNA, 18 nt, Human
auagucaaauugugugaa

SEQ ID NO: 770515 - RNA, 14 nt, Human
auauuuauuuuaau

SEQ ID NO: 770516 - RNA, 22 nt, Human
agaaagugacaagcucacagac

SEQ ID NO: 770517 - RNA, 11 nt, Human
uucacagggga

SEQ ID NO: 770518 - RNA, 12 nt, Human
uaagaagacugc

SEQ ID NO: 770519 - RNA, 17 nt, Human
ugcacaucaaaauaugc

SEQ ID NO: 770520 - RNA, 16 nt, Human
aaagacaaggaaaaaa

SEQ ID NO: 770521 - RNA, 20 nt, Human
aauuuugugaagcaaaauuu

SEQ ID NO: 770522 - RNA, 15 nt, Human
aaauauuuauuuuaa

SEQ ID NO: 770523 - RNA, 14 nt, Human
augggccauaugaa

SEQ ID NO: 770524 - RNA, 15 nt, Human
ucaguuuuugugaaa

SEQ ID NO: 770525 - RNA, 20 nt, Human
uguuggugaacuugguuuua

SEQ ID NO: 770526 - RNA, 22 nt, Human
ugaguuuuucuuuucauuuacc

SEQ ID NO: 770527 - RNA, 21 nt, Human
aauuaaguuuuuuuuuaaaaa

SEQ ID NO: 770528 - RNA, 21 nt, Human
agcccuucuuuccacagaagc

SEQ ID NO: 770529 - RNA, 22 nt, Human
agaagcaccaaucaugaauuag

SEQ ID NO: 770530 - RNA, 11 nt, Human
auaauuuaaau

SEQ ID NO: 770531 - RNA, 15 nt, Human
uauaaauaaaaauaa

SEQ ID NO: 770532 - RNA, 15 nt, Human
aauauaaauaaaaau

SEQ ID NO: 770533 - RNA, 22 nt, Human
aguauguuagugcaaauuguca

SEQ ID NO: 770534 - RNA, 16 nt, Human
aagaaaauaacaauaa

SEQ ID NO: 770535 - RNA, 13 nt, Human
aacaauaaaagac

SEQ ID NO: 770536 - RNA, 21 nt, Human
aaacaauaacgauaaaagaca

SEQ ID NO: 770537 - RNA, 20 nt, Human
uuuaaauaaaguguuugaaa

SEQ ID NO: 770538 - RNA, 18 nt, Human
gacauuugcucauggaau

SEQ ID NO: 770539 - RNA, 23 nt, Human
ugaaaugaguuuuucuuuucauu

SEQ ID NO: 770540 - RNA, 18 nt, Human
cuuucacauuuaaauaaa

SEQ ID NO: 770541 - RNA, 17 nt, Human
uuucacauuuaaauaaa

SEQ ID NO: 770542 - RNA, 18 nt, Human
uguacuuuauuuucuaua

SEQ ID NO: 770543 - RNA, 14 nt, Human
aaucucaauauuuc

SEQ ID NO: 770544 - RNA, 21 nt, Human
auuuacaaaugggaaacaaaa

SEQ ID NO: 770545 - RNA, 23 nt, Human
gaaugagagacacacugaagaag

SEQ ID NO: 770546 - RNA, 21 nt, Human
uaguauuucuaugaaauauua

SEQ ID NO: 770547 - RNA, 20 nt, Human
gaaacgaggauugggaaaaa

SEQ ID NO: 770548 - RNA, 15 nt, Human
uaacgauaaaagaca

SEQ ID NO: 770549 - RNA, 14 nt, Human
caaaugcauuucua

SEQ ID NO: 770550 - RNA, 22 nt, Human
uaaaauaauuuuuauauuugaa

SEQ ID NO: 770551 - RNA, 16 nt, Human
cauagaaguaaaaaca

SEQ ID NO: 770552 - RNA, 12 nt, Human
gaauuggagcuc

SEQ ID NO: 770553 - RNA, 14 nt, Human
uaauccuaaacaua

SEQ ID NO: 770554 - RNA, 23 nt, Human
uagacacacaugaaguccaagca

SEQ ID NO: 770555 - RNA, 20 nt, Human
gaauucauucacucaacaaa

SEQ ID NO: 770556 - RNA, 21 nt, Human
auauaugcuaagucuuauaua

SEQ ID NO: 770557 - RNA, 18 nt, Human
aaaagacaaggaaaaaau

SEQ ID NO: 770558 - RNA, 18 nt, Human
acauuugcucauggaauu

SEQ ID NO: 770559 - RNA, 14 nt, Human
uucuaugaaauauu

SEQ ID NO: 770560 - RNA, 20 nt, Human
ucacaugaacuuguaaagga

SEQ ID NO: 770561 - RNA, 14 nt, Human
uuuguauaaaauaa

SEQ ID NO: 770562 - RNA, 18 nt, Human
acauuuauauuuuuguga

SEQ ID NO: 770563 - RNA, 12 nt, Human
aauacuuuauaa

SEQ ID NO: 770564 - RNA, 18 nt, Human
auaaaguguuugaaagcu

SEQ ID NO: 770565 - RNA, 17 nt, Human
gacagugaaagaaaaua

SEQ ID NO: 770566 - RNA, 20 nt, Human
gaaaauaacgauaaaagaca

SEQ ID NO: 770567 - RNA, 16 nt, Human
agugaaggauuuaugu

SEQ ID NO: 770568 - RNA, 23 nt, Human
uaacgauaaaagacagugaaaga

SEQ ID NO: 770569 - RNA, 19 nt, Human
cauggaauuggagcucgug

SEQ ID NO: 770570 - RNA, 18 nt, Human
aguucuccacuagcuaug

SEQ ID NO: 770571 - RNA, 16 nt, Human
auuuguauaaaauaau

SEQ ID NO: 770572 - RNA, 16 nt, Human
aauaaaguguuugaaa

SEQ ID NO: 770573 - RNA, 21 nt, Human
augaauacuuuauaaaggauu

SEQ ID NO: 770574 - RNA, 22 nt, Human
guacacugccuucucaacucca

SEQ ID NO: 770575 - RNA, 22 nt, Human
uauuucuaugaaauauuauguu

SEQ ID NO: 770576 - RNA, 20 nt, Human
uguaaaggaauuuaaaaauc

SEQ ID NO: 770577 - RNA, 18 nt, Human
uacauuuguauaaaauaa

SEQ ID NO: 770578 - RNA, 23 nt, Human
augaauuaaguuuuuuuuuaaaa

SEQ ID NO: 770579 - RNA, 14 nt, Human
augauguuuagaaa

SEQ ID NO: 770580 - RNA, 20 nt, Human
aaugaauacuuuauaaagga

SEQ ID NO: 770581 - RNA, 17 nt, Human
uuccaagugauugaaac

SEQ ID NO: 770582 - RNA, 12 nt, Human
uguuugaaagcu

SEQ ID NO: 770583 - RNA, 13 nt, Human
aggauuugaaauu

SEQ ID NO: 770584 - RNA, 15 nt, Human
cuguaaaauaauaac

SEQ ID NO: 770585 - RNA, 18 nt, Human
acaagccuccuuuuaaag

SEQ ID NO: 770586 - RNA, 17 nt, Human
uugccaaauauaaauaa

SEQ ID NO: 770587 - RNA, 17 nt, Human
ucuauaauuuaaauaua

SEQ ID NO: 770588 - RNA, 20 nt, Human
ucauucacucaacaaacaua

SEQ ID NO: 770589 - RNA, 15 nt, Human
uacaggauuugaaau

SEQ ID NO: 770590 - RNA, 20 nt, Human
auuuugugauugauuauaug

SEQ ID NO: 770591 - RNA, 23 nt, Human
aauaauccucaguuuuugugaaa

SEQ ID NO: 770592 - RNA, 19 nt, Human
aaacaauaacgauaaaaga

SEQ ID NO: 770593 - RNA, 17 nt, Human
gaaugagagacacacug

SEQ ID NO: 770594 - RNA, 11 nt, Human
caauaaaagac

SEQ ID NO: 770595 - RNA, 16 nt, Human
gacaagcucacagacc

SEQ ID NO: 770596 - RNA, 20 nt, Human
aagacagugaaagaaaauaa

SEQ ID NO: 770597 - RNA, 19 nt, Human
aggucuaccaaaaaucuca

SEQ ID NO: 770598 - RNA, 20 nt, Human
cuaaaugucaaucagccuag

SEQ ID NO: 770599 - RNA, 14 nt, Human
auugucuagugaaa

SEQ ID NO: 770600 - RNA, 23 nt, Human
gggaaacaaaaggauaaugaaua

SEQ ID NO: 770601 - RNA, 15 nt, Human
uuuaauaauuuuuaa

SEQ ID NO: 770602 - RNA, 20 nt, Human
uguaagaaaauaucacuugu

SEQ ID NO: 770603 - RNA, 22 nt, Human
aauaugccccauucaacaucua

SEQ ID NO: 770604 - RNA, 22 nt, Human
ugguuguauuauuuuuuaaaaa

SEQ ID NO: 770605 - RNA, 14 nt, Human
caguucugaagaag

SEQ ID NO: 770606 - RNA, 18 nt, Human
auuuuaacucuauaaugu

SEQ ID NO: 770607 - RNA, 20 nt, Human
accucugccucagaaaacaa

SEQ ID NO: 770608 - RNA, 21 nt, Human
aggguuaugauuaaguaauga

SEQ ID NO: 770609 - RNA, 23 nt, Human
ggaugguucccuugaugaagaag

SEQ ID NO: 770610 - RNA, 21 nt, Human
aacuuguaaaggaauuuaaaa

SEQ ID NO: 770611 - RNA, 16 nt, Human
uaaaauccauacauuu

SEQ ID NO: 770612 - RNA, 13 nt, Human
ugaaagaaaauaa

SEQ ID NO: 770613 - RNA, 14 nt, Human
ccuugaugaagaag

SEQ ID NO: 770614 - RNA, 17 nt, Human
cuaucucauuuccaagc

SEQ ID NO: 770615 - RNA, 16 nt, Human
cauuucuaaagccauu

SEQ ID NO: 770616 - RNA, 22 nt, Human
ggacaguaaaauccacagacca

SEQ ID NO: 770617 - RNA, 15 nt, Human
ggcaauagucaaauu

SEQ ID NO: 770618 - RNA, 18 nt, Human
uaaugaauacuuuauaaa

SEQ ID NO: 770619 - RNA, 19 nt, Human
acaauaacgauaaaagaca

SEQ ID NO: 770620 - RNA, 18 nt, Human
uauagcuacuaauuuuaa

SEQ ID NO: 770621 - RNA, 21 nt, Human
ucuuaggguuaugauuaagua

SEQ ID NO: 770622 - RNA, 13 nt, Human
aagacaaggaaaa

SEQ ID NO: 770623 - RNA, 17 nt, Human
augauuaaguaaugaua

SEQ ID NO: 770624 - RNA, 19 nt, Human
aagcuuguauuccuuuuuc

SEQ ID NO: 770625 - RNA, 14 nt, Human
auuuaaauauaugc

SEQ ID NO: 770626 - RNA, 19 nt, Human
cuaagcuucacuguaaaau

SEQ ID NO: 770627 - RNA, 22 nt, Human
cacuaguauuucuaugaaauau

SEQ ID NO: 770628 - RNA, 14 nt, Human
uaacuaauuuuaac

SEQ ID NO: 770629 - RNA, 15 nt, Human
gcuguauuuuaaaag

SEQ ID NO: 770630 - RNA, 20 nt, Human
uuugcaagccagauuuuccu

SEQ ID NO: 770631 - RNA, 15 nt, Human
aaugauuaugaauua

SEQ ID NO: 770632 - RNA, 18 nt, Human
acaaaugcauuucuaaag

SEQ ID NO: 770633 - RNA, 14 nt, Human
uauuuauuuuaaua

SEQ ID NO: 770634 - RNA, 14 nt, Human
auuuguauaaaaua

SEQ ID NO: 770635 - RNA, 18 nt, Human
gaaaauaucacuugucaa

SEQ ID NO: 770636 - RNA, 14 nt, Human
gaaaacaauaacga

SEQ ID NO: 770637 - RNA, 15 nt, Human
uagauaggccauggg

SEQ ID NO: 770638 - RNA, 22 nt, Human
aaacauguuuaucguauuugau

SEQ ID NO: 770639 - RNA, 21 nt, Human
caccagucugacuguuuccau

SEQ ID NO: 770640 - RNA, 16 nt, Human
aagacugcacaucaaa

SEQ ID NO: 770641 - RNA, 18 nt, Human
gaaaauaacaauaaaaga

SEQ ID NO: 770642 - RNA, 20 nt, Human
cugauauuggacaguaaaau

SEQ ID NO: 770643 - RNA, 18 nt, Human
uuuugugaagcaaaauuu

SEQ ID NO: 770644 - RNA, 21 nt, Human
aaaugucuugcuugauuguau

SEQ ID NO: 770645 - RNA, 16 nt, Human
uauaugucacuuugcu

SEQ ID NO: 770646 - RNA, 23 nt, Human
aacuuguaaaggaauuuaaaaau

SEQ ID NO: 770647 - RNA, 17 nt, Human
acaaaugggaaacaaaa

SEQ ID NO: 770648 - RNA, 14 nt, Human
aauauuauguuaaa

SEQ ID NO: 770649 - RNA, 12 nt, Human
ucuuaagaagac

SEQ ID NO: 770650 - RNA, 14 nt, Human
acaaauccaaugaa

SEQ ID NO: 770651 - RNA, 19 nt, Human
agucaaauugugugaaagg

SEQ ID NO: 770652 - RNA, 18 nt, Human
gcuccauuuuuagugaaa

SEQ ID NO: 770653 - RNA, 22 nt, Human
uuuauagcuacuaauuuuaaaa

SEQ ID NO: 770654 - RNA, 20 nt, Human
gaaacauuugguaaggggaa

SEQ ID NO: 770655 - RNA, 21 nt, Human
ucauucacucaacaaacauaa

SEQ ID NO: 770656 - RNA, 22 nt, Human
aauuacauuuguauaaaauaau

SEQ ID NO: 770657 - RNA, 16 nt, Human
uacauuuguauaaaau

SEQ ID NO: 770658 - RNA, 16 nt, Human
cagggcucacagaauu

SEQ ID NO: 770659 - RNA, 14 nt, Human
auuuauguuuaauu

SEQ ID NO: 770660 - RNA, 18 nt, Human
uaagcuucacuguaaaau

SEQ ID NO: 770661 - RNA, 22 nt, Human
augguuguauuauuuuuuaaaa

SEQ ID NO: 770662 - RNA, 19 nt, Human
ucugagcauuuaauaugga

SEQ ID NO: 770663 - RNA, 23 nt, Human
agaaugauuaugaauuacauuug

SEQ ID NO: 770664 - RNA, 19 nt, Human
caauucuugccaaauauaa

SEQ ID NO: 770665 - RNA, 13 nt, Human
caguuauuauauu

SEQ ID NO: 770666 - RNA, 16 nt, Human
agugaaagaaaauaac

SEQ ID NO: 770667 - RNA, 21 nt, Human
auguuuaauucugaaagcaac

SEQ ID NO: 770668 - RNA, 17 nt, Human
agggcauagaaguaaaa

SEQ ID NO: 770669 - RNA, 16 nt, Human
guuuuuuuuuaaaaaa

SEQ ID NO: 770670 - RNA, 23 nt, Human
cuacacgagauacagaauuuuau

SEQ ID NO: 770671 - RNA, 21 nt, Human
ucacaugaacuuguaaaggaa

SEQ ID NO: 770672 - RNA, 12 nt, Human
aagaaaauaaca

SEQ ID NO: 770673 - RNA, 23 nt, Human
uaaguuuuuuuuuaaaaaagaaa

SEQ ID NO: 770674 - RNA, 17 nt, Human
agacacacugaagaagc

SEQ ID NO: 770675 - RNA, 19 nt, Human
aguauuucuaugaaauauu

SEQ ID NO: 770676 - RNA, 19 nt, Human
agaaaauaacgauaaaaga

SEQ ID NO: 770677 - RNA, 17 nt, Human
ucuuucacauuuaaaua

SEQ ID NO: 770678 - RNA, 21 nt, Human
caagacugcacaucaaaauau

SEQ ID NO: 770679 - RNA, 14 nt, Human
cuaagucuuauaua

SEQ ID NO: 770680 - RNA, 20 nt, Human
uugauaaguacaugauaagc

SEQ ID NO: 770681 - RNA, 23 nt, Human
uauguuaaaacugggacagggga

SEQ ID NO: 770682 - RNA, 15 nt, Human
ugucaauaaaaucca

SEQ ID NO: 770683 - RNA, 18 nt, Human
aaauauaaauaaaaauaa

SEQ ID NO: 770684 - RNA, 16 nt, Human
augaauacuuuauaaa

SEQ ID NO: 770685 - RNA, 22 nt, Human
gaaaacaauaacgauaaaagac

SEQ ID NO: 770686 - RNA, 23 nt, Human
cugaaaucauacuucuuaggguu

SEQ ID NO: 770687 - RNA, 15 nt, Human
gcacagccucuuaga

SEQ ID NO: 770688 - RNA, 14 nt, Human
uaaaggaauuuaaa

SEQ ID NO: 770689 - RNA, 20 nt, Human
uauaugcuaagucuuauaua

SEQ ID NO: 770690 - RNA, 19 nt, Human
guaguccuguaauggaagc

SEQ ID NO: 770691 - RNA, 17 nt, Human
aaucuuucacaggggac

SEQ ID NO: 770692 - RNA, 16 nt, Human
auuuuaauaauguuuc

SEQ ID NO: 770693 - RNA, 14 nt, Human
accacaagacugca

SEQ ID NO: 770694 - RNA, 15 nt, Human
uguauuuuaaaagaa

SEQ ID NO: 770695 - RNA, 15 nt, Human
cagugaaagaaaaua

SEQ ID NO: 770696 - RNA, 18 nt, Human
auucuugccaaauauaaa

SEQ ID NO: 770697 - RNA, 19 nt, Human
aaagacagugaaagaaaau

SEQ ID NO: 770698 - RNA, 21 nt, Human
gcacuguggguagacacacau

SEQ ID NO: 770699 - RNA, 13 nt, Human
auuuuuuaaaaaa

SEQ ID NO: 770700 - RNA, 18 nt, Human
uucucuaggaaauauuua

SEQ ID NO: 770701 - RNA, 18 nt, Human
acugugugcuaaaacaag

SEQ ID NO: 770702 - RNA, 16 nt, Human
ucucuaggaaauauuu

SEQ ID NO: 770703 - RNA, 21 nt, Human
cauuuucuucucacauuuaua

SEQ ID NO: 770704 - RNA, 15 nt, Human
ccagauccuggaaau

SEQ ID NO: 770705 - RNA, 14 nt, Human
uuuuaaaaaagaaa

SEQ ID NO: 770706 - RNA, 19 nt, Human
uggaacaguuaccucugcc

SEQ ID NO: 770707 - RNA, 15 nt, Human
aagccagauuuuccu

SEQ ID NO: 770708 - RNA, 14 nt, Human
auuucuaugaaaua

SEQ ID NO: 770709 - RNA, 17 nt, Human
cauuuguauaaaauaau

SEQ ID NO: 770710 - RNA, 18 nt, Human
ugcauagguuuaauaauu

SEQ ID NO: 770711 - RNA, 17 nt, Human
ucuuauaauuuaaaaua

SEQ ID NO: 770712 - RNA, 22 nt, Human
auaacaaugcuguauuuuaaaa

SEQ ID NO: 770713 - RNA, 16 nt, Human
aaauauuauguuaaaa

SEQ ID NO: 770714 - RNA, 15 nt, Human
uaaaagacaaggaaa

SEQ ID NO: 770715 - RNA, 14 nt, Human
aaaagacagugaaa

SEQ ID NO: 770716 - RNA, 18 nt, Human
auuaaguuuuuuuuuaaa

SEQ ID NO: 770717 - RNA, 13 nt, Human
acacacaugaagu

SEQ ID NO: 770718 - RNA, 16 nt, Human
acaaauccaaugaaau

SEQ ID NO: 770719 - RNA, 22 nt, Human
accaaucaugaauuaguuuuau

SEQ ID NO: 770720 - RNA, 13 nt, Human
ucuuauaauuuaa

SEQ ID NO: 770721 - RNA, 18 nt, Human
cauagguuuaauaauuuu

SEQ ID NO: 770722 - RNA, 15 nt, Human
agugacaagcucaca

SEQ ID NO: 770723 - RNA, 13 nt, Human
aaaguguuugaaa

SEQ ID NO: 770724 - RNA, 14 nt, Human
cacuaaacaaagag

SEQ ID NO: 770725 - RNA, 18 nt, Human
uauuuucuauaauuuaaa

SEQ ID NO: 770726 - RNA, 19 nt, Human
gucaaauugugugaaaggu

SEQ ID NO: 770727 - RNA, 19 nt, Human
uccagaaagugacaagcuc

SEQ ID NO: 770728 - RNA, 15 nt, Human
cagaauucauucacu

SEQ ID NO: 770729 - RNA, 17 nt, Human
ggaaauauuuauuuuaa

SEQ ID NO: 770730 - RNA, 16 nt, Human
cuuauaauuuaaaaua

SEQ ID NO: 770731 - RNA, 14 nt, Human
ucuaggaaauauuu

SEQ ID NO: 770732 - RNA, 16 nt, Human
uagcuacuaauuuuaa

SEQ ID NO: 770733 - RNA, 20 nt, Human
uaugcuucuguuuuauaauu

SEQ ID NO: 770734 - RNA, 15 nt, Human
aauaacgauaaaaga

SEQ ID NO: 770735 - RNA, 11 nt, Human
gagguaaaagc

SEQ ID NO: 770736 - RNA, 20 nt, Human
agccuaguugaucagcuuau

SEQ ID NO: 770737 - RNA, 21 nt, Human
uuauagcuacuaauuuuaaaa

SEQ ID NO: 770738 - RNA, 18 nt, Human
gaugcaguucugaagaag

SEQ ID NO: 770739 - RNA, 18 nt, Human
aaaucuuauaauuuaaaa

SEQ ID NO: 770740 - RNA, 22 nt, Human
auauauaacaaugcuguauuuu

SEQ ID NO: 770741 - RNA, 15 nt, Human
aaggaaaaaauaaca

SEQ ID NO: 770742 - RNA, 19 nt, Human
acuaucucauuuccaagca

SEQ ID NO: 770743 - RNA, 23 nt, Human
uagauaggucagugcaaauacuc

SEQ ID NO: 770744 - RNA, 22 nt, Human
auauuuacaaaugggaaacaaa

SEQ ID NO: 770745 - RNA, 19 nt, Human
aaacaaaaggauaaugaau

SEQ ID NO: 770746 - RNA, 18 nt, Human
aaauauuuauuuuaauaa

SEQ ID NO: 770747 - RNA, 12 nt, Human
acugaaaucaua

SEQ ID NO: 770748 - RNA, 23 nt, Human
cuugauaaauggcuuccuggcaa

SEQ ID NO: 770749 - RNA, 16 nt, Human
aaaauaauccucaguu

SEQ ID NO: 770750 - RNA, 22 nt, Human
ucuagcaugucgucaaagcuga

SEQ ID NO: 770751 - RNA, 13 nt, Human
aucucaauauuuc

SEQ ID NO: 770752 - RNA, 20 nt, Human
uaacgauaaaagacagugaa

SEQ ID NO: 770753 - RNA, 13 nt, Human
uaauuuuuauauu

SEQ ID NO: 770754 - RNA, 19 nt, Human
cucauggaauuggagcucg

SEQ ID NO: 770755 - RNA, 17 nt, Human
caagccuccuuuuaaag

SEQ ID NO: 770756 - RNA, 13 nt, Human
uuuaaaaaagaaa

SEQ ID NO: 770757 - RNA, 17 nt, Human
cagugaaagaaaauaac

SEQ ID NO: 770758 - RNA, 15 nt, Human
guaaggggaauugag

SEQ ID NO: 770759 - RNA, 15 nt, Human
uugcucauggaauug

SEQ ID NO: 770760 - RNA, 23 nt, Human
aaaauaucacuugucaauaaaau

SEQ ID NO: 770761 - RNA, 13 nt, Human
aagcauuccaacu

SEQ ID NO: 770762 - RNA, 24 nt, Human
cauucuggaauaauccuaaacaua

SEQ ID NO: 770763 - RNA, 17 nt, Human
gaagaccucauuuugaa

SEQ ID NO: 770764 - RNA, 21 nt, Human
auaauuuuuauauuugaaaua

SEQ ID NO: 770765 - RNA, 14 nt, Human
ugcuucuguuuuau

SEQ ID NO: 770766 - RNA, 20 nt, Human
acuuuauuuucuauaauuua

SEQ ID NO: 770767 - RNA, 13 nt, Human
aaaaauccuacuu

SEQ ID NO: 770768 - RNA, 13 nt, Human
ccagcacagccuc

SEQ ID NO: 770769 - RNA, 23 nt, Human
aguaauuggaaaggcagcucuaa

SEQ ID NO: 770770 - RNA, 15 nt, Human
agaaaacaauaacga

SEQ ID NO: 770771 - RNA, 21 nt, Human
gaaaaguauguuagugcaaau

SEQ ID NO: 770772 - RNA, 17 nt, Human
uuauauuugaaauauug

SEQ ID NO: 770773 - RNA, 19 nt, Human
auuauuuuuuaaaaaaauu

SEQ ID NO: 770774 - RNA, 17 nt, Human
gauaaaagacagugaaa

SEQ ID NO: 770775 - RNA, 16 nt, Human
ugaaauuguauuacaa

SEQ ID NO: 770776 - RNA, 21 nt, Human
ccaaauauaaauaaaaauaau

SEQ ID NO: 770777 - RNA, 19 nt, Human
uguuggacgagaaaacaau

SEQ ID NO: 770778 - RNA, 16 nt, Human
uuuucucuaggaaaua

SEQ ID NO: 770779 - RNA, 13 nt, Human
cucagaaaacaag

SEQ ID NO: 770780 - RNA, 13 nt, Human
gaagaacugaaau

SEQ ID NO: 770781 - RNA, 20 nt, Human
guauuauuuuuuaaaaaaau

SEQ ID NO: 770782 - RNA, 15 nt, Human
uuuagugaaauauua

SEQ ID NO: 770783 - RNA, 21 nt, Human
aagcuccauuuuuagugaaau

SEQ ID NO: 770784 - RNA, 17 nt, Human
aucaaggguacacugcc

SEQ ID NO: 770785 - RNA, 19 nt, Human
uaucucauuuccaagcaag

SEQ ID NO: 770786 - RNA, 18 nt, Human
ucaaggguacacugccuu

SEQ ID NO: 770787 - RNA, 14 nt, Human
agaauucauucacu

SEQ ID NO: 770788 - RNA, 19 nt, Human
uuuccugaaaacccuugcc

SEQ ID NO: 770789 - RNA, 22 nt, Human
uaauaggcguaacuaauuuuaa

SEQ ID NO: 770790 - RNA, 15 nt, Human
aaggguacacugccu

SEQ ID NO: 770791 - RNA, 18 nt, Human
gaaaauaacgauaaaaga

SEQ ID NO: 770792 - RNA, 15 nt, Human
caaauccaaugaaau

SEQ ID NO: 770793 - RNA, 17 nt, Human
ccccaguuguuucuacu

SEQ ID NO: 770794 - RNA, 17 nt, Human
agcuucacuguaaaaua

SEQ ID NO: 770795 - RNA, 13 nt, Human
aauuuuuauauuu

SEQ ID NO: 770796 - RNA, 14 nt, Human
acagaauuuuaugc

SEQ ID NO: 770797 - RNA, 16 nt, Human
accucugccucagaaa

SEQ ID NO: 770798 - RNA, 16 nt, Human
cugcucucaguucacu

SEQ ID NO: 770799 - RNA, 20 nt, Human
ugagagacacacugaagaag

SEQ ID NO: 770800 - RNA, 14 nt, Human
aaauauaaauaaaa

SEQ ID NO: 770801 - RNA, 14 nt, Human
auaaauaaaaauaa

SEQ ID NO: 770802 - RNA, 19 nt, Human
auucccagccagcacagcc

SEQ ID NO: 770803 - RNA, 22 nt, Human
aaagacagugaaagaaaauaac

SEQ ID NO: 770804 - RNA, 20 nt, Human
agccuuggggcugaugcagu

SEQ ID NO: 770805 - RNA, 20 nt, Human
uaugaaaaggcuaagcuuca

SEQ ID NO: 770806 - RNA, 14 nt, Human
uaaaauccauacau

SEQ ID NO: 770807 - RNA, 11 nt, Human
aauuuaaauau

SEQ ID NO: 770808 - RNA, 14 nt, Human
ggcaauagucaaau

SEQ ID NO: 770809 - RNA, 16 nt, Human
ugaauuaguuuuauau

SEQ ID NO: 770810 - RNA, 17 nt, Human
uucucuaggaaauauuu

SEQ ID NO: 770811 - RNA, 22 nt, Human
uuuaauaauguuucaaacauau

SEQ ID NO: 770812 - RNA, 19 nt, Human
agagccuuuuuuugaaaaa

SEQ ID NO: 770813 - RNA, 16 nt, Human
uaacaauaaaagacaa

SEQ ID NO: 770814 - RNA, 15 nt, Human
uaacaauaaaagaca

SEQ ID NO: 770815 - RNA, 13 nt, Human
auuggacaguaaa

SEQ ID NO: 770816 - RNA, 20 nt, Human
aauuaaguuuuuuuuuaaaa

SEQ ID NO: 770817 - RNA, 17 nt, Human
auguugacaugggacau

SEQ ID NO: 770818 - RNA, 18 nt, Human
cuuuucccaacuccagaa

SEQ ID NO: 770819 - RNA, 12 nt, Human
cucauggaauug

SEQ ID NO: 770820 - RNA, 16 nt, Human
uaaauaaaaauaaucc

SEQ ID NO: 770821 - RNA, 17 nt, Human
aauaacaauaaaagaca

SEQ ID NO: 770822 - RNA, 23 nt, Human
guaauuccguagguuauuuucag

SEQ ID NO: 770823 - RNA, 14 nt, Human
uugccaugugcuag

SEQ ID NO: 770824 - RNA, 13 nt, Human
auugucuagugaa

SEQ ID NO: 770825 - RNA, 15 nt, Human
augaauuaaguuuuu

SEQ ID NO: 770826 - RNA, 21 nt, Human
aauaauccucaguuuuuguga

SEQ ID NO: 770827 - RNA, 21 nt, Human
caucuagcaugucgucaaagc

SEQ ID NO: 770828 - RNA, 22 nt, Human
aaacaaggaugaauuaaguuuu

SEQ ID NO: 770829 - RNA, 18 nt, Human
aaagagugaaggauuuau

SEQ ID NO: 770830 - RNA, 21 nt, Human
uuauguuuaauucugaaagca

SEQ ID NO: 770831 - RNA, 13 nt, Human
uuauguuuaauuc

SEQ ID NO: 770832 - RNA, 14 nt, Human
uauaaauaaaaaua

SEQ ID NO: 770833 - RNA, 20 nt, Human
uaacaagccuccuuuuaaag

SEQ ID NO: 770834 - RNA, 13 nt, Human
aaaugggaaacaa

SEQ ID NO: 770835 - RNA, 12 nt, Human
cuugguuuuaau

SEQ ID NO: 770836 - RNA, 19 nt, Human
auuuugugaagcaaaauuu

SEQ ID NO: 770837 - RNA, 13 nt, Human
aguuaccucugcc

SEQ ID NO: 770838 - RNA, 14 nt, Human
guaacugauuugua

SEQ ID NO: 770839 - RNA, 17 nt, Human
cucgugggacagucacc

SEQ ID NO: 770840 - RNA, 18 nt, Human
aagaccucauuuugaagg

SEQ ID NO: 770841 - RNA, 13 nt, Human
uaacgauaaaaga

SEQ ID NO: 770842 - RNA, 21 nt, Human
uauuauuuuauagcuacuaau

SEQ ID NO: 770843 - RNA, 12 nt, Human
agacagugaaag

SEQ ID NO: 770844 - RNA, 12 nt, Human
cagugaaagaaa

SEQ ID NO: 770845 - RNA, 18 nt, Human
uuuauggcacuaguauuu

SEQ ID NO: 770846 - RNA, 18 nt, Human
cuucacuguaaaauaaua

SEQ ID NO: 770847 - RNA, 19 nt, Human
gucaaucagccuaguugau

SEQ ID NO: 770848 - RNA, 18 nt, Human
uacuuuauuuucuauaau

SEQ ID NO: 770849 - RNA, 18 nt, Human
gaauaauccuaaacauau

SEQ ID NO: 770850 - RNA, 15 nt, Human
acaaaugggaaacaa

SEQ ID NO: 770851 - RNA, 23 nt, Human
ucuuagaugcaguucugaagaag

SEQ ID NO: 770852 - RNA, 18 nt, Human
aaauaacgauaaaagaca

SEQ ID NO: 770853 - RNA, 19 nt, Human
gucuuucacauuuaaauaa

SEQ ID NO: 770854 - RNA, 15 nt, Human
auaaaguguuugaaa

SEQ ID NO: 770855 - RNA, 14 nt, Human
ucccuugaugaaga

SEQ ID NO: 770856 - RNA, 18 nt, Human
cuggaaacuucagcgguu

SEQ ID NO: 770857 - RNA, 19 nt, Human
aaaauaacgauaaaagaca

SEQ ID NO: 770858 - RNA, 22 nt, Human
uagacacacaugaaguccaagc

SEQ ID NO: 770859 - RNA, 14 nt, Human
uauaauuuaaaaua

SEQ ID NO: 770860 - RNA, 14 nt, Human
auuauuuuuuaaaa

SEQ ID NO: 770861 - RNA, 12 nt, Human
aguguuugaaag

SEQ ID NO: 770862 - RNA, 15 nt, Human
cucaacaaacauaau

SEQ ID NO: 770863 - RNA, 12 nt, Human
auuuuaaaagaa

SEQ ID NO: 770864 - RNA, 18 nt, Human
guuaguauuguccagguc

SEQ ID NO: 770865 - RNA, 20 nt, Human
cagugaaagaaaauaacgau

SEQ ID NO: 770866 - RNA, 15 nt, Human
acuuuauaaaggauu

SEQ ID NO: 770867 - RNA, 14 nt, Human
aguuuuuuuuuaaa

SEQ ID NO: 770868 - RNA, 22 nt, Human
ccauuucuugagguaaaagcau

SEQ ID NO: 770869 - RNA, 19 nt, Human
agacagugaaagaaaauaa

SEQ ID NO: 770870 - RNA, 22 nt, Human
uaaaacaagcacuaaacaaaga

SEQ ID NO: 770871 - RNA, 21 nt, Human
gauaaaagacagugaaagaaa

SEQ ID NO: 770872 - RNA, 15 nt, Human
auuucuaugaaauau

SEQ ID NO: 770873 - RNA, 13 nt, Human
uauuuauuuuaau

SEQ ID NO: 770874 - RNA, 22 nt, Human
uuguaacaagccuccuuuuaaa

SEQ ID NO: 770875 - RNA, 14 nt, Human
uuucuaugaaauau

SEQ ID NO: 770876 - RNA, 20 nt, Human
ugauuauaugucacuuugcu

SEQ ID NO: 770877 - RNA, 23 nt, Human
uaaaagacagugaaagaaaauaa

SEQ ID NO: 770878 - RNA, 14 nt, Human
auaaaauaauuuuu

SEQ ID NO: 770879 - RNA, 23 nt, Human
acgaggauugggaaaaaguaauu

SEQ ID NO: 770880 - RNA, 17 nt, Human
aaucuuauaauuuaaaa

SEQ ID NO: 770881 - RNA, 15 nt, Human
aagccuccuuuuaaa

SEQ ID NO: 770882 - RNA, 14 nt, Human
cagugaaagaaaau

SEQ ID NO: 770883 - RNA, 15 nt, Human
cucguggaacaguua

SEQ ID NO: 770884 - RNA, 22 nt, Human
uggaaaguuuaugguuguauua

SEQ ID NO: 770885 - RNA, 23 nt, Human
auuauauggcuugaguuuaaauu

SEQ ID NO: 770886 - RNA, 17 nt, Human
uuuuuaauuauauggcu

SEQ ID NO: 770887 - RNA, 15 nt, Human
auagaaguaaaaaca

SEQ ID NO: 770888 - RNA, 17 nt, Human
cuggagggaagccuugg

SEQ ID NO: 770889 - RNA, 20 nt, Human
ugaaaaucuuauaauuuaaa

SEQ ID NO: 770890 - RNA, 17 nt, Human
aaagacaaggaaaaaau

SEQ ID NO: 770891 - RNA, 17 nt, Human
agcuacuaauuuuaaaa

SEQ ID NO: 770892 - RNA, 22 nt, Human
cacuuccaagagccuuuuuuug

SEQ ID NO: 770893 - RNA, 19 nt, Human
auuuucaguuauuauauuu

SEQ ID NO: 770894 - RNA, 21 nt, Human
auuuguauaaaauaauuuuua

SEQ ID NO: 770895 - RNA, 15 nt, Human
agggcucacagaauu

SEQ ID NO: 770896 - RNA, 15 nt, Human
aauucugaaagcaac

SEQ ID NO: 770897 - RNA, 19 nt, Human
auugaggacacugauaugg

SEQ ID NO: 770898 - RNA, 22 nt, Human
aagagccuuuuuuugaaaaaaa

SEQ ID NO: 770899 - RNA, 14 nt, Human
ugcuaagucuuaua

SEQ ID NO: 770900 - RNA, 20 nt, Human
caaauauaaauaaaaauaau

SEQ ID NO: 770901 - RNA, 20 nt, Human
aagaugguaccaccagucug

SEQ ID NO: 770902 - RNA, 13 nt, Human
ccucauggaauug

SEQ ID NO: 770903 - RNA, 14 nt, Human
aaaagaaacauuug

SEQ ID NO: 770904 - RNA, 23 nt, Human
aggaugguucccuugaugaagaa

SEQ ID NO: 770905 - RNA, 17 nt, Human
aaauaacaauaaaagac

SEQ ID NO: 770906 - RNA, 15 nt, Human
caagcucacagaccu

SEQ ID NO: 770907 - RNA, 22 nt, Human
ugggcacuguggguagacacac

SEQ ID NO: 770908 - RNA, 18 nt, Human
auaauccuaaacauauga

SEQ ID NO: 770909 - RNA, 22 nt, Human
agucuuucacauuuaaauaaag

SEQ ID NO: 770910 - RNA, 14 nt, Human
ccaaauauaaauaa

SEQ ID NO: 770911 - RNA, 14 nt, Human
uacuaauuuuaaaa

SEQ ID NO: 770912 - RNA, 22 nt, Human
cauuuaaauaaaguguuugaaa

SEQ ID NO: 770913 - RNA, 22 nt, Human
gaauuaaguuuuuuuuuaaaaa

SEQ ID NO: 770914 - RNA, 22 nt, Human
acaccuuguacuuuauuuucua

SEQ ID NO: 770915 - RNA, 19 nt, Human
uguaguguuggagaagaac

SEQ ID NO: 770916 - RNA, 14 nt, Human
aagagugaaggauu

SEQ ID NO: 770917 - RNA, 16 nt, Human
auugucuagugaaacu

SEQ ID NO: 770918 - RNA, 19 nt, Human
gacagucaccucauggaau

SEQ ID NO: 770919 - RNA, 15 nt, Human
acagugaaagaaaau

SEQ ID NO: 770920 - RNA, 13 nt, Human
auugauuauaugu

SEQ ID NO: 770921 - RNA, 22 nt, Human
gcacagccucuuagaugcaguu

SEQ ID NO: 770922 - RNA, 15 nt, Human
uacuaauuuuaaaau

SEQ ID NO: 770923 - RNA, 15 nt, Human
auaauccuaaacaua

SEQ ID NO: 770924 - RNA, 22 nt, Human
cugggacaggggagaaccuagg

SEQ ID NO: 770925 - RNA, 23 nt, Human
caugcugucuacacuaagagaga

SEQ ID NO: 770926 - RNA, 15 nt, Human
cuuuucccaacucca

SEQ ID NO: 770927 - RNA, 22 nt, Human
caauaaaagacaaggaaaaaau

SEQ ID NO: 770928 - RNA, 23 nt, Human
agcaugucgucaaagcugaaaug

SEQ ID NO: 770929 - RNA, 23 nt, Human
auauaacaaugcuguauuuuaaa

SEQ ID NO: 770930 - RNA, 23 nt, Human
uacaaaugggaaacaaaaggaua

SEQ ID NO: 770931 - RNA, 21 nt, Human
ugaugcuacaggauuugaaau

SEQ ID NO: 770932 - RNA, 14 nt, Human
acauagugaggagc

SEQ ID NO: 770933 - RNA, 13 nt, Human
auaacgauaaaag

SEQ ID NO: 770934 - RNA, 18 nt, Human
aaaaucuuauaauuuaaa

SEQ ID NO: 770935 - RNA, 16 nt, Human
acauuugcucauggaa

SEQ ID NO: 770936 - RNA, 21 nt, Human
cuuguuggacgagaaaacaau

SEQ ID NO: 770937 - RNA, 16 nt, Human
ugcacaucaaaauaug

SEQ ID NO: 770938 - RNA, 23 nt, Human
ucuagcaugucgucaaagcugaa

SEQ ID NO: 770939 - RNA, 17 nt, Human
cucguggaacaguuacc

SEQ ID NO: 770940 - RNA, 17 nt, Human
aaauaacgauaaaagac

SEQ ID NO: 770941 - RNA, 22 nt, Human
uggacgagaaaacaauaacgau

SEQ ID NO: 770942 - RNA, 15 nt, Human
auauugacuuuuuau

SEQ ID NO: 770943 - RNA, 23 nt, Human
uuuauaugcuucuguuuuauaau

SEQ ID NO: 770944 - RNA, 11 nt, Human
cauaugaaaag

SEQ ID NO: 770945 - RNA, 21 nt, Human
aaacgaggauugggaaaaagu

SEQ ID NO: 770946 - RNA, 17 nt, Human
uuauuacuguaagaaaa

SEQ ID NO: 770947 - RNA, 20 nt, Human
aagucuuucacauuuaaaua

SEQ ID NO: 770948 - RNA, 16 nt, Human
aauuacauuuguauaa

SEQ ID NO: 770949 - RNA, 20 nt, Human
aguuuuuuuuuaaaaaagaa

SEQ ID NO: 770950 - RNA, 21 nt, Human
auuauauggcuugaguuuaaa

SEQ ID NO: 770951 - RNA, 22 nt, Human
uuugaaacgaggauugggaaaa

SEQ ID NO: 770952 - RNA, 21 nt, Human
aaaauaugccccauucaacau

SEQ ID NO: 770953 - RNA, 16 nt, Human
aggguguguaaguaga

SEQ ID NO: 770954 - RNA, 13 nt, Human
ugaaaaucuuaua

SEQ ID NO: 770955 - RNA, 17 nt, Human
aaccuagggugauauua

SEQ ID NO: 770956 - RNA, 13 nt, Human
ugcauuucuaaag

SEQ ID NO: 770957 - RNA, 20 nt, Human
ugauuucugagcauuuaaua

SEQ ID NO: 770958 - RNA, 12 nt, Human
uucucuaggaaa

SEQ ID NO: 770959 - RNA, 18 nt, Human
auagcuacuaauuuuaaa

SEQ ID NO: 770960 - RNA, 17 nt, Human
ugguucccuugaugaag

SEQ ID NO: 770961 - RNA, 18 nt, Human
ucucuaggaaauauuuau

SEQ ID NO: 770962 - RNA, 13 nt, Human
aacucuauaaugu

SEQ ID NO: 770963 - RNA, 22 nt, Human
aaauguugacaugggacauuug

SEQ ID NO: 770964 - RNA, 15 nt, Human
aagcacuaaacaaag

SEQ ID NO: 770965 - RNA, 15 nt, Human
uuaauucugaaagca

SEQ ID NO: 770966 - RNA, 20 nt, Human
agaagaacugaaaucauacu

SEQ ID NO: 770967 - RNA, 12 nt, Human
aauuuaaauaua

SEQ ID NO: 770968 - RNA, 20 nt, Human
acagcccuucuuuccacaga

SEQ ID NO: 770969 - RNA, 15 nt, Human
ucuaugaaauauuau

SEQ ID NO: 770970 - RNA, 18 nt, Human
gaaacaaaaggauaauga

SEQ ID NO: 770971 - RNA, 20 nt, Human
agcuuauugucuagugaaac

SEQ ID NO: 770972 - RNA, 22 nt, Human
gcuaaaacaagcacuaaacaaa

SEQ ID NO: 770973 - RNA, 20 nt, Human
caagccuccuuuuaaaguaa

SEQ ID NO: 770974 - RNA, 13 nt, Human
uacuuuauuuucu

SEQ ID NO: 770975 - RNA, 15 nt, Human
cuacuaauuuuaaaa

SEQ ID NO: 770976 - RNA, 15 nt, Human
ucacaggacagcccu

SEQ ID NO: 770977 - RNA, 12 nt, Human
uauaauuuaaaa

SEQ ID NO: 770978 - RNA, 23 nt, Human
uccaacuaucucauuuccaagca

SEQ ID NO: 770979 - RNA, 23 nt, Human
uuagaugcaguucugaagaagau

SEQ ID NO: 770980 - RNA, 18 nt, Human
uuguaaaggaauuuaaaa

SEQ ID NO: 770981 - RNA, 16 nt, Human
auuugaugcuacagga

SEQ ID NO: 770982 - RNA, 18 nt, Human
uauaacaaugcuguauuu

SEQ ID NO: 770983 - RNA, 22 nt, Human
caaaugggaaacaaaaggauaa

SEQ ID NO: 770984 - RNA, 22 nt, Human
uauuccuuuuucucuccucucc

SEQ ID NO: 770985 - RNA, 22 nt, Human
ugaagcaaaauuuuuucucuag

SEQ ID NO: 770986 - RNA, 20 nt, Human
aauaauuuuuauauuugaaa

SEQ ID NO: 770987 - RNA, 13 nt, Human
uucuauaauuuaa

SEQ ID NO: 770988 - RNA, 18 nt, Human
auuuguauaaaauaauuu

SEQ ID NO: 770989 - RNA, 14 nt, Human
cuaagcauuccaac

SEQ ID NO: 770990 - RNA, 15 nt, Human
aaacauaugaauuau

SEQ ID NO: 770991 - RNA, 22 nt, Human
aaauaacaaugaaaguugauaa

SEQ ID NO: 770992 - RNA, 13 nt, Human
ugauuauauguca

SEQ ID NO: 770993 - RNA, 19 nt, Human
cuuccagauccuggaaauc

SEQ ID NO: 770994 - RNA, 20 nt, Human
uuccacagaagcuccaggua

SEQ ID NO: 770995 - RNA, 11 nt, Human
auuuuugaagc

SEQ ID NO: 770996 - RNA, 18 nt, Human
acaaaaggauaaugaaua

SEQ ID NO: 770997 - RNA, 15 nt, Human
aaauauaaauaaaaa

SEQ ID NO: 770998 - RNA, 16 nt, Human
gccaugugcuaguaau

SEQ ID NO: 770999 - RNA, 22 nt, Human
gaugcaguuguugcccacagcu

SEQ ID NO: 771000 - RNA, 21 nt, Human
gccuuuucccaacuccagaaa

SEQ ID NO: 771001 - RNA, 14 nt, Human
ugcuguauuuuaaa

SEQ ID NO: 771002 - RNA, 16 nt, Human
aaaagcaucacaugaa

SEQ ID NO: 771003 - RNA, 16 nt, Human
ugaaguccaagcauuu

SEQ ID NO: 771004 - RNA, 19 nt, Human
auuaaguuuuuuuuuaaaa

SEQ ID NO: 771005 - RNA, 15 nt, Human
ugcuucuguuuuaua

SEQ ID NO: 771006 - RNA, 17 nt, Human
auuuuaauaauguuuca

SEQ ID NO: 771007 - RNA, 11 nt, Human
cgauaaaagac

SEQ ID NO: 771008 - RNA, 14 nt, Human
ugguauguuuucag

SEQ ID NO: 771009 - RNA, 11 nt, Human
auuuaaaaauc

SEQ ID NO: 771010 - RNA, 12 nt, Human
cagauuuuccug

SEQ ID NO: 771011 - RNA, 17 nt, Human
acuuccagauccuggaa

SEQ ID NO: 771012 - RNA, 22 nt, Human
uauuucagauaaucacaauaca

SEQ ID NO: 771013 - RNA, 23 nt, Human
augucaauucuugccaaauauaa

SEQ ID NO: 771014 - RNA, 13 nt, Human
acuaauuuuaaaa

SEQ ID NO: 771015 - RNA, 13 nt, Human
auaacuggaaacu

SEQ ID NO: 771016 - RNA, 20 nt, Human
agagacacacugaagaagca

SEQ ID NO: 771017 - RNA, 14 nt, Human
agucugacuguuuc

SEQ ID NO: 771018 - RNA, 13 nt, Human
ugaaauuguauua

SEQ ID NO: 771019 - RNA, 22 nt, Human
uuugaugcuacaggauuugaaa

SEQ ID NO: 771020 - RNA, 21 nt, Human
uaaaagacagugaaagaaaau

SEQ ID NO: 771021 - RNA, 15 nt, Human
ucauaauaaguugca

SEQ ID NO: 771022 - RNA, 12 nt, Human
uauuauuuuuua

SEQ ID NO: 771023 - RNA, 20 nt, Human
uuacaaauccaaugaaauga

SEQ ID NO: 771024 - RNA, 14 nt, Human
aagcaucacaugaa

SEQ ID NO: 771025 - RNA, 20 nt, Human
uuaaguuuuuuuuuaaaaaa

SEQ ID NO: 771026 - RNA, 14 nt, Human
uugaaauuguauua

SEQ ID NO: 771027 - RNA, 21 nt, Human
gaaaacaauaacgauaaaaga

SEQ ID NO: 771028 - RNA, 22 nt, Human
auauaaauaaaaauaauccuca

SEQ ID NO: 771029 - RNA, 13 nt, Human
cauuuguauaaaa

SEQ ID NO: 771030 - RNA, 22 nt, Human
agcacagccucuuagaugcagu

SEQ ID NO: 771031 - RNA, 15 nt, Human
cagccagcacagccu

SEQ ID NO: 771032 - RNA, 23 nt, Human
auuuuauagcuacuaauuuuaaa

SEQ ID NO: 771033 - RNA, 18 nt, Human
guuucaaacauauauaac

SEQ ID NO: 771034 - RNA, 16 nt, Human
auccuugaagauuuac

SEQ ID NO: 771035 - RNA, 12 nt, Human
caggacagcccu

SEQ ID NO: 771036 - RNA, 22 nt, Human
cauaaauguugacaugggacau

SEQ ID NO: 771037 - RNA, 14 nt, Human
cucaacaaacauaa

SEQ ID NO: 771038 - RNA, 22 nt, Human
ggcuaagcuucacuguaaaaua

SEQ ID NO: 771039 - RNA, 22 nt, Human
auauaugcuaagucuuauauau

SEQ ID NO: 771040 - RNA, 12 nt, Human
gacagugaaaga

SEQ ID NO: 771041 - RNA, 18 nt, Human
uuuuagugaaauauuauu

SEQ ID NO: 771042 - RNA, 17 nt, Human
gcaaauugucacaggac

SEQ ID NO: 771043 - RNA, 22 nt, Human
accauuucuugagguaaaagca

SEQ ID NO: 771044 - RNA, 18 nt, Human
uguauuauuuuuuaaaaa

SEQ ID NO: 771045 - RNA, 15 nt, Human
cacaggacagcccuu

SEQ ID NO: 771046 - RNA, 14 nt, Human
auuuucuauaauuu

SEQ ID NO: 771047 - RNA, 18 nt, Human
acucuuaagaagacugca

SEQ ID NO: 771048 - RNA, 22 nt, Human
caugaguaacugauuuguaaca

SEQ ID NO: 771049 - RNA, 12 nt, Human
gguuuauauaag

SEQ ID NO: 771050 - RNA, 22 nt, Human
aaaucaggguuaguauugucca

SEQ ID NO: 771051 - RNA, 19 nt, Human
caucaaggguacacugccu

SEQ ID NO: 771052 - RNA, 15 nt, Human
augguuguauuauuu

SEQ ID NO: 771053 - RNA, 17 nt, Human
ugaaaaucuuauaauuu

SEQ ID NO: 771054 - RNA, 15 nt, Human
uuauagcuacuaauu

SEQ ID NO: 771055 - RNA, 19 nt, Human
ggaaaaaauaacaaugaaa

SEQ ID NO: 771056 - RNA, 15 nt, Human
ccacaggaaccacaa

SEQ ID NO: 771057 - RNA, 18 nt, Human
uauuuucaguuauuauau

SEQ ID NO: 771058 - RNA, 20 nt, Human
auaacaaugcuguauuuuaa

SEQ ID NO: 771059 - RNA, 11 nt, Human
cuguuuuauaa

SEQ ID NO: 771060 - RNA, 22 nt, Human
uuuuauagcuacuaauuuuaaa

SEQ ID NO: 771061 - RNA, 21 nt, Human
aauuuuuauauuugaaauauu

SEQ ID NO: 771062 - RNA, 23 nt, Human
auaauguguucauucuggaauaa

SEQ ID NO: 771063 - RNA, 17 nt, Human
ucauacuucuuaggguu

SEQ ID NO: 771064 - RNA, 16 nt, Human
uccuguaauggaagca

SEQ ID NO: 771065 - RNA, 13 nt, Human
uuuagugaaauau

SEQ ID NO: 771066 - RNA, 21 nt, Human
auuccuuuuucucuccucucc

SEQ ID NO: 771067 - RNA, 14 nt, Human
uuauuauauuuaca

SEQ ID NO: 771068 - RNA, 13 nt, Human
cuucucaacucca

SEQ ID NO: 771069 - RNA, 14 nt, Human
uauuugaaauauug

SEQ ID NO: 771070 - RNA, 19 nt, Human
uauuuuaauaauguuucaa

SEQ ID NO: 771071 - RNA, 20 nt, Human
auaauccuaaacauaugaau

SEQ ID NO: 771072 - RNA, 12 nt, Human
gcugaugcaguu

SEQ ID NO: 771073 - RNA, 21 nt, Human
aaagaaaauaacgauaaaaga

SEQ ID NO: 771074 - RNA, 15 nt, Human
acucaacaaacauaa

SEQ ID NO: 771075 - RNA, 16 nt, Human
cugagcauuuaauaug

SEQ ID NO: 771076 - RNA, 15 nt, Human
gccccauucaacauc

SEQ ID NO: 771077 - RNA, 21 nt, Human
auaugcucuaaacauguuuau

SEQ ID NO: 771078 - RNA, 13 nt, Human
gaaccuaggguga

SEQ ID NO: 771079 - RNA, 16 nt, Human
aaaauaacaauaaaag

SEQ ID NO: 771080 - RNA, 23 nt, Human
ggaacaguuaccucugccucaga

SEQ ID NO: 771081 - RNA, 17 nt, Human
auaauuuaaauauaugc

SEQ ID NO: 771082 - RNA, 15 nt, Human
uaggaaauauuuauu

SEQ ID NO: 771083 - RNA, 21 nt, Human
uagggugauauuaaccagggg

SEQ ID NO: 771084 - RNA, 23 nt, Human
uccagguagaggguguguaagua

SEQ ID NO: 771085 - RNA, 14 nt, Human
ugugaaaagcucca

SEQ ID NO: 771086 - RNA, 16 nt, Human
ccuccuuuuaaaguaa

SEQ ID NO: 771087 - RNA, 20 nt, Human
agcuacuaauuuuaaaaugu

SEQ ID NO: 771088 - RNA, 13 nt, Human
uaugaaauauuau

SEQ ID NO: 771089 - RNA, 20 nt, Human
uauuuauuacuguaagaaaa

SEQ ID NO: 771090 - RNA, 14 nt, Human
uaugaauuacauuu

SEQ ID NO: 771091 - RNA, 13 nt, Human
cacaacuauauug

SEQ ID NO: 771092 - RNA, 11 nt, Human
acugggacagg

SEQ ID NO: 771093 - RNA, 17 nt, Human
gaagcaccaaucaugaa

SEQ ID NO: 771094 - RNA, 15 nt, Human
uucacauuuaaauaa

SEQ ID NO: 771095 - RNA, 20 nt, Human
aacaaugcuguauuuuaaaa

SEQ ID NO: 771096 - RNA, 15 nt, Human
ucuuauaauuuaaaa

SEQ ID NO: 771097 - RNA, 17 nt, Human
caauaacgauaaaagac

SEQ ID NO: 771098 - RNA, 18 nt, Human
agcaaaauuuuuucucua

SEQ ID NO: 771099 - RNA, 14 nt, Human
cuggaaaucagggu

SEQ ID NO: 771100 - RNA, 22 nt, Human
aaccuacacgagauacagaauu

SEQ ID NO: 771101 - RNA, 22 nt, Human
cuuguaaaggaauuuaaaaauc

SEQ ID NO: 771102 - RNA, 19 nt, Human
cuagaguuuagcuggaaaa

SEQ ID NO: 771103 - RNA, 16 nt, Human
auuuuuagugaaauau

SEQ ID NO: 771104 - RNA, 16 nt, Human
uuguaaaggaauuuaa

SEQ ID NO: 771105 - RNA, 15 nt, Human
uacaaaugcauuucu

SEQ ID NO: 771106 - RNA, 14 nt, Human
uauaauuuaaauau

SEQ ID NO: 771107 - RNA, 14 nt, Human
uaaauaaaaauaau

SEQ ID NO: 771108 - RNA, 20 nt, Human
accuacacgagauacagaau

SEQ ID NO: 771109 - RNA, 14 nt, Human
acgagaaaacaaua

SEQ ID NO: 771110 - RNA, 20 nt, Human
aaauccuugaagauuuacca

SEQ ID NO: 771111 - RNA, 22 nt, Human
auuacuguaagaaaauaucacu

SEQ ID NO: 771112 - RNA, 21 nt, Human
ucaagucuuucacauuuaaau

SEQ ID NO: 771113 - RNA, 16 nt, Human
auccaaugaaaugagu

SEQ ID NO: 771114 - RNA, 16 nt, Human
uacaaaugggaaacaa

SEQ ID NO: 771115 - RNA, 17 nt, Human
uacaaaugcauuucuaa

SEQ ID NO: 771116 - RNA, 21 nt, Human
aauucauucacucaacaaaca

SEQ ID NO: 771117 - RNA, 23 nt, Human
uccaaacugacucuuaagaagac

SEQ ID NO: 771118 - RNA, 22 nt, Human
auuuucuucucacauuuauauu

SEQ ID NO: 771119 - RNA, 16 nt, Human
gagcucgugggacagu

SEQ ID NO: 771120 - RNA, 18 nt, Human
guuuaugguuguauuauu

SEQ ID NO: 771121 - RNA, 14 nt, Human
uccagauccuggaa

SEQ ID NO: 771122 - RNA, 15 nt, Human
acaaggaaaaaauaa

SEQ ID NO: 771123 - RNA, 20 nt, Human
uagaugcaguucugaagaag

SEQ ID NO: 771124 - RNA, 15 nt, Human
uauuuauuuuaauaa

SEQ ID NO: 771125 - RNA, 19 nt, Human
uagugagcagucaggaaag

SEQ ID NO: 771126 - RNA, 19 nt, Human
acagucaccucauggaauu

SEQ ID NO: 771127 - RNA, 12 nt, Human
aaaauaacaaua

SEQ ID NO: 771128 - RNA, 15 nt, Human
gugaacuugguuuua

SEQ ID NO: 771129 - RNA, 14 nt, Human
ucuauaauuuaaau

SEQ ID NO: 771130 - RNA, 23 nt, Human
auuucugagcauuuaauauggau

SEQ ID NO: 771131 - RNA, 20 nt, Human
agccuuuuuuugaaaaaaag

SEQ ID NO: 771132 - RNA, 18 nt, Human
caguuguugcccacagcu

SEQ ID NO: 771133 - RNA, 16 nt, Human
acauuuauauuuuugu

SEQ ID NO: 771134 - RNA, 18 nt, Human
caugaauuaguuuuauau

SEQ ID NO: 771135 - RNA, 20 nt, Human
augucgucaaagcugaaaug

SEQ ID NO: 771136 - RNA, 17 nt, Human
gccuccuuuuaaaguaa

SEQ ID NO: 771137 - RNA, 16 nt, Human
aaaaauuccaagugau

SEQ ID NO: 771138 - RNA, 17 nt, Human
aauaacgauaaaagaca

SEQ ID NO: 771139 - RNA, 14 nt, Human
uugugauugauuau

SEQ ID NO: 771140 - RNA, 22 nt, Human
uguauacugugugcuaaaacaa

SEQ ID NO: 771141 - RNA, 15 nt, Human
uuuaugguuguauua

SEQ ID NO: 771142 - RNA, 21 nt, Human
uguauaaaauaauuuuuauau

SEQ ID NO: 771143 - RNA, 15 nt, Human
acgagauacagaauu

SEQ ID NO: 771144 - RNA, 18 nt, Human
auuuauuacuguaagaaa

SEQ ID NO: 771145 - RNA, 13 nt, Human
aaauccuugaaga

SEQ ID NO: 771146 - RNA, 18 nt, Human
acaaauccaaugaaauga

SEQ ID NO: 771147 - RNA, 21 nt, Human
aauaauguuucaaacauauau

SEQ ID NO: 771148 - RNA, 20 nt, Human
agcuucacuguaaaauaaua

SEQ ID NO: 771149 - RNA, 22 nt, Human
aauaauccuaaacauaugaauu

SEQ ID NO: 771150 - RNA, 14 nt, Human
gauaaaagacagug

SEQ ID NO: 771151 - RNA, 21 nt, Human
cuaagcuucacuguaaaauaa

SEQ ID NO: 771152 - RNA, 19 nt, Human
aaaagacagugaaagaaaa

SEQ ID NO: 771153 - RNA, 13 nt, Human
aggcuagauguau

SEQ ID NO: 771154 - RNA, 19 nt, Human
ugggacaggggagaaccua

SEQ ID NO: 771155 - RNA, 18 nt, Human
ccaaccuggaguugaaaa

SEQ ID NO: 771156 - RNA, 19 nt, Human
ugaaauggacuuuuguaca

SEQ ID NO: 771157 - RNA, 16 nt, Human
cauuuguauaaaauaa

SEQ ID NO: 771158 - RNA, 20 nt, Human
aacaagccuccuuuuaaagu

SEQ ID NO: 771159 - RNA, 21 nt, Human
ugaaauggacuuuuguacaua

SEQ ID NO: 771160 - RNA, 20 nt, Human
augcaguuguugcccacagc

SEQ ID NO: 771161 - RNA, 17 nt, Human
guauuauuuuuuaaaaa

SEQ ID NO: 771162 - RNA, 17 nt, Human
aguugauaaguacauga

SEQ ID NO: 771163 - RNA, 17 nt, Human
auaaguacaugauaagc

SEQ ID NO: 771164 - RNA, 19 nt, Human
guccaggucuaccaaaaau

SEQ ID NO: 771165 - RNA, 21 nt, Human
agggugauauuaaccaggggc

SEQ ID NO: 771166 - RNA, 23 nt, Human
uuuguauaaaauaauuuuuauau

SEQ ID NO: 771167 - RNA, 13 nt, Human
acaauaaaagaca

SEQ ID NO: 771168 - RNA, 15 nt, Human
uggacgagaaaacaa

SEQ ID NO: 771169 - RNA, 20 nt, Human
ucaagucuuucacauuuaaa

SEQ ID NO: 771170 - RNA, 15 nt, Human
aauacuuuauaaagg

SEQ ID NO: 771171 - RNA, 24 nt, Human
uaauuuaaaauaugcucuaaacau

SEQ ID NO: 771172 - RNA, 22 nt, Human
cccaugauguuuagaaacacaa

SEQ ID NO: 771173 - RNA, 19 nt, Human
uucccuugaugaagaaguu

SEQ ID NO: 771174 - RNA, 14 nt, Human
aauauaaauaaaaa

SEQ ID NO: 771175 - RNA, 12 nt, Human
gaaaauaacaau

SEQ ID NO: 771176 - RNA, 23 nt, Human
ggcuaagcuucacuguaaaauaa

SEQ ID NO: 771177 - RNA, 22 nt, Human
caccagucugacuguuuccauc

SEQ ID NO: 771178 - RNA, 20 nt, Human
aagcuucacuguaaaauaau

SEQ ID NO: 771179 - RNA, 13 nt, Human
caacaucuaguga

SEQ ID NO: 771180 - RNA, 19 nt, Human
gcucauggaauuggagcuc

SEQ ID NO: 771181 - RNA, 16 nt, Human
aaauauaaauaaaaau

SEQ ID NO: 771182 - RNA, 16 nt, Human
uucccaacuccagaaa

SEQ ID NO: 771183 - RNA, 19 nt, Human
auuggagcucgugggacag

SEQ ID NO: 771184 - RNA, 16 nt, Human
ugcauagguuuaauaa

SEQ ID NO: 771185 - RNA, 19 nt, Human
auagugaggagcuuugaaa

SEQ ID NO: 771186 - RNA, 22 nt, Human
ccacagcuguaugauucccagc

SEQ ID NO: 771187 - RNA, 20 nt, Human
auaaauggcuuccuggcaau

SEQ ID NO: 771188 - RNA, 21 nt, Human
cauuucuugagguaaaagcau

SEQ ID NO: 771189 - RNA, 23 nt, Human
ugaauuauguuugcauguucacu

SEQ ID NO: 771190 - RNA, 16 nt, Human
agugaaauauuauuuu

SEQ ID NO: 771191 - RNA, 13 nt, Human
aacacaacuauau

SEQ ID NO: 771192 - RNA, 18 nt, Human
uucugauauuggacagua

SEQ ID NO: 771193 - RNA, 16 nt, Human
ugcaaauugucacagg

SEQ ID NO: 771194 - RNA, 14 nt, Human
cauagaaguaaaaa

SEQ ID NO: 771195 - RNA, 14 nt, Human
uucuggaauaaucc

SEQ ID NO: 771196 - RNA, 13 nt, Human
ucacuguaaaaua

SEQ ID NO: 771197 - RNA, 17 nt, Human
aauaaaguguuugaaag

SEQ ID NO: 771198 - RNA, 23 nt, Human
caauaacgauaaaagacagugaa

SEQ ID NO: 771199 - RNA, 18 nt, Human
acugccuucucaacucca

SEQ ID NO: 771200 - RNA, 14 nt, Human
auccuugaagauuu

SEQ ID NO: 771201 - RNA, 13 nt, Human
cacacugaagaag

SEQ ID NO: 771202 - RNA, 18 nt, Human
cuccauuuuuagugaaau

SEQ ID NO: 771203 - RNA, 11 nt, Human
caucuagugag

SEQ ID NO: 771204 - RNA, 15 nt, Human
ccuugccaugugcua

SEQ ID NO: 771205 - RNA, 21 nt, Human
acaguuaccucugccucagaa

SEQ ID NO: 771206 - RNA, 23 nt, Human
uaauuuguaguguuggagaagaa

SEQ ID NO: 771207 - RNA, 18 nt, Human
cagugaaagaaaauaaca

SEQ ID NO: 771208 - RNA, 17 nt, Human
cuucacuguaaaauaau

SEQ ID NO: 771209 - RNA, 23 nt, Human
uguagguagaucuggucuuuaga

SEQ ID NO: 771210 - RNA, 13 nt, Human
uauuucuaugaaa

SEQ ID NO: 771211 - RNA, 21 nt, Human
aggacagcccuucuuuccaca

SEQ ID NO: 771212 - RNA, 16 nt, Human
cuucacuguaaaauaa

SEQ ID NO: 771213 - RNA, 19 nt, Human
gaaaauaacgauaaaagac

SEQ ID NO: 771214 - RNA, 21 nt, Human
aaagcugaaauggacuuuugu

SEQ ID NO: 771215 - RNA, 16 nt, Human
ucuugagguaaaagca

SEQ ID NO: 771216 - RNA, 16 nt, Human
augcuguauuuuaaaa

SEQ ID NO: 771217 - RNA, 21 nt, Human
acagugaaagaaaauaacaau

SEQ ID NO: 771218 - RNA, 15 nt, Human
gaaaacaaggaugaa

SEQ ID NO: 771219 - RNA, 15 nt, Human
auuugguaaggggaa

SEQ ID NO: 771220 - RNA, 12 nt, Human
agaaaacaauaa

SEQ ID NO: 771221 - RNA, 15 nt, Human
ugaaauuguauuaca

SEQ ID NO: 771222 - RNA, 12 nt, Human
ggcugaugcagu

SEQ ID NO: 771223 - RNA, 19 nt, Human
uauacugugugcuaaaaca

SEQ ID NO: 771224 - RNA, 16 nt, Human
gaaaaaauaacaauga

SEQ ID NO: 771225 - RNA, 17 nt, Human
caaacauauauaacaau

SEQ ID NO: 771226 - RNA, 13 nt, Human
cuaugaaauauua

SEQ ID NO: 771227 - RNA, 22 nt, Human
agcuuguauuccuuuuucucuc

SEQ ID NO: 771228 - RNA, 19 nt, Human
uuauggcacuaguauuucu

SEQ ID NO: 771229 - RNA, 16 nt, Human
auaacuggaaacuuca

SEQ ID NO: 771230 - RNA, 21 nt, Human
uuacauuuguauaaaauaauu

SEQ ID NO: 771231 - RNA, 16 nt, Human
aacaauaaaagacaag

SEQ ID NO: 771232 - RNA, 19 nt, Human
ugaaauuguauuacaaauc

SEQ ID NO: 771233 - RNA, 17 nt, Human
gacagucaccucaugga

SEQ ID NO: 771234 - RNA, 20 nt, Human
accugauuucugagcauuua

SEQ ID NO: 771235 - RNA, 22 nt, Human
ucaacuccaaacugacucuuaa

SEQ ID NO: 771236 - RNA, 14 nt, Human
auauuugaaauauu

SEQ ID NO: 771237 - RNA, 16 nt, Human
agguacuucaaauccu

SEQ ID NO: 771238 - RNA, 12 nt, Human
auaacuggaaac

SEQ ID NO: 771239 - RNA, 21 nt, Human
aguuguugcccacagcuguau

SEQ ID NO: 771240 - RNA, 18 nt, Human
uaaaauccauacauuugu

SEQ ID NO: 771241 - RNA, 22 nt, Human
uguucugauauuggacaguaaa

SEQ ID NO: 771242 - RNA, 16 nt, Human
aaaugggaaacaaaag

SEQ ID NO: 771243 - RNA, 16 nt, Human
aauuuuuaauuauaug

SEQ ID NO: 771244 - RNA, 22 nt, Human
caagcacuaaacaaagagugaa

SEQ ID NO: 771245 - RNA, 22 nt, Human
cuuuccacagaagcuccaggua

SEQ ID NO: 771246 - RNA, 16 nt, Human
uauuuuugugauuuug

SEQ ID NO: 771247 - RNA, 14 nt, Human
acuaauuuuaaaau

SEQ ID NO: 771248 - RNA, 21 nt, Human
ccuuuuuuugaaaaaaagcuu

SEQ ID NO: 771249 - RNA, 17 nt, Human
uaaaagacagugaaaga

SEQ ID NO: 771250 - RNA, 21 nt, Human
gaaaaaaagcuuuuuuugaau

SEQ ID NO: 771251 - RNA, 15 nt, Human
aaaaaauaacaauga

SEQ ID NO: 771252 - RNA, 19 nt, Human
cacaggaaccacaagacug

SEQ ID NO: 771253 - RNA, 18 nt, Human
uaaaagacaaggaaaaaa

SEQ ID NO: 771254 - RNA, 20 nt, Human
uaaaacaagcacuaaacaaa

SEQ ID NO: 771255 - RNA, 21 nt, Human
gacagugaaagaaaauaacaa

SEQ ID NO: 771256 - RNA, 19 nt, Human
auaaaagacaaggaaaaaa

SEQ ID NO: 771257 - RNA, 20 nt, Human
aaucuuucacaggggacagg

SEQ ID NO: 771258 - RNA, 15 nt, Human
gaaagaaaauaacga

SEQ ID NO: 771259 - RNA, 16 nt, Human
aauauaaauaaaaaua

SEQ ID NO: 771260 - RNA, 15 nt, Human
uuagugaaauauuau

SEQ ID NO: 771261 - RNA, 19 nt, Human
ucaauucuugccaaauaua

SEQ ID NO: 771262 - RNA, 21 nt, Human
uauacugugugcuaaaacaag

SEQ ID NO: 771263 - RNA, 17 nt, Human
aaagaaacauuugguaa

SEQ ID NO: 771264 - RNA, 12 nt, Human
aagaaaauaacg

SEQ ID NO: 771265 - RNA, 15 nt, Human
aaaagacaaggaaaa

SEQ ID NO: 771266 - RNA, 18 nt, Human
uuuuaaaaaagaaacauu

SEQ ID NO: 771267 - RNA, 19 nt, Human
aauauuauguuaaaacugg

SEQ ID NO: 771268 - RNA, 23 nt, Human
ucuccauguacuggcaagaccug

SEQ ID NO: 771269 - RNA, 14 nt, Human
cuugagguaaaagc

SEQ ID NO: 771270 - RNA, 14 nt, Human
gaaaaaauaacaau

SEQ ID NO: 771271 - RNA, 23 nt, Human
caccucauggaauuggagcucgu

SEQ ID NO: 771272 - RNA, 17 nt, Human
agucugacuguuuccau

SEQ ID NO: 771273 - RNA, 14 nt, Human
acacugaagaagca

SEQ ID NO: 771274 - RNA, 14 nt, Human
aauauuuauuuuaa

SEQ ID NO: 771275 - RNA, 14 nt, Human
caaggaaaaaauaa

SEQ ID NO: 771276 - RNA, 19 nt, Human
agugaggagcuuugaaacg

SEQ ID NO: 771277 - RNA, 21 nt, Human
uauaaaauaauuuuuauauuu

SEQ ID NO: 771278 - RNA, 17 nt, Human
ugaacuugguuuuaauu

SEQ ID NO: 771279 - RNA, 16 nt, Human
uguaguccuguaaugg

SEQ ID NO: 771280 - RNA, 22 nt, Human
ggacagcccuucuuuccacaga

SEQ ID NO: 771281 - RNA, 21 nt, Human
uuuauauaagcuuguauuccu

SEQ ID NO: 771282 - RNA, 23 nt, Human
ugucaauucuugccaaauauaaa

SEQ ID NO: 771283 - RNA, 15 nt, Human
auaauuuugugaagc

SEQ ID NO: 771284 - RNA, 22 nt, Human
cuaagcuucacuguaaaauaau

SEQ ID NO: 771285 - RNA, 12 nt, Human
uuuuuuuuaaaa

SEQ ID NO: 771286 - RNA, 18 nt, Human
uuauuacuguaagaaaau

SEQ ID NO: 771287 - RNA, 20 nt, Human
aaagagugaaggauuuaugu

SEQ ID NO: 771288 - RNA, 22 nt, Human
aucaucaagucuuucacauuua

SEQ ID NO: 771289 - RNA, 13 nt, Human
aacaagccuccuu

SEQ ID NO: 771290 - RNA, 14 nt, Human
aauauuauuuuaua

SEQ ID NO: 771291 - RNA, 18 nt, Human
aaguugauaugccuuuuc

SEQ ID NO: 771292 - RNA, 21 nt, Human
uauuacuguaagaaaauauca

SEQ ID NO: 771293 - RNA, 19 nt, Human
acuucagcgguuuauauaa

SEQ ID NO: 771294 - RNA, 19 nt, Human
uguauacugugugcuaaaa

SEQ ID NO: 771295 - RNA, 18 nt, Human
uaauuuuaacucuauaau

SEQ ID NO: 771296 - RNA, 14 nt, Human
agcaaguauuagaa

SEQ ID NO: 771297 - RNA, 21 nt, Human
guauacugugugcuaaaacaa

SEQ ID NO: 771298 - RNA, 19 nt, Human
auaauuuuuauauuugaaa

SEQ ID NO: 771299 - RNA, 16 nt, Human
aaauaacaaugaaagu

SEQ ID NO: 771300 - RNA, 20 nt, Human
agaugcaguucugaagaaga

SEQ ID NO: 771301 - RNA, 15 nt, Human
cuaguaauuggaaag

SEQ ID NO: 771302 - RNA, 18 nt, Human
cauggaauuggagcucgu

SEQ ID NO: 771303 - RNA, 17 nt, Human
cucuuuugggauuuuug

SEQ ID NO: 771304 - RNA, 19 nt, Human
aaguugcauagguuuaaua

SEQ ID NO: 771305 - RNA, 22 nt, Human
agaauuuuaugcggcauuuucu

SEQ ID NO: 771306 - RNA, 15 nt, Human
aucuuauaauuuaaa

SEQ ID NO: 771307 - RNA, 16 nt, Human
uuucuauaauuuaaau

SEQ ID NO: 771308 - RNA, 22 nt, Human
aaagagugaaggauuuauguuu

SEQ ID NO: 771309 - RNA, 13 nt, Human
aaaauaacaauga

SEQ ID NO: 771310 - RNA, 16 nt, Human
caauaacgauaaaaga

SEQ ID NO: 771311 - RNA, 18 nt, Human
aaaguaacccuacaaaac

SEQ ID NO: 771312 - RNA, 16 nt, Human
aaauauuuauuuuaau

SEQ ID NO: 771313 - RNA, 19 nt, Human
augaguaacugauuuguaa

SEQ ID NO: 771314 - RNA, 13 nt, Human
auaaauaaaaaua

SEQ ID NO: 771315 - RNA, 16 nt, Human
uucaguuauuauauuu

SEQ ID NO: 771316 - RNA, 15 nt, Human
uauaauuuaaauaua

SEQ ID NO: 771317 - RNA, 15 nt, Human
cugacucuuaagaag

SEQ ID NO: 771318 - RNA, 21 nt, Human
aagucuuucacauuuaaauaa

SEQ ID NO: 771319 - RNA, 15 nt, Human
auuuuaaaagaauga

SEQ ID NO: 771320 - RNA, 17 nt, Human
aauucuugccaaauaua

SEQ ID NO: 771321 - RNA, 20 nt, Human
augcuucuguuuuauaauuu

SEQ ID NO: 771322 - RNA, 12 nt, Human
acacugaagaag

SEQ ID NO: 771323 - RNA, 18 nt, Human
ucuaugaaauauuauguu

SEQ ID NO: 771324 - RNA, 18 nt, Human
auuauuuuuuaaaaaaau

SEQ ID NO: 771325 - RNA, 18 nt, Human
auggcuugaguuuaaauu

SEQ ID NO: 771326 - RNA, 12 nt, Human
gacgagaaaaca

SEQ ID NO: 771327 - RNA, 16 nt, Human
uaaaagacaaggaaaa

SEQ ID NO: 771328 - RNA, 13 nt, Human
aagacagugaaag

SEQ ID NO: 771329 - RNA, 15 nt, Human
agucaccucauggaa

SEQ ID NO: 771330 - RNA, 16 nt, Human
aacuugguuuuaauua

SEQ ID NO: 771331 - RNA, 19 nt, Human
aagucuuucacauuuaaau

SEQ ID NO: 771332 - RNA, 16 nt, Human
aaaagcuccauuuuua

SEQ ID NO: 771333 - RNA, 19 nt, Human
gcacuaguauuucuaugaa

SEQ ID NO: 771334 - RNA, 20 nt, Human
uggaauaauccuaaacauau

SEQ ID NO: 771335 - RNA, 12 nt, Human
ugagagacacac

SEQ ID NO: 771336 - RNA, 15 nt, Human
aacgauaaaagacag

SEQ ID NO: 771337 - RNA, 20 nt, Human
gacauuugcucauggaauug

SEQ ID NO: 771338 - RNA, 17 nt, Human
acacuaagagagaauga

SEQ ID NO: 771339 - RNA, 15 nt, Human
auuauuuuuuaaaaa

SEQ ID NO: 771340 - RNA, 19 nt, Human
agaaaauaacaauaaaaga

SEQ ID NO: 771341 - RNA, 13 nt, Human
uuuaaaaauccua

SEQ ID NO: 771342 - RNA, 22 nt, Human
uugaaaaucuuauaauuuaaaa

SEQ ID NO: 771343 - RNA, 18 nt, Human
uuacuguaagaaaauauc

SEQ ID NO: 771344 - RNA, 16 nt, Human
acaugaacuuguaaag

SEQ ID NO: 771345 - RNA, 21 nt, Human
uaauaggcguaacuaauuuua

SEQ ID NO: 771346 - RNA, 14 nt, Human
aacgauaaaagaca

SEQ ID NO: 771347 - RNA, 15 nt, Human
gccucuuagaugcag

SEQ ID NO: 771348 - RNA, 13 nt, Human
uuggacgagaaaa

SEQ ID NO: 771349 - RNA, 19 nt, Human
auagcuacuaauuuuaaaa

SEQ ID NO: 771350 - RNA, 20 nt, Human
cacuguggguagacacacau

SEQ ID NO: 771351 - RNA, 17 nt, Human
aagacagugaaagaaaa

SEQ ID NO: 771352 - RNA, 14 nt, Human
auuugaaauuguau

SEQ ID NO: 771353 - RNA, 20 nt, Human
aauucuugccaaauauaaau

SEQ ID NO: 771354 - RNA, 21 nt, Human
cacaugaacuuguaaaggaau

SEQ ID NO: 771355 - RNA, 14 nt, Human
cagauccuggaaau

SEQ ID NO: 771356 - RNA, 19 nt, Human
gcuuguauuccuuuuucuc

SEQ ID NO: 771357 - RNA, 15 nt, Human
aaaauaacaaugaaa

SEQ ID NO: 771358 - RNA, 20 nt, Human
uauacugugugcuaaaacaa

SEQ ID NO: 771359 - RNA, 23 nt, Human
ugcauagguuuaauaauuuuuaa

SEQ ID NO: 771360 - RNA, 17 nt, Human
uauauuguagauaauac

SEQ ID NO: 771361 - RNA, 14 nt, Human
gaaugauuaugaau

SEQ ID NO: 771362 - RNA, 14 nt, Human
auuguccaggucua

SEQ ID NO: 771363 - RNA, 14 nt, Human
agaaaauaacaaua

SEQ ID NO: 771364 - RNA, 16 nt, Human
ugcuguauuuuaaaag

SEQ ID NO: 771365 - RNA, 24 nt, Human
cauaugaaaaggcuaagcuucacu

SEQ ID NO: 771366 - RNA, 13 nt, Human
guaacuaauuuua

SEQ ID NO: 771367 - RNA, 17 nt, Human
aaagcuccauuuuuagu

SEQ ID NO: 771368 - RNA, 21 nt, Human
acagcccuucuuuccacagaa

SEQ ID NO: 771369 - RNA, 20 nt, Human
aaaaucuuauaauuuaaaau

SEQ ID NO: 771370 - RNA, 18 nt, Human
aagucuuucacauuuaaa

SEQ ID NO: 771371 - RNA, 17 nt, Human
guuuaauucugaaagca

SEQ ID NO: 771372 - RNA, 21 nt, Human
caaggaaaaaauaacaaugaa

SEQ ID NO: 771373 - RNA, 17 nt, Human
gucaaagcugaaaugga

SEQ ID NO: 771374 - RNA, 18 nt, Human
uaaaagacagugaaagaa

SEQ ID NO: 771375 - RNA, 16 nt, Human
aagcuucacuguaaaa

SEQ ID NO: 771376 - RNA, 19 nt, Human
auaaaagacagugaaagaa

SEQ ID NO: 771377 - RNA, 23 nt, Human
aagagccuuuuuuugaaaaaaag

SEQ ID NO: 771378 - RNA, 23 nt, Human
ugaaaaucuuauaauuuaaaaua

SEQ ID NO: 771379 - RNA, 20 nt, Human
uaaaagacaaggaaaaaaua

SEQ ID NO: 771380 - RNA, 20 nt, Human
auuacuguaagaaaauauca

SEQ ID NO: 771381 - RNA, 15 nt, Human
augauaacuggaaac

SEQ ID NO: 771382 - RNA, 16 nt, Human
acuaaacaaagaguga

SEQ ID NO: 771383 - RNA, 13 nt, Human
uaacaauaaaaga

SEQ ID NO: 771384 - RNA, 14 nt, Human
cucugccucagaaa

SEQ ID NO: 771385 - RNA, 13 nt, Human
acagcccuucuuu

SEQ ID NO: 771386 - RNA, 16 nt, Human
caaaaggauaaugaau

SEQ ID NO: 771387 - RNA, 15 nt, Human
agacaaggaaaaaau

SEQ ID NO: 771388 - RNA, 22 nt, Human
gaugguucccuugaugaagaag

SEQ ID NO: 771389 - RNA, 18 nt, Human
acugacucuuaagaagac

SEQ ID NO: 771390 - RNA, 20 nt, Human
aaaacaagcacuaaacaaag

SEQ ID NO: 771391 - RNA, 21 nt, Human
auuauauuuauuacuguaaga

SEQ ID NO: 771392 - RNA, 20 nt, Human
auuuucaguuauuauauuua

SEQ ID NO: 771393 - RNA, 15 nt, Human
cuuaagaagacugca

SEQ ID NO: 771394 - RNA, 17 nt, Human
cuaagcuucacuguaaa

SEQ ID NO: 771395 - RNA, 22 nt, Human
uuuccaagcaaguauuagaaua

SEQ ID NO: 771396 - RNA, 14 nt, Human
ccaaugaaaugagu

SEQ ID NO: 771397 - RNA, 15 nt, Human
aaauaauuuuuauau

SEQ ID NO: 771398 - RNA, 23 nt, Human
ggaugaauuaaguuuuuuuuuaa

SEQ ID NO: 771399 - RNA, 17 nt, Human
ggagcucguggaacagu

SEQ ID NO: 771400 - RNA, 12 nt, Human
guagacacacau

SEQ ID NO: 771401 - RNA, 14 nt, Human
cuuucauaauaagu

SEQ ID NO: 771402 - RNA, 23 nt, Human
ucuaccaaaaaucucaauauuuc

SEQ ID NO: 771403 - RNA, 22 nt, Human
caaugcuguauuuuaaaagaau

SEQ ID NO: 771404 - RNA, 19 nt, Human
gaaagaaaauaacaauaaa

SEQ ID NO: 771405 - RNA, 17 nt, Human
uuauaaucuuucacagg

SEQ ID NO: 771406 - RNA, 16 nt, Human
uuucacauuuaaauaa

SEQ ID NO: 771407 - RNA, 14 nt, Human
aaaggaauuuaaaa

SEQ ID NO: 771408 - RNA, 18 nt, Human
gaagcaccaaucaugaau

SEQ ID NO: 771409 - RNA, 20 nt, Human
ucaauaaaauccauacauuu

SEQ ID NO: 771410 - RNA, 22 nt, Human
uuuauggcacuaguauuucuau

SEQ ID NO: 771411 - RNA, 14 nt, Human
caugaacuuguaaa

SEQ ID NO: 771412 - RNA, 15 nt, Human
auaaauaaaaauaau

SEQ ID NO: 771413 - RNA, 20 nt, Human
auacugugugcuaaaacaag

SEQ ID NO: 771414 - RNA, 21 nt, Human
cugauauuggacaguaaaauc

SEQ ID NO: 771415 - RNA, 21 nt, Human
uuauuuucuauaauuuaaaua

SEQ ID NO: 771416 - RNA, 13 nt, Human
uuaaauuguaaua

SEQ ID NO: 771417 - RNA, 17 nt, Human
uucugagcauuuaauau

SEQ ID NO: 771418 - RNA, 18 nt, Human
cuucucacauuuauauuu

SEQ ID NO: 771419 - RNA, 17 nt, Human
uugugaagcaaaauuuu

SEQ ID NO: 771420 - RNA, 16 nt, Human
auaaugaauacuuuau

SEQ ID NO: 771421 - RNA, 20 nt, Human
uaauaaguugcauagguuua

SEQ ID NO: 771422 - RNA, 17 nt, Human
uaacgauaaaagacagu

SEQ ID NO: 771423 - RNA, 18 nt, Human
acaaaugggaaacaaaag

SEQ ID NO: 771424 - RNA, 19 nt, Human
caugaguaacugauuugua

SEQ ID NO: 771425 - RNA, 23 nt, Human
caaagcugaaauggacuuuugua

SEQ ID NO: 771426 - RNA, 13 nt, Human
uaaacauguuuau

SEQ ID NO: 771427 - RNA, 13 nt, Human
agaaguaaaaaca

SEQ ID NO: 771428 - RNA, 20 nt, Human
gaaaauaacaauaaaagaca

SEQ ID NO: 771429 - RNA, 17 nt, Human
aacaguuaccucugccu

SEQ ID NO: 771430 - RNA, 20 nt, Human
aaagacaaggaaaaaauaac

SEQ ID NO: 771431 - RNA, 16 nt, Human
uugucaauaaaaucca

SEQ ID NO: 771432 - RNA, 15 nt, Human
uccagauccuggaaa

SEQ ID NO: 771433 - RNA, 21 nt, Human
agccucuuagaugcaguucug

SEQ ID NO: 771434 - RNA, 23 nt, Human
uuauagcuacuaauuuuaaaaug

SEQ ID NO: 771435 - RNA, 22 nt, Human
agcagcauaaauguugacaugg

SEQ ID NO: 771436 - RNA, 20 nt, Human
caagagccuuuuuuugaaaa

SEQ ID NO: 771437 - RNA, 18 nt, Human
auuuuuagugaaauauua

SEQ ID NO: 771438 - RNA, 14 nt, Human
uucacauuuaaaua

SEQ ID NO: 771439 - RNA, 19 nt, Human
auuuucuauaauuuaaaua

SEQ ID NO: 771440 - RNA, 16 nt, Human
ugcuaagucuuauaua

SEQ ID NO: 771441 - RNA, 13 nt, Human
uggacgagaaaac

SEQ ID NO: 771442 - RNA, 18 nt, Human
cuuuccacagaagcucca

SEQ ID NO: 771443 - RNA, 23 nt, Human
acugucuuguuggacgagaaaac

SEQ ID NO: 771444 - RNA, 12 nt, Human
auucugaaagca

SEQ ID NO: 771445 - RNA, 17 nt, Human
aagacaaggaaaaaaua

SEQ ID NO: 771446 - RNA, 17 nt, Human
aguauuucuaugaaaua

SEQ ID NO: 771447 - RNA, 23 nt, Human
ugaauuacauuuguauaaaauaa

SEQ ID NO: 771448 - RNA, 14 nt, Human
acauauauaacaau

SEQ ID NO: 771449 - RNA, 13 nt, Human
uuuugaaucauca

SEQ ID NO: 771450 - RNA, 22 nt, Human
agaaaacaauaacgauaaaaga

SEQ ID NO: 771451 - RNA, 22 nt, Human
uuaccucugccucagaaaacaa

SEQ ID NO: 771452 - RNA, 23 nt, Human
agaguuuagcuggaaaaguaugu

SEQ ID NO: 771453 - RNA, 19 nt, Human
uacuucuuaggguuaugau

SEQ ID NO: 771454 - RNA, 17 nt, Human
guuuaauaauuuuuaau

SEQ ID NO: 771455 - RNA, 23 nt, Human
cuaguaauuggaaaggcagcucu

SEQ ID NO: 771456 - RNA, 16 nt, Human
auaauccuaaacauau

SEQ ID NO: 771457 - RNA, 16 nt, Human
ccauuuuuagugaaau

SEQ ID NO: 771458 - RNA, 17 nt, Human
uuaauaauuuuuaauua

SEQ ID NO: 771459 - RNA, 14 nt, Human
auuuauuuuaauaa

SEQ ID NO: 771460 - RNA, 18 nt, Human
gaagcaaaauuuuuucuc

SEQ ID NO: 771461 - RNA, 19 nt, Human
cucacauuuauauuuuugu

SEQ ID NO: 771462 - RNA, 13 nt, Listeria monocytogenes EGD-e
uuuuuuuaugcau

SEQ ID NO: 771463 - RNA, 13 nt, Listeria monocytogenes EGD-e
uuuucaaggcuuu

SEQ ID NO: 771464 - RNA, 17 nt, Listeria monocytogenes EGD-e
uuuuacggcuucaauga

SEQ ID NO: 771465 - RNA, 21 nt, Listeria monocytogenes EGD-e
uuugucaucauaaacauuuga

SEQ ID NO: 771466 - RNA, 14 nt, Listeria monocytogenes EGD-e
uuccuaauuuuacu

SEQ ID NO: 771467 - RNA, 15 nt, Listeria monocytogenes EGD-e
uguaggaagugaugu

SEQ ID NO: 771468 - RNA, 17 nt, Listeria monocytogenes EGD-e
uguaaguguuucuagau

SEQ ID NO: 771469 - RNA, 19 nt, Listeria monocytogenes EGD-e
uuauagcaucuuggcauga

SEQ ID NO: 771470 - RNA, 18 nt, Listeria monocytogenes EGD-e
guuucacuuuaucccaga

SEQ ID NO: 771471 - RNA, 16 nt, Listeria monocytogenes EGD-e
guuuauucauauaaag

SEQ ID NO: 771472 - RNA, 17 nt, Listeria monocytogenes EGD-e
uaaauccuuuuugauuc

SEQ ID NO: 771473 - RNA, 16 nt, Listeria monocytogenes EGD-e
uaaauccguugucuuc

SEQ ID NO: 771474 - RNA, 22 nt, Listeria monocytogenes EGD-e
uaaaucuuucacacgauaccaa

SEQ ID NO: 771475 - RNA, 12 nt, Listeria monocytogenes EGD-e
uaaaugcgacau

SEQ ID NO: 771476 - RNA, 14 nt, Listeria monocytogenes EGD-e
uaauuagaggauuu

SEQ ID NO: 771477 - RNA, 20 nt, Listeria monocytogenes EGD-e
uaauagcagagcuccaauaa

SEQ ID NO: 771478 - RNA, 22 nt, Listeria monocytogenes EGD-e
uaauacgugaaaaucuuguugc

SEQ ID NO: 771479 - RNA, 19 nt, Listeria monocytogenes EGD-e
uaagucaaugauauuauga

SEQ ID NO: 771480 - RNA, 20 nt, Listeria monocytogenes EGD-e
uagcacuccuugaucugccc

SEQ ID NO: 771481 - RNA, 16 nt, Listeria monocytogenes EGD-e
uacugcaaucauuuau

SEQ ID NO: 771482 - RNA, 15 nt, Listeria monocytogenes EGD-e
ucaaagguuuaauag

SEQ ID NO: 771483 - RNA, 14 nt, Listeria monocytogenes EGD-e
ucaaacacuucuaa

SEQ ID NO: 771484 - RNA, 18 nt, Listeria monocytogenes EGD-e
ucaacgggcgcuuucaca

SEQ ID NO: 771485 - RNA, 16 nt, Listeria monocytogenes EGD-e
ucacacgacgaauggc

SEQ ID NO: 771486 - RNA, 22 nt, Listeria monocytogenes EGD-e
uccauagaauguauacacuagu

SEQ ID NO: 771487 - RNA, 18 nt, Listeria monocytogenes EGD-e
ucgaguauaugcuacuau

SEQ ID NO: 771488 - RNA, 13 nt, Listeria monocytogenes EGD-e
ugaaauagaauca

SEQ ID NO: 771489 - RNA, 16 nt, Listeria monocytogenes EGD-e
ugaaugccagccauuu

SEQ ID NO: 771490 - RNA, 21 nt, Listeria monocytogenes EGD-e
gcuuuuaacuuucuuguuuca

SEQ ID NO: 771491 - RNA, 17 nt, Listeria monocytogenes EGD-e
gcuuuaauuuggaaaua

SEQ ID NO: 771492 - RNA, 15 nt, Listeria monocytogenes EGD-e
gcuaauacuauugaa

SEQ ID NO: 771493 - RNA, 17 nt, Listeria monocytogenes EGD-e
gcgacauuaaauagccu

SEQ ID NO: 771494 - RNA, 23 nt, Listeria monocytogenes EGD-e
ggauuaaaaguugaccgcaaaua

SEQ ID NO: 771495 - RNA, 19 nt, Listeria monocytogenes EGD-e
gucuggcauauuugccaga

SEQ ID NO: 771496 - RNA, 14 nt, Listeria monocytogenes EGD-e
gucgcguucuuguc

SEQ ID NO: 771497 - RNA, 17 nt, Listeria monocytogenes EGD-e
cuaguauuccuaucaca

SEQ ID NO: 771498 - RNA, 22 nt, Listeria monocytogenes EGD-e
cuccaaucagcaagauaacuca

SEQ ID NO: 771499 - RNA, 15 nt, Listeria monocytogenes EGD-e
cuucaaacacuucua

SEQ ID NO: 771500 - RNA, 14 nt, Listeria monocytogenes EGD-e
cuucaauugcuucu

SEQ ID NO: 771501 - RNA, 20 nt, Listeria monocytogenes EGD-e
cuuccacuccagcugcuucu

SEQ ID NO: 771502 - RNA, 23 nt, Listeria monocytogenes EGD-e
cuuuuuuuacauuuuugcuugcc

SEQ ID NO: 771503 - RNA, 15 nt, Listeria monocytogenes EGD-e
gaauagauugcguca

SEQ ID NO: 771504 - RNA, 16 nt, Listeria monocytogenes EGD-e
gaauguuuucuuccau

SEQ ID NO: 771505 - RNA, 17 nt, Listeria monocytogenes EGD-e
gauaauauugauaaaac

SEQ ID NO: 771506 - RNA, 17 nt, Listeria monocytogenes EGD-e
gagcuauuguaaauguu

SEQ ID NO: 771507 - RNA, 21 nt, Listeria monocytogenes EGD-e
gauugccugaaauaauaccag

SEQ ID NO: 771508 - RNA, 16 nt, Listeria monocytogenes EGD-e
gcaauuuuaggcguau

SEQ ID NO: 771509 - RNA, 15 nt, Listeria monocytogenes EGD-e
gccaauucuuccaca

SEQ ID NO: 771510 - RNA, 21 nt, Listeria monocytogenes EGD-e
gcauccucaaacgucauucgg

SEQ ID NO: 771511 - RNA, 18 nt, Listeria monocytogenes EGD-e
ccgauaauagguccgaua

SEQ ID NO: 771512 - RNA, 15 nt, Listeria monocytogenes EGD-e
cgaaaagcaaugaga

SEQ ID NO: 771513 - RNA, 19 nt, Listeria monocytogenes EGD-e
ccuugauuuaaauaaacaa

SEQ ID NO: 771514 - RNA, 13 nt, Listeria monocytogenes EGD-e
cgaauauccgaua

SEQ ID NO: 771515 - RNA, 17 nt, Listeria monocytogenes EGD-e
cgacguuuaauucggcu

SEQ ID NO: 771516 - RNA, 16 nt, Listeria monocytogenes EGD-e
caguacuucuauugac

SEQ ID NO: 771517 - RNA, 16 nt, Listeria monocytogenes EGD-e
caguucaacuacuuca

SEQ ID NO: 771518 - RNA, 21 nt, Listeria monocytogenes EGD-e
ccaaauuauaauuuaauucgc

SEQ ID NO: 771519 - RNA, 18 nt, Listeria monocytogenes EGD-e
ccauaagacauaacaagu

SEQ ID NO: 771520 - RNA, 14 nt, Listeria monocytogenes EGD-e
aucauaaacauuug

SEQ ID NO: 771521 - RNA, 18 nt, Listeria monocytogenes EGD-e
aucauaaucccaguagua

SEQ ID NO: 771522 - RNA, 13 nt, Listeria monocytogenes EGD-e
auccaaacacgaa

SEQ ID NO: 771523 - RNA, 18 nt, Listeria monocytogenes EGD-e
auccaaacacgaacauac

SEQ ID NO: 771524 - RNA, 21 nt, Listeria monocytogenes EGD-e
auccacauaacggaaauuccc

SEQ ID NO: 771525 - RNA, 22 nt, Listeria monocytogenes EGD-e
auccacauaacggaaauucccg

SEQ ID NO: 771526 - RNA, 17 nt, Listeria monocytogenes EGD-e
aucgcgguagcuucaau

SEQ ID NO: 771527 - RNA, 16 nt, Listeria monocytogenes EGD-e
augcgaaaaaugaaaa

SEQ ID NO: 771528 - RNA, 18 nt, Listeria monocytogenes EGD-e
auuaaugauuucaauaau

SEQ ID NO: 771529 - RNA, 16 nt, Listeria monocytogenes EGD-e
auucauugacaaguuc

SEQ ID NO: 771530 - RNA, 13 nt, Listeria monocytogenes EGD-e
auuacucgguuca

SEQ ID NO: 771531 - RNA, 14 nt, Listeria monocytogenes EGD-e
caaaaucgcauccu

SEQ ID NO: 771532 - RNA, 11 nt, Listeria monocytogenes EGD-e
auuuuuccaag

SEQ ID NO: 771533 - RNA, 16 nt, Listeria monocytogenes EGD-e
auuuucccuccuuuau

SEQ ID NO: 771534 - RNA, 18 nt, Listeria monocytogenes EGD-e
auuuucauuaaacggcuu

SEQ ID NO: 771535 - RNA, 19 nt, Listeria monocytogenes EGD-e
caacagauaguuguuccau

SEQ ID NO: 771536 - RNA, 19 nt, Listeria monocytogenes EGD-e
caagcauuucauaaucaaa

SEQ ID NO: 771537 - RNA, 21 nt, Listeria monocytogenes EGD-e
caaggguaauauaaauuugcc

SEQ ID NO: 771538 - RNA, 18 nt, Listeria monocytogenes EGD-e
caauucccaggcugcuug

SEQ ID NO: 771539 - RNA, 19 nt, Listeria monocytogenes EGD-e
aggagacauuaaaccgaua

SEQ ID NO: 771540 - RNA, 22 nt, Listeria monocytogenes EGD-e
aggcucucuucgccaccuucaa

SEQ ID NO: 771541 - RNA, 19 nt, Listeria monocytogenes EGD-e
auaacucaaaguaacuuua

SEQ ID NO: 771542 - RNA, 19 nt, Listeria monocytogenes EGD-e
auagcggucaaucauuucu

SEQ ID NO: 771543 - RNA, 13 nt, Listeria monocytogenes EGD-e
auaguuguuccau

SEQ ID NO: 771544 - RNA, 16 nt, Listeria monocytogenes EGD-e
auauaagcugacaguu

SEQ ID NO: 771545 - RNA, 14 nt, Listeria monocytogenes EGD-e
agcaucggucaaau

SEQ ID NO: 771546 - RNA, 19 nt, Listeria monocytogenes EGD-e
agaauauggacauacuuca

SEQ ID NO: 771547 - RNA, 18 nt, Listeria monocytogenes EGD-e
agcgguuuuguuuccaac

SEQ ID NO: 771548 - RNA, 15 nt, Listeria monocytogenes EGD-e
guuuacgaacgauuu

SEQ ID NO: 771549 - RNA, 23 nt, Listeria monocytogenes EGD-e
uaacaacuaauuuuucgauuggc

SEQ ID NO: 771550 - RNA, 22 nt, Listeria monocytogenes EGD-e
uaaaucacuucuuaagaauucc

SEQ ID NO: 771551 - RNA, 13 nt, Listeria monocytogenes EGD-e
uaaaacuuucaca

SEQ ID NO: 771552 - RNA, 21 nt, Listeria monocytogenes EGD-e
uaaagcuugauuuaauuguaa

SEQ ID NO: 771553 - RNA, 17 nt, Listeria monocytogenes EGD-e
aagugugauuguuccag

SEQ ID NO: 771554 - RNA, 13 nt, Listeria monocytogenes EGD-e
guguugaauaagu

SEQ ID NO: 771555 - RNA, 22 nt, Listeria monocytogenes EGD-e
uaguacgaaaucaaacuuauaa

SEQ ID NO: 771556 - RNA, 14 nt, Listeria monocytogenes EGD-e
uauaaguacuugaa

SEQ ID NO: 771557 - RNA, 16 nt, Listeria monocytogenes EGD-e
uauagucuacuuuuaa

SEQ ID NO: 771558 - RNA, 16 nt, Listeria monocytogenes EGD-e
uagaaggaauuugcca

SEQ ID NO: 771559 - RNA, 19 nt, Listeria monocytogenes EGD-e
uacuucagccacguuugga

SEQ ID NO: 771560 - RNA, 20 nt, Listeria monocytogenes EGD-e
uaauuuuccgcagcuucaau

SEQ ID NO: 771561 - RNA, 15 nt, Listeria monocytogenes EGD-e
uaauuuuacuucuac

SEQ ID NO: 771562 - RNA, 23 nt, Listeria monocytogenes EGD-e
uaccaucauauaauucuaauagc

SEQ ID NO: 771563 - RNA, 23 nt, Listeria monocytogenes EGD-e
uccaaauuauaauuuaauucgcg

SEQ ID NO: 771564 - RNA, 17 nt, Listeria monocytogenes EGD-e
ucagaaggaauaaagcc

SEQ ID NO: 771565 - RNA, 13 nt, Listeria monocytogenes EGD-e
ucuuaaauacgaa

SEQ ID NO: 771566 - RNA, 16 nt, Listeria monocytogenes EGD-e
ucuugcuuuaauuugg

SEQ ID NO: 771567 - RNA, 23 nt, Listeria monocytogenes EGD-e
ucuuucacacgauaccaaaguug

SEQ ID NO: 771568 - RNA, 16 nt, Listeria monocytogenes EGD-e
ugcagaaaauuucgcg

SEQ ID NO: 771569 - RNA, 17 nt, Listeria monocytogenes EGD-e
ugauaauaaucagaucu

SEQ ID NO: 771570 - RNA, 13 nt, Listeria monocytogenes EGD-e
acaauuacuucca

SEQ ID NO: 771571 - RNA, 15 nt, Listeria monocytogenes EGD-e
acaaguguuguacca

SEQ ID NO: 771572 - RNA, 22 nt, Listeria monocytogenes EGD-e
acaaucaugccagcuucuucca

SEQ ID NO: 771573 - RNA, 14 nt, Listeria monocytogenes EGD-e
acaugaugauuguu

SEQ ID NO: 771574 - RNA, 17 nt, Listeria monocytogenes EGD-e
accaauaaaaccugcuu

SEQ ID NO: 771575 - RNA, 19 nt, Listeria monocytogenes EGD-e
acauaaucccacaaaaaau

SEQ ID NO: 771576 - RNA, 15 nt, Listeria monocytogenes EGD-e
acgaucuacuucuaa

SEQ ID NO: 771577 - RNA, 17 nt, Listeria monocytogenes EGD-e
aauauagucuacuuuua

SEQ ID NO: 771578 - RNA, 14 nt, Listeria monocytogenes EGD-e
uucuggcuggcagu

SEQ ID NO: 771579 - RNA, 21 nt, Listeria monocytogenes EGD-e
aaucaguaccugcaagcgaau

SEQ ID NO: 771580 - RNA, 18 nt, Listeria monocytogenes EGD-e
aaucaucuuaucaaguaa

SEQ ID NO: 771581 - RNA, 18 nt, Listeria monocytogenes EGD-e
uugugcuaaaucugccau

SEQ ID NO: 771582 - RNA, 12 nt, Listeria monocytogenes EGD-e
uuuaaauaaaca

SEQ ID NO: 771583 - RNA, 20 nt, Listeria monocytogenes EGD-e
uuuaaauuucccgcuacuau

SEQ ID NO: 771584 - RNA, 17 nt, Listeria monocytogenes EGD-e
uuugucaaaccauuaua

SEQ ID NO: 771585 - RNA, 16 nt, Listeria monocytogenes EGD-e
uuugaaaacugaacaa

SEQ ID NO: 771586 - RNA, 17 nt, Listeria monocytogenes EGD-e
aauggaugcacuuuuaa

SEQ ID NO: 771587 - RNA, 20 nt, Listeria monocytogenes EGD-e
uuacguaauaggauuuuacu

SEQ ID NO: 771588 - RNA, 21 nt, Listeria monocytogenes EGD-e
aaucacuucuuaagaauuccg

SEQ ID NO: 771589 - RNA, 20 nt, Listeria monocytogenes EGD-e
uucggaagauccgcgaauag

SEQ ID NO: 771590 - RNA, 17 nt, Listeria monocytogenes EGD-e
uuccgcagcuucaaucu

SEQ ID NO: 771591 - RNA, 20 nt, Listeria monocytogenes EGD-e
uuccaaucggggaaauaguu

SEQ ID NO: 771592 - RNA, 13 nt, Listeria monocytogenes EGD-e
uuccacaucgaug

SEQ ID NO: 771593 - RNA, 21 nt, Listeria monocytogenes EGD-e
uuccaccuguauuaaugacug

SEQ ID NO: 771594 - RNA, 13 nt, Listeria monocytogenes EGD-e
aaauagaaucaga

SEQ ID NO: 771595 - RNA, 12 nt, Listeria monocytogenes EGD-e
aaaaaagcacuc

SEQ ID NO: 771596 - RNA, 17 nt, Listeria monocytogenes EGD-e
aaaucaagcgguaaaua

SEQ ID NO: 771597 - RNA, 13 nt, Listeria monocytogenes EGD-e
aaccaaauaugcu

SEQ ID NO: 771598 - RNA, 18 nt, Listeria monocytogenes EGD-e
aacaucucgucaaugaau

SEQ ID NO: 771599 - RNA, 13 nt, Listeria monocytogenes EGD-e
aacgacaaauggu

SEQ ID NO: 771600 - RNA, 23 nt, Listeria monocytogenes EGD-e
aacgcagguucaccaaaugcuuc

SEQ ID NO: 771601 - RNA, 22 nt, Listeria monocytogenes EGD-e
aagaucuuccgguaucaugaau

SEQ ID NO: 771602 - RNA, 16 nt, Listeria monocytogenes EGD-e
aaguaacauagcuaca

SEQ ID NO: 771603 - RNA, 19 nt, Listeria monocytogenes EGD-e
aagggcuuuuuuguaauag

SEQ ID NO: 771604 - RNA, 20 nt, Listeria monocytogenes EGD-e
aauaagcgaauauccgauaa

SEQ ID NO: 771605 - RNA, 14 nt, Listeria monocytogenes EGD-e
aauaaaauaggcaa

SEQ ID NO: 771606 - RNA, 22 nt, Listeria monocytogenes EGD-e
aauuauuuuuguaauaccgaga

SEQ ID NO: 771607 - RNA, 18 nt, Listeria monocytogenes EGD-e
aauuagacauauaucuua

SEQ ID NO: 771608 - RNA, 12 nt, Listeria monocytogenes EGD-e
aauuuaauugcu

SEQ ID NO: 771609 - RNA, 14 nt, Listeria monocytogenes EGD-e
aauuuaauugugcu

SEQ ID NO: 771610 - RNA, 20 nt, Listeria monocytogenes EGD-e
aauuugccaaagagaaacuu

SEQ ID NO: 771611 - RNA, 13 nt, Listeria monocytogenes EGD-e
aauuugauugccu

SEQ ID NO: 771612 - RNA, 15 nt, Listeria monocytogenes EGD-e
aaucgccaguugcug

SEQ ID NO: 771613 - RNA, 15 nt, Listeria monocytogenes EGD-e
aaucggggaaauagu

SEQ ID NO: 771614 - RNA, 19 nt, Listeria monocytogenes EGD-e
aaucaucuuaucaaguaau

SEQ ID NO: 771615 - RNA, 20 nt, Listeria monocytogenes EGD-e
aaucaugccuucaaacacuu

SEQ ID NO: 771616 - RNA, 18 nt, Listeria monocytogenes EGD-e
aauagcacagcuaccaca

SEQ ID NO: 771617 - RNA, 17 nt, Listeria monocytogenes EGD-e
accaacuucgagcagcu

SEQ ID NO: 771618 - RNA, 19 nt, Listeria monocytogenes EGD-e
aaaaugcucaucaagaaau

SEQ ID NO: 771619 - RNA, 18 nt, Listeria monocytogenes EGD-e
acuucuuaagaauuccgu

SEQ ID NO: 771620 - RNA, 16 nt, Listeria monocytogenes EGD-e
acuauugaauguucua

SEQ ID NO: 771621 - RNA, 14 nt, Listeria monocytogenes EGD-e
aaaccauuccguug

SEQ ID NO: 771622 - RNA, 20 nt, Listeria monocytogenes EGD-e
acgcauuucacaccacucuu

SEQ ID NO: 771623 - RNA, 19 nt, Listeria monocytogenes EGD-e
agcacgcgcguucauucgg

SEQ ID NO: 771624 - RNA, 13 nt, Listeria monocytogenes EGD-e
aguaguuuacuuc

SEQ ID NO: 771625 - RNA, 19 nt, Listeria monocytogenes EGD-e
aguaauaaaauaggcaaau

SEQ ID NO: 771626 - RNA, 21 nt, Listeria monocytogenes EGD-e
aguuccaucuucuaaugccgc

SEQ ID NO: 771627 - RNA, 14 nt, Listeria monocytogenes EGD-e
aguucgaauuccgu

SEQ ID NO: 771628 - RNA, 21 nt, Listeria monocytogenes EGD-e
agucacuagcgcacaaguaau

SEQ ID NO: 771629 - RNA, 16 nt, Listeria monocytogenes EGD-e
auaagugaauugaugg

SEQ ID NO: 771630 - RNA, 20 nt, Listeria monocytogenes EGD-e
auaaaaacacgcagcggacu

SEQ ID NO: 771631 - RNA, 22 nt, Listeria monocytogenes EGD-e
auagauacucuuuaaauccauu

SEQ ID NO: 771632 - RNA, 19 nt, Listeria monocytogenes EGD-e
auagagcgaauaagugaau

SEQ ID NO: 771633 - RNA, 20 nt, Listeria monocytogenes EGD-e
auacuuugaauuaagaagua

SEQ ID NO: 771634 - RNA, 22 nt, Listeria monocytogenes EGD-e
auaggaauuuggugcaagccgu

SEQ ID NO: 771635 - RNA, 22 nt, Listeria monocytogenes EGD-e
aucaauuacgcuuuaguuugua

SEQ ID NO: 771636 - RNA, 22 nt, Listeria monocytogenes EGD-e
aucacguaaggauuugucacuu

SEQ ID NO: 771637 - RNA, 16 nt, Listeria monocytogenes EGD-e
aucuaagucaucggcu

SEQ ID NO: 771638 - RNA, 14 nt, Listeria monocytogenes EGD-e
aucgaggaaguugc

SEQ ID NO: 771639 - RNA, 21 nt, Listeria monocytogenes EGD-e
auguugguguaggaagugaug

SEQ ID NO: 771640 - RNA, 13 nt, Listeria monocytogenes EGD-e
caacgauguucau

SEQ ID NO: 771641 - RNA, 15 nt, Listeria monocytogenes EGD-e
caaauggagcuauug

SEQ ID NO: 771642 - RNA, 16 nt, Listeria monocytogenes EGD-e
cacggugaugaaacca

SEQ ID NO: 771643 - RNA, 15 nt, Listeria monocytogenes EGD-e
cagcacaaguuccaa

SEQ ID NO: 771644 - RNA, 23 nt, Listeria monocytogenes EGD-e
cauaucaccaacaauuacuucca

SEQ ID NO: 771645 - RNA, 21 nt, Listeria monocytogenes EGD-e
cauaucuuuugagauaaucaa

SEQ ID NO: 771646 - RNA, 22 nt, Listeria monocytogenes EGD-e
cauaucaucaauaaaaugcaca

SEQ ID NO: 771647 - RNA, 19 nt, Listeria monocytogenes EGD-e
caguuagaagaacugcggc

SEQ ID NO: 771648 - RNA, 20 nt, Listeria monocytogenes EGD-e
ccaagcuucccguuaaucga

SEQ ID NO: 771649 - RNA, 14 nt, Listeria monocytogenes EGD-e
aaauaucaucaauu

SEQ ID NO: 771650 - RNA, 16 nt, Listeria monocytogenes EGD-e
aaauagcacagcuacc

SEQ ID NO: 771651 - RNA, 14 nt, Listeria monocytogenes EGD-e
aaauagcauucaca

SEQ ID NO: 771652 - RNA, 19 nt, Listeria monocytogenes EGD-e
ccauggucaggugaaacca

SEQ ID NO: 771653 - RNA, 19 nt, Listeria monocytogenes EGD-e
ccaucaguaguaaagcacu

SEQ ID NO: 771654 - RNA, 23 nt, Listeria monocytogenes EGD-e
aaauuggauuauucaauucccag

SEQ ID NO: 771655 - RNA, 13 nt, Listeria monocytogenes EGD-e
cgaaugaacuuca

SEQ ID NO: 771656 - RNA, 18 nt, Listeria monocytogenes EGD-e
cgaacauaccaauaacga

SEQ ID NO: 771657 - RNA, 15 nt, Listeria monocytogenes EGD-e
cgauaagcaucuagu

SEQ ID NO: 771658 - RNA, 12 nt, Listeria monocytogenes EGD-e
cgauaguuccuu

SEQ ID NO: 771659 - RNA, 14 nt, Listeria monocytogenes EGD-e
cgcauaucaucaau

SEQ ID NO: 771660 - RNA, 14 nt, Listeria monocytogenes EGD-e
aacauucaaaucac

SEQ ID NO: 771661 - RNA, 22 nt, Listeria monocytogenes EGD-e
aaguacaaccguugucauccca

SEQ ID NO: 771662 - RNA, 19 nt, Listeria monocytogenes EGD-e
ggugaaugccagccauuuu

SEQ ID NO: 771663 - RNA, 23 nt, Listeria monocytogenes EGD-e
guaagaagcuuuuacgaucuacu

SEQ ID NO: 771664 - RNA, 11 nt, Listeria monocytogenes EGD-e
guaauaagaag

SEQ ID NO: 771665 - RNA, 20 nt, Listeria monocytogenes EGD-e
gucaauuauucgcucgucaa

SEQ ID NO: 771666 - RNA, 15 nt, Listeria monocytogenes EGD-e
gcuaauuauuucaag

SEQ ID NO: 771667 - RNA, 23 nt, Listeria monocytogenes EGD-e
gcuacacccauaauauuauaguu

SEQ ID NO: 771668 - RNA, 15 nt, Listeria monocytogenes EGD-e
gcuagaaagccuuua

SEQ ID NO: 771669 - RNA, 13 nt, Listeria monocytogenes EGD-e
aaggaagaauagu

SEQ ID NO: 771670 - RNA, 18 nt, Listeria monocytogenes EGD-e
gcucuuccuuuuguuuua

SEQ ID NO: 771671 - RNA, 22 nt, Listeria monocytogenes EGD-e
aagcuacuuuucgaaucccuuu

SEQ ID NO: 771672 - RNA, 23 nt, Listeria monocytogenes EGD-e
gagaacgauuuugguaauaaucc

SEQ ID NO: 771673 - RNA, 19 nt, Listeria monocytogenes EGD-e
aacuaguaauuuaauugcu

SEQ ID NO: 771674 - RNA, 17 nt, Listeria monocytogenes EGD-e
gauaaauauagcuucaa

SEQ ID NO: 771675 - RNA, 17 nt, Listeria monocytogenes EGD-e
gaucgcgguagcuucaa

SEQ ID NO: 771676 - RNA, 19 nt, Listeria monocytogenes EGD-e
gcaauaagcgaauauccga

SEQ ID NO: 771677 - RNA, 18 nt, Listeria monocytogenes EGD-e
gaugguauacuauacaag

SEQ ID NO: 771678 - RNA, 20 nt, Listeria monocytogenes EGD-e
gauucucuucuaacaauuua

SEQ ID NO: 771679 - RNA, 21 nt, Listeria monocytogenes EGD-e
cuguugguguggaaauaacca

SEQ ID NO: 771680 - RNA, 15 nt, Listeria monocytogenes EGD-e
cuucacgugcugcuu

SEQ ID NO: 771681 - RNA, 16 nt, Listeria monocytogenes EGD-e
cuggauuucuccguaa

SEQ ID NO: 771682 - RNA, 17 nt, Listeria monocytogenes EGD-e
gaacgacaaaugguuca

SEQ ID NO: 771683 - RNA, 15 nt, Listeria monocytogenes EGD-e
gaauacuaacgcuuu

SEQ ID NO: 771684 - RNA, 20 nt, Listeria monocytogenes EGD-e
aacgacaaaugguucacuuu

SEQ ID NO: 771685 - RNA, 21 nt, Listeria monocytogenes EGD-e
cuaauuuaggggcauaucuuu

SEQ ID NO: 771686 - RNA, 18 nt, Listeria monocytogenes EGD-e
cuaauuuuacuucuacuu

SEQ ID NO: 771687 - RNA, 20 nt, Listeria monocytogenes EGD-e
cuaauacgacaccaauuuua

SEQ ID NO: 771688 - RNA, 19 nt, Listeria monocytogenes EGD-e
cguuucacuuuaucccaga

SEQ ID NO: 771689 - RNA, 15 nt, Listeria monocytogenes EGD-e
cuaaaauaucaucaa

SEQ ID NO: 771690 - RNA, 19 nt, Listeria monocytogenes EGD-e
cgucaaagcguucaaguga

SEQ ID NO: 771691 - RNA, 23 nt, Listeria monocytogenes EGD-e
uuuguucucuauauucauuauua

SEQ ID NO: 771692 - RNA, 14 nt, Listeria monocytogenes EGD-e
uuuccgcaaguucg

SEQ ID NO: 771693 - RNA, 16 nt, Listeria monocytogenes EGD-e
uuuaucaauaauagca

SEQ ID NO: 771694 - RNA, 15 nt, Listeria monocytogenes EGD-e
uuguuuaauaugcau

SEQ ID NO: 771695 - RNA, 21 nt, Listeria monocytogenes EGD-e
uucuuuuguucgggcgaauaa

SEQ ID NO: 771696 - RNA, 22 nt, Listeria monocytogenes EGD-e
ugucuucggauuuuucaaauca

SEQ ID NO: 771697 - RNA, 15 nt, Listeria monocytogenes EGD-e
uuccaugacaucuuc

SEQ ID NO: 771698 - RNA, 16 nt, Listeria monocytogenes EGD-e
uuccaugacaucuucu

SEQ ID NO: 771699 - RNA, 13 nt, Listeria monocytogenes EGD-e
uuccaacauaaua

SEQ ID NO: 771700 - RNA, 20 nt, Listeria monocytogenes EGD-e
uuauucacgguguugaauaa

SEQ ID NO: 771701 - RNA, 12 nt, Listeria monocytogenes EGD-e
uuaauauaaaga

SEQ ID NO: 771702 - RNA, 13 nt, Listeria monocytogenes EGD-e
uuaaaauucuauu

SEQ ID NO: 771703 - RNA, 19 nt, Listeria monocytogenes EGD-e
uuauccaguguaaucuuga

SEQ ID NO: 771704 - RNA, 23 nt, Listeria monocytogenes EGD-e
uuauaaacguuccaguuaaacaa

SEQ ID NO: 771705 - RNA, 22 nt, Listeria monocytogenes EGD-e
uuaguggagcucuuucuucuac

SEQ ID NO: 771706 - RNA, 15 nt, Listeria monocytogenes EGD-e
uuauaaugcagauua

SEQ ID NO: 771707 - RNA, 18 nt, Listeria monocytogenes EGD-e
uucgagcagcuccauuaa

SEQ ID NO: 771708 - RNA, 11 nt, Listeria monocytogenes EGD-e
guuuuuacuua

SEQ ID NO: 771709 - RNA, 23 nt, Listeria monocytogenes EGD-e
guuuugucaaaccauuauacaau

SEQ ID NO: 771710 - RNA, 23 nt, Listeria monocytogenes EGD-e
uaagcugacaguugcuguuacug

SEQ ID NO: 771711 - RNA, 20 nt, Listeria monocytogenes EGD-e
uaaggauuugucacuuggaa

SEQ ID NO: 771712 - RNA, 16 nt, Listeria monocytogenes EGD-e
uaacgucucucauugu

SEQ ID NO: 771713 - RNA, 13 nt, Listeria monocytogenes EGD-e
uaacaucagauua

SEQ ID NO: 771714 - RNA, 14 nt, Listeria monocytogenes EGD-e
uaaauugauaccaa

SEQ ID NO: 771715 - RNA, 13 nt, Listeria monocytogenes EGD-e
uaaacaacccauu

SEQ ID NO: 771716 - RNA, 13 nt, Listeria monocytogenes EGD-e
uaaaagaggauuu

SEQ ID NO: 771717 - RNA, 22 nt, Listeria monocytogenes EGD-e
uacuuauagcguacaugaugau

SEQ ID NO: 771718 - RNA, 18 nt, Listeria monocytogenes EGD-e
uagauuccgcuaaaacua

SEQ ID NO: 771719 - RNA, 18 nt, Listeria monocytogenes EGD-e
uaucaugacuaaaaagca

SEQ ID NO: 771720 - RNA, 14 nt, Listeria monocytogenes EGD-e
uauccccuagcucg

SEQ ID NO: 771721 - RNA, 13 nt, Listeria monocytogenes EGD-e
uauuaaugacugu

SEQ ID NO: 771722 - RNA, 16 nt, Listeria monocytogenes EGD-e
uauagucauaagcuaa

SEQ ID NO: 771723 - RNA, 24 nt, Listeria monocytogenes EGD-e
uccacacugguuuuuuaaugcgaa

SEQ ID NO: 771724 - RNA, 18 nt, Listeria monocytogenes EGD-e
uccagcguuaaucuuaca

SEQ ID NO: 771725 - RNA, 15 nt, Listeria monocytogenes EGD-e
uccuucaagcauuuc

SEQ ID NO: 771726 - RNA, 23 nt, Listeria monocytogenes EGD-e
ucgcucuguuucauuuuuccaag

SEQ ID NO: 771727 - RNA, 17 nt, Listeria monocytogenes EGD-e
ucuaauagcauaaagua

SEQ ID NO: 771728 - RNA, 13 nt, Listeria monocytogenes EGD-e
ucuucagaaagug

SEQ ID NO: 771729 - RNA, 22 nt, Listeria monocytogenes EGD-e
ucuuccuuuuucauuauaagug

SEQ ID NO: 771730 - RNA, 20 nt, Listeria monocytogenes EGD-e
ucuugacuuuguuaacuaga

SEQ ID NO: 771731 - RNA, 22 nt, Listeria monocytogenes EGD-e
ugaaaagacaccaauuucuguu

SEQ ID NO: 771732 - RNA, 18 nt, Listeria monocytogenes EGD-e
ugccgcgacuauuucgcg

SEQ ID NO: 771733 - RNA, 18 nt, Listeria monocytogenes EGD-e
ugcgcaacauucaaauca

SEQ ID NO: 771734 - RNA, 15 nt, Listeria monocytogenes EGD-e
ugcuaaaauaaaucu

SEQ ID NO: 771735 - RNA, 20 nt, Listeria monocytogenes EGD-e
ggacaacagguuuuguguua

SEQ ID NO: 771736 - RNA, 21 nt, Listeria monocytogenes EGD-e
gcuugcacuuggaacggcuuu

SEQ ID NO: 771737 - RNA, 14 nt, Listeria monocytogenes EGD-e
gucacaaacgcuuu

SEQ ID NO: 771738 - RNA, 21 nt, Listeria monocytogenes EGD-e
guaauaggauuuuacugcggc

SEQ ID NO: 771739 - RNA, 20 nt, Listeria monocytogenes EGD-e
guaaacuugcaucuucuguu

SEQ ID NO: 771740 - RNA, 22 nt, Listeria monocytogenes EGD-e
gguguaaucacuauugaauguc

SEQ ID NO: 771741 - RNA, 12 nt, Listeria monocytogenes EGD-e
ccuaaagcaucg

SEQ ID NO: 771742 - RNA, 20 nt, Listeria monocytogenes EGD-e
cggauaaauauagcuucaaa

SEQ ID NO: 771743 - RNA, 22 nt, Listeria monocytogenes EGD-e
gcaaguagcuuaggcuacuugc

SEQ ID NO: 771744 - RNA, 15 nt, Listeria monocytogenes EGD-e
gcaucggucaaaucu

SEQ ID NO: 771745 - RNA, 23 nt, Listeria monocytogenes EGD-e
gccagacuuuuuuuuauaagaaa

SEQ ID NO: 771746 - RNA, 16 nt, Listeria monocytogenes EGD-e
gcccauuaaaaagcuu

SEQ ID NO: 771747 - RNA, 22 nt, Listeria monocytogenes EGD-e
cuuccauauuuucucuaaauca

SEQ ID NO: 771748 - RNA, 17 nt, Listeria monocytogenes EGD-e
cuuguuccauuacuuua

SEQ ID NO: 771749 - RNA, 20 nt, Listeria monocytogenes EGD-e
cuuuaaaaacaguacuucua

SEQ ID NO: 771750 - RNA, 21 nt, Listeria monocytogenes EGD-e
cuuuuccuaauuuuacuucua

SEQ ID NO: 771751 - RNA, 14 nt, Listeria monocytogenes EGD-e
cuuuuguucuucua

SEQ ID NO: 771752 - RNA, 18 nt, Listeria monocytogenes EGD-e
gaaauuaccuaaugaaua

SEQ ID NO: 771753 - RNA, 12 nt, Listeria monocytogenes EGD-e
gagaaauggauu

SEQ ID NO: 771754 - RNA, 22 nt, Listeria monocytogenes EGD-e
cguuaguaaacuugcaucuucu

SEQ ID NO: 771755 - RNA, 13 nt, Listeria monocytogenes EGD-e
cgugagaacgaca

SEQ ID NO: 771756 - RNA, 21 nt, Listeria monocytogenes EGD-e
cuacuucuaaauuaacuucau

SEQ ID NO: 771757 - RNA, 19 nt, Listeria monocytogenes EGD-e
cucauugaggaauacuguu

SEQ ID NO: 771758 - RNA, 15 nt, Listeria monocytogenes EGD-e
caucaacgggcgcuu

SEQ ID NO: 771759 - RNA, 23 nt, Listeria monocytogenes EGD-e
cauucacugauuuauuauaagca

SEQ ID NO: 771760 - RNA, 15 nt, Listeria monocytogenes EGD-e
cauuaaccuacuuua

SEQ ID NO: 771761 - RNA, 23 nt, Listeria monocytogenes EGD-e
cauuuaauuuacuggcaacuuca

SEQ ID NO: 771762 - RNA, 23 nt, Listeria monocytogenes EGD-e
ccaauuucuguuuuguuuucagg

SEQ ID NO: 771763 - RNA, 15 nt, Listeria monocytogenes EGD-e
agcguucaagugaua

SEQ ID NO: 771764 - RNA, 14 nt, Listeria monocytogenes EGD-e
agcgaauaagugaa

SEQ ID NO: 771765 - RNA, 15 nt, Listeria monocytogenes EGD-e
agcgcaucucuaaca

SEQ ID NO: 771766 - RNA, 21 nt, Listeria monocytogenes EGD-e
agcaauuuguuuauccguuaa

SEQ ID NO: 771767 - RNA, 12 nt, Listeria monocytogenes EGD-e
aguaaacauuuc

SEQ ID NO: 771768 - RNA, 22 nt, Listeria monocytogenes EGD-e
aguuguucaggguuuguuccac

SEQ ID NO: 771769 - RNA, 15 nt, Listeria monocytogenes EGD-e
auacuauugaauguu

SEQ ID NO: 771770 - RNA, 13 nt, Listeria monocytogenes EGD-e
auagauugauguu

SEQ ID NO: 771771 - RNA, 22 nt, Listeria monocytogenes EGD-e
aucaauuuacguuguucuaaca

SEQ ID NO: 771772 - RNA, 20 nt, Listeria monocytogenes EGD-e
aucacaaaccaaauaccgaa

SEQ ID NO: 771773 - RNA, 16 nt, Listeria monocytogenes EGD-e
auauuaaugucaauua

SEQ ID NO: 771774 - RNA, 19 nt, Listeria monocytogenes EGD-e
auauccauaaagcuaagca

SEQ ID NO: 771775 - RNA, 19 nt, Listeria monocytogenes EGD-e
auucugugauggaaguaau

SEQ ID NO: 771776 - RNA, 17 nt, Listeria monocytogenes EGD-e
auucuauuaauaaugau

SEQ ID NO: 771777 - RNA, 17 nt, Listeria monocytogenes EGD-e
auucgaauaaagaacuu

SEQ ID NO: 771778 - RNA, 15 nt, Listeria monocytogenes EGD-e
auuccguucauuuga

SEQ ID NO: 771779 - RNA, 17 nt, Listeria monocytogenes EGD-e
auugcaagcaccauauc

SEQ ID NO: 771780 - RNA, 20 nt, Listeria monocytogenes EGD-e
auugaugccgacuaguucug

SEQ ID NO: 771781 - RNA, 16 nt, Listeria monocytogenes EGD-e
auugauggauuccuaa

SEQ ID NO: 771782 - RNA, 22 nt, Listeria monocytogenes EGD-e
aucuaguagcaauuuuaaaucu

SEQ ID NO: 771783 - RNA, 20 nt, Listeria monocytogenes EGD-e
aauuucuucgugcgcaacau

SEQ ID NO: 771784 - RNA, 20 nt, Listeria monocytogenes EGD-e
aauuugacgcaaggaaucuu

SEQ ID NO: 771785 - RNA, 13 nt, Listeria monocytogenes EGD-e
aauuuuaggcgua

SEQ ID NO: 771786 - RNA, 13 nt, Listeria monocytogenes EGD-e
acaccaaauucgc

SEQ ID NO: 771787 - RNA, 22 nt, Listeria monocytogenes EGD-e
acuuucaauuaagucugcuucu

SEQ ID NO: 771788 - RNA, 14 nt, Listeria monocytogenes EGD-e
uguugucaauguau

SEQ ID NO: 771789 - RNA, 14 nt, Listeria monocytogenes EGD-e
uuauaguuuucuac

SEQ ID NO: 771790 - RNA, 23 nt, Listeria monocytogenes EGD-e
uuacuuacaaaaguggaaauguu

SEQ ID NO: 771791 - RNA, 16 nt, Listeria monocytogenes EGD-e
uuccugauguguugcu

SEQ ID NO: 771792 - RNA, 16 nt, Listeria monocytogenes EGD-e
uuccuccaauuuuacu

SEQ ID NO: 771793 - RNA, 16 nt, Listeria monocytogenes EGD-e
uucucaaaaauaugcu

SEQ ID NO: 771794 - RNA, 17 nt, Listeria monocytogenes EGD-e
uucucuccaaucagcaa

SEQ ID NO: 771795 - RNA, 13 nt, Listeria monocytogenes EGD-e
uugaacgaacgau

SEQ ID NO: 771796 - RNA, 18 nt, Listeria monocytogenes EGD-e
uuguaauuucuuugucgc

SEQ ID NO: 771797 - RNA, 22 nt, Listeria monocytogenes EGD-e
uuuaagucgaaagaauaaaaca

SEQ ID NO: 771798 - RNA, 16 nt, Listeria monocytogenes EGD-e
uuuauucgaauaaaga

SEQ ID NO: 771799 - RNA, 13 nt, Listeria monocytogenes EGD-e
uuuauuauaagca

SEQ ID NO: 771800 - RNA, 18 nt, Listeria monocytogenes EGD-e
uuuaugcauaaaaaagca

SEQ ID NO: 771801 - RNA, 17 nt, Listeria monocytogenes EGD-e
uuucgauaucuucaugu

SEQ ID NO: 771802 - RNA, 18 nt, Listeria monocytogenes EGD-e
uuuguugucaauguauac

SEQ ID NO: 771803 - RNA, 13 nt, Listeria monocytogenes EGD-e
uuuuauuacuuua

SEQ ID NO: 771804 - RNA, 15 nt, Listeria monocytogenes EGD-e
aaucuuucacacgau

SEQ ID NO: 771805 - RNA, 18 nt, Listeria monocytogenes EGD-e
aaugauucaaagcuacuu

SEQ ID NO: 771806 - RNA, 20 nt, Listeria monocytogenes EGD-e
uuuugucgauaguucacugu

SEQ ID NO: 771807 - RNA, 21 nt, Listeria monocytogenes EGD-e
aauucaguuuauaaauaccug

SEQ ID NO: 771808 - RNA, 17 nt, Listeria monocytogenes EGD-e
aaugcugaauguuuucu

SEQ ID NO: 771809 - RNA, 16 nt, Listeria monocytogenes EGD-e
aauggagcuauuguaa

SEQ ID NO: 771810 - RNA, 13 nt, Listeria monocytogenes EGD-e
aauuacuucacca

SEQ ID NO: 771811 - RNA, 14 nt, Listeria monocytogenes EGD-e
aauuucaucguuuu

SEQ ID NO: 771812 - RNA, 22 nt, Listeria monocytogenes EGD-e
aauuucgccguuggaagugaaa

SEQ ID NO: 771813 - RNA, 18 nt, Listeria monocytogenes EGD-e
aaucaagugcagcgacaa

SEQ ID NO: 771814 - RNA, 11 nt, Listeria monocytogenes EGD-e
uguccauugau

SEQ ID NO: 771815 - RNA, 15 nt, Listeria monocytogenes EGD-e
aaucaauuucuucgu

SEQ ID NO: 771816 - RNA, 22 nt, Listeria monocytogenes EGD-e
aauaucaucaauuaaauuauac

SEQ ID NO: 771817 - RNA, 22 nt, Listeria monocytogenes EGD-e
aauauccauaaagcuaagcauu

SEQ ID NO: 771818 - RNA, 22 nt, Listeria monocytogenes EGD-e
guuuucaacaaaacaaacuagu

SEQ ID NO: 771819 - RNA, 19 nt, Listeria monocytogenes EGD-e
uaaaaucauuaaagcuaua

SEQ ID NO: 771820 - RNA, 14 nt, Listeria monocytogenes EGD-e
guuuuuuguuugua

SEQ ID NO: 771821 - RNA, 16 nt, Listeria monocytogenes EGD-e
uaaaccguuaccauaa

SEQ ID NO: 771822 - RNA, 18 nt, Listeria monocytogenes EGD-e
uaacauaaccuucaucgu

SEQ ID NO: 771823 - RNA, 17 nt, Listeria monocytogenes EGD-e
uaauaguauacuuuuaa

SEQ ID NO: 771824 - RNA, 15 nt, Listeria monocytogenes EGD-e
uaauagguccgauaa

SEQ ID NO: 771825 - RNA, 12 nt, Listeria monocytogenes EGD-e
uaauauccauaa

SEQ ID NO: 771826 - RNA, 16 nt, Listeria monocytogenes EGD-e
uaauauccauaaagcu

SEQ ID NO: 771827 - RNA, 21 nt, Listeria monocytogenes EGD-e
uaaucaauccgccaaccagua

SEQ ID NO: 771828 - RNA, 19 nt, Listeria monocytogenes EGD-e
uacaauuuucauuuaacau

SEQ ID NO: 771829 - RNA, 12 nt, Listeria monocytogenes EGD-e
uacggcuucaau

SEQ ID NO: 771830 - RNA, 20 nt, Listeria monocytogenes EGD-e
uauaccgaccaucaguagua

SEQ ID NO: 771831 - RNA, 15 nt, Listeria monocytogenes EGD-e
uauacaggaacuaca

SEQ ID NO: 771832 - RNA, 19 nt, Listeria monocytogenes EGD-e
uaugcauaaaaaagcacuc

SEQ ID NO: 771833 - RNA, 18 nt, Listeria monocytogenes EGD-e
uccacaucgauguuacca

SEQ ID NO: 771834 - RNA, 16 nt, Listeria monocytogenes EGD-e
ucagaucuccgaauac

SEQ ID NO: 771835 - RNA, 16 nt, Listeria monocytogenes EGD-e
ucguuucaacuccgcu

SEQ ID NO: 771836 - RNA, 12 nt, Listeria monocytogenes EGD-e
ucuaaaguuaga

SEQ ID NO: 771837 - RNA, 20 nt, Listeria monocytogenes EGD-e
ugagcgguuuuguuuccaac

SEQ ID NO: 771838 - RNA, 18 nt, Listeria monocytogenes EGD-e
ugcaagccguauucuguu

SEQ ID NO: 771839 - RNA, 20 nt, Listeria monocytogenes EGD-e
uccuucuacguagcagaugu

SEQ ID NO: 771840 - RNA, 22 nt, Listeria monocytogenes EGD-e
uccuucuacguagcagauguau

SEQ ID NO: 771841 - RNA, 18 nt, Listeria monocytogenes EGD-e
ucggauuuuucaaaucaa

SEQ ID NO: 771842 - RNA, 22 nt, Listeria monocytogenes EGD-e
agcuucuuccauuuguucucua

SEQ ID NO: 771843 - RNA, 19 nt, Listeria monocytogenes EGD-e
agcuagacaagcacuuacu

SEQ ID NO: 771844 - RNA, 15 nt, Listeria monocytogenes EGD-e
aguccaccagcuacu

SEQ ID NO: 771845 - RNA, 21 nt, Listeria monocytogenes EGD-e
auaauggaaaaauaaucacgu

SEQ ID NO: 771846 - RNA, 17 nt, Listeria monocytogenes EGD-e
auaaauauagcuucaaa

SEQ ID NO: 771847 - RNA, 21 nt, Listeria monocytogenes EGD-e
auagcuucaaacgcagguuca

SEQ ID NO: 771848 - RNA, 19 nt, Listeria monocytogenes EGD-e
auauuuugcucaagugaac

SEQ ID NO: 771849 - RNA, 11 nt, Listeria monocytogenes EGD-e
aucaauccgcc

SEQ ID NO: 771850 - RNA, 20 nt, Listeria monocytogenes EGD-e
aucaugccuucaaacacuuc

SEQ ID NO: 771851 - RNA, 12 nt, Listeria monocytogenes EGD-e
aucccaauagaa

SEQ ID NO: 771852 - RNA, 21 nt, Listeria monocytogenes EGD-e
aucggucaauugcaugagcaa

SEQ ID NO: 771853 - RNA, 17 nt, Listeria monocytogenes EGD-e
augauucaaagcuacuu

SEQ ID NO: 771854 - RNA, 17 nt, Listeria monocytogenes EGD-e
augaaaccaaauaugcu

SEQ ID NO: 771855 - RNA, 21 nt, Listeria monocytogenes EGD-e
aucuucuguuaacauuuccaa

SEQ ID NO: 771856 - RNA, 16 nt, Listeria monocytogenes EGD-e
aaacucucccauuugu

SEQ ID NO: 771857 - RNA, 17 nt, Listeria monocytogenes EGD-e
auuaugauuuguuucug

SEQ ID NO: 771858 - RNA, 19 nt, Listeria monocytogenes EGD-e
auuaauaguauaaggauac

SEQ ID NO: 771859 - RNA, 19 nt, Listeria monocytogenes EGD-e
auugugcuaaguagacaag

SEQ ID NO: 771860 - RNA, 19 nt, Listeria monocytogenes EGD-e
auuuugguuauuucuuuau

SEQ ID NO: 771861 - RNA, 14 nt, Listeria monocytogenes EGD-e
caaaacaaacuagu

SEQ ID NO: 771862 - RNA, 19 nt, Listeria monocytogenes EGD-e
auuuucagaaaaugcugcu

SEQ ID NO: 771863 - RNA, 13 nt, Listeria monocytogenes EGD-e
auuuuaacggcuu

SEQ ID NO: 771864 - RNA, 20 nt, Listeria monocytogenes EGD-e
auuuuauagguaacaucuuc

SEQ ID NO: 771865 - RNA, 15 nt, Listeria monocytogenes EGD-e
cagacgcaauuucaa

SEQ ID NO: 771866 - RNA, 23 nt, Listeria monocytogenes EGD-e
cagcauuuuuacgauuugucuuc

SEQ ID NO: 771867 - RNA, 19 nt, Listeria monocytogenes EGD-e
caugaauuuuugcauccac

SEQ ID NO: 771868 - RNA, 14 nt, Listeria monocytogenes EGD-e
aaagcuaagcauua

SEQ ID NO: 771869 - RNA, 14 nt, Listeria monocytogenes EGD-e
aaaguaccaauguu

SEQ ID NO: 771870 - RNA, 23 nt, Listeria monocytogenes EGD-e
aaaucaguaccugcaagcgaauu

SEQ ID NO: 771871 - RNA, 13 nt, Listeria monocytogenes EGD-e
cccauacuaauca

SEQ ID NO: 771872 - RNA, 21 nt, Listeria monocytogenes EGD-e
cccuuuacuugcaaaugcuuu

SEQ ID NO: 771873 - RNA, 21 nt, Listeria monocytogenes EGD-e
cgauguuaccacgaguugcuu

SEQ ID NO: 771874 - RNA, 12 nt, Listeria monocytogenes EGD-e
aaauuucaucgu

SEQ ID NO: 771875 - RNA, 17 nt, Listeria monocytogenes EGD-e
aacauaaccuucaucgu

SEQ ID NO: 771876 - RNA, 18 nt, Listeria monocytogenes EGD-e
ggcuuauuuuaacggcuu

SEQ ID NO: 771877 - RNA, 17 nt, Listeria monocytogenes EGD-e
guaauucgaauaagaac

SEQ ID NO: 771878 - RNA, 19 nt, Listeria monocytogenes EGD-e
gcuucgcuguccauuccaa

SEQ ID NO: 771879 - RNA, 19 nt, Listeria monocytogenes EGD-e
aacuguuguucuugccaaa

SEQ ID NO: 771880 - RNA, 19 nt, Listeria monocytogenes EGD-e
cuguuuuuucuuugucuug

SEQ ID NO: 771881 - RNA, 18 nt, Listeria monocytogenes EGD-e
cuuuaucuuuuccuucua

SEQ ID NO: 771882 - RNA, 18 nt, Listeria monocytogenes EGD-e
cuugcuucacgugcugcu

SEQ ID NO: 771883 - RNA, 19 nt, Listeria monocytogenes EGD-e
cuuuuacgaucuacuucua

SEQ ID NO: 771884 - RNA, 23 nt, Listeria monocytogenes EGD-e
cuuuuaaauuaucauucauaaug

SEQ ID NO: 771885 - RNA, 13 nt, Listeria monocytogenes EGD-e
cuuuuugcuggcu

SEQ ID NO: 771886 - RNA, 16 nt, Listeria monocytogenes EGD-e
aaccuucaucguuuaa

SEQ ID NO: 771887 - RNA, 12 nt, Listeria monocytogenes EGD-e
gaaaucaagcgg

SEQ ID NO: 771888 - RNA, 14 nt, Listeria monocytogenes EGD-e
gaauaacagauuug

SEQ ID NO: 771889 - RNA, 17 nt, Listeria monocytogenes EGD-e
gacauacuucaugugcu

SEQ ID NO: 771890 - RNA, 21 nt, Listeria monocytogenes EGD-e
aaccgagaaaucucaugaaac

SEQ ID NO: 771891 - RNA, 14 nt, Listeria monocytogenes EGD-e
cugaauaaguaaua

SEQ ID NO: 771892 - RNA, 16 nt, Listeria monocytogenes EGD-e
cuauaaaaacaugaua

SEQ ID NO: 771893 - RNA, 13 nt, Listeria monocytogenes EGD-e
cucauuacucggu

SEQ ID NO: 771894 - RNA, 13 nt, Listeria monocytogenes EGD-e
aaaauuucaucgu

SEQ ID NO: 771895 - RNA, 19 nt, Listeria monocytogenes EGD-e
accuuuugcuucuuccaua

SEQ ID NO: 771896 - RNA, 18 nt, Listeria monocytogenes EGD-e
acgaaagcaacaacugcu

SEQ ID NO: 771897 - RNA, 14 nt, Listeria monocytogenes EGD-e
accugaaagaacug

SEQ ID NO: 771898 - RNA, 18 nt, Listeria monocytogenes EGD-e
aaaauuagugccaugaau

SEQ ID NO: 771899 - RNA, 17 nt, Listeria monocytogenes EGD-e
acuacuaauuguuaccg

SEQ ID NO: 771900 - RNA, 20 nt, Listeria monocytogenes EGD-e
acggaucgcgguagcuucaa

SEQ ID NO: 771901 - RNA, 13 nt, Listeria monocytogenes EGD-e
acuuauaaugcag

SEQ ID NO: 771902 - RNA, 16 nt, Listeria monocytogenes EGD-e
acuaguuguaaaccgu

SEQ ID NO: 771903 - RNA, 19 nt, Listeria monocytogenes EGD-e
agaaauggcgguaauugga

SEQ ID NO: 771904 - RNA, 15 nt, Listeria monocytogenes EGD-e
agaagcaauuagucc

SEQ ID NO: 771905 - RNA, 15 nt, Listeria monocytogenes EGD-e
agaagguucaucacu

SEQ ID NO: 771906 - RNA, 21 nt, Listeria monocytogenes EGD-e
agauccauugcaagguaucga

SEQ ID NO: 771907 - RNA, 22 nt, Listeria monocytogenes EGD-e
aacuuuuucucaaaaauaugcu

SEQ ID NO: 771908 - RNA, 22 nt, Listeria monocytogenes EGD-e
aacuuggaaaguggaccccgau

SEQ ID NO: 771909 - RNA, 20 nt, Listeria monocytogenes EGD-e
aacuuacucgaguauaugcu

SEQ ID NO: 771910 - RNA, 14 nt, Listeria monocytogenes EGD-e
aacgauaaagcggu

SEQ ID NO: 771911 - RNA, 14 nt, Listeria monocytogenes EGD-e
aagucuggauuucu

SEQ ID NO: 771912 - RNA, 17 nt, Listeria monocytogenes EGD-e
aagucuauuucagcuaa

SEQ ID NO: 771913 - RNA, 15 nt, Listeria monocytogenes EGD-e
aaugcaauccauguu

SEQ ID NO: 771914 - RNA, 19 nt, Listeria monocytogenes EGD-e
aaucuuuuaauaacugaau

SEQ ID NO: 771915 - RNA, 21 nt, Listeria monocytogenes EGD-e
aaucacuauugaaugucacuu

SEQ ID NO: 771916 - RNA, 23 nt, Listeria monocytogenes EGD-e
aauuuccacaucgauguuaccac

SEQ ID NO: 771917 - RNA, 17 nt, Listeria monocytogenes EGD-e
aauuaaaaguuguauag

SEQ ID NO: 771918 - RNA, 21 nt, Listeria monocytogenes EGD-e
aauguugguguaggaagugau

SEQ ID NO: 771919 - RNA, 12 nt, Listeria monocytogenes EGD-e
aaaaagcuuauu

SEQ ID NO: 771920 - RNA, 13 nt, Listeria monocytogenes EGD-e
aaaaauaaucacg

SEQ ID NO: 771921 - RNA, 19 nt, Listeria monocytogenes EGD-e
aaaagucaugacagcaucu

SEQ ID NO: 771922 - RNA, 20 nt, Listeria monocytogenes EGD-e
aaaauacauuuuagcuuauu

SEQ ID NO: 771923 - RNA, 17 nt, Listeria monocytogenes EGD-e
aaaaugagcccaaaaau

SEQ ID NO: 771924 - RNA, 17 nt, Listeria monocytogenes EGD-e
aacaaacacaaaaugcu

SEQ ID NO: 771925 - RNA, 17 nt, Listeria monocytogenes EGD-e
aacaauuacuuccauga

SEQ ID NO: 771926 - RNA, 14 nt, Listeria monocytogenes EGD-e
aacaacccauuugc

SEQ ID NO: 771927 - RNA, 20 nt, Listeria monocytogenes EGD-e
uuuuuuucuuagaagaugca

SEQ ID NO: 771928 - RNA, 19 nt, Listeria monocytogenes EGD-e
uuuuuuucuuuaaaaucca

SEQ ID NO: 771929 - RNA, 17 nt, Listeria monocytogenes EGD-e
uuuuuugaaaaaacauc

SEQ ID NO: 771930 - RNA, 13 nt, Listeria monocytogenes EGD-e
uuuuuuccuucau

SEQ ID NO: 771931 - RNA, 13 nt, Listeria monocytogenes EGD-e
uuuuuuauuuuuu

SEQ ID NO: 771932 - RNA, 24 nt, Listeria monocytogenes EGD-e
uuuuucauuaauuuguccuuccuc

SEQ ID NO: 771933 - RNA, 14 nt, Listeria monocytogenes EGD-e
uuuugagauaauca

SEQ ID NO: 771934 - RNA, 23 nt, Listeria monocytogenes EGD-e
uuuugagauaaucaagauuuugu

SEQ ID NO: 771935 - RNA, 14 nt, Listeria monocytogenes EGD-e
uuuucuuuuccuaa

SEQ ID NO: 771936 - RNA, 16 nt, Listeria monocytogenes EGD-e
uuuugcacaaaaugca

SEQ ID NO: 771937 - RNA, 15 nt, Listeria monocytogenes EGD-e
uuuucuucuuguucc

SEQ ID NO: 771938 - RNA, 15 nt, Listeria monocytogenes EGD-e
uuuucgcgugauaaa

SEQ ID NO: 771939 - RNA, 21 nt, Listeria monocytogenes EGD-e
uuuucgauauuuuuuuguucu

SEQ ID NO: 771940 - RNA, 17 nt, Listeria monocytogenes EGD-e
uuuucacugcauaaaaa

SEQ ID NO: 771941 - RNA, 20 nt, Listeria monocytogenes EGD-e
uuuucacugcauaaaaaaca

SEQ ID NO: 771942 - RNA, 14 nt, Listeria monocytogenes EGD-e
uuuucaacaaaaca

SEQ ID NO: 771943 - RNA, 18 nt, Listeria monocytogenes EGD-e
uuuucaacaaaacaaacu

SEQ ID NO: 771944 - RNA, 12 nt, Listeria monocytogenes EGD-e
uuuucaaaauca

SEQ ID NO: 771945 - RNA, 13 nt, Listeria monocytogenes EGD-e
uuuaccuugcucc

SEQ ID NO: 771946 - RNA, 21 nt, Listeria monocytogenes EGD-e
uuuaccuuucguuuuuacuua

SEQ ID NO: 771947 - RNA, 12 nt, Listeria monocytogenes EGD-e
uuuucaucccuu

SEQ ID NO: 771948 - RNA, 20 nt, Listeria monocytogenes EGD-e
uuuucagcuaaauauuuaau

SEQ ID NO: 771949 - RNA, 14 nt, Listeria monocytogenes EGD-e
uuuuccuagaacua

SEQ ID NO: 771950 - RNA, 14 nt, Listeria monocytogenes EGD-e
uuuucgaaaguuuc

SEQ ID NO: 771951 - RNA, 14 nt, Listeria monocytogenes EGD-e
uuuuuauacacgau

SEQ ID NO: 771952 - RNA, 14 nt, Listeria monocytogenes EGD-e
uuuuguuuguaaaa

SEQ ID NO: 771953 - RNA, 21 nt, Listeria monocytogenes EGD-e
uuuuguucgggcgaauaacca

SEQ ID NO: 771954 - RNA, 20 nt, Listeria monocytogenes EGD-e
uuuuguucuaagaauugauu

SEQ ID NO: 771955 - RNA, 13 nt, Listeria monocytogenes EGD-e
uuuuguucuucua

SEQ ID NO: 771956 - RNA, 12 nt, Listeria monocytogenes EGD-e
uuuuguugaacu

SEQ ID NO: 771957 - RNA, 14 nt, Listeria monocytogenes EGD-e
uuuuguauugguuu

SEQ ID NO: 771958 - RNA, 13 nt, Listeria monocytogenes EGD-e
uuuuguccaaccu

SEQ ID NO: 771959 - RNA, 12 nt, Listeria monocytogenes EGD-e
uuuugcugauuu

SEQ ID NO: 771960 - RNA, 22 nt, Listeria monocytogenes EGD-e
uuuuguaauaccgagaucuugc

SEQ ID NO: 771961 - RNA, 15 nt, Listeria monocytogenes EGD-e
uuuuggugacgaauc

SEQ ID NO: 771962 - RNA, 15 nt, Listeria monocytogenes EGD-e
uuuuggguauauuuu

SEQ ID NO: 771963 - RNA, 13 nt, Listeria monocytogenes EGD-e
uuuugcuucuucc

SEQ ID NO: 771964 - RNA, 12 nt, Listeria monocytogenes EGD-e
uuuuggaaaauc

SEQ ID NO: 771965 - RNA, 15 nt, Listeria monocytogenes EGD-e
uucuaguuuguccca

SEQ ID NO: 771966 - RNA, 21 nt, Listeria monocytogenes EGD-e
uucuagccgcucgucuaaauu

SEQ ID NO: 771967 - RNA, 19 nt, Listeria monocytogenes EGD-e
uucuaaucaaaugcacagc

SEQ ID NO: 771968 - RNA, 13 nt, Listeria monocytogenes EGD-e
uucguuauuuccu

SEQ ID NO: 771969 - RNA, 18 nt, Listeria monocytogenes EGD-e
uucuaaauuaacuucaug

SEQ ID NO: 771970 - RNA, 16 nt, Listeria monocytogenes EGD-e
uucggagacagaaaaa

SEQ ID NO: 771971 - RNA, 23 nt, Listeria monocytogenes EGD-e
uucucgcugcaauuucaaccaau

SEQ ID NO: 771972 - RNA, 15 nt, Listeria monocytogenes EGD-e
uucuuccauuuguuc

SEQ ID NO: 771973 - RNA, 20 nt, Listeria monocytogenes EGD-e
uucuucagacgcaauuucaa

SEQ ID NO: 771974 - RNA, 16 nt, Listeria monocytogenes EGD-e
uucuucaacagcuuga

SEQ ID NO: 771975 - RNA, 22 nt, Listeria monocytogenes EGD-e
uucuuagaagaugcacuagaaa

SEQ ID NO: 771976 - RNA, 17 nt, Listeria monocytogenes EGD-e
uugaacggguuucccug

SEQ ID NO: 771977 - RNA, 17 nt, Listeria monocytogenes EGD-e
uugaauguucuaaaaua

SEQ ID NO: 771978 - RNA, 18 nt, Listeria monocytogenes EGD-e
uugacgcguggaaagaau

SEQ ID NO: 771979 - RNA, 11 nt, Listeria monocytogenes EGD-e
uucuugccaaa

SEQ ID NO: 771980 - RNA, 13 nt, Listeria monocytogenes EGD-e
uucuugauuuguu

SEQ ID NO: 771981 - RNA, 20 nt, Listeria monocytogenes EGD-e
uucuugcuggucagaacgua

SEQ ID NO: 771982 - RNA, 14 nt, Listeria monocytogenes EGD-e
uucuuucucguauu

SEQ ID NO: 771983 - RNA, 17 nt, Listeria monocytogenes EGD-e
uucuuuuuuaauaauua

SEQ ID NO: 771984 - RNA, 16 nt, Listeria monocytogenes EGD-e
uugagcgguuuuguuu

SEQ ID NO: 771985 - RNA, 21 nt, Listeria monocytogenes EGD-e
uugcaaucccuauaaaaacau

SEQ ID NO: 771986 - RNA, 19 nt, Listeria monocytogenes EGD-e
uugcaagguaucgaacgcu

SEQ ID NO: 771987 - RNA, 17 nt, Listeria monocytogenes EGD-e
uugauuuguuuccagcg

SEQ ID NO: 771988 - RNA, 16 nt, Listeria monocytogenes EGD-e
uugauuuguuuuauua

SEQ ID NO: 771989 - RNA, 14 nt, Listeria monocytogenes EGD-e
uuggauuauucaau

SEQ ID NO: 771990 - RNA, 21 nt, Listeria monocytogenes EGD-e
uugcuucuuccauaucaccaa

SEQ ID NO: 771991 - RNA, 19 nt, Listeria monocytogenes EGD-e
uugcuucaccaagaagagc

SEQ ID NO: 771992 - RNA, 22 nt, Listeria monocytogenes EGD-e
uugcuucuccguuuuccaccau

SEQ ID NO: 771993 - RNA, 23 nt, Listeria monocytogenes EGD-e
uugcugcuaaaggcaacaaagaa

SEQ ID NO: 771994 - RNA, 22 nt, Listeria monocytogenes EGD-e
uugcugcucgcucaucaucaac

SEQ ID NO: 771995 - RNA, 20 nt, Listeria monocytogenes EGD-e
uugggaauucguuauuuccu

SEQ ID NO: 771996 - RNA, 13 nt, Listeria monocytogenes EGD-e
uugggagcuuucu

SEQ ID NO: 771997 - RNA, 19 nt, Listeria monocytogenes EGD-e
uuggccuucgauaguuccu

SEQ ID NO: 771998 - RNA, 14 nt, Listeria monocytogenes EGD-e
uugguuuuguccaa

SEQ ID NO: 771999 - RNA, 15 nt, Listeria monocytogenes EGD-e
uugguuuaauuuccu

SEQ ID NO: 772000 - RNA, 16 nt, Listeria monocytogenes EGD-e
uugucaaucuaaauuu

SEQ ID NO: 772001 - RNA, 17 nt, Listeria monocytogenes EGD-e
uuguaggguuuggaaaa

SEQ ID NO: 772002 - RNA, 20 nt, Listeria monocytogenes EGD-e
uuguaggguuuggaaaacau

SEQ ID NO: 772003 - RNA, 12 nt, Listeria monocytogenes EGD-e
uuguuucuaauc

SEQ ID NO: 772004 - RNA, 21 nt, Listeria monocytogenes EGD-e
uuguguaaguguuucuagauu

SEQ ID NO: 772005 - RNA, 14 nt, Listeria monocytogenes EGD-e
uugugaaaguuuua

SEQ ID NO: 772006 - RNA, 20 nt, Listeria monocytogenes EGD-e
uuuacaauggaaugacaaaa

SEQ ID NO: 772007 - RNA, 21 nt, Listeria monocytogenes EGD-e
uuuacaauggaaugacaaaau

SEQ ID NO: 772008 - RNA, 12 nt, Listeria monocytogenes EGD-e
uuuaaucuaaau

SEQ ID NO: 772009 - RNA, 15 nt, Listeria monocytogenes EGD-e
uuuaaucuaaaucua

SEQ ID NO: 772010 - RNA, 21 nt, Listeria monocytogenes EGD-e
uuccgggcgugguaagccauu

SEQ ID NO: 772011 - RNA, 22 nt, Listeria monocytogenes EGD-e
uuccgggcgugguaagccauuu

SEQ ID NO: 772012 - RNA, 22 nt, Listeria monocytogenes EGD-e
uuccgugaaauucuucgcuugu

SEQ ID NO: 772013 - RNA, 13 nt, Listeria monocytogenes EGD-e
uuccguucauuug

SEQ ID NO: 772014 - RNA, 15 nt, Listeria monocytogenes EGD-e
uuccuccuaauuguu

SEQ ID NO: 772015 - RNA, 14 nt, Listeria monocytogenes EGD-e
uuccucgacuucaa

SEQ ID NO: 772016 - RNA, 15 nt, Listeria monocytogenes EGD-e
uuccuaauuuuacuu

SEQ ID NO: 772017 - RNA, 20 nt, Listeria monocytogenes EGD-e
uuccucaaugaggaauacug

SEQ ID NO: 772018 - RNA, 19 nt, Listeria monocytogenes EGD-e
uuccuucuuccauuaaucu

SEQ ID NO: 772019 - RNA, 15 nt, Listeria monocytogenes EGD-e
uuccuucaagcauuu

SEQ ID NO: 772020 - RNA, 22 nt, Listeria monocytogenes EGD-e
uuccuugcugcucgcucaucau

SEQ ID NO: 772021 - RNA, 15 nt, Listeria monocytogenes EGD-e
uucgccaauuugcga

SEQ ID NO: 772022 - RNA, 21 nt, Listeria monocytogenes EGD-e
uucgcucgucaaagcguucaa

SEQ ID NO: 772023 - RNA, 18 nt, Listeria monocytogenes EGD-e
uucgcuccguauuuauau

SEQ ID NO: 772024 - RNA, 17 nt, Listeria monocytogenes EGD-e
uucgaguuucuguucuu

SEQ ID NO: 772025 - RNA, 12 nt, Listeria monocytogenes EGD-e
uucgcaaucaau

SEQ ID NO: 772026 - RNA, 14 nt, Listeria monocytogenes EGD-e
uucgauuuucaacu

SEQ ID NO: 772027 - RNA, 17 nt, Listeria monocytogenes EGD-e
uucgauuucugcagaau

SEQ ID NO: 772028 - RNA, 22 nt, Listeria monocytogenes EGD-e
uucgcaaaaagucaugacagca

SEQ ID NO: 772029 - RNA, 11 nt, Listeria monocytogenes EGD-e
uucgagcagcu

SEQ ID NO: 772030 - RNA, 16 nt, Listeria monocytogenes EGD-e
uuccauuaaaucauaa

SEQ ID NO: 772031 - RNA, 16 nt, Listeria monocytogenes EGD-e
uuccaugacaucuucu

SEQ ID NO: 772032 - RNA, 13 nt, Listeria monocytogenes EGD-e
uucccagaaaaaa

SEQ ID NO: 772033 - RNA, 16 nt, Listeria monocytogenes EGD-e
uucccagaaaaaaaca

SEQ ID NO: 772034 - RNA, 16 nt, Listeria monocytogenes EGD-e
uuccccaccaagguaa

SEQ ID NO: 772035 - RNA, 18 nt, Listeria monocytogenes EGD-e
uuccccaccaggcaaaac

SEQ ID NO: 772036 - RNA, 13 nt, Listeria monocytogenes EGD-e
uucccgcuacuau

SEQ ID NO: 772037 - RNA, 21 nt, Listeria monocytogenes EGD-e
uucccguuaaucgaaaaauca

SEQ ID NO: 772038 - RNA, 17 nt, Listeria monocytogenes EGD-e
uucccuccuuuauuuuu

SEQ ID NO: 772039 - RNA, 18 nt, Listeria monocytogenes EGD-e
uuccaguuaaacaaacac

SEQ ID NO: 772040 - RNA, 16 nt, Listeria monocytogenes EGD-e
uuccaguggcugaaac

SEQ ID NO: 772041 - RNA, 23 nt, Listeria monocytogenes EGD-e
uuccagcuaaguuuucuaaacua

SEQ ID NO: 772042 - RNA, 19 nt, Listeria monocytogenes EGD-e
uuccagcuguaucaaugau

SEQ ID NO: 772043 - RNA, 14 nt, Listeria monocytogenes EGD-e
uuccacuuuuaaag

SEQ ID NO: 772044 - RNA, 15 nt, Listeria monocytogenes EGD-e
uuccaccauuuguuu

SEQ ID NO: 772045 - RNA, 19 nt, Listeria monocytogenes EGD-e
uuccaccauuuguuuuauu

SEQ ID NO: 772046 - RNA, 19 nt, Listeria monocytogenes EGD-e
uuccacauuguagcgauuc

SEQ ID NO: 772047 - RNA, 16 nt, Listeria monocytogenes EGD-e
uuccaaguguuuuagu

SEQ ID NO: 772048 - RNA, 16 nt, Listeria monocytogenes EGD-e
uuccaaaaauagcuuu

SEQ ID NO: 772049 - RNA, 16 nt, Listeria monocytogenes EGD-e
uucagcuaaauauuua

SEQ ID NO: 772050 - RNA, 16 nt, Listeria monocytogenes EGD-e
uucagcuaaucguuuu

SEQ ID NO: 772051 - RNA, 13 nt, Listeria monocytogenes EGD-e
uucagcucuuuuu

SEQ ID NO: 772052 - RNA, 21 nt, Listeria monocytogenes EGD-e
uucauaauggaaaaauaauca

SEQ ID NO: 772053 - RNA, 14 nt, Listeria monocytogenes EGD-e
uucauuuaauuguc

SEQ ID NO: 772054 - RNA, 18 nt, Listeria monocytogenes EGD-e
uucauuuucuauuccucc

SEQ ID NO: 772055 - RNA, 15 nt, Listeria monocytogenes EGD-e
uucauuuguuucuuu

SEQ ID NO: 772056 - RNA, 20 nt, Listeria monocytogenes EGD-e
uucauucccacaucgcuucu

SEQ ID NO: 772057 - RNA, 12 nt, Listeria monocytogenes EGD-e
uucauucuuuuu

SEQ ID NO: 772058 - RNA, 11 nt, Listeria monocytogenes EGD-e
uucaugcaagc

SEQ ID NO: 772059 - RNA, 22 nt, Listeria monocytogenes EGD-e
uucaugcaagcgcagaaugaag

SEQ ID NO: 772060 - RNA, 14 nt, Listeria monocytogenes EGD-e
uucaucgcaaaaug

SEQ ID NO: 772061 - RNA, 17 nt, Listeria monocytogenes EGD-e
uucaucguuuaacauau

SEQ ID NO: 772062 - RNA, 14 nt, Listeria monocytogenes EGD-e
uucacaucuucaau

SEQ ID NO: 772063 - RNA, 13 nt, Listeria monocytogenes EGD-e
uucaccaaaugcu

SEQ ID NO: 772064 - RNA, 24 nt, Listeria monocytogenes EGD-e
uucaccaagaagagcugcaacaga

SEQ ID NO: 772065 - RNA, 15 nt, Listeria monocytogenes EGD-e
uucacaaccaauuaa

SEQ ID NO: 772066 - RNA, 21 nt, Listeria monocytogenes EGD-e
uucacacgauaccaaaguugu

SEQ ID NO: 772067 - RNA, 21 nt, Listeria monocytogenes EGD-e
uucacaaguaacucuuccaaa

SEQ ID NO: 772068 - RNA, 14 nt, Listeria monocytogenes EGD-e
uucaauugcuucuu

SEQ ID NO: 772069 - RNA, 21 nt, Listeria monocytogenes EGD-e
uucaaggagcggcucagaucc

SEQ ID NO: 772070 - RNA, 18 nt, Listeria monocytogenes EGD-e
uucaagugauacaaugug

SEQ ID NO: 772071 - RNA, 15 nt, Listeria monocytogenes EGD-e
uucacugcauaaaaa

SEQ ID NO: 772072 - RNA, 16 nt, Listeria monocytogenes EGD-e
uucacugcauaaaaaa

SEQ ID NO: 772073 - RNA, 18 nt, Listeria monocytogenes EGD-e
uucacuucgaaaguaaaa

SEQ ID NO: 772074 - RNA, 14 nt, Listeria monocytogenes EGD-e
uucacugugaacug

SEQ ID NO: 772075 - RNA, 19 nt, Listeria monocytogenes EGD-e
uucacugugaacugauuuu

SEQ ID NO: 772076 - RNA, 19 nt, Listeria monocytogenes EGD-e
uucaccgugcguucccgca

SEQ ID NO: 772077 - RNA, 22 nt, Listeria monocytogenes EGD-e
uucagcaauguaggcauuguau

SEQ ID NO: 772078 - RNA, 22 nt, Listeria monocytogenes EGD-e
uucagcaagagcaccaauaaaa

SEQ ID NO: 772079 - RNA, 15 nt, Listeria monocytogenes EGD-e
uggaaaagagaaaaa

SEQ ID NO: 772080 - RNA, 21 nt, Listeria monocytogenes EGD-e
uggcguauacauuuugaugua

SEQ ID NO: 772081 - RNA, 12 nt, Listeria monocytogenes EGD-e
ugggaaugaaua

SEQ ID NO: 772082 - RNA, 15 nt, Listeria monocytogenes EGD-e
uggcuuccacauugu

SEQ ID NO: 772083 - RNA, 14 nt, Listeria monocytogenes EGD-e
uggcuuauuuuaac

SEQ ID NO: 772084 - RNA, 22 nt, Listeria monocytogenes EGD-e
uggcuggcaguuuuuuuagaaa

SEQ ID NO: 772085 - RNA, 14 nt, Listeria monocytogenes EGD-e
ugggagcuuucuuu

SEQ ID NO: 772086 - RNA, 13 nt, Listeria monocytogenes EGD-e
uggucauuuuuua

SEQ ID NO: 772087 - RNA, 17 nt, Listeria monocytogenes EGD-e
uggucauauguuucgcc

SEQ ID NO: 772088 - RNA, 15 nt, Listeria monocytogenes EGD-e
ugguaagccauuucu

SEQ ID NO: 772089 - RNA, 21 nt, Listeria monocytogenes EGD-e
ugguuucuuguugaauaacau

SEQ ID NO: 772090 - RNA, 16 nt, Listeria monocytogenes EGD-e
ugguguaggaagugau

SEQ ID NO: 772091 - RNA, 14 nt, Listeria monocytogenes EGD-e
uguaagguuuuuuu

SEQ ID NO: 772092 - RNA, 18 nt, Listeria monocytogenes EGD-e
uguaacaacuaauuuuuc

SEQ ID NO: 772093 - RNA, 22 nt, Listeria monocytogenes EGD-e
uguaaaugaauaggcacuaauu

SEQ ID NO: 772094 - RNA, 17 nt, Listeria monocytogenes EGD-e
uguaaucuguaaaaaua

SEQ ID NO: 772095 - RNA, 18 nt, Listeria monocytogenes EGD-e
uguaaucuguaaaaauaa

SEQ ID NO: 772096 - RNA, 21 nt, Listeria monocytogenes EGD-e
uguaaucacuauugaauguca

SEQ ID NO: 772097 - RNA, 14 nt, Listeria monocytogenes EGD-e
uguaaguguuucua

SEQ ID NO: 772098 - RNA, 15 nt, Listeria monocytogenes EGD-e
uguauugguuucuug

SEQ ID NO: 772099 - RNA, 13 nt, Listeria monocytogenes EGD-e
uguaucuuaauac

SEQ ID NO: 772100 - RNA, 13 nt, Listeria monocytogenes EGD-e
uguacacauuaua

SEQ ID NO: 772101 - RNA, 15 nt, Listeria monocytogenes EGD-e
ugucaaauucuucuc

SEQ ID NO: 772102 - RNA, 22 nt, Listeria monocytogenes EGD-e
ugucaaauucuucuccauacua

SEQ ID NO: 772103 - RNA, 18 nt, Listeria monocytogenes EGD-e
ugucaaaccauuauacaa

SEQ ID NO: 772104 - RNA, 21 nt, Listeria monocytogenes EGD-e
ugucaaaccauuauacaauua

SEQ ID NO: 772105 - RNA, 17 nt, Listeria monocytogenes EGD-e
ugucauaaaacuuucac

SEQ ID NO: 772106 - RNA, 20 nt, Listeria monocytogenes EGD-e
ugucaaucuaaauuuuaauc

SEQ ID NO: 772107 - RNA, 19 nt, Listeria monocytogenes EGD-e
ugucccaagauucuucuaa

SEQ ID NO: 772108 - RNA, 24 nt, Listeria monocytogenes EGD-e
uguccggacuuaguauuucagcaa

SEQ ID NO: 772109 - RNA, 17 nt, Listeria monocytogenes EGD-e
ugucgaaaaccuaaaua

SEQ ID NO: 772110 - RNA, 20 nt, Listeria monocytogenes EGD-e
ugucuagguuuucuuuuuuc

SEQ ID NO: 772111 - RNA, 13 nt, Listeria monocytogenes EGD-e
ugucguaugcuuu

SEQ ID NO: 772112 - RNA, 14 nt, Listeria monocytogenes EGD-e
ugucuucggauuuu

SEQ ID NO: 772113 - RNA, 23 nt, Listeria monocytogenes EGD-e
ugucuucggauuuuucaaaucaa

SEQ ID NO: 772114 - RNA, 22 nt, Listeria monocytogenes EGD-e
ugucuucuggaucacuauauaa

SEQ ID NO: 772115 - RNA, 23 nt, Listeria monocytogenes EGD-e
ugucuucuggaucacuauauaag

SEQ ID NO: 772116 - RNA, 14 nt, Listeria monocytogenes EGD-e
ugucuuaaaugaca

SEQ ID NO: 772117 - RNA, 16 nt, Listeria monocytogenes EGD-e
ugugcuuuuuuuagua

SEQ ID NO: 772118 - RNA, 15 nt, Listeria monocytogenes EGD-e
uguuacugugcucuu

SEQ ID NO: 772119 - RNA, 20 nt, Listeria monocytogenes EGD-e
uguguucgcauugauuuuug

SEQ ID NO: 772120 - RNA, 16 nt, Listeria monocytogenes EGD-e
uguguugcuuuuauuu

SEQ ID NO: 772121 - RNA, 21 nt, Listeria monocytogenes EGD-e
uguugaaaaguaguguauaac

SEQ ID NO: 772122 - RNA, 13 nt, Listeria monocytogenes EGD-e
uguucuugccaaa

SEQ ID NO: 772123 - RNA, 15 nt, Listeria monocytogenes EGD-e
uguucauuacuucag

SEQ ID NO: 772124 - RNA, 21 nt, Listeria monocytogenes EGD-e
uguucgcauugauuuuugaau

SEQ ID NO: 772125 - RNA, 15 nt, Listeria monocytogenes EGD-e
uguucgucgcaucaa

SEQ ID NO: 772126 - RNA, 21 nt, Listeria monocytogenes EGD-e
uuagaagaugcacuagaaaaa

SEQ ID NO: 772127 - RNA, 13 nt, Listeria monocytogenes EGD-e
uuagaaugaagau

SEQ ID NO: 772128 - RNA, 22 nt, Listeria monocytogenes EGD-e
uuacugcaaucauuuauuuucc

SEQ ID NO: 772129 - RNA, 14 nt, Listeria monocytogenes EGD-e
uuacuauuuggaua

SEQ ID NO: 772130 - RNA, 11 nt, Listeria monocytogenes EGD-e
uuacucccuuu

SEQ ID NO: 772131 - RNA, 19 nt, Listeria monocytogenes EGD-e
uuacauaauucauugacaa

SEQ ID NO: 772132 - RNA, 15 nt, Listeria monocytogenes EGD-e
uuacauuuuugcuug

SEQ ID NO: 772133 - RNA, 22 nt, Listeria monocytogenes EGD-e
uuacaaaaguggaaauguucca

SEQ ID NO: 772134 - RNA, 14 nt, Listeria monocytogenes EGD-e
uuaauugucauaaa

SEQ ID NO: 772135 - RNA, 11 nt, Listeria monocytogenes EGD-e
uuaaugccagu

SEQ ID NO: 772136 - RNA, 18 nt, Listeria monocytogenes EGD-e
uuaaugccaguauuuuga

SEQ ID NO: 772137 - RNA, 19 nt, Listeria monocytogenes EGD-e
uuaaugcgaaaaaugaaaa

SEQ ID NO: 772138 - RNA, 17 nt, Listeria monocytogenes EGD-e
uuaauuauggcauaaaa

SEQ ID NO: 772139 - RNA, 16 nt, Listeria monocytogenes EGD-e
uuaaucugauuaaaag

SEQ ID NO: 772140 - RNA, 13 nt, Listeria monocytogenes EGD-e
uuaaucuuacauu

SEQ ID NO: 772141 - RNA, 12 nt, Listeria monocytogenes EGD-e
uuaaacaaacac

SEQ ID NO: 772142 - RNA, 21 nt, Listeria monocytogenes EGD-e
uuaaaccgauaauuuucauuu

SEQ ID NO: 772143 - RNA, 11 nt, Listeria monocytogenes EGD-e
uuaaagguaac

SEQ ID NO: 772144 - RNA, 17 nt, Listeria monocytogenes EGD-e
uuaaagcuugauuuaau

SEQ ID NO: 772145 - RNA, 19 nt, Listeria monocytogenes EGD-e
uuaaagcuugauuuaauug

SEQ ID NO: 772146 - RNA, 19 nt, Listeria monocytogenes EGD-e
uuaaagcguuuuucugcau

SEQ ID NO: 772147 - RNA, 21 nt, Listeria monocytogenes EGD-e
uuaaagcguuuuucugcaucc

SEQ ID NO: 772148 - RNA, 16 nt, Listeria monocytogenes EGD-e
uuaaauacgaaaaaca

SEQ ID NO: 772149 - RNA, 19 nt, Listeria monocytogenes EGD-e
uuaaauacgaaaaacauua

SEQ ID NO: 772150 - RNA, 22 nt, Listeria monocytogenes EGD-e
uuaaauaguaguuauuucuuua

SEQ ID NO: 772151 - RNA, 22 nt, Listeria monocytogenes EGD-e
uuaaauauaacuuuuuuucuua

SEQ ID NO: 772152 - RNA, 18 nt, Listeria monocytogenes EGD-e
uuaaaugauuuuuaucua

SEQ ID NO: 772153 - RNA, 19 nt, Listeria monocytogenes EGD-e
uuaaauuuuuuugaaaaaa

SEQ ID NO: 772154 - RNA, 18 nt, Listeria monocytogenes EGD-e
uuaaauuucccgcuacua

SEQ ID NO: 772155 - RNA, 18 nt, Listeria monocytogenes EGD-e
uuaacaaccauuuuguuc

SEQ ID NO: 772156 - RNA, 18 nt, Listeria monocytogenes EGD-e
uuaacaucagauuaaaua

SEQ ID NO: 772157 - RNA, 14 nt, Listeria monocytogenes EGD-e
uuaacauaaaaagc

SEQ ID NO: 772158 - RNA, 20 nt, Listeria monocytogenes EGD-e
uuaacauaaaaagcugccac

SEQ ID NO: 772159 - RNA, 22 nt, Listeria monocytogenes EGD-e
uuaacguauuggguuugauaau

SEQ ID NO: 772160 - RNA, 17 nt, Listeria monocytogenes EGD-e
uuauccuguaauucgaa

SEQ ID NO: 772161 - RNA, 17 nt, Listeria monocytogenes EGD-e
uuaucgccaaagccagu

SEQ ID NO: 772162 - RNA, 14 nt, Listeria monocytogenes EGD-e
uuaucuaaaucuuu

SEQ ID NO: 772163 - RNA, 18 nt, Listeria monocytogenes EGD-e
uuaucucuucauuuuucu

SEQ ID NO: 772164 - RNA, 12 nt, Listeria monocytogenes EGD-e
uuaucuggcagu

SEQ ID NO: 772165 - RNA, 16 nt, Listeria monocytogenes EGD-e
uuauuaaacucauaac

SEQ ID NO: 772166 - RNA, 18 nt, Listeria monocytogenes EGD-e
uuauggaaaaauccacuc

SEQ ID NO: 772167 - RNA, 14 nt, Listeria monocytogenes EGD-e
uuaugcauaaaaaa

SEQ ID NO: 772168 - RNA, 20 nt, Listeria monocytogenes EGD-e
uuaugagaguuauaaagaaa

SEQ ID NO: 772169 - RNA, 23 nt, Listeria monocytogenes EGD-e
uuaugagaguuauaaagaaauaa

SEQ ID NO: 772170 - RNA, 16 nt, Listeria monocytogenes EGD-e
uuaucuuucccaucau

SEQ ID NO: 772171 - RNA, 20 nt, Listeria monocytogenes EGD-e
uuauaacucucauaagagaa

SEQ ID NO: 772172 - RNA, 21 nt, Listeria monocytogenes EGD-e
uuauaaaaaguggcuuccaca

SEQ ID NO: 772173 - RNA, 14 nt, Listeria monocytogenes EGD-e
uuauaaagaaauaa

SEQ ID NO: 772174 - RNA, 18 nt, Listeria monocytogenes EGD-e
uuauaaagaaauaacuac

SEQ ID NO: 772175 - RNA, 13 nt, Listeria monocytogenes EGD-e
uuauagcguacau

SEQ ID NO: 772176 - RNA, 12 nt, Listeria monocytogenes EGD-e
uuauaauuuaau

SEQ ID NO: 772177 - RNA, 20 nt, Listeria monocytogenes EGD-e
uuauccaguguaaucuugau

SEQ ID NO: 772178 - RNA, 13 nt, Listeria monocytogenes EGD-e
uuaucaauaauag

SEQ ID NO: 772179 - RNA, 17 nt, Listeria monocytogenes EGD-e
uuaucaaguaauaagaa

SEQ ID NO: 772180 - RNA, 18 nt, Listeria monocytogenes EGD-e
uuaucaggcuauaacaaa

SEQ ID NO: 772181 - RNA, 16 nt, Listeria monocytogenes EGD-e
uuaucauccacgaguu

SEQ ID NO: 772182 - RNA, 22 nt, Listeria monocytogenes EGD-e
uuauauagaaggaauuugccaa

SEQ ID NO: 772183 - RNA, 17 nt, Listeria monocytogenes EGD-e
uucaacuccccagugaa

SEQ ID NO: 772184 - RNA, 17 nt, Listeria monocytogenes EGD-e
uucaagcauuucauaau

SEQ ID NO: 772185 - RNA, 14 nt, Listeria monocytogenes EGD-e
uucaacaaucugaa

SEQ ID NO: 772186 - RNA, 13 nt, Listeria monocytogenes EGD-e
uucaacaaaacaa

SEQ ID NO: 772187 - RNA, 12 nt, Listeria monocytogenes EGD-e
uucaaaucaauu

SEQ ID NO: 772188 - RNA, 17 nt, Listeria monocytogenes EGD-e
uucaaaucaccacaaag

SEQ ID NO: 772189 - RNA, 19 nt, Listeria monocytogenes EGD-e
uucaaaucaccacaaagga

SEQ ID NO: 772190 - RNA, 16 nt, Listeria monocytogenes EGD-e
uucaaagcuacuuuuc

SEQ ID NO: 772191 - RNA, 19 nt, Listeria monocytogenes EGD-e
uucaaacgaucagccauuu

SEQ ID NO: 772192 - RNA, 22 nt, Listeria monocytogenes EGD-e
uucaaacgcagguucaccaaau

SEQ ID NO: 772193 - RNA, 16 nt, Listeria monocytogenes EGD-e
uucaaacacuucuaaa

SEQ ID NO: 772194 - RNA, 20 nt, Listeria monocytogenes EGD-e
uucaaaaagauuauggaaaa

SEQ ID NO: 772195 - RNA, 13 nt, Listeria monocytogenes EGD-e
uuauuuuuuauuu

SEQ ID NO: 772196 - RNA, 11 nt, Listeria monocytogenes EGD-e
uuauuuuuaaa

SEQ ID NO: 772197 - RNA, 19 nt, Listeria monocytogenes EGD-e
uuauuaauaguauaaggau

SEQ ID NO: 772198 - RNA, 13 nt, Listeria monocytogenes EGD-e
uuauucaauuccc

SEQ ID NO: 772199 - RNA, 13 nt, Listeria monocytogenes EGD-e
uuauuauugcuuu

SEQ ID NO: 772200 - RNA, 18 nt, Listeria monocytogenes EGD-e
ugcaucaagggaagcuuu

SEQ ID NO: 772201 - RNA, 15 nt, Listeria monocytogenes EGD-e
ugcauagugagaguu

SEQ ID NO: 772202 - RNA, 13 nt, Listeria monocytogenes EGD-e
ugcauaaaaaaca

SEQ ID NO: 772203 - RNA, 14 nt, Listeria monocytogenes EGD-e
ugcauaaaaaacau

SEQ ID NO: 772204 - RNA, 20 nt, Listeria monocytogenes EGD-e
ugcacuagaaaaaugaagag

SEQ ID NO: 772205 - RNA, 12 nt, Listeria monocytogenes EGD-e
ugcauuaaaaag

SEQ ID NO: 772206 - RNA, 16 nt, Listeria monocytogenes EGD-e
ugcaucuucuaagaaa

SEQ ID NO: 772207 - RNA, 23 nt, Listeria monocytogenes EGD-e
ugcaucuucuaagaaaaaaaguu

SEQ ID NO: 772208 - RNA, 17 nt, Listeria monocytogenes EGD-e
ugcaugaccuagccaga

SEQ ID NO: 772209 - RNA, 15 nt, Listeria monocytogenes EGD-e
ugcauuguuaaauua

SEQ ID NO: 772210 - RNA, 18 nt, Listeria monocytogenes EGD-e
ugcauuguuaaauuaucc

SEQ ID NO: 772211 - RNA, 19 nt, Listeria monocytogenes EGD-e
ugccagccauuuuggaaaa

SEQ ID NO: 772212 - RNA, 19 nt, Listeria monocytogenes EGD-e
ugccaucaggaguuucuuu

SEQ ID NO: 772213 - RNA, 15 nt, Listeria monocytogenes EGD-e
ugccugaaauaauac

SEQ ID NO: 772214 - RNA, 18 nt, Listeria monocytogenes EGD-e
ugcggcauagaaaguaga

SEQ ID NO: 772215 - RNA, 16 nt, Listeria monocytogenes EGD-e
ugcguaaacuuuuguu

SEQ ID NO: 772216 - RNA, 20 nt, Listeria monocytogenes EGD-e
ugcguaagauuuuugcucag

SEQ ID NO: 772217 - RNA, 18 nt, Listeria monocytogenes EGD-e
ugcucccgcgcuaaucuu

SEQ ID NO: 772218 - RNA, 16 nt, Listeria monocytogenes EGD-e
ugcucgaauucuuuuu

SEQ ID NO: 772219 - RNA, 15 nt, Listeria monocytogenes EGD-e
ugcuguuacugugcu

SEQ ID NO: 772220 - RNA, 16 nt, Listeria monocytogenes EGD-e
ugcuuuuauuuuuaaa

SEQ ID NO: 772221 - RNA, 19 nt, Listeria monocytogenes EGD-e
ugcuuuaauuuggaaauaa

SEQ ID NO: 772222 - RNA, 12 nt, Listeria monocytogenes EGD-e
ugcuucuuuuuu

SEQ ID NO: 772223 - RNA, 21 nt, Listeria monocytogenes EGD-e
ugcuucuuuuuucuuccauau

SEQ ID NO: 772224 - RNA, 21 nt, Listeria monocytogenes EGD-e
ugcuugcaaucccuauaaaaa

SEQ ID NO: 772225 - RNA, 13 nt, Listeria monocytogenes EGD-e
ugcuucacgugcu

SEQ ID NO: 772226 - RNA, 11 nt, Listeria monocytogenes EGD-e
ugcuucaaucc

SEQ ID NO: 772227 - RNA, 13 nt, Listeria monocytogenes EGD-e
ugcuucaccaaga

SEQ ID NO: 772228 - RNA, 19 nt, Listeria monocytogenes EGD-e
ugcuucaccaagaagagcu

SEQ ID NO: 772229 - RNA, 17 nt, Listeria monocytogenes EGD-e
ugaguuagcuugaccag

SEQ ID NO: 772230 - RNA, 17 nt, Listeria monocytogenes EGD-e
ugauaaagauaauaacc

SEQ ID NO: 772231 - RNA, 14 nt, Listeria monocytogenes EGD-e
ugauaauaaucaga

SEQ ID NO: 772232 - RNA, 22 nt, Listeria monocytogenes EGD-e
ugauaaauaacaagaauaauga

SEQ ID NO: 772233 - RNA, 21 nt, Listeria monocytogenes EGD-e
ugauaaugugaccuuaaauua

SEQ ID NO: 772234 - RNA, 23 nt, Listeria monocytogenes EGD-e
ugaucaaucaguucaacuacuuc

SEQ ID NO: 772235 - RNA, 14 nt, Listeria monocytogenes EGD-e
ugaucuuuucgcaa

SEQ ID NO: 772236 - RNA, 16 nt, Listeria monocytogenes EGD-e
ugauuucaauaaugug

SEQ ID NO: 772237 - RNA, 21 nt, Listeria monocytogenes EGD-e
ugcaaaagcaguagacuaaau

SEQ ID NO: 772238 - RNA, 16 nt, Listeria monocytogenes EGD-e
ugauuacuccaaaaua

SEQ ID NO: 772239 - RNA, 17 nt, Listeria monocytogenes EGD-e
ugauuaaugauuucaau

SEQ ID NO: 772240 - RNA, 18 nt, Listeria monocytogenes EGD-e
ugcaccugcauuucauuu

SEQ ID NO: 772241 - RNA, 16 nt, Listeria monocytogenes EGD-e
ugcaaucauuuauuuu

SEQ ID NO: 772242 - RNA, 23 nt, Listeria monocytogenes EGD-e
ugcaaucaucuuaucaaguaaua

SEQ ID NO: 772243 - RNA, 18 nt, Listeria monocytogenes EGD-e
ugcaacaguuauuaaaag

SEQ ID NO: 772244 - RNA, 16 nt, Listeria monocytogenes EGD-e
ugacuaaaaagcaacu

SEQ ID NO: 772245 - RNA, 21 nt, Listeria monocytogenes EGD-e
ugacuagaaauuaaugccagu

SEQ ID NO: 772246 - RNA, 18 nt, Listeria monocytogenes EGD-e
ugagaguuauaaagaaau

SEQ ID NO: 772247 - RNA, 19 nt, Listeria monocytogenes EGD-e
ugagaguuauaaagaaaua

SEQ ID NO: 772248 - RNA, 19 nt, Listeria monocytogenes EGD-e
ugagcaaucguauguuuuu

SEQ ID NO: 772249 - RNA, 23 nt, Listeria monocytogenes EGD-e
ugagauaaucaagauuuuguaca

SEQ ID NO: 772250 - RNA, 13 nt, Listeria monocytogenes EGD-e
ugacaauuaaaaa

SEQ ID NO: 772251 - RNA, 17 nt, Listeria monocytogenes EGD-e
ugaccuuaaauuauacu

SEQ ID NO: 772252 - RNA, 18 nt, Listeria monocytogenes EGD-e
ugacgcguggaaagaaua

SEQ ID NO: 772253 - RNA, 22 nt, Listeria monocytogenes EGD-e
ugaacugacuagaaauuaaugc

SEQ ID NO: 772254 - RNA, 15 nt, Listeria monocytogenes EGD-e
ugaacugauuuuuug

SEQ ID NO: 772255 - RNA, 20 nt, Listeria monocytogenes EGD-e
ugaagagauaaguuuucaua

SEQ ID NO: 772256 - RNA, 19 nt, Listeria monocytogenes EGD-e
ugaagaucccaaacucccu

SEQ ID NO: 772257 - RNA, 21 nt, Listeria monocytogenes EGD-e
ugaagauaaacuaauuacuaa

SEQ ID NO: 772258 - RNA, 22 nt, Listeria monocytogenes EGD-e
ugaagcgaugauuuucauuaaa

SEQ ID NO: 772259 - RNA, 16 nt, Listeria monocytogenes EGD-e
ugaauguucuaaaaua

SEQ ID NO: 772260 - RNA, 22 nt, Listeria monocytogenes EGD-e
ugaauggcgagauguuuuuauu

SEQ ID NO: 772261 - RNA, 22 nt, Listeria monocytogenes EGD-e
ugaauaagcaauuggaacaucu

SEQ ID NO: 772262 - RNA, 16 nt, Listeria monocytogenes EGD-e
ugaauaacuuuccagc

SEQ ID NO: 772263 - RNA, 21 nt, Listeria monocytogenes EGD-e
ugaauagauauucucuuauga

SEQ ID NO: 772264 - RNA, 19 nt, Listeria monocytogenes EGD-e
ugaauagauugcgucacaa

SEQ ID NO: 772265 - RNA, 20 nt, Listeria monocytogenes EGD-e
ugaauagauugcgucacaau

SEQ ID NO: 772266 - RNA, 16 nt, Listeria monocytogenes EGD-e
uccuucaagcauuuca

SEQ ID NO: 772267 - RNA, 23 nt, Listeria monocytogenes EGD-e
uccuucaauaauauaaugauuca

SEQ ID NO: 772268 - RNA, 23 nt, Listeria monocytogenes EGD-e
uccuucauaauuauuuuuguaau

SEQ ID NO: 772269 - RNA, 12 nt, Listeria monocytogenes EGD-e
uccuucuaauac

SEQ ID NO: 772270 - RNA, 20 nt, Listeria monocytogenes EGD-e
uccuguaacgucucucauug

SEQ ID NO: 772271 - RNA, 15 nt, Listeria monocytogenes EGD-e
uccugcugaaauagc

SEQ ID NO: 772272 - RNA, 13 nt, Listeria monocytogenes EGD-e
ucgaaagaaaugu

SEQ ID NO: 772273 - RNA, 14 nt, Listeria monocytogenes EGD-e
ucgaaaguaaaauc

SEQ ID NO: 772274 - RNA, 19 nt, Listeria monocytogenes EGD-e
uccuuuuguuuuaauaaau

SEQ ID NO: 772275 - RNA, 17 nt, Listeria monocytogenes EGD-e
uccuuuuucauuauaag

SEQ ID NO: 772276 - RNA, 13 nt, Listeria monocytogenes EGD-e
uccuuuuaguguc

SEQ ID NO: 772277 - RNA, 17 nt, Listeria monocytogenes EGD-e
uccuuguuguucuaaua

SEQ ID NO: 772278 - RNA, 14 nt, Listeria monocytogenes EGD-e
uccuuguacuaauu

SEQ ID NO: 772279 - RNA, 23 nt, Listeria monocytogenes EGD-e
uccuuguacuaauucugcgauuu

SEQ ID NO: 772280 - RNA, 13 nt, Listeria monocytogenes EGD-e
uccuuuauuuuuu

SEQ ID NO: 772281 - RNA, 23 nt, Listeria monocytogenes EGD-e
ucgauaguucacugugaacugau

SEQ ID NO: 772282 - RNA, 17 nt, Listeria monocytogenes EGD-e
ucgaguuuuuauucauu

SEQ ID NO: 772283 - RNA, 21 nt, Listeria monocytogenes EGD-e
ucgcaagcgacauuaaauagc

SEQ ID NO: 772284 - RNA, 16 nt, Listeria monocytogenes EGD-e
ucgauuuucaacuguu

SEQ ID NO: 772285 - RNA, 12 nt, Listeria monocytogenes EGD-e
ucgauuggaauc

SEQ ID NO: 772286 - RNA, 18 nt, Listeria monocytogenes EGD-e
ucgauuggcgauucuuca

SEQ ID NO: 772287 - RNA, 17 nt, Listeria monocytogenes EGD-e
ucgcagggcagaaaaca

SEQ ID NO: 772288 - RNA, 18 nt, Listeria monocytogenes EGD-e
ucgcagggcagaaaacag

SEQ ID NO: 772289 - RNA, 20 nt, Listeria monocytogenes EGD-e
ucgcagggcagaaaacagaa

SEQ ID NO: 772290 - RNA, 23 nt, Listeria monocytogenes EGD-e
ucgcaucaaucgccaguugcuga

SEQ ID NO: 772291 - RNA, 19 nt, Listeria monocytogenes EGD-e
ucgccguuggaagugaaaa

SEQ ID NO: 772292 - RNA, 14 nt, Listeria monocytogenes EGD-e
ucgcuuguuuugau

SEQ ID NO: 772293 - RNA, 16 nt, Listeria monocytogenes EGD-e
ucgggaauaaaucaag

SEQ ID NO: 772294 - RNA, 17 nt, Listeria monocytogenes EGD-e
ucggggaaauaguuuug

SEQ ID NO: 772295 - RNA, 13 nt, Listeria monocytogenes EGD-e
ucggguuuuaaaa

SEQ ID NO: 772296 - RNA, 14 nt, Listeria monocytogenes EGD-e
ucgguacaguagaa

SEQ ID NO: 772297 - RNA, 20 nt, Listeria monocytogenes EGD-e
ucgguacaguagaagcaauu

SEQ ID NO: 772298 - RNA, 13 nt, Listeria monocytogenes EGD-e
ucgguaagaccac

SEQ ID NO: 772299 - RNA, 13 nt, Listeria monocytogenes EGD-e
ucgguaaucuagu

SEQ ID NO: 772300 - RNA, 13 nt, Listeria monocytogenes EGD-e
ucgguauaaaaca

SEQ ID NO: 772301 - RNA, 12 nt, Listeria monocytogenes EGD-e
ucguacauuuuu

SEQ ID NO: 772302 - RNA, 15 nt, Listeria monocytogenes EGD-e
ucguauguuuucccu

SEQ ID NO: 772303 - RNA, 15 nt, Listeria monocytogenes EGD-e
ucgucuaaaaaauau

SEQ ID NO: 772304 - RNA, 15 nt, Listeria monocytogenes EGD-e
ucuaauaauuuuaau

SEQ ID NO: 772305 - RNA, 16 nt, Listeria monocytogenes EGD-e
ucuaauaauuuuaauu

SEQ ID NO: 772306 - RNA, 12 nt, Listeria monocytogenes EGD-e
ucuaaaaaugca

SEQ ID NO: 772307 - RNA, 20 nt, Listeria monocytogenes EGD-e
ucuaaaguuagauuaaaaau

SEQ ID NO: 772308 - RNA, 22 nt, Listeria monocytogenes EGD-e
ucguuccgacuaccggcccaca

SEQ ID NO: 772309 - RNA, 22 nt, Listeria monocytogenes EGD-e
ucguucuuaguuaauucuuuuu

SEQ ID NO: 772310 - RNA, 18 nt, Listeria monocytogenes EGD-e
ucguuucagcucuauaau

SEQ ID NO: 772311 - RNA, 14 nt, Listeria monocytogenes EGD-e
ucguuuauuuugau

SEQ ID NO: 772312 - RNA, 14 nt, Listeria monocytogenes EGD-e
ucguuauuuccuuc

SEQ ID NO: 772313 - RNA, 16 nt, Listeria monocytogenes EGD-e
ucugagaagccagcau

SEQ ID NO: 772314 - RNA, 15 nt, Listeria monocytogenes EGD-e
ucucucauuguugua

SEQ ID NO: 772315 - RNA, 22 nt, Listeria monocytogenes EGD-e
ucucuugcuuuaauuuggaaau

SEQ ID NO: 772316 - RNA, 17 nt, Listeria monocytogenes EGD-e
ucuccgcaaucauucca

SEQ ID NO: 772317 - RNA, 17 nt, Listeria monocytogenes EGD-e
ucucccucauccuuucu

SEQ ID NO: 772318 - RNA, 12 nt, Listeria monocytogenes EGD-e
ucucaugaaacu

SEQ ID NO: 772319 - RNA, 23 nt, Listeria monocytogenes EGD-e
ucuucaauugcuucuuuuuucuu

SEQ ID NO: 772320 - RNA, 16 nt, Listeria monocytogenes EGD-e
ucuuaggaauuucgaa

SEQ ID NO: 772321 - RNA, 14 nt, Listeria monocytogenes EGD-e
ucuuacuauuuucu

SEQ ID NO: 772322 - RNA, 15 nt, Listeria monocytogenes EGD-e
ucuuacuauuuucua

SEQ ID NO: 772323 - RNA, 15 nt, Listeria monocytogenes EGD-e
ucuuucugaaaaugu

SEQ ID NO: 772324 - RNA, 14 nt, Listeria monocytogenes EGD-e
ucuuuaucuuuccc

SEQ ID NO: 772325 - RNA, 21 nt, Listeria monocytogenes EGD-e
ucuuggaagaaccuucaagca

SEQ ID NO: 772326 - RNA, 23 nt, Listeria monocytogenes EGD-e
ucuugcuucacgugcugcuuucc

SEQ ID NO: 772327 - RNA, 15 nt, Listeria monocytogenes EGD-e
ucuuccauauuuucu

SEQ ID NO: 772328 - RNA, 17 nt, Listeria monocytogenes EGD-e
ucuuccauauuuucucu

SEQ ID NO: 772329 - RNA, 10 nt, Listeria monocytogenes EGD-e
ucuuugauuu

SEQ ID NO: 772330 - RNA, 18 nt, Listeria monocytogenes EGD-e
ucuuuguauacuucaaaa

SEQ ID NO: 772331 - RNA, 18 nt, Listeria monocytogenes EGD-e
ucuuuuaaagcuuuuaaa

SEQ ID NO: 772332 - RNA, 14 nt, Listeria monocytogenes EGD-e
ucuuuuaucuuccc

SEQ ID NO: 772333 - RNA, 14 nt, Listeria monocytogenes EGD-e
ucuuuuauuuuucu

SEQ ID NO: 772334 - RNA, 19 nt, Listeria monocytogenes EGD-e
ucuuuuauuuuucuuucuu

SEQ ID NO: 772335 - RNA, 17 nt, Listeria monocytogenes EGD-e
ucuuuucacaaccaauu

SEQ ID NO: 772336 - RNA, 15 nt, Listeria monocytogenes EGD-e
ucuuuuauaaaaaua

SEQ ID NO: 772337 - RNA, 21 nt, Listeria monocytogenes EGD-e
ucuuuuacgacuguugccauu

SEQ ID NO: 772338 - RNA, 22 nt, Listeria monocytogenes EGD-e
ucuuuuacggcuucaaugagug

SEQ ID NO: 772339 - RNA, 18 nt, Listeria monocytogenes EGD-e
ucuuuuuuucuuuaaaau

SEQ ID NO: 772340 - RNA, 13 nt, Listeria monocytogenes EGD-e
ucuuuuuuuagua

SEQ ID NO: 772341 - RNA, 23 nt, Listeria monocytogenes EGD-e
ucuuuuuuuaguaaacauuucuc

SEQ ID NO: 772342 - RNA, 14 nt, Listeria monocytogenes EGD-e
ucuuuuuuuaauuu

SEQ ID NO: 772343 - RNA, 13 nt, Listeria monocytogenes EGD-e
ucuuuuguaguaa

SEQ ID NO: 772344 - RNA, 13 nt, Listeria monocytogenes EGD-e
ucuuuuccaaaau

SEQ ID NO: 772345 - RNA, 12 nt, Listeria monocytogenes EGD-e
ucuuuuccuaau

SEQ ID NO: 772346 - RNA, 20 nt, Listeria monocytogenes EGD-e
ugaaacuuuaacaaaaguca

SEQ ID NO: 772347 - RNA, 14 nt, Listeria monocytogenes EGD-e
ugaaaccacuacua

SEQ ID NO: 772348 - RNA, 20 nt, Listeria monocytogenes EGD-e
ugaaaccacuacuaaaucgu

SEQ ID NO: 772349 - RNA, 20 nt, Listeria monocytogenes EGD-e
ugaaaaugagcccaaaaaua

SEQ ID NO: 772350 - RNA, 22 nt, Listeria monocytogenes EGD-e
ugaaaauuggauuauucaauuc

SEQ ID NO: 772351 - RNA, 18 nt, Listeria monocytogenes EGD-e
ugaaaaucuacaacuaga

SEQ ID NO: 772352 - RNA, 17 nt, Listeria monocytogenes EGD-e
ugaaaacugaacaaaga

SEQ ID NO: 772353 - RNA, 14 nt, Listeria monocytogenes EGD-e
ugaacaaagaagaa

SEQ ID NO: 772354 - RNA, 22 nt, Listeria monocytogenes EGD-e
ugaacacccgguccuucaaucg

SEQ ID NO: 772355 - RNA, 14 nt, Listeria monocytogenes EGD-e
gggaauaaaucaag

SEQ ID NO: 772356 - RNA, 14 nt, Listeria monocytogenes EGD-e
ggcuuauuccucca

SEQ ID NO: 772357 - RNA, 12 nt, Listeria monocytogenes EGD-e
gggcaaaaagga

SEQ ID NO: 772358 - RNA, 13 nt, Listeria monocytogenes EGD-e
gggcaaaaaggaa

SEQ ID NO: 772359 - RNA, 13 nt, Listeria monocytogenes EGD-e
ggggcaaaaagga

SEQ ID NO: 772360 - RNA, 13 nt, Listeria monocytogenes EGD-e
gguaucaaauaac

SEQ ID NO: 772361 - RNA, 21 nt, Listeria monocytogenes EGD-e
ggucaaaucuggauaaaaaua

SEQ ID NO: 772362 - RNA, 22 nt, Listeria monocytogenes EGD-e
ggucauuuucacugcauaaaaa

SEQ ID NO: 772363 - RNA, 17 nt, Listeria monocytogenes EGD-e
gguccugcugaaauagc

SEQ ID NO: 772364 - RNA, 18 nt, Listeria monocytogenes EGD-e
gguucaaaaagauacuuu

SEQ ID NO: 772365 - RNA, 23 nt, Listeria monocytogenes EGD-e
gguuagcagcuuuuguccaaccu

SEQ ID NO: 772366 - RNA, 17 nt, Listeria monocytogenes EGD-e
gguuuggaaaacauaga

SEQ ID NO: 772367 - RNA, 12 nt, Listeria monocytogenes EGD-e
guaaaaaacugu

SEQ ID NO: 772368 - RNA, 15 nt, Listeria monocytogenes EGD-e
gguuuuguccaaacc

SEQ ID NO: 772369 - RNA, 22 nt, Listeria monocytogenes EGD-e
gguuuaauaggaaggagcagaa

SEQ ID NO: 772370 - RNA, 20 nt, Listeria monocytogenes EGD-e
guaauucuaaauaaauauuu

SEQ ID NO: 772371 - RNA, 15 nt, Listeria monocytogenes EGD-e
guaauucgaauaaga

SEQ ID NO: 772372 - RNA, 17 nt, Listeria monocytogenes EGD-e
guaauaagucaaugaua

SEQ ID NO: 772373 - RNA, 16 nt, Listeria monocytogenes EGD-e
guacauaguuauaaau

SEQ ID NO: 772374 - RNA, 14 nt, Listeria monocytogenes EGD-e
guacauaaaagcau

SEQ ID NO: 772375 - RNA, 16 nt, Listeria monocytogenes EGD-e
guacaguuagaaccgu

SEQ ID NO: 772376 - RNA, 16 nt, Listeria monocytogenes EGD-e
guaccugcaagcgaau

SEQ ID NO: 772377 - RNA, 21 nt, Listeria monocytogenes EGD-e
guacuuucgucgccuaauugu

SEQ ID NO: 772378 - RNA, 17 nt, Listeria monocytogenes EGD-e
guagauuccgcuaaaac

SEQ ID NO: 772379 - RNA, 21 nt, Listeria monocytogenes EGD-e
guagcagauguaucuaaaauc

SEQ ID NO: 772380 - RNA, 14 nt, Listeria monocytogenes EGD-e
guagcuucaaucaa

SEQ ID NO: 772381 - RNA, 22 nt, Listeria monocytogenes EGD-e
guauagcuuaaagguuuuguuu

SEQ ID NO: 772382 - RNA, 19 nt, Listeria monocytogenes EGD-e
guauacuuuuaauuaaaag

SEQ ID NO: 772383 - RNA, 18 nt, Listeria monocytogenes EGD-e
guauccacauaacggaaa

SEQ ID NO: 772384 - RNA, 17 nt, Listeria monocytogenes EGD-e
guaucccucauguucaa

SEQ ID NO: 772385 - RNA, 18 nt, Listeria monocytogenes EGD-e
guauguuuuaauuucaaa

SEQ ID NO: 772386 - RNA, 22 nt, Listeria monocytogenes EGD-e
guauggugcgcggauaaauaua

SEQ ID NO: 772387 - RNA, 15 nt, Listeria monocytogenes EGD-e
guaugagaacaauca

SEQ ID NO: 772388 - RNA, 11 nt, Listeria monocytogenes EGD-e
guaucuuaucc

SEQ ID NO: 772389 - RNA, 17 nt, Listeria monocytogenes EGD-e
gucaaaccauuauacaa

SEQ ID NO: 772390 - RNA, 11 nt, Listeria monocytogenes EGD-e
guauuccucaa

SEQ ID NO: 772391 - RNA, 15 nt, Listeria monocytogenes EGD-e
guauuaccucgcuuu

SEQ ID NO: 772392 - RNA, 16 nt, Listeria monocytogenes EGD-e
guauuuauauucuucu

SEQ ID NO: 772393 - RNA, 15 nt, Listeria monocytogenes EGD-e
guauuggguuugaua

SEQ ID NO: 772394 - RNA, 20 nt, Listeria monocytogenes EGD-e
gucaucggcuuuuuuuauuu

SEQ ID NO: 772395 - RNA, 14 nt, Listeria monocytogenes EGD-e
gucaucauaaacau

SEQ ID NO: 772396 - RNA, 15 nt, Listeria monocytogenes EGD-e
gucaucauaaacauu

SEQ ID NO: 772397 - RNA, 13 nt, Listeria monocytogenes EGD-e
gucgaaaaccuaa

SEQ ID NO: 772398 - RNA, 16 nt, Listeria monocytogenes EGD-e
gucccaagauucuucu

SEQ ID NO: 772399 - RNA, 13 nt, Listeria monocytogenes EGD-e
guccgucaagccc

SEQ ID NO: 772400 - RNA, 15 nt, Listeria monocytogenes EGD-e
guccgucaagcccag

SEQ ID NO: 772401 - RNA, 18 nt, Listeria monocytogenes EGD-e
gucgcuauucuauuuauc

SEQ ID NO: 772402 - RNA, 23 nt, Listeria monocytogenes EGD-e
gucuacuuuugacgaagcguguu

SEQ ID NO: 772403 - RNA, 14 nt, Listeria monocytogenes EGD-e
gucuagguuuucuu

SEQ ID NO: 772404 - RNA, 13 nt, Listeria monocytogenes EGD-e
gucugcuuuuuca

SEQ ID NO: 772405 - RNA, 19 nt, Listeria monocytogenes EGD-e
gucuuuuuguaaaggauaa

SEQ ID NO: 772406 - RNA, 22 nt, Listeria monocytogenes EGD-e
gucuuuuuguguaaguguuucu

SEQ ID NO: 772407 - RNA, 21 nt, Listeria monocytogenes EGD-e
gugaaaauuggauuauucaau

SEQ ID NO: 772408 - RNA, 14 nt, Listeria monocytogenes EGD-e
gucuuuguuguuuu

SEQ ID NO: 772409 - RNA, 13 nt, Listeria monocytogenes EGD-e
gugaaaguuuuau

SEQ ID NO: 772410 - RNA, 12 nt, Listeria monocytogenes EGD-e
gugaaauagaau

SEQ ID NO: 772411 - RNA, 18 nt, Listeria monocytogenes EGD-e
gugagaacgacaaauggu

SEQ ID NO: 772412 - RNA, 21 nt, Listeria monocytogenes EGD-e
gugacgaaucaagauuuugcu

SEQ ID NO: 772413 - RNA, 17 nt, Listeria monocytogenes EGD-e
gugagcuucuuuuucga

SEQ ID NO: 772414 - RNA, 22 nt, Listeria monocytogenes EGD-e
gugcaccugcauuucauuuuaa

SEQ ID NO: 772415 - RNA, 12 nt, Listeria monocytogenes EGD-e
guguccaaaaac

SEQ ID NO: 772416 - RNA, 18 nt, Listeria monocytogenes EGD-e
guuaacuaacaaaaucca

SEQ ID NO: 772417 - RNA, 16 nt, Listeria monocytogenes EGD-e
guuaaucgaaaaauca

SEQ ID NO: 772418 - RNA, 16 nt, Listeria monocytogenes EGD-e
guuaaucugauuaaaa

SEQ ID NO: 772419 - RNA, 17 nt, Listeria monocytogenes EGD-e
guuaaucugauuaaaag

SEQ ID NO: 772420 - RNA, 16 nt, Listeria monocytogenes EGD-e
guuauaaagaaauaac

SEQ ID NO: 772421 - RNA, 15 nt, Listeria monocytogenes EGD-e
guuauuucuuuaucu

SEQ ID NO: 772422 - RNA, 20 nt, Listeria monocytogenes EGD-e
guucaacuacuucaacuaaa

SEQ ID NO: 772423 - RNA, 14 nt, Listeria monocytogenes EGD-e
guuauuaaaaggac

SEQ ID NO: 772424 - RNA, 20 nt, Listeria monocytogenes EGD-e
guuauguaauucuaaauaaa

SEQ ID NO: 772425 - RNA, 15 nt, Listeria monocytogenes EGD-e
guuccauuaaaucau

SEQ ID NO: 772426 - RNA, 18 nt, Listeria monocytogenes EGD-e
guuccaguuaaacaaaca

SEQ ID NO: 772427 - RNA, 19 nt, Listeria monocytogenes EGD-e
guuccagcuguaucaauga

SEQ ID NO: 772428 - RNA, 14 nt, Listeria monocytogenes EGD-e
guucucuauauuca

SEQ ID NO: 772429 - RNA, 17 nt, Listeria monocytogenes EGD-e
guuccuucaagcauuuc

SEQ ID NO: 772430 - RNA, 21 nt, Listeria monocytogenes EGD-e
guuucauauaauuuuuucauu

SEQ ID NO: 772431 - RNA, 18 nt, Listeria monocytogenes EGD-e
guuucauauauguaguuu

SEQ ID NO: 772432 - RNA, 18 nt, Listeria monocytogenes EGD-e
guuucauuucaucuuuuu

SEQ ID NO: 772433 - RNA, 14 nt, Listeria monocytogenes EGD-e
guuuaauaugcauu

SEQ ID NO: 772434 - RNA, 12 nt, Listeria monocytogenes EGD-e
guugugcuuucc

SEQ ID NO: 772435 - RNA, 16 nt, Listeria monocytogenes EGD-e
guuguuccauuuuguc

SEQ ID NO: 772436 - RNA, 17 nt, Listeria monocytogenes EGD-e
guucugguaauaaguca

SEQ ID NO: 772437 - RNA, 22 nt, Listeria monocytogenes EGD-e
guucugguaauaagucaaugau

SEQ ID NO: 772438 - RNA, 23 nt, Listeria monocytogenes EGD-e
guuuguaacaacuaauuuuucga

SEQ ID NO: 772439 - RNA, 17 nt, Listeria monocytogenes EGD-e
guuuggaaaacauagaa

SEQ ID NO: 772440 - RNA, 14 nt, Listeria monocytogenes EGD-e
guuuguuccaccgc

SEQ ID NO: 772441 - RNA, 15 nt, Listeria monocytogenes EGD-e
guuucuaauccagcu

SEQ ID NO: 772442 - RNA, 13 nt, Listeria monocytogenes EGD-e
guuuuccuuuguc

SEQ ID NO: 772443 - RNA, 20 nt, Listeria monocytogenes EGD-e
guuuucgauauuuuuuuguu

SEQ ID NO: 772444 - RNA, 12 nt, Listeria monocytogenes EGD-e
guuuucuacugu

SEQ ID NO: 772445 - RNA, 14 nt, Listeria monocytogenes EGD-e
guuuuauuacauua

SEQ ID NO: 772446 - RNA, 13 nt, Listeria monocytogenes EGD-e
guuuucaacgugu

SEQ ID NO: 772447 - RNA, 20 nt, Listeria monocytogenes EGD-e
guuuuaguggagcucuuucu

SEQ ID NO: 772448 - RNA, 14 nt, Listeria monocytogenes EGD-e
guuuuguccaaacc

SEQ ID NO: 772449 - RNA, 23 nt, Listeria monocytogenes EGD-e
guuuuuuuaugcuaaaugaauuc

SEQ ID NO: 772450 - RNA, 12 nt, Listeria monocytogenes EGD-e
uaaaaaaauaca

SEQ ID NO: 772451 - RNA, 16 nt, Listeria monocytogenes EGD-e
guuuuuuguuuguaaa

SEQ ID NO: 772452 - RNA, 21 nt, Listeria monocytogenes EGD-e
uaaaaaacagaaacgcuuugu

SEQ ID NO: 772453 - RNA, 18 nt, Listeria monocytogenes EGD-e
uaaaaaucauuuaaacac

SEQ ID NO: 772454 - RNA, 21 nt, Listeria monocytogenes EGD-e
uaaaaacaguuucuuuacaua

SEQ ID NO: 772455 - RNA, 14 nt, Listeria monocytogenes EGD-e
uaaaaacaguacuu

SEQ ID NO: 772456 - RNA, 17 nt, Listeria monocytogenes EGD-e
uaaaacaguauuccuca

SEQ ID NO: 772457 - RNA, 13 nt, Listeria monocytogenes EGD-e
uaaaacuuucaca

SEQ ID NO: 772458 - RNA, 13 nt, Listeria monocytogenes EGD-e
uaaaagcaugaau

SEQ ID NO: 772459 - RNA, 12 nt, Listeria monocytogenes EGD-e
uaaaauaaaaaa

SEQ ID NO: 772460 - RNA, 19 nt, Listeria monocytogenes EGD-e
uaaccucgcaaaaaauaau

SEQ ID NO: 772461 - RNA, 22 nt, Listeria monocytogenes EGD-e
uaaccucgcaaaaaauaauauc

SEQ ID NO: 772462 - RNA, 20 nt, Listeria monocytogenes EGD-e
uaacgaugacgaugacgcuc

SEQ ID NO: 772463 - RNA, 19 nt, Listeria monocytogenes EGD-e
uaacgcuaucaaucaucac

SEQ ID NO: 772464 - RNA, 17 nt, Listeria monocytogenes EGD-e
uaacaucuuuaaaaaca

SEQ ID NO: 772465 - RNA, 20 nt, Listeria monocytogenes EGD-e
uaacaauuuauacacaucuu

SEQ ID NO: 772466 - RNA, 15 nt, Listeria monocytogenes EGD-e
uaacaaaauaauaau

SEQ ID NO: 772467 - RNA, 21 nt, Listeria monocytogenes EGD-e
uaaauuauccaguguaaucuu

SEQ ID NO: 772468 - RNA, 13 nt, Listeria monocytogenes EGD-e
uaaauaaauauuu

SEQ ID NO: 772469 - RNA, 13 nt, Listeria monocytogenes EGD-e
uaaauagcacagc

SEQ ID NO: 772470 - RNA, 21 nt, Listeria monocytogenes EGD-e
uaaauagcacagcuaccacaa

SEQ ID NO: 772471 - RNA, 17 nt, Listeria monocytogenes EGD-e
uaaaugguugaauagau

SEQ ID NO: 772472 - RNA, 19 nt, Listeria monocytogenes EGD-e
uaaacgaccaucugggcuc

SEQ ID NO: 772473 - RNA, 17 nt, Listeria monocytogenes EGD-e
uaaacuaauuacuaaaa

SEQ ID NO: 772474 - RNA, 21 nt, Listeria monocytogenes EGD-e
uaaacguucuuccuuuuucau

SEQ ID NO: 772475 - RNA, 23 nt, Listeria monocytogenes EGD-e
uaaacguuccaguuaaacaaaca

SEQ ID NO: 772476 - RNA, 20 nt, Listeria monocytogenes EGD-e
uaaacauuugauacauauuu

SEQ ID NO: 772477 - RNA, 23 nt, Listeria monocytogenes EGD-e
uaaaccguaacuguugaaaagua

SEQ ID NO: 772478 - RNA, 18 nt, Listeria monocytogenes EGD-e
uaaagcacuggcaaauaa

SEQ ID NO: 772479 - RNA, 17 nt, Listeria monocytogenes EGD-e
uauuaauccgaauucca

SEQ ID NO: 772480 - RNA, 16 nt, Listeria monocytogenes EGD-e
uauuaaugacuguugu

SEQ ID NO: 772481 - RNA, 21 nt, Listeria monocytogenes EGD-e
uauuaauuauggcauaaaaaa

SEQ ID NO: 772482 - RNA, 17 nt, Listeria monocytogenes EGD-e
uauuaaugguugcauuu

SEQ ID NO: 772483 - RNA, 12 nt, Listeria monocytogenes EGD-e
uauuaacuaaua

SEQ ID NO: 772484 - RNA, 17 nt, Listeria monocytogenes EGD-e
uauuauaaccccaaaau

SEQ ID NO: 772485 - RNA, 23 nt, Listeria monocytogenes EGD-e
uauuauaagcaguacuuccuguu

SEQ ID NO: 772486 - RNA, 18 nt, Listeria monocytogenes EGD-e
uauuauaguuuucuacua

SEQ ID NO: 772487 - RNA, 15 nt, Listeria monocytogenes EGD-e
uauuagaauuccugc

SEQ ID NO: 772488 - RNA, 20 nt, Listeria monocytogenes EGD-e
uauucuucuaaaauaacauc

SEQ ID NO: 772489 - RNA, 17 nt, Listeria monocytogenes EGD-e
uauucgucuuuucaacu

SEQ ID NO: 772490 - RNA, 23 nt, Listeria monocytogenes EGD-e
uauucucuuaugagaguuauaaa

SEQ ID NO: 772491 - RNA, 21 nt, Listeria monocytogenes EGD-e
uauucaaccaagcaauaacau

SEQ ID NO: 772492 - RNA, 11 nt, Listeria monocytogenes EGD-e
uauuauuucug

SEQ ID NO: 772493 - RNA, 14 nt, Listeria monocytogenes EGD-e
uauucaauucccag

SEQ ID NO: 772494 - RNA, 15 nt, Listeria monocytogenes EGD-e
uauucauauaaaguu

SEQ ID NO: 772495 - RNA, 17 nt, Listeria monocytogenes EGD-e
uauucauauaaaguuuu

SEQ ID NO: 772496 - RNA, 19 nt, Listeria monocytogenes EGD-e
uauucauauaaaguuuuuu

SEQ ID NO: 772497 - RNA, 21 nt, Listeria monocytogenes EGD-e
uauucauauaaaguuuuuugg

SEQ ID NO: 772498 - RNA, 14 nt, Listeria monocytogenes EGD-e
uauucauucccaca

SEQ ID NO: 772499 - RNA, 21 nt, Listeria monocytogenes EGD-e
uauuccuccuaauuguuuugu

SEQ ID NO: 772500 - RNA, 15 nt, Listeria monocytogenes EGD-e
uauuuaccuugcucc

SEQ ID NO: 772501 - RNA, 22 nt, Listeria monocytogenes EGD-e
uauuuaaauaguaguuauuucu

SEQ ID NO: 772502 - RNA, 20 nt, Listeria monocytogenes EGD-e
uauuugucaaucuaaauuuu

SEQ ID NO: 772503 - RNA, 14 nt, Listeria monocytogenes EGD-e
uauuuuaacggcuu

SEQ ID NO: 772504 - RNA, 21 nt, Listeria monocytogenes EGD-e
uauuuccccgcagaaaaauaa

SEQ ID NO: 772505 - RNA, 21 nt, Listeria monocytogenes EGD-e
uauuuaucaaacaaaaaaguu

SEQ ID NO: 772506 - RNA, 17 nt, Listeria monocytogenes EGD-e
uauuucaagguucaucc

SEQ ID NO: 772507 - RNA, 16 nt, Listeria monocytogenes EGD-e
ucaaaagcaaaaaagu

SEQ ID NO: 772508 - RNA, 18 nt, Listeria monocytogenes EGD-e
ucaaaagcaaaaaaguag

SEQ ID NO: 772509 - RNA, 20 nt, Listeria monocytogenes EGD-e
uauuuuuuucgaaagaaaug

SEQ ID NO: 772510 - RNA, 15 nt, Listeria monocytogenes EGD-e
ucaaaaagauacuuu

SEQ ID NO: 772511 - RNA, 11 nt, Listeria monocytogenes EGD-e
uauuuuucuuu

SEQ ID NO: 772512 - RNA, 18 nt, Listeria monocytogenes EGD-e
uauuuugcggaaauauca

SEQ ID NO: 772513 - RNA, 16 nt, Listeria monocytogenes EGD-e
uauuuugguuauuucu

SEQ ID NO: 772514 - RNA, 17 nt, Listeria monocytogenes EGD-e
uauuuugguuauuucuu

SEQ ID NO: 772515 - RNA, 14 nt, Listeria monocytogenes EGD-e
uauuuugauaacgu

SEQ ID NO: 772516 - RNA, 22 nt, Listeria monocytogenes EGD-e
ucaaaguaaaauacguugucug

SEQ ID NO: 772517 - RNA, 14 nt, Listeria monocytogenes EGD-e
ucaaacucuuucug

SEQ ID NO: 772518 - RNA, 15 nt, Listeria monocytogenes EGD-e
ucaaacgucauucgg

SEQ ID NO: 772519 - RNA, 23 nt, Listeria monocytogenes EGD-e
ucaaacgucauucgguaaucuag

SEQ ID NO: 772520 - RNA, 18 nt, Listeria monocytogenes EGD-e
ucaaaccauuauacaauu

SEQ ID NO: 772521 - RNA, 13 nt, Listeria monocytogenes EGD-e
ucaagaaauuaaa

SEQ ID NO: 772522 - RNA, 13 nt, Listeria monocytogenes EGD-e
ucaagauuuugcu

SEQ ID NO: 772523 - RNA, 20 nt, Listeria monocytogenes EGD-e
ucaagcauuucauaaucaaa

SEQ ID NO: 772524 - RNA, 15 nt, Listeria monocytogenes EGD-e
ucaagcauauuaauu

SEQ ID NO: 772525 - RNA, 18 nt, Listeria monocytogenes EGD-e
ucaacgggcgcuuucaca

SEQ ID NO: 772526 - RNA, 20 nt, Listeria monocytogenes EGD-e
ucaacgggcgcuuucacauc

SEQ ID NO: 772527 - RNA, 15 nt, Listeria monocytogenes EGD-e
ucaacuggacaauga

SEQ ID NO: 772528 - RNA, 18 nt, Listeria monocytogenes EGD-e
ucaacuggacaaugaucc

SEQ ID NO: 772529 - RNA, 18 nt, Listeria monocytogenes EGD-e
ucaaaucaccacaaagga

SEQ ID NO: 772530 - RNA, 21 nt, Listeria monocytogenes EGD-e
ucaaaucagcuuccauacuuu

SEQ ID NO: 772531 - RNA, 18 nt, Listeria monocytogenes EGD-e
ucaaaucaauuucuucgu

SEQ ID NO: 772532 - RNA, 17 nt, Listeria monocytogenes EGD-e
ucaaaucuggauaaaaa

SEQ ID NO: 772533 - RNA, 21 nt, Listeria monocytogenes EGD-e
ucaaaucuggauaaaaauaac

SEQ ID NO: 772534 - RNA, 18 nt, Listeria monocytogenes EGD-e
ucaaauucaauuuauauu

SEQ ID NO: 772535 - RNA, 14 nt, Listeria monocytogenes EGD-e
ucaaauucuucucc

SEQ ID NO: 772536 - RNA, 15 nt, Listeria monocytogenes EGD-e
ucaacaaaacaaacu

SEQ ID NO: 772537 - RNA, 20 nt, Listeria monocytogenes EGD-e
ucaaccaagcaauaacaucu

SEQ ID NO: 772538 - RNA, 23 nt, Listeria monocytogenes EGD-e
ucaaccaagcaauaacaucuuua

SEQ ID NO: 772539 - RNA, 15 nt, Listeria monocytogenes EGD-e
ucaauaucuuuauuu

SEQ ID NO: 772540 - RNA, 16 nt, Listeria monocytogenes EGD-e
ucaauaauaauacaaa

SEQ ID NO: 772541 - RNA, 15 nt, Listeria monocytogenes EGD-e
ucaauaaugugguuc

SEQ ID NO: 772542 - RNA, 23 nt, Listeria monocytogenes EGD-e
ucaauacuuuuuucuauauucau

SEQ ID NO: 772543 - RNA, 16 nt, Listeria monocytogenes EGD-e
ucaauacguuucauag

SEQ ID NO: 772544 - RNA, 19 nt, Listeria monocytogenes EGD-e
ucaauaaaaugcacaugau

SEQ ID NO: 772545 - RNA, 22 nt, Listeria monocytogenes EGD-e
ucaauaaauccagcgucuaaaa

SEQ ID NO: 772546 - RNA, 16 nt, Listeria monocytogenes EGD-e
ucaaguaauaagaaga

SEQ ID NO: 772547 - RNA, 17 nt, Listeria monocytogenes EGD-e
ucaauuuugccagugau

SEQ ID NO: 772548 - RNA, 20 nt, Listeria monocytogenes EGD-e
ucaauuuacguuguucuaac

SEQ ID NO: 772549 - RNA, 17 nt, Listeria monocytogenes EGD-e
ucaauuaaauuauacau

SEQ ID NO: 772550 - RNA, 18 nt, Listeria monocytogenes EGD-e
ucaaucuguuccaacaua

SEQ ID NO: 772551 - RNA, 22 nt, Listeria monocytogenes EGD-e
ucaaugauaucaucaauaauaa

SEQ ID NO: 772552 - RNA, 22 nt, Listeria monocytogenes EGD-e
ucaaugcccaguaaaacuaaau

SEQ ID NO: 772553 - RNA, 20 nt, Listeria monocytogenes EGD-e
ucacagcguauccaccaaaa

SEQ ID NO: 772554 - RNA, 18 nt, Listeria monocytogenes EGD-e
ucacacgacgaauggccu

SEQ ID NO: 772555 - RNA, 18 nt, Listeria monocytogenes EGD-e
ucacaaguaacucuucca

SEQ ID NO: 772556 - RNA, 19 nt, Listeria monocytogenes EGD-e
ucacaaguaacucuuccaa

SEQ ID NO: 772557 - RNA, 21 nt, Listeria monocytogenes EGD-e
ucacaaguaacucuuccaaaa

SEQ ID NO: 772558 - RNA, 23 nt, Listeria monocytogenes EGD-e
ucacaccacucuuuuauaaaaau

SEQ ID NO: 772559 - RNA, 13 nt, Listeria monocytogenes EGD-e
ucacaauuuaagu

SEQ ID NO: 772560 - RNA, 20 nt, Listeria monocytogenes EGD-e
ucaccaacaauuacuuccau

SEQ ID NO: 772561 - RNA, 14 nt, Listeria monocytogenes EGD-e
ucaccaaaugcuuc

SEQ ID NO: 772562 - RNA, 15 nt, Listeria monocytogenes EGD-e
ucaccacuucuucca

SEQ ID NO: 772563 - RNA, 13 nt, Listeria monocytogenes EGD-e
ucaccuuuguuac

SEQ ID NO: 772564 - RNA, 15 nt, Listeria monocytogenes EGD-e
ucacgagaaagccaa

SEQ ID NO: 772565 - RNA, 19 nt, Listeria monocytogenes EGD-e
ucacugugaacugauuuuu

SEQ ID NO: 772566 - RNA, 23 nt, Listeria monocytogenes EGD-e
ucacuuucuugcugcauuuucac

SEQ ID NO: 772567 - RNA, 12 nt, Listeria monocytogenes EGD-e
ucacuuggaaaa

SEQ ID NO: 772568 - RNA, 18 nt, Listeria monocytogenes EGD-e
ucacuucuuaagaauucc

SEQ ID NO: 772569 - RNA, 18 nt, Listeria monocytogenes EGD-e
ucacuuaauucuugaaug

SEQ ID NO: 772570 - RNA, 14 nt, Listeria monocytogenes EGD-e
ucacuaacaaaaua

SEQ ID NO: 772571 - RNA, 17 nt, Listeria monocytogenes EGD-e
ucacuaacaaaauaaua

SEQ ID NO: 772572 - RNA, 18 nt, Listeria monocytogenes EGD-e
ucacuaacaaaauaauaa

SEQ ID NO: 772573 - RNA, 13 nt, Listeria monocytogenes EGD-e
ucacgucccauug

SEQ ID NO: 772574 - RNA, 15 nt, Listeria monocytogenes EGD-e
ucagacgcaauuuca

SEQ ID NO: 772575 - RNA, 23 nt, Listeria monocytogenes EGD-e
ucagaagcgaugugggaaugaau

SEQ ID NO: 772576 - RNA, 22 nt, Listeria monocytogenes EGD-e
ucagcaagauaacucaaaguaa

SEQ ID NO: 772577 - RNA, 17 nt, Listeria monocytogenes EGD-e
ucagccaauucuuccac

SEQ ID NO: 772578 - RNA, 14 nt, Listeria monocytogenes EGD-e
ucagcaucuggauc

SEQ ID NO: 772579 - RNA, 12 nt, Listeria monocytogenes EGD-e
uaucaaauaacc

SEQ ID NO: 772580 - RNA, 19 nt, Listeria monocytogenes EGD-e
uaucaaauaaccauuauuu

SEQ ID NO: 772581 - RNA, 18 nt, Listeria monocytogenes EGD-e
uaucaccauuacuauuaa

SEQ ID NO: 772582 - RNA, 14 nt, Listeria monocytogenes EGD-e
uauauguaguuuca

SEQ ID NO: 772583 - RNA, 13 nt, Listeria monocytogenes EGD-e
uauauuuauaaac

SEQ ID NO: 772584 - RNA, 13 nt, Listeria monocytogenes EGD-e
uauaugcuacuau

SEQ ID NO: 772585 - RNA, 15 nt, Listeria monocytogenes EGD-e
uauaaugauucaaag

SEQ ID NO: 772586 - RNA, 20 nt, Listeria monocytogenes EGD-e
uauaaucuacuguauauguu

SEQ ID NO: 772587 - RNA, 13 nt, Listeria monocytogenes EGD-e
uauccguuucauu

SEQ ID NO: 772588 - RNA, 21 nt, Listeria monocytogenes EGD-e
uauccacauaacggaaauucc

SEQ ID NO: 772589 - RNA, 16 nt, Listeria monocytogenes EGD-e
uauguuuaaucuaaau

SEQ ID NO: 772590 - RNA, 16 nt, Listeria monocytogenes EGD-e
uaugugcgaugccacu

SEQ ID NO: 772591 - RNA, 22 nt, Listeria monocytogenes EGD-e
uauggugcgcggauaaauauag

SEQ ID NO: 772592 - RNA, 14 nt, Listeria monocytogenes EGD-e
uauguccagucacu

SEQ ID NO: 772593 - RNA, 19 nt, Listeria monocytogenes EGD-e
uauguaauucuaaauaaau

SEQ ID NO: 772594 - RNA, 15 nt, Listeria monocytogenes EGD-e
uaugcgguagccugc

SEQ ID NO: 772595 - RNA, 19 nt, Listeria monocytogenes EGD-e
uaugcagguaaaacagcaa

SEQ ID NO: 772596 - RNA, 20 nt, Listeria monocytogenes EGD-e
uaugcagguaaaacagcaag

SEQ ID NO: 772597 - RNA, 16 nt, Listeria monocytogenes EGD-e
uaugaucuuuucgcaa

SEQ ID NO: 772598 - RNA, 17 nt, Listeria monocytogenes EGD-e
uaucugguacguuuuuu

SEQ ID NO: 772599 - RNA, 13 nt, Listeria monocytogenes EGD-e
uaucuuuauuuuu

SEQ ID NO: 772600 - RNA, 23 nt, Listeria monocytogenes EGD-e
uaucuuuuccaaaauggccaacc

SEQ ID NO: 772601 - RNA, 18 nt, Listeria monocytogenes EGD-e
uaucuuucccaucauauc

SEQ ID NO: 772602 - RNA, 11 nt, Listeria monocytogenes EGD-e
uaugaaaaaaa

SEQ ID NO: 772603 - RNA, 14 nt, Listeria monocytogenes EGD-e
uaugaaaaaaaaua

SEQ ID NO: 772604 - RNA, 22 nt, Listeria monocytogenes EGD-e
uagaaaacgacucaaugaaaag

SEQ ID NO: 772605 - RNA, 22 nt, Listeria monocytogenes EGD-e
uagauuuagaggcguacuaaaa

SEQ ID NO: 772606 - RNA, 16 nt, Listeria monocytogenes EGD-e
uagauuccgcuaaaac

SEQ ID NO: 772607 - RNA, 21 nt, Listeria monocytogenes EGD-e
uagauuccgcuaaaacuaaaa

SEQ ID NO: 772608 - RNA, 22 nt, Listeria monocytogenes EGD-e
uagcaggacaugcuaaauaaaa

SEQ ID NO: 772609 - RNA, 22 nt, Listeria monocytogenes EGD-e
uagcagauguaucuaaaaucau

SEQ ID NO: 772610 - RNA, 15 nt, Listeria monocytogenes EGD-e
uagcaacuucacuaa

SEQ ID NO: 772611 - RNA, 22 nt, Listeria monocytogenes EGD-e
uagccauuguugcggcaguagu

SEQ ID NO: 772612 - RNA, 19 nt, Listeria monocytogenes EGD-e
uagcguacaugaugauugu

SEQ ID NO: 772613 - RNA, 13 nt, Listeria monocytogenes EGD-e
uagcuacaauuaa

SEQ ID NO: 772614 - RNA, 17 nt, Listeria monocytogenes EGD-e
uagcgcaucucuaacag

SEQ ID NO: 772615 - RNA, 15 nt, Listeria monocytogenes EGD-e
uaggcauuguauuca

SEQ ID NO: 772616 - RNA, 13 nt, Listeria monocytogenes EGD-e
uaggcccauuaaa

SEQ ID NO: 772617 - RNA, 19 nt, Listeria monocytogenes EGD-e
uaggaauuucgaaauuaaa

SEQ ID NO: 772618 - RNA, 16 nt, Listeria monocytogenes EGD-e
uagcuuaaagguuuug

SEQ ID NO: 772619 - RNA, 18 nt, Listeria monocytogenes EGD-e
uagcuuaaagguuuuguu

SEQ ID NO: 772620 - RNA, 20 nt, Listeria monocytogenes EGD-e
uagcuagacuguaugaaacu

SEQ ID NO: 772621 - RNA, 22 nt, Listeria monocytogenes EGD-e
uagcuaugcguuacacuucgaa

SEQ ID NO: 772622 - RNA, 12 nt, Listeria monocytogenes EGD-e
uagcuauuuuuu

SEQ ID NO: 772623 - RNA, 14 nt, Listeria monocytogenes EGD-e
uagcuauuuuuuug

SEQ ID NO: 772624 - RNA, 19 nt, Listeria monocytogenes EGD-e
uauaacuuuuuuucuuaga

SEQ ID NO: 772625 - RNA, 14 nt, Listeria monocytogenes EGD-e
uauaagaaauuacg

SEQ ID NO: 772626 - RNA, 15 nt, Listeria monocytogenes EGD-e
uauaaagauccaucg

SEQ ID NO: 772627 - RNA, 22 nt, Listeria monocytogenes EGD-e
uauaacaaagcguuuuuuauuu

SEQ ID NO: 772628 - RNA, 13 nt, Listeria monocytogenes EGD-e
uaguuccuucuaa

SEQ ID NO: 772629 - RNA, 16 nt, Listeria monocytogenes EGD-e
uaguucacugugaacu

SEQ ID NO: 772630 - RNA, 14 nt, Listeria monocytogenes EGD-e
uagugcaucuucua

SEQ ID NO: 772631 - RNA, 17 nt, Listeria monocytogenes EGD-e
uaguugauauauucaca

SEQ ID NO: 772632 - RNA, 12 nt, Listeria monocytogenes EGD-e
uaguuccagcua

SEQ ID NO: 772633 - RNA, 22 nt, Listeria monocytogenes EGD-e
uauaaagaacuagauuuaauaa

SEQ ID NO: 772634 - RNA, 19 nt, Listeria monocytogenes EGD-e
uaguuguucaggguuuguu

SEQ ID NO: 772635 - RNA, 12 nt, Listeria monocytogenes EGD-e
uauaaaaacaug

SEQ ID NO: 772636 - RNA, 13 nt, Listeria monocytogenes EGD-e
uaguagcaauuuu

SEQ ID NO: 772637 - RNA, 17 nt, Listeria monocytogenes EGD-e
uaguagcaauuuuaaau

SEQ ID NO: 772638 - RNA, 23 nt, Listeria monocytogenes EGD-e
uaguagagcuucuguuuuuucuu

SEQ ID NO: 772639 - RNA, 15 nt, Listeria monocytogenes EGD-e
uaguauacuuuuaau

SEQ ID NO: 772640 - RNA, 16 nt, Listeria monocytogenes EGD-e
uaguauuucagcaaga

SEQ ID NO: 772641 - RNA, 20 nt, Listeria monocytogenes EGD-e
uagguguauagaagguauug

SEQ ID NO: 772642 - RNA, 19 nt, Listeria monocytogenes EGD-e
uaguaaauggcugaugacu

SEQ ID NO: 772643 - RNA, 12 nt, Listeria monocytogenes EGD-e
uaguaauuuaau

SEQ ID NO: 772644 - RNA, 18 nt, Listeria monocytogenes EGD-e
uacgaucuacuucuaaau

SEQ ID NO: 772645 - RNA, 15 nt, Listeria monocytogenes EGD-e
uacguaucuuauccg

SEQ ID NO: 772646 - RNA, 12 nt, Listeria monocytogenes EGD-e
uacggcuucaau

SEQ ID NO: 772647 - RNA, 11 nt, Listeria monocytogenes EGD-e
uaccuuuaaaa

SEQ ID NO: 772648 - RNA, 12 nt, Listeria monocytogenes EGD-e
uaccuugaucaa

SEQ ID NO: 772649 - RNA, 20 nt, Listeria monocytogenes EGD-e
uacgaaaucaaacuuauaau

SEQ ID NO: 772650 - RNA, 17 nt, Listeria monocytogenes EGD-e
uaccaggaucaaaaugg

SEQ ID NO: 772651 - RNA, 13 nt, Listeria monocytogenes EGD-e
uaccgcuaauaua

SEQ ID NO: 772652 - RNA, 14 nt, Listeria monocytogenes EGD-e
uaccgcuaauauaa

SEQ ID NO: 772653 - RNA, 14 nt, Listeria monocytogenes EGD-e
uaccgcauuuuucu

SEQ ID NO: 772654 - RNA, 23 nt, Listeria monocytogenes EGD-e
uacccuuuuuuuacauuuuugcu

SEQ ID NO: 772655 - RNA, 12 nt, Listeria monocytogenes EGD-e
uacuccaaaaua

SEQ ID NO: 772656 - RNA, 17 nt, Listeria monocytogenes EGD-e
uacuccaaaauaaaaug

SEQ ID NO: 772657 - RNA, 15 nt, Listeria monocytogenes EGD-e
uacucgguucaauua

SEQ ID NO: 772658 - RNA, 21 nt, Listeria monocytogenes EGD-e
uacucgucauagauacucuuu

SEQ ID NO: 772659 - RNA, 15 nt, Listeria monocytogenes EGD-e
uacuugcaaaugcuu

SEQ ID NO: 772660 - RNA, 15 nt, Listeria monocytogenes EGD-e
uacuuggaauaaaca

SEQ ID NO: 772661 - RNA, 17 nt, Listeria monocytogenes EGD-e
uacuugugaaaguuuua

SEQ ID NO: 772662 - RNA, 17 nt, Listeria monocytogenes EGD-e
uacuuuauuuauuuuua

SEQ ID NO: 772663 - RNA, 14 nt, Listeria monocytogenes EGD-e
uacuuucugccaaa

SEQ ID NO: 772664 - RNA, 20 nt, Listeria monocytogenes EGD-e
uacuuuuuucuauauucauc

SEQ ID NO: 772665 - RNA, 14 nt, Listeria monocytogenes EGD-e
uagaaaaaugaaga

SEQ ID NO: 772666 - RNA, 14 nt, Listeria monocytogenes EGD-e
uacuuuuccgaccu

SEQ ID NO: 772667 - RNA, 19 nt, Listeria monocytogenes EGD-e
uacuucggggcaaaaagga

SEQ ID NO: 772668 - RNA, 20 nt, Listeria monocytogenes EGD-e
uacuucggggcaaaaaggaa

SEQ ID NO: 772669 - RNA, 17 nt, Listeria monocytogenes EGD-e
uacuuaaaucacuucuu

SEQ ID NO: 772670 - RNA, 12 nt, Listeria monocytogenes EGD-e
uacuuacaaaag

SEQ ID NO: 772671 - RNA, 17 nt, Listeria monocytogenes EGD-e
uacugucgcaaaaauca

SEQ ID NO: 772672 - RNA, 19 nt, Listeria monocytogenes EGD-e
uacuguuuuauauuuuauu

SEQ ID NO: 772673 - RNA, 12 nt, Listeria monocytogenes EGD-e
uacuguauaugu

SEQ ID NO: 772674 - RNA, 18 nt, Listeria monocytogenes EGD-e
uacuguauauguuuuauu

SEQ ID NO: 772675 - RNA, 20 nt, Listeria monocytogenes EGD-e
uacugguuuuucuuuuccua

SEQ ID NO: 772676 - RNA, 15 nt, Listeria monocytogenes EGD-e
uaauauauucaaaau

SEQ ID NO: 772677 - RNA, 13 nt, Listeria monocytogenes EGD-e
uaauauacuuuau

SEQ ID NO: 772678 - RNA, 15 nt, Listeria monocytogenes EGD-e
uaauauacuuuauaa

SEQ ID NO: 772679 - RNA, 18 nt, Listeria monocytogenes EGD-e
uaauauacuuuauaacuu

SEQ ID NO: 772680 - RNA, 16 nt, Listeria monocytogenes EGD-e
uaauauauagucauaa

SEQ ID NO: 772681 - RNA, 15 nt, Listeria monocytogenes EGD-e
uaauaucuucuauau

SEQ ID NO: 772682 - RNA, 19 nt, Listeria monocytogenes EGD-e
uaaucacguuuuugcucua

SEQ ID NO: 772683 - RNA, 16 nt, Listeria monocytogenes EGD-e
uaaucgaaaaaucauu

SEQ ID NO: 772684 - RNA, 23 nt, Listeria monocytogenes EGD-e
uaaucgaaaaaucauuaaauuua

SEQ ID NO: 772685 - RNA, 18 nt, Listeria monocytogenes EGD-e
uaaugccaguauuuugau

SEQ ID NO: 772686 - RNA, 13 nt, Listeria monocytogenes EGD-e
uaaugccgcuugg

SEQ ID NO: 772687 - RNA, 19 nt, Listeria monocytogenes EGD-e
uaaugcgaaaaaugaaaag

SEQ ID NO: 772688 - RNA, 14 nt, Listeria monocytogenes EGD-e
uaauuaauugugcu

SEQ ID NO: 772689 - RNA, 16 nt, Listeria monocytogenes EGD-e
uaauuuccauuucgau

SEQ ID NO: 772690 - RNA, 13 nt, Listeria monocytogenes EGD-e
uaauuucuuuguc

SEQ ID NO: 772691 - RNA, 19 nt, Listeria monocytogenes EGD-e
uaauuugggagcuuucuuu

SEQ ID NO: 772692 - RNA, 17 nt, Listeria monocytogenes EGD-e
uaauuucaaauggagcu

SEQ ID NO: 772693 - RNA, 15 nt, Listeria monocytogenes EGD-e
uaauuuaauugugcu

SEQ ID NO: 772694 - RNA, 19 nt, Listeria monocytogenes EGD-e
uaauucuaaauaaauauuu

SEQ ID NO: 772695 - RNA, 13 nt, Listeria monocytogenes EGD-e
uaauucggcuuca

SEQ ID NO: 772696 - RNA, 16 nt, Listeria monocytogenes EGD-e
uaauucggcuucaaaa

SEQ ID NO: 772697 - RNA, 22 nt, Listeria monocytogenes EGD-e
uaauucggcaaacagcuuuucu

SEQ ID NO: 772698 - RNA, 23 nt, Listeria monocytogenes EGD-e
uaauucggcaaacagcuuuucua

SEQ ID NO: 772699 - RNA, 20 nt, Listeria monocytogenes EGD-e
uaauuuuuucauuuucuauu

SEQ ID NO: 772700 - RNA, 21 nt, Listeria monocytogenes EGD-e
uaauuugguccaucaaauuau

SEQ ID NO: 772701 - RNA, 15 nt, Listeria monocytogenes EGD-e
uacaauuaauaauaa

SEQ ID NO: 772702 - RNA, 14 nt, Listeria monocytogenes EGD-e
uacacaucuuucga

SEQ ID NO: 772703 - RNA, 22 nt, Listeria monocytogenes EGD-e
uacaggaacuacauacuuauag

SEQ ID NO: 772704 - RNA, 16 nt, Listeria monocytogenes EGD-e
gcugcauuuucacaag

SEQ ID NO: 772705 - RNA, 18 nt, Listeria monocytogenes EGD-e
gcuggauaaagaccuaaa

SEQ ID NO: 772706 - RNA, 13 nt, Listeria monocytogenes EGD-e
gcugcuuggacug

SEQ ID NO: 772707 - RNA, 20 nt, Listeria monocytogenes EGD-e
gcugcuaaaggcaacaaaga

SEQ ID NO: 772708 - RNA, 21 nt, Listeria monocytogenes EGD-e
gcugcuaaaggcaacaaagaa

SEQ ID NO: 772709 - RNA, 17 nt, Listeria monocytogenes EGD-e
gcugucaaauucuucuc

SEQ ID NO: 772710 - RNA, 19 nt, Listeria monocytogenes EGD-e
gcuggugcuuuuuuuguuu

SEQ ID NO: 772711 - RNA, 22 nt, Listeria monocytogenes EGD-e
gcugucuuggaagaaccuucaa

SEQ ID NO: 772712 - RNA, 22 nt, Listeria monocytogenes EGD-e
gcugggaauauccuuguuguuc

SEQ ID NO: 772713 - RNA, 13 nt, Listeria monocytogenes EGD-e
gcuuauuaaacau

SEQ ID NO: 772714 - RNA, 16 nt, Listeria monocytogenes EGD-e
gcuuauuccuccaauu

SEQ ID NO: 772715 - RNA, 19 nt, Listeria monocytogenes EGD-e
gcuucauaaaucgccacau

SEQ ID NO: 772716 - RNA, 23 nt, Listeria monocytogenes EGD-e
gcuucaaucccagcuuuuccuag

SEQ ID NO: 772717 - RNA, 18 nt, Listeria monocytogenes EGD-e
gcuucaaaacucucuuuc

SEQ ID NO: 772718 - RNA, 22 nt, Listeria monocytogenes EGD-e
gcuucaccaagaagagcugcaa

SEQ ID NO: 772719 - RNA, 22 nt, Listeria monocytogenes EGD-e
gcuucacgugcugcuuuccuug

SEQ ID NO: 772720 - RNA, 19 nt, Listeria monocytogenes EGD-e
gcuucuuccauaucaccaa

SEQ ID NO: 772721 - RNA, 21 nt, Listeria monocytogenes EGD-e
gcuucuuccauaucaccaaca

SEQ ID NO: 772722 - RNA, 18 nt, Listeria monocytogenes EGD-e
gcuucuuccauuuguucu

SEQ ID NO: 772723 - RNA, 18 nt, Listeria monocytogenes EGD-e
gcuucuguuuuuucuuug

SEQ ID NO: 772724 - RNA, 17 nt, Listeria monocytogenes EGD-e
gcuucuuuuuucuucca

SEQ ID NO: 772725 - RNA, 15 nt, Listeria monocytogenes EGD-e
gcuucugauucccac

SEQ ID NO: 772726 - RNA, 23 nt, Listeria monocytogenes EGD-e
gcuucguuucauuucaucuuuuu

SEQ ID NO: 772727 - RNA, 16 nt, Listeria monocytogenes EGD-e
gcuucuaagucaaaac

SEQ ID NO: 772728 - RNA, 18 nt, Listeria monocytogenes EGD-e
gcuucgcuguccauucca

SEQ ID NO: 772729 - RNA, 17 nt, Listeria monocytogenes EGD-e
gcuuccccauaguaaaa

SEQ ID NO: 772730 - RNA, 19 nt, Listeria monocytogenes EGD-e
gcuuccccauaguaaaaaa

SEQ ID NO: 772731 - RNA, 16 nt, Listeria monocytogenes EGD-e
gcuuguguaacauaaa

SEQ ID NO: 772732 - RNA, 16 nt, Listeria monocytogenes EGD-e
gcuuuuaacuuucuug

SEQ ID NO: 772733 - RNA, 20 nt, Listeria monocytogenes EGD-e
gcuuuguguuaauaaaauca

SEQ ID NO: 772734 - RNA, 19 nt, Listeria monocytogenes EGD-e
gcuuugucuagguuuucuu

SEQ ID NO: 772735 - RNA, 23 nt, Listeria monocytogenes EGD-e
gcuuuuguccaaccuaaaucuuu

SEQ ID NO: 772736 - RNA, 17 nt, Listeria monocytogenes EGD-e
gcuuuuucaaaaucaag

SEQ ID NO: 772737 - RNA, 13 nt, Listeria monocytogenes EGD-e
gcuuuccagcagg

SEQ ID NO: 772738 - RNA, 20 nt, Listeria monocytogenes EGD-e
ggaaagaauauccguuucau

SEQ ID NO: 772739 - RNA, 20 nt, Listeria monocytogenes EGD-e
ggaacgaauccuuggaaaaa

SEQ ID NO: 772740 - RNA, 17 nt, Listeria monocytogenes EGD-e
ggaaauaauucugcuaa

SEQ ID NO: 772741 - RNA, 17 nt, Listeria monocytogenes EGD-e
ggacacccauaauagca

SEQ ID NO: 772742 - RNA, 12 nt, Listeria monocytogenes EGD-e
ggagacagaaaa

SEQ ID NO: 772743 - RNA, 19 nt, Listeria monocytogenes EGD-e
ggacauacuucaugugcuu

SEQ ID NO: 772744 - RNA, 13 nt, Listeria monocytogenes EGD-e
ggauaaaaauugc

SEQ ID NO: 772745 - RNA, 14 nt, Listeria monocytogenes EGD-e
ggauaaaaauugca

SEQ ID NO: 772746 - RNA, 15 nt, Listeria monocytogenes EGD-e
ggauaguuccagcua

SEQ ID NO: 772747 - RNA, 22 nt, Listeria monocytogenes EGD-e
ggaucuuccaucauaaucccag

SEQ ID NO: 772748 - RNA, 19 nt, Listeria monocytogenes EGD-e
ggauucucuucuaacaauu

SEQ ID NO: 772749 - RNA, 19 nt, Listeria monocytogenes EGD-e
ggcaguccaccagcuacuu

SEQ ID NO: 772750 - RNA, 14 nt, Listeria monocytogenes EGD-e
gcggaaauaaaaac

SEQ ID NO: 772751 - RNA, 16 nt, Listeria monocytogenes EGD-e
gcggaaauaucaccau

SEQ ID NO: 772752 - RNA, 14 nt, Listeria monocytogenes EGD-e
gcggauaauaauca

SEQ ID NO: 772753 - RNA, 19 nt, Listeria monocytogenes EGD-e
gcgacuuuugcagcuggaa

SEQ ID NO: 772754 - RNA, 12 nt, Listeria monocytogenes EGD-e
gcgcagaaaguu

SEQ ID NO: 772755 - RNA, 16 nt, Listeria monocytogenes EGD-e
gcgcagaaugaagcca

SEQ ID NO: 772756 - RNA, 13 nt, Listeria monocytogenes EGD-e
gcgccagcuucac

SEQ ID NO: 772757 - RNA, 20 nt, Listeria monocytogenes EGD-e
gcgcaucguugugcuuuccc

SEQ ID NO: 772758 - RNA, 14 nt, Listeria monocytogenes EGD-e
gcuauuuuuuugcu

SEQ ID NO: 772759 - RNA, 16 nt, Listeria monocytogenes EGD-e
gcuauuuuuuugcuuu

SEQ ID NO: 772760 - RNA, 13 nt, Listeria monocytogenes EGD-e
gcuauuccagcua

SEQ ID NO: 772761 - RNA, 23 nt, Listeria monocytogenes EGD-e
gcucaagugaacguacaacuaaa

SEQ ID NO: 772762 - RNA, 16 nt, Listeria monocytogenes EGD-e
gcucagcggguugaaa

SEQ ID NO: 772763 - RNA, 17 nt, Listeria monocytogenes EGD-e
gcugaacuuggaaagug

SEQ ID NO: 772764 - RNA, 15 nt, Listeria monocytogenes EGD-e
gcucuuccuuuuguu

SEQ ID NO: 772765 - RNA, 23 nt, Listeria monocytogenes EGD-e
gcucuuccuuuuguuuuaauaaa

SEQ ID NO: 772766 - RNA, 14 nt, Listeria monocytogenes EGD-e
gcucuuugcuucaa

SEQ ID NO: 772767 - RNA, 19 nt, Listeria monocytogenes EGD-e
gcucuguuucauuuuucca

SEQ ID NO: 772768 - RNA, 21 nt, Listeria monocytogenes EGD-e
gcguaugguucaaaaagauac

SEQ ID NO: 772769 - RNA, 16 nt, Listeria monocytogenes EGD-e
gcgguagccugcucgc

SEQ ID NO: 772770 - RNA, 21 nt, Listeria monocytogenes EGD-e
gcaucuuggcaugaugaaaag

SEQ ID NO: 772771 - RNA, 22 nt, Listeria monocytogenes EGD-e
gcaucuucuaagaaaaaaaguu

SEQ ID NO: 772772 - RNA, 16 nt, Listeria monocytogenes EGD-e
gcaucuuuuucuugcu

SEQ ID NO: 772773 - RNA, 17 nt, Listeria monocytogenes EGD-e
gcaucuuuuucuugcuu

SEQ ID NO: 772774 - RNA, 21 nt, Listeria monocytogenes EGD-e
gcaugccuggcguaucaauaa

SEQ ID NO: 772775 - RNA, 13 nt, Listeria monocytogenes EGD-e
gcaucuaguagca

SEQ ID NO: 772776 - RNA, 14 nt, Listeria monocytogenes EGD-e
gcaucuaguagcaa

SEQ ID NO: 772777 - RNA, 11 nt, Listeria monocytogenes EGD-e
gcauuucacac

SEQ ID NO: 772778 - RNA, 22 nt, Listeria monocytogenes EGD-e
gcauuucacaccacucuuuuau

SEQ ID NO: 772779 - RNA, 14 nt, Listeria monocytogenes EGD-e
gcauuuuuucuuug

SEQ ID NO: 772780 - RNA, 13 nt, Listeria monocytogenes EGD-e
gccaauuaaaaua

SEQ ID NO: 772781 - RNA, 22 nt, Listeria monocytogenes EGD-e
gcccacaaaacggaucuuucuc

SEQ ID NO: 772782 - RNA, 16 nt, Listeria monocytogenes EGD-e
gccaugaauauuagaa

SEQ ID NO: 772783 - RNA, 23 nt, Listeria monocytogenes EGD-e
gccaucaauaucggcauuugaau

SEQ ID NO: 772784 - RNA, 15 nt, Listeria monocytogenes EGD-e
gccaucgcagcagaa

SEQ ID NO: 772785 - RNA, 19 nt, Listeria monocytogenes EGD-e
gcccuugauuuaaauaaac

SEQ ID NO: 772786 - RNA, 14 nt, Listeria monocytogenes EGD-e
gccgacuaguucug

SEQ ID NO: 772787 - RNA, 15 nt, Listeria monocytogenes EGD-e
gccgacuaguucugc

SEQ ID NO: 772788 - RNA, 17 nt, Listeria monocytogenes EGD-e
gccguccaauucuuucg

SEQ ID NO: 772789 - RNA, 17 nt, Listeria monocytogenes EGD-e
gaguuccaucuucuaau

SEQ ID NO: 772790 - RNA, 14 nt, Listeria monocytogenes EGD-e
gauacucuuuaaau

SEQ ID NO: 772791 - RNA, 18 nt, Listeria monocytogenes EGD-e
gauaccuuuuucaucgca

SEQ ID NO: 772792 - RNA, 18 nt, Listeria monocytogenes EGD-e
gauaaccgcuaucuacau

SEQ ID NO: 772793 - RNA, 19 nt, Listeria monocytogenes EGD-e
gauaaugugaccuuaaauu

SEQ ID NO: 772794 - RNA, 23 nt, Listeria monocytogenes EGD-e
gauaaugugaccuuaaauuauac

SEQ ID NO: 772795 - RNA, 18 nt, Listeria monocytogenes EGD-e
gauaugcagguaaaacag

SEQ ID NO: 772796 - RNA, 20 nt, Listeria monocytogenes EGD-e
gauaucuacaaguucuuuca

SEQ ID NO: 772797 - RNA, 23 nt, Listeria monocytogenes EGD-e
gauaucuacaaguucuuucaugu

SEQ ID NO: 772798 - RNA, 19 nt, Listeria monocytogenes EGD-e
gauccacgauggaaccauu

SEQ ID NO: 772799 - RNA, 23 nt, Listeria monocytogenes EGD-e
gaucgccuacuucuaaauuaacu

SEQ ID NO: 772800 - RNA, 19 nt, Listeria monocytogenes EGD-e
gaugccgacuaguucugcu

SEQ ID NO: 772801 - RNA, 21 nt, Listeria monocytogenes EGD-e
gauggagauucauaaacaaaa

SEQ ID NO: 772802 - RNA, 16 nt, Listeria monocytogenes EGD-e
gauuacuccaaaauaa

SEQ ID NO: 772803 - RNA, 21 nt, Listeria monocytogenes EGD-e
gauuacuccaaaauaaaaugg

SEQ ID NO: 772804 - RNA, 13 nt, Listeria monocytogenes EGD-e
gauguuuuugcuu

SEQ ID NO: 772805 - RNA, 21 nt, Listeria monocytogenes EGD-e
gauuggaucuuccaucauaau

SEQ ID NO: 772806 - RNA, 14 nt, Listeria monocytogenes EGD-e
gauugcgucacaau

SEQ ID NO: 772807 - RNA, 20 nt, Listeria monocytogenes EGD-e
gauuuuauuuuuauuauaaa

SEQ ID NO: 772808 - RNA, 22 nt, Listeria monocytogenes EGD-e
gauuuuguuguuuucccagaaa

SEQ ID NO: 772809 - RNA, 15 nt, Listeria monocytogenes EGD-e
gauuuuguacauaaa

SEQ ID NO: 772810 - RNA, 16 nt, Listeria monocytogenes EGD-e
gcaaacagcuuuucua

SEQ ID NO: 772811 - RNA, 17 nt, Listeria monocytogenes EGD-e
gcaaauaacguugcauu

SEQ ID NO: 772812 - RNA, 18 nt, Listeria monocytogenes EGD-e
gcaaaucuuucggcacac

SEQ ID NO: 772813 - RNA, 18 nt, Listeria monocytogenes EGD-e
gcagcuuuuguccaaccu

SEQ ID NO: 772814 - RNA, 12 nt, Listeria monocytogenes EGD-e
gcauagaaagua

SEQ ID NO: 772815 - RNA, 13 nt, Listeria monocytogenes EGD-e
gcaguagacuaaa

SEQ ID NO: 772816 - RNA, 15 nt, Listeria monocytogenes EGD-e
gcaguccaccagcua

SEQ ID NO: 772817 - RNA, 20 nt, Listeria monocytogenes EGD-e
gcauccaagcggguuuucuc

SEQ ID NO: 772818 - RNA, 19 nt, Listeria monocytogenes EGD-e
gcaucccaacucucuucag

SEQ ID NO: 772819 - RNA, 17 nt, Listeria monocytogenes EGD-e
gcaucccauaaaaccgc

SEQ ID NO: 772820 - RNA, 21 nt, Listeria monocytogenes EGD-e
gcacaaguaauauuauaucca

SEQ ID NO: 772821 - RNA, 16 nt, Listeria monocytogenes EGD-e
gcaauuucggaagauc

SEQ ID NO: 772822 - RNA, 20 nt, Listeria monocytogenes EGD-e
gcaccaaagacgcuuuuuuc

SEQ ID NO: 772823 - RNA, 13 nt, Listeria monocytogenes EGD-e
gcaccaaaaauac

SEQ ID NO: 772824 - RNA, 15 nt, Listeria monocytogenes EGD-e
gcaacuucuggauuu

SEQ ID NO: 772825 - RNA, 15 nt, Listeria monocytogenes EGD-e
gcaaucaauuuacgu

SEQ ID NO: 772826 - RNA, 18 nt, Listeria monocytogenes EGD-e
gcaaucguauguuuuuga

SEQ ID NO: 772827 - RNA, 18 nt, Listeria monocytogenes EGD-e
gcacuagaaaaaugaaga

SEQ ID NO: 772828 - RNA, 19 nt, Listeria monocytogenes EGD-e
gcacuagaaaaaugaagag

SEQ ID NO: 772829 - RNA, 13 nt, Listeria monocytogenes EGD-e
gcacuaauuucau

SEQ ID NO: 772830 - RNA, 22 nt, Listeria monocytogenes EGD-e
gcacguuuuaguggagcucuuu

SEQ ID NO: 772831 - RNA, 17 nt, Listeria monocytogenes EGD-e
cuuuuaaagcuuuuaaa

SEQ ID NO: 772832 - RNA, 21 nt, Listeria monocytogenes EGD-e
cuuugaaaacugaacaaagaa

SEQ ID NO: 772833 - RNA, 14 nt, Listeria monocytogenes EGD-e
cuuucuuuuuuaau

SEQ ID NO: 772834 - RNA, 15 nt, Listeria monocytogenes EGD-e
cuuugucuuaaauga

SEQ ID NO: 772835 - RNA, 20 nt, Listeria monocytogenes EGD-e
cuuugucaucauaaacauuu

SEQ ID NO: 772836 - RNA, 21 nt, Listeria monocytogenes EGD-e
cuuuguauacuucaaaaccuu

SEQ ID NO: 772837 - RNA, 13 nt, Listeria monocytogenes EGD-e
cuuuuccaaaaug

SEQ ID NO: 772838 - RNA, 18 nt, Listeria monocytogenes EGD-e
cuuuuccaaaauggccaa

SEQ ID NO: 772839 - RNA, 19 nt, Listeria monocytogenes EGD-e
cuuuuccuagaacuaauuc

SEQ ID NO: 772840 - RNA, 19 nt, Listeria monocytogenes EGD-e
cuuuuauaaaaauacauuu

SEQ ID NO: 772841 - RNA, 12 nt, Listeria monocytogenes EGD-e
cuuuuaucuucc

SEQ ID NO: 772842 - RNA, 20 nt, Listeria monocytogenes EGD-e
cuuuuauugcacuauuuggu

SEQ ID NO: 772843 - RNA, 16 nt, Listeria monocytogenes EGD-e
cuuuuacggcuucaau

SEQ ID NO: 772844 - RNA, 14 nt, Listeria monocytogenes EGD-e
cuuuuguuuuaaua

SEQ ID NO: 772845 - RNA, 23 nt, Listeria monocytogenes EGD-e
cuuuuugauuaggcauuucuuug

SEQ ID NO: 772846 - RNA, 20 nt, Listeria monocytogenes EGD-e
cuuuuucugaguagaaaguu

SEQ ID NO: 772847 - RNA, 22 nt, Listeria monocytogenes EGD-e
cuuuuucgauuaauauacuuua

SEQ ID NO: 772848 - RNA, 19 nt, Listeria monocytogenes EGD-e
cuuuuucaaguaaaaacaa

SEQ ID NO: 772849 - RNA, 17 nt, Listeria monocytogenes EGD-e
cuuuuuagaaugaagau

SEQ ID NO: 772850 - RNA, 23 nt, Listeria monocytogenes EGD-e
gaaaaaccgagaaaucucaugaa

SEQ ID NO: 772851 - RNA, 16 nt, Listeria monocytogenes EGD-e
cuuuuuuuauuuugcg

SEQ ID NO: 772852 - RNA, 17 nt, Listeria monocytogenes EGD-e
cuuuuuucgaugauaau

SEQ ID NO: 772853 - RNA, 10 nt, Listeria monocytogenes EGD-e
cuuuuuuccu

SEQ ID NO: 772854 - RNA, 11 nt, Listeria monocytogenes EGD-e
cuuuuuuccuu

SEQ ID NO: 772855 - RNA, 22 nt, Listeria monocytogenes EGD-e
gaaaaauguuugcaucccauaa

SEQ ID NO: 772856 - RNA, 22 nt, Listeria monocytogenes EGD-e
gaaaaaguuguuucuaauccag

SEQ ID NO: 772857 - RNA, 24 nt, Listeria monocytogenes EGD-e
gaaaaaugauucuaguuuguccca

SEQ ID NO: 772858 - RNA, 17 nt, Listeria monocytogenes EGD-e
gaaaaaucauuaaauuu

SEQ ID NO: 772859 - RNA, 14 nt, Listeria monocytogenes EGD-e
gaaaacugaacaaa

SEQ ID NO: 772860 - RNA, 18 nt, Listeria monocytogenes EGD-e
gaaaacugaacaaagaag

SEQ ID NO: 772861 - RNA, 20 nt, Listeria monocytogenes EGD-e
gaaaacugaacaaagaagaa

SEQ ID NO: 772862 - RNA, 22 nt, Listeria monocytogenes EGD-e
gaaaaugagcccaaaaauaagu

SEQ ID NO: 772863 - RNA, 22 nt, Listeria monocytogenes EGD-e
gaaacaaaguauugugcuaagu

SEQ ID NO: 772864 - RNA, 20 nt, Listeria monocytogenes EGD-e
gaaaauuggauuauucaauu

SEQ ID NO: 772865 - RNA, 20 nt, Listeria monocytogenes EGD-e
gaaaccaucgcaaaagcaaa

SEQ ID NO: 772866 - RNA, 21 nt, Listeria monocytogenes EGD-e
gaaaccaucgcaaaagcaaac

SEQ ID NO: 772867 - RNA, 19 nt, Listeria monocytogenes EGD-e
gaaaccauuccguugaaag

SEQ ID NO: 772868 - RNA, 18 nt, Listeria monocytogenes EGD-e
gaaacgacauccuucagc

SEQ ID NO: 772869 - RNA, 16 nt, Listeria monocytogenes EGD-e
gaaagaauaaaacaaa

SEQ ID NO: 772870 - RNA, 18 nt, Listeria monocytogenes EGD-e
gaaauaucaccauuacua

SEQ ID NO: 772871 - RNA, 16 nt, Listeria monocytogenes EGD-e
gaaaguuucgaaguga

SEQ ID NO: 772872 - RNA, 19 nt, Listeria monocytogenes EGD-e
gaaagugcgcuuauuuuuu

SEQ ID NO: 772873 - RNA, 15 nt, Listeria monocytogenes EGD-e
gaaaguuucuuuuug

SEQ ID NO: 772874 - RNA, 17 nt, Listeria monocytogenes EGD-e
gaaauaaccauuccauc

SEQ ID NO: 772875 - RNA, 13 nt, Listeria monocytogenes EGD-e
gaaagcaaaugca

SEQ ID NO: 772876 - RNA, 18 nt, Listeria monocytogenes EGD-e
gaaagcaaaugcauuucu

SEQ ID NO: 772877 - RNA, 19 nt, Listeria monocytogenes EGD-e
gaaauggauugcagguaau

SEQ ID NO: 772878 - RNA, 22 nt, Listeria monocytogenes EGD-e
gaacaacaugcguaaacuuuug

SEQ ID NO: 772879 - RNA, 14 nt, Listeria monocytogenes EGD-e
gaaauuaaagguaa

SEQ ID NO: 772880 - RNA, 21 nt, Listeria monocytogenes EGD-e
gaaauuaaauuuuuuugaaaa

SEQ ID NO: 772881 - RNA, 22 nt, Listeria monocytogenes EGD-e
gaaauuaaauuuuuuugaaaaa

SEQ ID NO: 772882 - RNA, 17 nt, Listeria monocytogenes EGD-e
gaacacccgguccuuca

SEQ ID NO: 772883 - RNA, 16 nt, Listeria monocytogenes EGD-e
gaaccaagcacauccg

SEQ ID NO: 772884 - RNA, 16 nt, Listeria monocytogenes EGD-e
gaauauggacauacuu

SEQ ID NO: 772885 - RNA, 18 nt, Listeria monocytogenes EGD-e
gaauagagcuuuuaaaua

SEQ ID NO: 772886 - RNA, 15 nt, Listeria monocytogenes EGD-e
gaauacuguuuuuga

SEQ ID NO: 772887 - RNA, 18 nt, Listeria monocytogenes EGD-e
gaauagcauaauagaaag

SEQ ID NO: 772888 - RNA, 15 nt, Listeria monocytogenes EGD-e
gaauaagaaauuacc

SEQ ID NO: 772889 - RNA, 21 nt, Listeria monocytogenes EGD-e
gaauaagcaucggucaaaucu

SEQ ID NO: 772890 - RNA, 18 nt, Listeria monocytogenes EGD-e
gaauaaauugcucgauuu

SEQ ID NO: 772891 - RNA, 14 nt, Listeria monocytogenes EGD-e
gaauaacuuuccag

SEQ ID NO: 772892 - RNA, 20 nt, Listeria monocytogenes EGD-e
gaauaaccaaucauggaaac

SEQ ID NO: 772893 - RNA, 20 nt, Listeria monocytogenes EGD-e
gaauaccauuguagcucauu

SEQ ID NO: 772894 - RNA, 20 nt, Listeria monocytogenes EGD-e
gaaguacaauaaaguuaacu

SEQ ID NO: 772895 - RNA, 15 nt, Listeria monocytogenes EGD-e
gaauaaaaucauaau

SEQ ID NO: 772896 - RNA, 16 nt, Listeria monocytogenes EGD-e
gaaucagagaaaccgc

SEQ ID NO: 772897 - RNA, 22 nt, Listeria monocytogenes EGD-e
gaauccaaacacgaacauacca

SEQ ID NO: 772898 - RNA, 18 nt, Listeria monocytogenes EGD-e
gaaugaacuucaccacuu

SEQ ID NO: 772899 - RNA, 14 nt, Listeria monocytogenes EGD-e
gaauguuaaauuca

SEQ ID NO: 772900 - RNA, 18 nt, Listeria monocytogenes EGD-e
gaaugcgguaacuaaaau

SEQ ID NO: 772901 - RNA, 13 nt, Listeria monocytogenes EGD-e
gaauucuuuuucu

SEQ ID NO: 772902 - RNA, 18 nt, Listeria monocytogenes EGD-e
gaauucguuauuuccuuc

SEQ ID NO: 772903 - RNA, 12 nt, Listeria monocytogenes EGD-e
gaauugauuuuu

SEQ ID NO: 772904 - RNA, 11 nt, Listeria monocytogenes EGD-e
gaauugcuucu

SEQ ID NO: 772905 - RNA, 22 nt, Listeria monocytogenes EGD-e
gaauuccacgcggcauuucaau

SEQ ID NO: 772906 - RNA, 18 nt, Listeria monocytogenes EGD-e
gaauuccugcuaaaacca

SEQ ID NO: 772907 - RNA, 18 nt, Listeria monocytogenes EGD-e
gaauuaagaaguacaaua

SEQ ID NO: 772908 - RNA, 13 nt, Listeria monocytogenes EGD-e
gaacccuuugaau

SEQ ID NO: 772909 - RNA, 23 nt, Listeria monocytogenes EGD-e
gaacgauaaagcgguaucccuca

SEQ ID NO: 772910 - RNA, 16 nt, Listeria monocytogenes EGD-e
gaaccuucaagcauau

SEQ ID NO: 772911 - RNA, 19 nt, Listeria monocytogenes EGD-e
gaacgaauccuuggaaaaa

SEQ ID NO: 772912 - RNA, 20 nt, Listeria monocytogenes EGD-e
gaacuagauuuaauaaauua

SEQ ID NO: 772913 - RNA, 14 nt, Listeria monocytogenes EGD-e
gaacuucaccacuu

SEQ ID NO: 772914 - RNA, 20 nt, Listeria monocytogenes EGD-e
gaacuucaccacuucuucca

SEQ ID NO: 772915 - RNA, 19 nt, Listeria monocytogenes EGD-e
gaacugcggcuaauaacau

SEQ ID NO: 772916 - RNA, 22 nt, Listeria monocytogenes EGD-e
gaagcuuccuuuaucauucaau

SEQ ID NO: 772917 - RNA, 14 nt, Listeria monocytogenes EGD-e
gaagcgaugauuuu

SEQ ID NO: 772918 - RNA, 19 nt, Listeria monocytogenes EGD-e
gaagccggggacuuggggu

SEQ ID NO: 772919 - RNA, 18 nt, Listeria monocytogenes EGD-e
gaagaugcacuagaaaaa

SEQ ID NO: 772920 - RNA, 19 nt, Listeria monocytogenes EGD-e
gaagaugcacuagaaaaau

SEQ ID NO: 772921 - RNA, 17 nt, Listeria monocytogenes EGD-e
cuucuuccauuuguucu

SEQ ID NO: 772922 - RNA, 15 nt, Listeria monocytogenes EGD-e
cuucugucacaucug

SEQ ID NO: 772923 - RNA, 15 nt, Listeria monocytogenes EGD-e
cuucuguuuuuucuu

SEQ ID NO: 772924 - RNA, 23 nt, Listeria monocytogenes EGD-e
cuugaaaaauuucaucguuuucu

SEQ ID NO: 772925 - RNA, 14 nt, Listeria monocytogenes EGD-e
cuucuuuuuucuuc

SEQ ID NO: 772926 - RNA, 15 nt, Listeria monocytogenes EGD-e
cuugauuuaaauaaa

SEQ ID NO: 772927 - RNA, 19 nt, Listeria monocytogenes EGD-e
cuugauuuaauuguaauuc

SEQ ID NO: 772928 - RNA, 20 nt, Listeria monocytogenes EGD-e
cuugauuuaauuguaauucc

SEQ ID NO: 772929 - RNA, 20 nt, Listeria monocytogenes EGD-e
cuuguuuugucgauaguuca

SEQ ID NO: 772930 - RNA, 21 nt, Listeria monocytogenes EGD-e
cuuguuuugucgauaguucac

SEQ ID NO: 772931 - RNA, 19 nt, Listeria monocytogenes EGD-e
cuuguuuagcugcuacgau

SEQ ID NO: 772932 - RNA, 19 nt, Listeria monocytogenes EGD-e
cuuuaaaaacaguuucuuu

SEQ ID NO: 772933 - RNA, 18 nt, Listeria monocytogenes EGD-e
cuugugugguguuuuuug

SEQ ID NO: 772934 - RNA, 15 nt, Listeria monocytogenes EGD-e
cuugucuugcaagag

SEQ ID NO: 772935 - RNA, 19 nt, Listeria monocytogenes EGD-e
cuuggaacggcuuuauccc

SEQ ID NO: 772936 - RNA, 23 nt, Listeria monocytogenes EGD-e
cuuguaacugugcggaaaucuug

SEQ ID NO: 772937 - RNA, 17 nt, Listeria monocytogenes EGD-e
cuuguaagaagcuuuua

SEQ ID NO: 772938 - RNA, 19 nt, Listeria monocytogenes EGD-e
cuuuaccuugaucaaaauu

SEQ ID NO: 772939 - RNA, 17 nt, Listeria monocytogenes EGD-e
cuuuaucauucaaugag

SEQ ID NO: 772940 - RNA, 16 nt, Listeria monocytogenes EGD-e
cuuuccccuuuuuaga

SEQ ID NO: 772941 - RNA, 19 nt, Listeria monocytogenes EGD-e
cuucauuagacaaaaagaa

SEQ ID NO: 772942 - RNA, 13 nt, Listeria monocytogenes EGD-e
cuuccauauuuuc

SEQ ID NO: 772943 - RNA, 14 nt, Listeria monocytogenes EGD-e
cuuccauauuuucu

SEQ ID NO: 772944 - RNA, 15 nt, Listeria monocytogenes EGD-e
cuuccauuuguucuc

SEQ ID NO: 772945 - RNA, 17 nt, Listeria monocytogenes EGD-e
cuucgccaccuucaauu

SEQ ID NO: 772946 - RNA, 16 nt, Listeria monocytogenes EGD-e
cuucauaauuauuuuu

SEQ ID NO: 772947 - RNA, 17 nt, Listeria monocytogenes EGD-e
cuuauuaacuaauaacc

SEQ ID NO: 772948 - RNA, 14 nt, Listeria monocytogenes EGD-e
cuuauuaaacauac

SEQ ID NO: 772949 - RNA, 20 nt, Listeria monocytogenes EGD-e
cuuauuauaaccccaaaaug

SEQ ID NO: 772950 - RNA, 21 nt, Listeria monocytogenes EGD-e
cuuauuauaaccccaaaaugc

SEQ ID NO: 772951 - RNA, 20 nt, Listeria monocytogenes EGD-e
cuuauuaauuauggcauaaa

SEQ ID NO: 772952 - RNA, 22 nt, Listeria monocytogenes EGD-e
cuuauuaauuauggcauaaaaa

SEQ ID NO: 772953 - RNA, 13 nt, Listeria monocytogenes EGD-e
cuuauuaauagua

SEQ ID NO: 772954 - RNA, 14 nt, Listeria monocytogenes EGD-e
cuuaucucuucauu

SEQ ID NO: 772955 - RNA, 20 nt, Listeria monocytogenes EGD-e
cuucacgugcugcuuuccuu

SEQ ID NO: 772956 - RNA, 21 nt, Listeria monocytogenes EGD-e
cuucacgugcugcuuuccuug

SEQ ID NO: 772957 - RNA, 17 nt, Listeria monocytogenes EGD-e
cuuacugcaaucauuua

SEQ ID NO: 772958 - RNA, 23 nt, Listeria monocytogenes EGD-e
cuuacugcaaucauuuauuuucc

SEQ ID NO: 772959 - RNA, 17 nt, Listeria monocytogenes EGD-e
cuuacuauuuucuaauc

SEQ ID NO: 772960 - RNA, 19 nt, Listeria monocytogenes EGD-e
cuuauaugaaaacuuaucu

SEQ ID NO: 772961 - RNA, 14 nt, Listeria monocytogenes EGD-e
cuuaaauacgaaaa

SEQ ID NO: 772962 - RNA, 15 nt, Listeria monocytogenes EGD-e
cuuaaauaaaaacua

SEQ ID NO: 772963 - RNA, 16 nt, Listeria monocytogenes EGD-e
cuuaauccaauuucug

SEQ ID NO: 772964 - RNA, 15 nt, Listeria monocytogenes EGD-e
cuguuguuuaauaug

SEQ ID NO: 772965 - RNA, 14 nt, Listeria monocytogenes EGD-e
cuguugcuaacaca

SEQ ID NO: 772966 - RNA, 20 nt, Listeria monocytogenes EGD-e
cuguucugauugguccugcu

SEQ ID NO: 772967 - RNA, 18 nt, Listeria monocytogenes EGD-e
cuguuuucaacaaaacaa

SEQ ID NO: 772968 - RNA, 19 nt, Listeria monocytogenes EGD-e
cuguuuucaacaaaacaaa

SEQ ID NO: 772969 - RNA, 18 nt, Listeria monocytogenes EGD-e
cuguuuccccgucuaaga

SEQ ID NO: 772970 - RNA, 18 nt, Listeria monocytogenes EGD-e
cuuaaaauaaaaaaauac

SEQ ID NO: 772971 - RNA, 19 nt, Listeria monocytogenes EGD-e
cugcuuuuucaaguaaaaa

SEQ ID NO: 772972 - RNA, 14 nt, Listeria monocytogenes EGD-e
cugcuuuccuugcu

SEQ ID NO: 772973 - RNA, 23 nt, Listeria monocytogenes EGD-e
cugcuacgccgguaccaucuuuu

SEQ ID NO: 772974 - RNA, 17 nt, Listeria monocytogenes EGD-e
cuggauaaagaccuaaa

SEQ ID NO: 772975 - RNA, 16 nt, Listeria monocytogenes EGD-e
cuggcaacuucaaaau

SEQ ID NO: 772976 - RNA, 18 nt, Listeria monocytogenes EGD-e
cuguaauucgaauaagaa

SEQ ID NO: 772977 - RNA, 13 nt, Listeria monocytogenes EGD-e
cuguaaaaauaaa

SEQ ID NO: 772978 - RNA, 14 nt, Listeria monocytogenes EGD-e
cuguaaaaauaaau

SEQ ID NO: 772979 - RNA, 12 nt, Listeria monocytogenes EGD-e
cuguauuaaucc

SEQ ID NO: 772980 - RNA, 13 nt, Listeria monocytogenes EGD-e
cugccguaugucc

SEQ ID NO: 772981 - RNA, 14 nt, Listeria monocytogenes EGD-e
cugccguaugucca

SEQ ID NO: 772982 - RNA, 16 nt, Listeria monocytogenes EGD-e
cugccaccacuuauag

SEQ ID NO: 772983 - RNA, 20 nt, Listeria monocytogenes EGD-e
cugcuaaaggcaacaaagaa

SEQ ID NO: 772984 - RNA, 12 nt, Listeria monocytogenes EGD-e
cugauuuauuau

SEQ ID NO: 772985 - RNA, 21 nt, Listeria monocytogenes EGD-e
cugcaaucauuuauuuucccu

SEQ ID NO: 772986 - RNA, 17 nt, Listeria monocytogenes EGD-e
cucauuuuucuugcugg

SEQ ID NO: 772987 - RNA, 14 nt, Listeria monocytogenes EGD-e
cuccuaauuguuuu

SEQ ID NO: 772988 - RNA, 14 nt, Listeria monocytogenes EGD-e
cuccauugcccagc

SEQ ID NO: 772989 - RNA, 23 nt, Listeria monocytogenes EGD-e
cuccugccguauguccagucacu

SEQ ID NO: 772990 - RNA, 14 nt, Listeria monocytogenes EGD-e
cucgaguauaugcu

SEQ ID NO: 772991 - RNA, 22 nt, Listeria monocytogenes EGD-e
cucgagauaaauuacugaauaa

SEQ ID NO: 772992 - RNA, 15 nt, Listeria monocytogenes EGD-e
cucgcaaaaaauaau

SEQ ID NO: 772993 - RNA, 18 nt, Listeria monocytogenes EGD-e
cucgcucuguuucauuuu

SEQ ID NO: 772994 - RNA, 23 nt, Listeria monocytogenes EGD-e
cuaauagcagagcuccaauaaua

SEQ ID NO: 772995 - RNA, 15 nt, Listeria monocytogenes EGD-e
cuacgacgcuuuagc

SEQ ID NO: 772996 - RNA, 23 nt, Listeria monocytogenes EGD-e
cuacuaauuguuaccgcauuuuu

SEQ ID NO: 772997 - RNA, 21 nt, Listeria monocytogenes EGD-e
cuacuaucaugacuaaaaagc

SEQ ID NO: 772998 - RNA, 18 nt, Listeria monocytogenes EGD-e
cuacuaucgguuguuccu

SEQ ID NO: 772999 - RNA, 12 nt, Listeria monocytogenes EGD-e
cuagcaauuucg

SEQ ID NO: 773000 - RNA, 17 nt, Listeria monocytogenes EGD-e
cuagcaucagcuuuuuu

SEQ ID NO: 773001 - RNA, 19 nt, Listeria monocytogenes EGD-e
cuagccagacaucuuugcc

SEQ ID NO: 773002 - RNA, 20 nt, Listeria monocytogenes EGD-e
cuauaacaaagcguuuuuua

SEQ ID NO: 773003 - RNA, 16 nt, Listeria monocytogenes EGD-e
cuauacauugaaaaaa

SEQ ID NO: 773004 - RNA, 20 nt, Listeria monocytogenes EGD-e
cucaagugaacguacaacua

SEQ ID NO: 773005 - RNA, 20 nt, Listeria monocytogenes EGD-e
cuauuuuuuugcuuuuuaag

SEQ ID NO: 773006 - RNA, 13 nt, Listeria monocytogenes EGD-e
cuauuuaaauaua

SEQ ID NO: 773007 - RNA, 18 nt, Listeria monocytogenes EGD-e
cuauuuaucaaacaaaaa

SEQ ID NO: 773008 - RNA, 23 nt, Listeria monocytogenes EGD-e
cuauuucagcuaaucguuuuaaa

SEQ ID NO: 773009 - RNA, 23 nt, Listeria monocytogenes EGD-e
cucauauuuggccaauuaaaaua

SEQ ID NO: 773010 - RNA, 19 nt, Listeria monocytogenes EGD-e
cucaucaagaaauuaaauu

SEQ ID NO: 773011 - RNA, 22 nt, Listeria monocytogenes EGD-e
cucauguucaaucucaucacca

SEQ ID NO: 773012 - RNA, 16 nt, Listeria monocytogenes EGD-e
cucaggaguuaauucu

SEQ ID NO: 773013 - RNA, 20 nt, Listeria monocytogenes EGD-e
cgugcuaauucuguuaaaug

SEQ ID NO: 773014 - RNA, 22 nt, Listeria monocytogenes EGD-e
cguuccaguuaaacaaacacaa

SEQ ID NO: 773015 - RNA, 17 nt, Listeria monocytogenes EGD-e
cuaaauuaauuugacca

SEQ ID NO: 773016 - RNA, 24 nt, Listeria monocytogenes EGD-e
cuaaaucuuuucgaaucguacuuu

SEQ ID NO: 773017 - RNA, 18 nt, Listeria monocytogenes EGD-e
cuaacaauuuauacacau

SEQ ID NO: 773018 - RNA, 12 nt, Listeria monocytogenes EGD-e
cuaacauuaauu

SEQ ID NO: 773019 - RNA, 20 nt, Listeria monocytogenes EGD-e
cuaaauugauaccaaauugu

SEQ ID NO: 773020 - RNA, 19 nt, Listeria monocytogenes EGD-e
cuaaauugugaaauuuuua

SEQ ID NO: 773021 - RNA, 15 nt, Listeria monocytogenes EGD-e
cuaacaacaagcaaa

SEQ ID NO: 773022 - RNA, 19 nt, Listeria monocytogenes EGD-e
cuaagaaugaacgaagagc

SEQ ID NO: 773023 - RNA, 15 nt, Listeria monocytogenes EGD-e
cuaagaaaaaaaguu

SEQ ID NO: 773024 - RNA, 21 nt, Listeria monocytogenes EGD-e
cuaagaaaaaaaguuauauuu

SEQ ID NO: 773025 - RNA, 16 nt, Listeria monocytogenes EGD-e
cuaagcauuauaaaaa

SEQ ID NO: 773026 - RNA, 14 nt, Listeria monocytogenes EGD-e
cuaaguuaaaccau

SEQ ID NO: 773027 - RNA, 15 nt, Listeria monocytogenes EGD-e
cuaacgcuuuuucag

SEQ ID NO: 773028 - RNA, 19 nt, Listeria monocytogenes EGD-e
cuaaaacaggcguaauaaa

SEQ ID NO: 773029 - RNA, 20 nt, Listeria monocytogenes EGD-e
cuaaaacaggcguaauaaau

SEQ ID NO: 773030 - RNA, 19 nt, Listeria monocytogenes EGD-e
cuaaaaaauauugaauaga

SEQ ID NO: 773031 - RNA, 19 nt, Listeria monocytogenes EGD-e
cguuuaaagcguuuuucug

SEQ ID NO: 773032 - RNA, 14 nt, Listeria monocytogenes EGD-e
cgucuuagaaaaau

SEQ ID NO: 773033 - RNA, 24 nt, Listeria monocytogenes EGD-e
cgucuuuucaacuccccagugaaa

SEQ ID NO: 773034 - RNA, 17 nt, Listeria monocytogenes EGD-e
cgcguucauucgguaag

SEQ ID NO: 773035 - RNA, 22 nt, Listeria monocytogenes EGD-e
cgcuccguauuuauauucuucu

SEQ ID NO: 773036 - RNA, 21 nt, Listeria monocytogenes EGD-e
cggagacaguuuguauaagag

SEQ ID NO: 773037 - RNA, 12 nt, Listeria monocytogenes EGD-e
cgcuuugguucc

SEQ ID NO: 773038 - RNA, 15 nt, Listeria monocytogenes EGD-e
cgcugccuuaagcaa

SEQ ID NO: 773039 - RNA, 20 nt, Listeria monocytogenes EGD-e
cggcauuucaaucgcagcag

SEQ ID NO: 773040 - RNA, 22 nt, Listeria monocytogenes EGD-e
cgggaacgaauccuuggaaaaa

SEQ ID NO: 773041 - RNA, 12 nt, Listeria monocytogenes EGD-e
cggguuuuaaaa

SEQ ID NO: 773042 - RNA, 13 nt, Listeria monocytogenes EGD-e
cgguaccaucuuu

SEQ ID NO: 773043 - RNA, 23 nt, Listeria monocytogenes EGD-e
cgguaccaucuuuuaucuucccc

SEQ ID NO: 773044 - RNA, 17 nt, Listeria monocytogenes EGD-e
cggggacuugggguacu

SEQ ID NO: 773045 - RNA, 21 nt, Listeria monocytogenes EGD-e
cguaagaugcgcauguuuuua

SEQ ID NO: 773046 - RNA, 15 nt, Listeria monocytogenes EGD-e
cgguuuuguuuccaa

SEQ ID NO: 773047 - RNA, 21 nt, Listeria monocytogenes EGD-e
cguaauauauucaaaauggua

SEQ ID NO: 773048 - RNA, 20 nt, Listeria monocytogenes EGD-e
cguacaugaugauuguucuu

SEQ ID NO: 773049 - RNA, 21 nt, Listeria monocytogenes EGD-e
cccuuuuuuuacauuuuugcu

SEQ ID NO: 773050 - RNA, 15 nt, Listeria monocytogenes EGD-e
ccgcaaauucaugca

SEQ ID NO: 773051 - RNA, 19 nt, Listeria monocytogenes EGD-e
ccgaaucgaguuuuuauuc

SEQ ID NO: 773052 - RNA, 15 nt, Listeria monocytogenes EGD-e
ccgccuauuauuucu

SEQ ID NO: 773053 - RNA, 17 nt, Listeria monocytogenes EGD-e
ccgccuauuauuucugc

SEQ ID NO: 773054 - RNA, 23 nt, Listeria monocytogenes EGD-e
ccggacuuaguauuucagcaaga

SEQ ID NO: 773055 - RNA, 22 nt, Listeria monocytogenes EGD-e
ccggcguacuuaaaucacuucu

SEQ ID NO: 773056 - RNA, 20 nt, Listeria monocytogenes EGD-e
ccgguccuucaaucggaaca

SEQ ID NO: 773057 - RNA, 22 nt, Listeria monocytogenes EGD-e
ccgucuccaccaaguucuguug

SEQ ID NO: 773058 - RNA, 13 nt, Listeria monocytogenes EGD-e
ccgguuuggaugu

SEQ ID NO: 773059 - RNA, 22 nt, Listeria monocytogenes EGD-e
ccguucauuugaaaaagggcug

SEQ ID NO: 773060 - RNA, 19 nt, Listeria monocytogenes EGD-e
ccucauuacucgguucaau

SEQ ID NO: 773061 - RNA, 18 nt, Listeria monocytogenes EGD-e
ccucaucugagaagccag

SEQ ID NO: 773062 - RNA, 20 nt, Listeria monocytogenes EGD-e
ccugaaacauagucagggaa

SEQ ID NO: 773063 - RNA, 19 nt, Listeria monocytogenes EGD-e
ccugaauaagucgaaagug

SEQ ID NO: 773064 - RNA, 14 nt, Listeria monocytogenes EGD-e
ccugcauuucauuu

SEQ ID NO: 773065 - RNA, 16 nt, Listeria monocytogenes EGD-e
ccugguaaauagccaa

SEQ ID NO: 773066 - RNA, 20 nt, Listeria monocytogenes EGD-e
ccugcgucuucuacuuuuac

SEQ ID NO: 773067 - RNA, 20 nt, Listeria monocytogenes EGD-e
ccuggauuuucuagguucuu

SEQ ID NO: 773068 - RNA, 15 nt, Listeria monocytogenes EGD-e
cgacguuuaucaaua

SEQ ID NO: 773069 - RNA, 19 nt, Listeria monocytogenes EGD-e
cgaguacaauuauaguuug

SEQ ID NO: 773070 - RNA, 17 nt, Listeria monocytogenes EGD-e
cgaguugcuuuagaaua

SEQ ID NO: 773071 - RNA, 13 nt, Listeria monocytogenes EGD-e
cgaguuuuuauuc

SEQ ID NO: 773072 - RNA, 12 nt, Listeria monocytogenes EGD-e
cgauaacguguu

SEQ ID NO: 773073 - RNA, 15 nt, Listeria monocytogenes EGD-e
cgauaccaaaguugu

SEQ ID NO: 773074 - RNA, 16 nt, Listeria monocytogenes EGD-e
cgauacaacaaaauaa

SEQ ID NO: 773075 - RNA, 21 nt, Listeria monocytogenes EGD-e
cgauaauuuucauuuguuucu

SEQ ID NO: 773076 - RNA, 12 nt, Listeria monocytogenes EGD-e
cgauguuaccac

SEQ ID NO: 773077 - RNA, 20 nt, Listeria monocytogenes EGD-e
cgauugucguuaguaaguuc

SEQ ID NO: 773078 - RNA, 15 nt, Listeria monocytogenes EGD-e
cgauugcuucaccaa

SEQ ID NO: 773079 - RNA, 15 nt, Listeria monocytogenes EGD-e
cgauuucugcagaau

SEQ ID NO: 773080 - RNA, 17 nt, Listeria monocytogenes EGD-e
cgcacguuuuaguggag

SEQ ID NO: 773081 - RNA, 17 nt, Listeria monocytogenes EGD-e
cgcaacauucaaaucac

SEQ ID NO: 773082 - RNA, 17 nt, Listeria monocytogenes EGD-e
cgcauugauuuuugaau

SEQ ID NO: 773083 - RNA, 15 nt, Listeria monocytogenes EGD-e
cgcaucugcuaauac

SEQ ID NO: 773084 - RNA, 14 nt, Listeria monocytogenes EGD-e
cgcaucuucguaua

SEQ ID NO: 773085 - RNA, 19 nt, Listeria monocytogenes EGD-e
cgcaucuucguauauuuua

SEQ ID NO: 773086 - RNA, 19 nt, Listeria monocytogenes EGD-e
ccuucgauuguagcuucuc

SEQ ID NO: 773087 - RNA, 14 nt, Listeria monocytogenes EGD-e
ccuugaucaaaauu

SEQ ID NO: 773088 - RNA, 21 nt, Listeria monocytogenes EGD-e
ccuugcugcucgcucaucauc

SEQ ID NO: 773089 - RNA, 21 nt, Listeria monocytogenes EGD-e
ccuugcucccgcgcuaaucuu

SEQ ID NO: 773090 - RNA, 21 nt, Listeria monocytogenes EGD-e
ccuuuguuacgggugagcuuc

SEQ ID NO: 773091 - RNA, 20 nt, Listeria monocytogenes EGD-e
ccuuugucaucauaaacauu

SEQ ID NO: 773092 - RNA, 12 nt, Listeria monocytogenes EGD-e
ccuuuauuuuuu

SEQ ID NO: 773093 - RNA, 12 nt, Listeria monocytogenes EGD-e
cgaaacaacugc

SEQ ID NO: 773094 - RNA, 22 nt, Listeria monocytogenes EGD-e
cgaaaaaucauuaaauuuagcu

SEQ ID NO: 773095 - RNA, 11 nt, Listeria monocytogenes EGD-e
ccuuuuuucau

SEQ ID NO: 773096 - RNA, 15 nt, Listeria monocytogenes EGD-e
cgaaagaauaaaaca

SEQ ID NO: 773097 - RNA, 16 nt, Listeria monocytogenes EGD-e
cgaaaguuucuuuuug

SEQ ID NO: 773098 - RNA, 21 nt, Listeria monocytogenes EGD-e
cgaaccccaauugcgccuaga

SEQ ID NO: 773099 - RNA, 16 nt, Listeria monocytogenes EGD-e
cgacaguuucuuuuug

SEQ ID NO: 773100 - RNA, 13 nt, Listeria monocytogenes EGD-e
cgaacuagcauca

SEQ ID NO: 773101 - RNA, 17 nt, Listeria monocytogenes EGD-e
cgaauaaaaucauaaua

SEQ ID NO: 773102 - RNA, 18 nt, Listeria monocytogenes EGD-e
cgaauaaaaucauaauag

SEQ ID NO: 773103 - RNA, 14 nt, Listeria monocytogenes EGD-e
cgaauagcauaaua

SEQ ID NO: 773104 - RNA, 14 nt, Listeria monocytogenes EGD-e
cgaauaccagcagu

SEQ ID NO: 773105 - RNA, 14 nt, Listeria monocytogenes EGD-e
cgaauaaagaacuu

SEQ ID NO: 773106 - RNA, 11 nt, Listeria monocytogenes EGD-e
cgaauaagaac

SEQ ID NO: 773107 - RNA, 23 nt, Listeria monocytogenes EGD-e
cgaauccuuuuagugucaguccu

SEQ ID NO: 773108 - RNA, 17 nt, Listeria monocytogenes EGD-e
cgaaucaagauuuugcu

SEQ ID NO: 773109 - RNA, 21 nt, Listeria monocytogenes EGD-e
cgaauuuuucaaggcuuucuu

SEQ ID NO: 773110 - RNA, 11 nt, Listeria monocytogenes EGD-e
ccaaagagaaa

SEQ ID NO: 773111 - RNA, 16 nt, Listeria monocytogenes EGD-e
ccaaagauuaucccca

SEQ ID NO: 773112 - RNA, 17 nt, Listeria monocytogenes EGD-e
ccaaaucugcgaauaac

SEQ ID NO: 773113 - RNA, 14 nt, Listeria monocytogenes EGD-e
cauuucuacaacug

SEQ ID NO: 773114 - RNA, 14 nt, Listeria monocytogenes EGD-e
ccaaaauaaaaugg

SEQ ID NO: 773115 - RNA, 17 nt, Listeria monocytogenes EGD-e
ccaacguuuuaauuugg

SEQ ID NO: 773116 - RNA, 21 nt, Listeria monocytogenes EGD-e
ccaaauuggucauauguuucg

SEQ ID NO: 773117 - RNA, 13 nt, Listeria monocytogenes EGD-e
ccaaauuguaccg

SEQ ID NO: 773118 - RNA, 18 nt, Listeria monocytogenes EGD-e
ccaaauuauaauuuaauu

SEQ ID NO: 773119 - RNA, 13 nt, Listeria monocytogenes EGD-e
ccaaguuuuuuaa

SEQ ID NO: 773120 - RNA, 22 nt, Listeria monocytogenes EGD-e
ccaagcuucccguuaaucgaaa

SEQ ID NO: 773121 - RNA, 19 nt, Listeria monocytogenes EGD-e
ccaagcggguuuucucaga

SEQ ID NO: 773122 - RNA, 20 nt, Listeria monocytogenes EGD-e
ccaagcguacggaauuuauu

SEQ ID NO: 773123 - RNA, 16 nt, Listeria monocytogenes EGD-e
ccaagcaauaacaucu

SEQ ID NO: 773124 - RNA, 18 nt, Listeria monocytogenes EGD-e
ccaauaauaguugauaua

SEQ ID NO: 773125 - RNA, 20 nt, Listeria monocytogenes EGD-e
ccaauaauaugauaaccgcu

SEQ ID NO: 773126 - RNA, 20 nt, Listeria monocytogenes EGD-e
ccaauaacgaguaauggagc

SEQ ID NO: 773127 - RNA, 22 nt, Listeria monocytogenes EGD-e
ccacaagaagggcuuuuuuccu

SEQ ID NO: 773128 - RNA, 19 nt, Listeria monocytogenes EGD-e
ccacaaacucauuacuuga

SEQ ID NO: 773129 - RNA, 22 nt, Listeria monocytogenes EGD-e
ccaauuuuacgcauaucaucaa

SEQ ID NO: 773130 - RNA, 15 nt, Listeria monocytogenes EGD-e
ccaauucacuuacuu

SEQ ID NO: 773131 - RNA, 18 nt, Listeria monocytogenes EGD-e
ccacaucgauguuaccac

SEQ ID NO: 773132 - RNA, 15 nt, Listeria monocytogenes EGD-e
ccagaaaaaaacaaa

SEQ ID NO: 773133 - RNA, 18 nt, Listeria monocytogenes EGD-e
ccacuuuugcaugaccua

SEQ ID NO: 773134 - RNA, 12 nt, Listeria monocytogenes EGD-e
ccacgugcaccu

SEQ ID NO: 773135 - RNA, 19 nt, Listeria monocytogenes EGD-e
ccacgugcaccugcauuuc

SEQ ID NO: 773136 - RNA, 17 nt, Listeria monocytogenes EGD-e
ccagaaagaauuuuuag

SEQ ID NO: 773137 - RNA, 14 nt, Listeria monocytogenes EGD-e
ccagcuugauuaaa

SEQ ID NO: 773138 - RNA, 19 nt, Listeria monocytogenes EGD-e
ccagcuuaauccaauuucu

SEQ ID NO: 773139 - RNA, 21 nt, Listeria monocytogenes EGD-e
ccaguggcugaaacaaucgcg

SEQ ID NO: 773140 - RNA, 18 nt, Listeria monocytogenes EGD-e
ccaguuaaacaaacacaa

SEQ ID NO: 773141 - RNA, 21 nt, Listeria monocytogenes EGD-e
ccaguuaaacaaacacaaaau

SEQ ID NO: 773142 - RNA, 19 nt, Listeria monocytogenes EGD-e
ccauacuagguguauagaa

SEQ ID NO: 773143 - RNA, 15 nt, Listeria monocytogenes EGD-e
ccauauaaucaauau

SEQ ID NO: 773144 - RNA, 16 nt, Listeria monocytogenes EGD-e
ccauauaaucaauauc

SEQ ID NO: 773145 - RNA, 14 nt, Listeria monocytogenes EGD-e
ccauauuuucucua

SEQ ID NO: 773146 - RNA, 17 nt, Listeria monocytogenes EGD-e
ccaucaaauuaucuagc

SEQ ID NO: 773147 - RNA, 17 nt, Listeria monocytogenes EGD-e
ccauccugauaacguau

SEQ ID NO: 773148 - RNA, 18 nt, Listeria monocytogenes EGD-e
ccaucgccgccuauuauu

SEQ ID NO: 773149 - RNA, 22 nt, Listeria monocytogenes EGD-e
ccaucugggcucguugcagaaa

SEQ ID NO: 773150 - RNA, 18 nt, Listeria monocytogenes EGD-e
ccauugcgaauaacaagc

SEQ ID NO: 773151 - RNA, 17 nt, Listeria monocytogenes EGD-e
ccauuacuuuaauuucu

SEQ ID NO: 773152 - RNA, 16 nt, Listeria monocytogenes EGD-e
cccagaaaaaaacaaa

SEQ ID NO: 773153 - RNA, 18 nt, Listeria monocytogenes EGD-e
cccagaaaaaaacaaauu

SEQ ID NO: 773154 - RNA, 22 nt, Listeria monocytogenes EGD-e
cccagcacaaguuccaaaaaua

SEQ ID NO: 773155 - RNA, 13 nt, Listeria monocytogenes EGD-e
cccaagauucuuc

SEQ ID NO: 773156 - RNA, 16 nt, Listeria monocytogenes EGD-e
cccaagauucuucuaa

SEQ ID NO: 773157 - RNA, 12 nt, Listeria monocytogenes EGD-e
cccagcuuuucc

SEQ ID NO: 773158 - RNA, 20 nt, Listeria monocytogenes EGD-e
cccauacuaaucaauaaaga

SEQ ID NO: 773159 - RNA, 20 nt, Listeria monocytogenes EGD-e
cagcgucuaaaaaugcagaa

SEQ ID NO: 773160 - RNA, 14 nt, Listeria monocytogenes EGD-e
cagcgguuguugua

SEQ ID NO: 773161 - RNA, 17 nt, Listeria monocytogenes EGD-e
cagcguauccaccaaaa

SEQ ID NO: 773162 - RNA, 14 nt, Listeria monocytogenes EGD-e
cagcugauuuuugg

SEQ ID NO: 773163 - RNA, 19 nt, Listeria monocytogenes EGD-e
cagcugauuuuugggguuu

SEQ ID NO: 773164 - RNA, 20 nt, Listeria monocytogenes EGD-e
cagcuaccacaagaagggcu

SEQ ID NO: 773165 - RNA, 13 nt, Listeria monocytogenes EGD-e
cagcuuuugucca

SEQ ID NO: 773166 - RNA, 18 nt, Listeria monocytogenes EGD-e
cagcuuuuccuagaacua

SEQ ID NO: 773167 - RNA, 16 nt, Listeria monocytogenes EGD-e
caggcugcuuggacug

SEQ ID NO: 773168 - RNA, 16 nt, Listeria monocytogenes EGD-e
caguaacgccucgaga

SEQ ID NO: 773169 - RNA, 19 nt, Listeria monocytogenes EGD-e
cagguucaccaaaugcuuc

SEQ ID NO: 773170 - RNA, 12 nt, Listeria monocytogenes EGD-e
caguuauuaaaa

SEQ ID NO: 773171 - RNA, 14 nt, Listeria monocytogenes EGD-e
caguuauuaaaagg

SEQ ID NO: 773172 - RNA, 21 nt, Listeria monocytogenes EGD-e
caguuauuaaaaggacaccca

SEQ ID NO: 773173 - RNA, 19 nt, Listeria monocytogenes EGD-e
caguuagaaccguauuuaa

SEQ ID NO: 773174 - RNA, 20 nt, Listeria monocytogenes EGD-e
caguuagaaccguauuuaau

SEQ ID NO: 773175 - RNA, 21 nt, Listeria monocytogenes EGD-e
cagugaugguauuguuuuuug

SEQ ID NO: 773176 - RNA, 18 nt, Listeria monocytogenes EGD-e
cagugaugguggaaucug

SEQ ID NO: 773177 - RNA, 20 nt, Listeria monocytogenes EGD-e
cauaagcuaacaacaagcaa

SEQ ID NO: 773178 - RNA, 12 nt, Listeria monocytogenes EGD-e
cauaaucaaaua

SEQ ID NO: 773179 - RNA, 19 nt, Listeria monocytogenes EGD-e
cauaaucccacaaaaaaua

SEQ ID NO: 773180 - RNA, 12 nt, Listeria monocytogenes EGD-e
cauaauaaugcu

SEQ ID NO: 773181 - RNA, 19 nt, Listeria monocytogenes EGD-e
cauaauaggagacauuaaa

SEQ ID NO: 773182 - RNA, 22 nt, Listeria monocytogenes EGD-e
cauaauaggagacauuaaaccg

SEQ ID NO: 773183 - RNA, 23 nt, Listeria monocytogenes EGD-e
cauaaagcuaagcauuauaaaaa

SEQ ID NO: 773184 - RNA, 12 nt, Listeria monocytogenes EGD-e
cauaaacaaaag

SEQ ID NO: 773185 - RNA, 20 nt, Listeria monocytogenes EGD-e
caugacuaaaaagcaacucu

SEQ ID NO: 773186 - RNA, 12 nt, Listeria monocytogenes EGD-e
caugaauuacuu

SEQ ID NO: 773187 - RNA, 13 nt, Listeria monocytogenes EGD-e
caugaauuuuugc

SEQ ID NO: 773188 - RNA, 19 nt, Listeria monocytogenes EGD-e
caugaauauuagaaaauca

SEQ ID NO: 773189 - RNA, 21 nt, Listeria monocytogenes EGD-e
caugaugauuguucuuuaaaa

SEQ ID NO: 773190 - RNA, 22 nt, Listeria monocytogenes EGD-e
cauguccuaggcgcucuuuaau

SEQ ID NO: 773191 - RNA, 12 nt, Listeria monocytogenes EGD-e
cauguucaaucu

SEQ ID NO: 773192 - RNA, 15 nt, Listeria monocytogenes EGD-e
cauucaaaucaccac

SEQ ID NO: 773193 - RNA, 22 nt, Listeria monocytogenes EGD-e
cauucaaaucaccacaaaggac

SEQ ID NO: 773194 - RNA, 23 nt, Listeria monocytogenes EGD-e
cauuauuuggaaucucacaauuu

SEQ ID NO: 773195 - RNA, 17 nt, Listeria monocytogenes EGD-e
cauucuuuccccuuuuu

SEQ ID NO: 773196 - RNA, 16 nt, Listeria monocytogenes EGD-e
cauucgguaaucuagu

SEQ ID NO: 773197 - RNA, 22 nt, Listeria monocytogenes EGD-e
cauugcgggcaaauucaacagu

SEQ ID NO: 773198 - RNA, 20 nt, Listeria monocytogenes EGD-e
cauuucauucuuuuuuauac

SEQ ID NO: 773199 - RNA, 14 nt, Listeria monocytogenes EGD-e
cauuuccaagucua

SEQ ID NO: 773200 - RNA, 17 nt, Listeria monocytogenes EGD-e
cauuucacaccacucuu

SEQ ID NO: 773201 - RNA, 20 nt, Listeria monocytogenes EGD-e
cauccaagcggguuuucuca

SEQ ID NO: 773202 - RNA, 22 nt, Listeria monocytogenes EGD-e
cauccaagcggguuuucucaga

SEQ ID NO: 773203 - RNA, 15 nt, Listeria monocytogenes EGD-e
caucccaacucucuu

SEQ ID NO: 773204 - RNA, 13 nt, Listeria monocytogenes EGD-e
caucgcagcagaa

SEQ ID NO: 773205 - RNA, 14 nt, Listeria monocytogenes EGD-e
caucguuuaacaua

SEQ ID NO: 773206 - RNA, 17 nt, Listeria monocytogenes EGD-e
caucguuuucuacugua

SEQ ID NO: 773207 - RNA, 12 nt, Listeria monocytogenes EGD-e
caucuaauuuag

SEQ ID NO: 773208 - RNA, 15 nt, Listeria monocytogenes EGD-e
cauaucaucaauaaa

SEQ ID NO: 773209 - RNA, 21 nt, Listeria monocytogenes EGD-e
cauaucaucaauaaaaugcac

SEQ ID NO: 773210 - RNA, 19 nt, Listeria monocytogenes EGD-e
cauauucuucuaaaauaac

SEQ ID NO: 773211 - RNA, 20 nt, Listeria monocytogenes EGD-e
caucaauuaaauuauacauu

SEQ ID NO: 773212 - RNA, 18 nt, Listeria monocytogenes EGD-e
cauagucagggaauaaga

SEQ ID NO: 773213 - RNA, 13 nt, Listeria monocytogenes EGD-e
cauaguaaaaaaa

SEQ ID NO: 773214 - RNA, 15 nt, Listeria monocytogenes EGD-e
cauaguaaaaaaacu

SEQ ID NO: 773215 - RNA, 15 nt, Listeria monocytogenes EGD-e
cauaauuauuuuugu

SEQ ID NO: 773216 - RNA, 18 nt, Listeria monocytogenes EGD-e
caauucucguaauguugc

SEQ ID NO: 773217 - RNA, 19 nt, Listeria monocytogenes EGD-e
caauucuuccacaucugaa

SEQ ID NO: 773218 - RNA, 23 nt, Listeria monocytogenes EGD-e
caauucuuccacaucugaaaaag

SEQ ID NO: 773219 - RNA, 15 nt, Listeria monocytogenes EGD-e
caauuggaacaucuu

SEQ ID NO: 773220 - RNA, 20 nt, Listeria monocytogenes EGD-e
caauuggaacaucuuuguau

SEQ ID NO: 773221 - RNA, 16 nt, Listeria monocytogenes EGD-e
caauugcuucuuuuuu

SEQ ID NO: 773222 - RNA, 22 nt, Listeria monocytogenes EGD-e
caauugcuucuuuuuucuucca

SEQ ID NO: 773223 - RNA, 22 nt, Listeria monocytogenes EGD-e
caauuacgcuuuaguuuguacu

SEQ ID NO: 773224 - RNA, 22 nt, Listeria monocytogenes EGD-e
caauuaugucggugcauuuuuu

SEQ ID NO: 773225 - RNA, 19 nt, Listeria monocytogenes EGD-e
caauuauucgcucgucaaa

SEQ ID NO: 773226 - RNA, 15 nt, Listeria monocytogenes EGD-e
caaucaguucaacua

SEQ ID NO: 773227 - RNA, 12 nt, Listeria monocytogenes EGD-e
caauuaaaauac

SEQ ID NO: 773228 - RNA, 13 nt, Listeria monocytogenes EGD-e
caauuaaaauacg

SEQ ID NO: 773229 - RNA, 17 nt, Listeria monocytogenes EGD-e
caauuaagucugcuucu

SEQ ID NO: 773230 - RNA, 22 nt, Listeria monocytogenes EGD-e
caauuuuacgcauaucaucaau

SEQ ID NO: 773231 - RNA, 22 nt, Listeria monocytogenes EGD-e
caauuuuauuugguuuugucca

SEQ ID NO: 773232 - RNA, 11 nt, Listeria monocytogenes EGD-e
caauuuugcuu

SEQ ID NO: 773233 - RNA, 13 nt, Listeria monocytogenes EGD-e
caauuucuuuuua

SEQ ID NO: 773234 - RNA, 15 nt, Listeria monocytogenes EGD-e
caauuucaaccaauu

SEQ ID NO: 773235 - RNA, 21 nt, Listeria monocytogenes EGD-e
caauuuauauuuuaaagagag

SEQ ID NO: 773236 - RNA, 15 nt, Listeria monocytogenes EGD-e
cacaaacucauuacu

SEQ ID NO: 773237 - RNA, 16 nt, Listeria monocytogenes EGD-e
cacaaacucauuacuu

SEQ ID NO: 773238 - RNA, 15 nt, Listeria monocytogenes EGD-e
cacaaacgcuuuuuc

SEQ ID NO: 773239 - RNA, 14 nt, Listeria monocytogenes EGD-e
cacaagaagggcuu

SEQ ID NO: 773240 - RNA, 18 nt, Listeria monocytogenes EGD-e
cacaaguuccaaaaauag

SEQ ID NO: 773241 - RNA, 14 nt, Listeria monocytogenes EGD-e
cacagcgcuuaaaa

SEQ ID NO: 773242 - RNA, 14 nt, Listeria monocytogenes EGD-e
cacagcaauggccg

SEQ ID NO: 773243 - RNA, 14 nt, Listeria monocytogenes EGD-e
cacauccgcaugaa

SEQ ID NO: 773244 - RNA, 15 nt, Listeria monocytogenes EGD-e
cacaucgcuucugau

SEQ ID NO: 773245 - RNA, 17 nt, Listeria monocytogenes EGD-e
cacauguccauugaugc

SEQ ID NO: 773246 - RNA, 19 nt, Listeria monocytogenes EGD-e
cacauuguagcgauucccu

SEQ ID NO: 773247 - RNA, 20 nt, Listeria monocytogenes EGD-e
cacauuguagcgauucccuu

SEQ ID NO: 773248 - RNA, 21 nt, Listeria monocytogenes EGD-e
caccacucuuuuauaaaaaua

SEQ ID NO: 773249 - RNA, 17 nt, Listeria monocytogenes EGD-e
caccaccuuugguaaaa

SEQ ID NO: 773250 - RNA, 16 nt, Listeria monocytogenes EGD-e
caccacuucuuccacc

SEQ ID NO: 773251 - RNA, 13 nt, Listeria monocytogenes EGD-e
caccaauuuuaaa

SEQ ID NO: 773252 - RNA, 14 nt, Listeria monocytogenes EGD-e
cacccauaauagca

SEQ ID NO: 773253 - RNA, 15 nt, Listeria monocytogenes EGD-e
caccaggcaaaacaa

SEQ ID NO: 773254 - RNA, 14 nt, Listeria monocytogenes EGD-e
caccgugcguuccc

SEQ ID NO: 773255 - RNA, 21 nt, Listeria monocytogenes EGD-e
caccugcauuucauuuuaauc

SEQ ID NO: 773256 - RNA, 17 nt, Listeria monocytogenes EGD-e
caccucuuguacacauu

SEQ ID NO: 773257 - RNA, 22 nt, Listeria monocytogenes EGD-e
caccuucuuuuugcuuuaaaaa

SEQ ID NO: 773258 - RNA, 15 nt, Listeria monocytogenes EGD-e
cacccgguccuucaa

SEQ ID NO: 773259 - RNA, 18 nt, Listeria monocytogenes EGD-e
cacccgguccuucaaucg

SEQ ID NO: 773260 - RNA, 13 nt, Listeria monocytogenes EGD-e
cacguuuuugcuc

SEQ ID NO: 773261 - RNA, 20 nt, Listeria monocytogenes EGD-e
cacuaacuuaucuuucaaac

SEQ ID NO: 773262 - RNA, 22 nt, Listeria monocytogenes EGD-e
cacuaauuagcauaauauccau

SEQ ID NO: 773263 - RNA, 17 nt, Listeria monocytogenes EGD-e
cacucuuuuauaaaaau

SEQ ID NO: 773264 - RNA, 21 nt, Listeria monocytogenes EGD-e
cacuaguauuccuaucacaaa

SEQ ID NO: 773265 - RNA, 15 nt, Listeria monocytogenes EGD-e
caacguguaccuuau

SEQ ID NO: 773266 - RNA, 21 nt, Listeria monocytogenes EGD-e
caagaagggcuuuuuuccuuc

SEQ ID NO: 773267 - RNA, 14 nt, Listeria monocytogenes EGD-e
caacuucuuccgcu

SEQ ID NO: 773268 - RNA, 14 nt, Listeria monocytogenes EGD-e
caagaggcuuauuc

SEQ ID NO: 773269 - RNA, 20 nt, Listeria monocytogenes EGD-e
caagaggcuuauuccuccaa

SEQ ID NO: 773270 - RNA, 21 nt, Listeria monocytogenes EGD-e
caagagcaccaauaaaaccug

SEQ ID NO: 773271 - RNA, 18 nt, Listeria monocytogenes EGD-e
caauaaugugguucguua

SEQ ID NO: 773272 - RNA, 16 nt, Listeria monocytogenes EGD-e
caauaccauguuuauu

SEQ ID NO: 773273 - RNA, 17 nt, Listeria monocytogenes EGD-e
caaucaauugguuuuac

SEQ ID NO: 773274 - RNA, 14 nt, Listeria monocytogenes EGD-e
caagauucuucuaa

SEQ ID NO: 773275 - RNA, 14 nt, Listeria monocytogenes EGD-e
caagcaaaacauuu

SEQ ID NO: 773276 - RNA, 20 nt, Listeria monocytogenes EGD-e
caagcaauaacaucuuuaaa

SEQ ID NO: 773277 - RNA, 12 nt, Listeria monocytogenes EGD-e
caaguaaaaaca

SEQ ID NO: 773278 - RNA, 12 nt, Listeria monocytogenes EGD-e
caaguaauaaga

SEQ ID NO: 773279 - RNA, 22 nt, Listeria monocytogenes EGD-e
caagugaacguacaacuaaaga

SEQ ID NO: 773280 - RNA, 17 nt, Listeria monocytogenes EGD-e
caagugugauuguucca

SEQ ID NO: 773281 - RNA, 15 nt, Listeria monocytogenes EGD-e
auuuuuauuauaaaa

SEQ ID NO: 773282 - RNA, 16 nt, Listeria monocytogenes EGD-e
auuuuucaaaucaauu

SEQ ID NO: 773283 - RNA, 10 nt, Listeria monocytogenes EGD-e
caaaaucaag

SEQ ID NO: 773284 - RNA, 13 nt, Listeria monocytogenes EGD-e
caaaauaauaaua

SEQ ID NO: 773285 - RNA, 18 nt, Listeria monocytogenes EGD-e
caaaauuacuauuuggau

SEQ ID NO: 773286 - RNA, 16 nt, Listeria monocytogenes EGD-e
caaacaaaaaaguucu

SEQ ID NO: 773287 - RNA, 21 nt, Listeria monocytogenes EGD-e
caaaaucgcauccucaaacgu

SEQ ID NO: 773288 - RNA, 16 nt, Listeria monocytogenes EGD-e
caaaaugcaaaaccuc

SEQ ID NO: 773289 - RNA, 18 nt, Listeria monocytogenes EGD-e
caaacagcuuuucuauag

SEQ ID NO: 773290 - RNA, 22 nt, Listeria monocytogenes EGD-e
caaacguuccgauacaacaaaa

SEQ ID NO: 773291 - RNA, 17 nt, Listeria monocytogenes EGD-e
caaacuaguaauuuaau

SEQ ID NO: 773292 - RNA, 18 nt, Listeria monocytogenes EGD-e
caaacgcagguucaccaa

SEQ ID NO: 773293 - RNA, 20 nt, Listeria monocytogenes EGD-e
caaaucuggauaaaaauaac

SEQ ID NO: 773294 - RNA, 18 nt, Listeria monocytogenes EGD-e
caaauucaacaguugcua

SEQ ID NO: 773295 - RNA, 22 nt, Listeria monocytogenes EGD-e
caaaugcuucgacguuuaauuc

SEQ ID NO: 773296 - RNA, 15 nt, Listeria monocytogenes EGD-e
caaauucaugcaagc

SEQ ID NO: 773297 - RNA, 12 nt, Listeria monocytogenes EGD-e
caacaaaauaau

SEQ ID NO: 773298 - RNA, 13 nt, Listeria monocytogenes EGD-e
caacaaaauaauc

SEQ ID NO: 773299 - RNA, 18 nt, Listeria monocytogenes EGD-e
caacaaaauaaucaaucc

SEQ ID NO: 773300 - RNA, 12 nt, Listeria monocytogenes EGD-e
caacaaaacaaa

SEQ ID NO: 773301 - RNA, 18 nt, Listeria monocytogenes EGD-e
caacaaagaagaaaaagu

SEQ ID NO: 773302 - RNA, 20 nt, Listeria monocytogenes EGD-e
caaagcguucaagugauaca

SEQ ID NO: 773303 - RNA, 22 nt, Listeria monocytogenes EGD-e
caaagcguuuuuuauuuuucag

SEQ ID NO: 773304 - RNA, 13 nt, Listeria monocytogenes EGD-e
caaagcuauuuuu

SEQ ID NO: 773305 - RNA, 18 nt, Listeria monocytogenes EGD-e
caaagagccauaaaauua

SEQ ID NO: 773306 - RNA, 20 nt, Listeria monocytogenes EGD-e
caaagagaaacuuuuucuca

SEQ ID NO: 773307 - RNA, 18 nt, Listeria monocytogenes EGD-e
caaauaugcuauacaaca

SEQ ID NO: 773308 - RNA, 16 nt, Listeria monocytogenes EGD-e
caaauagagccaagcu

SEQ ID NO: 773309 - RNA, 23 nt, Listeria monocytogenes EGD-e
auuuacuggcaacuucaaaauua

SEQ ID NO: 773310 - RNA, 19 nt, Listeria monocytogenes EGD-e
auuuauauuuuaaagagag

SEQ ID NO: 773311 - RNA, 15 nt, Listeria monocytogenes EGD-e
auuuaucaaacaaaa

SEQ ID NO: 773312 - RNA, 22 nt, Listeria monocytogenes EGD-e
auuuaggggcauaucuuuugag

SEQ ID NO: 773313 - RNA, 19 nt, Listeria monocytogenes EGD-e
auuuauauagaaggaauuu

SEQ ID NO: 773314 - RNA, 23 nt, Listeria monocytogenes EGD-e
auuuaauugucgaaaaccuaaau

SEQ ID NO: 773315 - RNA, 21 nt, Listeria monocytogenes EGD-e
auuuaauuugggagcuuucuu

SEQ ID NO: 773316 - RNA, 16 nt, Listeria monocytogenes EGD-e
auuguuuuuugauuuu

SEQ ID NO: 773317 - RNA, 19 nt, Listeria monocytogenes EGD-e
auuucauaaucaaauacau

SEQ ID NO: 773318 - RNA, 23 nt, Listeria monocytogenes EGD-e
auuuccaagucuauuucagcuaa

SEQ ID NO: 773319 - RNA, 17 nt, Listeria monocytogenes EGD-e
auuuuaggcguaucuuu

SEQ ID NO: 773320 - RNA, 23 nt, Listeria monocytogenes EGD-e
auuuucccuccuuuauuuuuuau

SEQ ID NO: 773321 - RNA, 18 nt, Listeria monocytogenes EGD-e
auuuuccgcagcuucaau

SEQ ID NO: 773322 - RNA, 20 nt, Listeria monocytogenes EGD-e
auuuuccgcagcuucaaucu

SEQ ID NO: 773323 - RNA, 16 nt, Listeria monocytogenes EGD-e
auuuucuaaucaaaug

SEQ ID NO: 773324 - RNA, 20 nt, Listeria monocytogenes EGD-e
auuuucauuuguuucuuuug

SEQ ID NO: 773325 - RNA, 17 nt, Listeria monocytogenes EGD-e
auuuugcggaaauauca

SEQ ID NO: 773326 - RNA, 18 nt, Listeria monocytogenes EGD-e
auuuugcggaaauaucac

SEQ ID NO: 773327 - RNA, 16 nt, Listeria monocytogenes EGD-e
auuuuggaguuaagua

SEQ ID NO: 773328 - RNA, 16 nt, Listeria monocytogenes EGD-e
auuuugcuugucuuau

SEQ ID NO: 773329 - RNA, 20 nt, Listeria monocytogenes EGD-e
auuucuuuaucuuucccauc

SEQ ID NO: 773330 - RNA, 13 nt, Listeria monocytogenes EGD-e
auuucuguuuugu

SEQ ID NO: 773331 - RNA, 20 nt, Listeria monocytogenes EGD-e
auuucuguuaugaacagaag

SEQ ID NO: 773332 - RNA, 23 nt, Listeria monocytogenes EGD-e
auuucugcagaaugagcuccuuc

SEQ ID NO: 773333 - RNA, 13 nt, Listeria monocytogenes EGD-e
auuucuauaaaaa

SEQ ID NO: 773334 - RNA, 17 nt, Listeria monocytogenes EGD-e
auuugccaucgcagcag

SEQ ID NO: 773335 - RNA, 14 nt, Listeria monocytogenes EGD-e
auuuguuucugguu

SEQ ID NO: 773336 - RNA, 15 nt, Listeria monocytogenes EGD-e
auuuguuuuauuaca

SEQ ID NO: 773337 - RNA, 17 nt, Listeria monocytogenes EGD-e
auuuguuuuauuacauu

SEQ ID NO: 773338 - RNA, 16 nt, Listeria monocytogenes EGD-e
auucuucuaauacauu

SEQ ID NO: 773339 - RNA, 16 nt, Listeria monocytogenes EGD-e
auucuucgcuuguuuu

SEQ ID NO: 773340 - RNA, 17 nt, Listeria monocytogenes EGD-e
auucuucgcuuguuuug

SEQ ID NO: 773341 - RNA, 19 nt, Listeria monocytogenes EGD-e
auucuucgcuuguuuugau

SEQ ID NO: 773342 - RNA, 17 nt, Listeria monocytogenes EGD-e
auucugcgauuuuuucu

SEQ ID NO: 773343 - RNA, 15 nt, Listeria monocytogenes EGD-e
auucgucuuagaaaa

SEQ ID NO: 773344 - RNA, 23 nt, Listeria monocytogenes EGD-e
auugcaugagcaaucguauguuu

SEQ ID NO: 773345 - RNA, 20 nt, Listeria monocytogenes EGD-e
auuggcgauucuucaauacg

SEQ ID NO: 773346 - RNA, 19 nt, Listeria monocytogenes EGD-e
auucauauaaaguuuuuug

SEQ ID NO: 773347 - RNA, 22 nt, Listeria monocytogenes EGD-e
auucaugcaagcgcagaaugaa

SEQ ID NO: 773348 - RNA, 14 nt, Listeria monocytogenes EGD-e
auguugcaauuuug

SEQ ID NO: 773349 - RNA, 12 nt, Listeria monocytogenes EGD-e
auuccacuuuua

SEQ ID NO: 773350 - RNA, 22 nt, Listeria monocytogenes EGD-e
auuccaaaaucgcauccucaaa

SEQ ID NO: 773351 - RNA, 22 nt, Listeria monocytogenes EGD-e
auucauuauuaaacucauaacg

SEQ ID NO: 773352 - RNA, 15 nt, Listeria monocytogenes EGD-e
auucgaauaagaacc

SEQ ID NO: 773353 - RNA, 19 nt, Listeria monocytogenes EGD-e
auucgaguuucuguucuuu

SEQ ID NO: 773354 - RNA, 14 nt, Listeria monocytogenes EGD-e
auuccuccuaauug

SEQ ID NO: 773355 - RNA, 12 nt, Listeria monocytogenes EGD-e
auuccucauuga

SEQ ID NO: 773356 - RNA, 13 nt, Listeria monocytogenes EGD-e
auuccucauugag

SEQ ID NO: 773357 - RNA, 18 nt, Listeria monocytogenes EGD-e
auuccucauugaggaaua

SEQ ID NO: 773358 - RNA, 13 nt, Listeria monocytogenes EGD-e
aucuguacuccuu

SEQ ID NO: 773359 - RNA, 22 nt, Listeria monocytogenes EGD-e
aucugcuucguccagcugcuuc

SEQ ID NO: 773360 - RNA, 22 nt, Listeria monocytogenes EGD-e
aucuuaggaauuucgaaauuaa

SEQ ID NO: 773361 - RNA, 19 nt, Listeria monocytogenes EGD-e
aucuuauccgguuuuugcu

SEQ ID NO: 773362 - RNA, 13 nt, Listeria monocytogenes EGD-e
aucuuaucaagua

SEQ ID NO: 773363 - RNA, 19 nt, Listeria monocytogenes EGD-e
aucuuaucaaguaauaaga

SEQ ID NO: 773364 - RNA, 17 nt, Listeria monocytogenes EGD-e
aucuucguauauuuuau

SEQ ID NO: 773365 - RNA, 21 nt, Listeria monocytogenes EGD-e
aucuuccgcuucggcaacaag

SEQ ID NO: 773366 - RNA, 16 nt, Listeria monocytogenes EGD-e
aucuucuaagaaaaaa

SEQ ID NO: 773367 - RNA, 21 nt, Listeria monocytogenes EGD-e
augaaaacuuaucucuucauu

SEQ ID NO: 773368 - RNA, 16 nt, Listeria monocytogenes EGD-e
augaaaagaaaaaccg

SEQ ID NO: 773369 - RNA, 19 nt, Listeria monocytogenes EGD-e
augaacacccgguccuuca

SEQ ID NO: 773370 - RNA, 17 nt, Listeria monocytogenes EGD-e
aucuuuauaaaaugcau

SEQ ID NO: 773371 - RNA, 17 nt, Listeria monocytogenes EGD-e
augagcccaaaaauaag

SEQ ID NO: 773372 - RNA, 13 nt, Listeria monocytogenes EGD-e
augagcuccuuca

SEQ ID NO: 773373 - RNA, 23 nt, Listeria monocytogenes EGD-e
augagcuaauuuuuuuauaccua

SEQ ID NO: 773374 - RNA, 18 nt, Listeria monocytogenes EGD-e
augagcaaucguauguuu

SEQ ID NO: 773375 - RNA, 21 nt, Listeria monocytogenes EGD-e
augauaaugugaccuuaaauu

SEQ ID NO: 773376 - RNA, 20 nt, Listeria monocytogenes EGD-e
augaauuuuuauacacgaua

SEQ ID NO: 773377 - RNA, 16 nt, Listeria monocytogenes EGD-e
augacaaagcuauuuu

SEQ ID NO: 773378 - RNA, 15 nt, Listeria monocytogenes EGD-e
augacaagagcgaga

SEQ ID NO: 773379 - RNA, 15 nt, Listeria monocytogenes EGD-e
augaacggauguaaa

SEQ ID NO: 773380 - RNA, 23 nt, Listeria monocytogenes EGD-e
augcaaaagcaguagacuaaauu

SEQ ID NO: 773381 - RNA, 20 nt, Listeria monocytogenes EGD-e
augauuuuuaucuaaaucuu

SEQ ID NO: 773382 - RNA, 15 nt, Listeria monocytogenes EGD-e
augauucuaguuugu

SEQ ID NO: 773383 - RNA, 20 nt, Listeria monocytogenes EGD-e
augcacuagaaaaaugaaga

SEQ ID NO: 773384 - RNA, 22 nt, Listeria monocytogenes EGD-e
augcacuagaaaaaugaagaga

SEQ ID NO: 773385 - RNA, 19 nt, Listeria monocytogenes EGD-e
augucgguucggagacaga

SEQ ID NO: 773386 - RNA, 14 nt, Listeria monocytogenes EGD-e
augucguaugcuuu

SEQ ID NO: 773387 - RNA, 14 nt, Listeria monocytogenes EGD-e
auguguugcuuuua

SEQ ID NO: 773388 - RNA, 23 nt, Listeria monocytogenes EGD-e
auguguugcuuuuauuuuuaaag

SEQ ID NO: 773389 - RNA, 20 nt, Listeria monocytogenes EGD-e
auguuaccacgaguugcuuu

SEQ ID NO: 773390 - RNA, 13 nt, Listeria monocytogenes EGD-e
auguucuaaaaua

SEQ ID NO: 773391 - RNA, 15 nt, Listeria monocytogenes EGD-e
auggagcuauuguaa

SEQ ID NO: 773392 - RNA, 15 nt, Listeria monocytogenes EGD-e
auggaaccauucacu

SEQ ID NO: 773393 - RNA, 21 nt, Listeria monocytogenes EGD-e
auggaaugcgguaacuaaaau

SEQ ID NO: 773394 - RNA, 20 nt, Listeria monocytogenes EGD-e
augcugaauguuuucuucca

SEQ ID NO: 773395 - RNA, 18 nt, Listeria monocytogenes EGD-e
augcuucgacguuuaauu

SEQ ID NO: 773396 - RNA, 19 nt, Listeria monocytogenes EGD-e
augcgguaacuaaaauauu

SEQ ID NO: 773397 - RNA, 12 nt, Listeria monocytogenes EGD-e
augcgcauguuu

SEQ ID NO: 773398 - RNA, 16 nt, Listeria monocytogenes EGD-e
aucauauucuucuaaa

SEQ ID NO: 773399 - RNA, 14 nt, Listeria monocytogenes EGD-e
aucauaaacauuug

SEQ ID NO: 773400 - RNA, 16 nt, Listeria monocytogenes EGD-e
aucaucacguaaggau

SEQ ID NO: 773401 - RNA, 16 nt, Listeria monocytogenes EGD-e
aucaugccagcuucuu

SEQ ID NO: 773402 - RNA, 17 nt, Listeria monocytogenes EGD-e
aucaugccagcuucuuc

SEQ ID NO: 773403 - RNA, 19 nt, Listeria monocytogenes EGD-e
aucaugccagcuucuucca

SEQ ID NO: 773404 - RNA, 17 nt, Listeria monocytogenes EGD-e
aucauuaauauaaagau

SEQ ID NO: 773405 - RNA, 17 nt, Listeria monocytogenes EGD-e
aucauuaaauauacaca

SEQ ID NO: 773406 - RNA, 19 nt, Listeria monocytogenes EGD-e
aucauuaaauauacacaaa

SEQ ID NO: 773407 - RNA, 14 nt, Listeria monocytogenes EGD-e
aucauuaaauuuag

SEQ ID NO: 773408 - RNA, 19 nt, Listeria monocytogenes EGD-e
auccaagcggguuuucuca

SEQ ID NO: 773409 - RNA, 20 nt, Listeria monocytogenes EGD-e
auccacuaacuuaucuuuca

SEQ ID NO: 773410 - RNA, 13 nt, Listeria monocytogenes EGD-e
auccaauuucugu

SEQ ID NO: 773411 - RNA, 21 nt, Listeria monocytogenes EGD-e
auccaaguuuuuuaauuuuuc

SEQ ID NO: 773412 - RNA, 21 nt, Listeria monocytogenes EGD-e
auccauguuguuuuagauaag

SEQ ID NO: 773413 - RNA, 19 nt, Listeria monocytogenes EGD-e
auccauuucauucuuuuuu

SEQ ID NO: 773414 - RNA, 17 nt, Listeria monocytogenes EGD-e
aucccacaaaaaauacg

SEQ ID NO: 773415 - RNA, 22 nt, Listeria monocytogenes EGD-e
auccaguguaaucuugaugcca

SEQ ID NO: 773416 - RNA, 18 nt, Listeria monocytogenes EGD-e
auccagcgucuaaaaaug

SEQ ID NO: 773417 - RNA, 14 nt, Listeria monocytogenes EGD-e
auccguugucuucu

SEQ ID NO: 773418 - RNA, 14 nt, Listeria monocytogenes EGD-e
auccuguaauucga

SEQ ID NO: 773419 - RNA, 17 nt, Listeria monocytogenes EGD-e
auccuguaauucgaaua

SEQ ID NO: 773420 - RNA, 20 nt, Listeria monocytogenes EGD-e
aucguuuuaaagcuugauuu

SEQ ID NO: 773421 - RNA, 21 nt, Listeria monocytogenes EGD-e
aucguuuuaaagcuugauuua

SEQ ID NO: 773422 - RNA, 16 nt, Listeria monocytogenes EGD-e
aucguuuaacauauaa

SEQ ID NO: 773423 - RNA, 17 nt, Listeria monocytogenes EGD-e
aucguugugcuuucccc

SEQ ID NO: 773424 - RNA, 19 nt, Listeria monocytogenes EGD-e
aucggcauuugaauaagca

SEQ ID NO: 773425 - RNA, 14 nt, Listeria monocytogenes EGD-e
aucgccaaagccag

SEQ ID NO: 773426 - RNA, 20 nt, Listeria monocytogenes EGD-e
auccuuguuguucuaauaau

SEQ ID NO: 773427 - RNA, 21 nt, Listeria monocytogenes EGD-e
auccuuggaaaaaugauucua

SEQ ID NO: 773428 - RNA, 16 nt, Listeria monocytogenes EGD-e
auccuuucuugauuug

SEQ ID NO: 773429 - RNA, 14 nt, Listeria monocytogenes EGD-e
aucgaauacuaacg

SEQ ID NO: 773430 - RNA, 19 nt, Listeria monocytogenes EGD-e
auaaucucgugcuaauucu

SEQ ID NO: 773431 - RNA, 16 nt, Listeria monocytogenes EGD-e
auaaucccacaaaaaa

SEQ ID NO: 773432 - RNA, 17 nt, Listeria monocytogenes EGD-e
auaaucccacaaaaaau

SEQ ID NO: 773433 - RNA, 18 nt, Listeria monocytogenes EGD-e
auaaucccacaaaaaaua

SEQ ID NO: 773434 - RNA, 20 nt, Listeria monocytogenes EGD-e
auaaucccacaaaaaauacg

SEQ ID NO: 773435 - RNA, 14 nt, Listeria monocytogenes EGD-e
auaacguaugaaca

SEQ ID NO: 773436 - RNA, 16 nt, Listeria monocytogenes EGD-e
auaauucugcuaacag

SEQ ID NO: 773437 - RNA, 12 nt, Listeria monocytogenes EGD-e
auaauuccauuu

SEQ ID NO: 773438 - RNA, 15 nt, Listeria monocytogenes EGD-e
auaauuccauuuaau

SEQ ID NO: 773439 - RNA, 17 nt, Listeria monocytogenes EGD-e
auaauuccauuuaauuu

SEQ ID NO: 773440 - RNA, 19 nt, Listeria monocytogenes EGD-e
auaaugugaccuuaaauua

SEQ ID NO: 773441 - RNA, 21 nt, Listeria monocytogenes EGD-e
auaaugugaccuuaaauuaua

SEQ ID NO: 773442 - RNA, 14 nt, Listeria monocytogenes EGD-e
auaaugcagauuaa

SEQ ID NO: 773443 - RNA, 20 nt, Listeria monocytogenes EGD-e
auacaacaaaauaaucaauc

SEQ ID NO: 773444 - RNA, 21 nt, Listeria monocytogenes EGD-e
auaauuuucauuuguuucuuu

SEQ ID NO: 773445 - RNA, 15 nt, Listeria monocytogenes EGD-e
auaauuuuuucauuu

SEQ ID NO: 773446 - RNA, 17 nt, Listeria monocytogenes EGD-e
auaauuuuuucauuuuc

SEQ ID NO: 773447 - RNA, 18 nt, Listeria monocytogenes EGD-e
auacacauaggucaggau

SEQ ID NO: 773448 - RNA, 16 nt, Listeria monocytogenes EGD-e
auacaauuaauaauaa

SEQ ID NO: 773449 - RNA, 18 nt, Listeria monocytogenes EGD-e
auacaauuaauaauaaug

SEQ ID NO: 773450 - RNA, 20 nt, Listeria monocytogenes EGD-e
auagauacucuuuaaaucca

SEQ ID NO: 773451 - RNA, 21 nt, Listeria monocytogenes EGD-e
auagccggaccugaaagaacu

SEQ ID NO: 773452 - RNA, 16 nt, Listeria monocytogenes EGD-e
auagcauaauagaaag

SEQ ID NO: 773453 - RNA, 15 nt, Listeria monocytogenes EGD-e
auacuucaaaaccuu

SEQ ID NO: 773454 - RNA, 17 nt, Listeria monocytogenes EGD-e
auacuaacgcuuuuuca

SEQ ID NO: 773455 - RNA, 13 nt, Listeria monocytogenes EGD-e
auaccuaaagcau

SEQ ID NO: 773456 - RNA, 23 nt, Listeria monocytogenes EGD-e
auacgaacaaacguucuugaaau

SEQ ID NO: 773457 - RNA, 13 nt, Listeria monocytogenes EGD-e
auaccauuuuuuc

SEQ ID NO: 773458 - RNA, 21 nt, Listeria monocytogenes EGD-e
auauaaucuacuguauauguu

SEQ ID NO: 773459 - RNA, 15 nt, Listeria monocytogenes EGD-e
auauaaagauccauc

SEQ ID NO: 773460 - RNA, 17 nt, Listeria monocytogenes EGD-e
auagucuacuuuuaaaa

SEQ ID NO: 773461 - RNA, 14 nt, Listeria monocytogenes EGD-e
auauccuuguuguu

SEQ ID NO: 773462 - RNA, 20 nt, Listeria monocytogenes EGD-e
auauccggcguacuuaaauc

SEQ ID NO: 773463 - RNA, 20 nt, Listeria monocytogenes EGD-e
auauccguuucauuuuugau

SEQ ID NO: 773464 - RNA, 22 nt, Listeria monocytogenes EGD-e
auaucaucaauuaaauuauaca

SEQ ID NO: 773465 - RNA, 15 nt, Listeria monocytogenes EGD-e
auaugcgcagaaagu

SEQ ID NO: 773466 - RNA, 19 nt, Listeria monocytogenes EGD-e
auaugcgcagaaaguuggg

SEQ ID NO: 773467 - RNA, 14 nt, Listeria monocytogenes EGD-e
auauuaauuugauu

SEQ ID NO: 773468 - RNA, 18 nt, Listeria monocytogenes EGD-e
auauuauacuuggaauaa

SEQ ID NO: 773469 - RNA, 20 nt, Listeria monocytogenes EGD-e
auauuccaaaaucgcauccu

SEQ ID NO: 773470 - RNA, 9 nt, Listeria monocytogenes EGD-e
auauucauu

SEQ ID NO: 773471 - RNA, 22 nt, Listeria monocytogenes EGD-e
aucaaaguaaaauacguugucu

SEQ ID NO: 773472 - RNA, 22 nt, Listeria monocytogenes EGD-e
aucaaaauucaguuuauaaaua

SEQ ID NO: 773473 - RNA, 21 nt, Listeria monocytogenes EGD-e
aucaaaaugggcaguuacuuu

SEQ ID NO: 773474 - RNA, 16 nt, Listeria monocytogenes EGD-e
aucaaauccaagcaca

SEQ ID NO: 773475 - RNA, 14 nt, Listeria monocytogenes EGD-e
aucaaauacaugac

SEQ ID NO: 773476 - RNA, 15 nt, Listeria monocytogenes EGD-e
aucaauaacaaucca

SEQ ID NO: 773477 - RNA, 21 nt, Listeria monocytogenes EGD-e
aucaauaacaauccaaccauu

SEQ ID NO: 773478 - RNA, 15 nt, Listeria monocytogenes EGD-e
aucaauaaagaagca

SEQ ID NO: 773479 - RNA, 16 nt, Listeria monocytogenes EGD-e
aucaauaaagaagcau

SEQ ID NO: 773480 - RNA, 13 nt, Listeria monocytogenes EGD-e
aucaaucaucacg

SEQ ID NO: 773481 - RNA, 16 nt, Listeria monocytogenes EGD-e
aguacgaaaucaaacu

SEQ ID NO: 773482 - RNA, 16 nt, Listeria monocytogenes EGD-e
aguaccugcaagcgaa

SEQ ID NO: 773483 - RNA, 14 nt, Listeria monocytogenes EGD-e
aguacuucuauuga

SEQ ID NO: 773484 - RNA, 23 nt, Listeria monocytogenes EGD-e
aguagagcuucuguuuuuucuuu

SEQ ID NO: 773485 - RNA, 23 nt, Listeria monocytogenes EGD-e
aguacuuugaauugcucguucuu

SEQ ID NO: 773486 - RNA, 19 nt, Listeria monocytogenes EGD-e
aguagaaaguuaguugcuu

SEQ ID NO: 773487 - RNA, 15 nt, Listeria monocytogenes EGD-e
aguaguaagggugaa

SEQ ID NO: 773488 - RNA, 15 nt, Listeria monocytogenes EGD-e
aguaguuauuucuuu

SEQ ID NO: 773489 - RNA, 12 nt, Listeria monocytogenes EGD-e
aguaguuuacuu

SEQ ID NO: 773490 - RNA, 17 nt, Listeria monocytogenes EGD-e
aguagcaauuuuaaauc

SEQ ID NO: 773491 - RNA, 20 nt, Listeria monocytogenes EGD-e
aguagcacuccuugaucugc

SEQ ID NO: 773492 - RNA, 13 nt, Listeria monocytogenes EGD-e
aguagcauuuucg

SEQ ID NO: 773493 - RNA, 17 nt, Listeria monocytogenes EGD-e
aguauuccuaucacaaa

SEQ ID NO: 773494 - RNA, 14 nt, Listeria monocytogenes EGD-e
agucacuuugcuug

SEQ ID NO: 773495 - RNA, 19 nt, Listeria monocytogenes EGD-e
agucacagcguauccacca

SEQ ID NO: 773496 - RNA, 23 nt, Listeria monocytogenes EGD-e
agucacagcguauccaccaaaaa

SEQ ID NO: 773497 - RNA, 21 nt, Listeria monocytogenes EGD-e
agucccauuacugucgcaaaa

SEQ ID NO: 773498 - RNA, 22 nt, Listeria monocytogenes EGD-e
agucccauuacugucgcaaaaa

SEQ ID NO: 773499 - RNA, 19 nt, Listeria monocytogenes EGD-e
agucaucggcuuuuuuuau

SEQ ID NO: 773500 - RNA, 15 nt, Listeria monocytogenes EGD-e
agugaaaauuggauu

SEQ ID NO: 773501 - RNA, 22 nt, Listeria monocytogenes EGD-e
aguuaauucuguuaaaggagaa

SEQ ID NO: 773502 - RNA, 12 nt, Listeria monocytogenes EGD-e
aguuauauuuaa

SEQ ID NO: 773503 - RNA, 21 nt, Listeria monocytogenes EGD-e
aguucaugacgcgcaucuucg

SEQ ID NO: 773504 - RNA, 12 nt, Listeria monocytogenes EGD-e
aguuuauaaaua

SEQ ID NO: 773505 - RNA, 18 nt, Listeria monocytogenes EGD-e
aguugguaguuuuaaauu

SEQ ID NO: 773506 - RNA, 23 nt, Listeria monocytogenes EGD-e
aguuguaaaccguaacuguugaa

SEQ ID NO: 773507 - RNA, 14 nt, Listeria monocytogenes EGD-e
aguugauauauuca

SEQ ID NO: 773508 - RNA, 19 nt, Listeria monocytogenes EGD-e
aguuuuaugacaauuaaaa

SEQ ID NO: 773509 - RNA, 21 nt, Listeria monocytogenes EGD-e
aguuuuuuaauuuuucuucaa

SEQ ID NO: 773510 - RNA, 12 nt, Listeria monocytogenes EGD-e
auaaaaacauga

SEQ ID NO: 773511 - RNA, 18 nt, Listeria monocytogenes EGD-e
auaaccauugauauccag

SEQ ID NO: 773512 - RNA, 20 nt, Listeria monocytogenes EGD-e
auaacauaaccuucaucguu

SEQ ID NO: 773513 - RNA, 14 nt, Listeria monocytogenes EGD-e
auaacauuaaaccu

SEQ ID NO: 773514 - RNA, 13 nt, Listeria monocytogenes EGD-e
auaacaagaauaa

SEQ ID NO: 773515 - RNA, 13 nt, Listeria monocytogenes EGD-e
auaacaaguacaa

SEQ ID NO: 773516 - RNA, 15 nt, Listeria monocytogenes EGD-e
auaaaugcauuucuu

SEQ ID NO: 773517 - RNA, 14 nt, Listeria monocytogenes EGD-e
auaaagaccuaaac

SEQ ID NO: 773518 - RNA, 15 nt, Listeria monocytogenes EGD-e
auaaagaaauaacua

SEQ ID NO: 773519 - RNA, 17 nt, Listeria monocytogenes EGD-e
auaaagaaauaacuacu

SEQ ID NO: 773520 - RNA, 21 nt, Listeria monocytogenes EGD-e
auaaagaacuagauuuaauaa

SEQ ID NO: 773521 - RNA, 17 nt, Listeria monocytogenes EGD-e
auaaagaacuuacagaa

SEQ ID NO: 773522 - RNA, 18 nt, Listeria monocytogenes EGD-e
auaaagaacuuacagaag

SEQ ID NO: 773523 - RNA, 16 nt, Listeria monocytogenes EGD-e
auaaauauagcuucaa

SEQ ID NO: 773524 - RNA, 17 nt, Listeria monocytogenes EGD-e
auaaaaauugcaacagu

SEQ ID NO: 773525 - RNA, 19 nt, Listeria monocytogenes EGD-e
auaaaaccauucaucuaau

SEQ ID NO: 773526 - RNA, 14 nt, Listeria monocytogenes EGD-e
auaaaaucauaaua

SEQ ID NO: 773527 - RNA, 15 nt, Listeria monocytogenes EGD-e
auaaaaucauaauag

SEQ ID NO: 773528 - RNA, 16 nt, Listeria monocytogenes EGD-e
auaaaaugcacaugau

SEQ ID NO: 773529 - RNA, 18 nt, Listeria monocytogenes EGD-e
auaaaauggauaaaaaaa

SEQ ID NO: 773530 - RNA, 16 nt, Listeria monocytogenes EGD-e
agccauuucucgcugc

SEQ ID NO: 773531 - RNA, 18 nt, Listeria monocytogenes EGD-e
agccgcaaauaguuguuc

SEQ ID NO: 773532 - RNA, 16 nt, Listeria monocytogenes EGD-e
agccuaaguuaaacca

SEQ ID NO: 773533 - RNA, 13 nt, Listeria monocytogenes EGD-e
agccuugcugcgu

SEQ ID NO: 773534 - RNA, 14 nt, Listeria monocytogenes EGD-e
agccuugcugcgug

SEQ ID NO: 773535 - RNA, 15 nt, Listeria monocytogenes EGD-e
agcgaauuaauaaaa

SEQ ID NO: 773536 - RNA, 17 nt, Listeria monocytogenes EGD-e
agcgacuuuugcagcug

SEQ ID NO: 773537 - RNA, 16 nt, Listeria monocytogenes EGD-e
agcucuuucuucuacu

SEQ ID NO: 773538 - RNA, 19 nt, Listeria monocytogenes EGD-e
agcuccugccguaugucca

SEQ ID NO: 773539 - RNA, 20 nt, Listeria monocytogenes EGD-e
agcuccugccguauguccag

SEQ ID NO: 773540 - RNA, 16 nt, Listeria monocytogenes EGD-e
agcuccuucaagacca

SEQ ID NO: 773541 - RNA, 19 nt, Listeria monocytogenes EGD-e
agcuacagcuguaaaugaa

SEQ ID NO: 773542 - RNA, 13 nt, Listeria monocytogenes EGD-e
agcgaugugggaa

SEQ ID NO: 773543 - RNA, 19 nt, Listeria monocytogenes EGD-e
agcgaugugggaaugaaua

SEQ ID NO: 773544 - RNA, 22 nt, Listeria monocytogenes EGD-e
agcaucuuuuucuugcuuucca

SEQ ID NO: 773545 - RNA, 14 nt, Listeria monocytogenes EGD-e
agcaugaauuuuua

SEQ ID NO: 773546 - RNA, 14 nt, Listeria monocytogenes EGD-e
agcauuauaaaaag

SEQ ID NO: 773547 - RNA, 19 nt, Listeria monocytogenes EGD-e
agcauuucauaaucaaaua

SEQ ID NO: 773548 - RNA, 21 nt, Listeria monocytogenes EGD-e
agccaaugaccuaguuaaucu

SEQ ID NO: 773549 - RNA, 15 nt, Listeria monocytogenes EGD-e
agccauaaaauuagu

SEQ ID NO: 773550 - RNA, 13 nt, Listeria monocytogenes EGD-e
agcaucuggauca

SEQ ID NO: 773551 - RNA, 16 nt, Listeria monocytogenes EGD-e
agcaucggucaaaucu

SEQ ID NO: 773552 - RNA, 21 nt, Listeria monocytogenes EGD-e
agcauccucuuuuguaguaaa

SEQ ID NO: 773553 - RNA, 14 nt, Listeria monocytogenes EGD-e
agcauaauagaaag

SEQ ID NO: 773554 - RNA, 13 nt, Listeria monocytogenes EGD-e
agcaguuuucauu

SEQ ID NO: 773555 - RNA, 16 nt, Listeria monocytogenes EGD-e
agcagcuccauuaaau

SEQ ID NO: 773556 - RNA, 22 nt, Listeria monocytogenes EGD-e
agcaggguggccgugauaaaua

SEQ ID NO: 773557 - RNA, 18 nt, Listeria monocytogenes EGD-e
agcaauuggaacaucuuu

SEQ ID NO: 773558 - RNA, 16 nt, Listeria monocytogenes EGD-e
agcaccaauaaaaccu

SEQ ID NO: 773559 - RNA, 17 nt, Listeria monocytogenes EGD-e
agcacauguccauugau

SEQ ID NO: 773560 - RNA, 14 nt, Listeria monocytogenes EGD-e
agcacagcuaccac

SEQ ID NO: 773561 - RNA, 17 nt, Listeria monocytogenes EGD-e
agcacgcgcguucauuc

SEQ ID NO: 773562 - RNA, 21 nt, Listeria monocytogenes EGD-e
agcacuaaugcucaccuucuu

SEQ ID NO: 773563 - RNA, 15 nt, Listeria monocytogenes EGD-e
agcagaaacuuucuu

SEQ ID NO: 773564 - RNA, 18 nt, Listeria monocytogenes EGD-e
agcagaagccccuuggac

SEQ ID NO: 773565 - RNA, 17 nt, Listeria monocytogenes EGD-e
agauaaguuuucauaua

SEQ ID NO: 773566 - RNA, 16 nt, Listeria monocytogenes EGD-e
agauaaguuaaucauu

SEQ ID NO: 773567 - RNA, 18 nt, Listeria monocytogenes EGD-e
agauuuuaauuucuuuug

SEQ ID NO: 773568 - RNA, 20 nt, Listeria monocytogenes EGD-e
agauuuagaggcguacuaaa

SEQ ID NO: 773569 - RNA, 21 nt, Listeria monocytogenes EGD-e
agauuuucaucccuuuuuuca

SEQ ID NO: 773570 - RNA, 20 nt, Listeria monocytogenes EGD-e
agauuuugcgaaagcuguaa

SEQ ID NO: 773571 - RNA, 12 nt, Listeria monocytogenes EGD-e
agcaaaacauuu

SEQ ID NO: 773572 - RNA, 22 nt, Listeria monocytogenes EGD-e
agcaaaacauuuucauucuuuc

SEQ ID NO: 773573 - RNA, 16 nt, Listeria monocytogenes EGD-e
agcaaacaaaguacca

SEQ ID NO: 773574 - RNA, 17 nt, Listeria monocytogenes EGD-e
agcaaaugcauuucucg

SEQ ID NO: 773575 - RNA, 15 nt, Listeria monocytogenes EGD-e
agcaaguagcuuagg

SEQ ID NO: 773576 - RNA, 21 nt, Listeria monocytogenes EGD-e
agcaagauaacucaaaguaac

SEQ ID NO: 773577 - RNA, 18 nt, Listeria monocytogenes EGD-e
agcaagagcaccaauaaa

SEQ ID NO: 773578 - RNA, 15 nt, Listeria monocytogenes EGD-e
agcaauaacaucuuu

SEQ ID NO: 773579 - RNA, 19 nt, Listeria monocytogenes EGD-e
agcaauggccggauaugcu

SEQ ID NO: 773580 - RNA, 15 nt, Listeria monocytogenes EGD-e
agaagcgauguggga

SEQ ID NO: 773581 - RNA, 23 nt, Listeria monocytogenes EGD-e
agaagauauuuugcucaagugaa

SEQ ID NO: 773582 - RNA, 13 nt, Listeria monocytogenes EGD-e
agaagaugcacua

SEQ ID NO: 773583 - RNA, 19 nt, Listeria monocytogenes EGD-e
agaaauuaccuaaugaaua

SEQ ID NO: 773584 - RNA, 13 nt, Listeria monocytogenes EGD-e
agaauaguacaua

SEQ ID NO: 773585 - RNA, 23 nt, Listeria monocytogenes EGD-e
agaauaguacauaguuauaaaua

SEQ ID NO: 773586 - RNA, 13 nt, Listeria monocytogenes EGD-e
agaauaaugacgc

SEQ ID NO: 773587 - RNA, 13 nt, Listeria monocytogenes EGD-e
agaauaaaacaaa

SEQ ID NO: 773588 - RNA, 18 nt, Listeria monocytogenes EGD-e
agacauuaaaccgauaau

SEQ ID NO: 773589 - RNA, 20 nt, Listeria monocytogenes EGD-e
agacgaccauauaaucaaua

SEQ ID NO: 773590 - RNA, 18 nt, Listeria monocytogenes EGD-e
agacuuuuuuuuauaaga

SEQ ID NO: 773591 - RNA, 15 nt, Listeria monocytogenes EGD-e
agagcuagaaagccu

SEQ ID NO: 773592 - RNA, 13 nt, Listeria monocytogenes EGD-e
agaggauuuucac

SEQ ID NO: 773593 - RNA, 15 nt, Listeria monocytogenes EGD-e
agagguuuugcacaa

SEQ ID NO: 773594 - RNA, 23 nt, Listeria monocytogenes EGD-e
agagguuuugcacaaaaugcaaa

SEQ ID NO: 773595 - RNA, 17 nt, Listeria monocytogenes EGD-e
agaggcguacuaaaaau

SEQ ID NO: 773596 - RNA, 20 nt, Listeria monocytogenes EGD-e
agauaacucaaaguaacuuu

SEQ ID NO: 773597 - RNA, 14 nt, Listeria monocytogenes EGD-e
agaaaacagaaagc

SEQ ID NO: 773598 - RNA, 15 nt, Listeria monocytogenes EGD-e
agaaaacagaaagcu

SEQ ID NO: 773599 - RNA, 23 nt, Listeria monocytogenes EGD-e
agaaaacagaaagcuguuuucaa

SEQ ID NO: 773600 - RNA, 15 nt, Listeria monocytogenes EGD-e
acuuuucgaaucccu

SEQ ID NO: 773601 - RNA, 11 nt, Listeria monocytogenes EGD-e
agaaaaaaaca

SEQ ID NO: 773602 - RNA, 12 nt, Listeria monocytogenes EGD-e
agaaaaaaacaa

SEQ ID NO: 773603 - RNA, 13 nt, Listeria monocytogenes EGD-e
agaaaaaaacaaa

SEQ ID NO: 773604 - RNA, 15 nt, Listeria monocytogenes EGD-e
agaaacuuucuuuuc

SEQ ID NO: 773605 - RNA, 17 nt, Listeria monocytogenes EGD-e
agaaacuuucuuuucuu

SEQ ID NO: 773606 - RNA, 14 nt, Listeria monocytogenes EGD-e
agaaaucgccuuga

SEQ ID NO: 773607 - RNA, 20 nt, Listeria monocytogenes EGD-e
agaaaucgccuugaugugga

SEQ ID NO: 773608 - RNA, 13 nt, Listeria monocytogenes EGD-e
acuuucaaaucag

SEQ ID NO: 773609 - RNA, 15 nt, Listeria monocytogenes EGD-e
acuuucaccaguuug

SEQ ID NO: 773610 - RNA, 16 nt, Listeria monocytogenes EGD-e
acuuucaccaguuugu

SEQ ID NO: 773611 - RNA, 19 nt, Listeria monocytogenes EGD-e
acuuuauaacuuucaccag

SEQ ID NO: 773612 - RNA, 20 nt, Listeria monocytogenes EGD-e
acuuucgacaguuucuuuuu

SEQ ID NO: 773613 - RNA, 18 nt, Listeria monocytogenes EGD-e
acuuucuuguuucauaua

SEQ ID NO: 773614 - RNA, 14 nt, Listeria monocytogenes EGD-e
acuuucugccaaau

SEQ ID NO: 773615 - RNA, 19 nt, Listeria monocytogenes EGD-e
acuuucucuugcuuuaauu

SEQ ID NO: 773616 - RNA, 21 nt, Listeria monocytogenes EGD-e
acuuuuaaaauucuauuaaua

SEQ ID NO: 773617 - RNA, 16 nt, Listeria monocytogenes EGD-e
acuucuaccguuccuu

SEQ ID NO: 773618 - RNA, 18 nt, Listeria monocytogenes EGD-e
acuucggggcaaaaagga

SEQ ID NO: 773619 - RNA, 21 nt, Listeria monocytogenes EGD-e
acuucggggcaaaaaggaauu

SEQ ID NO: 773620 - RNA, 14 nt, Listeria monocytogenes EGD-e
acuucuuccaccug

SEQ ID NO: 773621 - RNA, 14 nt, Listeria monocytogenes EGD-e
acuucuuaagaauu

SEQ ID NO: 773622 - RNA, 16 nt, Listeria monocytogenes EGD-e
acuugcaucuucuguu

SEQ ID NO: 773623 - RNA, 14 nt, Listeria monocytogenes EGD-e
acuugcaaaugcuu

SEQ ID NO: 773624 - RNA, 16 nt, Listeria monocytogenes EGD-e
acuugcuuuuuuuaaa

SEQ ID NO: 773625 - RNA, 17 nt, Listeria monocytogenes EGD-e
acuugcuuuuuuuaaac

SEQ ID NO: 773626 - RNA, 15 nt, Listeria monocytogenes EGD-e
acuucauuagacaaa

SEQ ID NO: 773627 - RNA, 17 nt, Listeria monocytogenes EGD-e
acuucaugugcuuuuuu

SEQ ID NO: 773628 - RNA, 21 nt, Listeria monocytogenes EGD-e
acuucaugugcuuuuuuuagu

SEQ ID NO: 773629 - RNA, 21 nt, Listeria monocytogenes EGD-e
acuuacagaagcauuuucaug

SEQ ID NO: 773630 - RNA, 15 nt, Listeria monocytogenes EGD-e
acuuacaaaagugga

SEQ ID NO: 773631 - RNA, 18 nt, Listeria monocytogenes EGD-e
acuuacaaaaguggaaau

SEQ ID NO: 773632 - RNA, 22 nt, Listeria monocytogenes EGD-e
acuuacugcaaucauuuauuuu

SEQ ID NO: 773633 - RNA, 22 nt, Listeria monocytogenes EGD-e
acuguuuccccgucuaagaaau

SEQ ID NO: 773634 - RNA, 12 nt, Listeria monocytogenes EGD-e
acuguuguucuu

SEQ ID NO: 773635 - RNA, 19 nt, Listeria monocytogenes EGD-e
acuguuguuuaauaugcau

SEQ ID NO: 773636 - RNA, 18 nt, Listeria monocytogenes EGD-e
acugugaacugauuuuuu

SEQ ID NO: 773637 - RNA, 16 nt, Listeria monocytogenes EGD-e
acuguccggacuuagu

SEQ ID NO: 773638 - RNA, 17 nt, Listeria monocytogenes EGD-e
acugugcucuuugcuuc

SEQ ID NO: 773639 - RNA, 18 nt, Listeria monocytogenes EGD-e
acugugcucuuugcuuca

SEQ ID NO: 773640 - RNA, 21 nt, Listeria monocytogenes EGD-e
acugacuagaaauuaaugcca

SEQ ID NO: 773641 - RNA, 16 nt, Listeria monocytogenes EGD-e
acgcauaucaucaaua

SEQ ID NO: 773642 - RNA, 20 nt, Listeria monocytogenes EGD-e
acgcauaucaucaauaaaau

SEQ ID NO: 773643 - RNA, 22 nt, Listeria monocytogenes EGD-e
acgccacgagcagauacuguuc

SEQ ID NO: 773644 - RNA, 22 nt, Listeria monocytogenes EGD-e
acgcaucugcuaauacuauuga

SEQ ID NO: 773645 - RNA, 13 nt, Listeria monocytogenes EGD-e
acggcuucaaaaa

SEQ ID NO: 773646 - RNA, 23 nt, Listeria monocytogenes EGD-e
acgcggcauuucaaucgcagcag

SEQ ID NO: 773647 - RNA, 16 nt, Listeria monocytogenes EGD-e
acgugaaaaucuuguu

SEQ ID NO: 773648 - RNA, 17 nt, Listeria monocytogenes EGD-e
acgugaaaaucuuguug

SEQ ID NO: 773649 - RNA, 22 nt, Listeria monocytogenes EGD-e
acguaugcgguagccugcucgc

SEQ ID NO: 773650 - RNA, 17 nt, Listeria monocytogenes EGD-e
acuaaguuuagccccaa

SEQ ID NO: 773651 - RNA, 14 nt, Listeria monocytogenes EGD-e
acuaacaaaauaau

SEQ ID NO: 773652 - RNA, 15 nt, Listeria monocytogenes EGD-e
acuaacaaaauaaua

SEQ ID NO: 773653 - RNA, 17 nt, Listeria monocytogenes EGD-e
acuaaauuaucauccac

SEQ ID NO: 773654 - RNA, 19 nt, Listeria monocytogenes EGD-e
acguucgagcagcauccau

SEQ ID NO: 773655 - RNA, 15 nt, Listeria monocytogenes EGD-e
acuacuaauuguuac

SEQ ID NO: 773656 - RNA, 16 nt, Listeria monocytogenes EGD-e
acuacuggauaaaaug

SEQ ID NO: 773657 - RNA, 14 nt, Listeria monocytogenes EGD-e
acuagugaaauaga

SEQ ID NO: 773658 - RNA, 16 nt, Listeria monocytogenes EGD-e
acuagauuuaauaaau

SEQ ID NO: 773659 - RNA, 15 nt, Listeria monocytogenes EGD-e
acuccaaaauaaaau

SEQ ID NO: 773660 - RNA, 23 nt, Listeria monocytogenes EGD-e
acuccaaaauaaaauggauaaaa

SEQ ID NO: 773661 - RNA, 18 nt, Listeria monocytogenes EGD-e
acuccaccaccuuuggua

SEQ ID NO: 773662 - RNA, 20 nt, Listeria monocytogenes EGD-e
acucacuguauuaauccgaa

SEQ ID NO: 773663 - RNA, 16 nt, Listeria monocytogenes EGD-e
acucggggugaaaaug

SEQ ID NO: 773664 - RNA, 14 nt, Listeria monocytogenes EGD-e
acucgucuaaaaaa

SEQ ID NO: 773665 - RNA, 16 nt, Listeria monocytogenes EGD-e
acucuuucugaaaaug

SEQ ID NO: 773666 - RNA, 14 nt, Listeria monocytogenes EGD-e
acugaacaaagaag

SEQ ID NO: 773667 - RNA, 16 nt, Listeria monocytogenes EGD-e
acucuuuaaauccauu

SEQ ID NO: 773668 - RNA, 18 nt, Listeria monocytogenes EGD-e
aauuauacuauaaagaac

SEQ ID NO: 773669 - RNA, 20 nt, Listeria monocytogenes EGD-e
aauuauacuauaaagaacua

SEQ ID NO: 773670 - RNA, 14 nt, Listeria monocytogenes EGD-e
aauuagucccauua

SEQ ID NO: 773671 - RNA, 14 nt, Listeria monocytogenes EGD-e
aauuauaauuuaau

SEQ ID NO: 773672 - RNA, 13 nt, Listeria monocytogenes EGD-e
aauuucaucguuu

SEQ ID NO: 773673 - RNA, 22 nt, Listeria monocytogenes EGD-e
aauuucaucguuuucuacugua

SEQ ID NO: 773674 - RNA, 22 nt, Listeria monocytogenes EGD-e
aauuucgccguuggaagugaaa

SEQ ID NO: 773675 - RNA, 16 nt, Listeria monocytogenes EGD-e
aauuucgaaauuaaaa

SEQ ID NO: 773676 - RNA, 17 nt, Listeria monocytogenes EGD-e
aauuucgaaauuaaaag

SEQ ID NO: 773677 - RNA, 19 nt, Listeria monocytogenes EGD-e
aauuuuaggcguaucuuuu

SEQ ID NO: 773678 - RNA, 13 nt, Listeria monocytogenes EGD-e
aauuuuacuucua

SEQ ID NO: 773679 - RNA, 22 nt, Listeria monocytogenes EGD-e
aauuuuaaauccguugucuucu

SEQ ID NO: 773680 - RNA, 15 nt, Listeria monocytogenes EGD-e
aauuugucuuuacua

SEQ ID NO: 773681 - RNA, 18 nt, Listeria monocytogenes EGD-e
aauuuguuuauccguuaa

SEQ ID NO: 773682 - RNA, 11 nt, Listeria monocytogenes EGD-e
aauuuuaaauc

SEQ ID NO: 773683 - RNA, 20 nt, Listeria monocytogenes EGD-e
aauuugauugccugaaauaa

SEQ ID NO: 773684 - RNA, 20 nt, Listeria monocytogenes EGD-e
aauuugccaaagagaaacuu

SEQ ID NO: 773685 - RNA, 20 nt, Listeria monocytogenes EGD-e
aauuugggagcuuucuuuuu

SEQ ID NO: 773686 - RNA, 21 nt, Listeria monocytogenes EGD-e
aauuuucauuuguuucuuuug

SEQ ID NO: 773687 - RNA, 21 nt, Listeria monocytogenes EGD-e
aauuuuggaguuaaguacaau

SEQ ID NO: 773688 - RNA, 19 nt, Listeria monocytogenes EGD-e
aauuuuuuugaaaaaacau

SEQ ID NO: 773689 - RNA, 16 nt, Listeria monocytogenes EGD-e
acaaaauaauaauaag

SEQ ID NO: 773690 - RNA, 17 nt, Listeria monocytogenes EGD-e
acaaaaggacaagccca

SEQ ID NO: 773691 - RNA, 16 nt, Listeria monocytogenes EGD-e
acaaaaguggaaaugu

SEQ ID NO: 773692 - RNA, 17 nt, Listeria monocytogenes EGD-e
acaaaacggaucuuucu

SEQ ID NO: 773693 - RNA, 16 nt, Listeria monocytogenes EGD-e
acaaaagauagacaca

SEQ ID NO: 773694 - RNA, 12 nt, Listeria monocytogenes EGD-e
acaaaaaauacg

SEQ ID NO: 773695 - RNA, 12 nt, Listeria monocytogenes EGD-e
acaaaaaaguuc

SEQ ID NO: 773696 - RNA, 23 nt, Listeria monocytogenes EGD-e
acaaacgcuuuuucaaaaucaag

SEQ ID NO: 773697 - RNA, 18 nt, Listeria monocytogenes EGD-e
acaaacuaguaauuuaau

SEQ ID NO: 773698 - RNA, 14 nt, Listeria monocytogenes EGD-e
acaaagaagaaaaa

SEQ ID NO: 773699 - RNA, 15 nt, Listeria monocytogenes EGD-e
acaaagaagaaaaag

SEQ ID NO: 773700 - RNA, 15 nt, Listeria monocytogenes EGD-e
acaaagcuauuuuuu

SEQ ID NO: 773701 - RNA, 15 nt, Listeria monocytogenes EGD-e
acaaaguaacuaaaa

SEQ ID NO: 773702 - RNA, 20 nt, Listeria monocytogenes EGD-e
acaaaguaacuaaaaaucau

SEQ ID NO: 773703 - RNA, 23 nt, Listeria monocytogenes EGD-e
acaaaggacaacagguuuugugu

SEQ ID NO: 773704 - RNA, 19 nt, Listeria monocytogenes EGD-e
acaaauuugccaaagagaa

SEQ ID NO: 773705 - RNA, 20 nt, Listeria monocytogenes EGD-e
acaaauuugccaaagagaaa

SEQ ID NO: 773706 - RNA, 14 nt, Listeria monocytogenes EGD-e
acaaauuauuagaa

SEQ ID NO: 773707 - RNA, 23 nt, Listeria monocytogenes EGD-e
acaagcguaugguucaaaaagau

SEQ ID NO: 773708 - RNA, 16 nt, Listeria monocytogenes EGD-e
acaagcgacaaaccaa

SEQ ID NO: 773709 - RNA, 23 nt, Listeria monocytogenes EGD-e
acaacuggcacagcgcuuaaaaa

SEQ ID NO: 773710 - RNA, 15 nt, Listeria monocytogenes EGD-e
acaacuaauuuuucg

SEQ ID NO: 773711 - RNA, 12 nt, Listeria monocytogenes EGD-e
acaacaugcgua

SEQ ID NO: 773712 - RNA, 14 nt, Listeria monocytogenes EGD-e
acaaccaucaaacu

SEQ ID NO: 773713 - RNA, 16 nt, Listeria monocytogenes EGD-e
acaacagguuuugugu

SEQ ID NO: 773714 - RNA, 20 nt, Listeria monocytogenes EGD-e
acacaaaaugcucaucaaga

SEQ ID NO: 773715 - RNA, 23 nt, Listeria monocytogenes EGD-e
acaauuuucauuuaacaucagau

SEQ ID NO: 773716 - RNA, 16 nt, Listeria monocytogenes EGD-e
acaauggaaugacaaa

SEQ ID NO: 773717 - RNA, 20 nt, Listeria monocytogenes EGD-e
acaauggaaugacaaaauua

SEQ ID NO: 773718 - RNA, 12 nt, Listeria monocytogenes EGD-e
acaauuaaaaua

SEQ ID NO: 773719 - RNA, 17 nt, Listeria monocytogenes EGD-e
acaaucgcgucuacuuu

SEQ ID NO: 773720 - RNA, 19 nt, Listeria monocytogenes EGD-e
acaaucgcgucuacuuuuc

SEQ ID NO: 773721 - RNA, 24 nt, Listeria monocytogenes EGD-e
acaaucgcauccacuaaauuauca

SEQ ID NO: 773722 - RNA, 23 nt, Listeria monocytogenes EGD-e
acaaguguuguaccauaagcagc

SEQ ID NO: 773723 - RNA, 20 nt, Listeria monocytogenes EGD-e
acaaguccgucaagcccagc

SEQ ID NO: 773724 - RNA, 14 nt, Listeria monocytogenes EGD-e
acaaguacuuugaa

SEQ ID NO: 773725 - RNA, 17 nt, Listeria monocytogenes EGD-e
acaaguaacucuuccaa

SEQ ID NO: 773726 - RNA, 15 nt, Listeria monocytogenes EGD-e
acaauacauaacuuc

SEQ ID NO: 773727 - RNA, 21 nt, Listeria monocytogenes EGD-e
acaauaccauguuuauuuaau

SEQ ID NO: 773728 - RNA, 18 nt, Listeria monocytogenes EGD-e
acacccgguccuucaauc

SEQ ID NO: 773729 - RNA, 12 nt, Listeria monocytogenes EGD-e
acaccaaauucg

SEQ ID NO: 773730 - RNA, 13 nt, Listeria monocytogenes EGD-e
acacauuauacga

SEQ ID NO: 773731 - RNA, 23 nt, Listeria monocytogenes EGD-e
acaccaauuucuguuuuguuuuc

SEQ ID NO: 773732 - RNA, 15 nt, Listeria monocytogenes EGD-e
acaccaauuuuaaau

SEQ ID NO: 773733 - RNA, 18 nt, Listeria monocytogenes EGD-e
acagauaguuguuccauu

SEQ ID NO: 773734 - RNA, 11 nt, Listeria monocytogenes EGD-e
acauaaaaagc

SEQ ID NO: 773735 - RNA, 22 nt, Listeria monocytogenes EGD-e
acauagucagggaauaagaaau

SEQ ID NO: 773736 - RNA, 17 nt, Listeria monocytogenes EGD-e
acauaguuauaaauacu

SEQ ID NO: 773737 - RNA, 17 nt, Listeria monocytogenes EGD-e
acauagcuacaauuaaa

SEQ ID NO: 773738 - RNA, 18 nt, Listeria monocytogenes EGD-e
acauagcuacaauuaaaa

SEQ ID NO: 773739 - RNA, 23 nt, Listeria monocytogenes EGD-e
acauccgcaugaauuuuugcauc

SEQ ID NO: 773740 - RNA, 16 nt, Listeria monocytogenes EGD-e
acauauaaucuacugu

SEQ ID NO: 773741 - RNA, 23 nt, Listeria monocytogenes EGD-e
acauauccggcguacuuaaauca

SEQ ID NO: 773742 - RNA, 12 nt, Listeria monocytogenes EGD-e
acauugaaaaaa

SEQ ID NO: 773743 - RNA, 15 nt, Listeria monocytogenes EGD-e
acauuaauucauuua

SEQ ID NO: 773744 - RNA, 19 nt, Listeria monocytogenes EGD-e
acauccuucagccaauucu

SEQ ID NO: 773745 - RNA, 22 nt, Listeria monocytogenes EGD-e
acauccuucagccaauucuucc

SEQ ID NO: 773746 - RNA, 23 nt, Listeria monocytogenes EGD-e
acauccuucagccaauucuucca

SEQ ID NO: 773747 - RNA, 14 nt, Listeria monocytogenes EGD-e
acaucgcuucugau

SEQ ID NO: 773748 - RNA, 13 nt, Listeria monocytogenes EGD-e
acauuuugaugua

SEQ ID NO: 773749 - RNA, 16 nt, Listeria monocytogenes EGD-e
acauuuugauguaguu

SEQ ID NO: 773750 - RNA, 14 nt, Listeria monocytogenes EGD-e
acauuuucucuugu

SEQ ID NO: 773751 - RNA, 23 nt, Listeria monocytogenes EGD-e
accacaagaagggcuuuuuuccu

SEQ ID NO: 773752 - RNA, 15 nt, Listeria monocytogenes EGD-e
accaaugcuuucuag

SEQ ID NO: 773753 - RNA, 14 nt, Listeria monocytogenes EGD-e
accaagaauaagca

SEQ ID NO: 773754 - RNA, 13 nt, Listeria monocytogenes EGD-e
accaacaauuacu

SEQ ID NO: 773755 - RNA, 21 nt, Listeria monocytogenes EGD-e
accagcuacuucggggcaaaa

SEQ ID NO: 773756 - RNA, 18 nt, Listeria monocytogenes EGD-e
accaccuugaauccgacc

SEQ ID NO: 773757 - RNA, 15 nt, Listeria monocytogenes EGD-e
accagcuucuaaguc

SEQ ID NO: 773758 - RNA, 12 nt, Listeria monocytogenes EGD-e
accaucgcaaaa

SEQ ID NO: 773759 - RNA, 21 nt, Listeria monocytogenes EGD-e
accaucgcaaaagcaaacaaa

SEQ ID NO: 773760 - RNA, 13 nt, Listeria monocytogenes EGD-e
acccauaauauua

SEQ ID NO: 773761 - RNA, 19 nt, Listeria monocytogenes EGD-e
acccauuugcauuggauug

SEQ ID NO: 773762 - RNA, 16 nt, Listeria monocytogenes EGD-e
acccgcguuuucuaac

SEQ ID NO: 773763 - RNA, 15 nt, Listeria monocytogenes EGD-e
acccuuuuuuuacau

SEQ ID NO: 773764 - RNA, 18 nt, Listeria monocytogenes EGD-e
acccuuugaauugauuuu

SEQ ID NO: 773765 - RNA, 23 nt, Listeria monocytogenes EGD-e
accgauaauagguccgauaauac

SEQ ID NO: 773766 - RNA, 21 nt, Listeria monocytogenes EGD-e
aaucagagagccuggauuuuc

SEQ ID NO: 773767 - RNA, 16 nt, Listeria monocytogenes EGD-e
aaucaauugguuuuac

SEQ ID NO: 773768 - RNA, 15 nt, Listeria monocytogenes EGD-e
aauauuuaauuuuau

SEQ ID NO: 773769 - RNA, 13 nt, Listeria monocytogenes EGD-e
aauauuauaucca

SEQ ID NO: 773770 - RNA, 16 nt, Listeria monocytogenes EGD-e
aauauuagaaaaucau

SEQ ID NO: 773771 - RNA, 16 nt, Listeria monocytogenes EGD-e
aaucaaaugcacagca

SEQ ID NO: 773772 - RNA, 13 nt, Listeria monocytogenes EGD-e
aauaucuucuaua

SEQ ID NO: 773773 - RNA, 18 nt, Listeria monocytogenes EGD-e
aauaucaccauuacuauu

SEQ ID NO: 773774 - RNA, 20 nt, Listeria monocytogenes EGD-e
aauaguuuugucaaaccauu

SEQ ID NO: 773775 - RNA, 16 nt, Listeria monocytogenes EGD-e
aauaggaaggagcaga

SEQ ID NO: 773776 - RNA, 18 nt, Listeria monocytogenes EGD-e
aauacgacaccaauuuua

SEQ ID NO: 773777 - RNA, 14 nt, Listeria monocytogenes EGD-e
aauacgugaaaauc

SEQ ID NO: 773778 - RNA, 19 nt, Listeria monocytogenes EGD-e
aauaccauguuuauuuaau

SEQ ID NO: 773779 - RNA, 22 nt, Listeria monocytogenes EGD-e
aauaccauguuuauuuaauaag

SEQ ID NO: 773780 - RNA, 18 nt, Listeria monocytogenes EGD-e
aauacuguuuuauauuuu

SEQ ID NO: 773781 - RNA, 23 nt, Listeria monocytogenes EGD-e
aauacuaacgcuuuuucagcaau

SEQ ID NO: 773782 - RNA, 17 nt, Listeria monocytogenes EGD-e
aauacaugaccgccaau

SEQ ID NO: 773783 - RNA, 19 nt, Listeria monocytogenes EGD-e
aauacauaacuucgguugu

SEQ ID NO: 773784 - RNA, 21 nt, Listeria monocytogenes EGD-e
aauacaggccacgugcaccug

SEQ ID NO: 773785 - RNA, 12 nt, Listeria monocytogenes EGD-e
aauaaagaacuu

SEQ ID NO: 773786 - RNA, 22 nt, Listeria monocytogenes EGD-e
aauaaagccaaaucgcggauaa

SEQ ID NO: 773787 - RNA, 22 nt, Listeria monocytogenes EGD-e
aauacaaacuuuuccuucuaca

SEQ ID NO: 773788 - RNA, 16 nt, Listeria monocytogenes EGD-e
aaucuuucggcacacu

SEQ ID NO: 773789 - RNA, 22 nt, Listeria monocytogenes EGD-e
aaucuuucacacgauaccaaag

SEQ ID NO: 773790 - RNA, 23 nt, Listeria monocytogenes EGD-e
aaucuuucacacgauaccaaagu

SEQ ID NO: 773791 - RNA, 14 nt, Listeria monocytogenes EGD-e
aaucugauuaaaag

SEQ ID NO: 773792 - RNA, 19 nt, Listeria monocytogenes EGD-e
aaucugcuucguccagcug

SEQ ID NO: 773793 - RNA, 15 nt, Listeria monocytogenes EGD-e
aaucuggauaaaaau

SEQ ID NO: 773794 - RNA, 16 nt, Listeria monocytogenes EGD-e
aaucuggauaaaaaua

SEQ ID NO: 773795 - RNA, 15 nt, Listeria monocytogenes EGD-e
aaucuucuugcuuca

SEQ ID NO: 773796 - RNA, 18 nt, Listeria monocytogenes EGD-e
aaucuucugccuguucac

SEQ ID NO: 773797 - RNA, 14 nt, Listeria monocytogenes EGD-e
aaugauaucaucaa

SEQ ID NO: 773798 - RNA, 15 nt, Listeria monocytogenes EGD-e
aaugauaucaucaau

SEQ ID NO: 773799 - RNA, 12 nt, Listeria monocytogenes EGD-e
aaugauagaaga

SEQ ID NO: 773800 - RNA, 20 nt, Listeria monocytogenes EGD-e
aaucugaacugacuagaaau

SEQ ID NO: 773801 - RNA, 15 nt, Listeria monocytogenes EGD-e
aaucucaucaccagc

SEQ ID NO: 773802 - RNA, 15 nt, Listeria monocytogenes EGD-e
aaucuaaaucuagua

SEQ ID NO: 773803 - RNA, 21 nt, Listeria monocytogenes EGD-e
aaucgagucaccgaauccaaa

SEQ ID NO: 773804 - RNA, 13 nt, Listeria monocytogenes EGD-e
aaucgcagcagau

SEQ ID NO: 773805 - RNA, 17 nt, Listeria monocytogenes EGD-e
aaucgcagggcagaaaa

SEQ ID NO: 773806 - RNA, 19 nt, Listeria monocytogenes EGD-e
aaucgcagggcagaaaaca

SEQ ID NO: 773807 - RNA, 23 nt, Listeria monocytogenes EGD-e
aaucgcagggcagaaaacagaaa

SEQ ID NO: 773808 - RNA, 17 nt, Listeria monocytogenes EGD-e
aauggauugcagguaau

SEQ ID NO: 773809 - RNA, 22 nt, Listeria monocytogenes EGD-e
aauggauugcagguaauuuaau

SEQ ID NO: 773810 - RNA, 17 nt, Listeria monocytogenes EGD-e
aaugcucaccuucuuuu

SEQ ID NO: 773811 - RNA, 14 nt, Listeria monocytogenes EGD-e
aaugcccaguaaaa

SEQ ID NO: 773812 - RNA, 19 nt, Listeria monocytogenes EGD-e
aauggcguuuuaaauccuu

SEQ ID NO: 773813 - RNA, 19 nt, Listeria monocytogenes EGD-e
aaugugaccuuaaauuaua

SEQ ID NO: 773814 - RNA, 24 nt, Listeria monocytogenes EGD-e
aaugugaccuuaaauuauacuaua

SEQ ID NO: 773815 - RNA, 17 nt, Listeria monocytogenes EGD-e
aauuaccuaaugaauaa

SEQ ID NO: 773816 - RNA, 22 nt, Listeria monocytogenes EGD-e
aauuagacauauaucuuaggaa

SEQ ID NO: 773817 - RNA, 23 nt, Listeria monocytogenes EGD-e
aauuaauauccacccuagcuaua

SEQ ID NO: 773818 - RNA, 23 nt, Listeria monocytogenes EGD-e
aauuaauaaaagaggauuuucca

SEQ ID NO: 773819 - RNA, 18 nt, Listeria monocytogenes EGD-e
aauuaagaaguacaauaa

SEQ ID NO: 773820 - RNA, 18 nt, Listeria monocytogenes EGD-e
aauguugguguaggaagu

SEQ ID NO: 773821 - RNA, 16 nt, Listeria monocytogenes EGD-e
aauguugcgaaacaac

SEQ ID NO: 773822 - RNA, 15 nt, Listeria monocytogenes EGD-e
aauguucuaaaauau

SEQ ID NO: 773823 - RNA, 12 nt, Listeria monocytogenes EGD-e
aauuaaaaguug

SEQ ID NO: 773824 - RNA, 17 nt, Listeria monocytogenes EGD-e
aagccaaugaccuaguu

SEQ ID NO: 773825 - RNA, 22 nt, Listeria monocytogenes EGD-e
aagccaaaucgcggauaauaau

SEQ ID NO: 773826 - RNA, 12 nt, Listeria monocytogenes EGD-e
aagcuauauaau

SEQ ID NO: 773827 - RNA, 17 nt, Listeria monocytogenes EGD-e
aagcuguuuucaacaaa

SEQ ID NO: 773828 - RNA, 20 nt, Listeria monocytogenes EGD-e
aagcuguuuucaacaaaaca

SEQ ID NO: 773829 - RNA, 22 nt, Listeria monocytogenes EGD-e
aagcuguuuucaacaaaacaaa

SEQ ID NO: 773830 - RNA, 23 nt, Listeria monocytogenes EGD-e
aagcuguuuucaacaaaacaaac

SEQ ID NO: 773831 - RNA, 23 nt, Listeria monocytogenes EGD-e
aaggagcggcucagauccuucaa

SEQ ID NO: 773832 - RNA, 15 nt, Listeria monocytogenes EGD-e
aaggcaacaaagaag

SEQ ID NO: 773833 - RNA, 18 nt, Listeria monocytogenes EGD-e
aaggauuugucacuugga

SEQ ID NO: 773834 - RNA, 20 nt, Listeria monocytogenes EGD-e
aaguuugggcauuacgaaag

SEQ ID NO: 773835 - RNA, 14 nt, Listeria monocytogenes EGD-e
aauaaaacaaaaga

SEQ ID NO: 773836 - RNA, 16 nt, Listeria monocytogenes EGD-e
aauaaaacaaaagaua

SEQ ID NO: 773837 - RNA, 14 nt, Listeria monocytogenes EGD-e
aauaaaaaaauaca

SEQ ID NO: 773838 - RNA, 21 nt, Listeria monocytogenes EGD-e
aaguggcgcaagugcuaaaau

SEQ ID NO: 773839 - RNA, 17 nt, Listeria monocytogenes EGD-e
aaguuaaucauuaaaua

SEQ ID NO: 773840 - RNA, 20 nt, Listeria monocytogenes EGD-e
aagugauguuucguuuuccu

SEQ ID NO: 773841 - RNA, 15 nt, Listeria monocytogenes EGD-e
aaguccgucaagccc

SEQ ID NO: 773842 - RNA, 18 nt, Listeria monocytogenes EGD-e
aaguaacuaaaaaucauu

SEQ ID NO: 773843 - RNA, 22 nt, Listeria monocytogenes EGD-e
aaguaacuaaaaaucauuuaaa

SEQ ID NO: 773844 - RNA, 13 nt, Listeria monocytogenes EGD-e
aaguaacuuuauc

SEQ ID NO: 773845 - RNA, 17 nt, Listeria monocytogenes EGD-e
aagucaaugauauuaug

SEQ ID NO: 773846 - RNA, 12 nt, Listeria monocytogenes EGD-e
aagucacagcgu

SEQ ID NO: 773847 - RNA, 16 nt, Listeria monocytogenes EGD-e
aagaauaguacauagu

SEQ ID NO: 773848 - RNA, 18 nt, Listeria monocytogenes EGD-e
aagaauugauucgucuua

SEQ ID NO: 773849 - RNA, 18 nt, Listeria monocytogenes EGD-e
aagacauaacaaguacaa

SEQ ID NO: 773850 - RNA, 12 nt, Listeria monocytogenes EGD-e
aagagauaaguu

SEQ ID NO: 773851 - RNA, 18 nt, Listeria monocytogenes EGD-e
aagagaaaaaguuucaau

SEQ ID NO: 773852 - RNA, 19 nt, Listeria monocytogenes EGD-e
aagagaaacuuuuucucaa

SEQ ID NO: 773853 - RNA, 20 nt, Listeria monocytogenes EGD-e
aagagaaacuuuuucucaaa

SEQ ID NO: 773854 - RNA, 21 nt, Listeria monocytogenes EGD-e
aagagaaacuuuuucucaaaa

SEQ ID NO: 773855 - RNA, 16 nt, Listeria monocytogenes EGD-e
aagagcggaagauguu

SEQ ID NO: 773856 - RNA, 14 nt, Listeria monocytogenes EGD-e
aagauaaacuaauu

SEQ ID NO: 773857 - RNA, 17 nt, Listeria monocytogenes EGD-e
aagauaaacuaauuacu

SEQ ID NO: 773858 - RNA, 16 nt, Listeria monocytogenes EGD-e
aagcaaaugcauuucu

SEQ ID NO: 773859 - RNA, 13 nt, Listeria monocytogenes EGD-e
aagcaacucuuuu

SEQ ID NO: 773860 - RNA, 15 nt, Listeria monocytogenes EGD-e
aagcaauaacaucuu

SEQ ID NO: 773861 - RNA, 15 nt, Listeria monocytogenes EGD-e
aagcacauguccauu

SEQ ID NO: 773862 - RNA, 18 nt, Listeria monocytogenes EGD-e
aagcacaaauuauuagaa

SEQ ID NO: 773863 - RNA, 13 nt, Listeria monocytogenes EGD-e
aagcacuuacugc

SEQ ID NO: 773864 - RNA, 18 nt, Listeria monocytogenes EGD-e
aagcaugaauuuuuauac

SEQ ID NO: 773865 - RNA, 17 nt, Listeria monocytogenes EGD-e
aagcauauuaauuugau

SEQ ID NO: 773866 - RNA, 15 nt, Listeria monocytogenes EGD-e
aagauuuugcucagc

SEQ ID NO: 773867 - RNA, 20 nt, Listeria monocytogenes EGD-e
aagauuuuguacauaaaagc

SEQ ID NO: 773868 - RNA, 22 nt, Listeria monocytogenes EGD-e
aagauuuuguacauaaaagcau

SEQ ID NO: 773869 - RNA, 12 nt, Listeria monocytogenes EGD-e
uuuguaaaaaua

SEQ ID NO: 773870 - RNA, 21 nt, Listeria monocytogenes EGD-e
uuuguaacaacuaauuuuucg

SEQ ID NO: 773871 - RNA, 23 nt, Listeria monocytogenes EGD-e
uuuguaauaguauacuuuuaauu

SEQ ID NO: 773872 - RNA, 17 nt, Listeria monocytogenes EGD-e
uuuguaggguuuggaaa

SEQ ID NO: 773873 - RNA, 22 nt, Listeria monocytogenes EGD-e
uuuguauugguuucuuguugaa

SEQ ID NO: 773874 - RNA, 21 nt, Listeria monocytogenes EGD-e
uuugugcaccaaagacgcuuu

SEQ ID NO: 773875 - RNA, 22 nt, Listeria monocytogenes EGD-e
uuugucuucggauuuuucaaau

SEQ ID NO: 773876 - RNA, 14 nt, Listeria monocytogenes EGD-e
uuugucaucauaaa

SEQ ID NO: 773877 - RNA, 18 nt, Listeria monocytogenes EGD-e
uuugguugcuuguuuugu

SEQ ID NO: 773878 - RNA, 19 nt, Listeria monocytogenes EGD-e
uuugguugcuuguuuuguc

SEQ ID NO: 773879 - RNA, 14 nt, Listeria monocytogenes EGD-e
uuugguaauaaucc

SEQ ID NO: 773880 - RNA, 21 nt, Listeria monocytogenes EGD-e
uuugguaaaaaacuguuguuc

SEQ ID NO: 773881 - RNA, 14 nt, Listeria monocytogenes EGD-e
uuugcuuuaaaaau

SEQ ID NO: 773882 - RNA, 14 nt, Listeria monocytogenes EGD-e
uuuguuaacuaaca

SEQ ID NO: 773883 - RNA, 16 nt, Listeria monocytogenes EGD-e
uuuguuaacuaacaaa

SEQ ID NO: 773884 - RNA, 20 nt, Listeria monocytogenes EGD-e
uuuguucucgccgacaagua

SEQ ID NO: 773885 - RNA, 13 nt, Listeria monocytogenes EGD-e
uuuguuuccaacg

SEQ ID NO: 773886 - RNA, 21 nt, Listeria monocytogenes EGD-e
uuuguuguuuucccagaaaaa

SEQ ID NO: 773887 - RNA, 14 nt, Listeria monocytogenes EGD-e
uuuguuguuuuggu

SEQ ID NO: 773888 - RNA, 13 nt, Listeria monocytogenes EGD-e
uuuuaaaauucua

SEQ ID NO: 773889 - RNA, 20 nt, Listeria monocytogenes EGD-e
uuuuaaaauucuauuaauaa

SEQ ID NO: 773890 - RNA, 20 nt, Listeria monocytogenes EGD-e
uuuuaaagcuugauuuaauu

SEQ ID NO: 773891 - RNA, 20 nt, Listeria monocytogenes EGD-e
uuuuaaaucuucugccuguu

SEQ ID NO: 773892 - RNA, 18 nt, Listeria monocytogenes EGD-e
uuuuaaauccguugucuu

SEQ ID NO: 773893 - RNA, 19 nt, Listeria monocytogenes EGD-e
uuuuaauaauuaagaccuu

SEQ ID NO: 773894 - RNA, 18 nt, Listeria monocytogenes EGD-e
uuuuaaugcgaaaaauga

SEQ ID NO: 773895 - RNA, 23 nt, Listeria monocytogenes EGD-e
uuuuaauuuuucuucaacagcuu

SEQ ID NO: 773896 - RNA, 13 nt, Listeria monocytogenes EGD-e
uuuuaauuucuuu

SEQ ID NO: 773897 - RNA, 16 nt, Listeria monocytogenes EGD-e
uuuuaauuaaaaguug

SEQ ID NO: 773898 - RNA, 14 nt, Listeria monocytogenes EGD-e
uuuuacuuacaaaa

SEQ ID NO: 773899 - RNA, 21 nt, Listeria monocytogenes EGD-e
uuuuacgaucuacuucuaaau

SEQ ID NO: 773900 - RNA, 14 nt, Listeria monocytogenes EGD-e
uuuuacgcauauca

SEQ ID NO: 773901 - RNA, 22 nt, Listeria monocytogenes EGD-e
uuuuauacgcaaugcugaaugu

SEQ ID NO: 773902 - RNA, 19 nt, Listeria monocytogenes EGD-e
uuuuauaauuaacaaccau

SEQ ID NO: 773903 - RNA, 12 nt, Listeria monocytogenes EGD-e
uuuuauaccauu

SEQ ID NO: 773904 - RNA, 15 nt, Listeria monocytogenes EGD-e
uuuuauaaaaauaca

SEQ ID NO: 773905 - RNA, 22 nt, Listeria monocytogenes EGD-e
uuuuauaaaaauacauuuuagc

SEQ ID NO: 773906 - RNA, 20 nt, Listeria monocytogenes EGD-e
uuuuauuacuuuauuuauuu

SEQ ID NO: 773907 - RNA, 13 nt, Listeria monocytogenes EGD-e
uuuuauuauaaaa

SEQ ID NO: 773908 - RNA, 21 nt, Listeria monocytogenes EGD-e
uuuuauucgaauaaagaacuu

SEQ ID NO: 773909 - RNA, 18 nt, Listeria monocytogenes EGD-e
uuuuaugacaauuaaaaa

SEQ ID NO: 773910 - RNA, 17 nt, Listeria monocytogenes EGD-e
uuuuaugcuaaaugaau

SEQ ID NO: 773911 - RNA, 18 nt, Listeria monocytogenes EGD-e
uuuuaugcacuuucaaau

SEQ ID NO: 773912 - RNA, 17 nt, Listeria monocytogenes EGD-e
uuuuaugcauaaaaaag

SEQ ID NO: 773913 - RNA, 22 nt, Listeria monocytogenes EGD-e
uuuuaucuggcaguuuuucaau

SEQ ID NO: 773914 - RNA, 21 nt, Listeria monocytogenes EGD-e
uuuuaugaaaaaaaauaaaug

SEQ ID NO: 773915 - RNA, 23 nt, Listeria monocytogenes EGD-e
uuuuaugaaaaaaaauaaaugca

SEQ ID NO: 773916 - RNA, 14 nt, Listeria monocytogenes EGD-e
uuuuccuaauuuua

SEQ ID NO: 773917 - RNA, 18 nt, Listeria monocytogenes EGD-e
uuuucccagaaaaaaaca

SEQ ID NO: 773918 - RNA, 19 nt, Listeria monocytogenes EGD-e
uuuucauuuguuucuuuug

SEQ ID NO: 773919 - RNA, 12 nt, Listeria monocytogenes EGD-e
uuuucagcaaug

SEQ ID NO: 773920 - RNA, 21 nt, Listeria monocytogenes EGD-e
uuuucagcuaaauauuuaauu

SEQ ID NO: 773921 - RNA, 21 nt, Listeria monocytogenes EGD-e
uuuucaacgauagauuuuaau

SEQ ID NO: 773922 - RNA, 22 nt, Listeria monocytogenes EGD-e
uuuucaacgauagauuuuaauu

SEQ ID NO: 773923 - RNA, 15 nt, Listeria monocytogenes EGD-e
uuuucaacaaaacaa

SEQ ID NO: 773924 - RNA, 16 nt, Listeria monocytogenes EGD-e
uuuucaaguaaaaaca

SEQ ID NO: 773925 - RNA, 14 nt, Listeria monocytogenes EGD-e
uuuuauuuuuaaag

SEQ ID NO: 773926 - RNA, 23 nt, Listeria monocytogenes EGD-e
uuuuauuuuucagcuaaauauuu

SEQ ID NO: 773927 - RNA, 21 nt, Listeria monocytogenes EGD-e
uuuuauuuugguuauuucuuu

SEQ ID NO: 773928 - RNA, 13 nt, Listeria monocytogenes EGD-e
uuuuucaaaauca

SEQ ID NO: 773929 - RNA, 16 nt, Listeria monocytogenes EGD-e
uuuuucaaggcuuucu

SEQ ID NO: 773930 - RNA, 12 nt, Listeria monocytogenes EGD-e
uuuuuaugcaua

SEQ ID NO: 773931 - RNA, 15 nt, Listeria monocytogenes EGD-e
uuuuuaaacuauuuu

SEQ ID NO: 773932 - RNA, 23 nt, Listeria monocytogenes EGD-e
uuuugguuauuucuuuaucuuuc

SEQ ID NO: 773933 - RNA, 12 nt, Listeria monocytogenes EGD-e
uuuucuauuccu

SEQ ID NO: 773934 - RNA, 17 nt, Listeria monocytogenes EGD-e
uuuucuaaucaaaugca

SEQ ID NO: 773935 - RNA, 20 nt, Listeria monocytogenes EGD-e
uuuucuuccaccgcuuguuu

SEQ ID NO: 773936 - RNA, 13 nt, Listeria monocytogenes EGD-e
uuuucuuccauau

SEQ ID NO: 773937 - RNA, 13 nt, Listeria monocytogenes EGD-e
uuuugaaaaaaca

SEQ ID NO: 773938 - RNA, 21 nt, Listeria monocytogenes EGD-e
uuuucuuuuccuaauuuuacu

SEQ ID NO: 773939 - RNA, 21 nt, Listeria monocytogenes EGD-e
uuuugcacaaaaugcaaaacc

SEQ ID NO: 773940 - RNA, 17 nt, Listeria monocytogenes EGD-e
uuuugaugcgaaaaaug

SEQ ID NO: 773941 - RNA, 21 nt, Listeria monocytogenes EGD-e
uuuugaugcgaaaaaugaaaa

SEQ ID NO: 773942 - RNA, 15 nt, Listeria monocytogenes EGD-e
uuuugcucaguaguu

SEQ ID NO: 773943 - RNA, 21 nt, Listeria monocytogenes EGD-e
uuuugcucaguaguucuuuua

SEQ ID NO: 773944 - RNA, 14 nt, Listeria monocytogenes EGD-e
uuuugcucaaguga

SEQ ID NO: 773945 - RNA, 15 nt, Listeria monocytogenes EGD-e
uuuugcuggugcuuu

SEQ ID NO: 773946 - RNA, 14 nt, Listeria monocytogenes EGD-e
uuuugcuucuucca

SEQ ID NO: 773947 - RNA, 14 nt, Listeria monocytogenes EGD-e
aaauucaauuuaua

SEQ ID NO: 773948 - RNA, 14 nt, Listeria monocytogenes EGD-e
aaauucuauuaaua

SEQ ID NO: 773949 - RNA, 15 nt, Listeria monocytogenes EGD-e
aaauucuauuaauaa

SEQ ID NO: 773950 - RNA, 16 nt, Listeria monocytogenes EGD-e
aaauucuauuaauaau

SEQ ID NO: 773951 - RNA, 19 nt, Listeria monocytogenes EGD-e
aaauucccggucauuuuca

SEQ ID NO: 773952 - RNA, 19 nt, Listeria monocytogenes EGD-e
aaauuaucccguuuguuaa

SEQ ID NO: 773953 - RNA, 14 nt, Listeria monocytogenes EGD-e
aaauuauacuauaa

SEQ ID NO: 773954 - RNA, 22 nt, Listeria monocytogenes EGD-e
uuuuuuuaugcauaaaaaagca

SEQ ID NO: 773955 - RNA, 12 nt, Listeria monocytogenes EGD-e
uuuuuuguucug

SEQ ID NO: 773956 - RNA, 16 nt, Listeria monocytogenes EGD-e
uuuuuuguugucaaug

SEQ ID NO: 773957 - RNA, 20 nt, Listeria monocytogenes EGD-e
uuuuuugaugcgaaaaauga

SEQ ID NO: 773958 - RNA, 18 nt, Listeria monocytogenes EGD-e
aaauuacguuucacuuua

SEQ ID NO: 773959 - RNA, 17 nt, Listeria monocytogenes EGD-e
aaauuaccuaaugaaua

SEQ ID NO: 773960 - RNA, 18 nt, Listeria monocytogenes EGD-e
aaauuacugaauaaguaa

SEQ ID NO: 773961 - RNA, 14 nt, Listeria monocytogenes EGD-e
uuuuugcuuuugau

SEQ ID NO: 773962 - RNA, 15 nt, Listeria monocytogenes EGD-e
uuuuugaguuggaau

SEQ ID NO: 773963 - RNA, 13 nt, Listeria monocytogenes EGD-e
uuuuugaauaacu

SEQ ID NO: 773964 - RNA, 16 nt, Listeria monocytogenes EGD-e
uuuuugaaaaaacauc

SEQ ID NO: 773965 - RNA, 15 nt, Listeria monocytogenes EGD-e
uuuuucuuugccuua

SEQ ID NO: 773966 - RNA, 12 nt, Listeria monocytogenes EGD-e
uuuuuccuucau

SEQ ID NO: 773967 - RNA, 19 nt, Listeria monocytogenes EGD-e
uuuuucuauauucauccuc

SEQ ID NO: 773968 - RNA, 13 nt, Listeria monocytogenes EGD-e
uuuuuuauuuaau

SEQ ID NO: 773969 - RNA, 14 nt, Listeria monocytogenes EGD-e
uuuuuuauuuaccu

SEQ ID NO: 773970 - RNA, 13 nt, Listeria monocytogenes EGD-e
uuuuuuauuaucc

SEQ ID NO: 773971 - RNA, 19 nt, Listeria monocytogenes EGD-e
aaauuaaaagcuaauuauu

SEQ ID NO: 773972 - RNA, 19 nt, Listeria monocytogenes EGD-e
aaauuaaauuuuuuugaaa

SEQ ID NO: 773973 - RNA, 22 nt, Listeria monocytogenes EGD-e
aaauuaaauuuuuuugaaaaaa

SEQ ID NO: 773974 - RNA, 21 nt, Listeria monocytogenes EGD-e
aaauuaaugccaguauuuuga

SEQ ID NO: 773975 - RNA, 19 nt, Listeria monocytogenes EGD-e
uuuccgcaaguucggaacu

SEQ ID NO: 773976 - RNA, 16 nt, Listeria monocytogenes EGD-e
uuucccugcgucuucu

SEQ ID NO: 773977 - RNA, 23 nt, Listeria monocytogenes EGD-e
uuucgcuccguauuuauauucuu

SEQ ID NO: 773978 - RNA, 16 nt, Listeria monocytogenes EGD-e
uuucgauuaauauacu

SEQ ID NO: 773979 - RNA, 18 nt, Listeria monocytogenes EGD-e
uuucgauauuuuuuuguu

SEQ ID NO: 773980 - RNA, 21 nt, Listeria monocytogenes EGD-e
uuuccuaauuuuacuucuacu

SEQ ID NO: 773981 - RNA, 15 nt, Listeria monocytogenes EGD-e
uuucguuucagcucu

SEQ ID NO: 773982 - RNA, 18 nt, Listeria monocytogenes EGD-e
uuucuauauucauccuca

SEQ ID NO: 773983 - RNA, 16 nt, Listeria monocytogenes EGD-e
uuucuagugcaucuuc

SEQ ID NO: 773984 - RNA, 19 nt, Listeria monocytogenes EGD-e
uuucuagugcaucuucuaa

SEQ ID NO: 773985 - RNA, 12 nt, Listeria monocytogenes EGD-e
uuucucuuguaa

SEQ ID NO: 773986 - RNA, 13 nt, Listeria monocytogenes EGD-e
uuugaauaagcaa

SEQ ID NO: 773987 - RNA, 19 nt, Listeria monocytogenes EGD-e
uuugaauaacuuuccagcg

SEQ ID NO: 773988 - RNA, 14 nt, Listeria monocytogenes EGD-e
uuugaaaaaacauc

SEQ ID NO: 773989 - RNA, 12 nt, Listeria monocytogenes EGD-e
uuucuuuuguuc

SEQ ID NO: 773990 - RNA, 16 nt, Listeria monocytogenes EGD-e
uuucuuuuguucuucu

SEQ ID NO: 773991 - RNA, 20 nt, Listeria monocytogenes EGD-e
uuugaauuaguauuuuguuc

SEQ ID NO: 773992 - RNA, 21 nt, Listeria monocytogenes EGD-e
uuugacaaaaggacaagccca

SEQ ID NO: 773993 - RNA, 18 nt, Listeria monocytogenes EGD-e
uuucuguuuuguuuucag

SEQ ID NO: 773994 - RNA, 15 nt, Listeria monocytogenes EGD-e
uuucuuccauauuuu

SEQ ID NO: 773995 - RNA, 22 nt, Listeria monocytogenes EGD-e
uuucuuccauauuuucucuaaa

SEQ ID NO: 773996 - RNA, 14 nt, Listeria monocytogenes EGD-e
uuucuugauuuguu

SEQ ID NO: 773997 - RNA, 21 nt, Listeria monocytogenes EGD-e
uuucuugcugcauuuucacaa

SEQ ID NO: 773998 - RNA, 14 nt, Listeria monocytogenes EGD-e
uuucuuuuauuuuu

SEQ ID NO: 773999 - RNA, 21 nt, Listeria monocytogenes EGD-e
uuugauuaauaaaguuguaag

SEQ ID NO: 774000 - RNA, 19 nt, Listeria monocytogenes EGD-e
uuugauuaggcauuucuuu

SEQ ID NO: 774001 - RNA, 17 nt, Listeria monocytogenes EGD-e
uuugcacaaaaugcaaa

SEQ ID NO: 774002 - RNA, 15 nt, Listeria monocytogenes EGD-e
uuugaguuggaauac

SEQ ID NO: 774003 - RNA, 19 nt, Listeria monocytogenes EGD-e
uuugcccaccgauaauagg

SEQ ID NO: 774004 - RNA, 22 nt, Listeria monocytogenes EGD-e
uuguuucauauaauuuuuucau

SEQ ID NO: 774005 - RNA, 14 nt, Listeria monocytogenes EGD-e
uuguuguucuaaua

SEQ ID NO: 774006 - RNA, 11 nt, Listeria monocytogenes EGD-e
uuguuuuguua

SEQ ID NO: 774007 - RNA, 19 nt, Listeria monocytogenes EGD-e
uuuaaagcguuuuucugca

SEQ ID NO: 774008 - RNA, 17 nt, Listeria monocytogenes EGD-e
uuuaaagcuuuuaaauu

SEQ ID NO: 774009 - RNA, 16 nt, Listeria monocytogenes EGD-e
uuuaaaauccaauaau

SEQ ID NO: 774010 - RNA, 18 nt, Listeria monocytogenes EGD-e
uuuaaauaguaguuauuu

SEQ ID NO: 774011 - RNA, 21 nt, Listeria monocytogenes EGD-e
uuuaacaucagauuaaauaua

SEQ ID NO: 774012 - RNA, 19 nt, Listeria monocytogenes EGD-e
uuuacuggcaacuucaaaa

SEQ ID NO: 774013 - RNA, 17 nt, Listeria monocytogenes EGD-e
uuuacucccuuuuucca

SEQ ID NO: 774014 - RNA, 22 nt, Listeria monocytogenes EGD-e
uuuacgcauaucaucaauaaaa

SEQ ID NO: 774015 - RNA, 22 nt, Listeria monocytogenes EGD-e
uuuaguagagcuucuguuuuuu

SEQ ID NO: 774016 - RNA, 16 nt, Listeria monocytogenes EGD-e
uuuaccuugaucaaaa

SEQ ID NO: 774017 - RNA, 19 nt, Listeria monocytogenes EGD-e
uuuacgaacgauuuccgca

SEQ ID NO: 774018 - RNA, 15 nt, Listeria monocytogenes EGD-e
uuuaauugucauaaa

SEQ ID NO: 774019 - RNA, 19 nt, Listeria monocytogenes EGD-e
uuuaauugucgaaaaccua

SEQ ID NO: 774020 - RNA, 15 nt, Listeria monocytogenes EGD-e
uuuaauuuuaucugg

SEQ ID NO: 774021 - RNA, 18 nt, Listeria monocytogenes EGD-e
uuucacaaguaacucuuc

SEQ ID NO: 774022 - RNA, 13 nt, Listeria monocytogenes EGD-e
uuucaacaaaaca

SEQ ID NO: 774023 - RNA, 14 nt, Listeria monocytogenes EGD-e
uuucaacaaaacaa

SEQ ID NO: 774024 - RNA, 18 nt, Listeria monocytogenes EGD-e
uuucaacaaaacaaacua

SEQ ID NO: 774025 - RNA, 21 nt, Listeria monocytogenes EGD-e
uuucaaaucagcuuccauacu

SEQ ID NO: 774026 - RNA, 21 nt, Listeria monocytogenes EGD-e
uuucagcuaaucguuuuaaag

SEQ ID NO: 774027 - RNA, 15 nt, Listeria monocytogenes EGD-e
uuucauauaaguguu

SEQ ID NO: 774028 - RNA, 16 nt, Listeria monocytogenes EGD-e
uuucauauaauuuuuu

SEQ ID NO: 774029 - RNA, 22 nt, Listeria monocytogenes EGD-e
uuucauagccggaccugaaaga

SEQ ID NO: 774030 - RNA, 19 nt, Listeria monocytogenes EGD-e
uuuccaccauuuguuuuau

SEQ ID NO: 774031 - RNA, 17 nt, Listeria monocytogenes EGD-e
uuaaccuacuuuaauuu

SEQ ID NO: 774032 - RNA, 13 nt, Listeria monocytogenes EGD-e
uuaacccaauuuu

SEQ ID NO: 774033 - RNA, 15 nt, Listeria monocytogenes EGD-e
uuaauacggugaaug

SEQ ID NO: 774034 - RNA, 20 nt, Listeria monocytogenes EGD-e
uuaauacggugaaugccagc

SEQ ID NO: 774035 - RNA, 16 nt, Listeria monocytogenes EGD-e
uuaaguuuacaaugga

SEQ ID NO: 774036 - RNA, 22 nt, Listeria monocytogenes EGD-e
uuaauuucuggguguuuauuca

SEQ ID NO: 774037 - RNA, 21 nt, Listeria monocytogenes EGD-e
uuaauuuccauuucgauaacu

SEQ ID NO: 774038 - RNA, 15 nt, Listeria monocytogenes EGD-e
uuaaucuaaaucuag

SEQ ID NO: 774039 - RNA, 23 nt, Listeria monocytogenes EGD-e
uuaguuacuccuccaaauuauaa

SEQ ID NO: 774040 - RNA, 15 nt, Listeria monocytogenes EGD-e
uuaguggagcucuuu

SEQ ID NO: 774041 - RNA, 15 nt, Listeria monocytogenes EGD-e
uuauaaaagcuucua

SEQ ID NO: 774042 - RNA, 16 nt, Listeria monocytogenes EGD-e
uuauaaaagcuucuau

SEQ ID NO: 774043 - RNA, 12 nt, Listeria monocytogenes EGD-e
uuauaaaaauac

SEQ ID NO: 774044 - RNA, 13 nt, Listeria monocytogenes EGD-e
uuaguauuucagc

SEQ ID NO: 774045 - RNA, 14 nt, Listeria monocytogenes EGD-e
uuaguauuucccag

SEQ ID NO: 774046 - RNA, 19 nt, Listeria monocytogenes EGD-e
uuauaaguguaaaaguuaa

SEQ ID NO: 774047 - RNA, 18 nt, Listeria monocytogenes EGD-e
uuauaaauaccuguuucu

SEQ ID NO: 774048 - RNA, 16 nt, Listeria monocytogenes EGD-e
uuauaaccccaaaaug

SEQ ID NO: 774049 - RNA, 22 nt, Listeria monocytogenes EGD-e
uuagaagaugcacuagaaaaau

SEQ ID NO: 774050 - RNA, 17 nt, Listeria monocytogenes EGD-e
uuagaggcguacuaaaa

SEQ ID NO: 774051 - RNA, 19 nt, Listeria monocytogenes EGD-e
uuagaggcguacuaaaaau

SEQ ID NO: 774052 - RNA, 20 nt, Listeria monocytogenes EGD-e
uuagaggcguacuaaaaauu

SEQ ID NO: 774053 - RNA, 14 nt, Listeria monocytogenes EGD-e
uuacuaaaaaggua

SEQ ID NO: 774054 - RNA, 17 nt, Listeria monocytogenes EGD-e
uuacguuucacuuuauc

SEQ ID NO: 774055 - RNA, 21 nt, Listeria monocytogenes EGD-e
uuacugguuuuucuuuuccua

SEQ ID NO: 774056 - RNA, 14 nt, Listeria monocytogenes EGD-e
uuacucccuuuuuc

SEQ ID NO: 774057 - RNA, 13 nt, Listeria monocytogenes EGD-e
uuacuccaaaaua

SEQ ID NO: 774058 - RNA, 18 nt, Listeria monocytogenes EGD-e
uuaugaaaaaaaauaaau

SEQ ID NO: 774059 - RNA, 16 nt, Listeria monocytogenes EGD-e
uuaugacaauuaaaaa

SEQ ID NO: 774060 - RNA, 18 nt, Listeria monocytogenes EGD-e
uuaugaagugauguaucu

SEQ ID NO: 774061 - RNA, 12 nt, Listeria monocytogenes EGD-e
uuauuaaaagga

SEQ ID NO: 774062 - RNA, 16 nt, Listeria monocytogenes EGD-e
uuaugucggugcauuu

SEQ ID NO: 774063 - RNA, 19 nt, Listeria monocytogenes EGD-e
uuaugauuuguuucugguu

SEQ ID NO: 774064 - RNA, 19 nt, Listeria monocytogenes EGD-e
uuaucaaacaaaaaaguuc

SEQ ID NO: 774065 - RNA, 17 nt, Listeria monocytogenes EGD-e
uuauauucuucugucac

SEQ ID NO: 774066 - RNA, 13 nt, Listeria monocytogenes EGD-e
uuauagcggucaa

SEQ ID NO: 774067 - RNA, 16 nt, Listeria monocytogenes EGD-e
uuauagguaacaucuu

SEQ ID NO: 774068 - RNA, 19 nt, Listeria monocytogenes EGD-e
uucacaucacuaauuagca

SEQ ID NO: 774069 - RNA, 22 nt, Listeria monocytogenes EGD-e
uucacacgauaccaaaguuguc

SEQ ID NO: 774070 - RNA, 15 nt, Listeria monocytogenes EGD-e
uucaaucaagccuag

SEQ ID NO: 774071 - RNA, 13 nt, Listeria monocytogenes EGD-e
uucagccaauucu

SEQ ID NO: 774072 - RNA, 11 nt, Listeria monocytogenes EGD-e
uucaaaaagau

SEQ ID NO: 774073 - RNA, 19 nt, Listeria monocytogenes EGD-e
uuauuuuucagcuaaauau

SEQ ID NO: 774074 - RNA, 12 nt, Listeria monocytogenes EGD-e
uuauuauaaaaa

SEQ ID NO: 774075 - RNA, 13 nt, Listeria monocytogenes EGD-e
uuauuacuuuauu

SEQ ID NO: 774076 - RNA, 22 nt, Listeria monocytogenes EGD-e
uucaaacgaucagccauuuuac

SEQ ID NO: 774077 - RNA, 15 nt, Listeria monocytogenes EGD-e
uucaaccaagcaaua

SEQ ID NO: 774078 - RNA, 13 nt, Listeria monocytogenes EGD-e
uucaaccaauucu

SEQ ID NO: 774079 - RNA, 15 nt, Listeria monocytogenes EGD-e
uucaagaccaagaac

SEQ ID NO: 774080 - RNA, 15 nt, Listeria monocytogenes EGD-e
uucaagcauauuaau

SEQ ID NO: 774081 - RNA, 19 nt, Listeria monocytogenes EGD-e
uucaagcauuucauaauca

SEQ ID NO: 774082 - RNA, 12 nt, Listeria monocytogenes EGD-e
uugaaaaaacau

SEQ ID NO: 774083 - RNA, 18 nt, Listeria monocytogenes EGD-e
uugaaaacugaacaaaga

SEQ ID NO: 774084 - RNA, 21 nt, Listeria monocytogenes EGD-e
uugaaaacugaacaaagaaga

SEQ ID NO: 774085 - RNA, 13 nt, Listeria monocytogenes EGD-e
uucuuuuucuucu

SEQ ID NO: 774086 - RNA, 19 nt, Listeria monocytogenes EGD-e
uucuuuuacggcuucaaug

SEQ ID NO: 774087 - RNA, 13 nt, Listeria monocytogenes EGD-e
uucuuuuaguucg

SEQ ID NO: 774088 - RNA, 17 nt, Listeria monocytogenes EGD-e
uucuuugccuuaaaaua

SEQ ID NO: 774089 - RNA, 14 nt, Listeria monocytogenes EGD-e
uucuuucuuuuguu

SEQ ID NO: 774090 - RNA, 15 nt, Listeria monocytogenes EGD-e
uucuuuccccuuuuu

SEQ ID NO: 774091 - RNA, 17 nt, Listeria monocytogenes EGD-e
uucuuuacauauuccaa

SEQ ID NO: 774092 - RNA, 17 nt, Listeria monocytogenes EGD-e
uucuugauuuguuuuau

SEQ ID NO: 774093 - RNA, 16 nt, Listeria monocytogenes EGD-e
uugaaugucacuucac

SEQ ID NO: 774094 - RNA, 22 nt, Listeria monocytogenes EGD-e
uugacuaccaccuugaauccga

SEQ ID NO: 774095 - RNA, 18 nt, Listeria monocytogenes EGD-e
uugacgcaaggaaucuua

SEQ ID NO: 774096 - RNA, 20 nt, Listeria monocytogenes EGD-e
uugaccagugugguuuacuc

SEQ ID NO: 774097 - RNA, 21 nt, Listeria monocytogenes EGD-e
uugacaaaaggacaagcccag

SEQ ID NO: 774098 - RNA, 15 nt, Listeria monocytogenes EGD-e
uugaauugauuuuuu

SEQ ID NO: 774099 - RNA, 19 nt, Listeria monocytogenes EGD-e
uugauauccaguauuuccc

SEQ ID NO: 774100 - RNA, 14 nt, Listeria monocytogenes EGD-e
uugauccaaguuuu

SEQ ID NO: 774101 - RNA, 11 nt, Listeria monocytogenes EGD-e
uugauuuaaau

SEQ ID NO: 774102 - RNA, 12 nt, Listeria monocytogenes EGD-e
uugauuuaaaua

SEQ ID NO: 774103 - RNA, 20 nt, Listeria monocytogenes EGD-e
uugauuuaaauaaacaaauu

SEQ ID NO: 774104 - RNA, 19 nt, Listeria monocytogenes EGD-e
uugauucgucuuagaaaaa

SEQ ID NO: 774105 - RNA, 20 nt, Listeria monocytogenes EGD-e
uugcaaucccuauaaaaaca

SEQ ID NO: 774106 - RNA, 17 nt, Listeria monocytogenes EGD-e
uugcaacaguuauuaaa

SEQ ID NO: 774107 - RNA, 20 nt, Listeria monocytogenes EGD-e
uugcaacaguuauuaaaagg

SEQ ID NO: 774108 - RNA, 21 nt, Listeria monocytogenes EGD-e
uugcaacaguuauuaaaagga

SEQ ID NO: 774109 - RNA, 15 nt, Listeria monocytogenes EGD-e
uugcaccaaaaauac

SEQ ID NO: 774110 - RNA, 19 nt, Listeria monocytogenes EGD-e
uuccuaauuuuacuucuac

SEQ ID NO: 774111 - RNA, 18 nt, Listeria monocytogenes EGD-e
uuccgcucuuuuuuauga

SEQ ID NO: 774112 - RNA, 14 nt, Listeria monocytogenes EGD-e
uuccuccaauuuua

SEQ ID NO: 774113 - RNA, 14 nt, Listeria monocytogenes EGD-e
uucccagaaaaaaa

SEQ ID NO: 774114 - RNA, 14 nt, Listeria monocytogenes EGD-e
uucccaucauaucu

SEQ ID NO: 774115 - RNA, 17 nt, Listeria monocytogenes EGD-e
uucccacagaucaaaag

SEQ ID NO: 774116 - RNA, 22 nt, Listeria monocytogenes EGD-e
uucccacagaucaaaagcaaaa

SEQ ID NO: 774117 - RNA, 18 nt, Listeria monocytogenes EGD-e
uuccgauacaacaaaaua

SEQ ID NO: 774118 - RNA, 20 nt, Listeria monocytogenes EGD-e
uucccuuuacuugcaaaugc

SEQ ID NO: 774119 - RNA, 12 nt, Listeria monocytogenes EGD-e
uuccauuuaauu

SEQ ID NO: 774120 - RNA, 15 nt, Listeria monocytogenes EGD-e
uuccaucuucuaaug

SEQ ID NO: 774121 - RNA, 22 nt, Listeria monocytogenes EGD-e
uuccacuccagcugcuucuaaa

SEQ ID NO: 774122 - RNA, 21 nt, Listeria monocytogenes EGD-e
uucuauuccuccuaauuguuu

SEQ ID NO: 774123 - RNA, 12 nt, Listeria monocytogenes EGD-e
uucuauuaauaa

SEQ ID NO: 774124 - RNA, 14 nt, Listeria monocytogenes EGD-e
uucuagugcaucuu

SEQ ID NO: 774125 - RNA, 18 nt, Listeria monocytogenes EGD-e
uucuaagucaaaacguuc

SEQ ID NO: 774126 - RNA, 17 nt, Listeria monocytogenes EGD-e
uucucgaauaccagcag

SEQ ID NO: 774127 - RNA, 19 nt, Listeria monocytogenes EGD-e
uucucauaagcuucauaaa

SEQ ID NO: 774128 - RNA, 23 nt, Listeria monocytogenes EGD-e
uucucaggaguuaauucuguuaa

SEQ ID NO: 774129 - RNA, 14 nt, Listeria monocytogenes EGD-e
uucguuaguauuuc

SEQ ID NO: 774130 - RNA, 19 nt, Listeria monocytogenes EGD-e
uucgugcgcaacauucaaa

SEQ ID NO: 774131 - RNA, 15 nt, Listeria monocytogenes EGD-e
uucuaaauaaauauu

SEQ ID NO: 774132 - RNA, 14 nt, Listeria monocytogenes EGD-e
uucuaagaaaaaaa

SEQ ID NO: 774133 - RNA, 14 nt, Listeria monocytogenes EGD-e
uucguacauuuuuu

SEQ ID NO: 774134 - RNA, 21 nt, Listeria monocytogenes EGD-e
uucgguccuuguacuaauucu

SEQ ID NO: 774135 - RNA, 17 nt, Listeria monocytogenes EGD-e
uucgcuguccauuccaa

SEQ ID NO: 774136 - RNA, 14 nt, Listeria monocytogenes EGD-e
uuccuuuacagaaa

SEQ ID NO: 774137 - RNA, 15 nt, Listeria monocytogenes EGD-e
uuccuuuuguuuuaa

SEQ ID NO: 774138 - RNA, 21 nt, Listeria monocytogenes EGD-e
uuccuuuuguuuuaauaaauc

SEQ ID NO: 774139 - RNA, 14 nt, Listeria monocytogenes EGD-e
uucgaaagaaaugu

SEQ ID NO: 774140 - RNA, 22 nt, Listeria monocytogenes EGD-e
uucgaaagcaaaugcauuucuc

SEQ ID NO: 774141 - RNA, 23 nt, Listeria monocytogenes EGD-e
uucgaaagcaaaugcauuucucg

SEQ ID NO: 774142 - RNA, 15 nt, Listeria monocytogenes EGD-e
uucgaaaguuucuuu

SEQ ID NO: 774143 - RNA, 17 nt, Listeria monocytogenes EGD-e
uucgaaaguuucuuuuu

SEQ ID NO: 774144 - RNA, 13 nt, Listeria monocytogenes EGD-e
uggagauucauaa

SEQ ID NO: 774145 - RNA, 19 nt, Listeria monocytogenes EGD-e
uggaucauauucuucuaaa

SEQ ID NO: 774146 - RNA, 22 nt, Listeria monocytogenes EGD-e
uggauaaaauggcguuuuaaau

SEQ ID NO: 774147 - RNA, 21 nt, Listeria monocytogenes EGD-e
uggauuuucuagguucuuuuu

SEQ ID NO: 774148 - RNA, 16 nt, Listeria monocytogenes EGD-e
ugggcaguccaccagc

SEQ ID NO: 774149 - RNA, 14 nt, Listeria monocytogenes EGD-e
uggguaaguagcau

SEQ ID NO: 774150 - RNA, 23 nt, Listeria monocytogenes EGD-e
ugggaaugaauagauauucucuu

SEQ ID NO: 774151 - RNA, 21 nt, Listeria monocytogenes EGD-e
uggccuucgauaguuccuucu

SEQ ID NO: 774152 - RNA, 19 nt, Listeria monocytogenes EGD-e
uguaaaugcgacauacuuu

SEQ ID NO: 774153 - RNA, 17 nt, Listeria monocytogenes EGD-e
uguaagauaauacguga

SEQ ID NO: 774154 - RNA, 22 nt, Listeria monocytogenes EGD-e
uguaagguuuuuuuaugcauaa

SEQ ID NO: 774155 - RNA, 15 nt, Listeria monocytogenes EGD-e
uguaauucgaauaag

SEQ ID NO: 774156 - RNA, 19 nt, Listeria monocytogenes EGD-e
uguaauucuaaauaaauau

SEQ ID NO: 774157 - RNA, 12 nt, Listeria monocytogenes EGD-e
uguacauaaaag

SEQ ID NO: 774158 - RNA, 23 nt, Listeria monocytogenes EGD-e
ugguuuuacaccauuuuguucua

SEQ ID NO: 774159 - RNA, 17 nt, Listeria monocytogenes EGD-e
uguaaaggauaaaaauu

SEQ ID NO: 774160 - RNA, 16 nt, Listeria monocytogenes EGD-e
ugguugcauuuggaga

SEQ ID NO: 774161 - RNA, 14 nt, Listeria monocytogenes EGD-e
ugguuguucuuuua

SEQ ID NO: 774162 - RNA, 23 nt, Listeria monocytogenes EGD-e
ugguuguucuuuuacggcuucaa

SEQ ID NO: 774163 - RNA, 13 nt, Listeria monocytogenes EGD-e
ugguucaaaaaga

SEQ ID NO: 774164 - RNA, 10 nt, Listeria monocytogenes EGD-e
ugguuauuuc

SEQ ID NO: 774165 - RNA, 13 nt, Listeria monocytogenes EGD-e
ugguuaauaaggu

SEQ ID NO: 774166 - RNA, 19 nt, Listeria monocytogenes EGD-e
uggguauacccuuuuuuua

SEQ ID NO: 774167 - RNA, 22 nt, Listeria monocytogenes EGD-e
uggguauacccuuuuuuuacau

SEQ ID NO: 774168 - RNA, 21 nt, Listeria monocytogenes EGD-e
ugucacaucuguuccuuugcu

SEQ ID NO: 774169 - RNA, 17 nt, Listeria monocytogenes EGD-e
uguccuaggcgcucuuu

SEQ ID NO: 774170 - RNA, 16 nt, Listeria monocytogenes EGD-e
ugucgcacguuuuagu

SEQ ID NO: 774171 - RNA, 15 nt, Listeria monocytogenes EGD-e
ugucgaaaaccuaaa

SEQ ID NO: 774172 - RNA, 21 nt, Listeria monocytogenes EGD-e
uguccuucgauuguagcuucu

SEQ ID NO: 774173 - RNA, 23 nt, Listeria monocytogenes EGD-e
ugucguuucaaagcaucagcuuu

SEQ ID NO: 774174 - RNA, 14 nt, Listeria monocytogenes EGD-e
ugucuuggaagaac

SEQ ID NO: 774175 - RNA, 22 nt, Listeria monocytogenes EGD-e
ugugaaggaaacgaauaaaauc

SEQ ID NO: 774176 - RNA, 16 nt, Listeria monocytogenes EGD-e
ugugaaaguuuuauga

SEQ ID NO: 774177 - RNA, 13 nt, Listeria monocytogenes EGD-e
ugugauuguucca

SEQ ID NO: 774178 - RNA, 14 nt, Listeria monocytogenes EGD-e
ugugauuguuccag

SEQ ID NO: 774179 - RNA, 16 nt, Listeria monocytogenes EGD-e
ugcucuuugcuucaau

SEQ ID NO: 774180 - RNA, 17 nt, Listeria monocytogenes EGD-e
ugcugcauuuucacaag

SEQ ID NO: 774181 - RNA, 15 nt, Listeria monocytogenes EGD-e
ugcugcgccaacaaa

SEQ ID NO: 774182 - RNA, 15 nt, Listeria monocytogenes EGD-e
ugcugucuuggaaga

SEQ ID NO: 774183 - RNA, 16 nt, Listeria monocytogenes EGD-e
ugcuucaccaagaaga

SEQ ID NO: 774184 - RNA, 18 nt, Listeria monocytogenes EGD-e
ugcuucacgugcugcuuu

SEQ ID NO: 774185 - RNA, 17 nt, Listeria monocytogenes EGD-e
ugcuucaucuuuauaaa

SEQ ID NO: 774186 - RNA, 15 nt, Listeria monocytogenes EGD-e
ugcuucguuauaauu

SEQ ID NO: 774187 - RNA, 20 nt, Listeria monocytogenes EGD-e
ugcuucgcuguccauuccaa

SEQ ID NO: 774188 - RNA, 11 nt, Listeria monocytogenes EGD-e
ugcuucuucca

SEQ ID NO: 774189 - RNA, 14 nt, Listeria monocytogenes EGD-e
ugcuucuaaagcua

SEQ ID NO: 774190 - RNA, 16 nt, Listeria monocytogenes EGD-e
ugcuuuagcagcaagu

SEQ ID NO: 774191 - RNA, 17 nt, Listeria monocytogenes EGD-e
ugcuuguguaacauaaa

SEQ ID NO: 774192 - RNA, 15 nt, Listeria monocytogenes EGD-e
ugcuuuuguuuuccu

SEQ ID NO: 774193 - RNA, 19 nt, Listeria monocytogenes EGD-e
ugcuuuuucaaguaaaaac

SEQ ID NO: 774194 - RNA, 15 nt, Listeria monocytogenes EGD-e
ugcuuuccuugcugc

SEQ ID NO: 774195 - RNA, 16 nt, Listeria monocytogenes EGD-e
ugcuuuaauuuggaaa

SEQ ID NO: 774196 - RNA, 20 nt, Listeria monocytogenes EGD-e
ugcuuucguuucagcucuau

SEQ ID NO: 774197 - RNA, 22 nt, Listeria monocytogenes EGD-e
ugcuuugccgcgacuauuucgc

SEQ ID NO: 774198 - RNA, 16 nt, Listeria monocytogenes EGD-e
uggaaaagagaaaaag

SEQ ID NO: 774199 - RNA, 18 nt, Listeria monocytogenes EGD-e
uggaaaacauagaaaaag

SEQ ID NO: 774200 - RNA, 16 nt, Listeria monocytogenes EGD-e
uggacaaugauccgaa

SEQ ID NO: 774201 - RNA, 17 nt, Listeria monocytogenes EGD-e
uggaagucaaagguuua

SEQ ID NO: 774202 - RNA, 18 nt, Listeria monocytogenes EGD-e
uggaagucaaagguuuaa

SEQ ID NO: 774203 - RNA, 21 nt, Listeria monocytogenes EGD-e
uggaaugcgguaacuaaaaua

SEQ ID NO: 774204 - RNA, 14 nt, Listeria monocytogenes EGD-e
ugcguaaacuuuug

SEQ ID NO: 774205 - RNA, 14 nt, Listeria monocytogenes EGD-e
ugcgguuucuuuua

SEQ ID NO: 774206 - RNA, 19 nt, Listeria monocytogenes EGD-e
ugcggcuaauaacauuaaa

SEQ ID NO: 774207 - RNA, 13 nt, Listeria monocytogenes EGD-e
ugcuaaauaaaac

SEQ ID NO: 774208 - RNA, 15 nt, Listeria monocytogenes EGD-e
ugcuaaaugaauucg

SEQ ID NO: 774209 - RNA, 23 nt, Listeria monocytogenes EGD-e
ugcuaaaggcaacaaagaagaaa

SEQ ID NO: 774210 - RNA, 16 nt, Listeria monocytogenes EGD-e
ugcuaaaauaaaucug

SEQ ID NO: 774211 - RNA, 15 nt, Listeria monocytogenes EGD-e
ugcuccauugcccag

SEQ ID NO: 774212 - RNA, 16 nt, Listeria monocytogenes EGD-e
ugcucaccuucuuuuu

SEQ ID NO: 774213 - RNA, 21 nt, Listeria monocytogenes EGD-e
ugcucagcggguugaaaggaa

SEQ ID NO: 774214 - RNA, 17 nt, Listeria monocytogenes EGD-e
ugcucaguaguucuuuu

SEQ ID NO: 774215 - RNA, 21 nt, Listeria monocytogenes EGD-e
ugcgaaaaaugaaaagaaaaa

SEQ ID NO: 774216 - RNA, 15 nt, Listeria monocytogenes EGD-e
ugcgaauaacaagcg

SEQ ID NO: 774217 - RNA, 15 nt, Listeria monocytogenes EGD-e
ugcgaauaacagauu

SEQ ID NO: 774218 - RNA, 19 nt, Listeria monocytogenes EGD-e
ugccuucaaacacuucuaa

SEQ ID NO: 774219 - RNA, 20 nt, Listeria monocytogenes EGD-e
ugccuucaaacacuucuaaa

SEQ ID NO: 774220 - RNA, 12 nt, Listeria monocytogenes EGD-e
ugauuuucauua

SEQ ID NO: 774221 - RNA, 14 nt, Listeria monocytogenes EGD-e
ugauuuuauuuuua

SEQ ID NO: 774222 - RNA, 13 nt, Listeria monocytogenes EGD-e
ugauuuuuucuuc

SEQ ID NO: 774223 - RNA, 11 nt, Listeria monocytogenes EGD-e
ugauucccaca

SEQ ID NO: 774224 - RNA, 12 nt, Listeria monocytogenes EGD-e
ugcaaaugcuuu

SEQ ID NO: 774225 - RNA, 19 nt, Listeria monocytogenes EGD-e
ugcacugcaccuaauagca

SEQ ID NO: 774226 - RNA, 17 nt, Listeria monocytogenes EGD-e
ugcaccugcauuucauu

SEQ ID NO: 774227 - RNA, 18 nt, Listeria monocytogenes EGD-e
ugcacagcagaaacuuuc

SEQ ID NO: 774228 - RNA, 23 nt, Listeria monocytogenes EGD-e
ugcacagcagaaacuuucuuuuc

SEQ ID NO: 774229 - RNA, 14 nt, Listeria monocytogenes EGD-e
ugcauuuucacaag

SEQ ID NO: 774230 - RNA, 13 nt, Listeria monocytogenes EGD-e
ugcauuuggagaa

SEQ ID NO: 774231 - RNA, 18 nt, Listeria monocytogenes EGD-e
ugcaucuucuaagaaaaa

SEQ ID NO: 774232 - RNA, 19 nt, Listeria monocytogenes EGD-e
ugcauucugugauggaagu

SEQ ID NO: 774233 - RNA, 20 nt, Listeria monocytogenes EGD-e
ugcauucugugauggaagua

SEQ ID NO: 774234 - RNA, 17 nt, Listeria monocytogenes EGD-e
ugagcuaugugcgaugc

SEQ ID NO: 774235 - RNA, 16 nt, Listeria monocytogenes EGD-e
ugagugaagauaaacu

SEQ ID NO: 774236 - RNA, 18 nt, Listeria monocytogenes EGD-e
ugagugaagauaaacuaa

SEQ ID NO: 774237 - RNA, 22 nt, Listeria monocytogenes EGD-e
ugauaaggguuuucagcucuuu

SEQ ID NO: 774238 - RNA, 16 nt, Listeria monocytogenes EGD-e
ugauaucaucaauaau

SEQ ID NO: 774239 - RNA, 15 nt, Listeria monocytogenes EGD-e
ugauagcauccucuu

SEQ ID NO: 774240 - RNA, 23 nt, Listeria monocytogenes EGD-e
ugauaugcagguaaaacagcaag

SEQ ID NO: 774241 - RNA, 14 nt, Listeria monocytogenes EGD-e
ugacuagaaauuaa

SEQ ID NO: 774242 - RNA, 20 nt, Listeria monocytogenes EGD-e
ugacguaaggcauguaucuu

SEQ ID NO: 774243 - RNA, 17 nt, Listeria monocytogenes EGD-e
ugagacguaaagucuca

SEQ ID NO: 774244 - RNA, 21 nt, Listeria monocytogenes EGD-e
ugaccuagccagacaucuuug

SEQ ID NO: 774245 - RNA, 18 nt, Listeria monocytogenes EGD-e
ugaccuaguuaaucuaag

SEQ ID NO: 774246 - RNA, 16 nt, Listeria monocytogenes EGD-e
ugaccaauuucuuuuu

SEQ ID NO: 774247 - RNA, 14 nt, Listeria monocytogenes EGD-e
ucugaaaugauuuu

SEQ ID NO: 774248 - RNA, 19 nt, Listeria monocytogenes EGD-e
ucugaacugacuagaaauu

SEQ ID NO: 774249 - RNA, 17 nt, Listeria monocytogenes EGD-e
aaaugcuaauuuauuua

SEQ ID NO: 774250 - RNA, 17 nt, Listeria monocytogenes EGD-e
aaaugcucaucaagaaa

SEQ ID NO: 774251 - RNA, 13 nt, Listeria monocytogenes EGD-e
ucugagaagccag

SEQ ID NO: 774252 - RNA, 22 nt, Listeria monocytogenes EGD-e
ucugagaagccagcauuuuuac

SEQ ID NO: 774253 - RNA, 15 nt, Listeria monocytogenes EGD-e
ucuggauaaaaauaa

SEQ ID NO: 774254 - RNA, 15 nt, Listeria monocytogenes EGD-e
ucugcuauuuuugaa

SEQ ID NO: 774255 - RNA, 13 nt, Listeria monocytogenes EGD-e
ucugauuaaaagu

SEQ ID NO: 774256 - RNA, 16 nt, Listeria monocytogenes EGD-e
ucuucauuuuucuagu

SEQ ID NO: 774257 - RNA, 16 nt, Listeria monocytogenes EGD-e
ucuuaugagaguuaua

SEQ ID NO: 774258 - RNA, 17 nt, Listeria monocytogenes EGD-e
ucuuacuauuuucuaau

SEQ ID NO: 774259 - RNA, 16 nt, Listeria monocytogenes EGD-e
ucuuaagaauuccguc

SEQ ID NO: 774260 - RNA, 12 nt, Listeria monocytogenes EGD-e
ucuucuaaaaua

SEQ ID NO: 774261 - RNA, 22 nt, Listeria monocytogenes EGD-e
ucuucuaagaaaaaaaguuaua

SEQ ID NO: 774262 - RNA, 15 nt, Listeria monocytogenes EGD-e
ucuucuaauacauuc

SEQ ID NO: 774263 - RNA, 16 nt, Listeria monocytogenes EGD-e
ucuucuaauacauucg

SEQ ID NO: 774264 - RNA, 13 nt, Listeria monocytogenes EGD-e
ucuucuugcuuca

SEQ ID NO: 774265 - RNA, 21 nt, Listeria monocytogenes EGD-e
ucuugauccaaguuuuuuaau

SEQ ID NO: 774266 - RNA, 20 nt, Listeria monocytogenes EGD-e
ucuugaugccaucaggaguu

SEQ ID NO: 774267 - RNA, 14 nt, Listeria monocytogenes EGD-e
ucuugcuuuaauuu

SEQ ID NO: 774268 - RNA, 19 nt, Listeria monocytogenes EGD-e
ucuuguguaugagaacaau

SEQ ID NO: 774269 - RNA, 18 nt, Listeria monocytogenes EGD-e
ucuuuauaacucucauaa

SEQ ID NO: 774270 - RNA, 23 nt, Listeria monocytogenes EGD-e
ucuuuaccauacacauaggucag

SEQ ID NO: 774271 - RNA, 16 nt, Listeria monocytogenes EGD-e
ucuuuaucuuucccau

SEQ ID NO: 774272 - RNA, 13 nt, Listeria monocytogenes EGD-e
ucuuuauuuuuug

SEQ ID NO: 774273 - RNA, 18 nt, Listeria monocytogenes EGD-e
ucuuuucgcaaucaauuu

SEQ ID NO: 774274 - RNA, 14 nt, Listeria monocytogenes EGD-e
ucuuuuaaagcuuu

SEQ ID NO: 774275 - RNA, 13 nt, Listeria monocytogenes EGD-e
ucuuuuaucuucc

SEQ ID NO: 774276 - RNA, 13 nt, Listeria monocytogenes EGD-e
ucuuuuucuucuu

SEQ ID NO: 774277 - RNA, 22 nt, Listeria monocytogenes EGD-e
ucuuuuguucgggcgaauaacc

SEQ ID NO: 774278 - RNA, 16 nt, Listeria monocytogenes EGD-e
ucuuuuuguaaaggau

SEQ ID NO: 774279 - RNA, 19 nt, Listeria monocytogenes EGD-e
ucuuucacacgauaccaaa

SEQ ID NO: 774280 - RNA, 14 nt, Listeria monocytogenes EGD-e
ucuuucuucuacua

SEQ ID NO: 774281 - RNA, 17 nt, Listeria monocytogenes EGD-e
ucuuugcuucaauccca

SEQ ID NO: 774282 - RNA, 14 nt, Listeria monocytogenes EGD-e
ucuuugauuuuuuc

SEQ ID NO: 774283 - RNA, 16 nt, Listeria monocytogenes EGD-e
ucuuugccuuaaaaua

SEQ ID NO: 774284 - RNA, 14 nt, Listeria monocytogenes EGD-e
ugaagccauucccg

SEQ ID NO: 774285 - RNA, 17 nt, Listeria monocytogenes EGD-e
ugaacugacuagaaauu

SEQ ID NO: 774286 - RNA, 13 nt, Listeria monocytogenes EGD-e
ugaaggaaacgaa

SEQ ID NO: 774287 - RNA, 14 nt, Listeria monocytogenes EGD-e
ugaagcuuccuuua

SEQ ID NO: 774288 - RNA, 19 nt, Listeria monocytogenes EGD-e
ugaagcuuccuuuaucauu

SEQ ID NO: 774289 - RNA, 23 nt, Listeria monocytogenes EGD-e
ugaaauaauaccaggaucaaaau

SEQ ID NO: 774290 - RNA, 12 nt, Listeria monocytogenes EGD-e
ugaaaaucgagg

SEQ ID NO: 774291 - RNA, 22 nt, Listeria monocytogenes EGD-e
ugaaaaugagcccaaaaauaag

SEQ ID NO: 774292 - RNA, 18 nt, Listeria monocytogenes EGD-e
ucuuuuuuuaauuuuccg

SEQ ID NO: 774293 - RNA, 12 nt, Listeria monocytogenes EGD-e
ugaaaaaacauc

SEQ ID NO: 774294 - RNA, 16 nt, Listeria monocytogenes EGD-e
ucuuuuuucuuccaua

SEQ ID NO: 774295 - RNA, 18 nt, Listeria monocytogenes EGD-e
ugaaaacugaacaaagaa

SEQ ID NO: 774296 - RNA, 22 nt, Listeria monocytogenes EGD-e
ugaaaacugaacaaagaagaag

SEQ ID NO: 774297 - RNA, 14 nt, Listeria monocytogenes EGD-e
ugaaaagaaaaacc

SEQ ID NO: 774298 - RNA, 16 nt, Listeria monocytogenes EGD-e
ucauugagucgcuauu

SEQ ID NO: 774299 - RNA, 16 nt, Listeria monocytogenes EGD-e
ucauuauaaguguaaa

SEQ ID NO: 774300 - RNA, 13 nt, Listeria monocytogenes EGD-e
ucauguucaaucu

SEQ ID NO: 774301 - RNA, 22 nt, Listeria monocytogenes EGD-e
ucaugugcuuguaagaagcuuu

SEQ ID NO: 774302 - RNA, 20 nt, Listeria monocytogenes EGD-e
ucauuucuacaacuggcaca

SEQ ID NO: 774303 - RNA, 15 nt, Listeria monocytogenes EGD-e
ucauuugaaaaaggg

SEQ ID NO: 774304 - RNA, 18 nt, Listeria monocytogenes EGD-e
ucauuugaaaaagggcug

SEQ ID NO: 774305 - RNA, 14 nt, Listeria monocytogenes EGD-e
ucauuguuguaaau

SEQ ID NO: 774306 - RNA, 22 nt, Listeria monocytogenes EGD-e
uccaaacacgaacauaccaaua

SEQ ID NO: 774307 - RNA, 18 nt, Listeria monocytogenes EGD-e
uccaaagagccauaaaau

SEQ ID NO: 774308 - RNA, 22 nt, Listeria monocytogenes EGD-e
uccaaagagccauaaaauuagu

SEQ ID NO: 774309 - RNA, 16 nt, Listeria monocytogenes EGD-e
uccaacguuuuaauuu

SEQ ID NO: 774310 - RNA, 19 nt, Listeria monocytogenes EGD-e
uccaagcggguuuucucag

SEQ ID NO: 774311 - RNA, 20 nt, Listeria monocytogenes EGD-e
uccaagcggguuuucucaga

SEQ ID NO: 774312 - RNA, 15 nt, Listeria monocytogenes EGD-e
uccaaguuuuuuaau

SEQ ID NO: 774313 - RNA, 11 nt, Listeria monocytogenes EGD-e
uccaauaauag

SEQ ID NO: 774314 - RNA, 18 nt, Listeria monocytogenes EGD-e
uccacgauggaaccauuc

SEQ ID NO: 774315 - RNA, 18 nt, Listeria monocytogenes EGD-e
uccacgcggcauuucaau

SEQ ID NO: 774316 - RNA, 20 nt, Listeria monocytogenes EGD-e
uccacuaacuuaucuuucaa

SEQ ID NO: 774317 - RNA, 16 nt, Listeria monocytogenes EGD-e
uccacacugguuuuuu

SEQ ID NO: 774318 - RNA, 16 nt, Listeria monocytogenes EGD-e
uccagcgucuaaaaau

SEQ ID NO: 774319 - RNA, 21 nt, Listeria monocytogenes EGD-e
uccauacuuucugccaaauug

SEQ ID NO: 774320 - RNA, 15 nt, Listeria monocytogenes EGD-e
uccaguuaaacaaac

SEQ ID NO: 774321 - RNA, 22 nt, Listeria monocytogenes EGD-e
uccaguuaaacaaacacaaaau

SEQ ID NO: 774322 - RNA, 15 nt, Listeria monocytogenes EGD-e
uccauauuuucucua

SEQ ID NO: 774323 - RNA, 14 nt, Listeria monocytogenes EGD-e
uccauauaaucucg

SEQ ID NO: 774324 - RNA, 13 nt, Listeria monocytogenes EGD-e
uccauaucaccaa

SEQ ID NO: 774325 - RNA, 14 nt, Listeria monocytogenes EGD-e
uccauaucaccaac

SEQ ID NO: 774326 - RNA, 18 nt, Listeria monocytogenes EGD-e
ucccaagauucuucuaau

SEQ ID NO: 774327 - RNA, 20 nt, Listeria monocytogenes EGD-e
uccauuuuucuucuggaaga

SEQ ID NO: 774328 - RNA, 14 nt, Listeria monocytogenes EGD-e
ucccagcuuuuccu

SEQ ID NO: 774329 - RNA, 13 nt, Listeria monocytogenes EGD-e
ucccagaaaaaaa

SEQ ID NO: 774330 - RNA, 14 nt, Listeria monocytogenes EGD-e
ucccagaaaaaaac

SEQ ID NO: 774331 - RNA, 16 nt, Listeria monocytogenes EGD-e
ucccagaaaaaaacaa

SEQ ID NO: 774332 - RNA, 17 nt, Listeria monocytogenes EGD-e
ucccagaaaaaaacaaa

SEQ ID NO: 774333 - RNA, 20 nt, Listeria monocytogenes EGD-e
uccccgcagaaaaauaaucc

SEQ ID NO: 774334 - RNA, 23 nt, Listeria monocytogenes EGD-e
uccccuagcucgauaacguguuu

SEQ ID NO: 774335 - RNA, 20 nt, Listeria monocytogenes EGD-e
uccccuuuuagaaugaagau

SEQ ID NO: 774336 - RNA, 19 nt, Listeria monocytogenes EGD-e
ucccgcgcuaaucuucuug

SEQ ID NO: 774337 - RNA, 15 nt, Listeria monocytogenes EGD-e
ucccucauccuuucu

SEQ ID NO: 774338 - RNA, 19 nt, Listeria monocytogenes EGD-e
ucccuccuuuauuuuuuau

SEQ ID NO: 774339 - RNA, 16 nt, Listeria monocytogenes EGD-e
uccgaauacuuucaau

SEQ ID NO: 774340 - RNA, 23 nt, Listeria monocytogenes EGD-e
ucccuuuacuugcaaaugcuuua

SEQ ID NO: 774341 - RNA, 13 nt, Listeria monocytogenes EGD-e
ucccuuuuugacc

SEQ ID NO: 774342 - RNA, 13 nt, Listeria monocytogenes EGD-e
ucccuuuuuucau

SEQ ID NO: 774343 - RNA, 16 nt, Listeria monocytogenes EGD-e
uccgaaccaagcacau

SEQ ID NO: 774344 - RNA, 15 nt, Listeria monocytogenes EGD-e
uccgaccuuguucac

SEQ ID NO: 774345 - RNA, 14 nt, Listeria monocytogenes EGD-e
uccgauacaacaaa

SEQ ID NO: 774346 - RNA, 20 nt, Listeria monocytogenes EGD-e
uccgauacaacaaaauaauc

SEQ ID NO: 774347 - RNA, 17 nt, Listeria monocytogenes EGD-e
uccuucuacauuaccaa

SEQ ID NO: 774348 - RNA, 13 nt, Listeria monocytogenes EGD-e
uccuuuaucauuc

SEQ ID NO: 774349 - RNA, 21 nt, Listeria monocytogenes EGD-e
uccuuguuuuuuguauucaac

SEQ ID NO: 774350 - RNA, 19 nt, Listeria monocytogenes EGD-e
uccuuguuguucuaauaau

SEQ ID NO: 774351 - RNA, 20 nt, Listeria monocytogenes EGD-e
uccuuguuguucuaauaauu

SEQ ID NO: 774352 - RNA, 15 nt, Listeria monocytogenes EGD-e
uccuuguacuaauuc

SEQ ID NO: 774353 - RNA, 21 nt, Listeria monocytogenes EGD-e
uccuugcugcucgcucaucau

SEQ ID NO: 774354 - RNA, 23 nt, Listeria monocytogenes EGD-e
uccuugcugcucgcucaucauca

SEQ ID NO: 774355 - RNA, 12 nt, Listeria monocytogenes EGD-e
ucgaaagcaaau

SEQ ID NO: 774356 - RNA, 16 nt, Listeria monocytogenes EGD-e
uccuuuuguuuuaaua

SEQ ID NO: 774357 - RNA, 23 nt, Listeria monocytogenes EGD-e
uccuuuuguuuuaauaaaucaua

SEQ ID NO: 774358 - RNA, 15 nt, Listeria monocytogenes EGD-e
ucgaauucuuuuucu

SEQ ID NO: 774359 - RNA, 21 nt, Listeria monocytogenes EGD-e
ucgaauacuaacgcuuuuuca

SEQ ID NO: 774360 - RNA, 22 nt, Listeria monocytogenes EGD-e
ucgaauacuaacgcuuuuucag

SEQ ID NO: 774361 - RNA, 14 nt, Listeria monocytogenes EGD-e
ucgacaguuucuuu

SEQ ID NO: 774362 - RNA, 19 nt, Listeria monocytogenes EGD-e
ucgaggaaguaauucaucc

SEQ ID NO: 774363 - RNA, 12 nt, Listeria monocytogenes EGD-e
ucgauauuuuuu

SEQ ID NO: 774364 - RNA, 19 nt, Listeria monocytogenes EGD-e
ucgauuuucaacuguugcu

SEQ ID NO: 774365 - RNA, 13 nt, Listeria monocytogenes EGD-e
ucgauuguagcuu

SEQ ID NO: 774366 - RNA, 16 nt, Listeria monocytogenes EGD-e
ucgauuguagcuucuc

SEQ ID NO: 774367 - RNA, 15 nt, Listeria monocytogenes EGD-e
ucgcagggcagaaaa

SEQ ID NO: 774368 - RNA, 21 nt, Listeria monocytogenes EGD-e
uccucuaagucugcuuuuuca

SEQ ID NO: 774369 - RNA, 16 nt, Listeria monocytogenes EGD-e
uccuccaauuuuacug

SEQ ID NO: 774370 - RNA, 22 nt, Listeria monocytogenes EGD-e
uccucauugaggaauacuguuu

SEQ ID NO: 774371 - RNA, 13 nt, Listeria monocytogenes EGD-e
uccucauauuugg

SEQ ID NO: 774372 - RNA, 13 nt, Listeria monocytogenes EGD-e
uccuuaaauaaaa

SEQ ID NO: 774373 - RNA, 15 nt, Listeria monocytogenes EGD-e
uccuuauuaauagua

SEQ ID NO: 774374 - RNA, 18 nt, Listeria monocytogenes EGD-e
uccuuauuaauaguauaa

SEQ ID NO: 774375 - RNA, 22 nt, Listeria monocytogenes EGD-e
uccuuauuaauaguauaaggau

SEQ ID NO: 774376 - RNA, 16 nt, Listeria monocytogenes EGD-e
uccuucauaauuauuu

SEQ ID NO: 774377 - RNA, 17 nt, Listeria monocytogenes EGD-e
uccuucauaauuauuuu

SEQ ID NO: 774378 - RNA, 22 nt, Listeria monocytogenes EGD-e
uccuguaauucgaauaagaacc

SEQ ID NO: 774379 - RNA, 20 nt, Listeria monocytogenes EGD-e
uccuguugcaccaaaaauac

SEQ ID NO: 774380 - RNA, 21 nt, Listeria monocytogenes EGD-e
uccuguugcaccaaaaauacg

SEQ ID NO: 774381 - RNA, 14 nt, Listeria monocytogenes EGD-e
uccugcuaaaacca

SEQ ID NO: 774382 - RNA, 23 nt, Listeria monocytogenes EGD-e
uccuaggcgcucuuuaauaauua

SEQ ID NO: 774383 - RNA, 13 nt, Listeria monocytogenes EGD-e
uccuaauuguuuu

SEQ ID NO: 774384 - RNA, 18 nt, Listeria monocytogenes EGD-e
uccuagaacuaauucuaa

SEQ ID NO: 774385 - RNA, 22 nt, Listeria monocytogenes EGD-e
uccguuucauuuuugauagcau

SEQ ID NO: 774386 - RNA, 13 nt, Listeria monocytogenes EGD-e
uccgucaagccca

SEQ ID NO: 774387 - RNA, 17 nt, Listeria monocytogenes EGD-e
uccgcuucguuucauuu

SEQ ID NO: 774388 - RNA, 16 nt, Listeria monocytogenes EGD-e
uagucguuucaacucc

SEQ ID NO: 774389 - RNA, 16 nt, Listeria monocytogenes EGD-e
uagucuacuuuuaaaa

SEQ ID NO: 774390 - RNA, 18 nt, Listeria monocytogenes EGD-e
uaguucguuuauuuugau

SEQ ID NO: 774391 - RNA, 17 nt, Listeria monocytogenes EGD-e
uaguuaggcuuccuugu

SEQ ID NO: 774392 - RNA, 20 nt, Listeria monocytogenes EGD-e
uaguuaggcuuccuuguuuu

SEQ ID NO: 774393 - RNA, 23 nt, Listeria monocytogenes EGD-e
uaguuaacgguuuucaugaagca

SEQ ID NO: 774394 - RNA, 17 nt, Listeria monocytogenes EGD-e
uaguggagcuauauaga

SEQ ID NO: 774395 - RNA, 15 nt, Listeria monocytogenes EGD-e
uaguacauaguuaua

SEQ ID NO: 774396 - RNA, 18 nt, Listeria monocytogenes EGD-e
uaguacauaguuauaaau

SEQ ID NO: 774397 - RNA, 22 nt, Listeria monocytogenes EGD-e
uagguuagcagcuuuuguccaa

SEQ ID NO: 774398 - RNA, 22 nt, Listeria monocytogenes EGD-e
uauaaguacuugaaaaauuuca

SEQ ID NO: 774399 - RNA, 22 nt, Listeria monocytogenes EGD-e
uauaagcggguguccaaaaacc

SEQ ID NO: 774400 - RNA, 23 nt, Listeria monocytogenes EGD-e
uauaagcggguguccaaaaacca

SEQ ID NO: 774401 - RNA, 23 nt, Listeria monocytogenes EGD-e
uauaaucucgugcuaauucuguu

SEQ ID NO: 774402 - RNA, 15 nt, Listeria monocytogenes EGD-e
uauaaucaauaucuu

SEQ ID NO: 774403 - RNA, 14 nt, Listeria monocytogenes EGD-e
uauaaccccaaaau

SEQ ID NO: 774404 - RNA, 18 nt, Listeria monocytogenes EGD-e
uauaaccccaaaaugcua

SEQ ID NO: 774405 - RNA, 15 nt, Listeria monocytogenes EGD-e
uaguugguaguuuua

SEQ ID NO: 774406 - RNA, 19 nt, Listeria monocytogenes EGD-e
uauaugaaaacuuaucucu

SEQ ID NO: 774407 - RNA, 20 nt, Listeria monocytogenes EGD-e
uauaugaaaacuuaucucuu

SEQ ID NO: 774408 - RNA, 22 nt, Listeria monocytogenes EGD-e
uauaugaaaacuuaucucuuca

SEQ ID NO: 774409 - RNA, 23 nt, Listeria monocytogenes EGD-e
uauauagucauaagcuaacaaca

SEQ ID NO: 774410 - RNA, 16 nt, Listeria monocytogenes EGD-e
uauaauuuuuucauuu

SEQ ID NO: 774411 - RNA, 17 nt, Listeria monocytogenes EGD-e
uauacaauuaauaauaa

SEQ ID NO: 774412 - RNA, 12 nt, Listeria monocytogenes EGD-e
uauagcuucaaa

SEQ ID NO: 774413 - RNA, 14 nt, Listeria monocytogenes EGD-e
uauacacgauaacu

SEQ ID NO: 774414 - RNA, 15 nt, Listeria monocytogenes EGD-e
uaucaauaaauccag

SEQ ID NO: 774415 - RNA, 14 nt, Listeria monocytogenes EGD-e
uauauuuuauucga

SEQ ID NO: 774416 - RNA, 15 nt, Listeria monocytogenes EGD-e
uaucaucaauaaaau

SEQ ID NO: 774417 - RNA, 18 nt, Listeria monocytogenes EGD-e
uaucaucaauaaaaugca

SEQ ID NO: 774418 - RNA, 14 nt, Listeria monocytogenes EGD-e
uaucaucaauaaua

SEQ ID NO: 774419 - RNA, 22 nt, Listeria monocytogenes EGD-e
uauccguuaaucugauuaaaag

SEQ ID NO: 774420 - RNA, 15 nt, Listeria monocytogenes EGD-e
uauccaguauuuccc

SEQ ID NO: 774421 - RNA, 23 nt, Listeria monocytogenes EGD-e
uaucgccaaagccaguuuucauu

SEQ ID NO: 774422 - RNA, 15 nt, Listeria monocytogenes EGD-e
uaucgccaacuucuu

SEQ ID NO: 774423 - RNA, 15 nt, Listeria monocytogenes EGD-e
uauccuuauuaauag

SEQ ID NO: 774424 - RNA, 15 nt, Listeria monocytogenes EGD-e
uaucuuuauuuuuug

SEQ ID NO: 774425 - RNA, 16 nt, Listeria monocytogenes EGD-e
uaucuuuuccaaaaug

SEQ ID NO: 774426 - RNA, 17 nt, Listeria monocytogenes EGD-e
uaucuauucauucccac

SEQ ID NO: 774427 - RNA, 19 nt, Listeria monocytogenes EGD-e
uaucuggcaguuuuucaau

SEQ ID NO: 774428 - RNA, 18 nt, Listeria monocytogenes EGD-e
uaucucuucauuuuucua

SEQ ID NO: 774429 - RNA, 14 nt, Listeria monocytogenes EGD-e
uaugcacuuucaaa

SEQ ID NO: 774430 - RNA, 18 nt, Listeria monocytogenes EGD-e
uaugcacuuucaaaucag

SEQ ID NO: 774431 - RNA, 17 nt, Listeria monocytogenes EGD-e
uaugauuuguuucuggu

SEQ ID NO: 774432 - RNA, 16 nt, Listeria monocytogenes EGD-e
uaugagaguuauaaag

SEQ ID NO: 774433 - RNA, 19 nt, Listeria monocytogenes EGD-e
uaugagaguuauaaagaaa

SEQ ID NO: 774434 - RNA, 20 nt, Listeria monocytogenes EGD-e
uaugauaaccgcuaucuaca

SEQ ID NO: 774435 - RNA, 20 nt, Listeria monocytogenes EGD-e
uaugcgguagccugcucgcu

SEQ ID NO: 774436 - RNA, 14 nt, Listeria monocytogenes EGD-e
uauucuucuaaaau

SEQ ID NO: 774437 - RNA, 15 nt, Listeria monocytogenes EGD-e
uauucuucuaaaaua

SEQ ID NO: 774438 - RNA, 16 nt, Listeria monocytogenes EGD-e
uauucuucuaaaauaa

SEQ ID NO: 774439 - RNA, 12 nt, Listeria monocytogenes EGD-e
uauucuucuaaa

SEQ ID NO: 774440 - RNA, 21 nt, Listeria monocytogenes EGD-e
uauucuucugucacaucuguu

SEQ ID NO: 774441 - RNA, 22 nt, Listeria monocytogenes EGD-e
uauucuagccgcucgucuaaau

SEQ ID NO: 774442 - RNA, 15 nt, Listeria monocytogenes EGD-e
uauuccuaucacaaa

SEQ ID NO: 774443 - RNA, 16 nt, Listeria monocytogenes EGD-e
uauuccuaucacaaac

SEQ ID NO: 774444 - RNA, 18 nt, Listeria monocytogenes EGD-e
uauuccuccaauuuuacu

SEQ ID NO: 774445 - RNA, 14 nt, Listeria monocytogenes EGD-e
uauuaugauuuguu

SEQ ID NO: 774446 - RNA, 18 nt, Listeria monocytogenes EGD-e
uauuguuuuuugauuuuu

SEQ ID NO: 774447 - RNA, 12 nt, Listeria monocytogenes EGD-e
uauuacauuaag

SEQ ID NO: 774448 - RNA, 20 nt, Listeria monocytogenes EGD-e
uauuaauuauggcauaaaaa

SEQ ID NO: 774449 - RNA, 15 nt, Listeria monocytogenes EGD-e
uauuaacuaauaacc

SEQ ID NO: 774450 - RNA, 18 nt, Listeria monocytogenes EGD-e
uauuaauaaugauuucua

SEQ ID NO: 774451 - RNA, 13 nt, Listeria monocytogenes EGD-e
uauuaauccgaau

SEQ ID NO: 774452 - RNA, 15 nt, Listeria monocytogenes EGD-e
uaugugcgaugccac

SEQ ID NO: 774453 - RNA, 15 nt, Listeria monocytogenes EGD-e
uauguuuuauuuaua

SEQ ID NO: 774454 - RNA, 16 nt, Listeria monocytogenes EGD-e
uauguuuuaauuucaa

SEQ ID NO: 774455 - RNA, 22 nt, Listeria monocytogenes EGD-e
uauguuucggguuuguuaauaa

SEQ ID NO: 774456 - RNA, 13 nt, Listeria monocytogenes EGD-e
uauguaauucuaa

SEQ ID NO: 774457 - RNA, 18 nt, Listeria monocytogenes EGD-e
uauguaauucuaaauaaa

SEQ ID NO: 774458 - RNA, 17 nt, Listeria monocytogenes EGD-e
uaugguucaaaaagaua

SEQ ID NO: 774459 - RNA, 18 nt, Listeria monocytogenes EGD-e
ucagcgguuguuguaauu

SEQ ID NO: 774460 - RNA, 18 nt, Listeria monocytogenes EGD-e
ucagcggguugaaaggaa

SEQ ID NO: 774461 - RNA, 17 nt, Listeria monocytogenes EGD-e
ucagcaauguaggcauu

SEQ ID NO: 774462 - RNA, 18 nt, Listeria monocytogenes EGD-e
ucagcaagauaacucaaa

SEQ ID NO: 774463 - RNA, 17 nt, Listeria monocytogenes EGD-e
aaaucucaugaaacuuu

SEQ ID NO: 774464 - RNA, 15 nt, Listeria monocytogenes EGD-e
ucagcucuauaauuu

SEQ ID NO: 774465 - RNA, 18 nt, Listeria monocytogenes EGD-e
ucagcucuauaauuuaua

SEQ ID NO: 774466 - RNA, 21 nt, Listeria monocytogenes EGD-e
ucagcucuuuuuuuauuuuca

SEQ ID NO: 774467 - RNA, 22 nt, Listeria monocytogenes EGD-e
ucagcucuuuuuuuauuuucau

SEQ ID NO: 774468 - RNA, 20 nt, Listeria monocytogenes EGD-e
ucaggugaaaccacuacuaa

SEQ ID NO: 774469 - RNA, 16 nt, Listeria monocytogenes EGD-e
ucagacgcaauuucaa

SEQ ID NO: 774470 - RNA, 12 nt, Listeria monocytogenes EGD-e
ucagaaggaaua

SEQ ID NO: 774471 - RNA, 16 nt, Listeria monocytogenes EGD-e
ucagauuccauauaau

SEQ ID NO: 774472 - RNA, 13 nt, Listeria monocytogenes EGD-e
ucagauccuucaa

SEQ ID NO: 774473 - RNA, 16 nt, Listeria monocytogenes EGD-e
aaaucggucaauugca

SEQ ID NO: 774474 - RNA, 18 nt, Listeria monocytogenes EGD-e
ucacuucgaaaguaaaau

SEQ ID NO: 774475 - RNA, 21 nt, Listeria monocytogenes EGD-e
ucacuucgaaaguaaaaucuu

SEQ ID NO: 774476 - RNA, 15 nt, Listeria monocytogenes EGD-e
ucacuucuuaagaau

SEQ ID NO: 774477 - RNA, 16 nt, Listeria monocytogenes EGD-e
ucacuucuuaagaauu

SEQ ID NO: 774478 - RNA, 18 nt, Listeria monocytogenes EGD-e
ucacuggagcugauuuua

SEQ ID NO: 774479 - RNA, 22 nt, Listeria monocytogenes EGD-e
ucacgucauaaccucgcaaaaa

SEQ ID NO: 774480 - RNA, 21 nt, Listeria monocytogenes EGD-e
ucacuagcgcacaaguaauau

SEQ ID NO: 774481 - RNA, 17 nt, Listeria monocytogenes EGD-e
ucaaagcuacuuuucga

SEQ ID NO: 774482 - RNA, 15 nt, Listeria monocytogenes EGD-e
ucaaaucaccacaaa

SEQ ID NO: 774483 - RNA, 13 nt, Listeria monocytogenes EGD-e
ucaaacucuuucu

SEQ ID NO: 774484 - RNA, 14 nt, Listeria monocytogenes EGD-e
ucaacaaaacaaac

SEQ ID NO: 774485 - RNA, 16 nt, Listeria monocytogenes EGD-e
ucaacaaaacaaacua

SEQ ID NO: 774486 - RNA, 16 nt, Listeria monocytogenes EGD-e
ucaaauucaauuuaua

SEQ ID NO: 774487 - RNA, 19 nt, Listeria monocytogenes EGD-e
ucaaauucaauuuauauuu

SEQ ID NO: 774488 - RNA, 18 nt, Listeria monocytogenes EGD-e
ucaaauggcgcaggaaua

SEQ ID NO: 774489 - RNA, 19 nt, Listeria monocytogenes EGD-e
ucaaaauuacuauuuggau

SEQ ID NO: 774490 - RNA, 15 nt, Listeria monocytogenes EGD-e
ucaaaagcaaaaaag

SEQ ID NO: 774491 - RNA, 11 nt, Listeria monocytogenes EGD-e
ucaacaaucug

SEQ ID NO: 774492 - RNA, 22 nt, Listeria monocytogenes EGD-e
ucaacuccccagugaaaauaga

SEQ ID NO: 774493 - RNA, 14 nt, Listeria monocytogenes EGD-e
ucaauaucuuuauu

SEQ ID NO: 774494 - RNA, 19 nt, Listeria monocytogenes EGD-e
ucaaugauaucaucaauaa

SEQ ID NO: 774495 - RNA, 14 nt, Listeria monocytogenes EGD-e
ucaauaaauccagc

SEQ ID NO: 774496 - RNA, 23 nt, Listeria monocytogenes EGD-e
ucaauaaauccagcgucuaaaaa

SEQ ID NO: 774497 - RNA, 16 nt, Listeria monocytogenes EGD-e
ucaauagcagaaucua

SEQ ID NO: 774498 - RNA, 23 nt, Listeria monocytogenes EGD-e
ucaauaucggcauuugaauaagc

SEQ ID NO: 774499 - RNA, 18 nt, Listeria monocytogenes EGD-e
ucacaaacgcuuuuucaa

SEQ ID NO: 774500 - RNA, 22 nt, Listeria monocytogenes EGD-e
ucacaaacgcuuuuucaaaauc

SEQ ID NO: 774501 - RNA, 20 nt, Listeria monocytogenes EGD-e
aaaucgaggaaguugcaaua

SEQ ID NO: 774502 - RNA, 23 nt, Listeria monocytogenes EGD-e
ucacaucacuaauuagcauaaua

SEQ ID NO: 774503 - RNA, 17 nt, Listeria monocytogenes EGD-e
uaaaguuaacuucauua

SEQ ID NO: 774504 - RNA, 16 nt, Listeria monocytogenes EGD-e
uaaaguuagauuaaaa

SEQ ID NO: 774505 - RNA, 19 nt, Listeria monocytogenes EGD-e
uaaaucacuucuuaagaau

SEQ ID NO: 774506 - RNA, 20 nt, Listeria monocytogenes EGD-e
uaaauaugcgcagaaaguug

SEQ ID NO: 774507 - RNA, 16 nt, Listeria monocytogenes EGD-e
uaaauauacacaaagu

SEQ ID NO: 774508 - RNA, 13 nt, Listeria monocytogenes EGD-e
uaaauauagcuuc

SEQ ID NO: 774509 - RNA, 14 nt, Listeria monocytogenes EGD-e
uaaauauagcuuca

SEQ ID NO: 774510 - RNA, 12 nt, Listeria monocytogenes EGD-e
uaaauaaaacca

SEQ ID NO: 774511 - RNA, 12 nt, Listeria monocytogenes EGD-e
uaaacauuugau

SEQ ID NO: 774512 - RNA, 19 nt, Listeria monocytogenes EGD-e
uaaauccagcgucuaaaaa

SEQ ID NO: 774513 - RNA, 22 nt, Listeria monocytogenes EGD-e
uaaauguugguguaggaaguga

SEQ ID NO: 774514 - RNA, 15 nt, Listeria monocytogenes EGD-e
uaaauuuuuuugaaa

SEQ ID NO: 774515 - RNA, 16 nt, Listeria monocytogenes EGD-e
uaaauuuuuuugaaaa

SEQ ID NO: 774516 - RNA, 19 nt, Listeria monocytogenes EGD-e
uaaauuuuuuugaaaaaac

SEQ ID NO: 774517 - RNA, 14 nt, Listeria monocytogenes EGD-e
uaacaagaauaaug

SEQ ID NO: 774518 - RNA, 15 nt, Listeria monocytogenes EGD-e
uaacaucuuccacuc

SEQ ID NO: 774519 - RNA, 20 nt, Listeria monocytogenes EGD-e
uaacaucagauuaaauauag

SEQ ID NO: 774520 - RNA, 12 nt, Listeria monocytogenes EGD-e
uaacaucugcua

SEQ ID NO: 774521 - RNA, 21 nt, Listeria monocytogenes EGD-e
uaacaucugcuauuuuugaau

SEQ ID NO: 774522 - RNA, 21 nt, Listeria monocytogenes EGD-e
uaacacuuauaugaaaacuua

SEQ ID NO: 774523 - RNA, 17 nt, Listeria monocytogenes EGD-e
uaacacgagagaaaugg

SEQ ID NO: 774524 - RNA, 17 nt, Listeria monocytogenes EGD-e
uaacgcuuuuucagcaa

SEQ ID NO: 774525 - RNA, 13 nt, Listeria monocytogenes EGD-e
uaacgguuuucau

SEQ ID NO: 774526 - RNA, 14 nt, Listeria monocytogenes EGD-e
uaacgguuuucaug

SEQ ID NO: 774527 - RNA, 20 nt, Listeria monocytogenes EGD-e
uaacgcaucugcuaauacua

SEQ ID NO: 774528 - RNA, 20 nt, Listeria monocytogenes EGD-e
uaagauuuuugcucaguagu

SEQ ID NO: 774529 - RNA, 20 nt, Listeria monocytogenes EGD-e
uaagcaacgguaaacaaccc

SEQ ID NO: 774530 - RNA, 23 nt, Listeria monocytogenes EGD-e
uaagcaauuggaacaucuuugua

SEQ ID NO: 774531 - RNA, 14 nt, Listeria monocytogenes EGD-e
uaagcacaaauuau

SEQ ID NO: 774532 - RNA, 15 nt, Listeria monocytogenes EGD-e
uaagcacaaauuauu

SEQ ID NO: 774533 - RNA, 14 nt, Listeria monocytogenes EGD-e
uaagccauuucucg

SEQ ID NO: 774534 - RNA, 13 nt, Listeria monocytogenes EGD-e
uaagcuucauaaa

SEQ ID NO: 774535 - RNA, 18 nt, Listeria monocytogenes EGD-e
uaagcuucauaaaucgcc

SEQ ID NO: 774536 - RNA, 18 nt, Listeria monocytogenes EGD-e
uaagcggguguccaaaaa

SEQ ID NO: 774537 - RNA, 18 nt, Listeria monocytogenes EGD-e
uaaggauaccuuuuucau

SEQ ID NO: 774538 - RNA, 20 nt, Listeria monocytogenes EGD-e
uaauaaaauaggcaaaucuu

SEQ ID NO: 774539 - RNA, 22 nt, Listeria monocytogenes EGD-e
uaauaaauuagacauauaucuu

SEQ ID NO: 774540 - RNA, 23 nt, Listeria monocytogenes EGD-e
uaagugaauugauggauuccuaa

SEQ ID NO: 774541 - RNA, 22 nt, Listeria monocytogenes EGD-e
uaagggugaagcuuccuuuauc

SEQ ID NO: 774542 - RNA, 18 nt, Listeria monocytogenes EGD-e
uaaggucuuuguuguuuu

SEQ ID NO: 774543 - RNA, 20 nt, Listeria monocytogenes EGD-e
uaaguccaaagagccauaaa

SEQ ID NO: 774544 - RNA, 15 nt, Listeria monocytogenes EGD-e
uaagucaaaacguuc

SEQ ID NO: 774545 - RNA, 23 nt, Listeria monocytogenes EGD-e
uaagucaaugauauuaugauuug

SEQ ID NO: 774546 - RNA, 13 nt, Listeria monocytogenes EGD-e
uaaguacaauuuu

SEQ ID NO: 774547 - RNA, 22 nt, Listeria monocytogenes EGD-e
uaagaccaccaagaauaagcau

SEQ ID NO: 774548 - RNA, 14 nt, Listeria monocytogenes EGD-e
uaacuuuuuuucuu

SEQ ID NO: 774549 - RNA, 17 nt, Listeria monocytogenes EGD-e
uaacuuuuuuucuuaga

SEQ ID NO: 774550 - RNA, 15 nt, Listeria monocytogenes EGD-e
uaacuuucuuguuuc

SEQ ID NO: 774551 - RNA, 22 nt, Listeria monocytogenes EGD-e
uaacuuucuuguuucauauaau

SEQ ID NO: 774552 - RNA, 16 nt, Listeria monocytogenes EGD-e
uaagaaguacaauaaa

SEQ ID NO: 774553 - RNA, 18 nt, Listeria monocytogenes EGD-e
uaagaagcggaaggggua

SEQ ID NO: 774554 - RNA, 11 nt, Listeria monocytogenes EGD-e
uaagaagcuuu

SEQ ID NO: 774555 - RNA, 20 nt, Listeria monocytogenes EGD-e
uaacucaaaguaacuuuauc

SEQ ID NO: 774556 - RNA, 16 nt, Listeria monocytogenes EGD-e
uaacucucauaagaga

SEQ ID NO: 774557 - RNA, 17 nt, Listeria monocytogenes EGD-e
uaacuacuauuuaaaua

SEQ ID NO: 774558 - RNA, 15 nt, Listeria monocytogenes EGD-e
uaacuaaaaaucauu

SEQ ID NO: 774559 - RNA, 16 nt, Listeria monocytogenes EGD-e
uaacuaaaaaucauuu

SEQ ID NO: 774560 - RNA, 21 nt, Listeria monocytogenes EGD-e
uaacuucauuagacaaaaaga

SEQ ID NO: 774561 - RNA, 14 nt, Listeria monocytogenes EGD-e
uaacugguuccauu

SEQ ID NO: 774562 - RNA, 14 nt, Listeria monocytogenes EGD-e
aaauccauuucauu

SEQ ID NO: 774563 - RNA, 16 nt, Listeria monocytogenes EGD-e
aaauccgcuucguuuc

SEQ ID NO: 774564 - RNA, 21 nt, Listeria monocytogenes EGD-e
aaauccgcuucguuucauuuc

SEQ ID NO: 774565 - RNA, 17 nt, Listeria monocytogenes EGD-e
uaauuacuaaaaaggua

SEQ ID NO: 774566 - RNA, 18 nt, Listeria monocytogenes EGD-e
uaaugugaccuuaaauua

SEQ ID NO: 774567 - RNA, 15 nt, Listeria monocytogenes EGD-e
uaauucgaauaagaa

SEQ ID NO: 774568 - RNA, 14 nt, Listeria monocytogenes EGD-e
uaauuccauuuaau

SEQ ID NO: 774569 - RNA, 22 nt, Listeria monocytogenes EGD-e
uaaugauucaaagcuacuuuuc

SEQ ID NO: 774570 - RNA, 23 nt, Listeria monocytogenes EGD-e
uaaugauuucuauaaaaaugaua

SEQ ID NO: 774571 - RNA, 15 nt, Listeria monocytogenes EGD-e
uaaugauuucaauaa

SEQ ID NO: 774572 - RNA, 16 nt, Listeria monocytogenes EGD-e
uaaugauuucaauaau

SEQ ID NO: 774573 - RNA, 22 nt, Listeria monocytogenes EGD-e
uaaucgcagggcagaaaacaga

SEQ ID NO: 774574 - RNA, 12 nt, Listeria monocytogenes EGD-e
uacaaacuuuuc

SEQ ID NO: 774575 - RNA, 16 nt, Listeria monocytogenes EGD-e
uacaacaaaauaauca

SEQ ID NO: 774576 - RNA, 13 nt, Listeria monocytogenes EGD-e
uaauuuuuuucga

SEQ ID NO: 774577 - RNA, 22 nt, Listeria monocytogenes EGD-e
uaauuugguccaucaaauuauc

SEQ ID NO: 774578 - RNA, 20 nt, Listeria monocytogenes EGD-e
uaauuuuccgcagcuucaau

SEQ ID NO: 774579 - RNA, 17 nt, Listeria monocytogenes EGD-e
uaauugcaacuuuucuu

SEQ ID NO: 774580 - RNA, 14 nt, Listeria monocytogenes EGD-e
uaauuuggaaauaa

SEQ ID NO: 774581 - RNA, 21 nt, Listeria monocytogenes EGD-e
uaauuuggaaauaauucugcu

SEQ ID NO: 774582 - RNA, 22 nt, Listeria monocytogenes EGD-e
uaauuuggaaauaauucugcua

SEQ ID NO: 774583 - RNA, 15 nt, Listeria monocytogenes EGD-e
uaauuucuuuugaga

SEQ ID NO: 774584 - RNA, 16 nt, Listeria monocytogenes EGD-e
uaauuucuuuugagaa

SEQ ID NO: 774585 - RNA, 20 nt, Listeria monocytogenes EGD-e
uaauauccacccuagcuaua

SEQ ID NO: 774586 - RNA, 15 nt, Listeria monocytogenes EGD-e
uaauaugauaaccgc

SEQ ID NO: 774587 - RNA, 21 nt, Listeria monocytogenes EGD-e
uaauaucuucuauauuaaugu

SEQ ID NO: 774588 - RNA, 17 nt, Listeria monocytogenes EGD-e
uaaucaaaugcacagca

SEQ ID NO: 774589 - RNA, 20 nt, Listeria monocytogenes EGD-e
uaaucaagauuuuguacaua

SEQ ID NO: 774590 - RNA, 14 nt, Listeria monocytogenes EGD-e
uaauauuauaucca

SEQ ID NO: 774591 - RNA, 14 nt, Listeria monocytogenes EGD-e
uaaucacuauugaa

SEQ ID NO: 774592 - RNA, 13 nt, Listeria monocytogenes EGD-e
uaaucccacaaaa

SEQ ID NO: 774593 - RNA, 17 nt, Listeria monocytogenes EGD-e
uaaucccacaaaaaaua

SEQ ID NO: 774594 - RNA, 12 nt, Listeria monocytogenes EGD-e
uaauagaagcca

SEQ ID NO: 774595 - RNA, 20 nt, Listeria monocytogenes EGD-e
uaauagaagccaauucacuu

SEQ ID NO: 774596 - RNA, 15 nt, Listeria monocytogenes EGD-e
uaauaccgagaucuu

SEQ ID NO: 774597 - RNA, 18 nt, Listeria monocytogenes EGD-e
uaauacgcuguaucgcca

SEQ ID NO: 774598 - RNA, 22 nt, Listeria monocytogenes EGD-e
uaauacgcuguaucgccaacuu

SEQ ID NO: 774599 - RNA, 19 nt, Listeria monocytogenes EGD-e
uaauacgcgccaaagacug

SEQ ID NO: 774600 - RNA, 17 nt, Listeria monocytogenes EGD-e
uaauagcauaaaguauu

SEQ ID NO: 774601 - RNA, 22 nt, Listeria monocytogenes EGD-e
uaauagcauaaaguauucagca

SEQ ID NO: 774602 - RNA, 23 nt, Listeria monocytogenes EGD-e
uaauagcagagcuccaauaauag

SEQ ID NO: 774603 - RNA, 15 nt, Listeria monocytogenes EGD-e
uaauacaaacuuuuc

SEQ ID NO: 774604 - RNA, 15 nt, Listeria monocytogenes EGD-e
uaauaccaggaucaa

SEQ ID NO: 774605 - RNA, 20 nt, Listeria monocytogenes EGD-e
uaauaccaggaucaaaaugg

SEQ ID NO: 774606 - RNA, 14 nt, Listeria monocytogenes EGD-e
uacagguguauucg

SEQ ID NO: 774607 - RNA, 15 nt, Listeria monocytogenes EGD-e
uacaauuuucauuua

SEQ ID NO: 774608 - RNA, 15 nt, Listeria monocytogenes EGD-e
uacaaguucuuucau

SEQ ID NO: 774609 - RNA, 12 nt, Listeria monocytogenes EGD-e
uacauaauucau

SEQ ID NO: 774610 - RNA, 18 nt, Listeria monocytogenes EGD-e
uacauaauucauugacaa

SEQ ID NO: 774611 - RNA, 23 nt, Listeria monocytogenes EGD-e
uaccacaagaagggcuuuuuucc

SEQ ID NO: 774612 - RNA, 16 nt, Listeria monocytogenes EGD-e
uaccauguuuauuuaa

SEQ ID NO: 774613 - RNA, 20 nt, Listeria monocytogenes EGD-e
uaccauguuuauuuaauaag

SEQ ID NO: 774614 - RNA, 20 nt, Listeria monocytogenes EGD-e
uaccaucauauaauucuaau

SEQ ID NO: 774615 - RNA, 13 nt, Listeria monocytogenes EGD-e
uaccauacacaua

SEQ ID NO: 774616 - RNA, 17 nt, Listeria monocytogenes EGD-e
uaccgcuugauguuuuu

SEQ ID NO: 774617 - RNA, 19 nt, Listeria monocytogenes EGD-e
uacuguuuuugauuuaauu

SEQ ID NO: 774618 - RNA, 21 nt, Listeria monocytogenes EGD-e
uacuguuguuuaauaugcauu

SEQ ID NO: 774619 - RNA, 14 nt, Listeria monocytogenes EGD-e
uacuagugaaauag

SEQ ID NO: 774620 - RNA, 14 nt, Listeria monocytogenes EGD-e
uacuagcuuugucu

SEQ ID NO: 774621 - RNA, 23 nt, Listeria monocytogenes EGD-e
uacuacuggauaaaauggcguuu

SEQ ID NO: 774622 - RNA, 15 nt, Listeria monocytogenes EGD-e
uacugcaucccaacu

SEQ ID NO: 774623 - RNA, 23 nt, Listeria monocytogenes EGD-e
uacguagcagauguaucuaaaau

SEQ ID NO: 774624 - RNA, 22 nt, Listeria monocytogenes EGD-e
uacuacauuuuguugaacuucu

SEQ ID NO: 774625 - RNA, 16 nt, Listeria monocytogenes EGD-e
uacuacacguucccca

SEQ ID NO: 774626 - RNA, 13 nt, Listeria monocytogenes EGD-e
uacguauuaccuc

SEQ ID NO: 774627 - RNA, 17 nt, Listeria monocytogenes EGD-e
uacgauugcuucaccaa

SEQ ID NO: 774628 - RNA, 12 nt, Listeria monocytogenes EGD-e
uacgauuugcuc

SEQ ID NO: 774629 - RNA, 19 nt, Listeria monocytogenes EGD-e
guccaaagagccauaaaau

SEQ ID NO: 774630 - RNA, 14 nt, Listeria monocytogenes EGD-e
guccaaccuaaauc

SEQ ID NO: 774631 - RNA, 19 nt, Listeria monocytogenes EGD-e
gucauuuuugcugauuuuu

SEQ ID NO: 774632 - RNA, 13 nt, Listeria monocytogenes EGD-e
gucaauguauaca

SEQ ID NO: 774633 - RNA, 13 nt, Listeria monocytogenes EGD-e
gucaagcccagcu

SEQ ID NO: 774634 - RNA, 13 nt, Listeria monocytogenes EGD-e
gucaaucauuucu

SEQ ID NO: 774635 - RNA, 14 nt, Listeria monocytogenes EGD-e
gucggugcauuuuu

SEQ ID NO: 774636 - RNA, 22 nt, Listeria monocytogenes EGD-e
gucguuauguaauucuaaauaa

SEQ ID NO: 774637 - RNA, 22 nt, Listeria monocytogenes EGD-e
gucugugauuacuccaaaauaa

SEQ ID NO: 774638 - RNA, 19 nt, Listeria monocytogenes EGD-e
gucuuaaaugacaaagcua

SEQ ID NO: 774639 - RNA, 11 nt, Listeria monocytogenes EGD-e
gugaaauagaa

SEQ ID NO: 774640 - RNA, 18 nt, Listeria monocytogenes EGD-e
aaauagccaagauuaaaa

SEQ ID NO: 774641 - RNA, 17 nt, Listeria monocytogenes EGD-e
gucuuuuuguaaaggau

SEQ ID NO: 774642 - RNA, 18 nt, Listeria monocytogenes EGD-e
aaauaggcccauuaaaaa

SEQ ID NO: 774643 - RNA, 15 nt, Listeria monocytogenes EGD-e
aaauagcuuucccuu

SEQ ID NO: 774644 - RNA, 20 nt, Listeria monocytogenes EGD-e
aaauaguaguuauuucuuua

SEQ ID NO: 774645 - RNA, 18 nt, Listeria monocytogenes EGD-e
gugaaugccagccauuuu

SEQ ID NO: 774646 - RNA, 22 nt, Listeria monocytogenes EGD-e
gugaaugccagccauuuuggaa

SEQ ID NO: 774647 - RNA, 11 nt, Listeria monocytogenes EGD-e
aaauauacaca

SEQ ID NO: 774648 - RNA, 14 nt, Listeria monocytogenes EGD-e
guguccaaaaacca

SEQ ID NO: 774649 - RNA, 22 nt, Listeria monocytogenes EGD-e
gugguuuacucccuuuuuccac

SEQ ID NO: 774650 - RNA, 22 nt, Listeria monocytogenes EGD-e
aaauaucaccauuacuauuaau

SEQ ID NO: 774651 - RNA, 20 nt, Listeria monocytogenes EGD-e
guuaaacaaacacaaaaugc

SEQ ID NO: 774652 - RNA, 18 nt, Listeria monocytogenes EGD-e
guuaauuuccauuucgau

SEQ ID NO: 774653 - RNA, 19 nt, Listeria monocytogenes EGD-e
guuaaucugauuaaaaguu

SEQ ID NO: 774654 - RNA, 18 nt, Listeria monocytogenes EGD-e
guuagaaccguauuuaau

SEQ ID NO: 774655 - RNA, 21 nt, Listeria monocytogenes EGD-e
guuacuuuaccuugaucaaaa

SEQ ID NO: 774656 - RNA, 16 nt, Listeria monocytogenes EGD-e
guuccauuacuuuaau

SEQ ID NO: 774657 - RNA, 22 nt, Listeria monocytogenes EGD-e
guucgcauugauuuuugaauaa

SEQ ID NO: 774658 - RNA, 11 nt, Listeria monocytogenes EGD-e
guucuaaaaua

SEQ ID NO: 774659 - RNA, 14 nt, Listeria monocytogenes EGD-e
guucaccaaaugcu

SEQ ID NO: 774660 - RNA, 22 nt, Listeria monocytogenes EGD-e
guuccaaucggggaaauaguuu

SEQ ID NO: 774661 - RNA, 21 nt, Listeria monocytogenes EGD-e
guuccaguuaaacaaacacaa

SEQ ID NO: 774662 - RNA, 19 nt, Listeria monocytogenes EGD-e
guucuaaugauagaagaac

SEQ ID NO: 774663 - RNA, 14 nt, Listeria monocytogenes EGD-e
guugauaauaauca

SEQ ID NO: 774664 - RNA, 21 nt, Listeria monocytogenes EGD-e
guugcuaguugcauaccuaaa

SEQ ID NO: 774665 - RNA, 16 nt, Listeria monocytogenes EGD-e
guugcggcaguaguuu

SEQ ID NO: 774666 - RNA, 20 nt, Listeria monocytogenes EGD-e
guugcuuuuguuuuccuuug

SEQ ID NO: 774667 - RNA, 16 nt, Listeria monocytogenes EGD-e
guuucauuuuuccaag

SEQ ID NO: 774668 - RNA, 14 nt, Listeria monocytogenes EGD-e
guuucauuuuugau

SEQ ID NO: 774669 - RNA, 15 nt, Listeria monocytogenes EGD-e
aaauauguuuaaucu

SEQ ID NO: 774670 - RNA, 10 nt, Listeria monocytogenes EGD-e
guuucaauuu

SEQ ID NO: 774671 - RNA, 20 nt, Listeria monocytogenes EGD-e
guuuccccgucuaagaaauc

SEQ ID NO: 774672 - RNA, 13 nt, Listeria monocytogenes EGD-e
aaauauuuaauuu

SEQ ID NO: 774673 - RNA, 17 nt, Listeria monocytogenes EGD-e
aaauauuuaauuuuauc

SEQ ID NO: 774674 - RNA, 18 nt, Listeria monocytogenes EGD-e
aaauauugaauagaacua

SEQ ID NO: 774675 - RNA, 14 nt, Listeria monocytogenes EGD-e
aaaucaaacuuaua

SEQ ID NO: 774676 - RNA, 23 nt, Listeria monocytogenes EGD-e
guuucuaauccagcuugauuaaa

SEQ ID NO: 774677 - RNA, 18 nt, Listeria monocytogenes EGD-e
guuugauaaucuacaggu

SEQ ID NO: 774678 - RNA, 17 nt, Listeria monocytogenes EGD-e
guuuguuaacuaacaaa

SEQ ID NO: 774679 - RNA, 23 nt, Listeria monocytogenes EGD-e
guuuuagauaaguuaaucauuaa

SEQ ID NO: 774680 - RNA, 12 nt, Listeria monocytogenes EGD-e
guuuguauaaga

SEQ ID NO: 774681 - RNA, 16 nt, Listeria monocytogenes EGD-e
guuuucaacaaaacaa

SEQ ID NO: 774682 - RNA, 23 nt, Listeria monocytogenes EGD-e
aaaucauuuaaacacgccaaaaa

SEQ ID NO: 774683 - RNA, 20 nt, Listeria monocytogenes EGD-e
aaaucauuucgauaagcaca

SEQ ID NO: 774684 - RNA, 12 nt, Listeria monocytogenes EGD-e
aaaucauaauaa

SEQ ID NO: 774685 - RNA, 13 nt, Listeria monocytogenes EGD-e
gcucauuuuucuu

SEQ ID NO: 774686 - RNA, 12 nt, Listeria monocytogenes EGD-e
gcuccguaucca

SEQ ID NO: 774687 - RNA, 18 nt, Listeria monocytogenes EGD-e
gcuccguauuuauauucu

SEQ ID NO: 774688 - RNA, 13 nt, Listeria monocytogenes EGD-e
gcucgauuuuuuu

SEQ ID NO: 774689 - RNA, 13 nt, Listeria monocytogenes EGD-e
gcucgucuaaauu

SEQ ID NO: 774690 - RNA, 15 nt, Listeria monocytogenes EGD-e
gcugaauaucaaauc

SEQ ID NO: 774691 - RNA, 18 nt, Listeria monocytogenes EGD-e
gcugcuacgauucgauuu

SEQ ID NO: 774692 - RNA, 23 nt, Listeria monocytogenes EGD-e
gcuguaucaaugauaucaucaau

SEQ ID NO: 774693 - RNA, 13 nt, Listeria monocytogenes EGD-e
gcugucaaauucu

SEQ ID NO: 774694 - RNA, 14 nt, Listeria monocytogenes EGD-e
gcugucaaauucuu

SEQ ID NO: 774695 - RNA, 14 nt, Listeria monocytogenes EGD-e
aaaggagaaaaagu

SEQ ID NO: 774696 - RNA, 22 nt, Listeria monocytogenes EGD-e
gcuguuacugugcucuuugcuu

SEQ ID NO: 774697 - RNA, 17 nt, Listeria monocytogenes EGD-e
gcuuaauacgcgcugga

SEQ ID NO: 774698 - RNA, 17 nt, Listeria monocytogenes EGD-e
gcuucauaaaucgccac

SEQ ID NO: 774699 - RNA, 12 nt, Listeria monocytogenes EGD-e
gcuucaucuuua

SEQ ID NO: 774700 - RNA, 15 nt, Listeria monocytogenes EGD-e
gcuucuguuuuuucu

SEQ ID NO: 774701 - RNA, 16 nt, Listeria monocytogenes EGD-e
gcuucuguuuuuucuu

SEQ ID NO: 774702 - RNA, 15 nt, Listeria monocytogenes EGD-e
gcuucuggcuggcag

SEQ ID NO: 774703 - RNA, 15 nt, Listeria monocytogenes EGD-e
gcuucuaagucaaaa

SEQ ID NO: 774704 - RNA, 17 nt, Listeria monocytogenes EGD-e
gcuucuaagucaaaacg

SEQ ID NO: 774705 - RNA, 15 nt, Listeria monocytogenes EGD-e
gcuucuauuugucaa

SEQ ID NO: 774706 - RNA, 14 nt, Listeria monocytogenes EGD-e
gcuucguccagcug

SEQ ID NO: 774707 - RNA, 13 nt, Listeria monocytogenes EGD-e
gcuucuuccauau

SEQ ID NO: 774708 - RNA, 16 nt, Listeria monocytogenes EGD-e
gcuucuuccauuuguu

SEQ ID NO: 774709 - RNA, 17 nt, Listeria monocytogenes EGD-e
gcuuguaagaagcuuuu

SEQ ID NO: 774710 - RNA, 17 nt, Listeria monocytogenes EGD-e
gcuuuaucuuuuccuuc

SEQ ID NO: 774711 - RNA, 22 nt, Listeria monocytogenes EGD-e
gcuuguuuugaugcuaacuuaa

SEQ ID NO: 774712 - RNA, 13 nt, Listeria monocytogenes EGD-e
gcuuuagcagcaa

SEQ ID NO: 774713 - RNA, 13 nt, Listeria monocytogenes EGD-e
ggaacuacauacu

SEQ ID NO: 774714 - RNA, 11 nt, Listeria monocytogenes EGD-e
ggaagugaaaa

SEQ ID NO: 774715 - RNA, 16 nt, Listeria monocytogenes EGD-e
ggagcaagugugaaaa

SEQ ID NO: 774716 - RNA, 17 nt, Listeria monocytogenes EGD-e
ggagcaagugugaaaau

SEQ ID NO: 774717 - RNA, 17 nt, Listeria monocytogenes EGD-e
aaaguaacuaaaaauca

SEQ ID NO: 774718 - RNA, 20 nt, Listeria monocytogenes EGD-e
aaaguaacuaaaaaucauuu

SEQ ID NO: 774719 - RNA, 18 nt, Listeria monocytogenes EGD-e
aaagguauccuuauuaau

SEQ ID NO: 774720 - RNA, 18 nt, Listeria monocytogenes EGD-e
ggauaaaaaaauaccuag

SEQ ID NO: 774721 - RNA, 20 nt, Listeria monocytogenes EGD-e
ggaguuuguaacaacuaauu

SEQ ID NO: 774722 - RNA, 20 nt, Listeria monocytogenes EGD-e
ggaugcacuuuuaauuuagu

SEQ ID NO: 774723 - RNA, 18 nt, Listeria monocytogenes EGD-e
aaaguaaguuucgcuccg

SEQ ID NO: 774724 - RNA, 11 nt, Listeria monocytogenes EGD-e
ggauuagaaug

SEQ ID NO: 774725 - RNA, 14 nt, Listeria monocytogenes EGD-e
ggauucucuucuaa

SEQ ID NO: 774726 - RNA, 15 nt, Listeria monocytogenes EGD-e
ggauuuuucaaauca

SEQ ID NO: 774727 - RNA, 22 nt, Listeria monocytogenes EGD-e
aaaguagauuccgcuaaaacua

SEQ ID NO: 774728 - RNA, 24 nt, Listeria monocytogenes EGD-e
ggcaucauuuuuuugauuaauaaa

SEQ ID NO: 774729 - RNA, 21 nt, Listeria monocytogenes EGD-e
aaaguauugugcuaaguagac

SEQ ID NO: 774730 - RNA, 21 nt, Listeria monocytogenes EGD-e
ggcauuucaaucgcagcagau

SEQ ID NO: 774731 - RNA, 13 nt, Listeria monocytogenes EGD-e
ggccaauuaaaau

SEQ ID NO: 774732 - RNA, 22 nt, Listeria monocytogenes EGD-e
aaauacaugaccgccaauuuua

SEQ ID NO: 774733 - RNA, 22 nt, Listeria monocytogenes EGD-e
aaauaaguccaaagagccauaa

SEQ ID NO: 774734 - RNA, 13 nt, Listeria monocytogenes EGD-e
aaauaauccuucc

SEQ ID NO: 774735 - RNA, 14 nt, Listeria monocytogenes EGD-e
aaauaaccauucca

SEQ ID NO: 774736 - RNA, 20 nt, Listeria monocytogenes EGD-e
aaauaacuacuauuuaaaua

SEQ ID NO: 774737 - RNA, 20 nt, Listeria monocytogenes EGD-e
aaauaacggaaacuaucaau

SEQ ID NO: 774738 - RNA, 15 nt, Listeria monocytogenes EGD-e
ggcucguugcagaaa

SEQ ID NO: 774739 - RNA, 20 nt, Listeria monocytogenes EGD-e
ggcucuuccuuuuguuuuaa

SEQ ID NO: 774740 - RNA, 12 nt, Listeria monocytogenes EGD-e
ggcuucaaaacu

SEQ ID NO: 774741 - RNA, 19 nt, Listeria monocytogenes EGD-e
ggcuuccuuguuuuuugua

SEQ ID NO: 774742 - RNA, 22 nt, Listeria monocytogenes EGD-e
ggcugugaaggaaacgaauaaa

SEQ ID NO: 774743 - RNA, 14 nt, Listeria monocytogenes EGD-e
gggagaagccuugc

SEQ ID NO: 774744 - RNA, 21 nt, Listeria monocytogenes EGD-e
gggguacugcggcauagaaag

SEQ ID NO: 774745 - RNA, 22 nt, Listeria monocytogenes EGD-e
gggcucguugcagaaacaauca

SEQ ID NO: 774746 - RNA, 13 nt, Listeria monocytogenes EGD-e
ggguuugauaauc

SEQ ID NO: 774747 - RNA, 21 nt, Listeria monocytogenes EGD-e
gguaaacaacccauuugcauu

SEQ ID NO: 774748 - RNA, 11 nt, Listeria monocytogenes EGD-e
gguaaauagcc

SEQ ID NO: 774749 - RNA, 21 nt, Listeria monocytogenes EGD-e
gguaaauagccaagauuaaaa

SEQ ID NO: 774750 - RNA, 17 nt, Listeria monocytogenes EGD-e
gguaacgucuacuuuug

SEQ ID NO: 774751 - RNA, 16 nt, Listeria monocytogenes EGD-e
gguaauauaaauuugc

SEQ ID NO: 774752 - RNA, 19 nt, Listeria monocytogenes EGD-e
ggguguuuauucauauaaa

SEQ ID NO: 774753 - RNA, 12 nt, Listeria monocytogenes EGD-e
gggugagcuucu

SEQ ID NO: 774754 - RNA, 21 nt, Listeria monocytogenes EGD-e
gguaucccucauguucaaucu

SEQ ID NO: 774755 - RNA, 19 nt, Listeria monocytogenes EGD-e
gguagcuucaaucaagccu

SEQ ID NO: 774756 - RNA, 23 nt, Listeria monocytogenes EGD-e
ggugaaaaugagcccaaaaauaa

SEQ ID NO: 774757 - RNA, 23 nt, Listeria monocytogenes EGD-e
gccuacuuuuuuuauuuaccuug

SEQ ID NO: 774758 - RNA, 15 nt, Listeria monocytogenes EGD-e
gccgugauaaauaac

SEQ ID NO: 774759 - RNA, 15 nt, Listeria monocytogenes EGD-e
gccuaggcucucuuc

SEQ ID NO: 774760 - RNA, 17 nt, Listeria monocytogenes EGD-e
gccuuucuuuuuuaaua

SEQ ID NO: 774761 - RNA, 17 nt, Listeria monocytogenes EGD-e
gccuuaaaauaaaaaaa

SEQ ID NO: 774762 - RNA, 13 nt, Listeria monocytogenes EGD-e
gcgcaaacaguua

SEQ ID NO: 774763 - RNA, 22 nt, Listeria monocytogenes EGD-e
gcgcacaaguaauauuauaucc

SEQ ID NO: 774764 - RNA, 16 nt, Listeria monocytogenes EGD-e
gcgcauacgaguucua

SEQ ID NO: 774765 - RNA, 18 nt, Listeria monocytogenes EGD-e
gcggcauuucaaucgcag

SEQ ID NO: 774766 - RNA, 20 nt, Listeria monocytogenes EGD-e
gcggcauuucaaucgcagca

SEQ ID NO: 774767 - RNA, 18 nt, Listeria monocytogenes EGD-e
gcggcucagauccuucaa

SEQ ID NO: 774768 - RNA, 19 nt, Listeria monocytogenes EGD-e
gcgccauuugccaucgcag

SEQ ID NO: 774769 - RNA, 23 nt, Listeria monocytogenes EGD-e
gcccauuaaaaagcuuauuaaac

SEQ ID NO: 774770 - RNA, 19 nt, Listeria monocytogenes EGD-e
gcccagcuuaauccaauuu

SEQ ID NO: 774771 - RNA, 14 nt, Listeria monocytogenes EGD-e
gccaucgcagcaga

SEQ ID NO: 774772 - RNA, 19 nt, Listeria monocytogenes EGD-e
gccgacaaguacuuugaau

SEQ ID NO: 774773 - RNA, 19 nt, Listeria monocytogenes EGD-e
gccgcucgucuaaauugag

SEQ ID NO: 774774 - RNA, 13 nt, Listeria monocytogenes EGD-e
aaagcugccacca

SEQ ID NO: 774775 - RNA, 13 nt, Listeria monocytogenes EGD-e
gccgccgucucca

SEQ ID NO: 774776 - RNA, 18 nt, Listeria monocytogenes EGD-e
gcagcugauuuuuggggu

SEQ ID NO: 774777 - RNA, 14 nt, Listeria monocytogenes EGD-e
gcagggcagaaaac

SEQ ID NO: 774778 - RNA, 17 nt, Listeria monocytogenes EGD-e
gcauugcuuccccauag

SEQ ID NO: 774779 - RNA, 14 nt, Listeria monocytogenes EGD-e
gcauugauuuuuga

SEQ ID NO: 774780 - RNA, 14 nt, Listeria monocytogenes EGD-e
gcauuuucaugaac

SEQ ID NO: 774781 - RNA, 20 nt, Listeria monocytogenes EGD-e
gcauuucauaaucaaauaca

SEQ ID NO: 774782 - RNA, 18 nt, Listeria monocytogenes EGD-e
gcaucuucguauauuuua

SEQ ID NO: 774783 - RNA, 21 nt, Listeria monocytogenes EGD-e
gcaucuucuaagaaaaaaagu

SEQ ID NO: 774784 - RNA, 21 nt, Listeria monocytogenes EGD-e
gcauccaagcggguuuucuca

SEQ ID NO: 774785 - RNA, 22 nt, Listeria monocytogenes EGD-e
gcaucauuuuuuugauuaauaa

SEQ ID NO: 774786 - RNA, 20 nt, Listeria monocytogenes EGD-e
gcauccucuuuuguaguaaa

SEQ ID NO: 774787 - RNA, 23 nt, Listeria monocytogenes EGD-e
gccagcuucuuccauuuguucuc

SEQ ID NO: 774788 - RNA, 14 nt, Listeria monocytogenes EGD-e
gcaaaagcaaacaa

SEQ ID NO: 774789 - RNA, 16 nt, Listeria monocytogenes EGD-e
gcaaaaaauaauaucu

SEQ ID NO: 774790 - RNA, 14 nt, Listeria monocytogenes EGD-e
gauuuuguacauaa

SEQ ID NO: 774791 - RNA, 18 nt, Listeria monocytogenes EGD-e
gauuuuguuguuuuccca

SEQ ID NO: 774792 - RNA, 21 nt, Listeria monocytogenes EGD-e
gauuuuuauuccguucauuug

SEQ ID NO: 774793 - RNA, 14 nt, Listeria monocytogenes EGD-e
gauuuuucaaauca

SEQ ID NO: 774794 - RNA, 19 nt, Listeria monocytogenes EGD-e
gcaaacugcucagaaggaa

SEQ ID NO: 774795 - RNA, 22 nt, Listeria monocytogenes EGD-e
gcaacauucaaaucaccacaaa

SEQ ID NO: 774796 - RNA, 18 nt, Listeria monocytogenes EGD-e
gcaacaaagaagaaaaag

SEQ ID NO: 774797 - RNA, 21 nt, Listeria monocytogenes EGD-e
gcaaaucuuucggcacacuuu

SEQ ID NO: 774798 - RNA, 18 nt, Listeria monocytogenes EGD-e
gcaaaugcauuucucgau

SEQ ID NO: 774799 - RNA, 21 nt, Listeria monocytogenes EGD-e
gauucuaguuugucccaagau

SEQ ID NO: 774800 - RNA, 12 nt, Listeria monocytogenes EGD-e
gauucucuucua

SEQ ID NO: 774801 - RNA, 14 nt, Listeria monocytogenes EGD-e
gauucucuucuaac

SEQ ID NO: 774802 - RNA, 17 nt, Listeria monocytogenes EGD-e
gauugcagguaauuuaa

SEQ ID NO: 774803 - RNA, 21 nt, Listeria monocytogenes EGD-e
gauugcuucaccaagaagagc

SEQ ID NO: 774804 - RNA, 18 nt, Listeria monocytogenes EGD-e
gauugggcggaaauaaaa

SEQ ID NO: 774805 - RNA, 17 nt, Listeria monocytogenes EGD-e
gauuggcgauucuucaa

SEQ ID NO: 774806 - RNA, 19 nt, Listeria monocytogenes EGD-e
gauucccacagaucaaaag

SEQ ID NO: 774807 - RNA, 9 nt, Listeria monocytogenes EGD-e
gauuuaaau

SEQ ID NO: 774808 - RNA, 17 nt, Listeria monocytogenes EGD-e
gauuuaaauaaacaaau

SEQ ID NO: 774809 - RNA, 15 nt, Listeria monocytogenes EGD-e
gauuguucuuuaaaa

SEQ ID NO: 774810 - RNA, 14 nt, Listeria monocytogenes EGD-e
gauuucugcagaau

SEQ ID NO: 774811 - RNA, 14 nt, Listeria monocytogenes EGD-e
gauggaagaagugg

SEQ ID NO: 774812 - RNA, 13 nt, Listeria monocytogenes EGD-e
gauggaaguaaug

SEQ ID NO: 774813 - RNA, 14 nt, Listeria monocytogenes EGD-e
gaugguauuguuuu

SEQ ID NO: 774814 - RNA, 20 nt, Listeria monocytogenes EGD-e
gauuacuccaaaauaaaaug

SEQ ID NO: 774815 - RNA, 12 nt, Listeria monocytogenes EGD-e
gauuaaauauag

SEQ ID NO: 774816 - RNA, 18 nt, Listeria monocytogenes EGD-e
gauguuuaaacaucuucc

SEQ ID NO: 774817 - RNA, 21 nt, Listeria monocytogenes EGD-e
gaucuugcauuuuggcuaaag

SEQ ID NO: 774818 - RNA, 18 nt, Listeria monocytogenes EGD-e
gaugcgaaaaaugaaaag

SEQ ID NO: 774819 - RNA, 16 nt, Listeria monocytogenes EGD-e
gaugcacuagaaaaau

SEQ ID NO: 774820 - RNA, 17 nt, Listeria monocytogenes EGD-e
gaugcacuagaaaaaug

SEQ ID NO: 774821 - RNA, 19 nt, Listeria monocytogenes EGD-e
aaagcgaacuuaacgaauu

SEQ ID NO: 774822 - RNA, 23 nt, Listeria monocytogenes EGD-e
gauaagcacaaauuauuagaauu

SEQ ID NO: 774823 - RNA, 21 nt, Listeria monocytogenes EGD-e
gauaggcucuuccuuuuguuu

SEQ ID NO: 774824 - RNA, 21 nt, Listeria monocytogenes EGD-e
gaucauauucuucuaaaauaa

SEQ ID NO: 774825 - RNA, 18 nt, Listeria monocytogenes EGD-e
aaagccaguuuucauuuc

SEQ ID NO: 774826 - RNA, 19 nt, Listeria monocytogenes EGD-e
gaucuacuucuaaauaguc

SEQ ID NO: 774827 - RNA, 14 nt, Listeria monocytogenes EGD-e
gagcugauuuuauu

SEQ ID NO: 774828 - RNA, 22 nt, Listeria monocytogenes EGD-e
gaguagauugcauucugugaug

SEQ ID NO: 774829 - RNA, 15 nt, Listeria monocytogenes EGD-e
gaguaucuuguuucg

SEQ ID NO: 774830 - RNA, 18 nt, Listeria monocytogenes EGD-e
gagugucaguguuuuugu

SEQ ID NO: 774831 - RNA, 16 nt, Listeria monocytogenes EGD-e
gauaaagauaauaacc

SEQ ID NO: 774832 - RNA, 18 nt, Listeria monocytogenes EGD-e
gauaaacuaauuacuaaa

SEQ ID NO: 774833 - RNA, 22 nt, Listeria monocytogenes EGD-e
gaguuucuuuaccauacacaua

SEQ ID NO: 774834 - RNA, 23 nt, Listeria monocytogenes EGD-e
gauaaaauggcguuuuaaauccu

SEQ ID NO: 774835 - RNA, 18 nt, Listeria monocytogenes EGD-e
gagcgguuuuguuuccaa

SEQ ID NO: 774836 - RNA, 14 nt, Listeria monocytogenes EGD-e
gacucaaugaaaag

SEQ ID NO: 774837 - RNA, 20 nt, Listeria monocytogenes EGD-e
gagcaagugugaaaaucgag

SEQ ID NO: 774838 - RNA, 16 nt, Listeria monocytogenes EGD-e
cuuucguuucagcucu

SEQ ID NO: 774839 - RNA, 13 nt, Listeria monocytogenes EGD-e
cuuucguuuuuac

SEQ ID NO: 774840 - RNA, 12 nt, Listeria monocytogenes EGD-e
cuuucuuuuguu

SEQ ID NO: 774841 - RNA, 14 nt, Listeria monocytogenes EGD-e
cuuucuuuuguucu

SEQ ID NO: 774842 - RNA, 15 nt, Listeria monocytogenes EGD-e
cuuucuuuuguucuu

SEQ ID NO: 774843 - RNA, 13 nt, Listeria monocytogenes EGD-e
cuuucuucuacua

SEQ ID NO: 774844 - RNA, 19 nt, Listeria monocytogenes EGD-e
cuuucuucggauucucuuc

SEQ ID NO: 774845 - RNA, 14 nt, Listeria monocytogenes EGD-e
cuuugauuuuuucu

SEQ ID NO: 774846 - RNA, 19 nt, Listeria monocytogenes EGD-e
cuuugcuaucaaccacuuu

SEQ ID NO: 774847 - RNA, 19 nt, Listeria monocytogenes EGD-e
cuuugaauugcucguucuu

SEQ ID NO: 774848 - RNA, 16 nt, Listeria monocytogenes EGD-e
cuuuguguuaauaaaa

SEQ ID NO: 774849 - RNA, 21 nt, Listeria monocytogenes EGD-e
cuuuguguuaauaaaaucauu

SEQ ID NO: 774850 - RNA, 15 nt, Listeria monocytogenes EGD-e
cuuuagaauauggac

SEQ ID NO: 774851 - RNA, 14 nt, Listeria monocytogenes EGD-e
cuuucacaucuuca

SEQ ID NO: 774852 - RNA, 21 nt, Listeria monocytogenes EGD-e
cuuucacacgauaccaaaguu

SEQ ID NO: 774853 - RNA, 20 nt, Listeria monocytogenes EGD-e
cuucggauuuuucaaaucaa

SEQ ID NO: 774854 - RNA, 12 nt, Listeria monocytogenes EGD-e
cuucgcuuguuu

SEQ ID NO: 774855 - RNA, 13 nt, Listeria monocytogenes EGD-e
cuuuugcuucuuc

SEQ ID NO: 774856 - RNA, 16 nt, Listeria monocytogenes EGD-e
cuuuuagaaugaagau

SEQ ID NO: 774857 - RNA, 14 nt, Listeria monocytogenes EGD-e
cuuuuauuuuuaaa

SEQ ID NO: 774858 - RNA, 15 nt, Listeria monocytogenes EGD-e
cuuuuauuuuuaaag

SEQ ID NO: 774859 - RNA, 19 nt, Listeria monocytogenes EGD-e
cuuuuacgaucuacuucua

SEQ ID NO: 774860 - RNA, 14 nt, Listeria monocytogenes EGD-e
cuuuuauuuuucuu

SEQ ID NO: 774861 - RNA, 14 nt, Listeria monocytogenes EGD-e
cuuuuccaaaaugg

SEQ ID NO: 774862 - RNA, 13 nt, Listeria monocytogenes EGD-e
cuuuuguuuuaau

SEQ ID NO: 774863 - RNA, 16 nt, Listeria monocytogenes EGD-e
gaaaaauuucaucguu

SEQ ID NO: 774864 - RNA, 18 nt, Listeria monocytogenes EGD-e
gaaaaaguuguuucuaau

SEQ ID NO: 774865 - RNA, 17 nt, Listeria monocytogenes EGD-e
gaaaaaguuucaauuuc

SEQ ID NO: 774866 - RNA, 20 nt, Listeria monocytogenes EGD-e
gaaaaagugaccuuugaaaa

SEQ ID NO: 774867 - RNA, 13 nt, Listeria monocytogenes EGD-e
gaaaagacaccaa

SEQ ID NO: 774868 - RNA, 19 nt, Listeria monocytogenes EGD-e
gaaaacugaacaaagaaga

SEQ ID NO: 774869 - RNA, 13 nt, Listeria monocytogenes EGD-e
gaaaagcaaugag

SEQ ID NO: 774870 - RNA, 14 nt, Listeria monocytogenes EGD-e
gaaaacagaaagcu

SEQ ID NO: 774871 - RNA, 12 nt, Listeria monocytogenes EGD-e
gaaauaaccauu

SEQ ID NO: 774872 - RNA, 20 nt, Listeria monocytogenes EGD-e
gaaagcuguuuucaacaaaa

SEQ ID NO: 774873 - RNA, 19 nt, Listeria monocytogenes EGD-e
gaaaaucgaggaaguugca

SEQ ID NO: 774874 - RNA, 13 nt, Listeria monocytogenes EGD-e
gaaaaugagccca

SEQ ID NO: 774875 - RNA, 20 nt, Listeria monocytogenes EGD-e
gaaaaugagcccaaaaauaa

SEQ ID NO: 774876 - RNA, 20 nt, Listeria monocytogenes EGD-e
gaaacuaucaauaaauccag

SEQ ID NO: 774877 - RNA, 20 nt, Listeria monocytogenes EGD-e
gaacaaucauggaaacgaca

SEQ ID NO: 774878 - RNA, 11 nt, Listeria monocytogenes EGD-e
gaacaaagaag

SEQ ID NO: 774879 - RNA, 14 nt, Listeria monocytogenes EGD-e
gaacggggcaucau

SEQ ID NO: 774880 - RNA, 17 nt, Listeria monocytogenes EGD-e
gaacugacuagaaauua

SEQ ID NO: 774881 - RNA, 21 nt, Listeria monocytogenes EGD-e
gaacgaauccuuggaaaaaug

SEQ ID NO: 774882 - RNA, 16 nt, Listeria monocytogenes EGD-e
gaacgaagagccaagc

SEQ ID NO: 774883 - RNA, 12 nt, Listeria monocytogenes EGD-e
gaccauauaauc

SEQ ID NO: 774884 - RNA, 22 nt, Listeria monocytogenes EGD-e
gacauguuggauacuaagugcu

SEQ ID NO: 774885 - RNA, 20 nt, Listeria monocytogenes EGD-e
gacaugcuaaauaaaaccau

SEQ ID NO: 774886 - RNA, 17 nt, Listeria monocytogenes EGD-e
gacacccgcguuuucua

SEQ ID NO: 774887 - RNA, 17 nt, Listeria monocytogenes EGD-e
gacgacguuuaucaaua

SEQ ID NO: 774888 - RNA, 12 nt, Listeria monocytogenes EGD-e
gaccuucuuuua

SEQ ID NO: 774889 - RNA, 13 nt, Listeria monocytogenes EGD-e
gacgaaaagcaau

SEQ ID NO: 774890 - RNA, 13 nt, Listeria monocytogenes EGD-e
gacgcuuuuuuca

SEQ ID NO: 774891 - RNA, 22 nt, Listeria monocytogenes EGD-e
gaacuuacagaagcauuuucau

SEQ ID NO: 774892 - RNA, 16 nt, Listeria monocytogenes EGD-e
aaagaggauuuuccaa

SEQ ID NO: 774893 - RNA, 19 nt, Listeria monocytogenes EGD-e
aaagagggcccgaaaaucg

SEQ ID NO: 774894 - RNA, 20 nt, Listeria monocytogenes EGD-e
gaagaguccgccgacagccc

SEQ ID NO: 774895 - RNA, 20 nt, Listeria monocytogenes EGD-e
gaagcaauuagucccauuac

SEQ ID NO: 774896 - RNA, 18 nt, Listeria monocytogenes EGD-e
gaagcguguugauaaaga

SEQ ID NO: 774897 - RNA, 13 nt, Listeria monocytogenes EGD-e
gaaggaauuugcc

SEQ ID NO: 774898 - RNA, 21 nt, Listeria monocytogenes EGD-e
gaaguucgaauuccguuuguu

SEQ ID NO: 774899 - RNA, 12 nt, Listeria monocytogenes EGD-e
gaauaccagcag

SEQ ID NO: 774900 - RNA, 20 nt, Listeria monocytogenes EGD-e
gaauaagugaauugauggau

SEQ ID NO: 774901 - RNA, 17 nt, Listeria monocytogenes EGD-e
gaauaagaaauuaccua

SEQ ID NO: 774902 - RNA, 18 nt, Listeria monocytogenes EGD-e
gaauaaaacaaaagauag

SEQ ID NO: 774903 - RNA, 21 nt, Listeria monocytogenes EGD-e
gaauaaaacaaaagauagaca

SEQ ID NO: 774904 - RNA, 22 nt, Listeria monocytogenes EGD-e
gaaucauuaauauaaagaucca

SEQ ID NO: 774905 - RNA, 21 nt, Listeria monocytogenes EGD-e
gaaugaacuucaccacuucuu

SEQ ID NO: 774906 - RNA, 14 nt, Listeria monocytogenes EGD-e
gaaugaauagauau

SEQ ID NO: 774907 - RNA, 13 nt, Listeria monocytogenes EGD-e
gaaugagcuccuu

SEQ ID NO: 774908 - RNA, 13 nt, Listeria monocytogenes EGD-e
gaaugcgguaacu

SEQ ID NO: 774909 - RNA, 15 nt, Listeria monocytogenes EGD-e
gacaaaaagaaaaaa

SEQ ID NO: 774910 - RNA, 22 nt, Listeria monocytogenes EGD-e
gacaaaaggacaagcccagcac

SEQ ID NO: 774911 - RNA, 15 nt, Listeria monocytogenes EGD-e
gacaccaauuucugu

SEQ ID NO: 774912 - RNA, 22 nt, Listeria monocytogenes EGD-e
gaauugcuucuccguuuuccac

SEQ ID NO: 774913 - RNA, 19 nt, Listeria monocytogenes EGD-e
gaauugauggauuccuaaa

SEQ ID NO: 774914 - RNA, 18 nt, Listeria monocytogenes EGD-e
cugaguagaaaguuaguu

SEQ ID NO: 774915 - RNA, 19 nt, Listeria monocytogenes EGD-e
cugauuuuauuuuuauuau

SEQ ID NO: 774916 - RNA, 22 nt, Listeria monocytogenes EGD-e
cugaugaugccgcaagaucuuc

SEQ ID NO: 774917 - RNA, 23 nt, Listeria monocytogenes EGD-e
cugaugacuaacuaguuguaaac

SEQ ID NO: 774918 - RNA, 15 nt, Listeria monocytogenes EGD-e
cugcagaaugagcuc

SEQ ID NO: 774919 - RNA, 21 nt, Listeria monocytogenes EGD-e
cugcaacagauaguuguucca

SEQ ID NO: 774920 - RNA, 18 nt, Listeria monocytogenes EGD-e
cugccgaaugaccugaaa

SEQ ID NO: 774921 - RNA, 11 nt, Listeria monocytogenes EGD-e
cugccaccacu

SEQ ID NO: 774922 - RNA, 13 nt, Listeria monocytogenes EGD-e
cugccaccacuua

SEQ ID NO: 774923 - RNA, 15 nt, Listeria monocytogenes EGD-e
aaacuaucaauaaau

SEQ ID NO: 774924 - RNA, 11 nt, Listeria monocytogenes EGD-e
cuggaagagcg

SEQ ID NO: 774925 - RNA, 15 nt, Listeria monocytogenes EGD-e
cuggauaaaaauaac

SEQ ID NO: 774926 - RNA, 16 nt, Listeria monocytogenes EGD-e
cuggauaaaaauaacg

SEQ ID NO: 774927 - RNA, 21 nt, Listeria monocytogenes EGD-e
cugggaguuuuuuauuacuuu

SEQ ID NO: 774928 - RNA, 17 nt, Listeria monocytogenes EGD-e
cugggaauauccuuguu

SEQ ID NO: 774929 - RNA, 14 nt, Listeria monocytogenes EGD-e
cuggcgaaugaacu

SEQ ID NO: 774930 - RNA, 21 nt, Listeria monocytogenes EGD-e
cugguucgauuucugcagaau

SEQ ID NO: 774931 - RNA, 15 nt, Listeria monocytogenes EGD-e
cuguaaaaauaaaua

SEQ ID NO: 774932 - RNA, 16 nt, Listeria monocytogenes EGD-e
cuguaacaaaaucuuu

SEQ ID NO: 774933 - RNA, 19 nt, Listeria monocytogenes EGD-e
cuguaacaaaaucuuuuug

SEQ ID NO: 774934 - RNA, 22 nt, Listeria monocytogenes EGD-e
cuguaccggucugugauuacuc

SEQ ID NO: 774935 - RNA, 18 nt, Listeria monocytogenes EGD-e
aaacugaacaaagaagaa

SEQ ID NO: 774936 - RNA, 18 nt, Listeria monocytogenes EGD-e
cuguaucgccaacuucuu

SEQ ID NO: 774937 - RNA, 14 nt, Listeria monocytogenes EGD-e
cugugaaggaaacg

SEQ ID NO: 774938 - RNA, 16 nt, Listeria monocytogenes EGD-e
cuguuccaacauaucc

SEQ ID NO: 774939 - RNA, 17 nt, Listeria monocytogenes EGD-e
cuguuaaaggagaaaaa

SEQ ID NO: 774940 - RNA, 17 nt, Listeria monocytogenes EGD-e
cuguuaaaugauuuuua

SEQ ID NO: 774941 - RNA, 15 nt, Listeria monocytogenes EGD-e
cuuaaaauaaaaaaa

SEQ ID NO: 774942 - RNA, 18 nt, Listeria monocytogenes EGD-e
cuguugcaccaaaaauac

SEQ ID NO: 774943 - RNA, 21 nt, Listeria monocytogenes EGD-e
cuguugcuaacacagcuaccu

SEQ ID NO: 774944 - RNA, 18 nt, Listeria monocytogenes EGD-e
cuuaucucuucauuuuuc

SEQ ID NO: 774945 - RNA, 17 nt, Listeria monocytogenes EGD-e
cuuauaaugcagauuaa

SEQ ID NO: 774946 - RNA, 17 nt, Listeria monocytogenes EGD-e
cuuacagaagcauuuuc

SEQ ID NO: 774947 - RNA, 12 nt, Listeria monocytogenes EGD-e
cuucagaaagug

SEQ ID NO: 774948 - RNA, 15 nt, Listeria monocytogenes EGD-e
cuucauaaaucgcca

SEQ ID NO: 774949 - RNA, 14 nt, Listeria monocytogenes EGD-e
cuucaugugcuuuu

SEQ ID NO: 774950 - RNA, 15 nt, Listeria monocytogenes EGD-e
cuucaucguuuaaca

SEQ ID NO: 774951 - RNA, 19 nt, Listeria monocytogenes EGD-e
cuuccauagaauguauaca

SEQ ID NO: 774952 - RNA, 14 nt, Listeria monocytogenes EGD-e
cuuccauaucacca

SEQ ID NO: 774953 - RNA, 17 nt, Listeria monocytogenes EGD-e
cuuccacaucugaaaaa

SEQ ID NO: 774954 - RNA, 18 nt, Listeria monocytogenes EGD-e
cuucgauugcaucucuuu

SEQ ID NO: 774955 - RNA, 19 nt, Listeria monocytogenes EGD-e
cuucgauugcaucucuuuu

SEQ ID NO: 774956 - RNA, 17 nt, Listeria monocytogenes EGD-e
cguacgauugcuucacc

SEQ ID NO: 774957 - RNA, 13 nt, Listeria monocytogenes EGD-e
cguacuaaaaauu

SEQ ID NO: 774958 - RNA, 17 nt, Listeria monocytogenes EGD-e
cguacggaauuuauuau

SEQ ID NO: 774959 - RNA, 19 nt, Listeria monocytogenes EGD-e
cguacggaauuuauuauug

SEQ ID NO: 774960 - RNA, 13 nt, Listeria monocytogenes EGD-e
cguauccagccgc

SEQ ID NO: 774961 - RNA, 18 nt, Listeria monocytogenes EGD-e
cguauccaccaaaaacuu

SEQ ID NO: 774962 - RNA, 11 nt, Listeria monocytogenes EGD-e
cguaucaauaa

SEQ ID NO: 774963 - RNA, 13 nt, Listeria monocytogenes EGD-e
cguauuuauauuc

SEQ ID NO: 774964 - RNA, 18 nt, Listeria monocytogenes EGD-e
cgucgcaucaaucgccag

SEQ ID NO: 774965 - RNA, 14 nt, Listeria monocytogenes EGD-e
cuacaacuagauuu

SEQ ID NO: 774966 - RNA, 17 nt, Listeria monocytogenes EGD-e
cuaauuuuacuucuacu

SEQ ID NO: 774967 - RNA, 19 nt, Listeria monocytogenes EGD-e
cuaauuuuacuucuacuug

SEQ ID NO: 774968 - RNA, 15 nt, Listeria monocytogenes EGD-e
cuaauuagcauaaua

SEQ ID NO: 774969 - RNA, 20 nt, Listeria monocytogenes EGD-e
cuaaucaaaugcacagcaga

SEQ ID NO: 774970 - RNA, 15 nt, Listeria monocytogenes EGD-e
cuaaguuuucuaaac

SEQ ID NO: 774971 - RNA, 22 nt, Listeria monocytogenes EGD-e
cuaaugcuaggccuacuuuuuu

SEQ ID NO: 774972 - RNA, 13 nt, Listeria monocytogenes EGD-e
cuaaugaauaagc

SEQ ID NO: 774973 - RNA, 20 nt, Listeria monocytogenes EGD-e
cuaaugauagaagaacgaau

SEQ ID NO: 774974 - RNA, 15 nt, Listeria monocytogenes EGD-e
cuaaguuaaaccaua

SEQ ID NO: 774975 - RNA, 17 nt, Listeria monocytogenes EGD-e
cuaagucaucggcuuuu

SEQ ID NO: 774976 - RNA, 16 nt, Listeria monocytogenes EGD-e
cuaaguagacaagucc

SEQ ID NO: 774977 - RNA, 13 nt, Listeria monocytogenes EGD-e
cuaagaagagucc

SEQ ID NO: 774978 - RNA, 18 nt, Listeria monocytogenes EGD-e
cuaaacgaccaucugggc

SEQ ID NO: 774979 - RNA, 19 nt, Listeria monocytogenes EGD-e
cuaacaacaagcaaaacau

SEQ ID NO: 774980 - RNA, 15 nt, Listeria monocytogenes EGD-e
cuaacacuuauauga

SEQ ID NO: 774981 - RNA, 18 nt, Listeria monocytogenes EGD-e
cuaacacagcuaccucau

SEQ ID NO: 774982 - RNA, 21 nt, Listeria monocytogenes EGD-e
cguucccgcaaauucaugcaa

SEQ ID NO: 774983 - RNA, 12 nt, Listeria monocytogenes EGD-e
cguuaccauaaa

SEQ ID NO: 774984 - RNA, 14 nt, Listeria monocytogenes EGD-e
cguuuuccaccauu

SEQ ID NO: 774985 - RNA, 21 nt, Listeria monocytogenes EGD-e
cuaaaaaauauugaauagaac

SEQ ID NO: 774986 - RNA, 18 nt, Listeria monocytogenes EGD-e
cguuuaaagcguuuuucu

SEQ ID NO: 774987 - RNA, 16 nt, Listeria monocytogenes EGD-e
cguuguucuaacauua

SEQ ID NO: 774988 - RNA, 14 nt, Listeria monocytogenes EGD-e
cguuuuaaauccuu

SEQ ID NO: 774989 - RNA, 20 nt, Listeria monocytogenes EGD-e
cguuuguugcgccacuucua

SEQ ID NO: 774990 - RNA, 14 nt, Listeria monocytogenes EGD-e
cucauuacaaaauu

SEQ ID NO: 774991 - RNA, 20 nt, Listeria monocytogenes EGD-e
cucauuacucgguucaauua

SEQ ID NO: 774992 - RNA, 21 nt, Listeria monocytogenes EGD-e
cucauuacucgguucaauuaa

SEQ ID NO: 774993 - RNA, 21 nt, Listeria monocytogenes EGD-e
cucaggaguuaauucuguuaa

SEQ ID NO: 774994 - RNA, 13 nt, Listeria monocytogenes EGD-e
cuccaaaauaaaa

SEQ ID NO: 774995 - RNA, 22 nt, Listeria monocytogenes EGD-e
cucccaaaucgcgcaaacaguu

SEQ ID NO: 774996 - RNA, 22 nt, Listeria monocytogenes EGD-e
cucccucauccuuucuugauuu

SEQ ID NO: 774997 - RNA, 14 nt, Listeria monocytogenes EGD-e
cuccguauccagcc

SEQ ID NO: 774998 - RNA, 14 nt, Listeria monocytogenes EGD-e
cuccguauuuauau

SEQ ID NO: 774999 - RNA, 18 nt, Listeria monocytogenes EGD-e
cuccguauuuauauucuu

SEQ ID NO: 775000 - RNA, 12 nt, Listeria monocytogenes EGD-e
cucgauuuuuuu

SEQ ID NO: 775001 - RNA, 17 nt, Listeria monocytogenes EGD-e
cucguucuuaguuaauu

SEQ ID NO: 775002 - RNA, 13 nt, Listeria monocytogenes EGD-e
cucgucuaaaaaa

SEQ ID NO: 775003 - RNA, 12 nt, Listeria monocytogenes EGD-e
cuauuauuucug

SEQ ID NO: 775004 - RNA, 21 nt, Listeria monocytogenes EGD-e
cuauuuaaauauaacuuuuuu

SEQ ID NO: 775005 - RNA, 18 nt, Listeria monocytogenes EGD-e
cuauugaauguucuaaaa

SEQ ID NO: 775006 - RNA, 23 nt, Listeria monocytogenes EGD-e
cuauucuauuuaucaaacaaaaa

SEQ ID NO: 775007 - RNA, 21 nt, Listeria monocytogenes EGD-e
cuauuccuccuaauuguuuug

SEQ ID NO: 775008 - RNA, 19 nt, Listeria monocytogenes EGD-e
cuauuuggauacaaguguc

SEQ ID NO: 775009 - RNA, 14 nt, Listeria monocytogenes EGD-e
cuauuuuuuugcuu

SEQ ID NO: 775010 - RNA, 14 nt, Listeria monocytogenes EGD-e
cucacaauuuaagu

SEQ ID NO: 775011 - RNA, 18 nt, Listeria monocytogenes EGD-e
cucagcuucgauuuuuuc

SEQ ID NO: 775012 - RNA, 14 nt, Listeria monocytogenes EGD-e
cuaguuguaaaccg

SEQ ID NO: 775013 - RNA, 19 nt, Listeria monocytogenes EGD-e
cuauaaagaacuagauuua

SEQ ID NO: 775014 - RNA, 23 nt, Listeria monocytogenes EGD-e
cuagcuuugucuagguuuucuuu

SEQ ID NO: 775015 - RNA, 20 nt, Listeria monocytogenes EGD-e
cuagcaugucguaugcuuua

SEQ ID NO: 775016 - RNA, 20 nt, Listeria monocytogenes EGD-e
cuagccgcucgucuaaauug

SEQ ID NO: 775017 - RNA, 19 nt, Listeria monocytogenes EGD-e
cuacuuuuuuuauuuaccu

SEQ ID NO: 775018 - RNA, 23 nt, Listeria monocytogenes EGD-e
cuacagguguauucgucuuuuca

SEQ ID NO: 775019 - RNA, 14 nt, Listeria monocytogenes EGD-e
cuacauacuuauag

SEQ ID NO: 775020 - RNA, 15 nt, Listeria monocytogenes EGD-e
cuacaauuaaaauag

SEQ ID NO: 775021 - RNA, 12 nt, Listeria monocytogenes EGD-e
aaaaaaacaaau

SEQ ID NO: 775022 - RNA, 22 nt, Listeria monocytogenes EGD-e
aaaacaaauuugccaaagagaa

SEQ ID NO: 775023 - RNA, 19 nt, Listeria monocytogenes EGD-e
aaaacaaaagauagacaca

SEQ ID NO: 775024 - RNA, 21 nt, Listeria monocytogenes EGD-e
aaaaccauucaucuaauuuag

SEQ ID NO: 775025 - RNA, 23 nt, Listeria monocytogenes EGD-e
aaaaaugauucuaguuuguccca

SEQ ID NO: 775026 - RNA, 19 nt, Listeria monocytogenes EGD-e
aaaaaugaaaagaaaaacc

SEQ ID NO: 775027 - RNA, 18 nt, Listeria monocytogenes EGD-e
aaaaagugcguaagauuu

SEQ ID NO: 775028 - RNA, 22 nt, Listeria monocytogenes EGD-e
aaaaagugaccuuugaaaacug

SEQ ID NO: 775029 - RNA, 23 nt, Listeria monocytogenes EGD-e
aaaaagugaccuuugaaaacuga

SEQ ID NO: 775030 - RNA, 16 nt, Listeria monocytogenes EGD-e
aaaaauaugcuugcaa

SEQ ID NO: 775031 - RNA, 24 nt, Listeria monocytogenes EGD-e
aaaaacuugguuaauauauaguca

SEQ ID NO: 775032 - RNA, 19 nt, Listeria monocytogenes EGD-e
aaaaagcugccaccacuua

SEQ ID NO: 775033 - RNA, 20 nt, Listeria monocytogenes EGD-e
aaaaagggaugaaaaucuac

SEQ ID NO: 775034 - RNA, 23 nt, Listeria monocytogenes EGD-e
aaaaagguauccuuauuaauagu

SEQ ID NO: 775035 - RNA, 15 nt, Listeria monocytogenes EGD-e
aaaaaggaauugcuu

SEQ ID NO: 775036 - RNA, 15 nt, Listeria monocytogenes EGD-e
aaaaaggaauuuuuc

SEQ ID NO: 775037 - RNA, 15 nt, Listeria monocytogenes EGD-e
aaaaugaaaagaaaa

SEQ ID NO: 775038 - RNA, 18 nt, Listeria monocytogenes EGD-e
aaaaucuggauuuacuac

SEQ ID NO: 775039 - RNA, 17 nt, Listeria monocytogenes EGD-e
aaaaucuuuuaauaacu

SEQ ID NO: 775040 - RNA, 15 nt, Listeria monocytogenes EGD-e
aaaaucuuuaaacaa

SEQ ID NO: 775041 - RNA, 17 nt, Listeria monocytogenes EGD-e
aaaaucuuuaaacaagc

SEQ ID NO: 775042 - RNA, 18 nt, Listeria monocytogenes EGD-e
aaaaucuuuaaacaagcu

SEQ ID NO: 775043 - RNA, 14 nt, Listeria monocytogenes EGD-e
aaaaguuucaauuu

SEQ ID NO: 775044 - RNA, 24 nt, Listeria monocytogenes EGD-e
aaaaguuucaauuucgccguugga

SEQ ID NO: 775045 - RNA, 17 nt, Listeria monocytogenes EGD-e
aaaagugaccuuugaaa

SEQ ID NO: 775046 - RNA, 15 nt, Listeria monocytogenes EGD-e
aaaauaaaucugcuu

SEQ ID NO: 775047 - RNA, 18 nt, Listeria monocytogenes EGD-e
aaaauaaaugcauuucuu

SEQ ID NO: 775048 - RNA, 24 nt, Listeria monocytogenes EGD-e
aaaagguaggccacuaacauaaau

SEQ ID NO: 775049 - RNA, 17 nt, Listeria monocytogenes EGD-e
aaaagucaugacagcau

SEQ ID NO: 775050 - RNA, 18 nt, Listeria monocytogenes EGD-e
aaaaggacacccauaaua

SEQ ID NO: 775051 - RNA, 17 nt, Listeria monocytogenes EGD-e
aaaacgacagauaaaua

SEQ ID NO: 775052 - RNA, 15 nt, Listeria monocytogenes EGD-e
aaaaacuguuguucu

SEQ ID NO: 775053 - RNA, 18 nt, Listeria monocytogenes EGD-e
aaaaagaaaaaacaagga

SEQ ID NO: 775054 - RNA, 20 nt, Listeria monocytogenes EGD-e
aaacagaaacgcuuuguuua

SEQ ID NO: 775055 - RNA, 22 nt, Listeria monocytogenes EGD-e
aaacauagucagggaauaagaa

SEQ ID NO: 775056 - RNA, 11 nt, Listeria monocytogenes EGD-e
aaacauagaaa

SEQ ID NO: 775057 - RNA, 19 nt, Listeria monocytogenes EGD-e
aaacaguauuccucauuga

SEQ ID NO: 775058 - RNA, 18 nt, Listeria monocytogenes EGD-e
aaaccguaacuguugaaa

SEQ ID NO: 775059 - RNA, 15 nt, Listeria monocytogenes EGD-e
aaacccuugauuucu

SEQ ID NO: 775060 - RNA, 20 nt, Listeria monocytogenes EGD-e
aaaccaucgcaaaagcaaac

SEQ ID NO: 775061 - RNA, 14 nt, Listeria monocytogenes EGD-e
aaacccgaauaacu

SEQ ID NO: 775062 - RNA, 20 nt, Listeria monocytogenes EGD-e
aaacaucuuccgcucuuuuu

SEQ ID NO: 775063 - RNA, 23 nt, Listeria monocytogenes EGD-e
aaacauuauuuugcuaaagaagu

SEQ ID NO: 775064 - RNA, 22 nt, Listeria monocytogenes EGD-e
aaacauuugauacauauuugaa

SEQ ID NO: 775065 - RNA, 20 nt, Listeria monocytogenes EGD-e
aaauccauuucauucuuuuu

SEQ ID NO: 775066 - RNA, 21 nt, Listeria monocytogenes EGD-e
aaauccagagcugauuauauc

SEQ ID NO: 775067 - RNA, 17 nt, Listeria monocytogenes EGD-e
aaauccagcgucuaaaa

SEQ ID NO: 775068 - RNA, 20 nt, Listeria monocytogenes EGD-e
aaauccagcgucuaaaaaug

SEQ ID NO: 775069 - RNA, 21 nt, Listeria monocytogenes EGD-e
aaaucgagucaccgaauccaa

SEQ ID NO: 775070 - RNA, 20 nt, Listeria monocytogenes EGD-e
aaaucuuuaaacaagcuuug

SEQ ID NO: 775071 - RNA, 19 nt, Listeria monocytogenes EGD-e
aaaucuggauaaaaauaac

SEQ ID NO: 775072 - RNA, 20 nt, Listeria monocytogenes EGD-e
aaaucugcgaauaacagauu

SEQ ID NO: 775073 - RNA, 17 nt, Listeria monocytogenes EGD-e
aaaugagcccaaaaaua

SEQ ID NO: 775074 - RNA, 18 nt, Listeria monocytogenes EGD-e
aaaugaccaaugcuuucu

SEQ ID NO: 775075 - RNA, 21 nt, Listeria monocytogenes EGD-e
aaaugacaaagcuauuuuuua

SEQ ID NO: 775076 - RNA, 15 nt, Listeria monocytogenes EGD-e
aaaaagcaacucuuu

SEQ ID NO: 775077 - RNA, 17 nt, Listeria monocytogenes EGD-e
aaaaagauuauggaaaa

SEQ ID NO: 775078 - RNA, 20 nt, Listeria monocytogenes EGD-e
aaaaagcacucgucuaaaaa

SEQ ID NO: 775079 - RNA, 23 nt, Listeria monocytogenes EGD-e
aaaaagcacucgucuaaaaaaua

SEQ ID NO: 775080 - RNA, 20 nt, Listeria monocytogenes EGD-e
aaaaagagcggaagauguuu

SEQ ID NO: 775081 - RNA, 20 nt, Listeria monocytogenes EGD-e
aaauuagugccaugaauauu

SEQ ID NO: 775082 - RNA, 22 nt, Listeria monocytogenes EGD-e
aaaugguacguugguuguucuu

SEQ ID NO: 775083 - RNA, 20 nt, Listeria monocytogenes EGD-e
aaaugguucacuuucuugcu

SEQ ID NO: 775084 - RNA, 14 nt, Listeria monocytogenes EGD-e
aaaugcacagcaga

SEQ ID NO: 775085 - RNA, 19 nt, Listeria monocytogenes EGD-e
aaaugcacagcagaaacuu

SEQ ID NO: 775086 - RNA, 14 nt, Listeria monocytogenes EGD-e
aaaugcauuucuua

SEQ ID NO: 775087 - RNA, 23 nt, Listeria monocytogenes EGD-e
aaaugcauuucuuacuauuuucu

SEQ ID NO: 775088 - RNA, 20 nt, Listeria monocytogenes EGD-e
aaauggcgcaggaauagcaa

SEQ ID NO: 775089 - RNA, 16 nt, Listeria monocytogenes EGD-e
aaauggcugaugacua

SEQ ID NO: 775090 - RNA, 15 nt, Listeria monocytogenes EGD-e
aaauuuuuuugaaaa

SEQ ID NO: 775091 - RNA, 19 nt, Listeria monocytogenes EGD-e
aaauuuuuuugaaaaaaca

SEQ ID NO: 775092 - RNA, 20 nt, Listeria monocytogenes EGD-e
aaauuuuuuugaaaaaacau

SEQ ID NO: 775093 - RNA, 17 nt, Listeria monocytogenes EGD-e
aacaaagaagaaaaagu

SEQ ID NO: 775094 - RNA, 19 nt, Listeria monocytogenes EGD-e
aacaaagcguuuuuuauuu

SEQ ID NO: 775095 - RNA, 16 nt, Listeria monocytogenes EGD-e
aacaaaagucacagcg

SEQ ID NO: 775096 - RNA, 22 nt, Listeria monocytogenes EGD-e
aacaaauucuccuuaaauaaaa

SEQ ID NO: 775097 - RNA, 20 nt, Listeria monocytogenes EGD-e
aacaaauuugccaaagagaa

SEQ ID NO: 775098 - RNA, 15 nt, Listeria monocytogenes EGD-e
aacaaccaucaaacu

SEQ ID NO: 775099 - RNA, 16 nt, Listeria monocytogenes EGD-e
aacaaccaucaaacuc

SEQ ID NO: 775100 - RNA, 18 nt, Listeria monocytogenes EGD-e
aacaacuaacacuuauau

SEQ ID NO: 775101 - RNA, 14 nt, Listeria monocytogenes EGD-e
aacaacuaauuuuu

SEQ ID NO: 775102 - RNA, 21 nt, Listeria monocytogenes EGD-e
aacaagaggcuuauuccucca

SEQ ID NO: 775103 - RNA, 21 nt, Listeria monocytogenes EGD-e
aacaaggaagaauaguacaua

SEQ ID NO: 775104 - RNA, 15 nt, Listeria monocytogenes EGD-e
aaauucaguuuauaa

SEQ ID NO: 775105 - RNA, 21 nt, Listeria monocytogenes EGD-e
aaauucaguuuauaaauaccu

SEQ ID NO: 775106 - RNA, 22 nt, Listeria monocytogenes EGD-e
aaauucaguuuauaaauaccug

SEQ ID NO: 775107 - RNA, 20 nt, Listeria monocytogenes EGD-e
aaauugcaacaguuauuaaa

SEQ ID NO: 775108 - RNA, 19 nt, Listeria monocytogenes EGD-e
aaauuggauuauucaauuc

SEQ ID NO: 775109 - RNA, 18 nt, Listeria monocytogenes EGD-e
aaauugucuacugcuuuu

SEQ ID NO: 775110 - RNA, 17 nt, Listeria monocytogenes EGD-e
aaauuggucauauguuu

SEQ ID NO: 775111 - RNA, 18 nt, Listeria monocytogenes EGD-e
aaauuucuguuaugaaca

SEQ ID NO: 775112 - RNA, 19 nt, Listeria monocytogenes EGD-e
aaauuucccgcuacuaucg

SEQ ID NO: 775113 - RNA, 14 nt, Listeria monocytogenes EGD-e
aaauacauuuuagc

SEQ ID NO: 775114 - RNA, 17 nt, Listeria monocytogenes EGD-e
aaauacgaaaaacauua

SEQ ID NO: 775115 - RNA, 19 nt, Listeria monocytogenes EGD-e
aaauaauuccauuuaauuu

SEQ ID NO: 775116 - RNA, 16 nt, Listeria monocytogenes EGD-e
aaauaaauauuuugca

SEQ ID NO: 775117 - RNA, 21 nt, Listeria monocytogenes EGD-e
aaauauagucuacuuuuaaaa

SEQ ID NO: 775118 - RNA, 19 nt, Listeria monocytogenes EGD-e
aaauauacacaaaguaaaa

SEQ ID NO: 775119 - RNA, 19 nt, Listeria monocytogenes EGD-e
aaauagacgaccauauaau

SEQ ID NO: 775120 - RNA, 23 nt, Listeria monocytogenes EGD-e
aaaguagauuccgcuaaaacuaa

SEQ ID NO: 775121 - RNA, 16 nt, Listeria monocytogenes EGD-e
aaagugaccuuugaaa

SEQ ID NO: 775122 - RNA, 17 nt, Listeria monocytogenes EGD-e
aaagugaccuuugaaaa

SEQ ID NO: 775123 - RNA, 23 nt, Listeria monocytogenes EGD-e
aaagugaccuuugaaaacugaac

SEQ ID NO: 775124 - RNA, 18 nt, Listeria monocytogenes EGD-e
aaagugcgcuuauuuuuu

SEQ ID NO: 775125 - RNA, 23 nt, Listeria monocytogenes EGD-e
aaagugcgcuuauuuuuugagcg

SEQ ID NO: 775126 - RNA, 13 nt, Listeria monocytogenes EGD-e
aaaguuucuuuuu

SEQ ID NO: 775127 - RNA, 17 nt, Listeria monocytogenes EGD-e
aaaguuucuuuuugauu

SEQ ID NO: 775128 - RNA, 12 nt, Listeria monocytogenes EGD-e
aaaguuagauua

SEQ ID NO: 775129 - RNA, 19 nt, Listeria monocytogenes EGD-e
aaaguuagauuaaaaaucu

SEQ ID NO: 775130 - RNA, 20 nt, Listeria monocytogenes EGD-e
aaaguuaguugcuuuuguuu

SEQ ID NO: 775131 - RNA, 17 nt, Listeria monocytogenes EGD-e
aaaguuauauuuaaaua

SEQ ID NO: 775132 - RNA, 12 nt, Listeria monocytogenes EGD-e
aaaguuguuucu

SEQ ID NO: 775133 - RNA, 14 nt, Listeria monocytogenes EGD-e
aaagcugccaccac

SEQ ID NO: 775134 - RNA, 16 nt, Listeria monocytogenes EGD-e
aaaggaaauaauucca

SEQ ID NO: 775135 - RNA, 23 nt, Listeria monocytogenes EGD-e
aaaguaaaaucuuuuaauaacug

SEQ ID NO: 775136 - RNA, 21 nt, Listeria monocytogenes EGD-e
aaagaacuuacagaagcauuu

SEQ ID NO: 775137 - RNA, 12 nt, Listeria monocytogenes EGD-e
aaagaagaaaaa

SEQ ID NO: 775138 - RNA, 18 nt, Listeria monocytogenes EGD-e
aaagaacuagauuuaaua

SEQ ID NO: 775139 - RNA, 17 nt, Listeria monocytogenes EGD-e
aaacuuuuucucaaaaa

SEQ ID NO: 775140 - RNA, 15 nt, Listeria monocytogenes EGD-e
aaagaggauuuucca

SEQ ID NO: 775141 - RNA, 16 nt, Listeria monocytogenes EGD-e
caaagagccauaaaau

SEQ ID NO: 775142 - RNA, 21 nt, Listeria monocytogenes EGD-e
caaacugcucagaaggaauaa

SEQ ID NO: 775143 - RNA, 21 nt, Listeria monocytogenes EGD-e
caaagcuacuuuucgaauccc

SEQ ID NO: 775144 - RNA, 15 nt, Listeria monocytogenes EGD-e
caaagcguuuuuuau

SEQ ID NO: 775145 - RNA, 13 nt, Listeria monocytogenes EGD-e
caaaguaaaaagg

SEQ ID NO: 775146 - RNA, 19 nt, Listeria monocytogenes EGD-e
caaaauaauaauaaguaua

SEQ ID NO: 775147 - RNA, 21 nt, Listeria monocytogenes EGD-e
caaaaucuuuuuguuuugcuu

SEQ ID NO: 775148 - RNA, 22 nt, Listeria monocytogenes EGD-e
caaaaucuuuuuguuuugcuuc

SEQ ID NO: 775149 - RNA, 23 nt, Listeria monocytogenes EGD-e
caaaaucuuuuuguuuugcuuca

SEQ ID NO: 775150 - RNA, 20 nt, Listeria monocytogenes EGD-e
caaaaucaugccuucaaaca

SEQ ID NO: 775151 - RNA, 21 nt, Listeria monocytogenes EGD-e
caaaaugggcaguuacuuuac

SEQ ID NO: 775152 - RNA, 15 nt, Listeria monocytogenes EGD-e
caaacacuucuaaaa

SEQ ID NO: 775153 - RNA, 20 nt, Listeria monocytogenes EGD-e
caaacacuucuaaaacaggc

SEQ ID NO: 775154 - RNA, 15 nt, Listeria monocytogenes EGD-e
caaacagcuuuucua

SEQ ID NO: 775155 - RNA, 16 nt, Listeria monocytogenes EGD-e
caaauuauuagaauuc

SEQ ID NO: 775156 - RNA, 19 nt, Listeria monocytogenes EGD-e
caaauggagcuauuguaaa

SEQ ID NO: 775157 - RNA, 18 nt, Listeria monocytogenes EGD-e
caacaaucugaacugacu

SEQ ID NO: 775158 - RNA, 21 nt, Listeria monocytogenes EGD-e
caaccaagcaauaacaucuuu

SEQ ID NO: 775159 - RNA, 16 nt, Listeria monocytogenes EGD-e
caacuaacacuuauau

SEQ ID NO: 775160 - RNA, 17 nt, Listeria monocytogenes EGD-e
caagaacagcaauuugu

SEQ ID NO: 775161 - RNA, 18 nt, Listeria monocytogenes EGD-e
caagagcagggcuauuuu

SEQ ID NO: 775162 - RNA, 22 nt, Listeria monocytogenes EGD-e
caagaagagcugcaacagauag

SEQ ID NO: 775163 - RNA, 22 nt, Listeria monocytogenes EGD-e
caagcacuuacugcaaucauuu

SEQ ID NO: 775164 - RNA, 12 nt, Listeria monocytogenes EGD-e
caagcccagcac

SEQ ID NO: 775165 - RNA, 22 nt, Listeria monocytogenes EGD-e
caagcgcuuccucgacuucaag

SEQ ID NO: 775166 - RNA, 13 nt, Listeria monocytogenes EGD-e
caaucggggaaau

SEQ ID NO: 775167 - RNA, 15 nt, Listeria monocytogenes EGD-e
caaucucaucaccag

SEQ ID NO: 775168 - RNA, 21 nt, Listeria monocytogenes EGD-e
caaucucaucaccagcuucua

SEQ ID NO: 775169 - RNA, 21 nt, Listeria monocytogenes EGD-e
caaucaucuuaucaaguaaua

SEQ ID NO: 775170 - RNA, 15 nt, Listeria monocytogenes EGD-e
caaucauuuauuuuc

SEQ ID NO: 775171 - RNA, 16 nt, Listeria monocytogenes EGD-e
caaucauuuauuuucc

SEQ ID NO: 775172 - RNA, 19 nt, Listeria monocytogenes EGD-e
caaugagucaaugcccagu

SEQ ID NO: 775173 - RNA, 16 nt, Listeria monocytogenes EGD-e
caaugagugaagauaa

SEQ ID NO: 775174 - RNA, 19 nt, Listeria monocytogenes EGD-e
caaucugaacugacuagaa

SEQ ID NO: 775175 - RNA, 14 nt, Listeria monocytogenes EGD-e
caauagaaaccauc

SEQ ID NO: 775176 - RNA, 21 nt, Listeria monocytogenes EGD-e
caauaccauguuuauuuaaua

SEQ ID NO: 775177 - RNA, 22 nt, Listeria monocytogenes EGD-e
caauaccauguuuauuuaauaa

SEQ ID NO: 775178 - RNA, 18 nt, Listeria monocytogenes EGD-e
caaguacuuugaauugcu

SEQ ID NO: 775179 - RNA, 14 nt, Listeria monocytogenes EGD-e
caaguaauaagaag

SEQ ID NO: 775180 - RNA, 15 nt, Listeria monocytogenes EGD-e
caaguaacucuucca

SEQ ID NO: 775181 - RNA, 13 nt, Listeria monocytogenes EGD-e
cacaaaguaaaaa

SEQ ID NO: 775182 - RNA, 17 nt, Listeria monocytogenes EGD-e
cacaaaguaaaaaggaa

SEQ ID NO: 775183 - RNA, 15 nt, Listeria monocytogenes EGD-e
caauuagucccauua

SEQ ID NO: 775184 - RNA, 19 nt, Listeria monocytogenes EGD-e
caauuaaaauaguuuuuuu

SEQ ID NO: 775185 - RNA, 16 nt, Listeria monocytogenes EGD-e
cacagcgcuuaaaaau

SEQ ID NO: 775186 - RNA, 17 nt, Listeria monocytogenes EGD-e
cacagcgcuuaaaaauu

SEQ ID NO: 775187 - RNA, 19 nt, Listeria monocytogenes EGD-e
caccaagcgcuuccucgac

SEQ ID NO: 775188 - RNA, 14 nt, Listeria monocytogenes EGD-e
caccaauaaaaccu

SEQ ID NO: 775189 - RNA, 18 nt, Listeria monocytogenes EGD-e
cacaugauaaccagaaac

SEQ ID NO: 775190 - RNA, 23 nt, Listeria monocytogenes EGD-e
caccaauuuuaaauccguugucu

SEQ ID NO: 775191 - RNA, 19 nt, Listeria monocytogenes EGD-e
caccaauuucuguuuuguu

SEQ ID NO: 775192 - RNA, 20 nt, Listeria monocytogenes EGD-e
aaaaguuugggcauuacgaa

SEQ ID NO: 775193 - RNA, 10 nt, Listeria monocytogenes EGD-e
aaaauaaaaa

SEQ ID NO: 775194 - RNA, 15 nt, Listeria monocytogenes EGD-e
aaaauaaaaaaauac

SEQ ID NO: 775195 - RNA, 21 nt, Listeria monocytogenes EGD-e
caccgaacuagcaucagcuuu

SEQ ID NO: 775196 - RNA, 21 nt, Listeria monocytogenes EGD-e
caccucuuguacacauuauac

SEQ ID NO: 775197 - RNA, 19 nt, Listeria monocytogenes EGD-e
aaaauaaucacguuuuugc

SEQ ID NO: 775198 - RNA, 20 nt, Listeria monocytogenes EGD-e
cacgaguugcuuuagaauau

SEQ ID NO: 775199 - RNA, 15 nt, Listeria monocytogenes EGD-e
cacgacgaauggccu

SEQ ID NO: 775200 - RNA, 22 nt, Listeria monocytogenes EGD-e
cacgucccauugcgaauaacaa

SEQ ID NO: 775201 - RNA, 17 nt, Listeria monocytogenes EGD-e
auuuccaaguguuuuag

SEQ ID NO: 775202 - RNA, 18 nt, Listeria monocytogenes EGD-e
auuucauucuuuuuuaua

SEQ ID NO: 775203 - RNA, 13 nt, Listeria monocytogenes EGD-e
auuucauuuuaau

SEQ ID NO: 775204 - RNA, 19 nt, Listeria monocytogenes EGD-e
auuucucaaggguuuuugu

SEQ ID NO: 775205 - RNA, 17 nt, Listeria monocytogenes EGD-e
auuucaucuuuuuuuau

SEQ ID NO: 775206 - RNA, 12 nt, Listeria monocytogenes EGD-e
auuucaucuuuu

SEQ ID NO: 775207 - RNA, 17 nt, Listeria monocytogenes EGD-e
auuucaucguuuucuac

SEQ ID NO: 775208 - RNA, 18 nt, Listeria monocytogenes EGD-e
auuucauaaucaaauaca

SEQ ID NO: 775209 - RNA, 20 nt, Listeria monocytogenes EGD-e
auuugucccacaaacucauu

SEQ ID NO: 775210 - RNA, 18 nt, Listeria monocytogenes EGD-e
auuugucuucggauuuuu

SEQ ID NO: 775211 - RNA, 17 nt, Listeria monocytogenes EGD-e
auuuggccaauuaaaau

SEQ ID NO: 775212 - RNA, 17 nt, Listeria monocytogenes EGD-e
auuugguccaucaaauu

SEQ ID NO: 775213 - RNA, 15 nt, Listeria monocytogenes EGD-e
auuucuuuugacaaa

SEQ ID NO: 775214 - RNA, 18 nt, Listeria monocytogenes EGD-e
auuucuuugucgccaccu

SEQ ID NO: 775215 - RNA, 15 nt, Listeria monocytogenes EGD-e
auuucuuuaucuuuc

SEQ ID NO: 775216 - RNA, 16 nt, Listeria monocytogenes EGD-e
auuucuuuaucuuucc

SEQ ID NO: 775217 - RNA, 17 nt, Listeria monocytogenes EGD-e
auuucuuuaucuuuccc

SEQ ID NO: 775218 - RNA, 22 nt, Listeria monocytogenes EGD-e
auuucuauaaaaaugauaaugu

SEQ ID NO: 775219 - RNA, 17 nt, Listeria monocytogenes EGD-e
auuucucccucauccuu

SEQ ID NO: 775220 - RNA, 21 nt, Listeria monocytogenes EGD-e
auuucucccucauccuuucuu

SEQ ID NO: 775221 - RNA, 15 nt, Listeria monocytogenes EGD-e
auuucuccguaagaa

SEQ ID NO: 775222 - RNA, 18 nt, Listeria monocytogenes EGD-e
auuugauugccugaaaua

SEQ ID NO: 775223 - RNA, 14 nt, Listeria monocytogenes EGD-e
auuugccaaucaau

SEQ ID NO: 775224 - RNA, 23 nt, Listeria monocytogenes EGD-e
caaaaacaaccaucaaacucuuu

SEQ ID NO: 775225 - RNA, 17 nt, Listeria monocytogenes EGD-e
auuuuuauuccguucau

SEQ ID NO: 775226 - RNA, 14 nt, Listeria monocytogenes EGD-e
auuuuuauuauaaa

SEQ ID NO: 775227 - RNA, 12 nt, Listeria monocytogenes EGD-e
auuuuuaucuaa

SEQ ID NO: 775228 - RNA, 22 nt, Listeria monocytogenes EGD-e
auuuuuuugaacggguuucccu

SEQ ID NO: 775229 - RNA, 16 nt, Listeria monocytogenes EGD-e
auuuucacccauacua

SEQ ID NO: 775230 - RNA, 14 nt, Listeria monocytogenes EGD-e
auuuucacugcaua

SEQ ID NO: 775231 - RNA, 14 nt, Listeria monocytogenes EGD-e
auuuuaaagagagu

SEQ ID NO: 775232 - RNA, 12 nt, Listeria monocytogenes EGD-e
auuuuaaaucuu

SEQ ID NO: 775233 - RNA, 19 nt, Listeria monocytogenes EGD-e
auuuuccgcagcuucaauc

SEQ ID NO: 775234 - RNA, 16 nt, Listeria monocytogenes EGD-e
auuuucccuccuuuau

SEQ ID NO: 775235 - RNA, 22 nt, Listeria monocytogenes EGD-e
auuuucccuccuuuauuuuuua

SEQ ID NO: 775236 - RNA, 16 nt, Listeria monocytogenes EGD-e
auuuugucaauccauu

SEQ ID NO: 775237 - RNA, 21 nt, Listeria monocytogenes EGD-e
auuuugucaauccauuuuucu

SEQ ID NO: 775238 - RNA, 22 nt, Listeria monocytogenes EGD-e
auuuugguuuggucaacaucau

SEQ ID NO: 775239 - RNA, 23 nt, Listeria monocytogenes EGD-e
auuuugguuuggucaacaucauu

SEQ ID NO: 775240 - RNA, 14 nt, Listeria monocytogenes EGD-e
auuuugcucaagug

SEQ ID NO: 775241 - RNA, 15 nt, Listeria monocytogenes EGD-e
auuuugauaggcucu

SEQ ID NO: 775242 - RNA, 19 nt, Listeria monocytogenes EGD-e
auuuagaggcguacuaaaa

SEQ ID NO: 775243 - RNA, 20 nt, Listeria monocytogenes EGD-e
auuuagaggcguacuaaaaa

SEQ ID NO: 775244 - RNA, 22 nt, Listeria monocytogenes EGD-e
auuuagaggcguacuaaaaauu

SEQ ID NO: 775245 - RNA, 22 nt, Listeria monocytogenes EGD-e
auuuacguuguucuaacauuaa

SEQ ID NO: 775246 - RNA, 17 nt, Listeria monocytogenes EGD-e
auuguuuuuugauuuuu

SEQ ID NO: 775247 - RNA, 16 nt, Listeria monocytogenes EGD-e
auuuaauuuaauuuuc

SEQ ID NO: 775248 - RNA, 15 nt, Listeria monocytogenes EGD-e
auuuaauuguaauuc

SEQ ID NO: 775249 - RNA, 22 nt, Listeria monocytogenes EGD-e
auuuaauugucgaaaaccuaaa

SEQ ID NO: 775250 - RNA, 13 nt, Listeria monocytogenes EGD-e
auuuaauuuaauu

SEQ ID NO: 775251 - RNA, 22 nt, Listeria monocytogenes EGD-e
aaaaguaacauagcuacaauua

SEQ ID NO: 775252 - RNA, 19 nt, Listeria monocytogenes EGD-e
auuggucauauguuucgcc

SEQ ID NO: 775253 - RNA, 17 nt, Listeria monocytogenes EGD-e
auugggcggaaauaaaa

SEQ ID NO: 775254 - RNA, 16 nt, Listeria monocytogenes EGD-e
auugcuucuuuuuucu

SEQ ID NO: 775255 - RNA, 17 nt, Listeria monocytogenes EGD-e
auugcuucuuuuuucuu

SEQ ID NO: 775256 - RNA, 19 nt, Listeria monocytogenes EGD-e
auugcuuccccauaguaaa

SEQ ID NO: 775257 - RNA, 20 nt, Listeria monocytogenes EGD-e
auugcuuccccauaguaaaa

SEQ ID NO: 775258 - RNA, 17 nt, Listeria monocytogenes EGD-e
auugcuucuccguuuuc

SEQ ID NO: 775259 - RNA, 19 nt, Listeria monocytogenes EGD-e
auugcuucuccguuuucca

SEQ ID NO: 775260 - RNA, 21 nt, Listeria monocytogenes EGD-e
auugcucguucuuaguuaauu

SEQ ID NO: 775261 - RNA, 16 nt, Listeria monocytogenes EGD-e
auugagugcuuucguu

SEQ ID NO: 775262 - RNA, 16 nt, Listeria monocytogenes EGD-e
auucccuuuuuuuacu

SEQ ID NO: 775263 - RNA, 14 nt, Listeria monocytogenes EGD-e
auucauaaacaaaa

SEQ ID NO: 775264 - RNA, 21 nt, Listeria monocytogenes EGD-e
auuccagcuagacaagcacuu

SEQ ID NO: 775265 - RNA, 12 nt, Listeria monocytogenes EGD-e
auucggcuucaa

SEQ ID NO: 775266 - RNA, 23 nt, Listeria monocytogenes EGD-e
auucgguauguuuuaauuucaaa

SEQ ID NO: 775267 - RNA, 13 nt, Listeria monocytogenes EGD-e
auucuaaauaaau

SEQ ID NO: 775268 - RNA, 15 nt, Listeria monocytogenes EGD-e
auucgaguuucuguu

SEQ ID NO: 775269 - RNA, 16 nt, Listeria monocytogenes EGD-e
auucgaauaaagaacu

SEQ ID NO: 775270 - RNA, 20 nt, Listeria monocytogenes EGD-e
auugaauagaacuauaacca

SEQ ID NO: 775271 - RNA, 18 nt, Listeria monocytogenes EGD-e
auugaccaauuucuuuuu

SEQ ID NO: 775272 - RNA, 17 nt, Listeria monocytogenes EGD-e
auucuguuaaaggagaa

SEQ ID NO: 775273 - RNA, 19 nt, Listeria monocytogenes EGD-e
auucuguuaaaggagaaaa

SEQ ID NO: 775274 - RNA, 20 nt, Listeria monocytogenes EGD-e
auucuagccgcucgucuaaa

SEQ ID NO: 775275 - RNA, 22 nt, Listeria monocytogenes EGD-e
augcacuuucaaaucagcuucc

SEQ ID NO: 775276 - RNA, 17 nt, Listeria monocytogenes EGD-e
augcacuagaaaaauga

SEQ ID NO: 775277 - RNA, 23 nt, Listeria monocytogenes EGD-e
augcauuucuuacuauuuucuaa

SEQ ID NO: 775278 - RNA, 16 nt, Listeria monocytogenes EGD-e
augcauggaacgguau

SEQ ID NO: 775279 - RNA, 14 nt, Listeria monocytogenes EGD-e
augcugaauguuuu

SEQ ID NO: 775280 - RNA, 12 nt, Listeria monocytogenes EGD-e
augcuaggccua

SEQ ID NO: 775281 - RNA, 13 nt, Listeria monocytogenes EGD-e
augcuaaauaaaa

SEQ ID NO: 775282 - RNA, 22 nt, Listeria monocytogenes EGD-e
augguauuguuuuuugauuuuu

SEQ ID NO: 775283 - RNA, 19 nt, Listeria monocytogenes EGD-e
auguaauucuaaauaaaua

SEQ ID NO: 775284 - RNA, 23 nt, Listeria monocytogenes EGD-e
auguaauucuaaauaaauauuuu

SEQ ID NO: 775285 - RNA, 18 nt, Listeria monocytogenes EGD-e
auguccaagcacagcaau

SEQ ID NO: 775286 - RNA, 17 nt, Listeria monocytogenes EGD-e
aaaagcaaacaaaguac

SEQ ID NO: 775287 - RNA, 14 nt, Listeria monocytogenes EGD-e
aaaagcaaaaaagu

SEQ ID NO: 775288 - RNA, 14 nt, Listeria monocytogenes EGD-e
auguauacaggaac

SEQ ID NO: 775289 - RNA, 15 nt, Listeria monocytogenes EGD-e
auuauacuauaaaga

SEQ ID NO: 775290 - RNA, 17 nt, Listeria monocytogenes EGD-e
auuauacuuggaauaaa

SEQ ID NO: 775291 - RNA, 19 nt, Listeria monocytogenes EGD-e
auuauacaauuaauaauaa

SEQ ID NO: 775292 - RNA, 13 nt, Listeria monocytogenes EGD-e
auuauacauuucc

SEQ ID NO: 775293 - RNA, 18 nt, Listeria monocytogenes EGD-e
auuauaaaaaguaacaua

SEQ ID NO: 775294 - RNA, 15 nt, Listeria monocytogenes EGD-e
auuaggcauuucuuu

SEQ ID NO: 775295 - RNA, 17 nt, Listeria monocytogenes EGD-e
auuaggcauuucuuuga

SEQ ID NO: 775296 - RNA, 16 nt, Listeria monocytogenes EGD-e
auuaugauuuguuucu

SEQ ID NO: 775297 - RNA, 15 nt, Listeria monocytogenes EGD-e
auuauccuguaauuc

SEQ ID NO: 775298 - RNA, 23 nt, Listeria monocytogenes EGD-e
auuauccuguaauucgaauaaga

SEQ ID NO: 775299 - RNA, 16 nt, Listeria monocytogenes EGD-e
auucaguuuauaaaua

SEQ ID NO: 775300 - RNA, 16 nt, Listeria monocytogenes EGD-e
auuaaauuuuuuugaa

SEQ ID NO: 775301 - RNA, 22 nt, Listeria monocytogenes EGD-e
auuaaauuuuuuugaaaaaaca

SEQ ID NO: 775302 - RNA, 23 nt, Listeria monocytogenes EGD-e
auuaaauuuuuuugaaaaaacau

SEQ ID NO: 775303 - RNA, 17 nt, Listeria monocytogenes EGD-e
auuaaugccaguauuuu

SEQ ID NO: 775304 - RNA, 11 nt, Listeria monocytogenes EGD-e
auuaaugacug

SEQ ID NO: 775305 - RNA, 12 nt, Listeria monocytogenes EGD-e
auuacaaaauuu

SEQ ID NO: 775306 - RNA, 22 nt, Listeria monocytogenes EGD-e
auuaauuugauugccugaaaua

SEQ ID NO: 775307 - RNA, 19 nt, Listeria monocytogenes EGD-e
auuaauuugaccaccuaau

SEQ ID NO: 775308 - RNA, 22 nt, Listeria monocytogenes EGD-e
auguccuaggcgcucuuuaaua

SEQ ID NO: 775309 - RNA, 15 nt, Listeria monocytogenes EGD-e
auguuguuuuagaua

SEQ ID NO: 775310 - RNA, 16 nt, Listeria monocytogenes EGD-e
auuaaaaguuguauag

SEQ ID NO: 775311 - RNA, 19 nt, Listeria monocytogenes EGD-e
auuaaaaguuguauagcuu

SEQ ID NO: 775312 - RNA, 19 nt, Listeria monocytogenes EGD-e
auuaaaccucuuuuuuuag

SEQ ID NO: 775313 - RNA, 21 nt, Listeria monocytogenes EGD-e
auuaaaccgauaauuuucauu

SEQ ID NO: 775314 - RNA, 16 nt, Listeria monocytogenes EGD-e
augaaaaucuacaacu

SEQ ID NO: 775315 - RNA, 23 nt, Listeria monocytogenes EGD-e
augaaaagacaccaauuucuguu

SEQ ID NO: 775316 - RNA, 16 nt, Listeria monocytogenes EGD-e
aucuuuuccaaaaugg

SEQ ID NO: 775317 - RNA, 16 nt, Listeria monocytogenes EGD-e
aucuuuuaucuucccc

SEQ ID NO: 775318 - RNA, 20 nt, Listeria monocytogenes EGD-e
augaacacccgguccuucaa

SEQ ID NO: 775319 - RNA, 15 nt, Listeria monocytogenes EGD-e
augacuguuguuuca

SEQ ID NO: 775320 - RNA, 22 nt, Listeria monocytogenes EGD-e
augacagcaucuuuuucuugcu

SEQ ID NO: 775321 - RNA, 14 nt, Listeria monocytogenes EGD-e
augagcuaauuuuu

SEQ ID NO: 775322 - RNA, 15 nt, Listeria monocytogenes EGD-e
augagcuaauuuuuu

SEQ ID NO: 775323 - RNA, 13 nt, Listeria monocytogenes EGD-e
augauccgaacca

SEQ ID NO: 775324 - RNA, 19 nt, Listeria monocytogenes EGD-e
augauaaccgcuaucuaca

SEQ ID NO: 775325 - RNA, 18 nt, Listeria monocytogenes EGD-e
augaguggcggauaaggu

SEQ ID NO: 775326 - RNA, 12 nt, Listeria monocytogenes EGD-e
augauaaccaga

SEQ ID NO: 775327 - RNA, 16 nt, Listeria monocytogenes EGD-e
aucucacaauuuaagu

SEQ ID NO: 775328 - RNA, 22 nt, Listeria monocytogenes EGD-e
aucuaguagcaauuuuaaaucu

SEQ ID NO: 775329 - RNA, 18 nt, Listeria monocytogenes EGD-e
aucguauguuuuugaguu

SEQ ID NO: 775330 - RNA, 22 nt, Listeria monocytogenes EGD-e
aucuacagguguauucgucuuu

SEQ ID NO: 775331 - RNA, 19 nt, Listeria monocytogenes EGD-e
aucuacaacuagauuuuca

SEQ ID NO: 775332 - RNA, 13 nt, Listeria monocytogenes EGD-e
aucucaucaccag

SEQ ID NO: 775333 - RNA, 19 nt, Listeria monocytogenes EGD-e
aucucaucaccagcuucua

SEQ ID NO: 775334 - RNA, 22 nt, Listeria monocytogenes EGD-e
aucugaacugacuagaaauuaa

SEQ ID NO: 775335 - RNA, 19 nt, Listeria monocytogenes EGD-e
aucuggcaguuuuucaaug

SEQ ID NO: 775336 - RNA, 14 nt, Listeria monocytogenes EGD-e
aucugcuauuuuug

SEQ ID NO: 775337 - RNA, 20 nt, Listeria monocytogenes EGD-e
aucuuaucaaguaauaagaa

SEQ ID NO: 775338 - RNA, 21 nt, Listeria monocytogenes EGD-e
aucuuaggaauuucgaaauua

SEQ ID NO: 775339 - RNA, 19 nt, Listeria monocytogenes EGD-e
aucuuccaucauaauccca

SEQ ID NO: 775340 - RNA, 21 nt, Listeria monocytogenes EGD-e
aucuuccgcucuuuuuuauga

SEQ ID NO: 775341 - RNA, 15 nt, Listeria monocytogenes EGD-e
aucuucaauugcuuc

SEQ ID NO: 775342 - RNA, 16 nt, Listeria monocytogenes EGD-e
aucuucaauugcuucu

SEQ ID NO: 775343 - RNA, 23 nt, Listeria monocytogenes EGD-e
aucauuaaagcuauauaaucuca

SEQ ID NO: 775344 - RNA, 15 nt, Listeria monocytogenes EGD-e
aucauuaaccuacuu

SEQ ID NO: 775345 - RNA, 18 nt, Listeria monocytogenes EGD-e
aucauuaaauuuagcuag

SEQ ID NO: 775346 - RNA, 16 nt, Listeria monocytogenes EGD-e
aucauuuauuuucccu

SEQ ID NO: 775347 - RNA, 17 nt, Listeria monocytogenes EGD-e
aucauuuauuuucccuc

SEQ ID NO: 775348 - RNA, 18 nt, Listeria monocytogenes EGD-e
auccauuucauucuuuuu

SEQ ID NO: 775349 - RNA, 15 nt, Listeria monocytogenes EGD-e
aucccagcuuuuccu

SEQ ID NO: 775350 - RNA, 15 nt, Listeria monocytogenes EGD-e
auccgaaccaagcac

SEQ ID NO: 775351 - RNA, 14 nt, Listeria monocytogenes EGD-e
auccgcgaauagca

SEQ ID NO: 775352 - RNA, 17 nt, Listeria monocytogenes EGD-e
aucccuauaaaaacaug

SEQ ID NO: 775353 - RNA, 17 nt, Listeria monocytogenes EGD-e
aucccucauguucaauc

SEQ ID NO: 775354 - RNA, 20 nt, Listeria monocytogenes EGD-e
aucggggaaauaguuuuguc

SEQ ID NO: 775355 - RNA, 23 nt, Listeria monocytogenes EGD-e
aucggcuuuuuuuauuuaaucau

SEQ ID NO: 775356 - RNA, 22 nt, Listeria monocytogenes EGD-e
aucgagucaccgaauccaaaca

SEQ ID NO: 775357 - RNA, 13 nt, Listeria monocytogenes EGD-e
auacuucaugugc

SEQ ID NO: 775358 - RNA, 22 nt, Listeria monocytogenes EGD-e
auacuauugaauguucuaaaau

SEQ ID NO: 775359 - RNA, 16 nt, Listeria monocytogenes EGD-e
auacaggaacuacaua

SEQ ID NO: 775360 - RNA, 20 nt, Listeria monocytogenes EGD-e
auacuuuuuucuauauucau

SEQ ID NO: 775361 - RNA, 22 nt, Listeria monocytogenes EGD-e
auagauugauguuguaaauacu

SEQ ID NO: 775362 - RNA, 18 nt, Listeria monocytogenes EGD-e
auagauacucuuuaaauc

SEQ ID NO: 775363 - RNA, 14 nt, Listeria monocytogenes EGD-e
auagcagagcucca

SEQ ID NO: 775364 - RNA, 15 nt, Listeria monocytogenes EGD-e
auagcggucaaucau

SEQ ID NO: 775365 - RNA, 14 nt, Listeria monocytogenes EGD-e
auagccaagauuaa

SEQ ID NO: 775366 - RNA, 13 nt, Listeria monocytogenes EGD-e
auagcuacaauua

SEQ ID NO: 775367 - RNA, 17 nt, Listeria monocytogenes EGD-e
auaguuuucuacuacac

SEQ ID NO: 775368 - RNA, 20 nt, Listeria monocytogenes EGD-e
auauaaaacaguauuccuca

SEQ ID NO: 775369 - RNA, 21 nt, Listeria monocytogenes EGD-e
auauaagcggguguccaaaaa

SEQ ID NO: 775370 - RNA, 21 nt, Listeria monocytogenes EGD-e
auauaaguguuaguuguugca

SEQ ID NO: 775371 - RNA, 21 nt, Listeria monocytogenes EGD-e
auauaaugauucaaagcuacu

SEQ ID NO: 775372 - RNA, 23 nt, Listeria monocytogenes EGD-e
auauaaugauucaaagcuacuuu

SEQ ID NO: 775373 - RNA, 21 nt, Listeria monocytogenes EGD-e
auaucaucaauaaaaugcaca

SEQ ID NO: 775374 - RNA, 23 nt, Listeria monocytogenes EGD-e
auaucaucaauaaaaugcacaug

SEQ ID NO: 775375 - RNA, 21 nt, Listeria monocytogenes EGD-e
auauccauugcaaucaucuua

SEQ ID NO: 775376 - RNA, 20 nt, Listeria monocytogenes EGD-e
auaucuuaggaauuucgaaa

SEQ ID NO: 775377 - RNA, 16 nt, Listeria monocytogenes EGD-e
auaucuuuauuuuuug

SEQ ID NO: 775378 - RNA, 16 nt, Listeria monocytogenes EGD-e
auaucuuuugagauaa

SEQ ID NO: 775379 - RNA, 19 nt, Listeria monocytogenes EGD-e
auaucuacaggcuauucca

SEQ ID NO: 775380 - RNA, 16 nt, Listeria monocytogenes EGD-e
auauuuggccaauuaa

SEQ ID NO: 775381 - RNA, 18 nt, Listeria monocytogenes EGD-e
auauuuggccaauuaaaa

SEQ ID NO: 775382 - RNA, 20 nt, Listeria monocytogenes EGD-e
auauuuggccaauuaaaaua

SEQ ID NO: 775383 - RNA, 19 nt, Listeria monocytogenes EGD-e
auauucauuauuaaacuca

SEQ ID NO: 775384 - RNA, 15 nt, Listeria monocytogenes EGD-e
aucaagaaauuaaau

SEQ ID NO: 775385 - RNA, 14 nt, Listeria monocytogenes EGD-e
aucaagauuuugua

SEQ ID NO: 775386 - RNA, 12 nt, Listeria monocytogenes EGD-e
aucaaacaaaaa

SEQ ID NO: 775387 - RNA, 13 nt, Listeria monocytogenes EGD-e
aucaaaauucagu

SEQ ID NO: 775388 - RNA, 19 nt, Listeria monocytogenes EGD-e
aucaaaauucaguuuauaa

SEQ ID NO: 775389 - RNA, 16 nt, Listeria monocytogenes EGD-e
aucaaucgccaguugc

SEQ ID NO: 775390 - RNA, 19 nt, Listeria monocytogenes EGD-e
aucaauagcagaaucuaca

SEQ ID NO: 775391 - RNA, 15 nt, Listeria monocytogenes EGD-e
aucaauaucuuuauu

SEQ ID NO: 775392 - RNA, 19 nt, Listeria monocytogenes EGD-e
aucaauaucuuuauuuuuu

SEQ ID NO: 775393 - RNA, 15 nt, Listeria monocytogenes EGD-e
aucaauaaauccagc

SEQ ID NO: 775394 - RNA, 22 nt, Listeria monocytogenes EGD-e
aucaagggaagcuuuugcuaca

SEQ ID NO: 775395 - RNA, 23 nt, Listeria monocytogenes EGD-e
aucaaguaauaagaagauauuuu

SEQ ID NO: 775396 - RNA, 13 nt, Listeria monocytogenes EGD-e
aucauaaacauuu

SEQ ID NO: 775397 - RNA, 19 nt, Listeria monocytogenes EGD-e
aucagcuuuuuuuauuuug

SEQ ID NO: 775398 - RNA, 20 nt, Listeria monocytogenes EGD-e
aucauauucuucuaaaauaa

SEQ ID NO: 775399 - RNA, 23 nt, Listeria monocytogenes EGD-e
aucauauucuucuaaaauaacau

SEQ ID NO: 775400 - RNA, 12 nt, Listeria monocytogenes EGD-e
aucaucaauuaa

SEQ ID NO: 775401 - RNA, 15 nt, Listeria monocytogenes EGD-e
aucaucaauuaaauu

SEQ ID NO: 775402 - RNA, 16 nt, Listeria monocytogenes EGD-e
aucaucaauaauaaua

SEQ ID NO: 775403 - RNA, 13 nt, Listeria monocytogenes EGD-e
aaaacuaaaacga

SEQ ID NO: 775404 - RNA, 22 nt, Listeria monocytogenes EGD-e
aaaacuaaaacgacagauaaau

SEQ ID NO: 775405 - RNA, 15 nt, Listeria monocytogenes EGD-e
aucaauuaaauuaua

SEQ ID NO: 775406 - RNA, 19 nt, Listeria monocytogenes EGD-e
auaaaauuagugccaugaa

SEQ ID NO: 775407 - RNA, 17 nt, Listeria monocytogenes EGD-e
auaaauaacaagaauaa

SEQ ID NO: 775408 - RNA, 19 nt, Listeria monocytogenes EGD-e
auaaauaugcgcagaaagu

SEQ ID NO: 775409 - RNA, 20 nt, Listeria monocytogenes EGD-e
auaaauaugcgcagaaaguu

SEQ ID NO: 775410 - RNA, 23 nt, Listeria monocytogenes EGD-e
auaaauaggcccauuaaaaagcu

SEQ ID NO: 775411 - RNA, 19 nt, Listeria monocytogenes EGD-e
auaacauuuucucuuguaa

SEQ ID NO: 775412 - RNA, 15 nt, Listeria monocytogenes EGD-e
auaacaucuuuaaaa

SEQ ID NO: 775413 - RNA, 14 nt, Listeria monocytogenes EGD-e
auaaaucgccacau

SEQ ID NO: 775414 - RNA, 16 nt, Listeria monocytogenes EGD-e
auaaaucgccacauca

SEQ ID NO: 775415 - RNA, 22 nt, Listeria monocytogenes EGD-e
auaaauccagcgucuaaaaaug

SEQ ID NO: 775416 - RNA, 14 nt, Listeria monocytogenes EGD-e
auaaccccaaaaug

SEQ ID NO: 775417 - RNA, 17 nt, Listeria monocytogenes EGD-e
auaaccauugauaucca

SEQ ID NO: 775418 - RNA, 17 nt, Listeria monocytogenes EGD-e
auaaccgccaaaaagca

SEQ ID NO: 775419 - RNA, 20 nt, Listeria monocytogenes EGD-e
auaaugauucaaagcuacuu

SEQ ID NO: 775420 - RNA, 22 nt, Listeria monocytogenes EGD-e
auaaucuccgcaaucauuccaa

SEQ ID NO: 775421 - RNA, 19 nt, Listeria monocytogenes EGD-e
auaauccuuccaucaacuu

SEQ ID NO: 775422 - RNA, 19 nt, Listeria monocytogenes EGD-e
auaaucacguuuuugcucu

SEQ ID NO: 775423 - RNA, 19 nt, Listeria monocytogenes EGD-e
auaauaguugauauauuca

SEQ ID NO: 775424 - RNA, 15 nt, Listeria monocytogenes EGD-e
auaaguguaaaaguu

SEQ ID NO: 775425 - RNA, 20 nt, Listeria monocytogenes EGD-e
auaaguuaaucauuaaauau

SEQ ID NO: 775426 - RNA, 22 nt, Listeria monocytogenes EGD-e
auaauacaaacuuuuccuucua

SEQ ID NO: 775427 - RNA, 17 nt, Listeria monocytogenes EGD-e
auaauacgcgccaaaga

SEQ ID NO: 775428 - RNA, 17 nt, Listeria monocytogenes EGD-e
auaauucugcuaacagc

SEQ ID NO: 775429 - RNA, 15 nt, Listeria monocytogenes EGD-e
auacaauuaauaaua

SEQ ID NO: 775430 - RNA, 15 nt, Listeria monocytogenes EGD-e
auacacaaaguaaaa

SEQ ID NO: 775431 - RNA, 15 nt, Listeria monocytogenes EGD-e
auacacauaggucag

SEQ ID NO: 775432 - RNA, 14 nt, Listeria monocytogenes EGD-e
auacaaacuuuucc

SEQ ID NO: 775433 - RNA, 15 nt, Listeria monocytogenes EGD-e
auacaaacuuuuccu

SEQ ID NO: 775434 - RNA, 14 nt, Listeria monocytogenes EGD-e
auacaacaaaauaa

SEQ ID NO: 775435 - RNA, 22 nt, Listeria monocytogenes EGD-e
aguuacuuuaccuugaucaaaa

SEQ ID NO: 775436 - RNA, 23 nt, Listeria monocytogenes EGD-e
aguuacuuuaccuugaucaaaau

SEQ ID NO: 775437 - RNA, 13 nt, Listeria monocytogenes EGD-e
aguguauuuacaa

SEQ ID NO: 775438 - RNA, 19 nt, Listeria monocytogenes EGD-e
agugucaguguuuuuguau

SEQ ID NO: 775439 - RNA, 22 nt, Listeria monocytogenes EGD-e
aguuacuccuccaaauuauaau

SEQ ID NO: 775440 - RNA, 14 nt, Listeria monocytogenes EGD-e
aguuagauuaaaaa

SEQ ID NO: 775441 - RNA, 12 nt, Listeria monocytogenes EGD-e
aguucuuaaggg

SEQ ID NO: 775442 - RNA, 19 nt, Listeria monocytogenes EGD-e
aguucacugugaacugauu

SEQ ID NO: 775443 - RNA, 19 nt, Listeria monocytogenes EGD-e
aguuguuccauuuugucaa

SEQ ID NO: 775444 - RNA, 15 nt, Listeria monocytogenes EGD-e
aguugcauaccuaaa

SEQ ID NO: 775445 - RNA, 14 nt, Listeria monocytogenes EGD-e
aguuucauugaguc

SEQ ID NO: 775446 - RNA, 23 nt, Listeria monocytogenes EGD-e
aguuuguaacaacuaauuuuucg

SEQ ID NO: 775447 - RNA, 21 nt, Listeria monocytogenes EGD-e
aguuuguuuaggauauuuuuu

SEQ ID NO: 775448 - RNA, 19 nt, Listeria monocytogenes EGD-e
agugcaucuucuaagaaaa

SEQ ID NO: 775449 - RNA, 17 nt, Listeria monocytogenes EGD-e
aguauuuuguuccaaca

SEQ ID NO: 775450 - RNA, 19 nt, Listeria monocytogenes EGD-e
aguaagggugaagcuuccu

SEQ ID NO: 775451 - RNA, 12 nt, Listeria monocytogenes EGD-e
aguaauacgcug

SEQ ID NO: 775452 - RNA, 16 nt, Listeria monocytogenes EGD-e
aguaauauuauaucca

SEQ ID NO: 775453 - RNA, 22 nt, Listeria monocytogenes EGD-e
aguaaaacaagaggcuuauucc

SEQ ID NO: 775454 - RNA, 12 nt, Listeria monocytogenes EGD-e
aguaaacauuuc

SEQ ID NO: 775455 - RNA, 16 nt, Listeria monocytogenes EGD-e
agguugcgguuucuuu

SEQ ID NO: 775456 - RNA, 18 nt, Listeria monocytogenes EGD-e
agguugcgguuucuuuua

SEQ ID NO: 775457 - RNA, 13 nt, Listeria monocytogenes EGD-e
aguaguuuacuuc

SEQ ID NO: 775458 - RNA, 18 nt, Listeria monocytogenes EGD-e
aguagcaggacaugcuaa

SEQ ID NO: 775459 - RNA, 19 nt, Listeria monocytogenes EGD-e
aguagcaggacaugcuaaa

SEQ ID NO: 775460 - RNA, 19 nt, Listeria monocytogenes EGD-e
aguauacuuuuaauuaaaa

SEQ ID NO: 775461 - RNA, 16 nt, Listeria monocytogenes EGD-e
aguauuccucaaugag

SEQ ID NO: 775462 - RNA, 19 nt, Listeria monocytogenes EGD-e
aguauuuccccgcagaaaa

SEQ ID NO: 775463 - RNA, 21 nt, Listeria monocytogenes EGD-e
aguauguuucggguuuguuaa

SEQ ID NO: 775464 - RNA, 17 nt, Listeria monocytogenes EGD-e
agggaagcuuuugcuac

SEQ ID NO: 775465 - RNA, 14 nt, Listeria monocytogenes EGD-e
agggcuauuuuucc

SEQ ID NO: 775466 - RNA, 14 nt, Listeria monocytogenes EGD-e
aggguaauauaaau

SEQ ID NO: 775467 - RNA, 14 nt, Listeria monocytogenes EGD-e
agggugaucaauca

SEQ ID NO: 775468 - RNA, 15 nt, Listeria monocytogenes EGD-e
agggugaucaaucag

SEQ ID NO: 775469 - RNA, 14 nt, Listeria monocytogenes EGD-e
aggcaacaaagaag

SEQ ID NO: 775470 - RNA, 15 nt, Listeria monocytogenes EGD-e
aggcaacaaagaaga

SEQ ID NO: 775471 - RNA, 16 nt, Listeria monocytogenes EGD-e
aggcaacaaagaagaa

SEQ ID NO: 775472 - RNA, 12 nt, Listeria monocytogenes EGD-e
aggauuuucacc

SEQ ID NO: 775473 - RNA, 14 nt, Listeria monocytogenes EGD-e
agcugccaccacuu

SEQ ID NO: 775474 - RNA, 18 nt, Listeria monocytogenes EGD-e
agcuccauuaaaugacca

SEQ ID NO: 775475 - RNA, 15 nt, Listeria monocytogenes EGD-e
agcuguaucaaugau

SEQ ID NO: 775476 - RNA, 13 nt, Listeria monocytogenes EGD-e
agcuguaaaugaa

SEQ ID NO: 775477 - RNA, 21 nt, Listeria monocytogenes EGD-e
agcuucuaagucaaaacguuc

SEQ ID NO: 775478 - RNA, 22 nt, Listeria monocytogenes EGD-e
agcuucccguuaaucgaaaaau

SEQ ID NO: 775479 - RNA, 22 nt, Listeria monocytogenes EGD-e
agcuuccauacuuucugccaaa

SEQ ID NO: 775480 - RNA, 16 nt, Listeria monocytogenes EGD-e
agcuugauaauuuuuu

SEQ ID NO: 775481 - RNA, 13 nt, Listeria monocytogenes EGD-e
aggaauuuuucca

SEQ ID NO: 775482 - RNA, 14 nt, Listeria monocytogenes EGD-e
aggaauuuuuccau

SEQ ID NO: 775483 - RNA, 17 nt, Listeria monocytogenes EGD-e
aggaauuucgaaauuaa

SEQ ID NO: 775484 - RNA, 18 nt, Listeria monocytogenes EGD-e
aggaauuugccaaucaau

SEQ ID NO: 775485 - RNA, 13 nt, Listeria monocytogenes EGD-e
aggacaagcccag

SEQ ID NO: 775486 - RNA, 14 nt, Listeria monocytogenes EGD-e
aggacaagcccagc

SEQ ID NO: 775487 - RNA, 22 nt, Listeria monocytogenes EGD-e
aggacaugcuaaauaaaaccau

SEQ ID NO: 775488 - RNA, 19 nt, Listeria monocytogenes EGD-e
aggagaaaucaagugcagc

SEQ ID NO: 775489 - RNA, 19 nt, Listeria monocytogenes EGD-e
aggagaaggcuuuuuaugc

SEQ ID NO: 775490 - RNA, 16 nt, Listeria monocytogenes EGD-e
agcuuuucuauagcuu

SEQ ID NO: 775491 - RNA, 14 nt, Listeria monocytogenes EGD-e
aggaacuacauacu

SEQ ID NO: 775492 - RNA, 20 nt, Listeria monocytogenes EGD-e
agaaaacgacucaaugaaaa

SEQ ID NO: 775493 - RNA, 12 nt, Listeria monocytogenes EGD-e
agaaaacagaaa

SEQ ID NO: 775494 - RNA, 19 nt, Listeria monocytogenes EGD-e
agaaaccaucgcaaaagca

SEQ ID NO: 775495 - RNA, 22 nt, Listeria monocytogenes EGD-e
agaaaccccgccaccagucaca

SEQ ID NO: 775496 - RNA, 16 nt, Listeria monocytogenes EGD-e
agaaacuuucuuuucu

SEQ ID NO: 775497 - RNA, 22 nt, Listeria monocytogenes EGD-e
agaaacuuuuucucaaaaauau

SEQ ID NO: 775498 - RNA, 15 nt, Listeria monocytogenes EGD-e
agaaagccaucaaua

SEQ ID NO: 775499 - RNA, 16 nt, Listeria monocytogenes EGD-e
agaaagccuuuauuga

SEQ ID NO: 775500 - RNA, 14 nt, Listeria monocytogenes EGD-e
agaaauaacuacua

SEQ ID NO: 775501 - RNA, 23 nt, Listeria monocytogenes EGD-e
agaaaguuggguaugacuuaaau

SEQ ID NO: 775502 - RNA, 20 nt, Listeria monocytogenes EGD-e
agaagaugcacuagaaaaau

SEQ ID NO: 775503 - RNA, 23 nt, Listeria monocytogenes EGD-e
agaacuagauuuaauaaauuaga

SEQ ID NO: 775504 - RNA, 20 nt, Listeria monocytogenes EGD-e
agaaauuaccuaaugaauaa

SEQ ID NO: 775505 - RNA, 17 nt, Listeria monocytogenes EGD-e
agaaauuacguuucacu

SEQ ID NO: 775506 - RNA, 19 nt, Listeria monocytogenes EGD-e
agaaauuacguuucacuuu

SEQ ID NO: 775507 - RNA, 18 nt, Listeria monocytogenes EGD-e
agaaggggcugugaagga

SEQ ID NO: 775508 - RNA, 21 nt, Listeria monocytogenes EGD-e
agaagguucaucacuuguuga

SEQ ID NO: 775509 - RNA, 22 nt, Listeria monocytogenes EGD-e
agaagguucaucacuuguugau

SEQ ID NO: 775510 - RNA, 22 nt, Listeria monocytogenes EGD-e
agaagguaccgucguaaauagc

SEQ ID NO: 775511 - RNA, 13 nt, Listeria monocytogenes EGD-e
agaaguacaauaa

SEQ ID NO: 775512 - RNA, 19 nt, Listeria monocytogenes EGD-e
agacaaguccggcgauaau

SEQ ID NO: 775513 - RNA, 21 nt, Listeria monocytogenes EGD-e
agacaaguccggcgauaauug

SEQ ID NO: 775514 - RNA, 23 nt, Listeria monocytogenes EGD-e
agaaugagcuccuucaagaccaa

SEQ ID NO: 775515 - RNA, 14 nt, Listeria monocytogenes EGD-e
agacaccaauuucu

SEQ ID NO: 775516 - RNA, 15 nt, Listeria monocytogenes EGD-e
aaaacaguuucuuua

SEQ ID NO: 775517 - RNA, 16 nt, Listeria monocytogenes EGD-e
agaccaccaagaauaa

SEQ ID NO: 775518 - RNA, 15 nt, Listeria monocytogenes EGD-e
agacaguuuguauaa

SEQ ID NO: 775519 - RNA, 15 nt, Listeria monocytogenes EGD-e
agagcaccaaaaaca

SEQ ID NO: 775520 - RNA, 19 nt, Listeria monocytogenes EGD-e
agagcagggcuauuuuucc

SEQ ID NO: 775521 - RNA, 18 nt, Listeria monocytogenes EGD-e
agagccuggauuuucuag

SEQ ID NO: 775522 - RNA, 18 nt, Listeria monocytogenes EGD-e
aaaacauuauuuugcuaa

SEQ ID NO: 775523 - RNA, 20 nt, Listeria monocytogenes EGD-e
aaaacaugauauauuuauaa

SEQ ID NO: 775524 - RNA, 21 nt, Listeria monocytogenes EGD-e
aaaacaugauauauuuauaaa

SEQ ID NO: 775525 - RNA, 22 nt, Listeria monocytogenes EGD-e
agaggauuuucacccauacuaa

SEQ ID NO: 775526 - RNA, 14 nt, Listeria monocytogenes EGD-e
agauaaguuuucau

SEQ ID NO: 775527 - RNA, 22 nt, Listeria monocytogenes EGD-e
agauaaguuuucauauaagugu

SEQ ID NO: 775528 - RNA, 15 nt, Listeria monocytogenes EGD-e
agauacuguucugau

SEQ ID NO: 775529 - RNA, 16 nt, Listeria monocytogenes EGD-e
aaaaccgagaaaucuc

SEQ ID NO: 775530 - RNA, 20 nt, Listeria monocytogenes EGD-e
aaaaccaguaaaacaagagg

SEQ ID NO: 775531 - RNA, 23 nt, Listeria monocytogenes EGD-e
agauggagauucauaaacaaaag

SEQ ID NO: 775532 - RNA, 15 nt, Listeria monocytogenes EGD-e
agauucauaaacaaa

SEQ ID NO: 775533 - RNA, 23 nt, Listeria monocytogenes EGD-e
agauugcauucugugauggaagu

SEQ ID NO: 775534 - RNA, 18 nt, Listeria monocytogenes EGD-e
agauugauguuguaaaua

SEQ ID NO: 775535 - RNA, 17 nt, Listeria monocytogenes EGD-e
agauuuaauaaauuaga

SEQ ID NO: 775536 - RNA, 16 nt, Listeria monocytogenes EGD-e
agauuuuguacauaaa

SEQ ID NO: 775537 - RNA, 17 nt, Listeria monocytogenes EGD-e
agauuuggucauuuuuu

SEQ ID NO: 775538 - RNA, 18 nt, Listeria monocytogenes EGD-e
agcaaaugcauuucucga

SEQ ID NO: 775539 - RNA, 18 nt, Listeria monocytogenes EGD-e
agcaaaaaaguaggccua

SEQ ID NO: 775540 - RNA, 19 nt, Listeria monocytogenes EGD-e
agcgacuuuugcagcugga

SEQ ID NO: 775541 - RNA, 17 nt, Listeria monocytogenes EGD-e
agcgcaucucuaacagu

SEQ ID NO: 775542 - RNA, 17 nt, Listeria monocytogenes EGD-e
agcuaccacaagaaggg

SEQ ID NO: 775543 - RNA, 23 nt, Listeria monocytogenes EGD-e
agcuacuucggggcaaaaaggaa

SEQ ID NO: 775544 - RNA, 12 nt, Listeria monocytogenes EGD-e
agcuaauuuuuu

SEQ ID NO: 775545 - RNA, 16 nt, Listeria monocytogenes EGD-e
agcuacaauuaaaaua

SEQ ID NO: 775546 - RNA, 15 nt, Listeria monocytogenes EGD-e
agcguucuaaugaua

SEQ ID NO: 775547 - RNA, 18 nt, Listeria monocytogenes EGD-e
agcuaacaacaagcaaaa

SEQ ID NO: 775548 - RNA, 18 nt, Listeria monocytogenes EGD-e
agcuauuuuuuauacucu

SEQ ID NO: 775549 - RNA, 14 nt, Listeria monocytogenes EGD-e
agcaugagagugac

SEQ ID NO: 775550 - RNA, 13 nt, Listeria monocytogenes EGD-e
agccaguuuucau

SEQ ID NO: 775551 - RNA, 23 nt, Listeria monocytogenes EGD-e
agccauuucucgcugcaauuuca

SEQ ID NO: 775552 - RNA, 13 nt, Listeria monocytogenes EGD-e
agcagauuuugcg

SEQ ID NO: 775553 - RNA, 22 nt, Listeria monocytogenes EGD-e
agcagauuuugcgaaagcugua

SEQ ID NO: 775554 - RNA, 15 nt, Listeria monocytogenes EGD-e
agcaucuuuuucuug

SEQ ID NO: 775555 - RNA, 22 nt, Listeria monocytogenes EGD-e
agcaucuuggcaugaugaaaag

SEQ ID NO: 775556 - RNA, 15 nt, Listeria monocytogenes EGD-e
agcaguagacuaaau

SEQ ID NO: 775557 - RNA, 19 nt, Listeria monocytogenes EGD-e
accauaagacauaacaagu

SEQ ID NO: 775558 - RNA, 15 nt, Listeria monocytogenes EGD-e
accauuguagcucau

SEQ ID NO: 775559 - RNA, 14 nt, Listeria monocytogenes EGD-e
accauugauaucca

SEQ ID NO: 775560 - RNA, 18 nt, Listeria monocytogenes EGD-e
accauuccguugaaagag

SEQ ID NO: 775561 - RNA, 15 nt, Listeria monocytogenes EGD-e
accauucgaaagcaa

SEQ ID NO: 775562 - RNA, 16 nt, Listeria monocytogenes EGD-e
accauucgaaagcaaa

SEQ ID NO: 775563 - RNA, 20 nt, Listeria monocytogenes EGD-e
accauuuguuuuauuuuggu

SEQ ID NO: 775564 - RNA, 18 nt, Listeria monocytogenes EGD-e
accauuuuguucuaagaa

SEQ ID NO: 775565 - RNA, 15 nt, Listeria monocytogenes EGD-e
acccgcuaagaagag

SEQ ID NO: 775566 - RNA, 23 nt, Listeria monocytogenes EGD-e
accgccgccgucuccaccaaguu

SEQ ID NO: 775567 - RNA, 15 nt, Listeria monocytogenes EGD-e
accgcgcgaugcuga

SEQ ID NO: 775568 - RNA, 22 nt, Listeria monocytogenes EGD-e
accugaaacauagucagggaau

SEQ ID NO: 775569 - RNA, 19 nt, Listeria monocytogenes EGD-e
accggucugugauuacucc

SEQ ID NO: 775570 - RNA, 15 nt, Listeria monocytogenes EGD-e
acgaaaucaaacuua

SEQ ID NO: 775571 - RNA, 14 nt, Listeria monocytogenes EGD-e
acgaaaagcaauga

SEQ ID NO: 775572 - RNA, 20 nt, Listeria monocytogenes EGD-e
acgaaaaacauuauuuugcu

SEQ ID NO: 775573 - RNA, 21 nt, Listeria monocytogenes EGD-e
accuuauuaacuaauaacccu

SEQ ID NO: 775574 - RNA, 17 nt, Listeria monocytogenes EGD-e
accuucaauuucuuuug

SEQ ID NO: 775575 - RNA, 22 nt, Listeria monocytogenes EGD-e
accuucaauuucuuuugacaaa

SEQ ID NO: 775576 - RNA, 16 nt, Listeria monocytogenes EGD-e
accuuaaauuauacua

SEQ ID NO: 775577 - RNA, 12 nt, Listeria monocytogenes EGD-e
acgaucuacuuc

SEQ ID NO: 775578 - RNA, 16 nt, Listeria monocytogenes EGD-e
acgauggaaccauuca

SEQ ID NO: 775579 - RNA, 18 nt, Listeria monocytogenes EGD-e
acgauggaaccauucacu

SEQ ID NO: 775580 - RNA, 16 nt, Listeria monocytogenes EGD-e
acgauucgauuuucaa

SEQ ID NO: 775581 - RNA, 23 nt, Listeria monocytogenes EGD-e
acgauuugucuucggauuuuuca

SEQ ID NO: 775582 - RNA, 22 nt, Listeria monocytogenes EGD-e
acgaguaacuccaccaugguca

SEQ ID NO: 775583 - RNA, 23 nt, Listeria monocytogenes EGD-e
acgauagauuuuaauuucuuuug

SEQ ID NO: 775584 - RNA, 23 nt, Listeria monocytogenes EGD-e
acgcaauuuuaggcguaucuuuu

SEQ ID NO: 775585 - RNA, 17 nt, Listeria monocytogenes EGD-e
acgcagguucaccaaau

SEQ ID NO: 775586 - RNA, 19 nt, Listeria monocytogenes EGD-e
acggaucgcgguagcuuca

SEQ ID NO: 775587 - RNA, 20 nt, Listeria monocytogenes EGD-e
acggaucgcgguagcuucaa

SEQ ID NO: 775588 - RNA, 17 nt, Listeria monocytogenes EGD-e
acuagcgcacaaguaau

SEQ ID NO: 775589 - RNA, 22 nt, Listeria monocytogenes EGD-e
acuagaacggugaaaaugggga

SEQ ID NO: 775590 - RNA, 16 nt, Listeria monocytogenes EGD-e
acuagaaaaaugaaga

SEQ ID NO: 775591 - RNA, 20 nt, Listeria monocytogenes EGD-e
acuagaaaaaugaagagaua

SEQ ID NO: 775592 - RNA, 16 nt, Listeria monocytogenes EGD-e
acuaaucaauaaagaa

SEQ ID NO: 775593 - RNA, 16 nt, Listeria monocytogenes EGD-e
acuaacauaaauugau

SEQ ID NO: 775594 - RNA, 13 nt, Listeria monocytogenes EGD-e
acuaaauuaucau

SEQ ID NO: 775595 - RNA, 14 nt, Listeria monocytogenes EGD-e
acguucuugaaauc

SEQ ID NO: 775596 - RNA, 13 nt, Listeria monocytogenes EGD-e
acguuuaucaaua

SEQ ID NO: 775597 - RNA, 18 nt, Listeria monocytogenes EGD-e
acuaaauuaauuugacca

SEQ ID NO: 775598 - RNA, 19 nt, Listeria monocytogenes EGD-e
acuaaauuaauuugaccac

SEQ ID NO: 775599 - RNA, 23 nt, Listeria monocytogenes EGD-e
acuuacggucuuuuuuucuuuaa

SEQ ID NO: 775600 - RNA, 22 nt, Listeria monocytogenes EGD-e
acuuaauucuugaauguuuuca

SEQ ID NO: 775601 - RNA, 16 nt, Listeria monocytogenes EGD-e
acuguuguucuugcca

SEQ ID NO: 775602 - RNA, 18 nt, Listeria monocytogenes EGD-e
acuguuguucuugccaaa

SEQ ID NO: 775603 - RNA, 16 nt, Listeria monocytogenes EGD-e
acuuaacgaauuuuuc

SEQ ID NO: 775604 - RNA, 14 nt, Listeria monocytogenes EGD-e
acuucaacuaaacg

SEQ ID NO: 775605 - RNA, 16 nt, Listeria monocytogenes EGD-e
acuucacuaacaaaau

SEQ ID NO: 775606 - RNA, 23 nt, Listeria monocytogenes EGD-e
acuucacuaacaaaauaauaaua

SEQ ID NO: 775607 - RNA, 19 nt, Listeria monocytogenes EGD-e
acuuacugcaaucauuuau

SEQ ID NO: 775608 - RNA, 18 nt, Listeria monocytogenes EGD-e
acuucaaaauuacuauuu

SEQ ID NO: 775609 - RNA, 17 nt, Listeria monocytogenes EGD-e
acuucuaccguuccuuc

SEQ ID NO: 775610 - RNA, 16 nt, Listeria monocytogenes EGD-e
acuucuggauuugcuu

SEQ ID NO: 775611 - RNA, 16 nt, Listeria monocytogenes EGD-e
acuucgagcagcucca

SEQ ID NO: 775612 - RNA, 19 nt, Listeria monocytogenes EGD-e
acuuccaugacaucuucua

SEQ ID NO: 775613 - RNA, 15 nt, Listeria monocytogenes EGD-e
acuucaugugcuuuu

SEQ ID NO: 775614 - RNA, 21 nt, Listeria monocytogenes EGD-e
acuucauuagacaaaaagaaa

SEQ ID NO: 775615 - RNA, 16 nt, Listeria monocytogenes EGD-e
acucuuuuauaaaaau

SEQ ID NO: 775616 - RNA, 21 nt, Listeria monocytogenes EGD-e
acucuuuuauaaaaauacauu

SEQ ID NO: 775617 - RNA, 22 nt, Listeria monocytogenes EGD-e
acucuuuggagugaggauuuuu

SEQ ID NO: 775618 - RNA, 20 nt, Listeria monocytogenes EGD-e
acuggacaaugauccgaacc

SEQ ID NO: 775619 - RNA, 17 nt, Listeria monocytogenes EGD-e
acuggagcugauuuuau

SEQ ID NO: 775620 - RNA, 22 nt, Listeria monocytogenes EGD-e
acucucccauuugucccacaaa

SEQ ID NO: 775621 - RNA, 16 nt, Listeria monocytogenes EGD-e
aaucauaauaggagac

SEQ ID NO: 775622 - RNA, 22 nt, Listeria monocytogenes EGD-e
aaucaguucaacuacuucaacu

SEQ ID NO: 775623 - RNA, 17 nt, Listeria monocytogenes EGD-e
aaucagcaucuggauca

SEQ ID NO: 775624 - RNA, 21 nt, Listeria monocytogenes EGD-e
aaucagcaucuggaucaggau

SEQ ID NO: 775625 - RNA, 22 nt, Listeria monocytogenes EGD-e
aaucagcaucuggaucaggaua

SEQ ID NO: 775626 - RNA, 14 nt, Listeria monocytogenes EGD-e
aaucauuaaagcua

SEQ ID NO: 775627 - RNA, 18 nt, Listeria monocytogenes EGD-e
aaucauuaauauaaagau

SEQ ID NO: 775628 - RNA, 14 nt, Listeria monocytogenes EGD-e
aauccaauaauaug

SEQ ID NO: 775629 - RNA, 19 nt, Listeria monocytogenes EGD-e
aaucuagucguuucaacuc

SEQ ID NO: 775630 - RNA, 13 nt, Listeria monocytogenes EGD-e
aaucuaguacgaa

SEQ ID NO: 775631 - RNA, 21 nt, Listeria monocytogenes EGD-e
aaucuaguacgaaaucaaacu

SEQ ID NO: 775632 - RNA, 21 nt, Listeria monocytogenes EGD-e
aaucgccuugauguggauaga

SEQ ID NO: 775633 - RNA, 18 nt, Listeria monocytogenes EGD-e
aaucgcgucuacuuuucc

SEQ ID NO: 775634 - RNA, 21 nt, Listeria monocytogenes EGD-e
aaucgccaguugcugaauauc

SEQ ID NO: 775635 - RNA, 22 nt, Listeria monocytogenes EGD-e
aaucgccaguugcugaauauca

SEQ ID NO: 775636 - RNA, 20 nt, Listeria monocytogenes EGD-e
aaucuuucacacgauaccaa

SEQ ID NO: 775637 - RNA, 19 nt, Listeria monocytogenes EGD-e
aaugaauaagcaauuggaa

SEQ ID NO: 775638 - RNA, 15 nt, Listeria monocytogenes EGD-e
aaugaacuucaccac

SEQ ID NO: 775639 - RNA, 13 nt, Listeria monocytogenes EGD-e
aaugagcuccuuc

SEQ ID NO: 775640 - RNA, 23 nt, Listeria monocytogenes EGD-e
aaugagcuccuucaagaccaaga

SEQ ID NO: 775641 - RNA, 16 nt, Listeria monocytogenes EGD-e
aaugagcccaaaaaua

SEQ ID NO: 775642 - RNA, 19 nt, Listeria monocytogenes EGD-e
aaugagcccaaaaauaagu

SEQ ID NO: 775643 - RNA, 17 nt, Listeria monocytogenes EGD-e
aaugaccuaguuaaucu

SEQ ID NO: 775644 - RNA, 15 nt, Listeria monocytogenes EGD-e
aaugcucauuuuucu

SEQ ID NO: 775645 - RNA, 19 nt, Listeria monocytogenes EGD-e
aaugcucaucaagaaauua

SEQ ID NO: 775646 - RNA, 20 nt, Listeria monocytogenes EGD-e
aaugcuaggccuacuuuuuu

SEQ ID NO: 775647 - RNA, 19 nt, Listeria monocytogenes EGD-e
aaugcuaauuuauuuagaa

SEQ ID NO: 775648 - RNA, 15 nt, Listeria monocytogenes EGD-e
aaugcgguaacuaaa

SEQ ID NO: 775649 - RNA, 16 nt, Listeria monocytogenes EGD-e
aauggcugaugacuaa

SEQ ID NO: 775650 - RNA, 13 nt, Listeria monocytogenes EGD-e
aaugauauuauga

SEQ ID NO: 775651 - RNA, 16 nt, Listeria monocytogenes EGD-e
aaugauucaaagcuac

SEQ ID NO: 775652 - RNA, 17 nt, Listeria monocytogenes EGD-e
aauuuucauuuaacauc

SEQ ID NO: 775653 - RNA, 17 nt, Listeria monocytogenes EGD-e
aauuuucauuuguuucu

SEQ ID NO: 775654 - RNA, 18 nt, Listeria monocytogenes EGD-e
aauuuucauuuguuucuu

SEQ ID NO: 775655 - RNA, 21 nt, Listeria monocytogenes EGD-e
aauuuuaggcguaucuuuucc

SEQ ID NO: 775656 - RNA, 14 nt, Listeria monocytogenes EGD-e
aauuuggaaauaau

SEQ ID NO: 775657 - RNA, 17 nt, Listeria monocytogenes EGD-e
aauuugggagcuuucuu

SEQ ID NO: 775658 - RNA, 16 nt, Listeria monocytogenes EGD-e
aauuugccaaagagaa

SEQ ID NO: 775659 - RNA, 19 nt, Listeria monocytogenes EGD-e
aauuugauugccugaaaua

SEQ ID NO: 775660 - RNA, 17 nt, Listeria monocytogenes EGD-e
aauuucuuuugacaaaa

SEQ ID NO: 775661 - RNA, 20 nt, Listeria monocytogenes EGD-e
aauuucuuuugacaaaagga

SEQ ID NO: 775662 - RNA, 14 nt, Listeria monocytogenes EGD-e
aauuugucuuuacu

SEQ ID NO: 775663 - RNA, 18 nt, Listeria monocytogenes EGD-e
aauuucuggguguuuauu

SEQ ID NO: 775664 - RNA, 17 nt, Listeria monocytogenes EGD-e
aauuuccuuuacagaaa

SEQ ID NO: 775665 - RNA, 20 nt, Listeria monocytogenes EGD-e
aauuucgaaauuaaaagcua

SEQ ID NO: 775666 - RNA, 15 nt, Listeria monocytogenes EGD-e
aauuuacguuguucu

SEQ ID NO: 775667 - RNA, 20 nt, Listeria monocytogenes EGD-e
aauuuacguuguucuaacau

SEQ ID NO: 775668 - RNA, 23 nt, Listeria monocytogenes EGD-e
aauuuacguuguucuaacauuaa

SEQ ID NO: 775669 - RNA, 16 nt, Listeria monocytogenes EGD-e
aauugaaguucgaauu

SEQ ID NO: 775670 - RNA, 16 nt, Listeria monocytogenes EGD-e
aauugauuuuuuugaa

SEQ ID NO: 775671 - RNA, 16 nt, Listeria monocytogenes EGD-e
aauugauuuguuucca

SEQ ID NO: 775672 - RNA, 13 nt, Listeria monocytogenes EGD-e
aaaacaaaagaua

SEQ ID NO: 775673 - RNA, 13 nt, Listeria monocytogenes EGD-e
aauuauuuuugua

SEQ ID NO: 775674 - RNA, 17 nt, Listeria monocytogenes EGD-e
aauucggcaaacagcuu

SEQ ID NO: 775675 - RNA, 22 nt, Listeria monocytogenes EGD-e
aauucuguuaaaggagaaaaag

SEQ ID NO: 775676 - RNA, 17 nt, Listeria monocytogenes EGD-e
aauucuaaauaaauauu

SEQ ID NO: 775677 - RNA, 20 nt, Listeria monocytogenes EGD-e
acaagcacuuacugcaauca

SEQ ID NO: 775678 - RNA, 12 nt, Listeria monocytogenes EGD-e
acaagcccagca

SEQ ID NO: 775679 - RNA, 21 nt, Listeria monocytogenes EGD-e
acaaguccgucaagcccagcu

SEQ ID NO: 775680 - RNA, 22 nt, Listeria monocytogenes EGD-e
acaauaacauuuucucuuguaa

SEQ ID NO: 775681 - RNA, 16 nt, Listeria monocytogenes EGD-e
aauuuuugcauccacu

SEQ ID NO: 775682 - RNA, 14 nt, Listeria monocytogenes EGD-e
acaauuaaaauagu

SEQ ID NO: 775683 - RNA, 18 nt, Listeria monocytogenes EGD-e
acaauggaaugacaaaau

SEQ ID NO: 775684 - RNA, 21 nt, Listeria monocytogenes EGD-e
acaauggaaugacaaaauuau

SEQ ID NO: 775685 - RNA, 22 nt, Listeria monocytogenes EGD-e
acaccacucuuuuauaaaaaua

SEQ ID NO: 775686 - RNA, 17 nt, Listeria monocytogenes EGD-e
acacuaaauugauacca

SEQ ID NO: 775687 - RNA, 23 nt, Listeria monocytogenes EGD-e
acacuaaauugauaccaaauugu

SEQ ID NO: 775688 - RNA, 14 nt, Listeria monocytogenes EGD-e
acacguuccccacc

SEQ ID NO: 775689 - RNA, 19 nt, Listeria monocytogenes EGD-e
acagaaacgcuuuguuuag

SEQ ID NO: 775690 - RNA, 15 nt, Listeria monocytogenes EGD-e
acauaguuauaaaua

SEQ ID NO: 775691 - RNA, 17 nt, Listeria monocytogenes EGD-e
acauauaaucuacugua

SEQ ID NO: 775692 - RNA, 22 nt, Listeria monocytogenes EGD-e
acauauuccaaaaucgcauccu

SEQ ID NO: 775693 - RNA, 16 nt, Listeria monocytogenes EGD-e
acauauuugaacccuu

SEQ ID NO: 775694 - RNA, 18 nt, Listeria monocytogenes EGD-e
acauauuugaacccuuug

SEQ ID NO: 775695 - RNA, 16 nt, Listeria monocytogenes EGD-e
acauuauuuugcuaaa

SEQ ID NO: 775696 - RNA, 15 nt, Listeria monocytogenes EGD-e
acauucaaaucacca

SEQ ID NO: 775697 - RNA, 21 nt, Listeria monocytogenes EGD-e
acauuaaaccgauaauuuuca

SEQ ID NO: 775698 - RNA, 20 nt, Listeria monocytogenes EGD-e
acauucgggaauaaaucaag

SEQ ID NO: 775699 - RNA, 14 nt, Listeria monocytogenes EGD-e
acaucuuugccauc

SEQ ID NO: 775700 - RNA, 19 nt, Listeria monocytogenes EGD-e
acaucuuuguauacuucaa

SEQ ID NO: 775701 - RNA, 18 nt, Listeria monocytogenes EGD-e
acaucuucaauugcuucu

SEQ ID NO: 775702 - RNA, 18 nt, Listeria monocytogenes EGD-e
acauuuccaaguguuuua

SEQ ID NO: 775703 - RNA, 19 nt, Listeria monocytogenes EGD-e
accaagggugaucaaucag

SEQ ID NO: 775704 - RNA, 13 nt, Listeria monocytogenes EGD-e
accaauaaaaccu

SEQ ID NO: 775705 - RNA, 16 nt, Listeria monocytogenes EGD-e
accaaugcuuucuagc

SEQ ID NO: 775706 - RNA, 17 nt, Listeria monocytogenes EGD-e
accaaucauggaaacaa

SEQ ID NO: 775707 - RNA, 21 nt, Listeria monocytogenes EGD-e
accacucuuuuauaaaaauac

SEQ ID NO: 775708 - RNA, 21 nt, Listeria monocytogenes EGD-e
accaccauaagacauaacaag

SEQ ID NO: 775709 - RNA, 20 nt, Listeria monocytogenes EGD-e
aauagcuuugucuuaaauga

SEQ ID NO: 775710 - RNA, 23 nt, Listeria monocytogenes EGD-e
aauagcuuugucuuaaaugacaa

SEQ ID NO: 775711 - RNA, 14 nt, Listeria monocytogenes EGD-e
aauaggauuuuacu

SEQ ID NO: 775712 - RNA, 20 nt, Listeria monocytogenes EGD-e
aauaggauuuuacugcggcg

SEQ ID NO: 775713 - RNA, 18 nt, Listeria monocytogenes EGD-e
aauaguagcacuccuuga

SEQ ID NO: 775714 - RNA, 13 nt, Listeria monocytogenes EGD-e
aauaguccccagu

SEQ ID NO: 775715 - RNA, 17 nt, Listeria monocytogenes EGD-e
aauaguaguuauuucuu

SEQ ID NO: 775716 - RNA, 16 nt, Listeria monocytogenes EGD-e
aauaguauaaggauac

SEQ ID NO: 775717 - RNA, 19 nt, Listeria monocytogenes EGD-e
aauagauauucucuuauga

SEQ ID NO: 775718 - RNA, 22 nt, Listeria monocytogenes EGD-e
aauagcaaucggcgcuuucaaa

SEQ ID NO: 775719 - RNA, 18 nt, Listeria monocytogenes EGD-e
aauauaaugauucaaagc

SEQ ID NO: 775720 - RNA, 21 nt, Listeria monocytogenes EGD-e
aauauaccgaccaucaguagu

SEQ ID NO: 775721 - RNA, 15 nt, Listeria monocytogenes EGD-e
aauauacacaaagua

SEQ ID NO: 775722 - RNA, 18 nt, Listeria monocytogenes EGD-e
aauauacuuuauaacuuu

SEQ ID NO: 775723 - RNA, 15 nt, Listeria monocytogenes EGD-e
aauauagcuucaaac

SEQ ID NO: 775724 - RNA, 18 nt, Listeria monocytogenes EGD-e
aauauagcuucaaacgca

SEQ ID NO: 775725 - RNA, 17 nt, Listeria monocytogenes EGD-e
aauaucaaauccaagca

SEQ ID NO: 775726 - RNA, 18 nt, Listeria monocytogenes EGD-e
aauaucaucaauuaaauu

SEQ ID NO: 775727 - RNA, 12 nt, Listeria monocytogenes EGD-e
aauauccuuguu

SEQ ID NO: 775728 - RNA, 21 nt, Listeria monocytogenes EGD-e
aauauccuuguuguucuaaua

SEQ ID NO: 775729 - RNA, 14 nt, Listeria monocytogenes EGD-e
aauaucuauucauu

SEQ ID NO: 775730 - RNA, 17 nt, Listeria monocytogenes EGD-e
aaaaaguggcgcuucca

SEQ ID NO: 775731 - RNA, 23 nt, Listeria monocytogenes EGD-e
aaaaagugcguaagauuuuugcu

SEQ ID NO: 775732 - RNA, 20 nt, Listeria monocytogenes EGD-e
aauaagcgaauauccgauaa

SEQ ID NO: 775733 - RNA, 17 nt, Listeria monocytogenes EGD-e
aaaaauaaauaggccca

SEQ ID NO: 775734 - RNA, 17 nt, Listeria monocytogenes EGD-e
aauaauaauaaguauag

SEQ ID NO: 775735 - RNA, 11 nt, Listeria monocytogenes EGD-e
aauaagugaau

SEQ ID NO: 775736 - RNA, 18 nt, Listeria monocytogenes EGD-e
aauaagugaauugaugga

SEQ ID NO: 775737 - RNA, 16 nt, Listeria monocytogenes EGD-e
aaguuguaagauaaua

SEQ ID NO: 775738 - RNA, 12 nt, Listeria monocytogenes EGD-e
aauaacaucuuu

SEQ ID NO: 775739 - RNA, 16 nt, Listeria monocytogenes EGD-e
aauaacaucuuuaaaa

SEQ ID NO: 775740 - RNA, 13 nt, Listeria monocytogenes EGD-e
aauaacauuaaac

SEQ ID NO: 775741 - RNA, 19 nt, Listeria monocytogenes EGD-e
aauaacauuaaaccucuuu

SEQ ID NO: 775742 - RNA, 12 nt, Listeria monocytogenes EGD-e
aauaaccauucc

SEQ ID NO: 775743 - RNA, 16 nt, Listeria monocytogenes EGD-e
aaaaaugaaaagaaaa

SEQ ID NO: 775744 - RNA, 20 nt, Listeria monocytogenes EGD-e
aaaaauagcuuugucuuaaa

SEQ ID NO: 775745 - RNA, 21 nt, Listeria monocytogenes EGD-e
aauaaugauuucuauaaaaau

SEQ ID NO: 775746 - RNA, 22 nt, Listeria monocytogenes EGD-e
aauacauuuuagcuuauuaauu

SEQ ID NO: 775747 - RNA, 22 nt, Listeria monocytogenes EGD-e
aauaccagcaguuuucauuaaa

SEQ ID NO: 775748 - RNA, 15 nt, Listeria monocytogenes EGD-e
aaaaaugcagaaaau

SEQ ID NO: 775749 - RNA, 17 nt, Listeria monocytogenes EGD-e
aaaaaugauucuaguuu

SEQ ID NO: 775750 - RNA, 16 nt, Listeria monocytogenes EGD-e
aauaccaggaucaaaa

SEQ ID NO: 775751 - RNA, 15 nt, Listeria monocytogenes EGD-e
aaguaaaaucuuuua

SEQ ID NO: 775752 - RNA, 13 nt, Listeria monocytogenes EGD-e
aaggcuuuuaacu

SEQ ID NO: 775753 - RNA, 20 nt, Listeria monocytogenes EGD-e
aaguagauuccgcuaaaacu

SEQ ID NO: 775754 - RNA, 21 nt, Listeria monocytogenes EGD-e
aaguagcaggacaugcuaaau

SEQ ID NO: 775755 - RNA, 13 nt, Listeria monocytogenes EGD-e
aaguacaauuuuc

SEQ ID NO: 775756 - RNA, 18 nt, Listeria monocytogenes EGD-e
aaguacaauuuucauuua

SEQ ID NO: 775757 - RNA, 21 nt, Listeria monocytogenes EGD-e
aaguacaauuuucauuuaaca

SEQ ID NO: 775758 - RNA, 19 nt, Listeria monocytogenes EGD-e
aaguaaugguguaaucacu

SEQ ID NO: 775759 - RNA, 15 nt, Listeria monocytogenes EGD-e
aaguauucaaauuca

SEQ ID NO: 775760 - RNA, 18 nt, Listeria monocytogenes EGD-e
aagucaaaacguucgagc

SEQ ID NO: 775761 - RNA, 21 nt, Listeria monocytogenes EGD-e
aaguaggccuagcauuagcua

SEQ ID NO: 775762 - RNA, 18 nt, Listeria monocytogenes EGD-e
aaguccgucaagcccagc

SEQ ID NO: 775763 - RNA, 13 nt, Listeria monocytogenes EGD-e
aagucaugacagc

SEQ ID NO: 775764 - RNA, 14 nt, Listeria monocytogenes EGD-e
aagucuuuuuguaa

SEQ ID NO: 775765 - RNA, 21 nt, Listeria monocytogenes EGD-e
aagucuuuuuguaaaggauaa

SEQ ID NO: 775766 - RNA, 23 nt, Listeria monocytogenes EGD-e
aagugaauugauggauuccuaaa

SEQ ID NO: 775767 - RNA, 23 nt, Listeria monocytogenes EGD-e
aagucguuauguaauucuaaaua

SEQ ID NO: 775768 - RNA, 21 nt, Listeria monocytogenes EGD-e
aaguucaugacgcgcaucuuc

SEQ ID NO: 775769 - RNA, 15 nt, Listeria monocytogenes EGD-e
aagugcguaagauuu

SEQ ID NO: 775770 - RNA, 15 nt, Listeria monocytogenes EGD-e
aagugaccuuugaaa

SEQ ID NO: 775771 - RNA, 22 nt, Listeria monocytogenes EGD-e
aagcucccaauuuaauuuggga

SEQ ID NO: 775772 - RNA, 20 nt, Listeria monocytogenes EGD-e
aagaucccaaacucccuuuu

SEQ ID NO: 775773 - RNA, 13 nt, Listeria monocytogenes EGD-e
aagcgcagaauga

SEQ ID NO: 775774 - RNA, 15 nt, Listeria monocytogenes EGD-e
aagcgacauuaaaua

SEQ ID NO: 775775 - RNA, 17 nt, Listeria monocytogenes EGD-e
aagcuaauuauuucaag

SEQ ID NO: 775776 - RNA, 22 nt, Listeria monocytogenes EGD-e
aagcuauuuuuuauacucucuu

SEQ ID NO: 775777 - RNA, 18 nt, Listeria monocytogenes EGD-e
aacaguauuccucaauga

SEQ ID NO: 775778 - RNA, 19 nt, Listeria monocytogenes EGD-e
aacagcuugauaauuuuuu

SEQ ID NO: 775779 - RNA, 17 nt, Listeria monocytogenes EGD-e
aacaucagauuaaauau

SEQ ID NO: 775780 - RNA, 18 nt, Listeria monocytogenes EGD-e
aacaucagauuaaauaua

SEQ ID NO: 775781 - RNA, 19 nt, Listeria monocytogenes EGD-e
aacaucagauuaaauauag

SEQ ID NO: 775782 - RNA, 21 nt, Listeria monocytogenes EGD-e
aacauagcuacaauuaaaaua

SEQ ID NO: 775783 - RNA, 21 nt, Listeria monocytogenes EGD-e
aacauaaaccgcaauaacaua

SEQ ID NO: 775784 - RNA, 13 nt, Listeria monocytogenes EGD-e
aacaguuauuaaa

SEQ ID NO: 775785 - RNA, 15 nt, Listeria monocytogenes EGD-e
aacaguuauuaaaag

SEQ ID NO: 775786 - RNA, 19 nt, Listeria monocytogenes EGD-e
aacaguuauuaaaaggaca

SEQ ID NO: 775787 - RNA, 17 nt, Listeria monocytogenes EGD-e
aacaucucgucaaugaa

SEQ ID NO: 775788 - RNA, 15 nt, Listeria monocytogenes EGD-e
aacaugauauauuua

SEQ ID NO: 775789 - RNA, 13 nt, Listeria monocytogenes EGD-e
aacauuucucccu

SEQ ID NO: 775790 - RNA, 14 nt, Listeria monocytogenes EGD-e
aacauuucucccuc

SEQ ID NO: 775791 - RNA, 21 nt, Listeria monocytogenes EGD-e
aacauuucucccucauccuuu

SEQ ID NO: 775792 - RNA, 14 nt, Listeria monocytogenes EGD-e
aaccacuuuugcau

SEQ ID NO: 775793 - RNA, 16 nt, Listeria monocytogenes EGD-e
aaccagaaacgccaau

SEQ ID NO: 775794 - RNA, 18 nt, Listeria monocytogenes EGD-e
aaccucgcaaaaaauaau

SEQ ID NO: 775795 - RNA, 22 nt, Listeria monocytogenes EGD-e
aaccuauuugguacuugugaaa

SEQ ID NO: 775796 - RNA, 13 nt, Listeria monocytogenes EGD-e
aaccuaguuuuau

SEQ ID NO: 775797 - RNA, 16 nt, Listeria monocytogenes EGD-e
aaccguaacuguugaa

SEQ ID NO: 775798 - RNA, 14 nt, Listeria monocytogenes EGD-e
aaccuuaugacgag

SEQ ID NO: 775799 - RNA, 15 nt, Listeria monocytogenes EGD-e
aacgauagauuuuaa

SEQ ID NO: 775800 - RNA, 16 nt, Listeria monocytogenes EGD-e
aacgauagauuuuaau

SEQ ID NO: 775801 - RNA, 14 nt, Listeria monocytogenes EGD-e
aacgcaucugcuaa

SEQ ID NO: 775802 - RNA, 15 nt, Listeria monocytogenes EGD-e
aacgaauccuuggaa

SEQ ID NO: 775803 - RNA, 21 nt, Listeria monocytogenes EGD-e
aacgaauccuuggaaaaauga

SEQ ID NO: 775804 - RNA, 13 nt, Listeria monocytogenes EGD-e
aacgcuaucaauc

SEQ ID NO: 775805 - RNA, 17 nt, Listeria monocytogenes EGD-e
aacgcuaucaaucauca

SEQ ID NO: 775806 - RNA, 23 nt, Listeria monocytogenes EGD-e
aacuuuuuuucuuagaagaugca

SEQ ID NO: 775807 - RNA, 11 nt, Listeria monocytogenes EGD-e
aagaaaaaaag

SEQ ID NO: 775808 - RNA, 14 nt, Listeria monocytogenes EGD-e
aacuuguuuuugua

SEQ ID NO: 775809 - RNA, 15 nt, Listeria monocytogenes EGD-e
aacuuguuuuuguag

SEQ ID NO: 775810 - RNA, 11 nt, Listeria monocytogenes EGD-e
aacuuucacaa

SEQ ID NO: 775811 - RNA, 23 nt, Listeria monocytogenes EGD-e
aacuuucucuugcuuuaauuugg

SEQ ID NO: 775812 - RNA, 16 nt, Listeria monocytogenes EGD-e
aacuucacuaacaaaa

SEQ ID NO: 775813 - RNA, 18 nt, Listeria monocytogenes EGD-e
aacuucacuaacaaaaua

SEQ ID NO: 775814 - RNA, 18 nt, Listeria monocytogenes EGD-e
aacuucauuagacaaaaa

SEQ ID NO: 775815 - RNA, 18 nt, Listeria monocytogenes EGD-e
aacuccccagugaaaaua

SEQ ID NO: 775816 - RNA, 20 nt, Listeria monocytogenes EGD-e
aacuccugcauuguuaaauu

SEQ ID NO: 775817 - RNA, 23 nt, Listeria monocytogenes EGD-e
aacuccugcauuguuaaauuauc

SEQ ID NO: 775818 - RNA, 16 nt, Listeria monocytogenes EGD-e
aagacaccaauuucug

SEQ ID NO: 775819 - RNA, 16 nt, Listeria monocytogenes EGD-e
aagaccaccaagaaua

SEQ ID NO: 775820 - RNA, 21 nt, Listeria monocytogenes EGD-e
aagaaaucgccuugaugugga

SEQ ID NO: 775821 - RNA, 16 nt, Listeria monocytogenes EGD-e
aagaccuaaacgaagc

SEQ ID NO: 775822 - RNA, 14 nt, Listeria monocytogenes EGD-e
aagaccuucuuuua

SEQ ID NO: 775823 - RNA, 13 nt, Listeria monocytogenes EGD-e
aagagccauaaaa

SEQ ID NO: 775824 - RNA, 14 nt, Listeria monocytogenes EGD-e
aagagccauaaaau

SEQ ID NO: 775825 - RNA, 22 nt, Listeria monocytogenes EGD-e
aagagcgagagcaccaaaaaca

SEQ ID NO: 775826 - RNA, 19 nt, Listeria monocytogenes EGD-e
aagaggcuuauuccuccaa

SEQ ID NO: 775827 - RNA, 17 nt, Listeria monocytogenes EGD-e
aagagcaccaauaaaac

SEQ ID NO: 775828 - RNA, 19 nt, Listeria monocytogenes EGD-e
cgcguucuugucuugcaag

SEQ ID NO: 775829 - RNA, 20 nt, Listeria monocytogenes EGD-e
cgcugauauccauugcaauc

SEQ ID NO: 775830 - RNA, 17 nt, Listeria monocytogenes EGD-e
cgcuuccucgacuucaa

SEQ ID NO: 775831 - RNA, 21 nt, Listeria monocytogenes EGD-e
cgcuucggcaacaagagauaa

SEQ ID NO: 775832 - RNA, 20 nt, Listeria monocytogenes EGD-e
cgccucgagauaaauuacug

SEQ ID NO: 775833 - RNA, 15 nt, Listeria monocytogenes EGD-e
cgcgaguacaauuau

SEQ ID NO: 775834 - RNA, 15 nt, Listeria monocytogenes EGD-e
cgccagcuucacgca

SEQ ID NO: 775835 - RNA, 20 nt, Listeria monocytogenes EGD-e
cgccaccugguaaauagcca

SEQ ID NO: 775836 - RNA, 14 nt, Listeria monocytogenes EGD-e
cgccaccuucaauu

SEQ ID NO: 775837 - RNA, 16 nt, Listeria monocytogenes EGD-e
cgaucagccauuuuac

SEQ ID NO: 775838 - RNA, 13 nt, Listeria monocytogenes EGD-e
cgauuauccugua

SEQ ID NO: 775839 - RNA, 16 nt, Listeria monocytogenes EGD-e
cgcaagugcuaaaaua

SEQ ID NO: 775840 - RNA, 14 nt, Listeria monocytogenes EGD-e
cgcagcuucaaucu

SEQ ID NO: 775841 - RNA, 22 nt, Listeria monocytogenes EGD-e
ccagucacaaacgcuuuuucaa

SEQ ID NO: 775842 - RNA, 17 nt, Listeria monocytogenes EGD-e
ccaguaguaagggugaa

SEQ ID NO: 775843 - RNA, 22 nt, Listeria monocytogenes EGD-e
ccaguaguugguaguuuuaaau

SEQ ID NO: 775844 - RNA, 18 nt, Listeria monocytogenes EGD-e
ccaguaaaacaagaggcu

SEQ ID NO: 775845 - RNA, 15 nt, Listeria monocytogenes EGD-e
ccaucauaaucccag

SEQ ID NO: 775846 - RNA, 18 nt, Listeria monocytogenes EGD-e
ccaucauaaucccaguag

SEQ ID NO: 775847 - RNA, 15 nt, Listeria monocytogenes EGD-e
cccaagauucuucua

SEQ ID NO: 775848 - RNA, 16 nt, Listeria monocytogenes EGD-e
ccauuuuguucuaaga

SEQ ID NO: 775849 - RNA, 22 nt, Listeria monocytogenes EGD-e
ccauuuuucuucuggaagagcg

SEQ ID NO: 775850 - RNA, 12 nt, Listeria monocytogenes EGD-e
ccauuuguucuc

SEQ ID NO: 775851 - RNA, 19 nt, Listeria monocytogenes EGD-e
ccauugcgaauaacaagcg

SEQ ID NO: 775852 - RNA, 11 nt, Listeria monocytogenes EGD-e
cccagaaaaaa

SEQ ID NO: 775853 - RNA, 23 nt, Listeria monocytogenes EGD-e
cccaaguagcaggacaugcuaaa

SEQ ID NO: 775854 - RNA, 14 nt, Listeria monocytogenes EGD-e
ccccauaguaaaaa

SEQ ID NO: 775855 - RNA, 14 nt, Listeria monocytogenes EGD-e
cccaucuuuuuucu

SEQ ID NO: 775856 - RNA, 23 nt, Listeria monocytogenes EGD-e
cccgcaaauucaugcaagcgcag

SEQ ID NO: 775857 - RNA, 18 nt, Listeria monocytogenes EGD-e
cccucauguucaaucuca

SEQ ID NO: 775858 - RNA, 16 nt, Listeria monocytogenes EGD-e
cccuccuuuauuuuuu

SEQ ID NO: 775859 - RNA, 14 nt, Listeria monocytogenes EGD-e
cccuauaaaaacau

SEQ ID NO: 775860 - RNA, 18 nt, Listeria monocytogenes EGD-e
aaacaggcguaauaaaug

SEQ ID NO: 775861 - RNA, 22 nt, Listeria monocytogenes EGD-e
cccuuuuuuuacauuuuugcuu

SEQ ID NO: 775862 - RNA, 13 nt, Listeria monocytogenes EGD-e
aaacagcuuuucu

SEQ ID NO: 775863 - RNA, 13 nt, Listeria monocytogenes EGD-e
ccgaaaaucgagu

SEQ ID NO: 775864 - RNA, 14 nt, Listeria monocytogenes EGD-e
aaacaucacaccuu

SEQ ID NO: 775865 - RNA, 15 nt, Listeria monocytogenes EGD-e
ccgaaccaagcacau

SEQ ID NO: 775866 - RNA, 20 nt, Listeria monocytogenes EGD-e
aaacauucgguccuuguacu

SEQ ID NO: 775867 - RNA, 21 nt, Listeria monocytogenes EGD-e
aaacauucgguccuuguacua

SEQ ID NO: 775868 - RNA, 20 nt, Listeria monocytogenes EGD-e
aaacauuauuuugcuaaaga

SEQ ID NO: 775869 - RNA, 18 nt, Listeria monocytogenes EGD-e
aaaccauuauacaauuaa

SEQ ID NO: 775870 - RNA, 20 nt, Listeria monocytogenes EGD-e
aaaccauuauacaauuaaua

SEQ ID NO: 775871 - RNA, 19 nt, Listeria monocytogenes EGD-e
aaaccauucaucuaauuua

SEQ ID NO: 775872 - RNA, 19 nt, Listeria monocytogenes EGD-e
ccgauuauccuguaauucg

SEQ ID NO: 775873 - RNA, 13 nt, Listeria monocytogenes EGD-e
ccgcagcuucaau

SEQ ID NO: 775874 - RNA, 13 nt, Listeria monocytogenes EGD-e
ccuaaaucuuuca

SEQ ID NO: 775875 - RNA, 12 nt, Listeria monocytogenes EGD-e
ccuaaaucagca

SEQ ID NO: 775876 - RNA, 18 nt, Listeria monocytogenes EGD-e
aaacgacagauaaauaug

SEQ ID NO: 775877 - RNA, 15 nt, Listeria monocytogenes EGD-e
ccuaauuguuuuguu

SEQ ID NO: 775878 - RNA, 15 nt, Listeria monocytogenes EGD-e
ccuaauuuacuacua

SEQ ID NO: 775879 - RNA, 11 nt, Listeria monocytogenes EGD-e
ccuaauuuuac

SEQ ID NO: 775880 - RNA, 16 nt, Listeria monocytogenes EGD-e
ccuaauuuuacuucua

SEQ ID NO: 775881 - RNA, 13 nt, Listeria monocytogenes EGD-e
ccuaguuaaucua

SEQ ID NO: 775882 - RNA, 14 nt, Listeria monocytogenes EGD-e
ccuagaacuaauuc

SEQ ID NO: 775883 - RNA, 13 nt, Listeria monocytogenes EGD-e
ccuagcuaaugcu

SEQ ID NO: 775884 - RNA, 14 nt, Listeria monocytogenes EGD-e
ccuagcuaaugcua

SEQ ID NO: 775885 - RNA, 15 nt, Listeria monocytogenes EGD-e
ccuccuguugcacca

SEQ ID NO: 775886 - RNA, 13 nt, Listeria monocytogenes EGD-e
ccuccuuuauuuu

SEQ ID NO: 775887 - RNA, 19 nt, Listeria monocytogenes EGD-e
ccuguaauucgaauaagaa

SEQ ID NO: 775888 - RNA, 14 nt, Listeria monocytogenes EGD-e
ccuucaagcauauu

SEQ ID NO: 775889 - RNA, 16 nt, Listeria monocytogenes EGD-e
ccuucaagcauauuaa

SEQ ID NO: 775890 - RNA, 12 nt, Listeria monocytogenes EGD-e
ccuucaagcauu

SEQ ID NO: 775891 - RNA, 22 nt, Listeria monocytogenes EGD-e
ccuucaauuucuuuugacaaaa

SEQ ID NO: 775892 - RNA, 18 nt, Listeria monocytogenes EGD-e
ccuucuucagacgcaauu

SEQ ID NO: 775893 - RNA, 17 nt, Listeria monocytogenes EGD-e
ccuucauaauuauuuuu

SEQ ID NO: 775894 - RNA, 18 nt, Listeria monocytogenes EGD-e
ccuucauaauuauuuuug

SEQ ID NO: 775895 - RNA, 17 nt, Listeria monocytogenes EGD-e
ccuuguuuuuuguauuc

SEQ ID NO: 775896 - RNA, 13 nt, Listeria monocytogenes EGD-e
ccuuuauuuuuua

SEQ ID NO: 775897 - RNA, 13 nt, Listeria monocytogenes EGD-e
ccuuuacuugcaa

SEQ ID NO: 775898 - RNA, 17 nt, Listeria monocytogenes EGD-e
ccuuugguaaaaaacug

SEQ ID NO: 775899 - RNA, 21 nt, Listeria monocytogenes EGD-e
cgaauaacucggggugaaaau

SEQ ID NO: 775900 - RNA, 17 nt, Listeria monocytogenes EGD-e
cgaaugaacuucaccac

SEQ ID NO: 775901 - RNA, 17 nt, Listeria monocytogenes EGD-e
cgaauguuaaauucauu

SEQ ID NO: 775902 - RNA, 12 nt, Listeria monocytogenes EGD-e
cgaauccuugga

SEQ ID NO: 775903 - RNA, 21 nt, Listeria monocytogenes EGD-e
cgacaaaguaacuaaaaauca

SEQ ID NO: 775904 - RNA, 18 nt, Listeria monocytogenes EGD-e
cgacaaaugguucacuuu

SEQ ID NO: 775905 - RNA, 12 nt, Listeria monocytogenes EGD-e
cgaauuuuucaa

SEQ ID NO: 775906 - RNA, 15 nt, Listeria monocytogenes EGD-e
cgaauucuuuuucuu

SEQ ID NO: 775907 - RNA, 18 nt, Listeria monocytogenes EGD-e
cgacaauaccauguuuau

SEQ ID NO: 775908 - RNA, 23 nt, Listeria monocytogenes EGD-e
cgacaauuaugucggugcauuuu

SEQ ID NO: 775909 - RNA, 17 nt, Listeria monocytogenes EGD-e
cauagaauguauacacu

SEQ ID NO: 775910 - RNA, 21 nt, Listeria monocytogenes EGD-e
cauaggucaggauuaaaaguu

SEQ ID NO: 775911 - RNA, 23 nt, Listeria monocytogenes EGD-e
cauagccggaccugaaagaacug

SEQ ID NO: 775912 - RNA, 18 nt, Listeria monocytogenes EGD-e
cauauucuucuaaaauaa

SEQ ID NO: 775913 - RNA, 13 nt, Listeria monocytogenes EGD-e
cauauuuucucua

SEQ ID NO: 775914 - RNA, 22 nt, Listeria monocytogenes EGD-e
cauauccggcguacuuaaauca

SEQ ID NO: 775915 - RNA, 17 nt, Listeria monocytogenes EGD-e
caucaagugcuucaucu

SEQ ID NO: 775916 - RNA, 20 nt, Listeria monocytogenes EGD-e
caucacuuaauucuugaaug

SEQ ID NO: 775917 - RNA, 19 nt, Listeria monocytogenes EGD-e
caucauuuuuuugauuaau

SEQ ID NO: 775918 - RNA, 13 nt, Listeria monocytogenes EGD-e
caugagcuaauuu

SEQ ID NO: 775919 - RNA, 22 nt, Listeria monocytogenes EGD-e
caugaccuagccagacaucuuu

SEQ ID NO: 775920 - RNA, 14 nt, Listeria monocytogenes EGD-e
caugacaucuucua

SEQ ID NO: 775921 - RNA, 23 nt, Listeria monocytogenes EGD-e
caugacaucuucuagcgucacaa

SEQ ID NO: 775922 - RNA, 20 nt, Listeria monocytogenes EGD-e
caugaacgcguacgauugcu

SEQ ID NO: 775923 - RNA, 18 nt, Listeria monocytogenes EGD-e
caugaaacuuuaacaaaa

SEQ ID NO: 775924 - RNA, 18 nt, Listeria monocytogenes EGD-e
caucuucucgaauaccag

SEQ ID NO: 775925 - RNA, 20 nt, Listeria monocytogenes EGD-e
caugaugauuguucuuuaaa

SEQ ID NO: 775926 - RNA, 12 nt, Listeria monocytogenes EGD-e
cauuaaauuuag

SEQ ID NO: 775927 - RNA, 18 nt, Listeria monocytogenes EGD-e
cauuaaaccucuuuuuuu

SEQ ID NO: 775928 - RNA, 15 nt, Listeria monocytogenes EGD-e
cauucacugauuuau

SEQ ID NO: 775929 - RNA, 14 nt, Listeria monocytogenes EGD-e
cauuaauuuguccu

SEQ ID NO: 775930 - RNA, 16 nt, Listeria monocytogenes EGD-e
cauuaauucauuuaau

SEQ ID NO: 775931 - RNA, 22 nt, Listeria monocytogenes EGD-e
cauugagucgcuauucuauuua

SEQ ID NO: 775932 - RNA, 22 nt, Listeria monocytogenes EGD-e
cauugauauccaguauuucccc

SEQ ID NO: 775933 - RNA, 20 nt, Listeria monocytogenes EGD-e
cauuuuucuucuggaagagc

SEQ ID NO: 775934 - RNA, 22 nt, Listeria monocytogenes EGD-e
cauuuuucuagugcaucuucua

SEQ ID NO: 775935 - RNA, 16 nt, Listeria monocytogenes EGD-e
cauuuuucucaggagu

SEQ ID NO: 775936 - RNA, 21 nt, Listeria monocytogenes EGD-e
ccaaaaucgcauccucaaacg

SEQ ID NO: 775937 - RNA, 17 nt, Listeria monocytogenes EGD-e
ccaaaaugcuaauuuau

SEQ ID NO: 775938 - RNA, 13 nt, Listeria monocytogenes EGD-e
ccaaaaauaaguc

SEQ ID NO: 775939 - RNA, 17 nt, Listeria monocytogenes EGD-e
ccaaacucccuuuuuga

SEQ ID NO: 775940 - RNA, 19 nt, Listeria monocytogenes EGD-e
ccaacaauuacuuccauga

SEQ ID NO: 775941 - RNA, 17 nt, Listeria monocytogenes EGD-e
ccaaagacgcuuuuuuc

SEQ ID NO: 775942 - RNA, 21 nt, Listeria monocytogenes EGD-e
ccaaggguaauauaaauuugc

SEQ ID NO: 775943 - RNA, 12 nt, Listeria monocytogenes EGD-e
ccaagaagagcu

SEQ ID NO: 775944 - RNA, 13 nt, Listeria monocytogenes EGD-e
ccaagaagagcug

SEQ ID NO: 775945 - RNA, 14 nt, Listeria monocytogenes EGD-e
ccaacguuuuaauu

SEQ ID NO: 775946 - RNA, 15 nt, Listeria monocytogenes EGD-e
ccaaccggaucauca

SEQ ID NO: 775947 - RNA, 12 nt, Listeria monocytogenes EGD-e
ccacaaaaaaua

SEQ ID NO: 775948 - RNA, 18 nt, Listeria monocytogenes EGD-e
ccacaaaggacaacaggu

SEQ ID NO: 775949 - RNA, 17 nt, Listeria monocytogenes EGD-e
ccacacugguuuuuuga

SEQ ID NO: 775950 - RNA, 21 nt, Listeria monocytogenes EGD-e
ccacuucuaccguuccuucaa

SEQ ID NO: 775951 - RNA, 21 nt, Listeria monocytogenes EGD-e
ccagaaacgccaauaccgcua

SEQ ID NO: 775952 - RNA, 17 nt, Listeria monocytogenes EGD-e
ccagaaaaaaacaaauu

SEQ ID NO: 775953 - RNA, 16 nt, Listeria monocytogenes EGD-e
ccagacuuuuuuuuau

SEQ ID NO: 775954 - RNA, 22 nt, Listeria monocytogenes EGD-e
ccagcacaaguuccaaaaauag

SEQ ID NO: 775955 - RNA, 22 nt, Listeria monocytogenes EGD-e
ccagcaggguggccgugauaaa

SEQ ID NO: 775956 - RNA, 16 nt, Listeria monocytogenes EGD-e
aaaauugcaacaguua

SEQ ID NO: 775957 - RNA, 23 nt, Listeria monocytogenes EGD-e
aaaauugcaacaguuauuaaaag

SEQ ID NO: 775958 - RNA, 21 nt, Listeria monocytogenes EGD-e
cagcuaccacaagaagggcuu

SEQ ID NO: 775959 - RNA, 21 nt, Listeria monocytogenes EGD-e
cagcuagacaagcacuuacug

SEQ ID NO: 775960 - RNA, 23 nt, Listeria monocytogenes EGD-e
cagcuaaauauuuaauuuuaucu

SEQ ID NO: 775961 - RNA, 14 nt, Listeria monocytogenes EGD-e
cagcuaaguuuucu

SEQ ID NO: 775962 - RNA, 19 nt, Listeria monocytogenes EGD-e
cagcuuuuccuagaacuaa

SEQ ID NO: 775963 - RNA, 15 nt, Listeria monocytogenes EGD-e
cagcuuuugaaacca

SEQ ID NO: 775964 - RNA, 22 nt, Listeria monocytogenes EGD-e
aaaauuugucuuuacuacauuu

SEQ ID NO: 775965 - RNA, 22 nt, Listeria monocytogenes EGD-e
aaaauuuugguuuggucaacau

SEQ ID NO: 775966 - RNA, 13 nt, Listeria monocytogenes EGD-e
cagggcuauuuuu

SEQ ID NO: 775967 - RNA, 22 nt, Listeria monocytogenes EGD-e
caggaucaaaaugggcaguuac

SEQ ID NO: 775968 - RNA, 18 nt, Listeria monocytogenes EGD-e
cagguucaccaaaugcuu

SEQ ID NO: 775969 - RNA, 18 nt, Listeria monocytogenes EGD-e
cagugaugguauuguuuu

SEQ ID NO: 775970 - RNA, 23 nt, Listeria monocytogenes EGD-e
caguccuguaacgucucucauug

SEQ ID NO: 775971 - RNA, 18 nt, Listeria monocytogenes EGD-e
caguccaccagcuacuuc

SEQ ID NO: 775972 - RNA, 20 nt, Listeria monocytogenes EGD-e
cagucacaaacgcuuuuuca

SEQ ID NO: 775973 - RNA, 19 nt, Listeria monocytogenes EGD-e
caguaccugcaagcgaauu

SEQ ID NO: 775974 - RNA, 14 nt, Listeria monocytogenes EGD-e
caguagacuaaauu

SEQ ID NO: 775975 - RNA, 22 nt, Listeria monocytogenes EGD-e
cagcauguccaagcacagcaau

SEQ ID NO: 775976 - RNA, 14 nt, Listeria monocytogenes EGD-e
cagaaaaaaacaaa

SEQ ID NO: 775977 - RNA, 17 nt, Listeria monocytogenes EGD-e
cagaaaccccgccacca

SEQ ID NO: 775978 - RNA, 12 nt, Listeria monocytogenes EGD-e
cagaaaaacugc

SEQ ID NO: 775979 - RNA, 12 nt, Listeria monocytogenes EGD-e
cagaaacaauca

SEQ ID NO: 775980 - RNA, 23 nt, Listeria monocytogenes EGD-e
cagaagcgaugugggaaugaaua

SEQ ID NO: 775981 - RNA, 24 nt, Listeria monocytogenes EGD-e
cagaagcgaugugggaaugaauag

SEQ ID NO: 775982 - RNA, 13 nt, Listeria monocytogenes EGD-e
cagaagcauuuuc

SEQ ID NO: 775983 - RNA, 15 nt, Listeria monocytogenes EGD-e
cagaagccccuugga

SEQ ID NO: 775984 - RNA, 16 nt, Listeria monocytogenes EGD-e
aaaaucaugccuucaa

SEQ ID NO: 775985 - RNA, 15 nt, Listeria monocytogenes EGD-e
aaaaucauuaaauuu

SEQ ID NO: 775986 - RNA, 17 nt, Listeria monocytogenes EGD-e
aaaaucauuaaauuuag

SEQ ID NO: 775987 - RNA, 14 nt, Listeria monocytogenes EGD-e
aaaaucauuuaaac

SEQ ID NO: 775988 - RNA, 19 nt, Listeria monocytogenes EGD-e
aaaaucauuucgauaagca

SEQ ID NO: 775989 - RNA, 19 nt, Listeria monocytogenes EGD-e
cagcaagagcaccaauaaa

SEQ ID NO: 775990 - RNA, 20 nt, Listeria monocytogenes EGD-e
cagcaagagcaccaauaaaa

SEQ ID NO: 775991 - RNA, 22 nt, Listeria monocytogenes EGD-e
aaaauggccaaccggaucauca

SEQ ID NO: 775992 - RNA, 18 nt, Listeria monocytogenes EGD-e
cagcacaaguuccaaaaa

SEQ ID NO: 775993 - RNA, 20 nt, Listeria monocytogenes EGD-e
cagcagaaacuuucuuuucu

SEQ ID NO: 775994 - RNA, 15 nt, Listeria monocytogenes EGD-e
aaaaucuuuuuguuu

SEQ ID NO: 775995 - RNA, 13 nt, Listeria monocytogenes EGD-e
aaaaugaaaagaa

SEQ ID NO: 775996 - RNA, 21 nt, Listeria monocytogenes EGD-e
uuuuuuauacgccuuugcaag

SEQ ID NO: 775997 - RNA, 21 nt, Listeria monocytogenes EGD-e
uuuuuuaugaucuuuucgcaa

SEQ ID NO: 775998 - RNA, 20 nt, Listeria monocytogenes EGD-e
uuuuuuaaugcgaaaaauga

SEQ ID NO: 775999 - RNA, 13 nt, Listeria monocytogenes EGD-e
uuuuuguuuugcu

SEQ ID NO: 776000 - RNA, 18 nt, Listeria monocytogenes EGD-e
uuuuuguuuuauuuggga

SEQ ID NO: 776001 - RNA, 15 nt, Listeria monocytogenes EGD-e
uuuugauuaggcauu

SEQ ID NO: 776002 - RNA, 21 nt, Listeria monocytogenes EGD-e
uuuugauucaagucuggauuu

SEQ ID NO: 776003 - RNA, 18 nt, Listeria monocytogenes EGD-e
uuuugaugcgaaaaauga

SEQ ID NO: 776004 - RNA, 20 nt, Listeria monocytogenes EGD-e
uuuugaugcgaaaaaugaaa

SEQ ID NO: 776005 - RNA, 13 nt, Listeria monocytogenes EGD-e
uuuuucucaggag

SEQ ID NO: 776006 - RNA, 23 nt, Listeria monocytogenes EGD-e
uuuuucgauuggcgauucuucaa

SEQ ID NO: 776007 - RNA, 18 nt, Listeria monocytogenes EGD-e
uuuuaacggcuucaaaaa

SEQ ID NO: 776008 - RNA, 17 nt, Listeria monocytogenes EGD-e
uuuuaaacuauuuuuua

SEQ ID NO: 776009 - RNA, 12 nt, Listeria monocytogenes EGD-e
uuuuaaauauac

SEQ ID NO: 776010 - RNA, 21 nt, Listeria monocytogenes EGD-e
uuuuaaaggaaaacucuccca

SEQ ID NO: 776011 - RNA, 19 nt, Listeria monocytogenes EGD-e
uuugucccacaaacucauu

SEQ ID NO: 776012 - RNA, 16 nt, Listeria monocytogenes EGD-e
uuugucaucauaaaca

SEQ ID NO: 776013 - RNA, 14 nt, Listeria monocytogenes EGD-e
uuuguggcaacuuc

SEQ ID NO: 776014 - RNA, 17 nt, Listeria monocytogenes EGD-e
uuuguggcaacuucugg

SEQ ID NO: 776015 - RNA, 22 nt, Listeria monocytogenes EGD-e
uuugucuuuacuacauuuuguu

SEQ ID NO: 776016 - RNA, 23 nt, Listeria monocytogenes EGD-e
uuugucuuuacuacauuuuguug

SEQ ID NO: 776017 - RNA, 16 nt, Listeria monocytogenes EGD-e
uuugucuuaaaugaca

SEQ ID NO: 776018 - RNA, 23 nt, Listeria monocytogenes EGD-e
uuuguguuaauaaaaucauucca

SEQ ID NO: 776019 - RNA, 15 nt, Listeria monocytogenes EGD-e
uuuguugucaaugua

SEQ ID NO: 776020 - RNA, 15 nt, Listeria monocytogenes EGD-e
uuuguuucuuuuguu

SEQ ID NO: 776021 - RNA, 15 nt, Listeria monocytogenes EGD-e
uuuguuuuccuuugu

SEQ ID NO: 776022 - RNA, 20 nt, Listeria monocytogenes EGD-e
uuugcucgaauucuuuuucu

SEQ ID NO: 776023 - RNA, 21 nt, Listeria monocytogenes EGD-e
uuugcucgaauucuuuuucuu

SEQ ID NO: 776024 - RNA, 13 nt, Listeria monocytogenes EGD-e
uuugcuuuaaaaa

SEQ ID NO: 776025 - RNA, 14 nt, Listeria monocytogenes EGD-e
uuugguuauuucuu

SEQ ID NO: 776026 - RNA, 22 nt, Listeria monocytogenes EGD-e
uuuguaggguuuggaaaacaua

SEQ ID NO: 776027 - RNA, 21 nt, Listeria monocytogenes EGD-e
uuugucaaucuaaauuuuaau

SEQ ID NO: 776028 - RNA, 18 nt, Listeria monocytogenes EGD-e
uuuucuuccauauuuucu

SEQ ID NO: 776029 - RNA, 20 nt, Listeria monocytogenes EGD-e
uuuucucaggaguuaauucu

SEQ ID NO: 776030 - RNA, 16 nt, Listeria monocytogenes EGD-e
uuuucucaaaaauaug

SEQ ID NO: 776031 - RNA, 14 nt, Listeria monocytogenes EGD-e
uuuugaaaaaacau

SEQ ID NO: 776032 - RNA, 21 nt, Listeria monocytogenes EGD-e
uuuuccaaggaauaacuccac

SEQ ID NO: 776033 - RNA, 15 nt, Listeria monocytogenes EGD-e
uuuucccagaaaaaa

SEQ ID NO: 776034 - RNA, 12 nt, Listeria monocytogenes EGD-e
uuuuauuuuuuu

SEQ ID NO: 776035 - RNA, 18 nt, Listeria monocytogenes EGD-e
uuuuauuuuuuuauaauu

SEQ ID NO: 776036 - RNA, 21 nt, Listeria monocytogenes EGD-e
uuuuauuuugcggaaauauca

SEQ ID NO: 776037 - RNA, 22 nt, Listeria monocytogenes EGD-e
uuuuccacacugguuuuuugau

SEQ ID NO: 776038 - RNA, 12 nt, Listeria monocytogenes EGD-e
uuuuccaaaaug

SEQ ID NO: 776039 - RNA, 13 nt, Listeria monocytogenes EGD-e
uuuucauugcacu

SEQ ID NO: 776040 - RNA, 16 nt, Listeria monocytogenes EGD-e
uuuucauuuguuucuu

SEQ ID NO: 776041 - RNA, 23 nt, Listeria monocytogenes EGD-e
uuuuauuugguuuuguccaaacc

SEQ ID NO: 776042 - RNA, 15 nt, Listeria monocytogenes EGD-e
uuuuauuuaaucauu

SEQ ID NO: 776043 - RNA, 20 nt, Listeria monocytogenes EGD-e
uuuuauugcacuauuugguu

SEQ ID NO: 776044 - RNA, 15 nt, Listeria monocytogenes EGD-e
uuuuauguuauaaau

SEQ ID NO: 776045 - RNA, 19 nt, Listeria monocytogenes EGD-e
uuuuauuacuuuauuuauu

SEQ ID NO: 776046 - RNA, 14 nt, Listeria monocytogenes EGD-e
uuuuauuauauuuu

SEQ ID NO: 776047 - RNA, 13 nt, Listeria monocytogenes EGD-e
uuuuagaaugaag

SEQ ID NO: 776048 - RNA, 20 nt, Listeria monocytogenes EGD-e
uuuuacguaauaggauuuua

SEQ ID NO: 776049 - RNA, 21 nt, Listeria monocytogenes EGD-e
uuuuacguaauaggauuuuac

SEQ ID NO: 776050 - RNA, 17 nt, Listeria monocytogenes EGD-e
uuuuaaugcgaaaaaug

SEQ ID NO: 776051 - RNA, 20 nt, Listeria monocytogenes EGD-e
uuuuaaugcgaaaaaugaaa

SEQ ID NO: 776052 - RNA, 12 nt, Listeria monocytogenes EGD-e
uuuuaauuuggu

SEQ ID NO: 776053 - RNA, 18 nt, Listeria monocytogenes EGD-e
uuuuaauuucaaauggag

SEQ ID NO: 776054 - RNA, 15 nt, Listeria monocytogenes EGD-e
uuuuaauuaaaaguu

SEQ ID NO: 776055 - RNA, 15 nt, Listeria monocytogenes EGD-e
uuuuaugcauaaaaa

SEQ ID NO: 776056 - RNA, 21 nt, Listeria monocytogenes EGD-e
uuuuauaauuaacaaccauuu

SEQ ID NO: 776057 - RNA, 19 nt, Listeria monocytogenes EGD-e
uuucugcaggguuucuugg

SEQ ID NO: 776058 - RNA, 17 nt, Listeria monocytogenes EGD-e
uuucucuugcuuuaauu

SEQ ID NO: 776059 - RNA, 18 nt, Listeria monocytogenes EGD-e
uuucucuaaaucaagccc

SEQ ID NO: 776060 - RNA, 14 nt, Listeria monocytogenes EGD-e
uuucuauuccuccu

SEQ ID NO: 776061 - RNA, 18 nt, Listeria monocytogenes EGD-e
uuucuauuccuccuaauu

SEQ ID NO: 776062 - RNA, 19 nt, Listeria monocytogenes EGD-e
uuucucaaggguuuuuguu

SEQ ID NO: 776063 - RNA, 13 nt, Listeria monocytogenes EGD-e
uuucggguuuguu

SEQ ID NO: 776064 - RNA, 17 nt, Listeria monocytogenes EGD-e
uuucggaccuuuugcuu

SEQ ID NO: 776065 - RNA, 16 nt, Listeria monocytogenes EGD-e
uuucgccguuggaagu

SEQ ID NO: 776066 - RNA, 18 nt, Listeria monocytogenes EGD-e
uuucgcuccguauuuaua

SEQ ID NO: 776067 - RNA, 20 nt, Listeria monocytogenes EGD-e
uuuccuucauaauuauuuuu

SEQ ID NO: 776068 - RNA, 22 nt, Listeria monocytogenes EGD-e
uuuccuucauaauuauuuuugu

SEQ ID NO: 776069 - RNA, 13 nt, Listeria monocytogenes EGD-e
uuucgccaauuug

SEQ ID NO: 776070 - RNA, 14 nt, Listeria monocytogenes EGD-e
uuucccagaaaaaa

SEQ ID NO: 776071 - RNA, 18 nt, Listeria monocytogenes EGD-e
uuucccagaaaaaaacaa

SEQ ID NO: 776072 - RNA, 19 nt, Listeria monocytogenes EGD-e
uuucccagaaaaaaacaaa

SEQ ID NO: 776073 - RNA, 21 nt, Listeria monocytogenes EGD-e
uuugaaaaagggcugcugcua

SEQ ID NO: 776074 - RNA, 12 nt, Listeria monocytogenes EGD-e
uuucuuuuccua

SEQ ID NO: 776075 - RNA, 13 nt, Listeria monocytogenes EGD-e
uuugaaaaaacau

SEQ ID NO: 776076 - RNA, 13 nt, Listeria monocytogenes EGD-e
uuucuuucuuuug

SEQ ID NO: 776077 - RNA, 15 nt, Listeria monocytogenes EGD-e
uuucuuucuuuuguu

SEQ ID NO: 776078 - RNA, 18 nt, Listeria monocytogenes EGD-e
uuucuuugccuuaaaaua

SEQ ID NO: 776079 - RNA, 18 nt, Listeria monocytogenes EGD-e
uuucuucgugcgcaacau

SEQ ID NO: 776080 - RNA, 23 nt, Listeria monocytogenes EGD-e
uuucuuccaccgcuuguuuugau

SEQ ID NO: 776081 - RNA, 19 nt, Listeria monocytogenes EGD-e
uuucuuuaaaauccaauaa

SEQ ID NO: 776082 - RNA, 11 nt, Listeria monocytogenes EGD-e
uuucuuuaaaa

SEQ ID NO: 776083 - RNA, 21 nt, Listeria monocytogenes EGD-e
uuucuuuacauaauucauuga

SEQ ID NO: 776084 - RNA, 20 nt, Listeria monocytogenes EGD-e
uuugauaggcucuuccuuuu

SEQ ID NO: 776085 - RNA, 14 nt, Listeria monocytogenes EGD-e
uuugauaaucuaca

SEQ ID NO: 776086 - RNA, 19 nt, Listeria monocytogenes EGD-e
uuugauugccugaaauaau

SEQ ID NO: 776087 - RNA, 12 nt, Listeria monocytogenes EGD-e
uuugauuuaauu

SEQ ID NO: 776088 - RNA, 21 nt, Listeria monocytogenes EGD-e
uuugaugcgaaaaaugaaaag

SEQ ID NO: 776089 - RNA, 15 nt, Listeria monocytogenes EGD-e
uuugaucugugggaa

SEQ ID NO: 776090 - RNA, 17 nt, Listeria monocytogenes EGD-e
uuuauuuuucagcuaaa

SEQ ID NO: 776091 - RNA, 22 nt, Listeria monocytogenes EGD-e
uuuauuauaagcaguacuuccu

SEQ ID NO: 776092 - RNA, 14 nt, Listeria monocytogenes EGD-e
uuuauucauauaaa

SEQ ID NO: 776093 - RNA, 13 nt, Listeria monocytogenes EGD-e
uuucauaaucaaa

SEQ ID NO: 776094 - RNA, 20 nt, Listeria monocytogenes EGD-e
uuucauauaauuuuuucauu

SEQ ID NO: 776095 - RNA, 17 nt, Listeria monocytogenes EGD-e
uuucagcuaaucguuuu

SEQ ID NO: 776096 - RNA, 22 nt, Listeria monocytogenes EGD-e
uuucagcaauguaggcauugua

SEQ ID NO: 776097 - RNA, 13 nt, Listeria monocytogenes EGD-e
uuucauucuuucc

SEQ ID NO: 776098 - RNA, 16 nt, Listeria monocytogenes EGD-e
uuucauuucaucuuuu

SEQ ID NO: 776099 - RNA, 15 nt, Listeria monocytogenes EGD-e
uuucauuuguuucuu

SEQ ID NO: 776100 - RNA, 21 nt, Listeria monocytogenes EGD-e
uuucauuuucuauuccuccua

SEQ ID NO: 776101 - RNA, 24 nt, Listeria monocytogenes EGD-e
uuucauuuucuauuccuccuaauu

SEQ ID NO: 776102 - RNA, 15 nt, Listeria monocytogenes EGD-e
uuuccaaaauggcca

SEQ ID NO: 776103 - RNA, 14 nt, Listeria monocytogenes EGD-e
uuucauuuuuccaa

SEQ ID NO: 776104 - RNA, 17 nt, Listeria monocytogenes EGD-e
uuucaucccuuuuuuca

SEQ ID NO: 776105 - RNA, 18 nt, Listeria monocytogenes EGD-e
uuuagcaacuucacuaac

SEQ ID NO: 776106 - RNA, 21 nt, Listeria monocytogenes EGD-e
uuuagcaacuucacuaacaaa

SEQ ID NO: 776107 - RNA, 23 nt, Listeria monocytogenes EGD-e
uuuaguagagcuucuguuuuuuc

SEQ ID NO: 776108 - RNA, 21 nt, Listeria monocytogenes EGD-e
uuuaggucggguuuuaaaaug

SEQ ID NO: 776109 - RNA, 18 nt, Listeria monocytogenes EGD-e
uuuacgacuguugccauu

SEQ ID NO: 776110 - RNA, 19 nt, Listeria monocytogenes EGD-e
uuuacgcauaucaucaaua

SEQ ID NO: 776111 - RNA, 13 nt, Listeria monocytogenes EGD-e
uuuacuugcaaau

SEQ ID NO: 776112 - RNA, 20 nt, Listeria monocytogenes EGD-e
uuuaucaaacaaaaaaguuc

SEQ ID NO: 776113 - RNA, 13 nt, Listeria monocytogenes EGD-e
uuuaucaauaaua

SEQ ID NO: 776114 - RNA, 19 nt, Listeria monocytogenes EGD-e
uuuaucaggcuauaacaaa

SEQ ID NO: 776115 - RNA, 23 nt, Listeria monocytogenes EGD-e
uuuauauagaaggaauuugccaa

SEQ ID NO: 776116 - RNA, 22 nt, Listeria monocytogenes EGD-e
uuuauauucuucugucacaucu

SEQ ID NO: 776117 - RNA, 22 nt, Listeria monocytogenes EGD-e
uuuauagagcgccgaguaucuu

SEQ ID NO: 776118 - RNA, 23 nt, Listeria monocytogenes EGD-e
uuuauaccuaaagcaucgaauac

SEQ ID NO: 776119 - RNA, 17 nt, Listeria monocytogenes EGD-e
uuuauaauuaacaacca

SEQ ID NO: 776120 - RNA, 19 nt, Listeria monocytogenes EGD-e
uuuauaauuaacaaccauu

SEQ ID NO: 776121 - RNA, 18 nt, Listeria monocytogenes EGD-e
uuuaugacaauuaaaaac

SEQ ID NO: 776122 - RNA, 20 nt, Listeria monocytogenes EGD-e
uuuaugaaaaaaaauaaaug

SEQ ID NO: 776123 - RNA, 22 nt, Listeria monocytogenes EGD-e
uuuaugaaaaaaaauaaaugca

SEQ ID NO: 776124 - RNA, 17 nt, Listeria monocytogenes EGD-e
uugcacugcaccuaaua

SEQ ID NO: 776125 - RNA, 13 nt, Listeria monocytogenes EGD-e
uugcagaaacaau

SEQ ID NO: 776126 - RNA, 23 nt, Listeria monocytogenes EGD-e
uugcacuauuugguugcuuguuu

SEQ ID NO: 776127 - RNA, 16 nt, Listeria monocytogenes EGD-e
uugcuuuaauuuggaa

SEQ ID NO: 776128 - RNA, 19 nt, Listeria monocytogenes EGD-e
uugcuuuaauuuggaaaua

SEQ ID NO: 776129 - RNA, 21 nt, Listeria monocytogenes EGD-e
uugcuuuaauuuggaaauaau

SEQ ID NO: 776130 - RNA, 17 nt, Listeria monocytogenes EGD-e
uuggacuaagaaugaac

SEQ ID NO: 776131 - RNA, 14 nt, Listeria monocytogenes EGD-e
uuggagaaauggau

SEQ ID NO: 776132 - RNA, 22 nt, Listeria monocytogenes EGD-e
uugcuuuguguuaauaaaauca

SEQ ID NO: 776133 - RNA, 21 nt, Listeria monocytogenes EGD-e
uugguacuugugaaaguuuua

SEQ ID NO: 776134 - RNA, 17 nt, Listeria monocytogenes EGD-e
uugguaguuuuaaauuu

SEQ ID NO: 776135 - RNA, 21 nt, Listeria monocytogenes EGD-e
uugguguggaaauaaccauuc

SEQ ID NO: 776136 - RNA, 18 nt, Listeria monocytogenes EGD-e
uuggugugggcaguccac

SEQ ID NO: 776137 - RNA, 20 nt, Listeria monocytogenes EGD-e
uuuaacauaaaaagcugcca

SEQ ID NO: 776138 - RNA, 14 nt, Listeria monocytogenes EGD-e
uuuaauaaaucaua

SEQ ID NO: 776139 - RNA, 15 nt, Listeria monocytogenes EGD-e
uuuaauaagcuugca

SEQ ID NO: 776140 - RNA, 15 nt, Listeria monocytogenes EGD-e
uuuaauuaaaaguug

SEQ ID NO: 776141 - RNA, 14 nt, Listeria monocytogenes EGD-e
uuuaauuuggaaau

SEQ ID NO: 776142 - RNA, 16 nt, Listeria monocytogenes EGD-e
uuuaauuuaauuuucc

SEQ ID NO: 776143 - RNA, 21 nt, Listeria monocytogenes EGD-e
uuuaaauaguaguuauuucuu

SEQ ID NO: 776144 - RNA, 17 nt, Listeria monocytogenes EGD-e
uuuaaauauaacuuuuu

SEQ ID NO: 776145 - RNA, 18 nt, Listeria monocytogenes EGD-e
uuguuuucccagaaaaaa

SEQ ID NO: 776146 - RNA, 14 nt, Listeria monocytogenes EGD-e
uuguugucaaugua

SEQ ID NO: 776147 - RNA, 14 nt, Listeria monocytogenes EGD-e
uugucacuuggaaa

SEQ ID NO: 776148 - RNA, 15 nt, Listeria monocytogenes EGD-e
uugucauaaaacuuu

SEQ ID NO: 776149 - RNA, 22 nt, Listeria monocytogenes EGD-e
uugucauaaaacuuucacaagu

SEQ ID NO: 776150 - RNA, 16 nt, Listeria monocytogenes EGD-e
uugucaucauaaacau

SEQ ID NO: 776151 - RNA, 17 nt, Listeria monocytogenes EGD-e
uugugcuaaguagacaa

SEQ ID NO: 776152 - RNA, 17 nt, Listeria monocytogenes EGD-e
uugucccaagauucuuc

SEQ ID NO: 776153 - RNA, 16 nt, Listeria monocytogenes EGD-e
uucuucugucacaucu

SEQ ID NO: 776154 - RNA, 15 nt, Listeria monocytogenes EGD-e
uucuuuaaaauccaa

SEQ ID NO: 776155 - RNA, 14 nt, Listeria monocytogenes EGD-e
uucuuuacauaauu

SEQ ID NO: 776156 - RNA, 24 nt, Listeria monocytogenes EGD-e
uucuuuacauauuccaaaaucgca

SEQ ID NO: 776157 - RNA, 19 nt, Listeria monocytogenes EGD-e
uucuuuauaacucucauaa

SEQ ID NO: 776158 - RNA, 13 nt, Listeria monocytogenes EGD-e
uucuuuuccuaau

SEQ ID NO: 776159 - RNA, 22 nt, Listeria monocytogenes EGD-e
uucuuuuccuaauuuuacuucu

SEQ ID NO: 776160 - RNA, 12 nt, Listeria monocytogenes EGD-e
uucuuuuguucu

SEQ ID NO: 776161 - RNA, 12 nt, Listeria monocytogenes EGD-e
uugaaaacugaa

SEQ ID NO: 776162 - RNA, 23 nt, Listeria monocytogenes EGD-e
uugaaaacugaacaaagaagaag

SEQ ID NO: 776163 - RNA, 17 nt, Listeria monocytogenes EGD-e
uugaauaacuuuccagc

SEQ ID NO: 776164 - RNA, 21 nt, Listeria monocytogenes EGD-e
uugaauaagcaacgguaaaca

SEQ ID NO: 776165 - RNA, 21 nt, Listeria monocytogenes EGD-e
uugaauagaacuauaaccaaa

SEQ ID NO: 776166 - RNA, 23 nt, Listeria monocytogenes EGD-e
uugaauauccuaacuccugcauu

SEQ ID NO: 776167 - RNA, 16 nt, Listeria monocytogenes EGD-e
uugauaccaaauugua

SEQ ID NO: 776168 - RNA, 18 nt, Listeria monocytogenes EGD-e
uugauaggcucuuccuuu

SEQ ID NO: 776169 - RNA, 18 nt, Listeria monocytogenes EGD-e
uugcacaaaaugcaaaac

SEQ ID NO: 776170 - RNA, 23 nt, Listeria monocytogenes EGD-e
uugcaacaguuauuaaaaggaca

SEQ ID NO: 776171 - RNA, 23 nt, Listeria monocytogenes EGD-e
uugauuaggcauuucuuugauua

SEQ ID NO: 776172 - RNA, 15 nt, Listeria monocytogenes EGD-e
uugauuaaaaccaac

SEQ ID NO: 776173 - RNA, 15 nt, Listeria monocytogenes EGD-e
uugauguuuuugcuu

SEQ ID NO: 776174 - RNA, 18 nt, Listeria monocytogenes EGD-e
uugaugcgaaaaaugaaa

SEQ ID NO: 776175 - RNA, 17 nt, Listeria monocytogenes EGD-e
uugauccaaguuuuuua

SEQ ID NO: 776176 - RNA, 14 nt, Listeria monocytogenes EGD-e
uucuguuuuuucuu

SEQ ID NO: 776177 - RNA, 16 nt, Listeria monocytogenes EGD-e
uucuguuaaaggagaa

SEQ ID NO: 776178 - RNA, 15 nt, Listeria monocytogenes EGD-e
uucugucacaucugu

SEQ ID NO: 776179 - RNA, 13 nt, Listeria monocytogenes EGD-e
uucuucuaaaaua

SEQ ID NO: 776180 - RNA, 22 nt, Listeria monocytogenes EGD-e
uucuucgugcgcaacauucaaa

SEQ ID NO: 776181 - RNA, 20 nt, Listeria monocytogenes EGD-e
uucuuaguuaauucuuuuuc

SEQ ID NO: 776182 - RNA, 21 nt, Listeria monocytogenes EGD-e
uucuuaguuaauucuuuuucu

SEQ ID NO: 776183 - RNA, 14 nt, Listeria monocytogenes EGD-e
uucucuuaugagag

SEQ ID NO: 776184 - RNA, 12 nt, Listeria monocytogenes EGD-e
uucggcuucaaa

SEQ ID NO: 776185 - RNA, 14 nt, Listeria monocytogenes EGD-e
uucgguauaaaaca

SEQ ID NO: 776186 - RNA, 16 nt, Listeria monocytogenes EGD-e
uucgguauaaaacauc

SEQ ID NO: 776187 - RNA, 19 nt, Listeria monocytogenes EGD-e
uucguuucagcucuauaau

SEQ ID NO: 776188 - RNA, 13 nt, Listeria monocytogenes EGD-e
uucuauuaauaau

SEQ ID NO: 776189 - RNA, 14 nt, Listeria monocytogenes EGD-e
uucuauuccuccua

SEQ ID NO: 776190 - RNA, 16 nt, Listeria monocytogenes EGD-e
uucuauuugucaaucu

SEQ ID NO: 776191 - RNA, 20 nt, Listeria monocytogenes EGD-e
uucuauuugucaaucuaaau

SEQ ID NO: 776192 - RNA, 20 nt, Listeria monocytogenes EGD-e
uucuaccguuccuucaagca

SEQ ID NO: 776193 - RNA, 23 nt, Listeria monocytogenes EGD-e
uucuaaacguucuuccuuuuuca

SEQ ID NO: 776194 - RNA, 18 nt, Listeria monocytogenes EGD-e
ugacacccgcguuuucua

SEQ ID NO: 776195 - RNA, 18 nt, Listeria monocytogenes EGD-e
ucuuucacacgauaccaa

SEQ ID NO: 776196 - RNA, 12 nt, Listeria monocytogenes EGD-e
ugaauauuagaa

SEQ ID NO: 776197 - RNA, 20 nt, Listeria monocytogenes EGD-e
ugaauauuagaaaaucauuu

SEQ ID NO: 776198 - RNA, 24 nt, Listeria monocytogenes EGD-e
ugaauauuagaaaaucauuucgau

SEQ ID NO: 776199 - RNA, 13 nt, Listeria monocytogenes EGD-e
ugaccaauuucuu

SEQ ID NO: 776200 - RNA, 16 nt, Listeria monocytogenes EGD-e
ugacagcaucuuuuuc

SEQ ID NO: 776201 - RNA, 19 nt, Listeria monocytogenes EGD-e
ugacagcaucuuuuucuug

SEQ ID NO: 776202 - RNA, 20 nt, Listeria monocytogenes EGD-e
ugaccuagccagacaucuuu

SEQ ID NO: 776203 - RNA, 21 nt, Listeria monocytogenes EGD-e
ugacgagguugcgguuucuuu

SEQ ID NO: 776204 - RNA, 16 nt, Listeria monocytogenes EGD-e
ugagcccaaaaauaag

SEQ ID NO: 776205 - RNA, 20 nt, Listeria monocytogenes EGD-e
ugagaaucauuaauauaaag

SEQ ID NO: 776206 - RNA, 12 nt, Listeria monocytogenes EGD-e
ugagcuucuuuu

SEQ ID NO: 776207 - RNA, 24 nt, Listeria monocytogenes EGD-e
ugagcuaauuuuuuuauaccuaaa

SEQ ID NO: 776208 - RNA, 20 nt, Listeria monocytogenes EGD-e
ugagcgccuucaauuuuauu

SEQ ID NO: 776209 - RNA, 17 nt, Listeria monocytogenes EGD-e
ugauaucaucaauaaua

SEQ ID NO: 776210 - RNA, 22 nt, Listeria monocytogenes EGD-e
ugaugacuaacuaguuguaaac

SEQ ID NO: 776211 - RNA, 20 nt, Listeria monocytogenes EGD-e
ugauucgucuuagaaaaaug

SEQ ID NO: 776212 - RNA, 22 nt, Listeria monocytogenes EGD-e
ugauucgucuuagaaaaauguu

SEQ ID NO: 776213 - RNA, 13 nt, Listeria monocytogenes EGD-e
ugauuuaauuuaa

SEQ ID NO: 776214 - RNA, 19 nt, Listeria monocytogenes EGD-e
ugauuuaauuuaauuuucc

SEQ ID NO: 776215 - RNA, 15 nt, Listeria monocytogenes EGD-e
ugauuuguuuuauua

SEQ ID NO: 776216 - RNA, 13 nt, Listeria monocytogenes EGD-e
ugauuuuuauucc

SEQ ID NO: 776217 - RNA, 16 nt, Listeria monocytogenes EGD-e
ugauuuuuauuccguu

SEQ ID NO: 776218 - RNA, 23 nt, Listeria monocytogenes EGD-e
ugauuuuugagaacgauuuuggu

SEQ ID NO: 776219 - RNA, 16 nt, Listeria monocytogenes EGD-e
ugauguuguaaauacu

SEQ ID NO: 776220 - RNA, 16 nt, Listeria monocytogenes EGD-e
ugauguuucguuuucc

SEQ ID NO: 776221 - RNA, 17 nt, Listeria monocytogenes EGD-e
ugauguguugcuuuuau

SEQ ID NO: 776222 - RNA, 22 nt, Listeria monocytogenes EGD-e
ugcaaggcuuuuaacuuucuug

SEQ ID NO: 776223 - RNA, 16 nt, Listeria monocytogenes EGD-e
ugcaaucccuauaaaa

SEQ ID NO: 776224 - RNA, 14 nt, Listeria monocytogenes EGD-e
ugcagaaacaauca

SEQ ID NO: 776225 - RNA, 16 nt, Listeria monocytogenes EGD-e
ugcacuuucaaaucag

SEQ ID NO: 776226 - RNA, 19 nt, Listeria monocytogenes EGD-e
ugcacuuucaaaucagcuu

SEQ ID NO: 776227 - RNA, 16 nt, Listeria monocytogenes EGD-e
ugcccaccgauaauag

SEQ ID NO: 776228 - RNA, 19 nt, Listeria monocytogenes EGD-e
ugccgauuauccuguaauu

SEQ ID NO: 776229 - RNA, 17 nt, Listeria monocytogenes EGD-e
ugcccuugauuuaaaua

SEQ ID NO: 776230 - RNA, 13 nt, Listeria monocytogenes EGD-e
ugccuaccaaaac

SEQ ID NO: 776231 - RNA, 14 nt, Listeria monocytogenes EGD-e
ugcgaaaaaugaaa

SEQ ID NO: 776232 - RNA, 21 nt, Listeria monocytogenes EGD-e
ugcuacuaucaugacuaaaaa

SEQ ID NO: 776233 - RNA, 23 nt, Listeria monocytogenes EGD-e
ugcuaaagaagucuuuuuguaaa

SEQ ID NO: 776234 - RNA, 20 nt, Listeria monocytogenes EGD-e
ugcuaaaauaaaucugcuuc

SEQ ID NO: 776235 - RNA, 21 nt, Listeria monocytogenes EGD-e
ugcuaacacagcuaccucauu

SEQ ID NO: 776236 - RNA, 17 nt, Listeria monocytogenes EGD-e
ugcuaaauugugaaauu

SEQ ID NO: 776237 - RNA, 13 nt, Listeria monocytogenes EGD-e
ugcgcauguuuuu

SEQ ID NO: 776238 - RNA, 19 nt, Listeria monocytogenes EGD-e
ugcgcaucguugugcuuuc

SEQ ID NO: 776239 - RNA, 17 nt, Listeria monocytogenes EGD-e
ugcuuucguuucaaccc

SEQ ID NO: 776240 - RNA, 12 nt, Listeria monocytogenes EGD-e
ugcuucuuccau

SEQ ID NO: 776241 - RNA, 20 nt, Listeria monocytogenes EGD-e
uggaaauaaccauuccaucg

SEQ ID NO: 776242 - RNA, 23 nt, Listeria monocytogenes EGD-e
uggaaagaauauccguuucauuu

SEQ ID NO: 776243 - RNA, 13 nt, Listeria monocytogenes EGD-e
ugcuuuuuuuaaa

SEQ ID NO: 776244 - RNA, 14 nt, Listeria monocytogenes EGD-e
ugcuuuuuuuaaac

SEQ ID NO: 776245 - RNA, 23 nt, Listeria monocytogenes EGD-e
ugcuuuuuuuaaacuauuuuuua

SEQ ID NO: 776246 - RNA, 23 nt, Listeria monocytogenes EGD-e
uggacaaugauccgaaccaagca

SEQ ID NO: 776247 - RNA, 20 nt, Listeria monocytogenes EGD-e
uggaauagagcuuuuaaaua

SEQ ID NO: 776248 - RNA, 13 nt, Listeria monocytogenes EGD-e
uggaagugaaaau

SEQ ID NO: 776249 - RNA, 12 nt, Listeria monocytogenes EGD-e
uuaguaaacauu

SEQ ID NO: 776250 - RNA, 13 nt, Listeria monocytogenes EGD-e
uuaguaaacauuu

SEQ ID NO: 776251 - RNA, 18 nt, Listeria monocytogenes EGD-e
uuagguuagcagcuuuug

SEQ ID NO: 776252 - RNA, 18 nt, Listeria monocytogenes EGD-e
uuaguucguuuauuuuga

SEQ ID NO: 776253 - RNA, 23 nt, Listeria monocytogenes EGD-e
uuauaugaaaacuuaucucuuca

SEQ ID NO: 776254 - RNA, 16 nt, Listeria monocytogenes EGD-e
uuauaguuuucuacua

SEQ ID NO: 776255 - RNA, 23 nt, Listeria monocytogenes EGD-e
uuauaccuaaagcaucgaauacu

SEQ ID NO: 776256 - RNA, 15 nt, Listeria monocytogenes EGD-e
uuacuucaccaguaa

SEQ ID NO: 776257 - RNA, 16 nt, Listeria monocytogenes EGD-e
uuaccuugaucaaaau

SEQ ID NO: 776258 - RNA, 19 nt, Listeria monocytogenes EGD-e
uuaccuugaucaaaauuca

SEQ ID NO: 776259 - RNA, 12 nt, Listeria monocytogenes EGD-e
uuacuuccauga

SEQ ID NO: 776260 - RNA, 15 nt, Listeria monocytogenes EGD-e
uuacuugcaaaugcu

SEQ ID NO: 776261 - RNA, 21 nt, Listeria monocytogenes EGD-e
uuacuugauagagcugagccu

SEQ ID NO: 776262 - RNA, 14 nt, Listeria monocytogenes EGD-e
uuagaaauauguuu

SEQ ID NO: 776263 - RNA, 14 nt, Listeria monocytogenes EGD-e
uuagacaaaaagaa

SEQ ID NO: 776264 - RNA, 14 nt, Listeria monocytogenes EGD-e
uuacaccauuuugu

SEQ ID NO: 776265 - RNA, 18 nt, Listeria monocytogenes EGD-e
uuaauccgaauuccacgc

SEQ ID NO: 776266 - RNA, 19 nt, Listeria monocytogenes EGD-e
uuaauucgcggucaugagc

SEQ ID NO: 776267 - RNA, 13 nt, Listeria monocytogenes EGD-e
uuaauuuuccgca

SEQ ID NO: 776268 - RNA, 23 nt, Listeria monocytogenes EGD-e
uuaauuugguccaucaaauuauc

SEQ ID NO: 776269 - RNA, 19 nt, Listeria monocytogenes EGD-e
uuaaucauuaaccuacuuu

SEQ ID NO: 776270 - RNA, 12 nt, Listeria monocytogenes EGD-e
uuaaucauugcu

SEQ ID NO: 776271 - RNA, 14 nt, Listeria monocytogenes EGD-e
uuaauaugcauuca

SEQ ID NO: 776272 - RNA, 22 nt, Listeria monocytogenes EGD-e
uuaauaaugauuucuauaaaaa

SEQ ID NO: 776273 - RNA, 13 nt, Listeria monocytogenes EGD-e
uuaagucugcuuc

SEQ ID NO: 776274 - RNA, 16 nt, Listeria monocytogenes EGD-e
uguuaauaaaaucauu

SEQ ID NO: 776275 - RNA, 16 nt, Listeria monocytogenes EGD-e
uguuaacuaacaaaau

SEQ ID NO: 776276 - RNA, 17 nt, Listeria monocytogenes EGD-e
uguucuaauaauuuuaa

SEQ ID NO: 776277 - RNA, 19 nt, Listeria monocytogenes EGD-e
uguucuaauaauuuuaauu

SEQ ID NO: 776278 - RNA, 20 nt, Listeria monocytogenes EGD-e
uguugcuuuuauuuuuaaag

SEQ ID NO: 776279 - RNA, 20 nt, Listeria monocytogenes EGD-e
uguugcagcccaaccuauuu

SEQ ID NO: 776280 - RNA, 16 nt, Listeria monocytogenes EGD-e
uguuguuuugguacaa

SEQ ID NO: 776281 - RNA, 13 nt, Listeria monocytogenes EGD-e
uguuguuuuagau

SEQ ID NO: 776282 - RNA, 13 nt, Listeria monocytogenes EGD-e
uguuguucuugcc

SEQ ID NO: 776283 - RNA, 16 nt, Listeria monocytogenes EGD-e
uguuguucuugccaaa

SEQ ID NO: 776284 - RNA, 22 nt, Listeria monocytogenes EGD-e
uguugguguggaaauaaccauu

SEQ ID NO: 776285 - RNA, 15 nt, Listeria monocytogenes EGD-e
uguuguaccauaagc

SEQ ID NO: 776286 - RNA, 13 nt, Listeria monocytogenes EGD-e
uguuuuugcuucu

SEQ ID NO: 776287 - RNA, 20 nt, Listeria monocytogenes EGD-e
uguuuuuguaggguuuggaa

SEQ ID NO: 776288 - RNA, 13 nt, Listeria monocytogenes EGD-e
uguuuuuuuuagu

SEQ ID NO: 776289 - RNA, 17 nt, Listeria monocytogenes EGD-e
uuaaaaaggaauuuuuc

SEQ ID NO: 776290 - RNA, 16 nt, Listeria monocytogenes EGD-e
uuaaaauccaauaaua

SEQ ID NO: 776291 - RNA, 20 nt, Listeria monocytogenes EGD-e
uuaaaaguugaccgcaaaua

SEQ ID NO: 776292 - RNA, 18 nt, Listeria monocytogenes EGD-e
uuaaaaggacacccauaa

SEQ ID NO: 776293 - RNA, 20 nt, Listeria monocytogenes EGD-e
uuaaaaggacacccauaaua

SEQ ID NO: 776294 - RNA, 14 nt, Listeria monocytogenes EGD-e
uguuucauauaauu

SEQ ID NO: 776295 - RNA, 19 nt, Listeria monocytogenes EGD-e
uguuucauauaauuuuuuc

SEQ ID NO: 776296 - RNA, 14 nt, Listeria monocytogenes EGD-e
uguuucauuuuucc

SEQ ID NO: 776297 - RNA, 21 nt, Listeria monocytogenes EGD-e
uguuucgccaauuugcgacaa

SEQ ID NO: 776298 - RNA, 12 nt, Listeria monocytogenes EGD-e
uguuuauuuaau

SEQ ID NO: 776299 - RNA, 14 nt, Listeria monocytogenes EGD-e
uguuuauuuaauaa

SEQ ID NO: 776300 - RNA, 18 nt, Listeria monocytogenes EGD-e
uguuuaaucuaaaucuag

SEQ ID NO: 776301 - RNA, 15 nt, Listeria monocytogenes EGD-e
uguuuaggauauuuu

SEQ ID NO: 776302 - RNA, 14 nt, Listeria monocytogenes EGD-e
uguuuagccuuuua

SEQ ID NO: 776303 - RNA, 16 nt, Listeria monocytogenes EGD-e
uguuuagccuuuuauc

SEQ ID NO: 776304 - RNA, 13 nt, Listeria monocytogenes EGD-e
uguuucuaaucca

SEQ ID NO: 776305 - RNA, 13 nt, Listeria monocytogenes EGD-e
uguuucuuuuguu

SEQ ID NO: 776306 - RNA, 16 nt, Listeria monocytogenes EGD-e
uguuuuauuuauagau

SEQ ID NO: 776307 - RNA, 18 nt, Listeria monocytogenes EGD-e
uguuuucccagaaaaaaa

SEQ ID NO: 776308 - RNA, 19 nt, Listeria monocytogenes EGD-e
uguuuucccagaaaaaaac

SEQ ID NO: 776309 - RNA, 22 nt, Listeria monocytogenes EGD-e
uguuuucccagaaaaaaacaaa

SEQ ID NO: 776310 - RNA, 14 nt, Listeria monocytogenes EGD-e
uguuuucgauauuu

SEQ ID NO: 776311 - RNA, 14 nt, Listeria monocytogenes EGD-e
uguuuguaaaaaua

SEQ ID NO: 776312 - RNA, 15 nt, Listeria monocytogenes EGD-e
uguuuuaauuucaaa

SEQ ID NO: 776313 - RNA, 13 nt, Listeria monocytogenes EGD-e
uggacuguuuccc

SEQ ID NO: 776314 - RNA, 15 nt, Listeria monocytogenes EGD-e
uggauaguuccagcu

SEQ ID NO: 776315 - RNA, 22 nt, Listeria monocytogenes EGD-e
uggauagagcgaauaagugaau

SEQ ID NO: 776316 - RNA, 14 nt, Listeria monocytogenes EGD-e
uggauaaaaaaaua

SEQ ID NO: 776317 - RNA, 17 nt, Listeria monocytogenes EGD-e
uggaucauauucuucua

SEQ ID NO: 776318 - RNA, 18 nt, Listeria monocytogenes EGD-e
uggaucaggauagcccgc

SEQ ID NO: 776319 - RNA, 17 nt, Listeria monocytogenes EGD-e
uggaugcacuuuuaauu

SEQ ID NO: 776320 - RNA, 15 nt, Listeria monocytogenes EGD-e
uggauuauucaauuc

SEQ ID NO: 776321 - RNA, 15 nt, Listeria monocytogenes EGD-e
uggcaacuucuggau

SEQ ID NO: 776322 - RNA, 19 nt, Listeria monocytogenes EGD-e
uggcacagcgcuuaaaaau

SEQ ID NO: 776323 - RNA, 14 nt, Listeria monocytogenes EGD-e
uggcaucagauucc

SEQ ID NO: 776324 - RNA, 15 nt, Listeria monocytogenes EGD-e
uggccaauuaaaaua

SEQ ID NO: 776325 - RNA, 16 nt, Listeria monocytogenes EGD-e
uggcgcaagugcuaaa

SEQ ID NO: 776326 - RNA, 14 nt, Listeria monocytogenes EGD-e
uggcgauucuucaa

SEQ ID NO: 776327 - RNA, 22 nt, Listeria monocytogenes EGD-e
ugggcaaccuaguuuuauuaua

SEQ ID NO: 776328 - RNA, 19 nt, Listeria monocytogenes EGD-e
ugggucgucguauguuuuc

SEQ ID NO: 776329 - RNA, 18 nt, Listeria monocytogenes EGD-e
ugggccguccaauucuuu

SEQ ID NO: 776330 - RNA, 19 nt, Listeria monocytogenes EGD-e
ugggccguccaauucuuuc

SEQ ID NO: 776331 - RNA, 21 nt, Listeria monocytogenes EGD-e
ugguguggaaauaaccauucc

SEQ ID NO: 776332 - RNA, 17 nt, Listeria monocytogenes EGD-e
ugguacguuuuuuauuu

SEQ ID NO: 776333 - RNA, 12 nt, Listeria monocytogenes EGD-e
ugguaaaaaacu

SEQ ID NO: 776334 - RNA, 16 nt, Listeria monocytogenes EGD-e
uguaggguuuggaaaa

SEQ ID NO: 776335 - RNA, 17 nt, Listeria monocytogenes EGD-e
uguagcucauuacaaaa

SEQ ID NO: 776336 - RNA, 16 nt, Listeria monocytogenes EGD-e
uguauagcuuaaaggu

SEQ ID NO: 776337 - RNA, 13 nt, Listeria monocytogenes EGD-e
uguaucuaaaauc

SEQ ID NO: 776338 - RNA, 16 nt, Listeria monocytogenes EGD-e
uguauuaaugacuguu

SEQ ID NO: 776339 - RNA, 22 nt, Listeria monocytogenes EGD-e
uguaccggucugugauuacucc

SEQ ID NO: 776340 - RNA, 16 nt, Listeria monocytogenes EGD-e
uguaauaguauacuuu

SEQ ID NO: 776341 - RNA, 22 nt, Listeria monocytogenes EGD-e
uguaauaguauacuuuuaauua

SEQ ID NO: 776342 - RNA, 12 nt, Listeria monocytogenes EGD-e
ugguuauuucuu

SEQ ID NO: 776343 - RNA, 14 nt, Listeria monocytogenes EGD-e
uguaaaccguaacu

SEQ ID NO: 776344 - RNA, 16 nt, Listeria monocytogenes EGD-e
uguaaaccguaacugu

SEQ ID NO: 776345 - RNA, 20 nt, Listeria monocytogenes EGD-e
uguaaacgcaguauguuucg

SEQ ID NO: 776346 - RNA, 14 nt, Listeria monocytogenes EGD-e
uguaagaagcuuuu

SEQ ID NO: 776347 - RNA, 14 nt, Listeria monocytogenes EGD-e
ucuucauuuuucua

SEQ ID NO: 776348 - RNA, 18 nt, Listeria monocytogenes EGD-e
ucuuccuuuuguuuuaau

SEQ ID NO: 776349 - RNA, 19 nt, Listeria monocytogenes EGD-e
ucuucggauucucuucuaa

SEQ ID NO: 776350 - RNA, 17 nt, Listeria monocytogenes EGD-e
ucuucgcuuguuuugau

SEQ ID NO: 776351 - RNA, 20 nt, Listeria monocytogenes EGD-e
ucuucgcuuguuuugaugcu

SEQ ID NO: 776352 - RNA, 13 nt, Listeria monocytogenes EGD-e
ucuucuaagaaaa

SEQ ID NO: 776353 - RNA, 19 nt, Listeria monocytogenes EGD-e
ucuucuaagaaaaaaaguu

SEQ ID NO: 776354 - RNA, 23 nt, Listeria monocytogenes EGD-e
ucuucuauauuaaugucaauuau

SEQ ID NO: 776355 - RNA, 22 nt, Listeria monocytogenes EGD-e
ucuucugucacaucuguuccuu

SEQ ID NO: 776356 - RNA, 16 nt, Listeria monocytogenes EGD-e
ucuucuguuaacauuu

SEQ ID NO: 776357 - RNA, 12 nt, Listeria monocytogenes EGD-e
ucuucuuugauu

SEQ ID NO: 776358 - RNA, 19 nt, Listeria monocytogenes EGD-e
ucuucuuugauuuuuucuu

SEQ ID NO: 776359 - RNA, 13 nt, Listeria monocytogenes EGD-e
ucuugaugccauc

SEQ ID NO: 776360 - RNA, 21 nt, Listeria monocytogenes EGD-e
ucuucuuuuugauuaaugauu

SEQ ID NO: 776361 - RNA, 22 nt, Listeria monocytogenes EGD-e
ucuucuuuuugauuaaugauuu

SEQ ID NO: 776362 - RNA, 13 nt, Listeria monocytogenes EGD-e
ucuuuaaacaagc

SEQ ID NO: 776363 - RNA, 17 nt, Listeria monocytogenes EGD-e
ucuuuacauauuccaaa

SEQ ID NO: 776364 - RNA, 11 nt, Listeria monocytogenes EGD-e
ucuuuaaaaac

SEQ ID NO: 776365 - RNA, 22 nt, Listeria monocytogenes EGD-e
ucuugauccaaguuuuuuaauu

SEQ ID NO: 776366 - RNA, 14 nt, Listeria monocytogenes EGD-e
ucuugcaagagcag

SEQ ID NO: 776367 - RNA, 20 nt, Listeria monocytogenes EGD-e
ucuuguaaaagcgaacuuaa

SEQ ID NO: 776368 - RNA, 13 nt, Listeria monocytogenes EGD-e
ucuuguacacauu

SEQ ID NO: 776369 - RNA, 22 nt, Listeria monocytogenes EGD-e
ucugggcucguugcagaaacaa

SEQ ID NO: 776370 - RNA, 23 nt, Listeria monocytogenes EGD-e
ucuggauuuacuacgcgacaaag

SEQ ID NO: 776371 - RNA, 23 nt, Listeria monocytogenes EGD-e
ucuggauuucuccguaagaagaa

SEQ ID NO: 776372 - RNA, 15 nt, Listeria monocytogenes EGD-e
ucuggaucauauucu

SEQ ID NO: 776373 - RNA, 13 nt, Listeria monocytogenes EGD-e
ucuguacuccuug

SEQ ID NO: 776374 - RNA, 15 nt, Listeria monocytogenes EGD-e
ucuguuuuuucuuug

SEQ ID NO: 776375 - RNA, 15 nt, Listeria monocytogenes EGD-e
ucugaaaauguugca

SEQ ID NO: 776376 - RNA, 22 nt, Listeria monocytogenes EGD-e
ucugccgauuauccuguaauuc

SEQ ID NO: 776377 - RNA, 19 nt, Listeria monocytogenes EGD-e
ucugccuaccaaaaccauu

SEQ ID NO: 776378 - RNA, 23 nt, Listeria monocytogenes EGD-e
ucugauugguccugcugaaauag

SEQ ID NO: 776379 - RNA, 22 nt, Listeria monocytogenes EGD-e
ucgguucggagacagaaaaaga

SEQ ID NO: 776380 - RNA, 15 nt, Listeria monocytogenes EGD-e
ucuaaauuuuaaucu

SEQ ID NO: 776381 - RNA, 16 nt, Listeria monocytogenes EGD-e
ucuaacauuaauucau

SEQ ID NO: 776382 - RNA, 18 nt, Listeria monocytogenes EGD-e
ucguugcagaaacaauca

SEQ ID NO: 776383 - RNA, 22 nt, Listeria monocytogenes EGD-e
ucguuuuaaagcuugauuuaau

SEQ ID NO: 776384 - RNA, 18 nt, Listeria monocytogenes EGD-e
ucuacuagugaaauagaa

SEQ ID NO: 776385 - RNA, 14 nt, Listeria monocytogenes EGD-e
ucuaaucaaaugca

SEQ ID NO: 776386 - RNA, 14 nt, Listeria monocytogenes EGD-e
ucuauauuaauguc

SEQ ID NO: 776387 - RNA, 22 nt, Listeria monocytogenes EGD-e
ucuagccgcucgucuaaauuga

SEQ ID NO: 776388 - RNA, 22 nt, Listeria monocytogenes EGD-e
ucuagcgucacaauacccgaag

SEQ ID NO: 776389 - RNA, 16 nt, Listeria monocytogenes EGD-e
ucuacuucuaaauagu

SEQ ID NO: 776390 - RNA, 15 nt, Listeria monocytogenes EGD-e
ucuacuuuuaaaauu

SEQ ID NO: 776391 - RNA, 17 nt, Listeria monocytogenes EGD-e
ucuaguagcaauuuuaa

SEQ ID NO: 776392 - RNA, 17 nt, Listeria monocytogenes EGD-e
ucuauaauuuauaaaag

SEQ ID NO: 776393 - RNA, 16 nt, Listeria monocytogenes EGD-e
ucuccguaagaagaaa

SEQ ID NO: 776394 - RNA, 17 nt, Listeria monocytogenes EGD-e
ucuccuuaaauaaaaac

SEQ ID NO: 776395 - RNA, 20 nt, Listeria monocytogenes EGD-e
ucucauaagagaauaucuau

SEQ ID NO: 776396 - RNA, 20 nt, Listeria monocytogenes EGD-e
ucuccaccaaguucuguugg

SEQ ID NO: 776397 - RNA, 14 nt, Listeria monocytogenes EGD-e
ucucacuaaacaua

SEQ ID NO: 776398 - RNA, 18 nt, Listeria monocytogenes EGD-e
ucgcgguagcuucaauca

SEQ ID NO: 776399 - RNA, 13 nt, Listeria monocytogenes EGD-e
ucgcuauucuauu

SEQ ID NO: 776400 - RNA, 14 nt, Listeria monocytogenes EGD-e
ucgcucaucaucaa

SEQ ID NO: 776401 - RNA, 14 nt, Listeria monocytogenes EGD-e
ucggagacagaaaa

SEQ ID NO: 776402 - RNA, 21 nt, Listeria monocytogenes EGD-e
ucggaccuuuugcuucuucca

SEQ ID NO: 776403 - RNA, 21 nt, Listeria monocytogenes EGD-e
ucgccaguugcugaauaucaa

SEQ ID NO: 776404 - RNA, 15 nt, Listeria monocytogenes EGD-e
ucgcggauaauaauc

SEQ ID NO: 776405 - RNA, 14 nt, Listeria monocytogenes EGD-e
ucgcaaaaaauaau

SEQ ID NO: 776406 - RNA, 19 nt, Listeria monocytogenes EGD-e
ucgcaaaaaauaauaucuu

SEQ ID NO: 776407 - RNA, 14 nt, Listeria monocytogenes EGD-e
ucgcaaaaaucauc

SEQ ID NO: 776408 - RNA, 14 nt, Listeria monocytogenes EGD-e
ucgcaaaagcaaac

SEQ ID NO: 776409 - RNA, 16 nt, Listeria monocytogenes EGD-e
ucgcaaaaugguuucu

SEQ ID NO: 776410 - RNA, 22 nt, Listeria monocytogenes EGD-e
ucgcagcagauuuugcgaaagc

SEQ ID NO: 776411 - RNA, 19 nt, Listeria monocytogenes EGD-e
ucgcauugauuuuugaaua

SEQ ID NO: 776412 - RNA, 16 nt, Listeria monocytogenes EGD-e
ucgccaccuucaauuu

SEQ ID NO: 776413 - RNA, 15 nt, Listeria monocytogenes EGD-e
ucgauuuuuucaacg

SEQ ID NO: 776414 - RNA, 14 nt, Listeria monocytogenes EGD-e
uccguaagaagaaa

SEQ ID NO: 776415 - RNA, 16 nt, Listeria monocytogenes EGD-e
uccguaagaagaaaau

SEQ ID NO: 776416 - RNA, 19 nt, Listeria monocytogenes EGD-e
uccgguuuuugcuccauug

SEQ ID NO: 776417 - RNA, 15 nt, Listeria monocytogenes EGD-e
uccgcucuuuuuuau

SEQ ID NO: 776418 - RNA, 21 nt, Listeria monocytogenes EGD-e
uccgcuuugguuccuugcuua

SEQ ID NO: 776419 - RNA, 20 nt, Listeria monocytogenes EGD-e
uccgcgaauagcauaauaga

SEQ ID NO: 776420 - RNA, 22 nt, Listeria monocytogenes EGD-e
uccucuaagucugcuuuuucaa

SEQ ID NO: 776421 - RNA, 22 nt, Listeria monocytogenes EGD-e
uccuaggcgcucuuuaauaauu

SEQ ID NO: 776422 - RNA, 18 nt, Listeria monocytogenes EGD-e
uccucauugaggaauacu

SEQ ID NO: 776423 - RNA, 13 nt, Listeria monocytogenes EGD-e
uccuccuaauugu

SEQ ID NO: 776424 - RNA, 19 nt, Listeria monocytogenes EGD-e
uccguuaaucugauuaaaa

SEQ ID NO: 776425 - RNA, 14 nt, Listeria monocytogenes EGD-e
uccguuucauuuuu

SEQ ID NO: 776426 - RNA, 17 nt, Listeria monocytogenes EGD-e
uccuaauuuuacuucua

SEQ ID NO: 776427 - RNA, 22 nt, Listeria monocytogenes EGD-e
uccguuuguugcgccacuucua

SEQ ID NO: 776428 - RNA, 21 nt, Listeria monocytogenes EGD-e
uccccuuuuuagaaugaagau

SEQ ID NO: 776429 - RNA, 22 nt, Listeria monocytogenes EGD-e
ucccgcugaacuuggaaagugg

SEQ ID NO: 776430 - RNA, 16 nt, Listeria monocytogenes EGD-e
ucccggucauuuucac

SEQ ID NO: 776431 - RNA, 15 nt, Listeria monocytogenes EGD-e
ucccuauaaaaacau

SEQ ID NO: 776432 - RNA, 17 nt, Listeria monocytogenes EGD-e
ucccucauguucaaucu

SEQ ID NO: 776433 - RNA, 21 nt, Listeria monocytogenes EGD-e
ucccuuuacuugcaaaugcuu

SEQ ID NO: 776434 - RNA, 20 nt, Listeria monocytogenes EGD-e
ucccuuuuuucauccuuuuu

SEQ ID NO: 776435 - RNA, 22 nt, Listeria monocytogenes EGD-e
uccgaaccaagcacauccgcau

SEQ ID NO: 776436 - RNA, 22 nt, Listeria monocytogenes EGD-e
uccgaccuguucguacauuuuu

SEQ ID NO: 776437 - RNA, 16 nt, Listeria monocytogenes EGD-e
uccccaccaggcaaaa

SEQ ID NO: 776438 - RNA, 19 nt, Listeria monocytogenes EGD-e
ucccauugcgaauaacaag

SEQ ID NO: 776439 - RNA, 16 nt, Listeria monocytogenes EGD-e
uccauuacuuuaauuu

SEQ ID NO: 776440 - RNA, 17 nt, Listeria monocytogenes EGD-e
ucccaauagaaaccauc

SEQ ID NO: 776441 - RNA, 15 nt, Listeria monocytogenes EGD-e
uccauuuuucuucug

SEQ ID NO: 776442 - RNA, 18 nt, Listeria monocytogenes EGD-e
ucccagaaaaaaacaaau

SEQ ID NO: 776443 - RNA, 18 nt, Listeria monocytogenes EGD-e
ucccacaucgcuucugau

SEQ ID NO: 776444 - RNA, 14 nt, Listeria monocytogenes EGD-e
ucccaauuuaauuu

SEQ ID NO: 776445 - RNA, 16 nt, Listeria monocytogenes EGD-e
uccauauuuucucuaa

SEQ ID NO: 776446 - RNA, 15 nt, Listeria monocytogenes EGD-e
uccaucauaauccca

SEQ ID NO: 776447 - RNA, 18 nt, Listeria monocytogenes EGD-e
uccauagaauguauacac

SEQ ID NO: 776448 - RNA, 20 nt, Listeria monocytogenes EGD-e
uccauagaauguauacacua

SEQ ID NO: 776449 - RNA, 24 nt, Listeria monocytogenes EGD-e
uccauacuuucugccaaauugguc

SEQ ID NO: 776450 - RNA, 14 nt, Listeria monocytogenes EGD-e
uccaguuaaacaaa

SEQ ID NO: 776451 - RNA, 14 nt, Listeria monocytogenes EGD-e
uccagcuaaguuuu

SEQ ID NO: 776452 - RNA, 22 nt, Listeria monocytogenes EGD-e
uccagcuaaguuuucuaaacua

SEQ ID NO: 776453 - RNA, 19 nt, Listeria monocytogenes EGD-e
uccagcgucuaaaaaugca

SEQ ID NO: 776454 - RNA, 22 nt, Listeria monocytogenes EGD-e
uccaccuguauuaaugacuguu

SEQ ID NO: 776455 - RNA, 19 nt, Listeria monocytogenes EGD-e
uccacgauggaaccauuca

SEQ ID NO: 776456 - RNA, 14 nt, Listeria monocytogenes EGD-e
uccaccagcuacuu

SEQ ID NO: 776457 - RNA, 14 nt, Listeria monocytogenes EGD-e
uccaccaaaaacuu

SEQ ID NO: 776458 - RNA, 16 nt, Listeria monocytogenes EGD-e
uccacauaacggaaau

SEQ ID NO: 776459 - RNA, 19 nt, Listeria monocytogenes EGD-e
uccacacugguuuuuuaau

SEQ ID NO: 776460 - RNA, 19 nt, Listeria monocytogenes EGD-e
uccacacugguuuuuugau

SEQ ID NO: 776461 - RNA, 14 nt, Listeria monocytogenes EGD-e
uccaacguuuuaau

SEQ ID NO: 776462 - RNA, 23 nt, Listeria monocytogenes EGD-e
uccaagaacagcaauuuguuuau

SEQ ID NO: 776463 - RNA, 17 nt, Listeria monocytogenes EGD-e
uccaaguuuuuuaauuu

SEQ ID NO: 776464 - RNA, 16 nt, Listeria monocytogenes EGD-e
uccaagcggguuuucu

SEQ ID NO: 776465 - RNA, 21 nt, Listeria monocytogenes EGD-e
uccaaucagcaagauaacuca

SEQ ID NO: 776466 - RNA, 15 nt, Listeria monocytogenes EGD-e
uccaauucuuucgcu

SEQ ID NO: 776467 - RNA, 22 nt, Listeria monocytogenes EGD-e
ucagcuaaauauuuaauuuuau

SEQ ID NO: 776468 - RNA, 19 nt, Listeria monocytogenes EGD-e
ucagcucuauaauuuauaa

SEQ ID NO: 776469 - RNA, 20 nt, Listeria monocytogenes EGD-e
ucagcucuuuuuuuauuuuc

SEQ ID NO: 776470 - RNA, 17 nt, Listeria monocytogenes EGD-e
ucaguuuauaaauaccu

SEQ ID NO: 776471 - RNA, 12 nt, Listeria monocytogenes EGD-e
ucauaaacauuu

SEQ ID NO: 776472 - RNA, 15 nt, Listeria monocytogenes EGD-e
ucauaauaggagaca

SEQ ID NO: 776473 - RNA, 17 nt, Listeria monocytogenes EGD-e
ucauauaauuuuuucau

SEQ ID NO: 776474 - RNA, 15 nt, Listeria monocytogenes EGD-e
ucaucauaaacauuu

SEQ ID NO: 776475 - RNA, 23 nt, Listeria monocytogenes EGD-e
ucaucggagacaguuuguauaag

SEQ ID NO: 776476 - RNA, 14 nt, Listeria monocytogenes EGD-e
ucaucuuaucaagu

SEQ ID NO: 776477 - RNA, 18 nt, Listeria monocytogenes EGD-e
ucaucuuuauaaaaugca

SEQ ID NO: 776478 - RNA, 19 nt, Listeria monocytogenes EGD-e
ucaugaaacuuuaacaaaa

SEQ ID NO: 776479 - RNA, 22 nt, Listeria monocytogenes EGD-e
ucaugccuucaaacacuucuaa

SEQ ID NO: 776480 - RNA, 14 nt, Listeria monocytogenes EGD-e
ucauggaaacaaag

SEQ ID NO: 776481 - RNA, 20 nt, Listeria monocytogenes EGD-e
ucauuuuuuugauuaauaaa

SEQ ID NO: 776482 - RNA, 13 nt, Listeria monocytogenes EGD-e
uccaaaaucgcau

SEQ ID NO: 776483 - RNA, 20 nt, Listeria monocytogenes EGD-e
uccaaagagccauaaaauua

SEQ ID NO: 776484 - RNA, 18 nt, Listeria monocytogenes EGD-e
ucauugcuuuguguuaau

SEQ ID NO: 776485 - RNA, 22 nt, Listeria monocytogenes EGD-e
ucauuuaacaucagauuaaaua

SEQ ID NO: 776486 - RNA, 22 nt, Listeria monocytogenes EGD-e
ucauucuuuuuuauacgccuuu

SEQ ID NO: 776487 - RNA, 20 nt, Listeria monocytogenes EGD-e
ucauucgguaagaccaccaa

SEQ ID NO: 776488 - RNA, 22 nt, Listeria monocytogenes EGD-e
ucauucgguaagaccaccaaga

SEQ ID NO: 776489 - RNA, 15 nt, Listeria monocytogenes EGD-e
ucauuauuaaacuca

SEQ ID NO: 776490 - RNA, 13 nt, Listeria monocytogenes EGD-e
ucauucaaugagu

SEQ ID NO: 776491 - RNA, 17 nt, Listeria monocytogenes EGD-e
ucauguucaaucucauc

SEQ ID NO: 776492 - RNA, 18 nt, Listeria monocytogenes EGD-e
ucauuaaagcuauauaau

SEQ ID NO: 776493 - RNA, 20 nt, Listeria monocytogenes EGD-e
ggaccuuuugcuucuuccau

SEQ ID NO: 776494 - RNA, 13 nt, Listeria monocytogenes EGD-e
ggacaagcccagc

SEQ ID NO: 776495 - RNA, 14 nt, Listeria monocytogenes EGD-e
ggacaagcccagca

SEQ ID NO: 776496 - RNA, 22 nt, Listeria monocytogenes EGD-e
ggaauacuguuuuugauuuaau

SEQ ID NO: 776497 - RNA, 13 nt, Listeria monocytogenes EGD-e
ggagaaaaagugg

SEQ ID NO: 776498 - RNA, 16 nt, Listeria monocytogenes EGD-e
ggagugucaguguuuu

SEQ ID NO: 776499 - RNA, 16 nt, Listeria monocytogenes EGD-e
ggauuuuucaaaucaa

SEQ ID NO: 776500 - RNA, 12 nt, Listeria monocytogenes EGD-e
ggcaaaacaagu

SEQ ID NO: 776501 - RNA, 14 nt, Listeria monocytogenes EGD-e
ggcaaauaacguug

SEQ ID NO: 776502 - RNA, 15 nt, Listeria monocytogenes EGD-e
ggcaacaaagaagaa

SEQ ID NO: 776503 - RNA, 19 nt, Listeria monocytogenes EGD-e
ggcaacuucaaaauuacua

SEQ ID NO: 776504 - RNA, 21 nt, Listeria monocytogenes EGD-e
ggcaguuugauaauauugaua

SEQ ID NO: 776505 - RNA, 19 nt, Listeria monocytogenes EGD-e
ggcgcgggaugguauacua

SEQ ID NO: 776506 - RNA, 17 nt, Listeria monocytogenes EGD-e
ggcuaauuacuagcuuu

SEQ ID NO: 776507 - RNA, 18 nt, Listeria monocytogenes EGD-e
ggccuacuuuuuugcuuu

SEQ ID NO: 776508 - RNA, 12 nt, Listeria monocytogenes EGD-e
ggcgauucuuca

SEQ ID NO: 776509 - RNA, 13 nt, Listeria monocytogenes EGD-e
ggcuuuuuaugca

SEQ ID NO: 776510 - RNA, 16 nt, Listeria monocytogenes EGD-e
gggcccgaaaaucgag

SEQ ID NO: 776511 - RNA, 21 nt, Listeria monocytogenes EGD-e
gggcauaucuuuugagauaau

SEQ ID NO: 776512 - RNA, 20 nt, Listeria monocytogenes EGD-e
gguaagaccaccaagaauaa

SEQ ID NO: 776513 - RNA, 11 nt, Listeria monocytogenes EGD-e
gguaacaucuu

SEQ ID NO: 776514 - RNA, 22 nt, Listeria monocytogenes EGD-e
gguauacaccgaacuagcauca

SEQ ID NO: 776515 - RNA, 16 nt, Listeria monocytogenes EGD-e
gguacaguagaagcaa

SEQ ID NO: 776516 - RNA, 22 nt, Listeria monocytogenes EGD-e
gguaaucgcagggcagaaaaca

SEQ ID NO: 776517 - RNA, 13 nt, Listeria monocytogenes EGD-e
ggucaggauuaaa

SEQ ID NO: 776518 - RNA, 18 nt, Listeria monocytogenes EGD-e
ggucugugauuacuccaa

SEQ ID NO: 776519 - RNA, 16 nt, Listeria monocytogenes EGD-e
guaaggcauguaucuu

SEQ ID NO: 776520 - RNA, 18 nt, Listeria monocytogenes EGD-e
guaaggcauguaucuuaa

SEQ ID NO: 776521 - RNA, 14 nt, Listeria monocytogenes EGD-e
guaauaggauuuua

SEQ ID NO: 776522 - RNA, 14 nt, Listeria monocytogenes EGD-e
guaauaaaugguug

SEQ ID NO: 776523 - RNA, 15 nt, Listeria monocytogenes EGD-e
guaaguagcauuuuc

SEQ ID NO: 776524 - RNA, 17 nt, Listeria monocytogenes EGD-e
guaaguagcauuuucga

SEQ ID NO: 776525 - RNA, 19 nt, Listeria monocytogenes EGD-e
guaacaucuuccacuccag

SEQ ID NO: 776526 - RNA, 19 nt, Listeria monocytogenes EGD-e
guaacuaaaaaucauuuaa

SEQ ID NO: 776527 - RNA, 23 nt, Listeria monocytogenes EGD-e
guaacuaaaaaucauuuaaacac

SEQ ID NO: 776528 - RNA, 14 nt, Listeria monocytogenes EGD-e
guaacuaaaauauu

SEQ ID NO: 776529 - RNA, 15 nt, Listeria monocytogenes EGD-e
guaacgucuacuuuu

SEQ ID NO: 776530 - RNA, 13 nt, Listeria monocytogenes EGD-e
guaacucuuccaa

SEQ ID NO: 776531 - RNA, 15 nt, Listeria monocytogenes EGD-e
guaacuguugaaaag

SEQ ID NO: 776532 - RNA, 16 nt, Listeria monocytogenes EGD-e
guaaaaucuuuuaaua

SEQ ID NO: 776533 - RNA, 23 nt, Listeria monocytogenes EGD-e
guaacauagcuacaauuaaaaua

SEQ ID NO: 776534 - RNA, 17 nt, Listeria monocytogenes EGD-e
guaaauaggauuaaaau

SEQ ID NO: 776535 - RNA, 19 nt, Listeria monocytogenes EGD-e
guaaauaggauuaaaauaa

SEQ ID NO: 776536 - RNA, 15 nt, Listeria monocytogenes EGD-e
guacccguaauauau

SEQ ID NO: 776537 - RNA, 19 nt, Listeria monocytogenes EGD-e
guacccguaauauauucaa

SEQ ID NO: 776538 - RNA, 17 nt, Listeria monocytogenes EGD-e
guaaucuguaaaaauaa

SEQ ID NO: 776539 - RNA, 15 nt, Listeria monocytogenes EGD-e
guacuaauucugcga

SEQ ID NO: 776540 - RNA, 12 nt, Listeria monocytogenes EGD-e
guagagcuucug

SEQ ID NO: 776541 - RNA, 18 nt, Listeria monocytogenes EGD-e
gucaaugcccaguaaaac

SEQ ID NO: 776542 - RNA, 22 nt, Listeria monocytogenes EGD-e
gucaacaucauuagauuugcaa

SEQ ID NO: 776543 - RNA, 18 nt, Listeria monocytogenes EGD-e
guauauguuuuauuuaua

SEQ ID NO: 776544 - RNA, 14 nt, Listeria monocytogenes EGD-e
guauaugcuacuau

SEQ ID NO: 776545 - RNA, 16 nt, Listeria monocytogenes EGD-e
guauaugcuacuauca

SEQ ID NO: 776546 - RNA, 12 nt, Listeria monocytogenes EGD-e
guauacccuuuu

SEQ ID NO: 776547 - RNA, 19 nt, Listeria monocytogenes EGD-e
gucaauuugacgcaaggaa

SEQ ID NO: 776548 - RNA, 15 nt, Listeria monocytogenes EGD-e
gucacgucccauugc

SEQ ID NO: 776549 - RNA, 17 nt, Listeria monocytogenes EGD-e
gucauaaaacuuucaca

SEQ ID NO: 776550 - RNA, 23 nt, Listeria monocytogenes EGD-e
gugaugaaaccaaauaugcuaua

SEQ ID NO: 776551 - RNA, 20 nt, Listeria monocytogenes EGD-e
gucgcugucaaauucuucuc

SEQ ID NO: 776552 - RNA, 20 nt, Listeria monocytogenes EGD-e
gugguguuuuuuguuuguaa

SEQ ID NO: 776553 - RNA, 19 nt, Listeria monocytogenes EGD-e
guguaaucacuauugaaug

SEQ ID NO: 776554 - RNA, 18 nt, Listeria monocytogenes EGD-e
gugugguguuuuuuguuu

SEQ ID NO: 776555 - RNA, 23 nt, Listeria monocytogenes EGD-e
guguugauaaagauaauaaccgc

SEQ ID NO: 776556 - RNA, 14 nt, Listeria monocytogenes EGD-e
guuaaacaaacaca

SEQ ID NO: 776557 - RNA, 17 nt, Listeria monocytogenes EGD-e
guuaaacuaauaaaaac

SEQ ID NO: 776558 - RNA, 14 nt, Listeria monocytogenes EGD-e
guuaauaaaaucau

SEQ ID NO: 776559 - RNA, 12 nt, Listeria monocytogenes EGD-e
guuaauucuguu

SEQ ID NO: 776560 - RNA, 21 nt, Listeria monocytogenes EGD-e
guuacuccuccaaauuauaau

SEQ ID NO: 776561 - RNA, 15 nt, Listeria monocytogenes EGD-e
guucauuugaaaaag

SEQ ID NO: 776562 - RNA, 13 nt, Listeria monocytogenes EGD-e
guucacuaaguuu

SEQ ID NO: 776563 - RNA, 15 nt, Listeria monocytogenes EGD-e
guucaggguuuguuc

SEQ ID NO: 776564 - RNA, 13 nt, Listeria monocytogenes EGD-e
guucuugccaaaa

SEQ ID NO: 776565 - RNA, 16 nt, Listeria monocytogenes EGD-e
guucuugccaaaaagg

SEQ ID NO: 776566 - RNA, 17 nt, Listeria monocytogenes EGD-e
guucuuuaucgccaaag

SEQ ID NO: 776567 - RNA, 12 nt, Listeria monocytogenes EGD-e
guucuaaaauau

SEQ ID NO: 776568 - RNA, 22 nt, Listeria monocytogenes EGD-e
guucuaaacguucuuccuuuuu

SEQ ID NO: 776569 - RNA, 22 nt, Listeria monocytogenes EGD-e
guucuuccuuuuucauuauaag

SEQ ID NO: 776570 - RNA, 18 nt, Listeria monocytogenes EGD-e
guucuuuuuuaugaaaaa

SEQ ID NO: 776571 - RNA, 15 nt, Listeria monocytogenes EGD-e
guugaacuucucucc

SEQ ID NO: 776572 - RNA, 22 nt, Listeria monocytogenes EGD-e
guugcgguuucuuuuauuuuuc

SEQ ID NO: 776573 - RNA, 23 nt, Listeria monocytogenes EGD-e
guugcauuaaaaaggaauuuuuc

SEQ ID NO: 776574 - RNA, 14 nt, Listeria monocytogenes EGD-e
guugcauuuggaga

SEQ ID NO: 776575 - RNA, 21 nt, Listeria monocytogenes EGD-e
guugcccaucuuuuuucucaa

SEQ ID NO: 776576 - RNA, 19 nt, Listeria monocytogenes EGD-e
guugcugggaauauccuug

SEQ ID NO: 776577 - RNA, 20 nt, Listeria monocytogenes EGD-e
guuggaauaccauuguagcu

SEQ ID NO: 776578 - RNA, 17 nt, Listeria monocytogenes EGD-e
guugcuuuuauuuuuaa

SEQ ID NO: 776579 - RNA, 12 nt, Listeria monocytogenes EGD-e
guugcuuuuguu

SEQ ID NO: 776580 - RNA, 13 nt, Listeria monocytogenes EGD-e
guugcuuuuguuu

SEQ ID NO: 776581 - RNA, 19 nt, Listeria monocytogenes EGD-e
guuguaaaccguaacuguu

SEQ ID NO: 776582 - RNA, 20 nt, Listeria monocytogenes EGD-e
guuucgauaucuucaugucc

SEQ ID NO: 776583 - RNA, 22 nt, Listeria monocytogenes EGD-e
guuugacccgcuaagaagaguc

SEQ ID NO: 776584 - RNA, 13 nt, Listeria monocytogenes EGD-e
guuucuuuuugcu

SEQ ID NO: 776585 - RNA, 14 nt, Listeria monocytogenes EGD-e
guuguucuaacauu

SEQ ID NO: 776586 - RNA, 19 nt, Listeria monocytogenes EGD-e
guuguuuucccagaaaaaa

SEQ ID NO: 776587 - RNA, 15 nt, Listeria monocytogenes EGD-e
uaaaauccaauaaua

SEQ ID NO: 776588 - RNA, 21 nt, Listeria monocytogenes EGD-e
uaaaaugcacaugauaaccag

SEQ ID NO: 776589 - RNA, 17 nt, Listeria monocytogenes EGD-e
uaaaauggauaaaaaaa

SEQ ID NO: 776590 - RNA, 21 nt, Listeria monocytogenes EGD-e
uaaaauaguuuuuuucauuaa

SEQ ID NO: 776591 - RNA, 17 nt, Listeria monocytogenes EGD-e
uaaacaagcuuugugga

SEQ ID NO: 776592 - RNA, 22 nt, Listeria monocytogenes EGD-e
uaaacaaauucuccuuaaauaa

SEQ ID NO: 776593 - RNA, 19 nt, Listeria monocytogenes EGD-e
uaaacaacccauuugcauu

SEQ ID NO: 776594 - RNA, 16 nt, Listeria monocytogenes EGD-e
uaaaaggacacccaua

SEQ ID NO: 776595 - RNA, 17 nt, Listeria monocytogenes EGD-e
uaaaagcuucuauuugu

SEQ ID NO: 776596 - RNA, 17 nt, Listeria monocytogenes EGD-e
uaaaagaggauuuucca

SEQ ID NO: 776597 - RNA, 15 nt, Listeria monocytogenes EGD-e
uaaaaaccuaguagu

SEQ ID NO: 776598 - RNA, 20 nt, Listeria monocytogenes EGD-e
uaaaaaggaauuuuuccauu

SEQ ID NO: 776599 - RNA, 16 nt, Listeria monocytogenes EGD-e
uaaaaagcuuauuaaa

SEQ ID NO: 776600 - RNA, 19 nt, Listeria monocytogenes EGD-e
uaaaaagcuuauuaaacau

SEQ ID NO: 776601 - RNA, 19 nt, Listeria monocytogenes EGD-e
uaaacuaccaucauauaau

SEQ ID NO: 776602 - RNA, 19 nt, Listeria monocytogenes EGD-e
uaaaccgauaauuuucauu

SEQ ID NO: 776603 - RNA, 22 nt, Listeria monocytogenes EGD-e
uaaacauaauguacccaacaau

SEQ ID NO: 776604 - RNA, 16 nt, Listeria monocytogenes EGD-e
uaaagcuaacgcaauu

SEQ ID NO: 776605 - RNA, 14 nt, Listeria monocytogenes EGD-e
uaaaggaaaacucu

SEQ ID NO: 776606 - RNA, 15 nt, Listeria monocytogenes EGD-e
uaaaggcaacaaaga

SEQ ID NO: 776607 - RNA, 16 nt, Listeria monocytogenes EGD-e
uaaaggcaacaaagaa

SEQ ID NO: 776608 - RNA, 17 nt, Listeria monocytogenes EGD-e
uaaaggcaacaaagaag

SEQ ID NO: 776609 - RNA, 16 nt, Listeria monocytogenes EGD-e
uaaaggauaaaaauug

SEQ ID NO: 776610 - RNA, 23 nt, Listeria monocytogenes EGD-e
uaaagaaauaacuacuauuuaaa

SEQ ID NO: 776611 - RNA, 19 nt, Listeria monocytogenes EGD-e
uaaagaacuagauuuaaua

SEQ ID NO: 776612 - RNA, 21 nt, Listeria monocytogenes EGD-e
uaaagaacuagauuuaauaaa

SEQ ID NO: 776613 - RNA, 16 nt, Listeria monocytogenes EGD-e
uaaauccguugucuuc

SEQ ID NO: 776614 - RNA, 16 nt, Listeria monocytogenes EGD-e
uaaauccauuucauuc

SEQ ID NO: 776615 - RNA, 22 nt, Listeria monocytogenes EGD-e
uaaauccauuucauucuuuuuu

SEQ ID NO: 776616 - RNA, 23 nt, Listeria monocytogenes EGD-e
uaaauauacacaaaguaaaaagg

SEQ ID NO: 776617 - RNA, 20 nt, Listeria monocytogenes EGD-e
uaaauauaacuuuuuuucuu

SEQ ID NO: 776618 - RNA, 14 nt, Listeria monocytogenes EGD-e
uaaauauuuaauuu

SEQ ID NO: 776619 - RNA, 18 nt, Listeria monocytogenes EGD-e
uaaaguuagauuaaaaau

SEQ ID NO: 776620 - RNA, 16 nt, Listeria monocytogenes EGD-e
uaaauacgaaaaacau

SEQ ID NO: 776621 - RNA, 17 nt, Listeria monocytogenes EGD-e
uaaauacgaaaaacauu

SEQ ID NO: 776622 - RNA, 16 nt, Listeria monocytogenes EGD-e
uaaauaggauuaaaau

SEQ ID NO: 776623 - RNA, 18 nt, Listeria monocytogenes EGD-e
uaaauaggauuaaaauaa

SEQ ID NO: 776624 - RNA, 18 nt, Listeria monocytogenes EGD-e
uaaauaggcccauuaaaa

SEQ ID NO: 776625 - RNA, 23 nt, Listeria monocytogenes EGD-e
uaacaggugugucauuuuugcug

SEQ ID NO: 776626 - RNA, 16 nt, Listeria monocytogenes EGD-e
uaacaucagauuaaau

SEQ ID NO: 776627 - RNA, 17 nt, Listeria monocytogenes EGD-e
uaacaacaagcaaaaca

SEQ ID NO: 776628 - RNA, 14 nt, Listeria monocytogenes EGD-e
uaacaaaauaauaa

SEQ ID NO: 776629 - RNA, 20 nt, Listeria monocytogenes EGD-e
uaaauuuuuuugaaaaaaca

SEQ ID NO: 776630 - RNA, 23 nt, Listeria monocytogenes EGD-e
uaaauuuuuuugaaaaaacaucu

SEQ ID NO: 776631 - RNA, 18 nt, Listeria monocytogenes EGD-e
uaacacuuauaugaaaac

SEQ ID NO: 776632 - RNA, 18 nt, Listeria monocytogenes EGD-e
uaacaacuaauuuuucga

SEQ ID NO: 776633 - RNA, 20 nt, Listeria monocytogenes EGD-e
uaacaacuaauuuuucgauu

SEQ ID NO: 776634 - RNA, 20 nt, Listeria monocytogenes EGD-e
uaacgccgguugauaauaau

SEQ ID NO: 776635 - RNA, 14 nt, Listeria monocytogenes EGD-e
uaacuaaaaaucau

SEQ ID NO: 776636 - RNA, 17 nt, Listeria monocytogenes EGD-e
uaacguuuucccgcuga

SEQ ID NO: 776637 - RNA, 16 nt, Listeria monocytogenes EGD-e
uaaccccaaaaugcua

SEQ ID NO: 776638 - RNA, 12 nt, Listeria monocytogenes EGD-e
uaacucuuccaa

SEQ ID NO: 776639 - RNA, 17 nt, Listeria monocytogenes EGD-e
uaacucggggugaaaau

SEQ ID NO: 776640 - RNA, 13 nt, Listeria monocytogenes EGD-e
uaacuaauaaccc

SEQ ID NO: 776641 - RNA, 13 nt, Listeria monocytogenes EGD-e
uaagaaaaaaagu

SEQ ID NO: 776642 - RNA, 16 nt, Listeria monocytogenes EGD-e
uaagaagauauuuugc

SEQ ID NO: 776643 - RNA, 17 nt, Listeria monocytogenes EGD-e
uaagaagauauuuugcu

SEQ ID NO: 776644 - RNA, 19 nt, Listeria monocytogenes EGD-e
uaacuucauuagacaaaaa

SEQ ID NO: 776645 - RNA, 23 nt, Listeria monocytogenes EGD-e
uaacuucauuagacaaaaagaaa

SEQ ID NO: 776646 - RNA, 15 nt, Listeria monocytogenes EGD-e
uaacuguugaaaagu

SEQ ID NO: 776647 - RNA, 20 nt, Listeria monocytogenes EGD-e
uaagaaugaacgaagagcca

SEQ ID NO: 776648 - RNA, 17 nt, Listeria monocytogenes EGD-e
uaagaaguacaauaaag

SEQ ID NO: 776649 - RNA, 16 nt, Listeria monocytogenes EGD-e
uaagacauaacaagua

SEQ ID NO: 776650 - RNA, 21 nt, Listeria monocytogenes EGD-e
uaagaccaccaagaauaagca

SEQ ID NO: 776651 - RNA, 13 nt, Listeria monocytogenes EGD-e
uaagcauuauaaa

SEQ ID NO: 776652 - RNA, 18 nt, Listeria monocytogenes EGD-e
uaagcaucggucaaaucu

SEQ ID NO: 776653 - RNA, 13 nt, Listeria monocytogenes EGD-e
uaagcacaaauua

SEQ ID NO: 776654 - RNA, 19 nt, Listeria monocytogenes EGD-e
uaagcagccuccgcuuugg

SEQ ID NO: 776655 - RNA, 22 nt, Listeria monocytogenes EGD-e
uaagcggguguccaaaaaccaa

SEQ ID NO: 776656 - RNA, 14 nt, Listeria monocytogenes EGD-e
uaaucuguaaaaau

SEQ ID NO: 776657 - RNA, 17 nt, Listeria monocytogenes EGD-e
uaaucuccgcaaucauu

SEQ ID NO: 776658 - RNA, 18 nt, Listeria monocytogenes EGD-e
uaaucuccgcaaucauuc

SEQ ID NO: 776659 - RNA, 22 nt, Listeria monocytogenes EGD-e
uaaucuaagucaucggcuuuuu

SEQ ID NO: 776660 - RNA, 20 nt, Listeria monocytogenes EGD-e
uaaucgcagggcagaaaaca

SEQ ID NO: 776661 - RNA, 13 nt, Listeria monocytogenes EGD-e
uaauccagcuuga

SEQ ID NO: 776662 - RNA, 16 nt, Listeria monocytogenes EGD-e
uaaucccacaaaaaau

SEQ ID NO: 776663 - RNA, 22 nt, Listeria monocytogenes EGD-e
uaauagcagagcuccaauaaua

SEQ ID NO: 776664 - RNA, 18 nt, Listeria monocytogenes EGD-e
uaauagaagccaauucac

SEQ ID NO: 776665 - RNA, 15 nt, Listeria monocytogenes EGD-e
uaaucaagauuuugu

SEQ ID NO: 776666 - RNA, 18 nt, Listeria monocytogenes EGD-e
uaaucaauaucuuuauuu

SEQ ID NO: 776667 - RNA, 20 nt, Listeria monocytogenes EGD-e
uaauugcuagcgaagucaau

SEQ ID NO: 776668 - RNA, 20 nt, Listeria monocytogenes EGD-e
uaauucugcgauuuuuucuu

SEQ ID NO: 776669 - RNA, 13 nt, Listeria monocytogenes EGD-e
uaauucugcuaac

SEQ ID NO: 776670 - RNA, 16 nt, Listeria monocytogenes EGD-e
uaauucgaauaagaac

SEQ ID NO: 776671 - RNA, 17 nt, Listeria monocytogenes EGD-e
uaaugcucauuuuucuu

SEQ ID NO: 776672 - RNA, 22 nt, Listeria monocytogenes EGD-e
uaaucuugaugccaucaggagu

SEQ ID NO: 776673 - RNA, 16 nt, Listeria monocytogenes EGD-e
uaaggauuugucacuu

SEQ ID NO: 776674 - RNA, 12 nt, Listeria monocytogenes EGD-e
uaaguagacaag

SEQ ID NO: 776675 - RNA, 23 nt, Listeria monocytogenes EGD-e
uaagucugcuuuuucaaguaaaa

SEQ ID NO: 776676 - RNA, 13 nt, Listeria monocytogenes EGD-e
uaaguauucaaau

SEQ ID NO: 776677 - RNA, 21 nt, Listeria monocytogenes EGD-e
uaaguuagcguuaguaaacuu

SEQ ID NO: 776678 - RNA, 17 nt, Listeria monocytogenes EGD-e
uaaguucuagcucaacu

SEQ ID NO: 776679 - RNA, 13 nt, Listeria monocytogenes EGD-e
uaauaaaaucauu

SEQ ID NO: 776680 - RNA, 15 nt, Listeria monocytogenes EGD-e
uaauaaaucauaaua

SEQ ID NO: 776681 - RNA, 16 nt, Listeria monocytogenes EGD-e
uaauaacugaauaaau

SEQ ID NO: 776682 - RNA, 13 nt, Listeria monocytogenes EGD-e
uaauaacauuaaa

SEQ ID NO: 776683 - RNA, 19 nt, Listeria monocytogenes EGD-e
uaauaacauuaaaccucuu

SEQ ID NO: 776684 - RNA, 18 nt, Listeria monocytogenes EGD-e
uaauaccaggaucaaaau

SEQ ID NO: 776685 - RNA, 19 nt, Listeria monocytogenes EGD-e
uaauaccaggaucaaaaug

SEQ ID NO: 776686 - RNA, 13 nt, Listeria monocytogenes EGD-e
uaauacguauucu

SEQ ID NO: 776687 - RNA, 18 nt, Listeria monocytogenes EGD-e
uaauacaaacuuuuccuu

SEQ ID NO: 776688 - RNA, 20 nt, Listeria monocytogenes EGD-e
uaauaaugauuucuauaaaa

SEQ ID NO: 776689 - RNA, 21 nt, Listeria monocytogenes EGD-e
uaauuguuaccgcauuuuucu

SEQ ID NO: 776690 - RNA, 17 nt, Listeria monocytogenes EGD-e
uaauugucauaaaacuu

SEQ ID NO: 776691 - RNA, 12 nt, Listeria monocytogenes EGD-e
uaauuguauaag

SEQ ID NO: 776692 - RNA, 21 nt, Listeria monocytogenes EGD-e
uaauuguaauuccgugaaauu

SEQ ID NO: 776693 - RNA, 14 nt, Listeria monocytogenes EGD-e
uacaacaaaauaau

SEQ ID NO: 776694 - RNA, 21 nt, Listeria monocytogenes EGD-e
uacacaaaguaaaaaggaaag

SEQ ID NO: 776695 - RNA, 19 nt, Listeria monocytogenes EGD-e
uacauuuuagcuuauuaau

SEQ ID NO: 776696 - RNA, 17 nt, Listeria monocytogenes EGD-e
uacauucgggaauaaau

SEQ ID NO: 776697 - RNA, 22 nt, Listeria monocytogenes EGD-e
uacaucaagugcuucaucuuua

SEQ ID NO: 776698 - RNA, 14 nt, Listeria monocytogenes EGD-e
uacauauuccaaaa

SEQ ID NO: 776699 - RNA, 15 nt, Listeria monocytogenes EGD-e
uacauauuccaaaau

SEQ ID NO: 776700 - RNA, 17 nt, Listeria monocytogenes EGD-e
uacaugaccgccaauuu

SEQ ID NO: 776701 - RNA, 19 nt, Listeria monocytogenes EGD-e
uacaugaauuacuucacca

SEQ ID NO: 776702 - RNA, 17 nt, Listeria monocytogenes EGD-e
uaccgagaucuugcauu

SEQ ID NO: 776703 - RNA, 22 nt, Listeria monocytogenes EGD-e
uaccgagaucuugcauuuuggc

SEQ ID NO: 776704 - RNA, 13 nt, Listeria monocytogenes EGD-e
uaccgaaugcaau

SEQ ID NO: 776705 - RNA, 14 nt, Listeria monocytogenes EGD-e
uaccgaaugcaauc

SEQ ID NO: 776706 - RNA, 16 nt, Listeria monocytogenes EGD-e
uaccgaaugcaaucca

SEQ ID NO: 776707 - RNA, 23 nt, Listeria monocytogenes EGD-e
uaccgaguucgguauaaaacauc

SEQ ID NO: 776708 - RNA, 17 nt, Listeria monocytogenes EGD-e
uaccguuccuucaagca

SEQ ID NO: 776709 - RNA, 21 nt, Listeria monocytogenes EGD-e
uaccauaagcagccuccgcuu

SEQ ID NO: 776710 - RNA, 17 nt, Listeria monocytogenes EGD-e
uaccaucauauaauucu

SEQ ID NO: 776711 - RNA, 18 nt, Listeria monocytogenes EGD-e
uaccaucauauaauucua

SEQ ID NO: 776712 - RNA, 11 nt, Listeria monocytogenes EGD-e
uaccaucuuuu

SEQ ID NO: 776713 - RNA, 16 nt, Listeria monocytogenes EGD-e
uaccaccgacacuaaa

SEQ ID NO: 776714 - RNA, 20 nt, Listeria monocytogenes EGD-e
uacguaauaggauuuuacug

SEQ ID NO: 776715 - RNA, 16 nt, Listeria monocytogenes EGD-e
uacuaacgcuuuuuca

SEQ ID NO: 776716 - RNA, 17 nt, Listeria monocytogenes EGD-e
uacuaacgcuuuuucag

SEQ ID NO: 776717 - RNA, 20 nt, Listeria monocytogenes EGD-e
uacguuguucuaacauuaau

SEQ ID NO: 776718 - RNA, 19 nt, Listeria monocytogenes EGD-e
uacuaagugcuucgcuguc

SEQ ID NO: 776719 - RNA, 19 nt, Listeria monocytogenes EGD-e
uacuacauuuuguugaacu

SEQ ID NO: 776720 - RNA, 20 nt, Listeria monocytogenes EGD-e
uacuacauuuuguugaacuu

SEQ ID NO: 776721 - RNA, 15 nt, Listeria monocytogenes EGD-e
uacgauugcuucacc

SEQ ID NO: 776722 - RNA, 23 nt, Listeria monocytogenes EGD-e
uacgauugggcggaaauaaaaac

SEQ ID NO: 776723 - RNA, 22 nt, Listeria monocytogenes EGD-e
uacgccuuugcaaggcuuuuaa

SEQ ID NO: 776724 - RNA, 13 nt, Listeria monocytogenes EGD-e
uaguuauuucuuu

SEQ ID NO: 776725 - RNA, 21 nt, Listeria monocytogenes EGD-e
uaguuuuauuauauuuuagcu

SEQ ID NO: 776726 - RNA, 23 nt, Listeria monocytogenes EGD-e
uaguuugucccaagauucuucua

SEQ ID NO: 776727 - RNA, 13 nt, Listeria monocytogenes EGD-e
uaguuuucuacua

SEQ ID NO: 776728 - RNA, 17 nt, Listeria monocytogenes EGD-e
uauaaaguuuuuugguu

SEQ ID NO: 776729 - RNA, 13 nt, Listeria monocytogenes EGD-e
uaguggagcucuu

SEQ ID NO: 776730 - RNA, 20 nt, Listeria monocytogenes EGD-e
uaguggagcucuuucuucua

SEQ ID NO: 776731 - RNA, 23 nt, Listeria monocytogenes EGD-e
uaguggagcucuuucuucuacua

SEQ ID NO: 776732 - RNA, 17 nt, Listeria monocytogenes EGD-e
uagucuacuuuuaaaau

SEQ ID NO: 776733 - RNA, 20 nt, Listeria monocytogenes EGD-e
uauaccuuauuuuauacgca

SEQ ID NO: 776734 - RNA, 14 nt, Listeria monocytogenes EGD-e
uauacauugaaaaa

SEQ ID NO: 776735 - RNA, 20 nt, Listeria monocytogenes EGD-e
uauaauucggcaaacagcuu

SEQ ID NO: 776736 - RNA, 16 nt, Listeria monocytogenes EGD-e
uauaauuaacaaccau

SEQ ID NO: 776737 - RNA, 22 nt, Listeria monocytogenes EGD-e
uauacaggaacuacauacuuau

SEQ ID NO: 776738 - RNA, 22 nt, Listeria monocytogenes EGD-e
uauacaagcguaugguucaaaa

SEQ ID NO: 776739 - RNA, 11 nt, Listeria monocytogenes EGD-e
uauaugaaaac

SEQ ID NO: 776740 - RNA, 18 nt, Listeria monocytogenes EGD-e
uauauucauccucauauu

SEQ ID NO: 776741 - RNA, 18 nt, Listeria monocytogenes EGD-e
uauauucacaucacuaau

SEQ ID NO: 776742 - RNA, 22 nt, Listeria monocytogenes EGD-e
uauauucuucugucacaucugu

SEQ ID NO: 776743 - RNA, 14 nt, Listeria monocytogenes EGD-e
uauagcguacauga

SEQ ID NO: 776744 - RNA, 15 nt, Listeria monocytogenes EGD-e
uauagguaacaucuu

SEQ ID NO: 776745 - RNA, 12 nt, Listeria monocytogenes EGD-e
uaucaauaauag

SEQ ID NO: 776746 - RNA, 20 nt, Listeria monocytogenes EGD-e
uaucaucaauaaaaugcaca

SEQ ID NO: 776747 - RNA, 17 nt, Listeria monocytogenes EGD-e
uaucaucaauuaaauua

SEQ ID NO: 776748 - RNA, 18 nt, Listeria monocytogenes EGD-e
uaucaugaauaaguuauu

SEQ ID NO: 776749 - RNA, 11 nt, Listeria monocytogenes EGD-e
uaucuaaaauc

SEQ ID NO: 776750 - RNA, 19 nt, Listeria monocytogenes EGD-e
uaucuacaaguucuuucau

SEQ ID NO: 776751 - RNA, 21 nt, Listeria monocytogenes EGD-e
uaucuacaggcuauuccagcu

SEQ ID NO: 776752 - RNA, 20 nt, Listeria monocytogenes EGD-e
uaucugguacguuuuuuauu

SEQ ID NO: 776753 - RNA, 12 nt, Listeria monocytogenes EGD-e
uaucucuucauu

SEQ ID NO: 776754 - RNA, 12 nt, Listeria monocytogenes EGD-e
uagccuuuuauc

SEQ ID NO: 776755 - RNA, 21 nt, Listeria monocytogenes EGD-e
uagccugaugaugccgcaaga

SEQ ID NO: 776756 - RNA, 15 nt, Listeria monocytogenes EGD-e
uagcacagcuaccac

SEQ ID NO: 776757 - RNA, 13 nt, Listeria monocytogenes EGD-e
uagcaauuucgga

SEQ ID NO: 776758 - RNA, 18 nt, Listeria monocytogenes EGD-e
uagcuuugucuuaaauga

SEQ ID NO: 776759 - RNA, 21 nt, Listeria monocytogenes EGD-e
uagcuuuaucuuuuccuucua

SEQ ID NO: 776760 - RNA, 17 nt, Listeria monocytogenes EGD-e
uaggauauuuuuuucga

SEQ ID NO: 776761 - RNA, 18 nt, Listeria monocytogenes EGD-e
uaggauauuuuuuucgaa

SEQ ID NO: 776762 - RNA, 22 nt, Listeria monocytogenes EGD-e
uaggauauuuuuuucgaaagaa

SEQ ID NO: 776763 - RNA, 20 nt, Listeria monocytogenes EGD-e
uaggcgcgaguacaauuaua

SEQ ID NO: 776764 - RNA, 14 nt, Listeria monocytogenes EGD-e
uaggguuuggaaaa

SEQ ID NO: 776765 - RNA, 12 nt, Listeria monocytogenes EGD-e
uagacuaaauug

SEQ ID NO: 776766 - RNA, 22 nt, Listeria monocytogenes EGD-e
uagacuguaugaaacuuguuuu

SEQ ID NO: 776767 - RNA, 14 nt, Listeria monocytogenes EGD-e
uagaggauuuucac

SEQ ID NO: 776768 - RNA, 17 nt, Listeria monocytogenes EGD-e
uagagcuuuuaaauaua

SEQ ID NO: 776769 - RNA, 20 nt, Listeria monocytogenes EGD-e
uagauacucuuuaaauccau

SEQ ID NO: 776770 - RNA, 13 nt, Listeria monocytogenes EGD-e
uagaaaguagauu

SEQ ID NO: 776771 - RNA, 18 nt, Listeria monocytogenes EGD-e
uagaaauauguuuaaucu

SEQ ID NO: 776772 - RNA, 16 nt, Listeria monocytogenes EGD-e
uagaaaccaucgcaaa

SEQ ID NO: 776773 - RNA, 20 nt, Listeria monocytogenes EGD-e
uagaaaccaucgcaaaagca

SEQ ID NO: 776774 - RNA, 16 nt, Listeria monocytogenes EGD-e
uacuagcuuugucuag

SEQ ID NO: 776775 - RNA, 18 nt, Listeria monocytogenes EGD-e
uagaauguauacacuagu

SEQ ID NO: 776776 - RNA, 14 nt, Listeria monocytogenes EGD-e
uagaagccaauuca

SEQ ID NO: 776777 - RNA, 17 nt, Listeria monocytogenes EGD-e
uagaaccguauuuaaua

SEQ ID NO: 776778 - RNA, 21 nt, Listeria monocytogenes EGD-e
gccacuaacauaaauugauuc

SEQ ID NO: 776779 - RNA, 14 nt, Listeria monocytogenes EGD-e
gcauagauggaaga

SEQ ID NO: 776780 - RNA, 14 nt, Listeria monocytogenes EGD-e
gccaccuucaauuu

SEQ ID NO: 776781 - RNA, 16 nt, Listeria monocytogenes EGD-e
gccggguauggcuggg

SEQ ID NO: 776782 - RNA, 19 nt, Listeria monocytogenes EGD-e
gccuaaguuaaaccauaaa

SEQ ID NO: 776783 - RNA, 16 nt, Listeria monocytogenes EGD-e
gccuaauuguauaagu

SEQ ID NO: 776784 - RNA, 21 nt, Listeria monocytogenes EGD-e
gccuacuuuuuuuauuuaccu

SEQ ID NO: 776785 - RNA, 15 nt, Listeria monocytogenes EGD-e
gccuggauuuucuag

SEQ ID NO: 776786 - RNA, 21 nt, Listeria monocytogenes EGD-e
gccuucaaacacuucuaaaac

SEQ ID NO: 776787 - RNA, 22 nt, Listeria monocytogenes EGD-e
gccuucgauaguuccuucuaau

SEQ ID NO: 776788 - RNA, 13 nt, Listeria monocytogenes EGD-e
gccuuuauugaua

SEQ ID NO: 776789 - RNA, 16 nt, Listeria monocytogenes EGD-e
gcgauuuuuucuucca

SEQ ID NO: 776790 - RNA, 18 nt, Listeria monocytogenes EGD-e
gcgcaacauucaaaucac

SEQ ID NO: 776791 - RNA, 21 nt, Listeria monocytogenes EGD-e
gcgccauuugccaucgcagca

SEQ ID NO: 776792 - RNA, 15 nt, Listeria monocytogenes EGD-e
gcguuaaucuuacau

SEQ ID NO: 776793 - RNA, 13 nt, Listeria monocytogenes EGD-e
gcguauccacaua

SEQ ID NO: 776794 - RNA, 12 nt, Listeria monocytogenes EGD-e
gcguaucuuuuc

SEQ ID NO: 776795 - RNA, 15 nt, Listeria monocytogenes EGD-e
gcuaaucguuuuaaa

SEQ ID NO: 776796 - RNA, 18 nt, Listeria monocytogenes EGD-e
gcuaauaacauuaaaccu

SEQ ID NO: 776797 - RNA, 18 nt, Listeria monocytogenes EGD-e
gcuaaaacuaaaacgaca

SEQ ID NO: 776798 - RNA, 17 nt, Listeria monocytogenes EGD-e
gcuaaaggcaacaaaga

SEQ ID NO: 776799 - RNA, 23 nt, Listeria monocytogenes EGD-e
gcuaaauaaaaccauucaucuaa

SEQ ID NO: 776800 - RNA, 18 nt, Listeria monocytogenes EGD-e
gcuaacaacaagcaaaac

SEQ ID NO: 776801 - RNA, 15 nt, Listeria monocytogenes EGD-e
gcuaaauugugaaau

SEQ ID NO: 776802 - RNA, 14 nt, Listeria monocytogenes EGD-e
gcuccguauuuaua

SEQ ID NO: 776803 - RNA, 16 nt, Listeria monocytogenes EGD-e
gcucagauccuucaau

SEQ ID NO: 776804 - RNA, 20 nt, Listeria monocytogenes EGD-e
gcguaagauuuuugcucagu

SEQ ID NO: 776805 - RNA, 23 nt, Listeria monocytogenes EGD-e
gcggcauuucaaucgcagcagau

SEQ ID NO: 776806 - RNA, 17 nt, Listeria monocytogenes EGD-e
gcaaaacauuuucauuc

SEQ ID NO: 776807 - RNA, 16 nt, Listeria monocytogenes EGD-e
gcaaaagcaguagacu

SEQ ID NO: 776808 - RNA, 15 nt, Listeria monocytogenes EGD-e
gcaacaguuauuaaa

SEQ ID NO: 776809 - RNA, 16 nt, Listeria monocytogenes EGD-e
gcaacaguuauuaaaa

SEQ ID NO: 776810 - RNA, 17 nt, Listeria monocytogenes EGD-e
gcaacaguuauuaaaag

SEQ ID NO: 776811 - RNA, 15 nt, Listeria monocytogenes EGD-e
gcaacauucaaauca

SEQ ID NO: 776812 - RNA, 14 nt, Listeria monocytogenes EGD-e
gcacaaaaugcaaa

SEQ ID NO: 776813 - RNA, 16 nt, Listeria monocytogenes EGD-e
gcacaaauuauuagaa

SEQ ID NO: 776814 - RNA, 12 nt, Listeria monocytogenes EGD-e
gcacauccgcau

SEQ ID NO: 776815 - RNA, 16 nt, Listeria monocytogenes EGD-e
gcacagcaauggccgg

SEQ ID NO: 776816 - RNA, 15 nt, Listeria monocytogenes EGD-e
gcaccaauaaaaccu

SEQ ID NO: 776817 - RNA, 23 nt, Listeria monocytogenes EGD-e
gcagaaggggcugugaaggaaac

SEQ ID NO: 776818 - RNA, 21 nt, Listeria monocytogenes EGD-e
gcagaaaguuggguaugacuu

SEQ ID NO: 776819 - RNA, 13 nt, Listeria monocytogenes EGD-e
gcagaaacaauca

SEQ ID NO: 776820 - RNA, 16 nt, Listeria monocytogenes EGD-e
gcacuuucaaaucagc

SEQ ID NO: 776821 - RNA, 18 nt, Listeria monocytogenes EGD-e
gcagcaagugugauuguu

SEQ ID NO: 776822 - RNA, 15 nt, Listeria monocytogenes EGD-e
gcagcgacaauuaug

SEQ ID NO: 776823 - RNA, 22 nt, Listeria monocytogenes EGD-e
gcaggguggccgugauaaauaa

SEQ ID NO: 776824 - RNA, 17 nt, Listeria monocytogenes EGD-e
gcagggcuauuuuuccg

SEQ ID NO: 776825 - RNA, 21 nt, Listeria monocytogenes EGD-e
gauguguugcuuuuauuuuua

SEQ ID NO: 776826 - RNA, 18 nt, Listeria monocytogenes EGD-e
gauuaauuuaucuuuuac

SEQ ID NO: 776827 - RNA, 14 nt, Listeria monocytogenes EGD-e
gauucauaaacaaa

SEQ ID NO: 776828 - RNA, 11 nt, Listeria monocytogenes EGD-e
gauucaaagcu

SEQ ID NO: 776829 - RNA, 17 nt, Listeria monocytogenes EGD-e
gauucgucuuagaaaaa

SEQ ID NO: 776830 - RNA, 22 nt, Listeria monocytogenes EGD-e
gauucgucuuagaaaaauguuu

SEQ ID NO: 776831 - RNA, 23 nt, Listeria monocytogenes EGD-e
gauucgucuuagaaaaauguuug

SEQ ID NO: 776832 - RNA, 14 nt, Listeria monocytogenes EGD-e
gauugguccugcug

SEQ ID NO: 776833 - RNA, 20 nt, Listeria monocytogenes EGD-e
gauuuuugggguuucauaua

SEQ ID NO: 776834 - RNA, 19 nt, Listeria monocytogenes EGD-e
gauuugucacuuggaaaag

SEQ ID NO: 776835 - RNA, 15 nt, Listeria monocytogenes EGD-e
gaucuacuucuaaau

SEQ ID NO: 776836 - RNA, 19 nt, Listeria monocytogenes EGD-e
gaucuuccgguaucaugaa

SEQ ID NO: 776837 - RNA, 22 nt, Listeria monocytogenes EGD-e
gaucuuccaucauaaucccagu

SEQ ID NO: 776838 - RNA, 15 nt, Listeria monocytogenes EGD-e
gauauucucuuauga

SEQ ID NO: 776839 - RNA, 14 nt, Listeria monocytogenes EGD-e
gauauuuugcucaa

SEQ ID NO: 776840 - RNA, 17 nt, Listeria monocytogenes EGD-e
gauccauugcaagguau

SEQ ID NO: 776841 - RNA, 14 nt, Listeria monocytogenes EGD-e
gauaguuccagcua

SEQ ID NO: 776842 - RNA, 22 nt, Listeria monocytogenes EGD-e
gauaaguuuucauauaaguguu

SEQ ID NO: 776843 - RNA, 22 nt, Listeria monocytogenes EGD-e
gagguuuugcacaaaaugcaaa

SEQ ID NO: 776844 - RNA, 15 nt, Listeria monocytogenes EGD-e
gaguuuguaacaacu

SEQ ID NO: 776845 - RNA, 22 nt, Listeria monocytogenes EGD-e
gauaacuuucucuugcuuuaau

SEQ ID NO: 776846 - RNA, 16 nt, Listeria monocytogenes EGD-e
gagugagguguaauau

SEQ ID NO: 776847 - RNA, 14 nt, Listeria monocytogenes EGD-e
gagaguuauaaaga

SEQ ID NO: 776848 - RNA, 18 nt, Listeria monocytogenes EGD-e
gagaguuauaaagaaaua

SEQ ID NO: 776849 - RNA, 13 nt, Listeria monocytogenes EGD-e
gagcagcuccauu

SEQ ID NO: 776850 - RNA, 15 nt, Listeria monocytogenes EGD-e
gagcagcauccaucc

SEQ ID NO: 776851 - RNA, 20 nt, Listeria monocytogenes EGD-e
gagccuggauuuucuagguu

SEQ ID NO: 776852 - RNA, 14 nt, Listeria monocytogenes EGD-e
gagcuuucuuuuuu

SEQ ID NO: 776853 - RNA, 13 nt, Listeria monocytogenes EGD-e
gaggauuuuccaa

SEQ ID NO: 776854 - RNA, 22 nt, Listeria monocytogenes EGD-e
gacguuuaucaauaauagcaau

SEQ ID NO: 776855 - RNA, 13 nt, Listeria monocytogenes EGD-e
gacuaguucugcu

SEQ ID NO: 776856 - RNA, 17 nt, Listeria monocytogenes EGD-e
gacuucuuagggagaag

SEQ ID NO: 776857 - RNA, 20 nt, Listeria monocytogenes EGD-e
gacuucuuagggagaagccu

SEQ ID NO: 776858 - RNA, 21 nt, Listeria monocytogenes EGD-e
gacuguuguuucauauaauuu

SEQ ID NO: 776859 - RNA, 11 nt, Listeria monocytogenes EGD-e
gagaaauggau

SEQ ID NO: 776860 - RNA, 18 nt, Listeria monocytogenes EGD-e
gagacagaaaaagaagua

SEQ ID NO: 776861 - RNA, 17 nt, Listeria monocytogenes EGD-e
gaccgcaaauagagcca

SEQ ID NO: 776862 - RNA, 20 nt, Listeria monocytogenes EGD-e
gaccaucaguaguaaagcac

SEQ ID NO: 776863 - RNA, 18 nt, Listeria monocytogenes EGD-e
gacgaaucaagauuuugc

SEQ ID NO: 776864 - RNA, 14 nt, Listeria monocytogenes EGD-e
gaccuuuugcuucu

SEQ ID NO: 776865 - RNA, 18 nt, Listeria monocytogenes EGD-e
gaccuuuugcuucuucca

SEQ ID NO: 776866 - RNA, 13 nt, Listeria monocytogenes EGD-e
gaccuuugaaaac

SEQ ID NO: 776867 - RNA, 17 nt, Listeria monocytogenes EGD-e
gacgauuggaucuucca

SEQ ID NO: 776868 - RNA, 19 nt, Listeria monocytogenes EGD-e
gacgacguuuaucaauaau

SEQ ID NO: 776869 - RNA, 15 nt, Listeria monocytogenes EGD-e
gacgagaaaugaauu

SEQ ID NO: 776870 - RNA, 21 nt, Listeria monocytogenes EGD-e
gacacacggugaugaaaccaa

SEQ ID NO: 776871 - RNA, 14 nt, Listeria monocytogenes EGD-e
gacacccauaauag

SEQ ID NO: 776872 - RNA, 13 nt, Listeria monocytogenes EGD-e
gacagauaaauau

SEQ ID NO: 776873 - RNA, 20 nt, Listeria monocytogenes EGD-e
gacaagagcgagagcaccaa

SEQ ID NO: 776874 - RNA, 12 nt, Listeria monocytogenes EGD-e
gacaagcccagc

SEQ ID NO: 776875 - RNA, 13 nt, Listeria monocytogenes EGD-e
gacaaaaagaaaa

SEQ ID NO: 776876 - RNA, 17 nt, Listeria monocytogenes EGD-e
gacaaaaagaaaaaaca

SEQ ID NO: 776877 - RNA, 22 nt, Listeria monocytogenes EGD-e
gaauuuuugcauccacuaacuu

SEQ ID NO: 776878 - RNA, 14 nt, Listeria monocytogenes EGD-e
cuuugguaaaaaac

SEQ ID NO: 776879 - RNA, 21 nt, Listeria monocytogenes EGD-e
gacaaaguaacuaaaaaucau

SEQ ID NO: 776880 - RNA, 16 nt, Listeria monocytogenes EGD-e
gacaaagcuauuuuuu

SEQ ID NO: 776881 - RNA, 20 nt, Listeria monocytogenes EGD-e
gacauaaucccacaaaaaau

SEQ ID NO: 776882 - RNA, 23 nt, Listeria monocytogenes EGD-e
gacaguugcuguuacugugcucu

SEQ ID NO: 776883 - RNA, 14 nt, Listeria monocytogenes EGD-e
cgucauucgguaau

SEQ ID NO: 776884 - RNA, 17 nt, Listeria monocytogenes EGD-e
cguuccgauacaacaaa

SEQ ID NO: 776885 - RNA, 21 nt, Listeria monocytogenes EGD-e
cguucauuugaaaaagggcug

SEQ ID NO: 776886 - RNA, 21 nt, Listeria monocytogenes EGD-e
cuaaacguucuuccuuuuuca

SEQ ID NO: 776887 - RNA, 12 nt, Listeria monocytogenes EGD-e
cguuuuuacuua

SEQ ID NO: 776888 - RNA, 18 nt, Listeria monocytogenes EGD-e
cuacaacuagauuuucau

SEQ ID NO: 776889 - RNA, 16 nt, Listeria monocytogenes EGD-e
cuacaacuggcacagc

SEQ ID NO: 776890 - RNA, 14 nt, Listeria monocytogenes EGD-e
cuacaauuaaaaua

SEQ ID NO: 776891 - RNA, 14 nt, Listeria monocytogenes EGD-e
cuaauuuuuuuaua

SEQ ID NO: 776892 - RNA, 17 nt, Listeria monocytogenes EGD-e
cuaauuuuuuuauaccu

SEQ ID NO: 776893 - RNA, 23 nt, Listeria monocytogenes EGD-e
cuaauuuuuuuauaccuaaagca

SEQ ID NO: 776894 - RNA, 13 nt, Listeria monocytogenes EGD-e
cuaauuuuacuuc

SEQ ID NO: 776895 - RNA, 21 nt, Listeria monocytogenes EGD-e
cuaauuguuaccgcauuuuuc

SEQ ID NO: 776896 - RNA, 15 nt, Listeria monocytogenes EGD-e
cuaaauauuuaauuu

SEQ ID NO: 776897 - RNA, 13 nt, Listeria monocytogenes EGD-e
cuaauaacauuaa

SEQ ID NO: 776898 - RNA, 14 nt, Listeria monocytogenes EGD-e
cuaauaacauuaaa

SEQ ID NO: 776899 - RNA, 21 nt, Listeria monocytogenes EGD-e
cuaauaacauuaaaccucuuu

SEQ ID NO: 776900 - RNA, 13 nt, Listeria monocytogenes EGD-e
cuaauaauuuuaa

SEQ ID NO: 776901 - RNA, 21 nt, Listeria monocytogenes EGD-e
cuaauccagcuugauuaaaac

SEQ ID NO: 776902 - RNA, 13 nt, Listeria monocytogenes EGD-e
cuaauuacuaaaa

SEQ ID NO: 776903 - RNA, 19 nt, Listeria monocytogenes EGD-e
cuaauucugcgauuuuuuc

SEQ ID NO: 776904 - RNA, 14 nt, Listeria monocytogenes EGD-e
cuacuggauaaaau

SEQ ID NO: 776905 - RNA, 20 nt, Listeria monocytogenes EGD-e
cuagacuguaugaaacuugu

SEQ ID NO: 776906 - RNA, 16 nt, Listeria monocytogenes EGD-e
cuacuuuuuuuauuua

SEQ ID NO: 776907 - RNA, 20 nt, Listeria monocytogenes EGD-e
cuacuuuuaaaauucuauua

SEQ ID NO: 776908 - RNA, 17 nt, Listeria monocytogenes EGD-e
cuacuuacggucuuuuu

SEQ ID NO: 776909 - RNA, 17 nt, Listeria monocytogenes EGD-e
cuagauuuaauaaauua

SEQ ID NO: 776910 - RNA, 23 nt, Listeria monocytogenes EGD-e
cuagauuuagaggcguacuaaaa

SEQ ID NO: 776911 - RNA, 18 nt, Listeria monocytogenes EGD-e
cuaguagcaauuuuaaau

SEQ ID NO: 776912 - RNA, 16 nt, Listeria monocytogenes EGD-e
cuagguuuucuuuuuu

SEQ ID NO: 776913 - RNA, 18 nt, Listeria monocytogenes EGD-e
cuagguuuucuuuuuucg

SEQ ID NO: 776914 - RNA, 22 nt, Listeria monocytogenes EGD-e
cuagguucuuuuuuaugaaaaa

SEQ ID NO: 776915 - RNA, 15 nt, Listeria monocytogenes EGD-e
cuaguaauuuaauug

SEQ ID NO: 776916 - RNA, 14 nt, Listeria monocytogenes EGD-e
cuaucaucuucucg

SEQ ID NO: 776917 - RNA, 20 nt, Listeria monocytogenes EGD-e
cuauauucauccucauauuu

SEQ ID NO: 776918 - RNA, 19 nt, Listeria monocytogenes EGD-e
cuauauucauuauuaaacu

SEQ ID NO: 776919 - RNA, 13 nt, Listeria monocytogenes EGD-e
cuauaaaaacaug

SEQ ID NO: 776920 - RNA, 15 nt, Listeria monocytogenes EGD-e
cuaugucuuuuugug

SEQ ID NO: 776921 - RNA, 16 nt, Listeria monocytogenes EGD-e
cuauuccuccuaauug

SEQ ID NO: 776922 - RNA, 23 nt, Listeria monocytogenes EGD-e
cuauuguaaauguugguguagga

SEQ ID NO: 776923 - RNA, 21 nt, Listeria monocytogenes EGD-e
cucaugaaacuuuaacaaaag

SEQ ID NO: 776924 - RNA, 23 nt, Listeria monocytogenes EGD-e
cuccaauuuuacugguuuuucuu

SEQ ID NO: 776925 - RNA, 20 nt, Listeria monocytogenes EGD-e
cuccaauaauaguugauaua

SEQ ID NO: 776926 - RNA, 24 nt, Listeria monocytogenes EGD-e
cucauaacgaugacgaugacgcuc

SEQ ID NO: 776927 - RNA, 14 nt, Listeria monocytogenes EGD-e
cucauaagcuucau

SEQ ID NO: 776928 - RNA, 16 nt, Listeria monocytogenes EGD-e
cucauaagcuucauaa

SEQ ID NO: 776929 - RNA, 13 nt, Listeria monocytogenes EGD-e
cucauaagagaau

SEQ ID NO: 776930 - RNA, 13 nt, Listeria monocytogenes EGD-e
cuccuuuauuuuu

SEQ ID NO: 776931 - RNA, 16 nt, Listeria monocytogenes EGD-e
cuccuuuauuuuuuau

SEQ ID NO: 776932 - RNA, 20 nt, Listeria monocytogenes EGD-e
cuccuuuauuuuuuauuuua

SEQ ID NO: 776933 - RNA, 14 nt, Listeria monocytogenes EGD-e
cucgaauucuuuuu

SEQ ID NO: 776934 - RNA, 18 nt, Listeria monocytogenes EGD-e
cucuaagucugcuuuuuc

SEQ ID NO: 776935 - RNA, 23 nt, Listeria monocytogenes EGD-e
cucuaagucugcuuuuucaagua

SEQ ID NO: 776936 - RNA, 11 nt, Listeria monocytogenes EGD-e
cucucccauuu

SEQ ID NO: 776937 - RNA, 20 nt, Listeria monocytogenes EGD-e
cucuucauuuuucuagugca

SEQ ID NO: 776938 - RNA, 14 nt, Listeria monocytogenes EGD-e
cucuguuucauuuu

SEQ ID NO: 776939 - RNA, 23 nt, Listeria monocytogenes EGD-e
cucuuuaaauccauuucauucuu

SEQ ID NO: 776940 - RNA, 15 nt, Listeria monocytogenes EGD-e
cucuuguaaaagcga

SEQ ID NO: 776941 - RNA, 22 nt, Listeria monocytogenes EGD-e
cugaaaauguugcaauuuugcu

SEQ ID NO: 776942 - RNA, 14 nt, Listeria monocytogenes EGD-e
cugaaauagcauuc

SEQ ID NO: 776943 - RNA, 20 nt, Listeria monocytogenes EGD-e
cucuuuggagugaggauuuu

SEQ ID NO: 776944 - RNA, 20 nt, Listeria monocytogenes EGD-e
cucuuuuuuuaguaaacauu

SEQ ID NO: 776945 - RNA, 21 nt, Listeria monocytogenes EGD-e
cucuuuuuuuaguaaacauuu

SEQ ID NO: 776946 - RNA, 18 nt, Listeria monocytogenes EGD-e
cugaacugacuagaaauu

SEQ ID NO: 776947 - RNA, 14 nt, Listeria monocytogenes EGD-e
cugagaguaauaaa

SEQ ID NO: 776948 - RNA, 20 nt, Listeria monocytogenes EGD-e
cugacuagaaauuaaugcca

SEQ ID NO: 776949 - RNA, 22 nt, Listeria monocytogenes EGD-e
cugcaacaacuaacacuuauau

SEQ ID NO: 776950 - RNA, 23 nt, Listeria monocytogenes EGD-e
cugauuuuuuggugacgaaucaa

SEQ ID NO: 776951 - RNA, 21 nt, Listeria monocytogenes EGD-e
cugcugcuacgccgguaccau

SEQ ID NO: 776952 - RNA, 17 nt, Listeria monocytogenes EGD-e
cugcucgcucaucauca

SEQ ID NO: 776953 - RNA, 21 nt, Listeria monocytogenes EGD-e
cugcuucguccagcugcuuca

SEQ ID NO: 776954 - RNA, 20 nt, Listeria monocytogenes EGD-e
cugggaguuuuuuauuauug

SEQ ID NO: 776955 - RNA, 23 nt, Listeria monocytogenes EGD-e
cugggaauauccuuguuguucua

SEQ ID NO: 776956 - RNA, 12 nt, Listeria monocytogenes EGD-e
cugguucgauuu

SEQ ID NO: 776957 - RNA, 12 nt, Listeria monocytogenes EGD-e
cuguacuccuug

SEQ ID NO: 776958 - RNA, 14 nt, Listeria monocytogenes EGD-e
cuguauauguuuua

SEQ ID NO: 776959 - RNA, 21 nt, Listeria monocytogenes EGD-e
cuguauauguuuuauuuauag

SEQ ID NO: 776960 - RNA, 22 nt, Listeria monocytogenes EGD-e
cuguauauguuuuauuuauaga

SEQ ID NO: 776961 - RNA, 20 nt, Listeria monocytogenes EGD-e
cuguaugaaacuuguuuuug

SEQ ID NO: 776962 - RNA, 14 nt, Listeria monocytogenes EGD-e
cuguccauuccaau

SEQ ID NO: 776963 - RNA, 21 nt, Listeria monocytogenes EGD-e
cugugauuacuccaaaauaaa

SEQ ID NO: 776964 - RNA, 18 nt, Listeria monocytogenes EGD-e
cuguuacugugcucuuug

SEQ ID NO: 776965 - RNA, 18 nt, Listeria monocytogenes EGD-e
cuucuuugauuuuuucuu

SEQ ID NO: 776966 - RNA, 15 nt, Listeria monocytogenes EGD-e
cuugauuuguuuuau

SEQ ID NO: 776967 - RNA, 23 nt, Listeria monocytogenes EGD-e
cuugauuuguuuuauuacauuaa

SEQ ID NO: 776968 - RNA, 22 nt, Listeria monocytogenes EGD-e
cuugcccuugauuuaaauaaac

SEQ ID NO: 776969 - RNA, 13 nt, Listeria monocytogenes EGD-e
cuugcaagagcag

SEQ ID NO: 776970 - RNA, 16 nt, Listeria monocytogenes EGD-e
cuuggauggacauaau

SEQ ID NO: 776971 - RNA, 20 nt, Listeria monocytogenes EGD-e
cuugcugcucgcucaucauc

SEQ ID NO: 776972 - RNA, 15 nt, Listeria monocytogenes EGD-e
cuuuacauaauucau

SEQ ID NO: 776973 - RNA, 15 nt, Listeria monocytogenes EGD-e
cuuuaauuuggaaau

SEQ ID NO: 776974 - RNA, 18 nt, Listeria monocytogenes EGD-e
cuuuacuacauuuuguug

SEQ ID NO: 776975 - RNA, 11 nt, Listeria monocytogenes EGD-e
cuuuaucuuuc

SEQ ID NO: 776976 - RNA, 16 nt, Listeria monocytogenes EGD-e
cuuuaucuuucccauc

SEQ ID NO: 776977 - RNA, 18 nt, Listeria monocytogenes EGD-e
cuuuaucccagaaagaau

SEQ ID NO: 776978 - RNA, 23 nt, Listeria monocytogenes EGD-e
cuuugaauuaagaaguacaauaa

SEQ ID NO: 776979 - RNA, 21 nt, Listeria monocytogenes EGD-e
cuuugaauugauuuuuuugaa

SEQ ID NO: 776980 - RNA, 12 nt, Listeria monocytogenes EGD-e
cuuuccagcagg

SEQ ID NO: 776981 - RNA, 16 nt, Listeria monocytogenes EGD-e
cuuucugccuaccaaa

SEQ ID NO: 776982 - RNA, 21 nt, Listeria monocytogenes EGD-e
cuuugauuaauuuaucuuuua

SEQ ID NO: 776983 - RNA, 18 nt, Listeria monocytogenes EGD-e
cuuugcuuguguaacaua

SEQ ID NO: 776984 - RNA, 15 nt, Listeria monocytogenes EGD-e
cuuaguuaauucuuu

SEQ ID NO: 776985 - RNA, 18 nt, Listeria monocytogenes EGD-e
cuuaguuaauucuuuuuc

SEQ ID NO: 776986 - RNA, 15 nt, Listeria monocytogenes EGD-e
cuuagaaaaauguuu

SEQ ID NO: 776987 - RNA, 15 nt, Listeria monocytogenes EGD-e
cuuagaagaugcacu

SEQ ID NO: 776988 - RNA, 14 nt, Listeria monocytogenes EGD-e
cuuaaauuauacua

SEQ ID NO: 776989 - RNA, 11 nt, Listeria monocytogenes EGD-e
cuuaagcaagg

SEQ ID NO: 776990 - RNA, 15 nt, Listeria monocytogenes EGD-e
cuuaagggcuuuuuu

SEQ ID NO: 776991 - RNA, 19 nt, Listeria monocytogenes EGD-e
cuuaugagaguuauaaaga

SEQ ID NO: 776992 - RNA, 21 nt, Listeria monocytogenes EGD-e
cuuaugagaguuauaaagaaa

SEQ ID NO: 776993 - RNA, 16 nt, Listeria monocytogenes EGD-e
cuucaaacacuucuaa

SEQ ID NO: 776994 - RNA, 20 nt, Listeria monocytogenes EGD-e
cuuauuuuaacggcuucaaa

SEQ ID NO: 776995 - RNA, 17 nt, Listeria monocytogenes EGD-e
cuuauuuuuugagcgcc

SEQ ID NO: 776996 - RNA, 16 nt, Listeria monocytogenes EGD-e
cuucaaucccagcuuu

SEQ ID NO: 776997 - RNA, 20 nt, Listeria monocytogenes EGD-e
cuucaaucccagcuuuuccu

SEQ ID NO: 776998 - RNA, 22 nt, Listeria monocytogenes EGD-e
cuucaauugcuucuuuuuucuu

SEQ ID NO: 776999 - RNA, 23 nt, Listeria monocytogenes EGD-e
cuucaauugcuucuuuuuucuuc

SEQ ID NO: 777000 - RNA, 16 nt, Listeria monocytogenes EGD-e
cuucaccaguaacgcc

SEQ ID NO: 777001 - RNA, 14 nt, Listeria monocytogenes EGD-e
cuuccuuuuguuuu

SEQ ID NO: 777002 - RNA, 19 nt, Listeria monocytogenes EGD-e
cuucgaaaguaaaaucuuu

SEQ ID NO: 777003 - RNA, 18 nt, Listeria monocytogenes EGD-e
cuucuaagaaaaaaaguu

SEQ ID NO: 777004 - RNA, 16 nt, Listeria monocytogenes EGD-e
cuucuagcgucacaau

SEQ ID NO: 777005 - RNA, 17 nt, Listeria monocytogenes EGD-e
cuucuagcgucacaaua

SEQ ID NO: 777006 - RNA, 14 nt, Listeria monocytogenes EGD-e
cuucguuucauuuc

SEQ ID NO: 777007 - RNA, 20 nt, Listeria monocytogenes EGD-e
cuucguuucauuucaucuuu

SEQ ID NO: 777008 - RNA, 13 nt, Listeria monocytogenes EGD-e
cuucguccagcug

SEQ ID NO: 777009 - RNA, 21 nt, Listeria monocytogenes EGD-e
cuuccaccuguauuaaugacu

SEQ ID NO: 777010 - RNA, 14 nt, Listeria monocytogenes EGD-e
cuucaucuuuauaa

SEQ ID NO: 777011 - RNA, 17 nt, Listeria monocytogenes EGD-e
cgaugauaauaacgaac

SEQ ID NO: 777012 - RNA, 19 nt, Listeria monocytogenes EGD-e
ccuucauaauuauuuuugu

SEQ ID NO: 777013 - RNA, 20 nt, Listeria monocytogenes EGD-e
cgccaccaacuucgagcagc

SEQ ID NO: 777014 - RNA, 19 nt, Listeria monocytogenes EGD-e
cgccaguugcugaauauca

SEQ ID NO: 777015 - RNA, 13 nt, Listeria monocytogenes EGD-e
cgccagcuucacg

SEQ ID NO: 777016 - RNA, 14 nt, Listeria monocytogenes EGD-e
cgccuauuauuucu

SEQ ID NO: 777017 - RNA, 23 nt, Listeria monocytogenes EGD-e
cgcgacaaaguaacuaaaaauca

SEQ ID NO: 777018 - RNA, 23 nt, Listeria monocytogenes EGD-e
cgcgccauuugccaucgcagcag

SEQ ID NO: 777019 - RNA, 14 nt, Listeria monocytogenes EGD-e
cgguccuucaaucg

SEQ ID NO: 777020 - RNA, 21 nt, Listeria monocytogenes EGD-e
cguagcagauguaucuaaaau

SEQ ID NO: 777021 - RNA, 17 nt, Listeria monocytogenes EGD-e
cguaacgggucgcuguc

SEQ ID NO: 777022 - RNA, 14 nt, Listeria monocytogenes EGD-e
cguaucaauaacaa

SEQ ID NO: 777023 - RNA, 19 nt, Listeria monocytogenes EGD-e
cguauuaccucgcuuuaau

SEQ ID NO: 777024 - RNA, 20 nt, Listeria monocytogenes EGD-e
cgucauagauacucuuuaaa

SEQ ID NO: 777025 - RNA, 15 nt, Listeria monocytogenes EGD-e
cgucacgucccauug

SEQ ID NO: 777026 - RNA, 14 nt, Listeria monocytogenes EGD-e
cggcuuauuauaac

SEQ ID NO: 777027 - RNA, 15 nt, Listeria monocytogenes EGD-e
cgggcgcuuucacau

SEQ ID NO: 777028 - RNA, 16 nt, Listeria monocytogenes EGD-e
cgcuggauaaagaccu

SEQ ID NO: 777029 - RNA, 17 nt, Listeria monocytogenes EGD-e
cgcuuguuuugaugcua

SEQ ID NO: 777030 - RNA, 15 nt, Listeria monocytogenes EGD-e
cgcuguccauuccaa

SEQ ID NO: 777031 - RNA, 14 nt, Listeria monocytogenes EGD-e
cgcugucaaauucu

SEQ ID NO: 777032 - RNA, 23 nt, Listeria monocytogenes EGD-e
cgcggucaugagcuaauuuuuuu

SEQ ID NO: 777033 - RNA, 22 nt, Listeria monocytogenes EGD-e
cggccuccuguugcaccaaaaa

SEQ ID NO: 777034 - RNA, 14 nt, Listeria monocytogenes EGD-e
cggauucucuucua

SEQ ID NO: 777035 - RNA, 18 nt, Listeria monocytogenes EGD-e
cggaucgcgguagcuuca

SEQ ID NO: 777036 - RNA, 23 nt, Listeria monocytogenes EGD-e
cggaucgcgguagcuucaaucaa

SEQ ID NO: 777037 - RNA, 18 nt, Listeria monocytogenes EGD-e
ccagcaguuuucauuaaa

SEQ ID NO: 777038 - RNA, 17 nt, Listeria monocytogenes EGD-e
ccauaagacauaacaag

SEQ ID NO: 777039 - RNA, 17 nt, Listeria monocytogenes EGD-e
ccaucuucuaaugccgc

SEQ ID NO: 777040 - RNA, 13 nt, Listeria monocytogenes EGD-e
ccaucgcagcaga

SEQ ID NO: 777041 - RNA, 16 nt, Listeria monocytogenes EGD-e
ccaucauaaucccagu

SEQ ID NO: 777042 - RNA, 19 nt, Listeria monocytogenes EGD-e
ccagugaugguauuguuuu

SEQ ID NO: 777043 - RNA, 18 nt, Listeria monocytogenes EGD-e
ccagucacaaacgcuuuu

SEQ ID NO: 777044 - RNA, 23 nt, Listeria monocytogenes EGD-e
ccagcuagacaagcacuuacugc

SEQ ID NO: 777045 - RNA, 11 nt, Listeria monocytogenes EGD-e
cccaaaaauaa

SEQ ID NO: 777046 - RNA, 12 nt, Listeria monocytogenes EGD-e
ccauuuuucuuc

SEQ ID NO: 777047 - RNA, 17 nt, Listeria monocytogenes EGD-e
ccauugcccagcuuaau

SEQ ID NO: 777048 - RNA, 18 nt, Listeria monocytogenes EGD-e
ccauugcccagcuuaauc

SEQ ID NO: 777049 - RNA, 21 nt, Listeria monocytogenes EGD-e
cccuagcuauacauugaaaaa

SEQ ID NO: 777050 - RNA, 21 nt, Listeria monocytogenes EGD-e
ccgauaauuuucauuuguuuc

SEQ ID NO: 777051 - RNA, 18 nt, Listeria monocytogenes EGD-e
ccgauacaacaaaauaau

SEQ ID NO: 777052 - RNA, 23 nt, Listeria monocytogenes EGD-e
ccgauacaacaaaauaaucaauc

SEQ ID NO: 777053 - RNA, 22 nt, Listeria monocytogenes EGD-e
ccgcuugauguuuuugcuucuc

SEQ ID NO: 777054 - RNA, 14 nt, Listeria monocytogenes EGD-e
ccgugauaaauaac

SEQ ID NO: 777055 - RNA, 22 nt, Listeria monocytogenes EGD-e
ccuaggcgcucuuuaauaauua

SEQ ID NO: 777056 - RNA, 16 nt, Listeria monocytogenes EGD-e
ccuaucacaaaccaaa

SEQ ID NO: 777057 - RNA, 19 nt, Listeria monocytogenes EGD-e
ccuacuucuaaauuaacuu

SEQ ID NO: 777058 - RNA, 16 nt, Listeria monocytogenes EGD-e
ccuagaacuaauucua

SEQ ID NO: 777059 - RNA, 18 nt, Listeria monocytogenes EGD-e
ccuagccagacaucuuug

SEQ ID NO: 777060 - RNA, 15 nt, Listeria monocytogenes EGD-e
ccgguaccaucuuuu

SEQ ID NO: 777061 - RNA, 18 nt, Listeria monocytogenes EGD-e
ccggucugugauuacucc

SEQ ID NO: 777062 - RNA, 16 nt, Listeria monocytogenes EGD-e
ccgucaagcccagcua

SEQ ID NO: 777063 - RNA, 15 nt, Listeria monocytogenes EGD-e
ccguauuuauauucu

SEQ ID NO: 777064 - RNA, 14 nt, Listeria monocytogenes EGD-e
ccguccaauucuuu

SEQ ID NO: 777065 - RNA, 19 nt, Listeria monocytogenes EGD-e
ccucuaaaguuagauuaaa

SEQ ID NO: 777066 - RNA, 21 nt, Listeria monocytogenes EGD-e
ccucuaaaguuagauuaaaaa

SEQ ID NO: 777067 - RNA, 21 nt, Listeria monocytogenes EGD-e
ccucauauuuggccaauuaaa

SEQ ID NO: 777068 - RNA, 11 nt, Listeria monocytogenes EGD-e
ccuuaaaauaa

SEQ ID NO: 777069 - RNA, 13 nt, Listeria monocytogenes EGD-e
ccuucaauaauau

SEQ ID NO: 777070 - RNA, 12 nt, Listeria monocytogenes EGD-e
ccuuaugacaag

SEQ ID NO: 777071 - RNA, 20 nt, Listeria monocytogenes EGD-e
cagcuccauuaaaugaccaa

SEQ ID NO: 777072 - RNA, 18 nt, Listeria monocytogenes EGD-e
cagcuucaaucuguucca

SEQ ID NO: 777073 - RNA, 20 nt, Listeria monocytogenes EGD-e
cagcuucuuccauuuguucu

SEQ ID NO: 777074 - RNA, 12 nt, Listeria monocytogenes EGD-e
caggaagcccau

SEQ ID NO: 777075 - RNA, 17 nt, Listeria monocytogenes EGD-e
cagcuugauaauuuuuu

SEQ ID NO: 777076 - RNA, 20 nt, Listeria monocytogenes EGD-e
cagcuugauaauuuuuuucg

SEQ ID NO: 777077 - RNA, 13 nt, Listeria monocytogenes EGD-e
cagcuugauuaaa

SEQ ID NO: 777078 - RNA, 16 nt, Listeria monocytogenes EGD-e
caggaguuaauucugu

SEQ ID NO: 777079 - RNA, 16 nt, Listeria monocytogenes EGD-e
caggauuaaaaguuga

SEQ ID NO: 777080 - RNA, 18 nt, Listeria monocytogenes EGD-e
caguagacuaaauugucu

SEQ ID NO: 777081 - RNA, 21 nt, Listeria monocytogenes EGD-e
caguaguugguaguuuuaaau

SEQ ID NO: 777082 - RNA, 14 nt, Listeria monocytogenes EGD-e
caguaguuuacuuc

SEQ ID NO: 777083 - RNA, 20 nt, Listeria monocytogenes EGD-e
caggguggccgugauaaaua

SEQ ID NO: 777084 - RNA, 15 nt, Listeria monocytogenes EGD-e
cauaaauugauucug

SEQ ID NO: 777085 - RNA, 15 nt, Listeria monocytogenes EGD-e
caguuuauaaauacc

SEQ ID NO: 777086 - RNA, 23 nt, Listeria monocytogenes EGD-e
caguuuauaaauaccuguuucug

SEQ ID NO: 777087 - RNA, 14 nt, Listeria monocytogenes EGD-e
cauaaccuucaucg

SEQ ID NO: 777088 - RNA, 15 nt, Listeria monocytogenes EGD-e
cauaccaauaacgag

SEQ ID NO: 777089 - RNA, 22 nt, Listeria monocytogenes EGD-e
cauacgauugggcggaaauaaa

SEQ ID NO: 777090 - RNA, 20 nt, Listeria monocytogenes EGD-e
cauauaauucuaauagcaua

SEQ ID NO: 777091 - RNA, 21 nt, Listeria monocytogenes EGD-e
cauauaauuuuuucauuuucu

SEQ ID NO: 777092 - RNA, 15 nt, Listeria monocytogenes EGD-e
cauauaaucuacugu

SEQ ID NO: 777093 - RNA, 16 nt, Listeria monocytogenes EGD-e
cauauaaucuacugua

SEQ ID NO: 777094 - RNA, 14 nt, Listeria monocytogenes EGD-e
cauacuuuuuaucu

SEQ ID NO: 777095 - RNA, 15 nt, Listeria monocytogenes EGD-e
cauauaaaguuuuuu

SEQ ID NO: 777096 - RNA, 16 nt, Listeria monocytogenes EGD-e
cauauauguaguuuca

SEQ ID NO: 777097 - RNA, 19 nt, Listeria monocytogenes EGD-e
cauauuuggccaauuaaaa

SEQ ID NO: 777098 - RNA, 21 nt, Listeria monocytogenes EGD-e
caucauauaauucuaauagca

SEQ ID NO: 777099 - RNA, 16 nt, Listeria monocytogenes EGD-e
caucaguaguaaagca

SEQ ID NO: 777100 - RNA, 14 nt, Listeria monocytogenes EGD-e
caucauaaacauuu

SEQ ID NO: 777101 - RNA, 14 nt, Listeria monocytogenes EGD-e
cauccuuuuuucug

SEQ ID NO: 777102 - RNA, 19 nt, Listeria monocytogenes EGD-e
caucgaauacuaacgcuuu

SEQ ID NO: 777103 - RNA, 20 nt, Listeria monocytogenes EGD-e
caucugaaaaaguuguuucu

SEQ ID NO: 777104 - RNA, 17 nt, Listeria monocytogenes EGD-e
caucugagaagccagca

SEQ ID NO: 777105 - RNA, 15 nt, Listeria monocytogenes EGD-e
caucuuaucaaguaa

SEQ ID NO: 777106 - RNA, 17 nt, Listeria monocytogenes EGD-e
caucuuaucaaguaaua

SEQ ID NO: 777107 - RNA, 18 nt, Listeria monocytogenes EGD-e
caucuuaucaaguaauaa

SEQ ID NO: 777108 - RNA, 13 nt, Listeria monocytogenes EGD-e
caucuuccgcuuc

SEQ ID NO: 777109 - RNA, 14 nt, Listeria monocytogenes EGD-e
caugcuaaauaaaa

SEQ ID NO: 777110 - RNA, 13 nt, Listeria monocytogenes EGD-e
caucuuuuuucuc

SEQ ID NO: 777111 - RNA, 12 nt, Listeria monocytogenes EGD-e
caucuuuuucuu

SEQ ID NO: 777112 - RNA, 16 nt, Listeria monocytogenes EGD-e
caucuuuuaucuuccc

SEQ ID NO: 777113 - RNA, 14 nt, Listeria monocytogenes EGD-e
caucuuuguauacu

SEQ ID NO: 777114 - RNA, 15 nt, Listeria monocytogenes EGD-e
cauuagauuugcaag

SEQ ID NO: 777115 - RNA, 14 nt, Listeria monocytogenes EGD-e
cauuaauucauuua

SEQ ID NO: 777116 - RNA, 22 nt, Listeria monocytogenes EGD-e
cauuacaaaauuugucuuuacu

SEQ ID NO: 777117 - RNA, 16 nt, Listeria monocytogenes EGD-e
cauuaaccuacuuuaa

SEQ ID NO: 777118 - RNA, 15 nt, Listeria monocytogenes EGD-e
cauuaaagcuauaua

SEQ ID NO: 777119 - RNA, 21 nt, Listeria monocytogenes EGD-e
cauuaaaaaggaauuuuucca

SEQ ID NO: 777120 - RNA, 18 nt, Listeria monocytogenes EGD-e
cauuuaacaucagauuaa

SEQ ID NO: 777121 - RNA, 21 nt, Listeria monocytogenes EGD-e
cauuuaacaucagauuaaaua

SEQ ID NO: 777122 - RNA, 21 nt, Listeria monocytogenes EGD-e
cauuuaauugucgaaaaccua

SEQ ID NO: 777123 - RNA, 14 nt, Listeria monocytogenes EGD-e
cauuugaaaaaggg

SEQ ID NO: 777124 - RNA, 15 nt, Listeria monocytogenes EGD-e
cauuuaauuuacugg

SEQ ID NO: 777125 - RNA, 19 nt, Listeria monocytogenes EGD-e
cauuugauacauauuugaa

SEQ ID NO: 777126 - RNA, 13 nt, Listeria monocytogenes EGD-e
cauuuguuucuuu

SEQ ID NO: 777127 - RNA, 15 nt, Listeria monocytogenes EGD-e
cauuuguuucuuuug

SEQ ID NO: 777128 - RNA, 15 nt, Listeria monocytogenes EGD-e
cauuuguuuuauuuu

SEQ ID NO: 777129 - RNA, 18 nt, Listeria monocytogenes EGD-e
cauuuguuuuauuuuggu

SEQ ID NO: 777130 - RNA, 13 nt, Listeria monocytogenes EGD-e
cauuuucacaagu

SEQ ID NO: 777131 - RNA, 12 nt, Listeria monocytogenes EGD-e
cauugauaucca

SEQ ID NO: 777132 - RNA, 20 nt, Listeria monocytogenes EGD-e
cauugauauccaguauuucc

SEQ ID NO: 777133 - RNA, 19 nt, Listeria monocytogenes EGD-e
cauugcaaucaucuuauca

SEQ ID NO: 777134 - RNA, 14 nt, Listeria monocytogenes EGD-e
cauuguuaaauuau

SEQ ID NO: 777135 - RNA, 22 nt, Listeria monocytogenes EGD-e
cauuguugcggcaguaguuuac

SEQ ID NO: 777136 - RNA, 17 nt, Listeria monocytogenes EGD-e
cauugcuuuguguuaau

SEQ ID NO: 777137 - RNA, 22 nt, Listeria monocytogenes EGD-e
cagcagauuuugcgaaagcugu

SEQ ID NO: 777138 - RNA, 16 nt, Listeria monocytogenes EGD-e
cagcaguuuucauuaa

SEQ ID NO: 777139 - RNA, 15 nt, Listeria monocytogenes EGD-e
cagccaauucuucca

SEQ ID NO: 777140 - RNA, 16 nt, Listeria monocytogenes EGD-e
cacugugaacugauuu

SEQ ID NO: 777141 - RNA, 20 nt, Listeria monocytogenes EGD-e
cacugugaacugauuuuuug

SEQ ID NO: 777142 - RNA, 17 nt, Listeria monocytogenes EGD-e
cacuggagcugauuuua

SEQ ID NO: 777143 - RNA, 21 nt, Listeria monocytogenes EGD-e
cacuggagcugauuuuauuuu

SEQ ID NO: 777144 - RNA, 21 nt, Listeria monocytogenes EGD-e
cacuuagguuagcagcuuuug

SEQ ID NO: 777145 - RNA, 15 nt, Listeria monocytogenes EGD-e
cacuucuuccaccug

SEQ ID NO: 777146 - RNA, 19 nt, Listeria monocytogenes EGD-e
cacuucuaccguuccuuca

SEQ ID NO: 777147 - RNA, 17 nt, Listeria monocytogenes EGD-e
cagaaaacagaaagcug

SEQ ID NO: 777148 - RNA, 19 nt, Listeria monocytogenes EGD-e
cacuuggaacggcuuuauc

SEQ ID NO: 777149 - RNA, 17 nt, Listeria monocytogenes EGD-e
cagaaacuuucuuuucu

SEQ ID NO: 777150 - RNA, 22 nt, Listeria monocytogenes EGD-e
cagaaagcuguuuucaacaaaa

SEQ ID NO: 777151 - RNA, 23 nt, Listeria monocytogenes EGD-e
cagaaggggcugugaaggaaacg

SEQ ID NO: 777152 - RNA, 19 nt, Listeria monocytogenes EGD-e
cagaaugggccguccaauu

SEQ ID NO: 777153 - RNA, 17 nt, Listeria monocytogenes EGD-e
cagacuuuuuuuuauaa

SEQ ID NO: 777154 - RNA, 13 nt, Listeria monocytogenes EGD-e
cagagaaaccgcu

SEQ ID NO: 777155 - RNA, 21 nt, Listeria monocytogenes EGD-e
cagaucaaaagcaaaaaagua

SEQ ID NO: 777156 - RNA, 15 nt, Listeria monocytogenes EGD-e
cagauaguuguucca

SEQ ID NO: 777157 - RNA, 22 nt, Listeria monocytogenes EGD-e
cagauguaucuaaaaucauuaa

SEQ ID NO: 777158 - RNA, 18 nt, Listeria monocytogenes EGD-e
cagauuuggucauuuuuu

SEQ ID NO: 777159 - RNA, 19 nt, Listeria monocytogenes EGD-e
cagcaagugugauuguucc

SEQ ID NO: 777160 - RNA, 20 nt, Listeria monocytogenes EGD-e
cagcaagugugauuguucca

SEQ ID NO: 777161 - RNA, 16 nt, Listeria monocytogenes EGD-e
caaaaggacaagccca

SEQ ID NO: 777162 - RNA, 14 nt, Listeria monocytogenes EGD-e
caaacuuuuccuuc

SEQ ID NO: 777163 - RNA, 13 nt, Listeria monocytogenes EGD-e
caaagaagaaaaa

SEQ ID NO: 777164 - RNA, 23 nt, Listeria monocytogenes EGD-e
caaagaagaagacgaaaagcaau

SEQ ID NO: 777165 - RNA, 17 nt, Listeria monocytogenes EGD-e
caaaguaacuaaaaauc

SEQ ID NO: 777166 - RNA, 13 nt, Listeria monocytogenes EGD-e
caaaguaaaauac

SEQ ID NO: 777167 - RNA, 15 nt, Listeria monocytogenes EGD-e
caaaguauugugcua

SEQ ID NO: 777168 - RNA, 22 nt, Listeria monocytogenes EGD-e
caaaguauugugcuaaguagac

SEQ ID NO: 777169 - RNA, 22 nt, Listeria monocytogenes EGD-e
caaauagguugggcugcaacaa

SEQ ID NO: 777170 - RNA, 17 nt, Listeria monocytogenes EGD-e
caaaugcacagcagaaa

SEQ ID NO: 777171 - RNA, 21 nt, Listeria monocytogenes EGD-e
caaauucugaaaugauuuuua

SEQ ID NO: 777172 - RNA, 13 nt, Listeria monocytogenes EGD-e
caaauuauuagaa

SEQ ID NO: 777173 - RNA, 14 nt, Listeria monocytogenes EGD-e
caacaauuacuucc

SEQ ID NO: 777174 - RNA, 15 nt, Listeria monocytogenes EGD-e
caacaauuacuucca

SEQ ID NO: 777175 - RNA, 17 nt, Listeria monocytogenes EGD-e
caacaaucguacccgua

SEQ ID NO: 777176 - RNA, 21 nt, Listeria monocytogenes EGD-e
caacacacuaucccaaagauu

SEQ ID NO: 777177 - RNA, 21 nt, Listeria monocytogenes EGD-e
caaauuucuguuaugaacaga

SEQ ID NO: 777178 - RNA, 20 nt, Listeria monocytogenes EGD-e
caaccaagcaauaacaucuu

SEQ ID NO: 777179 - RNA, 19 nt, Listeria monocytogenes EGD-e
caaccaguauuccuagcac

SEQ ID NO: 777180 - RNA, 16 nt, Listeria monocytogenes EGD-e
caacuggacaaugauc

SEQ ID NO: 777181 - RNA, 18 nt, Listeria monocytogenes EGD-e
caacuaauuuuucgauug

SEQ ID NO: 777182 - RNA, 22 nt, Listeria monocytogenes EGD-e
caaccuauuugguacuugugaa

SEQ ID NO: 777183 - RNA, 23 nt, Listeria monocytogenes EGD-e
caaucugaacugacuagaaauua

SEQ ID NO: 777184 - RNA, 13 nt, Listeria monocytogenes EGD-e
caaucgcagcaga

SEQ ID NO: 777185 - RNA, 14 nt, Listeria monocytogenes EGD-e
caauccauuuuucu

SEQ ID NO: 777186 - RNA, 17 nt, Listeria monocytogenes EGD-e
caaucccuauaaaaaca

SEQ ID NO: 777187 - RNA, 17 nt, Listeria monocytogenes EGD-e
caaucauuuauuuuccc

SEQ ID NO: 777188 - RNA, 15 nt, Listeria monocytogenes EGD-e
caaucaugccagcuu

SEQ ID NO: 777189 - RNA, 17 nt, Listeria monocytogenes EGD-e
caaugauaucaucaaua

SEQ ID NO: 777190 - RNA, 15 nt, Listeria monocytogenes EGD-e
caaucuguuccaaca

SEQ ID NO: 777191 - RNA, 20 nt, Listeria monocytogenes EGD-e
caaugaccuaguuaaucuaa

SEQ ID NO: 777192 - RNA, 11 nt, Listeria monocytogenes EGD-e
caauguauaca

SEQ ID NO: 777193 - RNA, 13 nt, Listeria monocytogenes EGD-e
caaugcccaguaa

SEQ ID NO: 777194 - RNA, 20 nt, Listeria monocytogenes EGD-e
caauaauaauacaaacuuuu

SEQ ID NO: 777195 - RNA, 19 nt, Listeria monocytogenes EGD-e
caauaacaucuuuaaaaac

SEQ ID NO: 777196 - RNA, 21 nt, Listeria monocytogenes EGD-e
caaguuuuuuaauuuuucuuc

SEQ ID NO: 777197 - RNA, 13 nt, Listeria monocytogenes EGD-e
caagcacagcaau

SEQ ID NO: 777198 - RNA, 18 nt, Listeria monocytogenes EGD-e
caagcguacggaauuuau

SEQ ID NO: 777199 - RNA, 21 nt, Listeria monocytogenes EGD-e
caagggugaucaaucaguuca

SEQ ID NO: 777200 - RNA, 15 nt, Listeria monocytogenes EGD-e
auuuuugcauccacu

SEQ ID NO: 777201 - RNA, 19 nt, Listeria monocytogenes EGD-e
auuuuugaauuaguauuuu

SEQ ID NO: 777202 - RNA, 13 nt, Listeria monocytogenes EGD-e
auuuuucuuucuu

SEQ ID NO: 777203 - RNA, 22 nt, Listeria monocytogenes EGD-e
auuuuucuagugcaucuucuaa

SEQ ID NO: 777204 - RNA, 18 nt, Listeria monocytogenes EGD-e
auuuuucagcuaaauauu

SEQ ID NO: 777205 - RNA, 19 nt, Listeria monocytogenes EGD-e
auuuuuugcgcguucuucu

SEQ ID NO: 777206 - RNA, 21 nt, Listeria monocytogenes EGD-e
auuuuuucuuugccuuaaaau

SEQ ID NO: 777207 - RNA, 19 nt, Listeria monocytogenes EGD-e
auuuuuuggugacgaauca

SEQ ID NO: 777208 - RNA, 16 nt, Listeria monocytogenes EGD-e
auuuuuuugaaaaaac

SEQ ID NO: 777209 - RNA, 15 nt, Listeria monocytogenes EGD-e
auuuuuuugauuaau

SEQ ID NO: 777210 - RNA, 16 nt, Listeria monocytogenes EGD-e
auuuuuuucgaaagaa

SEQ ID NO: 777211 - RNA, 14 nt, Listeria monocytogenes EGD-e
caaaacauuuucau

SEQ ID NO: 777212 - RNA, 16 nt, Listeria monocytogenes EGD-e
caaaagauagacacac

SEQ ID NO: 777213 - RNA, 13 nt, Listeria monocytogenes EGD-e
caaaaauaugcuu

SEQ ID NO: 777214 - RNA, 15 nt, Listeria monocytogenes EGD-e
caaaaagauacuuug

SEQ ID NO: 777215 - RNA, 21 nt, Listeria monocytogenes EGD-e
caaaaagauuauggaaaaauc

SEQ ID NO: 777216 - RNA, 18 nt, Listeria monocytogenes EGD-e
auuucucccucauccuuu

SEQ ID NO: 777217 - RNA, 22 nt, Listeria monocytogenes EGD-e
auuugaacccuuugaauugauu

SEQ ID NO: 777218 - RNA, 16 nt, Listeria monocytogenes EGD-e
auuugguacuugugaa

SEQ ID NO: 777219 - RNA, 17 nt, Listeria monocytogenes EGD-e
auuugcucgaauucuuu

SEQ ID NO: 777220 - RNA, 20 nt, Listeria monocytogenes EGD-e
auuugucuucggauuuuuca

SEQ ID NO: 777221 - RNA, 19 nt, Listeria monocytogenes EGD-e
auuugucccacaaacucau

SEQ ID NO: 777222 - RNA, 13 nt, Listeria monocytogenes EGD-e
auuuucauucuuu

SEQ ID NO: 777223 - RNA, 18 nt, Listeria monocytogenes EGD-e
auuuuaaucauugcuuug

SEQ ID NO: 777224 - RNA, 14 nt, Listeria monocytogenes EGD-e
auucugugauggaa

SEQ ID NO: 777225 - RNA, 16 nt, Listeria monocytogenes EGD-e
auucagccguuuccuc

SEQ ID NO: 777226 - RNA, 21 nt, Listeria monocytogenes EGD-e
auucuagccgcucgucuaaau

SEQ ID NO: 777227 - RNA, 15 nt, Listeria monocytogenes EGD-e
auucuucaauacguu

SEQ ID NO: 777228 - RNA, 20 nt, Listeria monocytogenes EGD-e
auugcccagcuuaauccaau

SEQ ID NO: 777229 - RNA, 22 nt, Listeria monocytogenes EGD-e
auugagcgguuuuguuuccaac

SEQ ID NO: 777230 - RNA, 20 nt, Listeria monocytogenes EGD-e
auugcaacaguuauuaaaag

SEQ ID NO: 777231 - RNA, 21 nt, Listeria monocytogenes EGD-e
auugcaacaguuauuaaaagg

SEQ ID NO: 777232 - RNA, 21 nt, Listeria monocytogenes EGD-e
auugcuuuguguuaauaaaau

SEQ ID NO: 777233 - RNA, 13 nt, Listeria monocytogenes EGD-e
auugcuucaccaa

SEQ ID NO: 777234 - RNA, 19 nt, Listeria monocytogenes EGD-e
auugcuucuuuuuucuucc

SEQ ID NO: 777235 - RNA, 22 nt, Listeria monocytogenes EGD-e
auugcuucuccguuuuccacca

SEQ ID NO: 777236 - RNA, 16 nt, Listeria monocytogenes EGD-e
auugcgaauaacaagc

SEQ ID NO: 777237 - RNA, 15 nt, Listeria monocytogenes EGD-e
auuguuaauagaagc

SEQ ID NO: 777238 - RNA, 18 nt, Listeria monocytogenes EGD-e
auuguuaauagaagccaa

SEQ ID NO: 777239 - RNA, 20 nt, Listeria monocytogenes EGD-e
auugucauaaaacuuucaca

SEQ ID NO: 777240 - RNA, 21 nt, Listeria monocytogenes EGD-e
auuguaccgcuugauguuuuu

SEQ ID NO: 777241 - RNA, 21 nt, Listeria monocytogenes EGD-e
auuuagaggcguacuaaaaau

SEQ ID NO: 777242 - RNA, 21 nt, Listeria monocytogenes EGD-e
auuuaaucauuaaccuacuuu

SEQ ID NO: 777243 - RNA, 22 nt, Listeria monocytogenes EGD-e
auuucagcuaaucguuuuaaag

SEQ ID NO: 777244 - RNA, 16 nt, Listeria monocytogenes EGD-e
auuucaaauggagcua

SEQ ID NO: 777245 - RNA, 15 nt, Listeria monocytogenes EGD-e
auuucaaccaauucu

SEQ ID NO: 777246 - RNA, 15 nt, Listeria monocytogenes EGD-e
auuucaauaaugugg

SEQ ID NO: 777247 - RNA, 14 nt, Listeria monocytogenes EGD-e
auuuauuuucccuc

SEQ ID NO: 777248 - RNA, 15 nt, Listeria monocytogenes EGD-e
auuuauuuagaaauc

SEQ ID NO: 777249 - RNA, 15 nt, Listeria monocytogenes EGD-e
auuuauuauuguuaa

SEQ ID NO: 777250 - RNA, 13 nt, Listeria monocytogenes EGD-e
auuuauuauaagc

SEQ ID NO: 777251 - RNA, 13 nt, Listeria monocytogenes EGD-e
auuacuaaaaagg

SEQ ID NO: 777252 - RNA, 23 nt, Listeria monocytogenes EGD-e
auuacggaucgcgguagcuucaa

SEQ ID NO: 777253 - RNA, 22 nt, Listeria monocytogenes EGD-e
auuaccuaaugaauaagcaauu

SEQ ID NO: 777254 - RNA, 22 nt, Listeria monocytogenes EGD-e
auuacaaaauuugucuuuacua

SEQ ID NO: 777255 - RNA, 23 nt, Listeria monocytogenes EGD-e
auuaauuugauugccugaaauaa

SEQ ID NO: 777256 - RNA, 18 nt, Listeria monocytogenes EGD-e
auuagugccaugaauauu

SEQ ID NO: 777257 - RNA, 16 nt, Listeria monocytogenes EGD-e
auuauaaaaaguggcu

SEQ ID NO: 777258 - RNA, 18 nt, Listeria monocytogenes EGD-e
auuauaaccccaaaaugc

SEQ ID NO: 777259 - RNA, 18 nt, Listeria monocytogenes EGD-e
auuauaaguguaaaaguu

SEQ ID NO: 777260 - RNA, 18 nt, Listeria monocytogenes EGD-e
auuauacaauuaauaaua

SEQ ID NO: 777261 - RNA, 16 nt, Listeria monocytogenes EGD-e
auuagaaugcuaaauu

SEQ ID NO: 777262 - RNA, 16 nt, Listeria monocytogenes EGD-e
auuagaaaaucauuuc

SEQ ID NO: 777263 - RNA, 21 nt, Listeria monocytogenes EGD-e
auuagcuaggccuacuuuuuu

SEQ ID NO: 777264 - RNA, 13 nt, Listeria monocytogenes EGD-e
auuagacaaaaag

SEQ ID NO: 777265 - RNA, 16 nt, Listeria monocytogenes EGD-e
auucaauuuauauuuu

SEQ ID NO: 777266 - RNA, 21 nt, Listeria monocytogenes EGD-e
auucaauucccaggcugcuug

SEQ ID NO: 777267 - RNA, 18 nt, Listeria monocytogenes EGD-e
auucacgguguugaauaa

SEQ ID NO: 777268 - RNA, 22 nt, Listeria monocytogenes EGD-e
auucaauacuuuuuucuauauu

SEQ ID NO: 777269 - RNA, 13 nt, Listeria monocytogenes EGD-e
auucaaauucaau

SEQ ID NO: 777270 - RNA, 11 nt, Listeria monocytogenes EGD-e
auucaaaucac

SEQ ID NO: 777271 - RNA, 13 nt, Listeria monocytogenes EGD-e
auucaaaauggua

SEQ ID NO: 777272 - RNA, 22 nt, Listeria monocytogenes EGD-e
auuaugucggugcauuuuuucu

SEQ ID NO: 777273 - RNA, 19 nt, Listeria monocytogenes EGD-e
auuauggcauaaaaaaucu

SEQ ID NO: 777274 - RNA, 17 nt, Listeria monocytogenes EGD-e
auuauggaaaaauccac

SEQ ID NO: 777275 - RNA, 17 nt, Listeria monocytogenes EGD-e
auuauauuuuagcuauu

SEQ ID NO: 777276 - RNA, 16 nt, Listeria monocytogenes EGD-e
auuaaagcuauauaau

SEQ ID NO: 777277 - RNA, 10 nt, Listeria monocytogenes EGD-e
auguuuuccc

SEQ ID NO: 777278 - RNA, 19 nt, Listeria monocytogenes EGD-e
auuaaaauaguuuuuuuca

SEQ ID NO: 777279 - RNA, 19 nt, Listeria monocytogenes EGD-e
auuaaaaggacacccauaa

SEQ ID NO: 777280 - RNA, 16 nt, Listeria monocytogenes EGD-e
auuaaccuacuuuaau

SEQ ID NO: 777281 - RNA, 15 nt, Listeria monocytogenes EGD-e
auuaagaaguacaau

SEQ ID NO: 777282 - RNA, 21 nt, Listeria monocytogenes EGD-e
auuaagaaguacaauaaaguu

SEQ ID NO: 777283 - RNA, 14 nt, Listeria monocytogenes EGD-e
auuaacaaccauuu

SEQ ID NO: 777284 - RNA, 19 nt, Listeria monocytogenes EGD-e
auuaaaugaccaaugcuuu

SEQ ID NO: 777285 - RNA, 18 nt, Listeria monocytogenes EGD-e
auuaaauuuuuuugaaaa

SEQ ID NO: 777286 - RNA, 21 nt, Listeria monocytogenes EGD-e
auuaaauuuuuuugaaaaaac

SEQ ID NO: 777287 - RNA, 19 nt, Listeria monocytogenes EGD-e
auuaauaaaagaggauuuu

SEQ ID NO: 777288 - RNA, 22 nt, Listeria monocytogenes EGD-e
auuaauaaaagaggauuuucca

SEQ ID NO: 777289 - RNA, 23 nt, Listeria monocytogenes EGD-e
auuaauaaugauuucuauaaaaa

SEQ ID NO: 777290 - RNA, 14 nt, Listeria monocytogenes EGD-e
auuaaugauuucaa

SEQ ID NO: 777291 - RNA, 16 nt, Listeria monocytogenes EGD-e
auuaaugacuguuguu

SEQ ID NO: 777292 - RNA, 16 nt, Listeria monocytogenes EGD-e
augguauacuauacaa

SEQ ID NO: 777293 - RNA, 13 nt, Listeria monocytogenes EGD-e
auggggauuuuac

SEQ ID NO: 777294 - RNA, 15 nt, Listeria monocytogenes EGD-e
auggcauaaaaaauc

SEQ ID NO: 777295 - RNA, 14 nt, Listeria monocytogenes EGD-e
auguaucuaaaauc

SEQ ID NO: 777296 - RNA, 17 nt, Listeria monocytogenes EGD-e
auguaucuaaaaucauu

SEQ ID NO: 777297 - RNA, 22 nt, Listeria monocytogenes EGD-e
auguauauuccggaaugcgcgc

SEQ ID NO: 777298 - RNA, 21 nt, Listeria monocytogenes EGD-e
auguauacacuaguauuccua

SEQ ID NO: 777299 - RNA, 23 nt, Listeria monocytogenes EGD-e
auguaguuauagcggucaaucau

SEQ ID NO: 777300 - RNA, 21 nt, Listeria monocytogenes EGD-e
augugcuuguaagaagcuuuu

SEQ ID NO: 777301 - RNA, 14 nt, Listeria monocytogenes EGD-e
auguuaaauucauu

SEQ ID NO: 777302 - RNA, 21 nt, Listeria monocytogenes EGD-e
aucugcuaauacuauugaaug

SEQ ID NO: 777303 - RNA, 23 nt, Listeria monocytogenes EGD-e
aucugguacguuuuuuauuuuuu

SEQ ID NO: 777304 - RNA, 15 nt, Listeria monocytogenes EGD-e
aucugggcucguugc

SEQ ID NO: 777305 - RNA, 22 nt, Listeria monocytogenes EGD-e
aucuuucaaacguuccgauaca

SEQ ID NO: 777306 - RNA, 16 nt, Listeria monocytogenes EGD-e
aucuugacuuuguuaa

SEQ ID NO: 777307 - RNA, 22 nt, Listeria monocytogenes EGD-e
aucuugauccaaguuuuuuaau

SEQ ID NO: 777308 - RNA, 14 nt, Listeria monocytogenes EGD-e
aucuugaugccauc

SEQ ID NO: 777309 - RNA, 20 nt, Listeria monocytogenes EGD-e
augaagagauaaguuuucau

SEQ ID NO: 777310 - RNA, 17 nt, Listeria monocytogenes EGD-e
augaagccauucccguc

SEQ ID NO: 777311 - RNA, 22 nt, Listeria monocytogenes EGD-e
augaaaccaaauaugcuauaca

SEQ ID NO: 777312 - RNA, 15 nt, Listeria monocytogenes EGD-e
aucuuuuccaaaaug

SEQ ID NO: 777313 - RNA, 15 nt, Listeria monocytogenes EGD-e
aucuuuuaucuuccc

SEQ ID NO: 777314 - RNA, 12 nt, Listeria monocytogenes EGD-e
augacuuaaaug

SEQ ID NO: 777315 - RNA, 22 nt, Listeria monocytogenes EGD-e
augaauagauauucucuuauga

SEQ ID NO: 777316 - RNA, 13 nt, Listeria monocytogenes EGD-e
augaauauuagaa

SEQ ID NO: 777317 - RNA, 14 nt, Listeria monocytogenes EGD-e
augaccaaaucugc

SEQ ID NO: 777318 - RNA, 23 nt, Listeria monocytogenes EGD-e
augacaucuucuagcgucacaau

SEQ ID NO: 777319 - RNA, 17 nt, Listeria monocytogenes EGD-e
augauuguucuuuaaaa

SEQ ID NO: 777320 - RNA, 18 nt, Listeria monocytogenes EGD-e
augcaauccauguuguuu

SEQ ID NO: 777321 - RNA, 15 nt, Listeria monocytogenes EGD-e
augcagguaaaacag

SEQ ID NO: 777322 - RNA, 21 nt, Listeria monocytogenes EGD-e
augccuucaaacacuucuaaa

SEQ ID NO: 777323 - RNA, 13 nt, Listeria monocytogenes EGD-e
augccaucaggag

SEQ ID NO: 777324 - RNA, 13 nt, Listeria monocytogenes EGD-e
augccaguauuuu

SEQ ID NO: 777325 - RNA, 17 nt, Listeria monocytogenes EGD-e
aucuaguacgaaaucaa

SEQ ID NO: 777326 - RNA, 21 nt, Listeria monocytogenes EGD-e
aucuaguacgaaaucaaacuu

SEQ ID NO: 777327 - RNA, 15 nt, Listeria monocytogenes EGD-e
aucugagaagccagc

SEQ ID NO: 777328 - RNA, 13 nt, Listeria monocytogenes EGD-e
aucugauuaaaag

SEQ ID NO: 777329 - RNA, 21 nt, Listeria monocytogenes EGD-e
aucugaacugacuagaaauua

SEQ ID NO: 777330 - RNA, 13 nt, Listeria monocytogenes EGD-e
aucuaaaaucauu

SEQ ID NO: 777331 - RNA, 16 nt, Listeria monocytogenes EGD-e
aucuaaaaucauuaaa

SEQ ID NO: 777332 - RNA, 20 nt, Listeria monocytogenes EGD-e
aucuacagguguauucgucu

SEQ ID NO: 777333 - RNA, 17 nt, Listeria monocytogenes EGD-e
aucgcaagcgacauuaa

SEQ ID NO: 777334 - RNA, 17 nt, Listeria monocytogenes EGD-e
aucgcaaaagcaaacaa

SEQ ID NO: 777335 - RNA, 12 nt, Listeria monocytogenes EGD-e
aucgcagcagaa

SEQ ID NO: 777336 - RNA, 18 nt, Listeria monocytogenes EGD-e
auaaugcucauuuuucuu

SEQ ID NO: 777337 - RNA, 18 nt, Listeria monocytogenes EGD-e
auaaucacguuuuugcuc

SEQ ID NO: 777338 - RNA, 20 nt, Listeria monocytogenes EGD-e
auaauaucuucuauauuaau

SEQ ID NO: 777339 - RNA, 19 nt, Listeria monocytogenes EGD-e
auaaucaauccgccaacca

SEQ ID NO: 777340 - RNA, 21 nt, Listeria monocytogenes EGD-e
auaauaccaggaucaaaaugg

SEQ ID NO: 777341 - RNA, 19 nt, Listeria monocytogenes EGD-e
auaauagguccgauaauac

SEQ ID NO: 777342 - RNA, 19 nt, Listeria monocytogenes EGD-e
auaagcaacgguaaacaac

SEQ ID NO: 777343 - RNA, 14 nt, Listeria monocytogenes EGD-e
auaagaagauauuu

SEQ ID NO: 777344 - RNA, 16 nt, Listeria monocytogenes EGD-e
auaagaagauauuuug

SEQ ID NO: 777345 - RNA, 16 nt, Listeria monocytogenes EGD-e
auaagacauaacaagu

SEQ ID NO: 777346 - RNA, 17 nt, Listeria monocytogenes EGD-e
auaagcaucggucaaau

SEQ ID NO: 777347 - RNA, 17 nt, Listeria monocytogenes EGD-e
auaagcgaauauccgau

SEQ ID NO: 777348 - RNA, 20 nt, Listeria monocytogenes EGD-e
auaagcuaacaacaagcaaa

SEQ ID NO: 777349 - RNA, 19 nt, Listeria monocytogenes EGD-e
auaaggguuuucagcucuu

SEQ ID NO: 777350 - RNA, 23 nt, Listeria monocytogenes EGD-e
auaaguuuucauauaaguguuag

SEQ ID NO: 777351 - RNA, 17 nt, Listeria monocytogenes EGD-e
auaaaccguuaccauaa

SEQ ID NO: 777352 - RNA, 11 nt, Listeria monocytogenes EGD-e
auaaaaauaca

SEQ ID NO: 777353 - RNA, 21 nt, Listeria monocytogenes EGD-e
auaaaaauaacggaaacuauc

SEQ ID NO: 777354 - RNA, 21 nt, Listeria monocytogenes EGD-e
auaaaaagcugccaccacuua

SEQ ID NO: 777355 - RNA, 15 nt, Listeria monocytogenes EGD-e
auaaccccaaaaugc

SEQ ID NO: 777356 - RNA, 19 nt, Listeria monocytogenes EGD-e
auaacccucgauuggaauc

SEQ ID NO: 777357 - RNA, 23 nt, Listeria monocytogenes EGD-e
auaacauuuucucuuguaaaagc

SEQ ID NO: 777358 - RNA, 23 nt, Listeria monocytogenes EGD-e
auaacagauuuggucauuuuuua

SEQ ID NO: 777359 - RNA, 20 nt, Listeria monocytogenes EGD-e
auaaccucgcaaaaaauaau

SEQ ID NO: 777360 - RNA, 20 nt, Listeria monocytogenes EGD-e
auaacuacuauuuaaauaua

SEQ ID NO: 777361 - RNA, 16 nt, Listeria monocytogenes EGD-e
auaacuuucucuugcu

SEQ ID NO: 777362 - RNA, 14 nt, Listeria monocytogenes EGD-e
agucuuuuuguaaa

SEQ ID NO: 777363 - RNA, 22 nt, Listeria monocytogenes EGD-e
agucuggauuucuccguaagaa

SEQ ID NO: 777364 - RNA, 16 nt, Listeria monocytogenes EGD-e
aguccgucaagcccag

SEQ ID NO: 777365 - RNA, 12 nt, Listeria monocytogenes EGD-e
agucgaaagugc

SEQ ID NO: 777366 - RNA, 15 nt, Listeria monocytogenes EGD-e
agugcaucuucuaag

SEQ ID NO: 777367 - RNA, 18 nt, Listeria monocytogenes EGD-e
agugcaucuucuaagaaa

SEQ ID NO: 777368 - RNA, 20 nt, Listeria monocytogenes EGD-e
agugcaucuucuaagaaaaa

SEQ ID NO: 777369 - RNA, 16 nt, Listeria monocytogenes EGD-e
agugcguaagauuuuu

SEQ ID NO: 777370 - RNA, 18 nt, Listeria monocytogenes EGD-e
agugcuaaaauaaaucug

SEQ ID NO: 777371 - RNA, 15 nt, Listeria monocytogenes EGD-e
aguguaauugauuug

SEQ ID NO: 777372 - RNA, 15 nt, Listeria monocytogenes EGD-e
agugguaguguaauu

SEQ ID NO: 777373 - RNA, 19 nt, Listeria monocytogenes EGD-e
aguggguaggcgaauccuu

SEQ ID NO: 777374 - RNA, 17 nt, Listeria monocytogenes EGD-e
aguuacuuuaccuugau

SEQ ID NO: 777375 - RNA, 22 nt, Listeria monocytogenes EGD-e
aguuagauuaaaaaucuagauu

SEQ ID NO: 777376 - RNA, 16 nt, Listeria monocytogenes EGD-e
aguuaaaccauaaaaa

SEQ ID NO: 777377 - RNA, 20 nt, Listeria monocytogenes EGD-e
aguucuguuggcgcagaaau

SEQ ID NO: 777378 - RNA, 14 nt, Listeria monocytogenes EGD-e
aguuccaucuucua

SEQ ID NO: 777379 - RNA, 17 nt, Listeria monocytogenes EGD-e
aguuguugcagcccaac

SEQ ID NO: 777380 - RNA, 22 nt, Listeria monocytogenes EGD-e
aguuguugcagcccaaccuauu

SEQ ID NO: 777381 - RNA, 15 nt, Listeria monocytogenes EGD-e
aguugcuuuagaaua

SEQ ID NO: 777382 - RNA, 21 nt, Listeria monocytogenes EGD-e
aguuucgaagugagaaucauu

SEQ ID NO: 777383 - RNA, 15 nt, Listeria monocytogenes EGD-e
aguuucuguucuuua

SEQ ID NO: 777384 - RNA, 21 nt, Listeria monocytogenes EGD-e
aguuucuuuaccauacacaua

SEQ ID NO: 777385 - RNA, 14 nt, Listeria monocytogenes EGD-e
aguuucuuuuugau

SEQ ID NO: 777386 - RNA, 19 nt, Listeria monocytogenes EGD-e
aguuuuuuuagaaauaugu

SEQ ID NO: 777387 - RNA, 12 nt, Listeria monocytogenes EGD-e
auaaaaaaauac

SEQ ID NO: 777388 - RNA, 13 nt, Listeria monocytogenes EGD-e
auaaaaaaauaca

SEQ ID NO: 777389 - RNA, 21 nt, Listeria monocytogenes EGD-e
auaauuaagaccuucuuuuaa

SEQ ID NO: 777390 - RNA, 23 nt, Listeria monocytogenes EGD-e
auacgauugggcggaaauaaaaa

SEQ ID NO: 777391 - RNA, 18 nt, Listeria monocytogenes EGD-e
auacuauugaauguucua

SEQ ID NO: 777392 - RNA, 19 nt, Listeria monocytogenes EGD-e
auacuucaugugcuuuuuu

SEQ ID NO: 777393 - RNA, 20 nt, Listeria monocytogenes EGD-e
auacuuugaauuaagaagua

SEQ ID NO: 777394 - RNA, 17 nt, Listeria monocytogenes EGD-e
auagagcuuuuaaauau

SEQ ID NO: 777395 - RNA, 21 nt, Listeria monocytogenes EGD-e
auagagcuuuuaaauauaccg

SEQ ID NO: 777396 - RNA, 14 nt, Listeria monocytogenes EGD-e
auagcccgcugccu

SEQ ID NO: 777397 - RNA, 19 nt, Listeria monocytogenes EGD-e
auagcuuucccuuuacuug

SEQ ID NO: 777398 - RNA, 20 nt, Listeria monocytogenes EGD-e
auagcuuaaagguuuuguuu

SEQ ID NO: 777399 - RNA, 18 nt, Listeria monocytogenes EGD-e
auagcuacaauuaaaaua

SEQ ID NO: 777400 - RNA, 20 nt, Listeria monocytogenes EGD-e
auaggcgcgaguacaauuau

SEQ ID NO: 777401 - RNA, 14 nt, Listeria monocytogenes EGD-e
auaguuuucuacua

SEQ ID NO: 777402 - RNA, 12 nt, Listeria monocytogenes EGD-e
auauaauuuuuu

SEQ ID NO: 777403 - RNA, 10 nt, Listeria monocytogenes EGD-e
auaucaccaa

SEQ ID NO: 777404 - RNA, 22 nt, Listeria monocytogenes EGD-e
auaucaccaacaauuacuucca

SEQ ID NO: 777405 - RNA, 16 nt, Listeria monocytogenes EGD-e
auaucaaaguaaaaua

SEQ ID NO: 777406 - RNA, 23 nt, Listeria monocytogenes EGD-e
auauacacaaaguaaaaaggaaa

SEQ ID NO: 777407 - RNA, 16 nt, Listeria monocytogenes EGD-e
auauccaguauuuccc

SEQ ID NO: 777408 - RNA, 23 nt, Listeria monocytogenes EGD-e
auaucuacaggcuauuccagcua

SEQ ID NO: 777409 - RNA, 22 nt, Listeria monocytogenes EGD-e
auauuuggccaauuaaaauacg

SEQ ID NO: 777410 - RNA, 21 nt, Listeria monocytogenes EGD-e
auauuuugcucaagugaacgu

SEQ ID NO: 777411 - RNA, 12 nt, Listeria monocytogenes EGD-e
auauuuucucua

SEQ ID NO: 777412 - RNA, 17 nt, Listeria monocytogenes EGD-e
auauucuucuaaaauaa

SEQ ID NO: 777413 - RNA, 18 nt, Listeria monocytogenes EGD-e
auauucuucuaaaauaac

SEQ ID NO: 777414 - RNA, 22 nt, Listeria monocytogenes EGD-e
auauucuucugucacaucuguu

SEQ ID NO: 777415 - RNA, 17 nt, Listeria monocytogenes EGD-e
auauucacaucacuaau

SEQ ID NO: 777416 - RNA, 14 nt, Listeria monocytogenes EGD-e
auauucaaaauggu

SEQ ID NO: 777417 - RNA, 22 nt, Listeria monocytogenes EGD-e
auaugauaaccgcuaucuacau

SEQ ID NO: 777418 - RNA, 12 nt, Listeria monocytogenes EGD-e
aucaaccacuuu

SEQ ID NO: 777419 - RNA, 19 nt, Listeria monocytogenes EGD-e
aucaacgggcgcuuucaca

SEQ ID NO: 777420 - RNA, 20 nt, Listeria monocytogenes EGD-e
aucaacgggcgcuuucacau

SEQ ID NO: 777421 - RNA, 17 nt, Listeria monocytogenes EGD-e
aucaagauuuugcucag

SEQ ID NO: 777422 - RNA, 21 nt, Listeria monocytogenes EGD-e
aucaagauuuuguacauaaaa

SEQ ID NO: 777423 - RNA, 23 nt, Listeria monocytogenes EGD-e
aucaagccuaggcucucuucgcc

SEQ ID NO: 777424 - RNA, 17 nt, Listeria monocytogenes EGD-e
aucaaguaauaagaaga

SEQ ID NO: 777425 - RNA, 15 nt, Listeria monocytogenes EGD-e
aucaagggaagcuuu

SEQ ID NO: 777426 - RNA, 16 nt, Listeria monocytogenes EGD-e
aucaagggaagcuuuu

SEQ ID NO: 777427 - RNA, 20 nt, Listeria monocytogenes EGD-e
aucaagcguaccauucacuu

SEQ ID NO: 777428 - RNA, 20 nt, Listeria monocytogenes EGD-e
aucaauugguuuuacaccau

SEQ ID NO: 777429 - RNA, 20 nt, Listeria monocytogenes EGD-e
aucaaugauaucaucaauaa

SEQ ID NO: 777430 - RNA, 22 nt, Listeria monocytogenes EGD-e
aucaaugauaucaucaauaaua

SEQ ID NO: 777431 - RNA, 22 nt, Listeria monocytogenes EGD-e
aucaauaucggcauuugaauaa

SEQ ID NO: 777432 - RNA, 17 nt, Listeria monocytogenes EGD-e
aucaauaucuuuauuuu

SEQ ID NO: 777433 - RNA, 23 nt, Listeria monocytogenes EGD-e
aucaagugcagcgacaauuaugu

SEQ ID NO: 777434 - RNA, 23 nt, Listeria monocytogenes EGD-e
aucaagugcuucaucuuuauaaa

SEQ ID NO: 777435 - RNA, 21 nt, Listeria monocytogenes EGD-e
aucaauagcagaaucuacaac

SEQ ID NO: 777436 - RNA, 16 nt, Listeria monocytogenes EGD-e
aucaccagcuucuaag

SEQ ID NO: 777437 - RNA, 16 nt, Listeria monocytogenes EGD-e
aucacgagaaagccaa

SEQ ID NO: 777438 - RNA, 20 nt, Listeria monocytogenes EGD-e
aucacuauugaaugucacuu

SEQ ID NO: 777439 - RNA, 18 nt, Listeria monocytogenes EGD-e
aucacuaauuagcauaau

SEQ ID NO: 777440 - RNA, 20 nt, Listeria monocytogenes EGD-e
aucacuaauuagcauaauau

SEQ ID NO: 777441 - RNA, 21 nt, Listeria monocytogenes EGD-e
aucacuaauuagcauaauauc

SEQ ID NO: 777442 - RNA, 23 nt, Listeria monocytogenes EGD-e
aucagaagcgaugugggaaugaa

SEQ ID NO: 777443 - RNA, 22 nt, Listeria monocytogenes EGD-e
agguaacaucuuccacuccagc

SEQ ID NO: 777444 - RNA, 11 nt, Listeria monocytogenes EGD-e
aguaaacauuu

SEQ ID NO: 777445 - RNA, 18 nt, Listeria monocytogenes EGD-e
aguaaacauuucucccuc

SEQ ID NO: 777446 - RNA, 16 nt, Listeria monocytogenes EGD-e
aguaaaaucuuuuaau

SEQ ID NO: 777447 - RNA, 17 nt, Listeria monocytogenes EGD-e
agguucaccaaaugcuu

SEQ ID NO: 777448 - RNA, 17 nt, Listeria monocytogenes EGD-e
aguacauaguuauaaau

SEQ ID NO: 777449 - RNA, 15 nt, Listeria monocytogenes EGD-e
aguacaucaagugcu

SEQ ID NO: 777450 - RNA, 21 nt, Listeria monocytogenes EGD-e
aguaauggagcaagugugaaa

SEQ ID NO: 777451 - RNA, 16 nt, Listeria monocytogenes EGD-e
aguaagggugaagcuu

SEQ ID NO: 777452 - RNA, 15 nt, Listeria monocytogenes EGD-e
aguaacucuuccaaa

SEQ ID NO: 777453 - RNA, 23 nt, Listeria monocytogenes EGD-e
aguaacauagcuacaauuaaaau

SEQ ID NO: 777454 - RNA, 23 nt, Listeria monocytogenes EGD-e
aguaaauggcugaugacuaacua

SEQ ID NO: 777455 - RNA, 22 nt, Listeria monocytogenes EGD-e
aggcucuuccuuuuguuuuaau

SEQ ID NO: 777456 - RNA, 17 nt, Listeria monocytogenes EGD-e
aggcgcucuuuaauaau

SEQ ID NO: 777457 - RNA, 14 nt, Listeria monocytogenes EGD-e
aggcgaauccuuuu

SEQ ID NO: 777458 - RNA, 23 nt, Listeria monocytogenes EGD-e
aggcgaauccuuuuagugucagu

SEQ ID NO: 777459 - RNA, 15 nt, Listeria monocytogenes EGD-e
agggcuuuuuuccuu

SEQ ID NO: 777460 - RNA, 15 nt, Listeria monocytogenes EGD-e
aggcuuauuccucca

SEQ ID NO: 777461 - RNA, 23 nt, Listeria monocytogenes EGD-e
agggaagcuuuugcuacacccau

SEQ ID NO: 777462 - RNA, 21 nt, Listeria monocytogenes EGD-e
aggcuuuuaacuuucuuguuu

SEQ ID NO: 777463 - RNA, 18 nt, Listeria monocytogenes EGD-e
agcuaagcauuauaaaaa

SEQ ID NO: 777464 - RNA, 16 nt, Listeria monocytogenes EGD-e
agcuaaucguuuuaaa

SEQ ID NO: 777465 - RNA, 20 nt, Listeria monocytogenes EGD-e
agcuaaucguuuuaaagcuu

SEQ ID NO: 777466 - RNA, 14 nt, Listeria monocytogenes EGD-e
agcuauuguaaaug

SEQ ID NO: 777467 - RNA, 16 nt, Listeria monocytogenes EGD-e
agcuauuuuuuugcuu

SEQ ID NO: 777468 - RNA, 19 nt, Listeria monocytogenes EGD-e
agcuauuuuuuugcuuuuu

SEQ ID NO: 777469 - RNA, 17 nt, Listeria monocytogenes EGD-e
agcuaugcguuacacuu

SEQ ID NO: 777470 - RNA, 18 nt, Listeria monocytogenes EGD-e
agcuaugugcgaugccac

SEQ ID NO: 777471 - RNA, 14 nt, Listeria monocytogenes EGD-e
agcggucaaucauu

SEQ ID NO: 777472 - RNA, 20 nt, Listeria monocytogenes EGD-e
agcgcuggcagcuuuugaaa

SEQ ID NO: 777473 - RNA, 18 nt, Listeria monocytogenes EGD-e
agcugcuucaagcgaaau

SEQ ID NO: 777474 - RNA, 13 nt, Listeria monocytogenes EGD-e
agcuguaucaaug

SEQ ID NO: 777475 - RNA, 18 nt, Listeria monocytogenes EGD-e
agcuucccguuaaucgaa

SEQ ID NO: 777476 - RNA, 23 nt, Listeria monocytogenes EGD-e
agcuucuaagucaaaacguucga

SEQ ID NO: 777477 - RNA, 19 nt, Listeria monocytogenes EGD-e
agcuuccauacuuucugcc

SEQ ID NO: 777478 - RNA, 20 nt, Listeria monocytogenes EGD-e
agcuuccauacuuucugcca

SEQ ID NO: 777479 - RNA, 18 nt, Listeria monocytogenes EGD-e
agcuucacgcaaugcuuu

SEQ ID NO: 777480 - RNA, 11 nt, Listeria monocytogenes EGD-e
agcuucaauca

SEQ ID NO: 777481 - RNA, 21 nt, Listeria monocytogenes EGD-e
agcuuuuacgaucuacuucua

SEQ ID NO: 777482 - RNA, 17 nt, Listeria monocytogenes EGD-e
agcuugauuaaaaccaa

SEQ ID NO: 777483 - RNA, 19 nt, Listeria monocytogenes EGD-e
aggauuugucacuuggaaa

SEQ ID NO: 777484 - RNA, 14 nt, Listeria monocytogenes EGD-e
aggcaaaucuuucg

SEQ ID NO: 777485 - RNA, 13 nt, Listeria monocytogenes EGD-e
aggcaacaaagaa

SEQ ID NO: 777486 - RNA, 16 nt, Listeria monocytogenes EGD-e
aggccacuaacauaaa

SEQ ID NO: 777487 - RNA, 14 nt, Listeria monocytogenes EGD-e
aggcauguaucuua

SEQ ID NO: 777488 - RNA, 19 nt, Listeria monocytogenes EGD-e
aggacaugcuaaauaaaac

SEQ ID NO: 777489 - RNA, 20 nt, Listeria monocytogenes EGD-e
aggagaaggcuuuuuaugca

SEQ ID NO: 777490 - RNA, 12 nt, Listeria monocytogenes EGD-e
aggaguuucuuu

SEQ ID NO: 777491 - RNA, 11 nt, Listeria monocytogenes EGD-e
aggauaaaaau

SEQ ID NO: 777492 - RNA, 18 nt, Listeria monocytogenes EGD-e
agcuuuuuuuauuuugcg

SEQ ID NO: 777493 - RNA, 20 nt, Listeria monocytogenes EGD-e
aggaaacgaauaaaaucaua

SEQ ID NO: 777494 - RNA, 15 nt, Listeria monocytogenes EGD-e
aggaacuacauacuu

SEQ ID NO: 777495 - RNA, 13 nt, Listeria monocytogenes EGD-e
aggaauacuguuu

SEQ ID NO: 777496 - RNA, 18 nt, Listeria monocytogenes EGD-e
acgcuuuuucaaaaucaa

SEQ ID NO: 777497 - RNA, 22 nt, Listeria monocytogenes EGD-e
acgcaaugcugaauguuuucuu

SEQ ID NO: 777498 - RNA, 17 nt, Listeria monocytogenes EGD-e
acggugaugaaaccaaa

SEQ ID NO: 777499 - RNA, 17 nt, Listeria monocytogenes EGD-e
acgucucucauuguugu

SEQ ID NO: 777500 - RNA, 13 nt, Listeria monocytogenes EGD-e
acuaaaaaucauu

SEQ ID NO: 777501 - RNA, 15 nt, Listeria monocytogenes EGD-e
acuaaaaaucauuua

SEQ ID NO: 777502 - RNA, 18 nt, Listeria monocytogenes EGD-e
acguugguuguucuuuua

SEQ ID NO: 777503 - RNA, 21 nt, Listeria monocytogenes EGD-e
acguuuaauucggcuucaaaa

SEQ ID NO: 777504 - RNA, 13 nt, Listeria monocytogenes EGD-e
acuaucaucuucu

SEQ ID NO: 777505 - RNA, 14 nt, Listeria monocytogenes EGD-e
acuaucaucuucuc

SEQ ID NO: 777506 - RNA, 18 nt, Listeria monocytogenes EGD-e
acuaucaugacuaaaaag

SEQ ID NO: 777507 - RNA, 12 nt, Listeria monocytogenes EGD-e
acuauuuucuaa

SEQ ID NO: 777508 - RNA, 18 nt, Listeria monocytogenes EGD-e
acuauuuucuaaucaaau

SEQ ID NO: 777509 - RNA, 19 nt, Listeria monocytogenes EGD-e
acuaccggcccacaaaacg

SEQ ID NO: 777510 - RNA, 14 nt, Listeria monocytogenes EGD-e
acuagaaaaaugaa

SEQ ID NO: 777511 - RNA, 24 nt, Listeria monocytogenes EGD-e
acuagaaaaaugaagagauaaguu

SEQ ID NO: 777512 - RNA, 14 nt, Listeria monocytogenes EGD-e
acuagaaauuaaug

SEQ ID NO: 777513 - RNA, 16 nt, Listeria monocytogenes EGD-e
acuaauuacuaaaaag

SEQ ID NO: 777514 - RNA, 13 nt, Listeria monocytogenes EGD-e
acuacauuuuguu

SEQ ID NO: 777515 - RNA, 19 nt, Listeria monocytogenes EGD-e
acucaaugaaaagcaaguu

SEQ ID NO: 777516 - RNA, 16 nt, Listeria monocytogenes EGD-e
acucgaguauaugcua

SEQ ID NO: 777517 - RNA, 16 nt, Listeria monocytogenes EGD-e
acucucuucagaaagu

SEQ ID NO: 777518 - RNA, 19 nt, Listeria monocytogenes EGD-e
acucucuucagaaaguggu

SEQ ID NO: 777519 - RNA, 23 nt, Listeria monocytogenes EGD-e
acucuuuggagugaggauuuuuu

SEQ ID NO: 777520 - RNA, 16 nt, Listeria monocytogenes EGD-e
acugcauaaaaaacau

SEQ ID NO: 777521 - RNA, 17 nt, Listeria monocytogenes EGD-e
acugcauaaaaaacauu

SEQ ID NO: 777522 - RNA, 18 nt, Listeria monocytogenes EGD-e
acugcuaacacgagagaa

SEQ ID NO: 777523 - RNA, 15 nt, Listeria monocytogenes EGD-e
acugcggcauagaaa

SEQ ID NO: 777524 - RNA, 18 nt, Listeria monocytogenes EGD-e
acugcggcauagaaagua

SEQ ID NO: 777525 - RNA, 19 nt, Listeria monocytogenes EGD-e
acugcggcauagaaaguag

SEQ ID NO: 777526 - RNA, 18 nt, Listeria monocytogenes EGD-e
acugcggcuaauaacauu

SEQ ID NO: 777527 - RNA, 23 nt, Listeria monocytogenes EGD-e
acugguuuuuuaaugcgaaaaau

SEQ ID NO: 777528 - RNA, 16 nt, Listeria monocytogenes EGD-e
acuuaaaucacuucuu

SEQ ID NO: 777529 - RNA, 17 nt, Listeria monocytogenes EGD-e
acuuaacgcgaaaugga

SEQ ID NO: 777530 - RNA, 20 nt, Listeria monocytogenes EGD-e
acuuaucucuucauuuuucu

SEQ ID NO: 777531 - RNA, 22 nt, Listeria monocytogenes EGD-e
acuuaucucuucauuuuucuag

SEQ ID NO: 777532 - RNA, 23 nt, Listeria monocytogenes EGD-e
acuuaucucuucauuuuucuagu

SEQ ID NO: 777533 - RNA, 19 nt, Listeria monocytogenes EGD-e
agacuaaauugucuacugc

SEQ ID NO: 777534 - RNA, 15 nt, Listeria monocytogenes EGD-e
agagagccuggauuu

SEQ ID NO: 777535 - RNA, 19 nt, Listeria monocytogenes EGD-e
agagagccuggauuuucua

SEQ ID NO: 777536 - RNA, 22 nt, Listeria monocytogenes EGD-e
agagcgauggaguuuguaacaa

SEQ ID NO: 777537 - RNA, 20 nt, Listeria monocytogenes EGD-e
agagcuucuguuuuuucuuu

SEQ ID NO: 777538 - RNA, 16 nt, Listeria monocytogenes EGD-e
agauacuguucugauu

SEQ ID NO: 777539 - RNA, 15 nt, Listeria monocytogenes EGD-e
agauacucuuuaaau

SEQ ID NO: 777540 - RNA, 20 nt, Listeria monocytogenes EGD-e
agauaucuacaaguucuuuc

SEQ ID NO: 777541 - RNA, 14 nt, Listeria monocytogenes EGD-e
agauaguuguucca

SEQ ID NO: 777542 - RNA, 17 nt, Listeria monocytogenes EGD-e
agaucaaaagcaaaaaa

SEQ ID NO: 777543 - RNA, 18 nt, Listeria monocytogenes EGD-e
agaucccaaacucccuuu

SEQ ID NO: 777544 - RNA, 17 nt, Listeria monocytogenes EGD-e
agaucuccgaauacuuu

SEQ ID NO: 777545 - RNA, 16 nt, Listeria monocytogenes EGD-e
agauucauaaacaaaa

SEQ ID NO: 777546 - RNA, 15 nt, Listeria monocytogenes EGD-e
agauggaagaagugg

SEQ ID NO: 777547 - RNA, 23 nt, Listeria monocytogenes EGD-e
agauguuuuuauuuauauagaag

SEQ ID NO: 777548 - RNA, 18 nt, Listeria monocytogenes EGD-e
agaagaagacgaaaagca

SEQ ID NO: 777549 - RNA, 15 nt, Listeria monocytogenes EGD-e
agaagccaauucacu

SEQ ID NO: 777550 - RNA, 20 nt, Listeria monocytogenes EGD-e
agaauuccugcuaaaaccau

SEQ ID NO: 777551 - RNA, 15 nt, Listeria monocytogenes EGD-e
agaccaccaagaaua

SEQ ID NO: 777552 - RNA, 17 nt, Listeria monocytogenes EGD-e
agaacgacaaaugguuc

SEQ ID NO: 777553 - RNA, 13 nt, Listeria monocytogenes EGD-e
acuuuugcagcug

SEQ ID NO: 777554 - RNA, 16 nt, Listeria monocytogenes EGD-e
agaaaaaguuucaauu

SEQ ID NO: 777555 - RNA, 14 nt, Listeria monocytogenes EGD-e
agaaaaauaauccu

SEQ ID NO: 777556 - RNA, 15 nt, Listeria monocytogenes EGD-e
agaaaaagugcguaa

SEQ ID NO: 777557 - RNA, 20 nt, Listeria monocytogenes EGD-e
agaaaccccgccaccaguca

SEQ ID NO: 777558 - RNA, 23 nt, Listeria monocytogenes EGD-e
agaaacgcuuuguuuagccuuuu

SEQ ID NO: 777559 - RNA, 21 nt, Listeria monocytogenes EGD-e
agaaagcuguuuucaacaaaa

SEQ ID NO: 777560 - RNA, 23 nt, Listeria monocytogenes EGD-e
agaaagcuguuuucaacaaaaca

SEQ ID NO: 777561 - RNA, 13 nt, Listeria monocytogenes EGD-e
accguaacuguug

SEQ ID NO: 777562 - RNA, 14 nt, Listeria monocytogenes EGD-e
accuaaaucuuuca

SEQ ID NO: 777563 - RNA, 16 nt, Listeria monocytogenes EGD-e
accguuaccauaaaga

SEQ ID NO: 777564 - RNA, 17 nt, Listeria monocytogenes EGD-e
accuacuuuaauuucca

SEQ ID NO: 777565 - RNA, 23 nt, Listeria monocytogenes EGD-e
accuaguaguuaacgguuuucau

SEQ ID NO: 777566 - RNA, 13 nt, Listeria monocytogenes EGD-e
accuagccagaca

SEQ ID NO: 777567 - RNA, 19 nt, Listeria monocytogenes EGD-e
accuagccagacaucuuug

SEQ ID NO: 777568 - RNA, 20 nt, Listeria monocytogenes EGD-e
accuaguuuuauuauauuuu

SEQ ID NO: 777569 - RNA, 18 nt, Listeria monocytogenes EGD-e
accucgcaaaaaauaaua

SEQ ID NO: 777570 - RNA, 15 nt, Listeria monocytogenes EGD-e
accugcaagcgaauu

SEQ ID NO: 777571 - RNA, 22 nt, Listeria monocytogenes EGD-e
accuugcucccgcgcuaaucuu

SEQ ID NO: 777572 - RNA, 15 nt, Listeria monocytogenes EGD-e
accuugaucaaaauu

SEQ ID NO: 777573 - RNA, 11 nt, Listeria monocytogenes EGD-e
acgaaaagcaa

SEQ ID NO: 777574 - RNA, 12 nt, Listeria monocytogenes EGD-e
acgaaaagcaau

SEQ ID NO: 777575 - RNA, 17 nt, Listeria monocytogenes EGD-e
acgaaaagcaaugagac

SEQ ID NO: 777576 - RNA, 13 nt, Listeria monocytogenes EGD-e
acgaaaucaaacu

SEQ ID NO: 777577 - RNA, 12 nt, Listeria monocytogenes EGD-e
acgaaagcaaca

SEQ ID NO: 777578 - RNA, 19 nt, Listeria monocytogenes EGD-e
accuuugaaaacugaacaa

SEQ ID NO: 777579 - RNA, 17 nt, Listeria monocytogenes EGD-e
accuuuugcuucuucca

SEQ ID NO: 777580 - RNA, 17 nt, Listeria monocytogenes EGD-e
acgaccauauaaucaau

SEQ ID NO: 777581 - RNA, 20 nt, Listeria monocytogenes EGD-e
acgacguuuaucaauaauag

SEQ ID NO: 777582 - RNA, 14 nt, Listeria monocytogenes EGD-e
acgaaucaagauuu

SEQ ID NO: 777583 - RNA, 21 nt, Listeria monocytogenes EGD-e
acgaacggggcaucauuuuuu

SEQ ID NO: 777584 - RNA, 16 nt, Listeria monocytogenes EGD-e
acgauaacuuucucuu

SEQ ID NO: 777585 - RNA, 22 nt, Listeria monocytogenes EGD-e
acgaguuuguuuaggauauuuu

SEQ ID NO: 777586 - RNA, 13 nt, Listeria monocytogenes EGD-e
accaaauaugcua

SEQ ID NO: 777587 - RNA, 18 nt, Listeria monocytogenes EGD-e
accaaauaugcuauacaa

SEQ ID NO: 777588 - RNA, 13 nt, Listeria monocytogenes EGD-e
accaagggugauc

SEQ ID NO: 777589 - RNA, 18 nt, Listeria monocytogenes EGD-e
accaagggugaucaauca

SEQ ID NO: 777590 - RNA, 18 nt, Listeria monocytogenes EGD-e
accaauuucuuuuuaacg

SEQ ID NO: 777591 - RNA, 22 nt, Listeria monocytogenes EGD-e
accacucuuuuauaaaaauaca

SEQ ID NO: 777592 - RNA, 23 nt, Listeria monocytogenes EGD-e
accagugugguuuacucccuuuu

SEQ ID NO: 777593 - RNA, 16 nt, Listeria monocytogenes EGD-e
accaguuugugcacca

SEQ ID NO: 777594 - RNA, 22 nt, Listeria monocytogenes EGD-e
accauauccggugagccuaagu

SEQ ID NO: 777595 - RNA, 17 nt, Listeria monocytogenes EGD-e
accauauaaucaauauc

SEQ ID NO: 777596 - RNA, 12 nt, Listeria monocytogenes EGD-e
accauuauacaa

SEQ ID NO: 777597 - RNA, 19 nt, Listeria monocytogenes EGD-e
accauucaucuaauuuagg

SEQ ID NO: 777598 - RNA, 20 nt, Listeria monocytogenes EGD-e
accauuccguugaaagaggg

SEQ ID NO: 777599 - RNA, 12 nt, Listeria monocytogenes EGD-e
accauucgaguu

SEQ ID NO: 777600 - RNA, 15 nt, Listeria monocytogenes EGD-e
acccaauuguuuuac

SEQ ID NO: 777601 - RNA, 17 nt, Listeria monocytogenes EGD-e
acaucagauuaaauaua

SEQ ID NO: 777602 - RNA, 18 nt, Listeria monocytogenes EGD-e
acaucacuaauuagcaua

SEQ ID NO: 777603 - RNA, 17 nt, Listeria monocytogenes EGD-e
acauauuugaacccuuu

SEQ ID NO: 777604 - RNA, 18 nt, Listeria monocytogenes EGD-e
acaugauaaccagaaacg

SEQ ID NO: 777605 - RNA, 16 nt, Listeria monocytogenes EGD-e
acaugauauauuuaua

SEQ ID NO: 777606 - RNA, 19 nt, Listeria monocytogenes EGD-e
acaugaccgccaauuuuac

SEQ ID NO: 777607 - RNA, 20 nt, Listeria monocytogenes EGD-e
acaucuucaauugcuucuuu

SEQ ID NO: 777608 - RNA, 22 nt, Listeria monocytogenes EGD-e
acaguuagaaccguauuuaaua

SEQ ID NO: 777609 - RNA, 18 nt, Listeria monocytogenes EGD-e
acaguauuccucaaugag

SEQ ID NO: 777610 - RNA, 14 nt, Listeria monocytogenes EGD-e
acaggcuauuccag

SEQ ID NO: 777611 - RNA, 22 nt, Listeria monocytogenes EGD-e
aacaacugcuaacacgagagaa

SEQ ID NO: 777612 - RNA, 15 nt, Listeria monocytogenes EGD-e
aacaagcuuugugga

SEQ ID NO: 777613 - RNA, 22 nt, Listeria monocytogenes EGD-e
aacaagaggcuuauuccuccaa

SEQ ID NO: 777614 - RNA, 13 nt, Listeria monocytogenes EGD-e
aacaaggaagaau

SEQ ID NO: 777615 - RNA, 19 nt, Listeria monocytogenes EGD-e
aacaaguccgucaagccca

SEQ ID NO: 777616 - RNA, 21 nt, Listeria monocytogenes EGD-e
aacaaguccgucaagcccagc

SEQ ID NO: 777617 - RNA, 13 nt, Listeria monocytogenes EGD-e
aacaaccaucaaa

SEQ ID NO: 777618 - RNA, 19 nt, Listeria monocytogenes EGD-e
aacaacaugcguaaacuuu

SEQ ID NO: 777619 - RNA, 16 nt, Listeria monocytogenes EGD-e
aacaaaauaaucaauc

SEQ ID NO: 777620 - RNA, 18 nt, Listeria monocytogenes EGD-e
aacaaaagucacagcgua

SEQ ID NO: 777621 - RNA, 13 nt, Listeria monocytogenes EGD-e
aacaaacacaaaa

SEQ ID NO: 777622 - RNA, 17 nt, Listeria monocytogenes EGD-e
aacaaacacaaaaugcu

SEQ ID NO: 777623 - RNA, 14 nt, Listeria monocytogenes EGD-e
aacaacaagcaaaa

SEQ ID NO: 777624 - RNA, 18 nt, Listeria monocytogenes EGD-e
aacaacaagcaaaacauu

SEQ ID NO: 777625 - RNA, 19 nt, Listeria monocytogenes EGD-e
aacaaauuugccaaagaga

SEQ ID NO: 777626 - RNA, 20 nt, Listeria monocytogenes EGD-e
aacaaacuaguaauuuaauu

SEQ ID NO: 777627 - RNA, 15 nt, Listeria monocytogenes EGD-e
aaauugugaaauuuu

SEQ ID NO: 777628 - RNA, 15 nt, Listeria monocytogenes EGD-e
aaauugcaacaguua

SEQ ID NO: 777629 - RNA, 21 nt, Listeria monocytogenes EGD-e
aaauugcaacaguuauuaaaa

SEQ ID NO: 777630 - RNA, 20 nt, Listeria monocytogenes EGD-e
aaauuugccaaagagaaacu

SEQ ID NO: 777631 - RNA, 18 nt, Listeria monocytogenes EGD-e
aaauuugcccaccgauaa

SEQ ID NO: 777632 - RNA, 20 nt, Listeria monocytogenes EGD-e
aaauuuugguuuggucaaca

SEQ ID NO: 777633 - RNA, 15 nt, Listeria monocytogenes EGD-e
aacaaucugaacuga

SEQ ID NO: 777634 - RNA, 23 nt, Listeria monocytogenes EGD-e
aacaaucaguccaucuuccgcuu

SEQ ID NO: 777635 - RNA, 16 nt, Listeria monocytogenes EGD-e
aacacgagagaaaugg

SEQ ID NO: 777636 - RNA, 20 nt, Listeria monocytogenes EGD-e
aacagaaagcuguuuucaac

SEQ ID NO: 777637 - RNA, 13 nt, Listeria monocytogenes EGD-e
aacagcuuuucua

SEQ ID NO: 777638 - RNA, 19 nt, Listeria monocytogenes EGD-e
aacauagcuacaauuaaaa

SEQ ID NO: 777639 - RNA, 20 nt, Listeria monocytogenes EGD-e
aacauagcuacaauuaaaau

SEQ ID NO: 777640 - RNA, 23 nt, Listeria monocytogenes EGD-e
aacauagcuacaauuaaaauagu

SEQ ID NO: 777641 - RNA, 16 nt, Listeria monocytogenes EGD-e
aacaucacaccuugug

SEQ ID NO: 777642 - RNA, 13 nt, Listeria monocytogenes EGD-e
aacaucagauuaa

SEQ ID NO: 777643 - RNA, 16 nt, Listeria monocytogenes EGD-e
aacaucagauuaaaua

SEQ ID NO: 777644 - RNA, 11 nt, Listeria monocytogenes EGD-e
aacaucauuag

SEQ ID NO: 777645 - RNA, 14 nt, Listeria monocytogenes EGD-e
aacaguuauuaaaa

SEQ ID NO: 777646 - RNA, 16 nt, Listeria monocytogenes EGD-e
aacaguuauuaaaagg

SEQ ID NO: 777647 - RNA, 20 nt, Listeria monocytogenes EGD-e
aacaguuauuaaaaggacac

SEQ ID NO: 777648 - RNA, 23 nt, Listeria monocytogenes EGD-e
aacauaaaaagcugccaccacuu

SEQ ID NO: 777649 - RNA, 19 nt, Listeria monocytogenes EGD-e
aacauaaccuucaucguuu

SEQ ID NO: 777650 - RNA, 23 nt, Listeria monocytogenes EGD-e
aaccaaauaugcuauacaacaca

SEQ ID NO: 777651 - RNA, 15 nt, Listeria monocytogenes EGD-e
aaccaacaccaaauu

SEQ ID NO: 777652 - RNA, 17 nt, Listeria monocytogenes EGD-e
aaccaaauuucuguuau

SEQ ID NO: 777653 - RNA, 12 nt, Listeria monocytogenes EGD-e
aaccaagcaaua

SEQ ID NO: 777654 - RNA, 17 nt, Listeria monocytogenes EGD-e
aaccaaucauggaaaca

SEQ ID NO: 777655 - RNA, 20 nt, Listeria monocytogenes EGD-e
aaccaaucauggaaacaaag

SEQ ID NO: 777656 - RNA, 23 nt, Listeria monocytogenes EGD-e
aacauuuucauucuuuccccuuu

SEQ ID NO: 777657 - RNA, 19 nt, Listeria monocytogenes EGD-e
aacaucugcuauuuuugaa

SEQ ID NO: 777658 - RNA, 15 nt, Listeria monocytogenes EGD-e
aacaucuuuguauac

SEQ ID NO: 777659 - RNA, 20 nt, Listeria monocytogenes EGD-e
aacaucuuuguauacuucaa

SEQ ID NO: 777660 - RNA, 15 nt, Listeria monocytogenes EGD-e
aacauuaaaccucuu

SEQ ID NO: 777661 - RNA, 12 nt, Listeria monocytogenes EGD-e
aacaugauauau

SEQ ID NO: 777662 - RNA, 18 nt, Listeria monocytogenes EGD-e
aacaugauauauuuauaa

SEQ ID NO: 777663 - RNA, 19 nt, Listeria monocytogenes EGD-e
aaccaguaaaacaagaggc

SEQ ID NO: 777664 - RNA, 19 nt, Listeria monocytogenes EGD-e
aaccauucgaaagcaaaug

SEQ ID NO: 777665 - RNA, 19 nt, Listeria monocytogenes EGD-e
aaccauucaucuaauuuag

SEQ ID NO: 777666 - RNA, 13 nt, Listeria monocytogenes EGD-e
aaccauuauuugg

SEQ ID NO: 777667 - RNA, 17 nt, Listeria monocytogenes EGD-e
aaccauuacgauaagca

SEQ ID NO: 777668 - RNA, 20 nt, Listeria monocytogenes EGD-e
aaccauuauacaauuaauaa

SEQ ID NO: 777669 - RNA, 17 nt, Listeria monocytogenes EGD-e
aacccuuugaauugauu

SEQ ID NO: 777670 - RNA, 21 nt, Listeria monocytogenes EGD-e
aaccgaguuaccugucgcugu

SEQ ID NO: 777671 - RNA, 12 nt, Listeria monocytogenes EGD-e
aaccccaaaaug

SEQ ID NO: 777672 - RNA, 15 nt, Listeria monocytogenes EGD-e
aaccggaucaucacu

SEQ ID NO: 777673 - RNA, 16 nt, Listeria monocytogenes EGD-e
aaccuucaagcauauu

SEQ ID NO: 777674 - RNA, 18 nt, Listeria monocytogenes EGD-e
aacgaauccuuggaaaaa

SEQ ID NO: 777675 - RNA, 23 nt, Listeria monocytogenes EGD-e
aacgaauccuuggaaaaaugauu

SEQ ID NO: 777676 - RNA, 21 nt, Listeria monocytogenes EGD-e
aacgacauccuucagccaauu

SEQ ID NO: 777677 - RNA, 17 nt, Listeria monocytogenes EGD-e
aacgaacggggcaucau

SEQ ID NO: 777678 - RNA, 14 nt, Listeria monocytogenes EGD-e
aaccguauuuaaua

SEQ ID NO: 777679 - RNA, 20 nt, Listeria monocytogenes EGD-e
aacgauguucauuacuucag

SEQ ID NO: 777680 - RNA, 12 nt, Listeria monocytogenes EGD-e
aacgaucagcca

SEQ ID NO: 777681 - RNA, 22 nt, Listeria monocytogenes EGD-e
aacgcaucugcuaauacuauug

SEQ ID NO: 777682 - RNA, 18 nt, Listeria monocytogenes EGD-e
aacgcgcguauccacaua

SEQ ID NO: 777683 - RNA, 21 nt, Listeria monocytogenes EGD-e
aacggaaacuaucaauaaauc

SEQ ID NO: 777684 - RNA, 20 nt, Listeria monocytogenes EGD-e
aacgcuuuuucaaaaucaag

SEQ ID NO: 777685 - RNA, 21 nt, Listeria monocytogenes EGD-e
aacggaucuuucucauaagcu

SEQ ID NO: 777686 - RNA, 18 nt, Listeria monocytogenes EGD-e
aacgguuuucaugaagca

SEQ ID NO: 777687 - RNA, 13 nt, Listeria monocytogenes EGD-e
aacuacauacuua

SEQ ID NO: 777688 - RNA, 15 nt, Listeria monocytogenes EGD-e
aacuacuucaacuaa

SEQ ID NO: 777689 - RNA, 19 nt, Listeria monocytogenes EGD-e
aacuagauuuaauaaauua

SEQ ID NO: 777690 - RNA, 17 nt, Listeria monocytogenes EGD-e
aacuauaaccaaauuuc

SEQ ID NO: 777691 - RNA, 13 nt, Listeria monocytogenes EGD-e
aacuaaauuaauu

SEQ ID NO: 777692 - RNA, 12 nt, Listeria monocytogenes EGD-e
aacuaacaaaau

SEQ ID NO: 777693 - RNA, 21 nt, Listeria monocytogenes EGD-e
aacuaaaacgacagauaaaua

SEQ ID NO: 777694 - RNA, 18 nt, Listeria monocytogenes EGD-e
aacguauuggguuugaua

SEQ ID NO: 777695 - RNA, 23 nt, Listeria monocytogenes EGD-e
aacucucccauuugucccacaaa

SEQ ID NO: 777696 - RNA, 18 nt, Listeria monocytogenes EGD-e
aacucucuuucugccuac

SEQ ID NO: 777697 - RNA, 14 nt, Listeria monocytogenes EGD-e
aacucccagccaua

SEQ ID NO: 777698 - RNA, 20 nt, Listeria monocytogenes EGD-e
aacucaaaguaacuuuauca

SEQ ID NO: 777699 - RNA, 14 nt, Listeria monocytogenes EGD-e
aacugaacaaagaa

SEQ ID NO: 777700 - RNA, 15 nt, Listeria monocytogenes EGD-e
aacugaacaaagaag

SEQ ID NO: 777701 - RNA, 19 nt, Listeria monocytogenes EGD-e
aacugaacaaagaagaaga

SEQ ID NO: 777702 - RNA, 15 nt, Listeria monocytogenes EGD-e
aacugacuagaaauu

SEQ ID NO: 777703 - RNA, 23 nt, Listeria monocytogenes EGD-e
aacugacuagaaauuaaugccag

SEQ ID NO: 777704 - RNA, 16 nt, Listeria monocytogenes EGD-e
aacugauuuuuuggug

SEQ ID NO: 777705 - RNA, 19 nt, Listeria monocytogenes EGD-e
aacuugcaucuucuguuaa

SEQ ID NO: 777706 - RNA, 16 nt, Listeria monocytogenes EGD-e
aacuuuaucaagaaca

SEQ ID NO: 777707 - RNA, 16 nt, Listeria monocytogenes EGD-e
aacuuucuuguuucau

SEQ ID NO: 777708 - RNA, 18 nt, Listeria monocytogenes EGD-e
aacuuuuccuucuacauu

SEQ ID NO: 777709 - RNA, 17 nt, Listeria monocytogenes EGD-e
aacuuuuucucaaaaau

SEQ ID NO: 777710 - RNA, 22 nt, Listeria monocytogenes EGD-e
aacuucucuccaaucagcaaga

SEQ ID NO: 777711 - RNA, 14 nt, Listeria monocytogenes EGD-e
aacuucuuccgcuu

SEQ ID NO: 777712 - RNA, 21 nt, Listeria monocytogenes EGD-e
aacuucacuaacaaaauaaua

SEQ ID NO: 777713 - RNA, 21 nt, Listeria monocytogenes EGD-e
aacuucauuagacaaaaagaa

SEQ ID NO: 777714 - RNA, 18 nt, Listeria monocytogenes EGD-e
aacuuaucucuucauuuu

SEQ ID NO: 777715 - RNA, 16 nt, Listeria monocytogenes EGD-e
aacuucaaaauuacua

SEQ ID NO: 777716 - RNA, 22 nt, Listeria monocytogenes EGD-e
aacuuauaaugcagauuaaccc

SEQ ID NO: 777717 - RNA, 21 nt, Listeria monocytogenes EGD-e
aacuuacagaagcauuuucau

SEQ ID NO: 777718 - RNA, 19 nt, Listeria monocytogenes EGD-e
aagaagagcugcaacagau

SEQ ID NO: 777719 - RNA, 15 nt, Listeria monocytogenes EGD-e
aagaagacgaaaagc

SEQ ID NO: 777720 - RNA, 12 nt, Listeria monocytogenes EGD-e
aagaagaaaaag

SEQ ID NO: 777721 - RNA, 14 nt, Listeria monocytogenes EGD-e
aagaagaaaaagug

SEQ ID NO: 777722 - RNA, 16 nt, Listeria monocytogenes EGD-e
aagaacgaauguuaaa

SEQ ID NO: 777723 - RNA, 16 nt, Listeria monocytogenes EGD-e
aagaacuagauuuaau

SEQ ID NO: 777724 - RNA, 20 nt, Listeria monocytogenes EGD-e
aagaaauguugcgaaacaac

SEQ ID NO: 777725 - RNA, 19 nt, Listeria monocytogenes EGD-e
aagaaaaucccaauagaaa

SEQ ID NO: 777726 - RNA, 20 nt, Listeria monocytogenes EGD-e
aagaaaaaccgagaaaucuc

SEQ ID NO: 777727 - RNA, 21 nt, Listeria monocytogenes EGD-e
aagaaaaaccgagaaaucuca

SEQ ID NO: 777728 - RNA, 21 nt, Listeria monocytogenes EGD-e
aagaaaaaaaguuauauuuaa

SEQ ID NO: 777729 - RNA, 13 nt, Listeria monocytogenes EGD-e
aauccaaccauuc

SEQ ID NO: 777730 - RNA, 17 nt, Listeria monocytogenes EGD-e
aaucauuuauuuucccu

SEQ ID NO: 777731 - RNA, 18 nt, Listeria monocytogenes EGD-e
aaucauuuauuuucccuc

SEQ ID NO: 777732 - RNA, 17 nt, Listeria monocytogenes EGD-e
aaucauuucuacaacug

SEQ ID NO: 777733 - RNA, 19 nt, Listeria monocytogenes EGD-e
aaucauuggaccagaaugg

SEQ ID NO: 777734 - RNA, 19 nt, Listeria monocytogenes EGD-e
aaucauugggaauucguua

SEQ ID NO: 777735 - RNA, 21 nt, Listeria monocytogenes EGD-e
aaucauuucgauaagcacaaa

SEQ ID NO: 777736 - RNA, 18 nt, Listeria monocytogenes EGD-e
aauccagcgucuaaaaau

SEQ ID NO: 777737 - RNA, 17 nt, Listeria monocytogenes EGD-e
aauccagcuugauuaaa

SEQ ID NO: 777738 - RNA, 22 nt, Listeria monocytogenes EGD-e
aauccagcuugauuaaaaccaa

SEQ ID NO: 777739 - RNA, 19 nt, Listeria monocytogenes EGD-e
aauccagagcugauuauau

SEQ ID NO: 777740 - RNA, 15 nt, Listeria monocytogenes EGD-e
aauccauuuuucuuc

SEQ ID NO: 777741 - RNA, 18 nt, Listeria monocytogenes EGD-e
aauccauuucauucuuuu

SEQ ID NO: 777742 - RNA, 19 nt, Listeria monocytogenes EGD-e
aauccauuucauucuuuuu

SEQ ID NO: 777743 - RNA, 15 nt, Listeria monocytogenes EGD-e
aaucauuccacuuuu

SEQ ID NO: 777744 - RNA, 17 nt, Listeria monocytogenes EGD-e
aaucauuaaccuacuuu

SEQ ID NO: 777745 - RNA, 20 nt, Listeria monocytogenes EGD-e
aaucauggaaacaaaguauu

SEQ ID NO: 777746 - RNA, 20 nt, Listeria monocytogenes EGD-e
aaucauggaaacgacauccu

SEQ ID NO: 777747 - RNA, 22 nt, Listeria monocytogenes EGD-e
aaucaugccuucaaacacuucu

SEQ ID NO: 777748 - RNA, 19 nt, Listeria monocytogenes EGD-e
aaucaucuuaucaaguaau

SEQ ID NO: 777749 - RNA, 14 nt, Listeria monocytogenes EGD-e
aaucccagcuuuuc

SEQ ID NO: 777750 - RNA, 14 nt, Listeria monocytogenes EGD-e
aaucccacaaaaaa

SEQ ID NO: 777751 - RNA, 15 nt, Listeria monocytogenes EGD-e
aauccgcuucguuuc

SEQ ID NO: 777752 - RNA, 17 nt, Listeria monocytogenes EGD-e
aaucuagucguuucaac

SEQ ID NO: 777753 - RNA, 22 nt, Listeria monocytogenes EGD-e
aaucuacaacaggaagcccaua

SEQ ID NO: 777754 - RNA, 17 nt, Listeria monocytogenes EGD-e
aaucuacaacuagauuu

SEQ ID NO: 777755 - RNA, 14 nt, Listeria monocytogenes EGD-e
aaucggggaaauag

SEQ ID NO: 777756 - RNA, 15 nt, Listeria monocytogenes EGD-e
aauccuuggaaaaau

SEQ ID NO: 777757 - RNA, 14 nt, Listeria monocytogenes EGD-e
aaucuguaaaaaua

SEQ ID NO: 777758 - RNA, 15 nt, Listeria monocytogenes EGD-e
aaucuguaaaaauaa

SEQ ID NO: 777759 - RNA, 16 nt, Listeria monocytogenes EGD-e
aaucuguaaaaauaaa

SEQ ID NO: 777760 - RNA, 17 nt, Listeria monocytogenes EGD-e
aaucuguaaaaauaaau

SEQ ID NO: 777761 - RNA, 16 nt, Listeria monocytogenes EGD-e
aaucuguacuccuugu

SEQ ID NO: 777762 - RNA, 14 nt, Listeria monocytogenes EGD-e
aaugaaaagaaaaa

SEQ ID NO: 777763 - RNA, 17 nt, Listeria monocytogenes EGD-e
aaugagcccaaaaauaa

SEQ ID NO: 777764 - RNA, 18 nt, Listeria monocytogenes EGD-e
aaugagcccaaaaauaag

SEQ ID NO: 777765 - RNA, 23 nt, Listeria monocytogenes EGD-e
aaugauuuuuaucuaaaucuuuu

SEQ ID NO: 777766 - RNA, 22 nt, Listeria monocytogenes EGD-e
aaugauuucuauaaaaaugaua

SEQ ID NO: 777767 - RNA, 20 nt, Listeria monocytogenes EGD-e
aaugauccgaaccaagcaca

SEQ ID NO: 777768 - RNA, 18 nt, Listeria monocytogenes EGD-e
aaugcaucucccucuuuu

SEQ ID NO: 777769 - RNA, 20 nt, Listeria monocytogenes EGD-e
aaugguugcauuuggagaaa

SEQ ID NO: 777770 - RNA, 23 nt, Listeria monocytogenes EGD-e
aauggcgcgggaugguauacuau

SEQ ID NO: 777771 - RNA, 16 nt, Listeria monocytogenes EGD-e
aaugcuuuagcagcaa

SEQ ID NO: 777772 - RNA, 18 nt, Listeria monocytogenes EGD-e
aaugcuuugguauuauuc

SEQ ID NO: 777773 - RNA, 20 nt, Listeria monocytogenes EGD-e
aauugcucguucuuaguuaa

SEQ ID NO: 777774 - RNA, 23 nt, Listeria monocytogenes EGD-e
aauugcucguucuuaguuaauuc

SEQ ID NO: 777775 - RNA, 16 nt, Listeria monocytogenes EGD-e
aauugcaacuuuucuu

SEQ ID NO: 777776 - RNA, 12 nt, Listeria monocytogenes EGD-e
aauugauaccaa

SEQ ID NO: 777777 - RNA, 14 nt, Listeria monocytogenes EGD-e
aauugauaccaaau

SEQ ID NO: 777778 - RNA, 16 nt, Listeria monocytogenes EGD-e
aauucuugaauguuuu

SEQ ID NO: 777779 - RNA, 16 nt, Listeria monocytogenes EGD-e
aauucuucgcuuguuu

SEQ ID NO: 777780 - RNA, 15 nt, Listeria monocytogenes EGD-e
aauucuuuuucuucu

SEQ ID NO: 777781 - RNA, 19 nt, Listeria monocytogenes EGD-e
aauucuguuaaaggagaaa

SEQ ID NO: 777782 - RNA, 21 nt, Listeria monocytogenes EGD-e
aauucuguuaaaggagaaaaa

SEQ ID NO: 777783 - RNA, 15 nt, Listeria monocytogenes EGD-e
aauuucaaccaauuc

SEQ ID NO: 777784 - RNA, 16 nt, Listeria monocytogenes EGD-e
aauuuaauuuucccca

SEQ ID NO: 777785 - RNA, 20 nt, Listeria monocytogenes EGD-e
aauuuaauugcuagcgaagu

SEQ ID NO: 777786 - RNA, 17 nt, Listeria monocytogenes EGD-e
aauuuauauuuuaaaga

SEQ ID NO: 777787 - RNA, 15 nt, Listeria monocytogenes EGD-e
aauugugcuaaaucu

SEQ ID NO: 777788 - RNA, 13 nt, Listeria monocytogenes EGD-e
aauuguaauuccg

SEQ ID NO: 777789 - RNA, 19 nt, Listeria monocytogenes EGD-e
aauuguaauuccgugaaau

SEQ ID NO: 777790 - RNA, 15 nt, Listeria monocytogenes EGD-e
aauuguaccgcuuga

SEQ ID NO: 777791 - RNA, 15 nt, Listeria monocytogenes EGD-e
aauuguauaaguacu

SEQ ID NO: 777792 - RNA, 16 nt, Listeria monocytogenes EGD-e
aauugucauaaaacuu

SEQ ID NO: 777793 - RNA, 23 nt, Listeria monocytogenes EGD-e
aauugguuuuacaccauuuuguu

SEQ ID NO: 777794 - RNA, 19 nt, Listeria monocytogenes EGD-e
aauucccggucauuuucac

SEQ ID NO: 777795 - RNA, 21 nt, Listeria monocytogenes EGD-e
aauucauuuaauugucgaaaa

SEQ ID NO: 777796 - RNA, 20 nt, Listeria monocytogenes EGD-e
aauucauuuaguacauaaaa

SEQ ID NO: 777797 - RNA, 12 nt, Listeria monocytogenes EGD-e
aauucaguuuau

SEQ ID NO: 777798 - RNA, 18 nt, Listeria monocytogenes EGD-e
aauuccugcuaaaaccau

SEQ ID NO: 777799 - RNA, 15 nt, Listeria monocytogenes EGD-e
aauucggcuucaaaa

SEQ ID NO: 777800 - RNA, 23 nt, Listeria monocytogenes EGD-e
aauucggcuucaaaacucucuuu

SEQ ID NO: 777801 - RNA, 18 nt, Listeria monocytogenes EGD-e
aauucuccuuaaauaaaa

SEQ ID NO: 777802 - RNA, 18 nt, Listeria monocytogenes EGD-e
aauuaaauuuuuuugaaa

SEQ ID NO: 777803 - RNA, 15 nt, Listeria monocytogenes EGD-e
aauuaacaaccauuu

SEQ ID NO: 777804 - RNA, 15 nt, Listeria monocytogenes EGD-e
aauuacuaaaaaggu

SEQ ID NO: 777805 - RNA, 14 nt, Listeria monocytogenes EGD-e
aauuauuuuuguaa

SEQ ID NO: 777806 - RNA, 21 nt, Listeria monocytogenes EGD-e
aauuauuucaagguucaucca

SEQ ID NO: 777807 - RNA, 18 nt, Listeria monocytogenes EGD-e
aauuaucccguuuguuaa

SEQ ID NO: 777808 - RNA, 12 nt, Listeria monocytogenes EGD-e
aauuaucuagcu

SEQ ID NO: 777809 - RNA, 20 nt, Listeria monocytogenes EGD-e
aauuaugucggugcauuuuu

SEQ ID NO: 777810 - RNA, 14 nt, Listeria monocytogenes EGD-e
aauuauggcauaaa

SEQ ID NO: 777811 - RNA, 18 nt, Listeria monocytogenes EGD-e
aauuauggcauaaaaaau

SEQ ID NO: 777812 - RNA, 19 nt, Listeria monocytogenes EGD-e
aauuauggcauaaaaaauc

SEQ ID NO: 777813 - RNA, 18 nt, Listeria monocytogenes EGD-e
aauaaaguuaacuucauu

SEQ ID NO: 777814 - RNA, 16 nt, Listeria monocytogenes EGD-e
aauaaauauuuugcag

SEQ ID NO: 777815 - RNA, 11 nt, Listeria monocytogenes EGD-e
aauaaaucaag

SEQ ID NO: 777816 - RNA, 20 nt, Listeria monocytogenes EGD-e
aauaaauaggcccauuaaaa

SEQ ID NO: 777817 - RNA, 14 nt, Listeria monocytogenes EGD-e
aauaacauuuucuc

SEQ ID NO: 777818 - RNA, 22 nt, Listeria monocytogenes EGD-e
aauaaccaaucauggaaacaaa

SEQ ID NO: 777819 - RNA, 15 nt, Listeria monocytogenes EGD-e
aauaacaucuuuaaa

SEQ ID NO: 777820 - RNA, 22 nt, Listeria monocytogenes EGD-e
aauaacauuaaaccucuuuuuu

SEQ ID NO: 777821 - RNA, 22 nt, Listeria monocytogenes EGD-e
aauaacgaacggggcaucauuu

SEQ ID NO: 777822 - RNA, 22 nt, Listeria monocytogenes EGD-e
aauaacucggggugaaaaugag

SEQ ID NO: 777823 - RNA, 21 nt, Listeria monocytogenes EGD-e
aauaacggaaacuaucaauaa

SEQ ID NO: 777824 - RNA, 19 nt, Listeria monocytogenes EGD-e
aauaacguugcauuaaaaa

SEQ ID NO: 777825 - RNA, 20 nt, Listeria monocytogenes EGD-e
aauaacguugcauuaaaaag

SEQ ID NO: 777826 - RNA, 17 nt, Listeria monocytogenes EGD-e
aauaacuacuauuuaaa

SEQ ID NO: 777827 - RNA, 12 nt, Listeria monocytogenes EGD-e
aauaauaucuuc

SEQ ID NO: 777828 - RNA, 15 nt, Listeria monocytogenes EGD-e
aauaauacaaacuuu

SEQ ID NO: 777829 - RNA, 22 nt, Listeria monocytogenes EGD-e
aauaaguccaaagagccauaaa

SEQ ID NO: 777830 - RNA, 16 nt, Listeria monocytogenes EGD-e
aauaaguauucaaauu

SEQ ID NO: 777831 - RNA, 13 nt, Listeria monocytogenes EGD-e
aauaagucaauga

SEQ ID NO: 777832 - RNA, 18 nt, Listeria monocytogenes EGD-e
aauaaugugguucguuag

SEQ ID NO: 777833 - RNA, 23 nt, Listeria monocytogenes EGD-e
aauaauuaagaccuucuuuuaaa

SEQ ID NO: 777834 - RNA, 16 nt, Listeria monocytogenes EGD-e
aauaauuagaggauuu

SEQ ID NO: 777835 - RNA, 20 nt, Listeria monocytogenes EGD-e
aauaaugauuucuauaaaaa

SEQ ID NO: 777836 - RNA, 23 nt, Listeria monocytogenes EGD-e
aauacgcgcuggauaaagaccua

SEQ ID NO: 777837 - RNA, 22 nt, Listeria monocytogenes EGD-e
aauagcagagcuccaauaauag

SEQ ID NO: 777838 - RNA, 21 nt, Listeria monocytogenes EGD-e
aauauccacccuagcuauaca

SEQ ID NO: 777839 - RNA, 15 nt, Listeria monocytogenes EGD-e
aauaugcuauacaac

SEQ ID NO: 777840 - RNA, 16 nt, Listeria monocytogenes EGD-e
aauaucuauucauucc

SEQ ID NO: 777841 - RNA, 21 nt, Listeria monocytogenes EGD-e
aauaggcccauuaaaaagcuu

SEQ ID NO: 777842 - RNA, 16 nt, Listeria monocytogenes EGD-e
aauaggauuaaaauaa

SEQ ID NO: 777843 - RNA, 13 nt, Listeria monocytogenes EGD-e
aauauagcuucaa

SEQ ID NO: 777844 - RNA, 17 nt, Listeria monocytogenes EGD-e
aauauacacaaaguaaa

SEQ ID NO: 777845 - RNA, 14 nt, Listeria monocytogenes EGD-e
aagugugaaaaucg

SEQ ID NO: 777846 - RNA, 16 nt, Listeria monocytogenes EGD-e
aagugcguaagauuuu

SEQ ID NO: 777847 - RNA, 15 nt, Listeria monocytogenes EGD-e
aaguguaaaaguuaa

SEQ ID NO: 777848 - RNA, 17 nt, Listeria monocytogenes EGD-e
aaguguaaaaguuaaga

SEQ ID NO: 777849 - RNA, 21 nt, Listeria monocytogenes EGD-e
aagucugcuuuuucaaguaaa

SEQ ID NO: 777850 - RNA, 17 nt, Listeria monocytogenes EGD-e
aagugaccuuugaaaac

SEQ ID NO: 777851 - RNA, 18 nt, Listeria monocytogenes EGD-e
aagugaccuuugaaaacu

SEQ ID NO: 777852 - RNA, 22 nt, Listeria monocytogenes EGD-e
aagugagaaucauuaauauaaa

SEQ ID NO: 777853 - RNA, 21 nt, Listeria monocytogenes EGD-e
aagucaaagguuuaauaggaa

SEQ ID NO: 777854 - RNA, 22 nt, Listeria monocytogenes EGD-e
aaguccaaagagccauaaaauu

SEQ ID NO: 777855 - RNA, 17 nt, Listeria monocytogenes EGD-e
aagucgaaagaauaaaa

SEQ ID NO: 777856 - RNA, 13 nt, Listeria monocytogenes EGD-e
aaguagcauuuuc

SEQ ID NO: 777857 - RNA, 16 nt, Listeria monocytogenes EGD-e
aaguauucagcaggca

SEQ ID NO: 777858 - RNA, 14 nt, Listeria monocytogenes EGD-e
aaggcuuuuuaugc

SEQ ID NO: 777859 - RNA, 13 nt, Listeria monocytogenes EGD-e
aagggaagcuuuu

SEQ ID NO: 777860 - RNA, 20 nt, Listeria monocytogenes EGD-e
aagggaagcuuuugcuacac

SEQ ID NO: 777861 - RNA, 13 nt, Listeria monocytogenes EGD-e
aagguauugagug

SEQ ID NO: 777862 - RNA, 14 nt, Listeria monocytogenes EGD-e
aaggguuuucagcu

SEQ ID NO: 777863 - RNA, 17 nt, Listeria monocytogenes EGD-e
aaguacuuugaauugcu

SEQ ID NO: 777864 - RNA, 22 nt, Listeria monocytogenes EGD-e
aaguacaauuuucauuuaacau

SEQ ID NO: 777865 - RNA, 23 nt, Listeria monocytogenes EGD-e
aagaagucuuuuuguaaaggaua

SEQ ID NO: 777866 - RNA, 17 nt, Listeria monocytogenes EGD-e
aagcgaauauccgauaa

SEQ ID NO: 777867 - RNA, 20 nt, Listeria monocytogenes EGD-e
aaggacacccauaauagcag

SEQ ID NO: 777868 - RNA, 13 nt, Listeria monocytogenes EGD-e
aaggaaauaauuc

SEQ ID NO: 777869 - RNA, 16 nt, Listeria monocytogenes EGD-e
aaggaaacgaauaaaa

SEQ ID NO: 777870 - RNA, 16 nt, Listeria monocytogenes EGD-e
aagcugaugcauggaa

SEQ ID NO: 777871 - RNA, 17 nt, Listeria monocytogenes EGD-e
aagcuaagcauuauaaa

SEQ ID NO: 777872 - RNA, 18 nt, Listeria monocytogenes EGD-e
aagcuaagcauuauaaaa

SEQ ID NO: 777873 - RNA, 21 nt, Listeria monocytogenes EGD-e
aagcuaagcauuauaaaaagu

SEQ ID NO: 777874 - RNA, 22 nt, Listeria monocytogenes EGD-e
aagcguucuaaugauagaagaa

SEQ ID NO: 777875 - RNA, 22 nt, Listeria monocytogenes EGD-e
aagcgaugugggaaugaauaga

SEQ ID NO: 777876 - RNA, 20 nt, Listeria monocytogenes EGD-e
uugagcgguuuuguuuccaa

SEQ ID NO: 777877 - RNA, 16 nt, Listeria monocytogenes EGD-e
uucuuguugaauaaca

SEQ ID NO: 777878 - RNA, 20 nt, Listeria monocytogenes EGD-e
uugauaaucuacagguguau

SEQ ID NO: 777879 - RNA, 13 nt, Listeria monocytogenes EGD-e
uugauaauaauca

SEQ ID NO: 777880 - RNA, 22 nt, Listeria monocytogenes EGD-e
uugagucgcuauucuauuuauc

SEQ ID NO: 777881 - RNA, 15 nt, Listeria monocytogenes EGD-e
uugauacauauuuga

SEQ ID NO: 777882 - RNA, 18 nt, Listeria monocytogenes EGD-e
uugauguuuuugcuucuc

SEQ ID NO: 777883 - RNA, 21 nt, Listeria monocytogenes EGD-e
uugauuuguuuuauuacauua

SEQ ID NO: 777884 - RNA, 23 nt, Listeria monocytogenes EGD-e
uugauuuguuuuauuacauuaag

SEQ ID NO: 777885 - RNA, 12 nt, Listeria monocytogenes EGD-e
uugauuuaauuu

SEQ ID NO: 777886 - RNA, 21 nt, Listeria monocytogenes EGD-e
uugcauagugagaguuccauc

SEQ ID NO: 777887 - RNA, 19 nt, Listeria monocytogenes EGD-e
uugcggcaguaguuuacuu

SEQ ID NO: 777888 - RNA, 13 nt, Listeria monocytogenes EGD-e
uugcggcuuguug

SEQ ID NO: 777889 - RNA, 16 nt, Listeria monocytogenes EGD-e
uugcccaccgauaaua

SEQ ID NO: 777890 - RNA, 14 nt, Listeria monocytogenes EGD-e
uuggaucuuccauc

SEQ ID NO: 777891 - RNA, 21 nt, Listeria monocytogenes EGD-e
uuggaacggcuuuauccccua

SEQ ID NO: 777892 - RNA, 13 nt, Listeria monocytogenes EGD-e
uuggaagugaaaa

SEQ ID NO: 777893 - RNA, 22 nt, Listeria monocytogenes EGD-e
uuggaaaaucggucaauugcau

SEQ ID NO: 777894 - RNA, 14 nt, Listeria monocytogenes EGD-e
uuggaaaagagaaa

SEQ ID NO: 777895 - RNA, 17 nt, Listeria monocytogenes EGD-e
uuggaaaagagaaaaag

SEQ ID NO: 777896 - RNA, 16 nt, Listeria monocytogenes EGD-e
uuggacgagaaaugaa

SEQ ID NO: 777897 - RNA, 17 nt, Listeria monocytogenes EGD-e
uuggacgagaaaugaau

SEQ ID NO: 777898 - RNA, 21 nt, Listeria monocytogenes EGD-e
uuggacgauuggaucuuccau

SEQ ID NO: 777899 - RNA, 21 nt, Listeria monocytogenes EGD-e
uuggagaaauggauugcaggu

SEQ ID NO: 777900 - RNA, 19 nt, Listeria monocytogenes EGD-e
uugcuacacccauaauauu

SEQ ID NO: 777901 - RNA, 17 nt, Listeria monocytogenes EGD-e
uugcuaucaaccacuuu

SEQ ID NO: 777902 - RNA, 18 nt, Listeria monocytogenes EGD-e
uugcuuguguaacauaaa

SEQ ID NO: 777903 - RNA, 20 nt, Listeria monocytogenes EGD-e
uuggcgcagaaauaucaaag

SEQ ID NO: 777904 - RNA, 15 nt, Listeria monocytogenes EGD-e
uugguccaucaaauu

SEQ ID NO: 777905 - RNA, 15 nt, Listeria monocytogenes EGD-e
uugguacuugugaaa

SEQ ID NO: 777906 - RNA, 16 nt, Listeria monocytogenes EGD-e
uugguaguuuuaaauu

SEQ ID NO: 777907 - RNA, 23 nt, Listeria monocytogenes EGD-e
uuuaauaauuaagaccuucuuuu

SEQ ID NO: 777908 - RNA, 21 nt, Listeria monocytogenes EGD-e
uuuaauaagcuugcacuugga

SEQ ID NO: 777909 - RNA, 18 nt, Listeria monocytogenes EGD-e
uuuaauaaaucauaauaa

SEQ ID NO: 777910 - RNA, 23 nt, Listeria monocytogenes EGD-e
uuuaauaggaaggagcagaaaaa

SEQ ID NO: 777911 - RNA, 22 nt, Listeria monocytogenes EGD-e
uuuaacuuucuuguuucauaua

SEQ ID NO: 777912 - RNA, 22 nt, Listeria monocytogenes EGD-e
uuuaagugcugcgccaacaaaa

SEQ ID NO: 777913 - RNA, 12 nt, Listeria monocytogenes EGD-e
uuuacaccauuu

SEQ ID NO: 777914 - RNA, 22 nt, Listeria monocytogenes EGD-e
uuuagaaugaagaucccaaacu

SEQ ID NO: 777915 - RNA, 14 nt, Listeria monocytogenes EGD-e
uuuacguuguucua

SEQ ID NO: 777916 - RNA, 13 nt, Listeria monocytogenes EGD-e
uuuauaagaaauu

SEQ ID NO: 777917 - RNA, 22 nt, Listeria monocytogenes EGD-e
uuuauccguuaaucugauuaaa

SEQ ID NO: 777918 - RNA, 21 nt, Listeria monocytogenes EGD-e
uuuaucaaacaaaaaaguucu

SEQ ID NO: 777919 - RNA, 12 nt, Listeria monocytogenes EGD-e
uuuaucuaaauc

SEQ ID NO: 777920 - RNA, 15 nt, Listeria monocytogenes EGD-e
uuuaugcuaaaugaa

SEQ ID NO: 777921 - RNA, 16 nt, Listeria monocytogenes EGD-e
uuuaugcacuuucaaa

SEQ ID NO: 777922 - RNA, 15 nt, Listeria monocytogenes EGD-e
uuuaugcauaaaaaa

SEQ ID NO: 777923 - RNA, 14 nt, Listeria monocytogenes EGD-e
uuuauuacauuaag

SEQ ID NO: 777924 - RNA, 14 nt, Listeria monocytogenes EGD-e
uuuauuuaauaagc

SEQ ID NO: 777925 - RNA, 20 nt, Listeria monocytogenes EGD-e
uugucuucggauuuuucaaa

SEQ ID NO: 777926 - RNA, 23 nt, Listeria monocytogenes EGD-e
uuguggcaacuucuggauuugcu

SEQ ID NO: 777927 - RNA, 13 nt, Listeria monocytogenes EGD-e
uuguguaacauaa

SEQ ID NO: 777928 - RNA, 14 nt, Listeria monocytogenes EGD-e
uuguuaaauuaucc

SEQ ID NO: 777929 - RNA, 23 nt, Listeria monocytogenes EGD-e
uuguuccaacauaauauauggga

SEQ ID NO: 777930 - RNA, 11 nt, Listeria monocytogenes EGD-e
uuguucuggua

SEQ ID NO: 777931 - RNA, 11 nt, Listeria monocytogenes EGD-e
uuguuuuauuu

SEQ ID NO: 777932 - RNA, 19 nt, Listeria monocytogenes EGD-e
uuguuuucaggaagauauc

SEQ ID NO: 777933 - RNA, 23 nt, Listeria monocytogenes EGD-e
uuguuuucccagaaaaaaacaaa

SEQ ID NO: 777934 - RNA, 12 nt, Listeria monocytogenes EGD-e
uuguuuuccuuu

SEQ ID NO: 777935 - RNA, 15 nt, Listeria monocytogenes EGD-e
uuguaacaacuaauu

SEQ ID NO: 777936 - RNA, 21 nt, Listeria monocytogenes EGD-e
uuguaaaaauagcuuugucuu

SEQ ID NO: 777937 - RNA, 18 nt, Listeria monocytogenes EGD-e
uuguaaaccguaacuguu

SEQ ID NO: 777938 - RNA, 14 nt, Listeria monocytogenes EGD-e
uuguaauuucuuug

SEQ ID NO: 777939 - RNA, 14 nt, Listeria monocytogenes EGD-e
uuguacauaaaagc

SEQ ID NO: 777940 - RNA, 21 nt, Listeria monocytogenes EGD-e
uuguacauaaaagcaugaauu

SEQ ID NO: 777941 - RNA, 19 nt, Listeria monocytogenes EGD-e
uuguauagcuuaaagguuu

SEQ ID NO: 777942 - RNA, 15 nt, Listeria monocytogenes EGD-e
uuguauacuucaaaa

SEQ ID NO: 777943 - RNA, 15 nt, Listeria monocytogenes EGD-e
uugucaaucuaaauu

SEQ ID NO: 777944 - RNA, 13 nt, Listeria monocytogenes EGD-e
uugucaucauaaa

SEQ ID NO: 777945 - RNA, 19 nt, Listeria monocytogenes EGD-e
uucccguuaaucgaaaaau

SEQ ID NO: 777946 - RNA, 13 nt, Listeria monocytogenes EGD-e
uucccuccuuuau

SEQ ID NO: 777947 - RNA, 15 nt, Listeria monocytogenes EGD-e
uucgacaguuucuuu

SEQ ID NO: 777948 - RNA, 14 nt, Listeria monocytogenes EGD-e
uucgaauaaagaac

SEQ ID NO: 777949 - RNA, 14 nt, Listeria monocytogenes EGD-e
uuccuucuaauacg

SEQ ID NO: 777950 - RNA, 14 nt, Listeria monocytogenes EGD-e
uucgccaccuucaa

SEQ ID NO: 777951 - RNA, 16 nt, Listeria monocytogenes EGD-e
uucgccaccuucaauu

SEQ ID NO: 777952 - RNA, 15 nt, Listeria monocytogenes EGD-e
uucgcaaucaauuua

SEQ ID NO: 777953 - RNA, 20 nt, Listeria monocytogenes EGD-e
uucgauaguuccuucuaaua

SEQ ID NO: 777954 - RNA, 23 nt, Listeria monocytogenes EGD-e
uucgauauuuuuuuguucuggua

SEQ ID NO: 777955 - RNA, 14 nt, Listeria monocytogenes EGD-e
uucgauaucuucau

SEQ ID NO: 777956 - RNA, 19 nt, Listeria monocytogenes EGD-e
uucgucuuagaaaaauguu

SEQ ID NO: 777957 - RNA, 18 nt, Listeria monocytogenes EGD-e
uucgguaagaccaccaag

SEQ ID NO: 777958 - RNA, 16 nt, Listeria monocytogenes EGD-e
uucggauuuuucaaau

SEQ ID NO: 777959 - RNA, 18 nt, Listeria monocytogenes EGD-e
uucggauuuuucaaauca

SEQ ID NO: 777960 - RNA, 17 nt, Listeria monocytogenes EGD-e
uucucccucauccuuuc

SEQ ID NO: 777961 - RNA, 20 nt, Listeria monocytogenes EGD-e
uucugcuuugccgcgacuau

SEQ ID NO: 777962 - RNA, 13 nt, Listeria monocytogenes EGD-e
uucguuuuuacuu

SEQ ID NO: 777963 - RNA, 21 nt, Listeria monocytogenes EGD-e
uucguuuuuacuuacaaaagu

SEQ ID NO: 777964 - RNA, 19 nt, Listeria monocytogenes EGD-e
uucuacuguaccuuuaaaa

SEQ ID NO: 777965 - RNA, 13 nt, Listeria monocytogenes EGD-e
uucuuaaauacga

SEQ ID NO: 777966 - RNA, 14 nt, Listeria monocytogenes EGD-e
uucuuaagaauucc

SEQ ID NO: 777967 - RNA, 17 nt, Listeria monocytogenes EGD-e
uucuuaguuaauucuuu

SEQ ID NO: 777968 - RNA, 12 nt, Listeria monocytogenes EGD-e
uucuguucuuua

SEQ ID NO: 777969 - RNA, 21 nt, Listeria monocytogenes EGD-e
uucuguuaaaugauuuuuauc

SEQ ID NO: 777970 - RNA, 18 nt, Listeria monocytogenes EGD-e
uucuguuaacauuuccaa

SEQ ID NO: 777971 - RNA, 17 nt, Listeria monocytogenes EGD-e
uucuuccauuaaucucg

SEQ ID NO: 777972 - RNA, 14 nt, Listeria monocytogenes EGD-e
uucuuccauuuguu

SEQ ID NO: 777973 - RNA, 16 nt, Listeria monocytogenes EGD-e
uucuuccauuuguucu

SEQ ID NO: 777974 - RNA, 23 nt, Listeria monocytogenes EGD-e
uucuuccauuuguucucuauauu

SEQ ID NO: 777975 - RNA, 14 nt, Listeria monocytogenes EGD-e
uucuucuaauacau

SEQ ID NO: 777976 - RNA, 15 nt, Listeria monocytogenes EGD-e
uucuucuaaaauaac

SEQ ID NO: 777977 - RNA, 19 nt, Listeria monocytogenes EGD-e
uucauaaacaaaagauuca

SEQ ID NO: 777978 - RNA, 15 nt, Listeria monocytogenes EGD-e
uucagcuaaauauuu

SEQ ID NO: 777979 - RNA, 14 nt, Listeria monocytogenes EGD-e
uucauauaaguguu

SEQ ID NO: 777980 - RNA, 13 nt, Listeria monocytogenes EGD-e
uucauuuuuccaa

SEQ ID NO: 777981 - RNA, 18 nt, Listeria monocytogenes EGD-e
uucauuagacaaaaagaa

SEQ ID NO: 777982 - RNA, 23 nt, Listeria monocytogenes EGD-e
uucauuagacaaaaagaaaaaac

SEQ ID NO: 777983 - RNA, 19 nt, Listeria monocytogenes EGD-e
uucauuuaguacauaaaau

SEQ ID NO: 777984 - RNA, 21 nt, Listeria monocytogenes EGD-e
uucauuuaauugucgaaaacc

SEQ ID NO: 777985 - RNA, 14 nt, Listeria monocytogenes EGD-e
uucauuucaucuuu

SEQ ID NO: 777986 - RNA, 21 nt, Listeria monocytogenes EGD-e
uucaugugcuuguaagaagcu

SEQ ID NO: 777987 - RNA, 22 nt, Listeria monocytogenes EGD-e
uucaugacgcgcaucuucguau

SEQ ID NO: 777988 - RNA, 22 nt, Listeria monocytogenes EGD-e
uucaucggagacaguuuguaua

SEQ ID NO: 777989 - RNA, 20 nt, Listeria monocytogenes EGD-e
uucaacuaaacgaccaucug

SEQ ID NO: 777990 - RNA, 10 nt, Listeria monocytogenes EGD-e
uuauuuuaac

SEQ ID NO: 777991 - RNA, 18 nt, Listeria monocytogenes EGD-e
uucaaaucaccacaaagg

SEQ ID NO: 777992 - RNA, 14 nt, Listeria monocytogenes EGD-e
uucaaagcuacuuu

SEQ ID NO: 777993 - RNA, 22 nt, Listeria monocytogenes EGD-e
uuauucauugaacgaacgauaa

SEQ ID NO: 777994 - RNA, 15 nt, Listeria monocytogenes EGD-e
uuauuucaagguuca

SEQ ID NO: 777995 - RNA, 20 nt, Listeria monocytogenes EGD-e
uucacaaguaacucuuccaa

SEQ ID NO: 777996 - RNA, 13 nt, Listeria monocytogenes EGD-e
uucaauuuuauuu

SEQ ID NO: 777997 - RNA, 16 nt, Listeria monocytogenes EGD-e
uucaauuuuauuuggu

SEQ ID NO: 777998 - RNA, 17 nt, Listeria monocytogenes EGD-e
uucaauuuuauuugguu

SEQ ID NO: 777999 - RNA, 17 nt, Listeria monocytogenes EGD-e
uucaaucuguuccaaca

SEQ ID NO: 778000 - RNA, 19 nt, Listeria monocytogenes EGD-e
uucaaucuguuccaacaua

SEQ ID NO: 778001 - RNA, 19 nt, Listeria monocytogenes EGD-e
uucaaugagucaaugccca

SEQ ID NO: 778002 - RNA, 20 nt, Listeria monocytogenes EGD-e
uucaaguaaaaacaauaaca

SEQ ID NO: 778003 - RNA, 20 nt, Listeria monocytogenes EGD-e
uucaccacuucuuccaccug

SEQ ID NO: 778004 - RNA, 13 nt, Listeria monocytogenes EGD-e
uucacugcauaaa

SEQ ID NO: 778005 - RNA, 17 nt, Listeria monocytogenes EGD-e
uucacuggagcugauuu

SEQ ID NO: 778006 - RNA, 16 nt, Listeria monocytogenes EGD-e
ugggagcuuucuuuuu

SEQ ID NO: 778007 - RNA, 16 nt, Listeria monocytogenes EGD-e
ugggaguuuuuuauua

SEQ ID NO: 778008 - RNA, 21 nt, Listeria monocytogenes EGD-e
ugggaguuuuuuauuauugcu

SEQ ID NO: 778009 - RNA, 20 nt, Listeria monocytogenes EGD-e
ugggcaaccuaguuuuauua

SEQ ID NO: 778010 - RNA, 15 nt, Listeria monocytogenes EGD-e
ugguccugcugaaau

SEQ ID NO: 778011 - RNA, 16 nt, Listeria monocytogenes EGD-e
ugguccaucaaauuau

SEQ ID NO: 778012 - RNA, 19 nt, Listeria monocytogenes EGD-e
ugguccaucaaauuaucua

SEQ ID NO: 778013 - RNA, 21 nt, Listeria monocytogenes EGD-e
ugguaaaaaacuguuguucuu

SEQ ID NO: 778014 - RNA, 13 nt, Listeria monocytogenes EGD-e
ugguaguuuuaaa

SEQ ID NO: 778015 - RNA, 14 nt, Listeria monocytogenes EGD-e
ugguaguuuuaaau

SEQ ID NO: 778016 - RNA, 23 nt, Listeria monocytogenes EGD-e
ugguacuugugaaaguuuuauga

SEQ ID NO: 778017 - RNA, 19 nt, Listeria monocytogenes EGD-e
uggauuccuaaaucagcau

SEQ ID NO: 778018 - RNA, 15 nt, Listeria monocytogenes EGD-e
uggauugauauuaua

SEQ ID NO: 778019 - RNA, 20 nt, Listeria monocytogenes EGD-e
uggauuucuccguaagaaga

SEQ ID NO: 778020 - RNA, 16 nt, Listeria monocytogenes EGD-e
uggauuugcuuuauag

SEQ ID NO: 778021 - RNA, 14 nt, Listeria monocytogenes EGD-e
uguaacaaaaucuu

SEQ ID NO: 778022 - RNA, 19 nt, Listeria monocytogenes EGD-e
ugguuuacucccuuuuucc

SEQ ID NO: 778023 - RNA, 16 nt, Listeria monocytogenes EGD-e
ugguuuuucuuuuccu

SEQ ID NO: 778024 - RNA, 13 nt, Listeria monocytogenes EGD-e
uguaccuuauuaa

SEQ ID NO: 778025 - RNA, 14 nt, Listeria monocytogenes EGD-e
uguaaucuugaugc

SEQ ID NO: 778026 - RNA, 12 nt, Listeria monocytogenes EGD-e
uguaauaugggg

SEQ ID NO: 778027 - RNA, 17 nt, Listeria monocytogenes EGD-e
uguaacgucucucauug

SEQ ID NO: 778028 - RNA, 20 nt, Listeria monocytogenes EGD-e
uguaacugugcggaaaucuu

SEQ ID NO: 778029 - RNA, 23 nt, Listeria monocytogenes EGD-e
uguaacugugcggaaaucuugau

SEQ ID NO: 778030 - RNA, 16 nt, Listeria monocytogenes EGD-e
uguauauguuuuauuu

SEQ ID NO: 778031 - RNA, 19 nt, Listeria monocytogenes EGD-e
uguauauguuuuauuuaua

SEQ ID NO: 778032 - RNA, 22 nt, Listeria monocytogenes EGD-e
uguaguuauagcggucaaucau

SEQ ID NO: 778033 - RNA, 20 nt, Listeria monocytogenes EGD-e
uguaguuucaagauuagcca

SEQ ID NO: 778034 - RNA, 17 nt, Listeria monocytogenes EGD-e
uguaguuucgauaucuu

SEQ ID NO: 778035 - RNA, 12 nt, Listeria monocytogenes EGD-e
uguaucaaugau

SEQ ID NO: 778036 - RNA, 13 nt, Listeria monocytogenes EGD-e
ugucaucauaaac

SEQ ID NO: 778037 - RNA, 16 nt, Listeria monocytogenes EGD-e
ugucaucauaaacauu

SEQ ID NO: 778038 - RNA, 19 nt, Listeria monocytogenes EGD-e
ugucauaaaacuuucacaa

SEQ ID NO: 778039 - RNA, 21 nt, Listeria monocytogenes EGD-e
ugucacuuggaaaagagaaaa

SEQ ID NO: 778040 - RNA, 16 nt, Listeria monocytogenes EGD-e
uguccaagcacagcaa

SEQ ID NO: 778041 - RNA, 19 nt, Listeria monocytogenes EGD-e
ugucuuaaaugacaaagcu

SEQ ID NO: 778042 - RNA, 16 nt, Listeria monocytogenes EGD-e
ugugcucuuugcuuca

SEQ ID NO: 778043 - RNA, 18 nt, Listeria monocytogenes EGD-e
uguggauggcuagcaaca

SEQ ID NO: 778044 - RNA, 23 nt, Listeria monocytogenes EGD-e
uuacauauuccaaaaucgcaucc

SEQ ID NO: 778045 - RNA, 23 nt, Listeria monocytogenes EGD-e
uuaccuuucguuuuuacuuacaa

SEQ ID NO: 778046 - RNA, 16 nt, Listeria monocytogenes EGD-e
uuaccuaaugaauaag

SEQ ID NO: 778047 - RNA, 12 nt, Listeria monocytogenes EGD-e
uuaauuuaauuu

SEQ ID NO: 778048 - RNA, 22 nt, Listeria monocytogenes EGD-e
uuaaugacuguuguuucauaua

SEQ ID NO: 778049 - RNA, 22 nt, Listeria monocytogenes EGD-e
uuaauuuuccgcagcuucaauc

SEQ ID NO: 778050 - RNA, 19 nt, Listeria monocytogenes EGD-e
uuagcuauuuuuuugcuuu

SEQ ID NO: 778051 - RNA, 15 nt, Listeria monocytogenes EGD-e
uuagacaaaaagaaa

SEQ ID NO: 778052 - RNA, 19 nt, Listeria monocytogenes EGD-e
uuacuacauuuuguugaac

SEQ ID NO: 778053 - RNA, 21 nt, Listeria monocytogenes EGD-e
uuacuacauuuuguugaacuu

SEQ ID NO: 778054 - RNA, 15 nt, Listeria monocytogenes EGD-e
uuacgcauaucauca

SEQ ID NO: 778055 - RNA, 16 nt, Listeria monocytogenes EGD-e
uuacgcauaucaucaa

SEQ ID NO: 778056 - RNA, 20 nt, Listeria monocytogenes EGD-e
uuacgcauaucaucaauaaa

SEQ ID NO: 778057 - RNA, 14 nt, Listeria monocytogenes EGD-e
uuaaagcguuuuuc

SEQ ID NO: 778058 - RNA, 23 nt, Listeria monocytogenes EGD-e
uuaaauauagucuacuuuuaaaa

SEQ ID NO: 778059 - RNA, 20 nt, Listeria monocytogenes EGD-e
uuaaauauacacaaaguaaa

SEQ ID NO: 778060 - RNA, 20 nt, Listeria monocytogenes EGD-e
uuaaauaguaguuauuucuu

SEQ ID NO: 778061 - RNA, 16 nt, Listeria monocytogenes EGD-e
uuaacaaccauuuugu

SEQ ID NO: 778062 - RNA, 20 nt, Listeria monocytogenes EGD-e
uuaacaaccauuuuguucuc

SEQ ID NO: 778063 - RNA, 20 nt, Listeria monocytogenes EGD-e
uuaaauuuuuuugaaaaaac

SEQ ID NO: 778064 - RNA, 21 nt, Listeria monocytogenes EGD-e
uuaaauuuuuuugaaaaaaca

SEQ ID NO: 778065 - RNA, 21 nt, Listeria monocytogenes EGD-e
uuaauauccacccuagcuaua

SEQ ID NO: 778066 - RNA, 22 nt, Listeria monocytogenes EGD-e
uuaaucauuaaauauacacaaa

SEQ ID NO: 778067 - RNA, 19 nt, Listeria monocytogenes EGD-e
uuaaucauugcuuuguguu

SEQ ID NO: 778068 - RNA, 19 nt, Listeria monocytogenes EGD-e
uuaaguacaauuuucauuu

SEQ ID NO: 778069 - RNA, 20 nt, Listeria monocytogenes EGD-e
uuaacaucagauuaaauaua

SEQ ID NO: 778070 - RNA, 18 nt, Listeria monocytogenes EGD-e
uguuuguaaaaauagcuu

SEQ ID NO: 778071 - RNA, 22 nt, Listeria monocytogenes EGD-e
uguuuguaaaaauagcuuuguc

SEQ ID NO: 778072 - RNA, 13 nt, Listeria monocytogenes EGD-e
uguuuuaauaaau

SEQ ID NO: 778073 - RNA, 15 nt, Listeria monocytogenes EGD-e
uguuuuauuuauaga

SEQ ID NO: 778074 - RNA, 22 nt, Listeria monocytogenes EGD-e
uguuuuagauaaguuaaucauu

SEQ ID NO: 778075 - RNA, 17 nt, Listeria monocytogenes EGD-e
uguuuucgauauuuuuu

SEQ ID NO: 778076 - RNA, 17 nt, Listeria monocytogenes EGD-e
uguuuucccagaaaaaa

SEQ ID NO: 778077 - RNA, 13 nt, Listeria monocytogenes EGD-e
uguuuuuauuuau

SEQ ID NO: 778078 - RNA, 15 nt, Listeria monocytogenes EGD-e
uguuucauuuuucca

SEQ ID NO: 778079 - RNA, 18 nt, Listeria monocytogenes EGD-e
uguuuccaacguuuuaau

SEQ ID NO: 778080 - RNA, 19 nt, Listeria monocytogenes EGD-e
uguuuauucauauaaaguu

SEQ ID NO: 778081 - RNA, 19 nt, Listeria monocytogenes EGD-e
uguuuauccguuaaucuga

SEQ ID NO: 778082 - RNA, 11 nt, Listeria monocytogenes EGD-e
uguuucuuuug

SEQ ID NO: 778083 - RNA, 15 nt, Listeria monocytogenes EGD-e
uuaaacaagcuuugu

SEQ ID NO: 778084 - RNA, 13 nt, Listeria monocytogenes EGD-e
uuaaaccauaaaa

SEQ ID NO: 778085 - RNA, 18 nt, Listeria monocytogenes EGD-e
uuaaaccgauaauuuuca

SEQ ID NO: 778086 - RNA, 18 nt, Listeria monocytogenes EGD-e
uguuuuuucuuugucuug

SEQ ID NO: 778087 - RNA, 17 nt, Listeria monocytogenes EGD-e
uuaaaaacaguuucuuu

SEQ ID NO: 778088 - RNA, 22 nt, Listeria monocytogenes EGD-e
uuaaaauaguuuuuuucauuaa

SEQ ID NO: 778089 - RNA, 15 nt, Listeria monocytogenes EGD-e
uuaaaaauuuugguu

SEQ ID NO: 778090 - RNA, 22 nt, Listeria monocytogenes EGD-e
uuaaaaauuuugguuuggucaa

SEQ ID NO: 778091 - RNA, 18 nt, Listeria monocytogenes EGD-e
uguucaggguuuguucca

SEQ ID NO: 778092 - RNA, 17 nt, Listeria monocytogenes EGD-e
uguucauuacuucagcc

SEQ ID NO: 778093 - RNA, 23 nt, Listeria monocytogenes EGD-e
uguucuaaaauaucaucaauuaa

SEQ ID NO: 778094 - RNA, 18 nt, Listeria monocytogenes EGD-e
uguucuaauaauuuuaau

SEQ ID NO: 778095 - RNA, 17 nt, Listeria monocytogenes EGD-e
uguuccuuugcuaucaa

SEQ ID NO: 778096 - RNA, 16 nt, Listeria monocytogenes EGD-e
uguugaacggaaaaug

SEQ ID NO: 778097 - RNA, 16 nt, Listeria monocytogenes EGD-e
uguugcgccacuucua

SEQ ID NO: 778098 - RNA, 16 nt, Listeria monocytogenes EGD-e
uguugcgaaacaacug

SEQ ID NO: 778099 - RNA, 18 nt, Listeria monocytogenes EGD-e
uguugcaccaaaaauacg

SEQ ID NO: 778100 - RNA, 17 nt, Listeria monocytogenes EGD-e
uguuuaaucuaaaucua

SEQ ID NO: 778101 - RNA, 16 nt, Listeria monocytogenes EGD-e
uguuuaaacaucuucc

SEQ ID NO: 778102 - RNA, 15 nt, Listeria monocytogenes EGD-e
uguuguucuaauaau

SEQ ID NO: 778103 - RNA, 22 nt, Listeria monocytogenes EGD-e
uguuuaguggagcuauauagaa

SEQ ID NO: 778104 - RNA, 18 nt, Listeria monocytogenes EGD-e
uguuuaggauauuuuuuu

SEQ ID NO: 778105 - RNA, 13 nt, Listeria monocytogenes EGD-e
uguuuagcugcua

SEQ ID NO: 778106 - RNA, 20 nt, Listeria monocytogenes EGD-e
uguuuacgaacgauuuccgc

SEQ ID NO: 778107 - RNA, 22 nt, Listeria monocytogenes EGD-e
uguuuacgaacgauuuccgcaa

SEQ ID NO: 778108 - RNA, 18 nt, Listeria monocytogenes EGD-e
uguuguaauuucuuuguc

SEQ ID NO: 778109 - RNA, 20 nt, Listeria monocytogenes EGD-e
uguugucaauguauacagga

SEQ ID NO: 778110 - RNA, 14 nt, Listeria monocytogenes EGD-e
ugauuuguuuuauu

SEQ ID NO: 778111 - RNA, 15 nt, Listeria monocytogenes EGD-e
ugcagaaacaaucau

SEQ ID NO: 778112 - RNA, 21 nt, Listeria monocytogenes EGD-e
ugcacuuucaaaucagcuucc

SEQ ID NO: 778113 - RNA, 15 nt, Listeria monocytogenes EGD-e
ugcagcgacaauuau

SEQ ID NO: 778114 - RNA, 20 nt, Listeria monocytogenes EGD-e
ugcaucuucuguuaacauuu

SEQ ID NO: 778115 - RNA, 22 nt, Listeria monocytogenes EGD-e
ugcauuaaaaaggaauuuuucc

SEQ ID NO: 778116 - RNA, 23 nt, Listeria monocytogenes EGD-e
ugcauuaaaaaggaauuuuucca

SEQ ID NO: 778117 - RNA, 15 nt, Listeria monocytogenes EGD-e
ugcauuuuuucuuug

SEQ ID NO: 778118 - RNA, 18 nt, Listeria monocytogenes EGD-e
ugcauuuuuucuuugccu

SEQ ID NO: 778119 - RNA, 20 nt, Listeria monocytogenes EGD-e
ugccaaauuggucauauguu

SEQ ID NO: 778120 - RNA, 14 nt, Listeria monocytogenes EGD-e
ugccacuugaauau

SEQ ID NO: 778121 - RNA, 20 nt, Listeria monocytogenes EGD-e
ugccaucgguacaguagaag

SEQ ID NO: 778122 - RNA, 20 nt, Listeria monocytogenes EGD-e
ugccaucgccgccuauuauu

SEQ ID NO: 778123 - RNA, 21 nt, Listeria monocytogenes EGD-e
ugccaucgccgccuauuauuu

SEQ ID NO: 778124 - RNA, 16 nt, Listeria monocytogenes EGD-e
ugccaucgcagcagaa

SEQ ID NO: 778125 - RNA, 14 nt, Listeria monocytogenes EGD-e
ugcccaucuuuuuu

SEQ ID NO: 778126 - RNA, 19 nt, Listeria monocytogenes EGD-e
ugcccuugauuuaaauaaa

SEQ ID NO: 778127 - RNA, 16 nt, Listeria monocytogenes EGD-e
ugccgacuaguucugc

SEQ ID NO: 778128 - RNA, 16 nt, Listeria monocytogenes EGD-e
ugcgcaacauucaaau

SEQ ID NO: 778129 - RNA, 18 nt, Listeria monocytogenes EGD-e
ugcgcaacauucaaauca

SEQ ID NO: 778130 - RNA, 22 nt, Listeria monocytogenes EGD-e
aaaugggcaguuacuuuaccuu

SEQ ID NO: 778131 - RNA, 17 nt, Listeria monocytogenes EGD-e
aaauggcugaugacuaa

SEQ ID NO: 778132 - RNA, 17 nt, Listeria monocytogenes EGD-e
aaauggcguuuuaaauc

SEQ ID NO: 778133 - RNA, 19 nt, Listeria monocytogenes EGD-e
aaauggcguuuuaaauccu

SEQ ID NO: 778134 - RNA, 21 nt, Listeria monocytogenes EGD-e
aaaugguacguugguuguucu

SEQ ID NO: 778135 - RNA, 14 nt, Listeria monocytogenes EGD-e
aaaugguuucuuaa

SEQ ID NO: 778136 - RNA, 19 nt, Listeria monocytogenes EGD-e
aaaugguuucuuaaauacg

SEQ ID NO: 778137 - RNA, 16 nt, Listeria monocytogenes EGD-e
ugcgcggauaaauaua

SEQ ID NO: 778138 - RNA, 15 nt, Listeria monocytogenes EGD-e
ugcgcgcauggcuag

SEQ ID NO: 778139 - RNA, 14 nt, Listeria monocytogenes EGD-e
ugacuguuguuuca

SEQ ID NO: 778140 - RNA, 17 nt, Listeria monocytogenes EGD-e
ugaccuuugaaaacuga

SEQ ID NO: 778141 - RNA, 13 nt, Listeria monocytogenes EGD-e
ugagcacuaaugc

SEQ ID NO: 778142 - RNA, 14 nt, Listeria monocytogenes EGD-e
ugagcccaaaaaua

SEQ ID NO: 778143 - RNA, 18 nt, Listeria monocytogenes EGD-e
ugagcuucuuuuucgauu

SEQ ID NO: 778144 - RNA, 20 nt, Listeria monocytogenes EGD-e
ugauaaugugaccuuaaauu

SEQ ID NO: 778145 - RNA, 17 nt, Listeria monocytogenes EGD-e
ugauauuaugauuuguu

SEQ ID NO: 778146 - RNA, 20 nt, Listeria monocytogenes EGD-e
ugauauuaugauuuguuucu

SEQ ID NO: 778147 - RNA, 14 nt, Listeria monocytogenes EGD-e
ugauaccaaauugu

SEQ ID NO: 778148 - RNA, 21 nt, Listeria monocytogenes EGD-e
ugaugaaaagacaccaauuuc

SEQ ID NO: 778149 - RNA, 20 nt, Listeria monocytogenes EGD-e
ugaugccgacuaguucugcu

SEQ ID NO: 778150 - RNA, 22 nt, Listeria monocytogenes EGD-e
ugaugccgacuaguucugcuag

SEQ ID NO: 778151 - RNA, 21 nt, Listeria monocytogenes EGD-e
ugauugguccugcugaaauag

SEQ ID NO: 778152 - RNA, 17 nt, Listeria monocytogenes EGD-e
ugauuaggcauuucuuu

SEQ ID NO: 778153 - RNA, 21 nt, Listeria monocytogenes EGD-e
ugaugguauuguuuuuugauu

SEQ ID NO: 778154 - RNA, 14 nt, Listeria monocytogenes EGD-e
ugaauuaagaagua

SEQ ID NO: 778155 - RNA, 18 nt, Listeria monocytogenes EGD-e
ugaauuaagaaguacaau

SEQ ID NO: 778156 - RNA, 20 nt, Listeria monocytogenes EGD-e
ugaauuaagaaguacaauaa

SEQ ID NO: 778157 - RNA, 14 nt, Listeria monocytogenes EGD-e
ugaauuuuuauaca

SEQ ID NO: 778158 - RNA, 20 nt, Listeria monocytogenes EGD-e
ugaaugccagccauuuugga

SEQ ID NO: 778159 - RNA, 22 nt, Listeria monocytogenes EGD-e
ugaauccgaccuuguucacuag

SEQ ID NO: 778160 - RNA, 19 nt, Listeria monocytogenes EGD-e
ugacaaaaggacaagccca

SEQ ID NO: 778161 - RNA, 14 nt, Listeria monocytogenes EGD-e
ugaccuuaaauuau

SEQ ID NO: 778162 - RNA, 22 nt, Listeria monocytogenes EGD-e
ugaccagugugguuuacucccu

SEQ ID NO: 778163 - RNA, 22 nt, Listeria monocytogenes EGD-e
ucuucgugcgcaacauucaaau

SEQ ID NO: 778164 - RNA, 16 nt, Listeria monocytogenes EGD-e
ugaaacuuuaacaaaa

SEQ ID NO: 778165 - RNA, 23 nt, Listeria monocytogenes EGD-e
ugaaagagggcccgaaaaucgag

SEQ ID NO: 778166 - RNA, 13 nt, Listeria monocytogenes EGD-e
ugaacaaagaaga

SEQ ID NO: 778167 - RNA, 15 nt, Listeria monocytogenes EGD-e
ugaacaaagaagaag

SEQ ID NO: 778168 - RNA, 17 nt, Listeria monocytogenes EGD-e
ugaaaugauuuuuauuc

SEQ ID NO: 778169 - RNA, 14 nt, Listeria monocytogenes EGD-e
ugaauauccuaacu

SEQ ID NO: 778170 - RNA, 13 nt, Listeria monocytogenes EGD-e
ugaauaagcaauu

SEQ ID NO: 778171 - RNA, 16 nt, Listeria monocytogenes EGD-e
ucgccguuggaaguga

SEQ ID NO: 778172 - RNA, 14 nt, Listeria monocytogenes EGD-e
ucgccuacuucuaa

SEQ ID NO: 778173 - RNA, 22 nt, Listeria monocytogenes EGD-e
ucgccaccugguaaauagccaa

SEQ ID NO: 778174 - RNA, 16 nt, Listeria monocytogenes EGD-e
ucgcggauaauaauca

SEQ ID NO: 778175 - RNA, 19 nt, Listeria monocytogenes EGD-e
ucgcugucaaauucuucuc

SEQ ID NO: 778176 - RNA, 22 nt, Listeria monocytogenes EGD-e
ucgcuuuaauacguauucuagc

SEQ ID NO: 778177 - RNA, 22 nt, Listeria monocytogenes EGD-e
ucggaccuuuugcuucuuccau

SEQ ID NO: 778178 - RNA, 13 nt, Listeria monocytogenes EGD-e
ucggauuuuucaa

SEQ ID NO: 778179 - RNA, 18 nt, Listeria monocytogenes EGD-e
ucggauuuuucaaaucaa

SEQ ID NO: 778180 - RNA, 18 nt, Listeria monocytogenes EGD-e
ucggguuuguuaauaauu

SEQ ID NO: 778181 - RNA, 13 nt, Listeria monocytogenes EGD-e
ucggucaaaucug

SEQ ID NO: 778182 - RNA, 23 nt, Listeria monocytogenes EGD-e
ucggcuuuuuuuauuuaaucauu

SEQ ID NO: 778183 - RNA, 17 nt, Listeria monocytogenes EGD-e
ucguaaauagcacagcu

SEQ ID NO: 778184 - RNA, 18 nt, Listeria monocytogenes EGD-e
ucgucuaaaaaauauuga

SEQ ID NO: 778185 - RNA, 19 nt, Listeria monocytogenes EGD-e
ucgucguauguuuucccuu

SEQ ID NO: 778186 - RNA, 22 nt, Listeria monocytogenes EGD-e
ucgucuuagaaaaauguuugca

SEQ ID NO: 778187 - RNA, 21 nt, Listeria monocytogenes EGD-e
ucgugcgcaacauucaaauca

SEQ ID NO: 778188 - RNA, 22 nt, Listeria monocytogenes EGD-e
ucgugcgcaacauucaaaucac

SEQ ID NO: 778189 - RNA, 16 nt, Listeria monocytogenes EGD-e
ucguuuaacauauaau

SEQ ID NO: 778190 - RNA, 15 nt, Listeria monocytogenes EGD-e
ucguucuuaguuaau

SEQ ID NO: 778191 - RNA, 17 nt, Listeria monocytogenes EGD-e
ucucccauuugucccac

SEQ ID NO: 778192 - RNA, 17 nt, Listeria monocytogenes EGD-e
ucuccguaagaagaaaa

SEQ ID NO: 778193 - RNA, 14 nt, Listeria monocytogenes EGD-e
ucuccuuaaauaaa

SEQ ID NO: 778194 - RNA, 19 nt, Listeria monocytogenes EGD-e
ucugaguagaaaguuaguu

SEQ ID NO: 778195 - RNA, 13 nt, Listeria monocytogenes EGD-e
ucucuauauucau

SEQ ID NO: 778196 - RNA, 12 nt, Listeria monocytogenes EGD-e
aaaugcuuuaac

SEQ ID NO: 778197 - RNA, 22 nt, Listeria monocytogenes EGD-e
aaaugcuuuaacugguuccauu

SEQ ID NO: 778198 - RNA, 18 nt, Listeria monocytogenes EGD-e
ucuuauagcaucuuggca

SEQ ID NO: 778199 - RNA, 22 nt, Listeria monocytogenes EGD-e
ucuuaguuaauucuuuuucuga

SEQ ID NO: 778200 - RNA, 14 nt, Listeria monocytogenes EGD-e
ucuguuucauuuuu

SEQ ID NO: 778201 - RNA, 18 nt, Listeria monocytogenes EGD-e
ucuguuucauuuuuccaa

SEQ ID NO: 778202 - RNA, 16 nt, Listeria monocytogenes EGD-e
ucuucggauuuuucaa

SEQ ID NO: 778203 - RNA, 13 nt, Listeria monocytogenes EGD-e
ucuucgcuuguuu

SEQ ID NO: 778204 - RNA, 13 nt, Listeria monocytogenes EGD-e
ucuuccuuuuguu

SEQ ID NO: 778205 - RNA, 23 nt, Listeria monocytogenes EGD-e
ucuuccauagaauguauacacua

SEQ ID NO: 778206 - RNA, 15 nt, Listeria monocytogenes EGD-e
ucuuccauaucacca

SEQ ID NO: 778207 - RNA, 14 nt, Listeria monocytogenes EGD-e
ucuuccauauuuuc

SEQ ID NO: 778208 - RNA, 19 nt, Listeria monocytogenes EGD-e
ucuuccauauuuucucuaa

SEQ ID NO: 778209 - RNA, 15 nt, Listeria monocytogenes EGD-e
ucuucaauugcuucu

SEQ ID NO: 778210 - RNA, 18 nt, Listeria monocytogenes EGD-e
ucuuccaccuguauuaau

SEQ ID NO: 778211 - RNA, 22 nt, Listeria monocytogenes EGD-e
ucugcauccaagcggguuuucu

SEQ ID NO: 778212 - RNA, 19 nt, Listeria monocytogenes EGD-e
ucugcuuuuucaaguaaaa

SEQ ID NO: 778213 - RNA, 20 nt, Listeria monocytogenes EGD-e
aaaugcacagcagaaacuuu

SEQ ID NO: 778214 - RNA, 22 nt, Listeria monocytogenes EGD-e
aaaugcacaugauaaccagaaa

SEQ ID NO: 778215 - RNA, 14 nt, Listeria monocytogenes EGD-e
ucuagcgucacaau

SEQ ID NO: 778216 - RNA, 13 nt, Listeria monocytogenes EGD-e
ucuagguuuucuu

SEQ ID NO: 778217 - RNA, 12 nt, Listeria monocytogenes EGD-e
aaaugauaaugu

SEQ ID NO: 778218 - RNA, 14 nt, Listeria monocytogenes EGD-e
ucuaguuuguccca

SEQ ID NO: 778219 - RNA, 12 nt, Listeria monocytogenes EGD-e
ucuauauucauc

SEQ ID NO: 778220 - RNA, 22 nt, Listeria monocytogenes EGD-e
ucucauaagagaauaucuauuc

SEQ ID NO: 778221 - RNA, 17 nt, Listeria monocytogenes EGD-e
ucuaagaaaaaaaguua

SEQ ID NO: 778222 - RNA, 22 nt, Listeria monocytogenes EGD-e
ucuaagucugcuuuuucaagua

SEQ ID NO: 778223 - RNA, 23 nt, Listeria monocytogenes EGD-e
aaaucuuucacacgauaccaaag

SEQ ID NO: 778224 - RNA, 17 nt, Listeria monocytogenes EGD-e
aaaucuuuaaacaagcu

SEQ ID NO: 778225 - RNA, 11 nt, Listeria monocytogenes EGD-e
aaaucuuuucg

SEQ ID NO: 778226 - RNA, 20 nt, Listeria monocytogenes EGD-e
aaaucuuuuuguuuugcuuc

SEQ ID NO: 778227 - RNA, 19 nt, Listeria monocytogenes EGD-e
ucguuuuuacuuacaaaag

SEQ ID NO: 778228 - RNA, 14 nt, Listeria monocytogenes EGD-e
ucguuuuaaagcuu

SEQ ID NO: 778229 - RNA, 17 nt, Listeria monocytogenes EGD-e
ucuaaaauaucaucaau

SEQ ID NO: 778230 - RNA, 16 nt, Listeria monocytogenes EGD-e
ucuaaaaucauuaaag

SEQ ID NO: 778231 - RNA, 13 nt, Listeria monocytogenes EGD-e
ucuaaauuaacuu

SEQ ID NO: 778232 - RNA, 22 nt, Listeria monocytogenes EGD-e
ucuaacauuaauucauuuaauu

SEQ ID NO: 778233 - RNA, 18 nt, Listeria monocytogenes EGD-e
ucuaaacguucuuccuuu

SEQ ID NO: 778234 - RNA, 18 nt, Listeria monocytogenes EGD-e
ucuaaaguuagauuaaaa

SEQ ID NO: 778235 - RNA, 19 nt, Listeria monocytogenes EGD-e
ucuaaaguuagauuaaaaa

SEQ ID NO: 778236 - RNA, 21 nt, Listeria monocytogenes EGD-e
ucuaaaguuagauuaaaaauc

SEQ ID NO: 778237 - RNA, 19 nt, Listeria monocytogenes EGD-e
ucuaaauaaauauuuugca

SEQ ID NO: 778238 - RNA, 16 nt, Listeria monocytogenes EGD-e
ucuacuagugaaauag

SEQ ID NO: 778239 - RNA, 14 nt, Listeria monocytogenes EGD-e
aaaugagcccaaaa

SEQ ID NO: 778240 - RNA, 11 nt, Listeria monocytogenes EGD-e
ucuacuucuaa

SEQ ID NO: 778241 - RNA, 16 nt, Listeria monocytogenes EGD-e
ucuacaggcuauucca

SEQ ID NO: 778242 - RNA, 15 nt, Listeria monocytogenes EGD-e
ucuacaacuggcaca

SEQ ID NO: 778243 - RNA, 18 nt, Listeria monocytogenes EGD-e
ucuacaaguucuuucaug

SEQ ID NO: 778244 - RNA, 16 nt, Listeria monocytogenes EGD-e
ucuaauacgacaauac

SEQ ID NO: 778245 - RNA, 23 nt, Listeria monocytogenes EGD-e
ucuaauacgacaauaccauguuu

SEQ ID NO: 778246 - RNA, 12 nt, Listeria monocytogenes EGD-e
uauuuaaauaua

SEQ ID NO: 778247 - RNA, 16 nt, Listeria monocytogenes EGD-e
uauuuauauucuucug

SEQ ID NO: 778248 - RNA, 20 nt, Listeria monocytogenes EGD-e
uauuucagcuaaucguuuua

SEQ ID NO: 778249 - RNA, 16 nt, Listeria monocytogenes EGD-e
uauuuaucaaacaaaa

SEQ ID NO: 778250 - RNA, 19 nt, Listeria monocytogenes EGD-e
uauucauugaacgaacgau

SEQ ID NO: 778251 - RNA, 15 nt, Listeria monocytogenes EGD-e
uauuccaaaaucgca

SEQ ID NO: 778252 - RNA, 15 nt, Listeria monocytogenes EGD-e
uauucagcaggcacg

SEQ ID NO: 778253 - RNA, 13 nt, Listeria monocytogenes EGD-e
uauuagaaaauca

SEQ ID NO: 778254 - RNA, 16 nt, Listeria monocytogenes EGD-e
uaucccuuaugacaag

SEQ ID NO: 778255 - RNA, 14 nt, Listeria monocytogenes EGD-e
ucaaagguuuaaua

SEQ ID NO: 778256 - RNA, 23 nt, Listeria monocytogenes EGD-e
ucaaacgaucagccauuuuacgg

SEQ ID NO: 778257 - RNA, 20 nt, Listeria monocytogenes EGD-e
ucaaacgcagguucaccaaa

SEQ ID NO: 778258 - RNA, 18 nt, Listeria monocytogenes EGD-e
ucaaaaucaagcguacca

SEQ ID NO: 778259 - RNA, 12 nt, Listeria monocytogenes EGD-e
ucaaaaauaugc

SEQ ID NO: 778260 - RNA, 15 nt, Listeria monocytogenes EGD-e
uauuuuuauuauaaa

SEQ ID NO: 778261 - RNA, 20 nt, Listeria monocytogenes EGD-e
uauuuuucagcuaaauauuu

SEQ ID NO: 778262 - RNA, 16 nt, Listeria monocytogenes EGD-e
uauuuuuuuuacuguc

SEQ ID NO: 778263 - RNA, 17 nt, Listeria monocytogenes EGD-e
uauuucuuuauaacucu

SEQ ID NO: 778264 - RNA, 17 nt, Listeria monocytogenes EGD-e
uauuucuuuaucuuucc

SEQ ID NO: 778265 - RNA, 16 nt, Listeria monocytogenes EGD-e
uauuugggauuagaau

SEQ ID NO: 778266 - RNA, 20 nt, Listeria monocytogenes EGD-e
uauuuuaacauaaaaagcug

SEQ ID NO: 778267 - RNA, 17 nt, Listeria monocytogenes EGD-e
uauuugucaaucuaaau

SEQ ID NO: 778268 - RNA, 19 nt, Listeria monocytogenes EGD-e
uauuugucaaucuaaauuu

SEQ ID NO: 778269 - RNA, 18 nt, Listeria monocytogenes EGD-e
uauuuggccaauuaaaau

SEQ ID NO: 778270 - RNA, 20 nt, Listeria monocytogenes EGD-e
uauuuggccaauuaaaauac

SEQ ID NO: 778271 - RNA, 21 nt, Listeria monocytogenes EGD-e
uauuuuauucgaauaaagaac

SEQ ID NO: 778272 - RNA, 20 nt, Listeria monocytogenes EGD-e
uauuuugcggaaauaucacc

SEQ ID NO: 778273 - RNA, 19 nt, Listeria monocytogenes EGD-e
uauuuugguuauuucuuua

SEQ ID NO: 778274 - RNA, 16 nt, Listeria monocytogenes EGD-e
ucaagaccaagaacau

SEQ ID NO: 778275 - RNA, 18 nt, Listeria monocytogenes EGD-e
ucaaaucuggauaaaaau

SEQ ID NO: 778276 - RNA, 19 nt, Listeria monocytogenes EGD-e
ucaaaucuggauaaaaaua

SEQ ID NO: 778277 - RNA, 17 nt, Listeria monocytogenes EGD-e
ucaaguaaaaacaauaa

SEQ ID NO: 778278 - RNA, 19 nt, Listeria monocytogenes EGD-e
ucaaguaaaaacaauaaca

SEQ ID NO: 778279 - RNA, 22 nt, Listeria monocytogenes EGD-e
ucaaguaaaaacaauaacauuu

SEQ ID NO: 778280 - RNA, 15 nt, Listeria monocytogenes EGD-e
ucaaguaauaagaag

SEQ ID NO: 778281 - RNA, 20 nt, Listeria monocytogenes EGD-e
ucaaguaauaagaagauauu

SEQ ID NO: 778282 - RNA, 17 nt, Listeria monocytogenes EGD-e
ucaagauuuugcucagc

SEQ ID NO: 778283 - RNA, 12 nt, Listeria monocytogenes EGD-e
ucaagauuuugu

SEQ ID NO: 778284 - RNA, 15 nt, Listeria monocytogenes EGD-e
ucaagcgaaaucuca

SEQ ID NO: 778285 - RNA, 18 nt, Listeria monocytogenes EGD-e
ucaagcguaccauucacu

SEQ ID NO: 778286 - RNA, 15 nt, Listeria monocytogenes EGD-e
ucaagcccagcuaaa

SEQ ID NO: 778287 - RNA, 20 nt, Listeria monocytogenes EGD-e
ucaagcauauuaauuugauu

SEQ ID NO: 778288 - RNA, 14 nt, Listeria monocytogenes EGD-e
ucaauccauuuuuc

SEQ ID NO: 778289 - RNA, 15 nt, Listeria monocytogenes EGD-e
ucaauccauuuuucu

SEQ ID NO: 778290 - RNA, 18 nt, Listeria monocytogenes EGD-e
ucaaucccagcuuuuccu

SEQ ID NO: 778291 - RNA, 17 nt, Listeria monocytogenes EGD-e
ucaagugcuucaucuuu

SEQ ID NO: 778292 - RNA, 16 nt, Listeria monocytogenes EGD-e
ucaaucggaacaccaa

SEQ ID NO: 778293 - RNA, 17 nt, Listeria monocytogenes EGD-e
ucaaucggaacaccaag

SEQ ID NO: 778294 - RNA, 18 nt, Listeria monocytogenes EGD-e
ucaaucgcagcagauuuu

SEQ ID NO: 778295 - RNA, 15 nt, Listeria monocytogenes EGD-e
ucaaucucaucacca

SEQ ID NO: 778296 - RNA, 16 nt, Listeria monocytogenes EGD-e
ucaaucuaaauuuuaa

SEQ ID NO: 778297 - RNA, 22 nt, Listeria monocytogenes EGD-e
ucacaccuugugugguguuuuu

SEQ ID NO: 778298 - RNA, 15 nt, Listeria monocytogenes EGD-e
ucacacgaaccccaa

SEQ ID NO: 778299 - RNA, 16 nt, Listeria monocytogenes EGD-e
ucacaaguaacucuuc

SEQ ID NO: 778300 - RNA, 18 nt, Listeria monocytogenes EGD-e
ucacaaguaccaaauagg

SEQ ID NO: 778301 - RNA, 13 nt, Listeria monocytogenes EGD-e
ucaccaaaugcuu

SEQ ID NO: 778302 - RNA, 15 nt, Listeria monocytogenes EGD-e
ucacacgauaccaaa

SEQ ID NO: 778303 - RNA, 15 nt, Listeria monocytogenes EGD-e
ucaccacaaaggaca

SEQ ID NO: 778304 - RNA, 19 nt, Listeria monocytogenes EGD-e
ucacccauacuaaucaaua

SEQ ID NO: 778305 - RNA, 16 nt, Listeria monocytogenes EGD-e
ucaccuucuuuuugcu

SEQ ID NO: 778306 - RNA, 19 nt, Listeria monocytogenes EGD-e
ucacuaauuagcauaauau

SEQ ID NO: 778307 - RNA, 19 nt, Listeria monocytogenes EGD-e
uccagcuaaguuuucuaaa

SEQ ID NO: 778308 - RNA, 20 nt, Listeria monocytogenes EGD-e
uccagcuguaucaaugauau

SEQ ID NO: 778309 - RNA, 20 nt, Listeria monocytogenes EGD-e
uccagcugcuucuaaagcua

SEQ ID NO: 778310 - RNA, 21 nt, Listeria monocytogenes EGD-e
uccaguauuuccccgcagaaa

SEQ ID NO: 778311 - RNA, 18 nt, Listeria monocytogenes EGD-e
uccacucguuccgacuac

SEQ ID NO: 778312 - RNA, 16 nt, Listeria monocytogenes EGD-e
uccaauucuuucgcuu

SEQ ID NO: 778313 - RNA, 21 nt, Listeria monocytogenes EGD-e
uccaauucuuucgcuucacug

SEQ ID NO: 778314 - RNA, 22 nt, Listeria monocytogenes EGD-e
uccacccuagcuauacauugaa

SEQ ID NO: 778315 - RNA, 20 nt, Listeria monocytogenes EGD-e
uccaccaccuuugguaaaaa

SEQ ID NO: 778316 - RNA, 14 nt, Listeria monocytogenes EGD-e
ucauuaaacggcuu

SEQ ID NO: 778317 - RNA, 15 nt, Listeria monocytogenes EGD-e
ucauuaaauauacac

SEQ ID NO: 778318 - RNA, 15 nt, Listeria monocytogenes EGD-e
ucauuaaauuuagcu

SEQ ID NO: 778319 - RNA, 15 nt, Listeria monocytogenes EGD-e
ucauuaaaucaguac

SEQ ID NO: 778320 - RNA, 17 nt, Listeria monocytogenes EGD-e
ucauuacaaaauuuguc

SEQ ID NO: 778321 - RNA, 15 nt, Listeria monocytogenes EGD-e
uccaaaauaaaaugg

SEQ ID NO: 778322 - RNA, 22 nt, Listeria monocytogenes EGD-e
uccaaaauaaaauggauaaaaa

SEQ ID NO: 778323 - RNA, 21 nt, Listeria monocytogenes EGD-e
ucauuuucacugcauaaaaaa

SEQ ID NO: 778324 - RNA, 17 nt, Listeria monocytogenes EGD-e
ucauuuuucuagugcau

SEQ ID NO: 778325 - RNA, 15 nt, Listeria monocytogenes EGD-e
ucauuuauuuucccu

SEQ ID NO: 778326 - RNA, 15 nt, Listeria monocytogenes EGD-e
ucaugccuucaaaca

SEQ ID NO: 778327 - RNA, 16 nt, Listeria monocytogenes EGD-e
ucaugagcuaauuuuu

SEQ ID NO: 778328 - RNA, 13 nt, Listeria monocytogenes EGD-e
ucaugaauaaguu

SEQ ID NO: 778329 - RNA, 18 nt, Listeria monocytogenes EGD-e
ucaugaagcaaaccauua

SEQ ID NO: 778330 - RNA, 22 nt, Listeria monocytogenes EGD-e
ucaucguuuucuacuguagaau

SEQ ID NO: 778331 - RNA, 21 nt, Listeria monocytogenes EGD-e
ucaucuuaucaaguaauaaga

SEQ ID NO: 778332 - RNA, 21 nt, Listeria monocytogenes EGD-e
ucaucaacgggcgcuuucaca

SEQ ID NO: 778333 - RNA, 22 nt, Listeria monocytogenes EGD-e
ucaucaacgggcgcuuucacau

SEQ ID NO: 778334 - RNA, 13 nt, Listeria monocytogenes EGD-e
ucaucaauaaaau

SEQ ID NO: 778335 - RNA, 19 nt, Listeria monocytogenes EGD-e
ucauauuuggccaauuaaa

SEQ ID NO: 778336 - RNA, 21 nt, Listeria monocytogenes EGD-e
ucauauuuggccaauuaaaau

SEQ ID NO: 778337 - RNA, 22 nt, Listeria monocytogenes EGD-e
ucauauuuggccaauuaaaaua

SEQ ID NO: 778338 - RNA, 18 nt, Listeria monocytogenes EGD-e
ucauauucuucuaaaaua

SEQ ID NO: 778339 - RNA, 16 nt, Listeria monocytogenes EGD-e
ucauauaauucuaaua

SEQ ID NO: 778340 - RNA, 10 nt, Listeria monocytogenes EGD-e
ucauaauagg

SEQ ID NO: 778341 - RNA, 16 nt, Listeria monocytogenes EGD-e
ucauaauaggagacau

SEQ ID NO: 778342 - RNA, 20 nt, Listeria monocytogenes EGD-e
ucauaaucaaauacaugacc

SEQ ID NO: 778343 - RNA, 14 nt, Listeria monocytogenes EGD-e
ucaucauaaacauu

SEQ ID NO: 778344 - RNA, 16 nt, Listeria monocytogenes EGD-e
ucauaaaacuuucaca

SEQ ID NO: 778345 - RNA, 17 nt, Listeria monocytogenes EGD-e
ucauaaaacuuucacaa

SEQ ID NO: 778346 - RNA, 24 nt, Listeria monocytogenes EGD-e
ucauaagcuaacaacaagcaaaac

SEQ ID NO: 778347 - RNA, 14 nt, Listeria monocytogenes EGD-e
ucauaagcuucaua

SEQ ID NO: 778348 - RNA, 17 nt, Listeria monocytogenes EGD-e
ucagggaauaagaaauu

SEQ ID NO: 778349 - RNA, 21 nt, Listeria monocytogenes EGD-e
ucagggaauaagaaauuaccu

SEQ ID NO: 778350 - RNA, 16 nt, Listeria monocytogenes EGD-e
ucagcuuccauacuuu

SEQ ID NO: 778351 - RNA, 19 nt, Listeria monocytogenes EGD-e
ucagcuucgauuuuuucaa

SEQ ID NO: 778352 - RNA, 18 nt, Listeria monocytogenes EGD-e
ucagcuaaauauuuaauu

SEQ ID NO: 778353 - RNA, 22 nt, Listeria monocytogenes EGD-e
ucacugauuuauuauaagcagu

SEQ ID NO: 778354 - RNA, 13 nt, Listeria monocytogenes EGD-e
uaggccuagcuaa

SEQ ID NO: 778355 - RNA, 17 nt, Listeria monocytogenes EGD-e
uaggccacuaacauaaa

SEQ ID NO: 778356 - RNA, 19 nt, Listeria monocytogenes EGD-e
uaggccacuaacauaaauu

SEQ ID NO: 778357 - RNA, 22 nt, Listeria monocytogenes EGD-e
uaggccacuaacauaaauugau

SEQ ID NO: 778358 - RNA, 19 nt, Listeria monocytogenes EGD-e
uaggcuuccuuguuuuuug

SEQ ID NO: 778359 - RNA, 21 nt, Listeria monocytogenes EGD-e
uaggcucuuccuuuuguuuua

SEQ ID NO: 778360 - RNA, 23 nt, Listeria monocytogenes EGD-e
uaggcucuuccuuuuguuuuaau

SEQ ID NO: 778361 - RNA, 22 nt, Listeria monocytogenes EGD-e
uaggucaggauuaaaaguugac

SEQ ID NO: 778362 - RNA, 12 nt, Listeria monocytogenes EGD-e
uagguaacaucu

SEQ ID NO: 778363 - RNA, 17 nt, Listeria monocytogenes EGD-e
uaggguuuggaaaacau

SEQ ID NO: 778364 - RNA, 21 nt, Listeria monocytogenes EGD-e
uaguaaagcacuggcaaauaa

SEQ ID NO: 778365 - RNA, 15 nt, Listeria monocytogenes EGD-e
uaguagcacuccuug

SEQ ID NO: 778366 - RNA, 16 nt, Listeria monocytogenes EGD-e
uaguugguaguuuuaa

SEQ ID NO: 778367 - RNA, 12 nt, Listeria monocytogenes EGD-e
uaguuguuccau

SEQ ID NO: 778368 - RNA, 14 nt, Listeria monocytogenes EGD-e
uaguuauuucuuua

SEQ ID NO: 778369 - RNA, 17 nt, Listeria monocytogenes EGD-e
uaguuauuucuuuauaa

SEQ ID NO: 778370 - RNA, 17 nt, Listeria monocytogenes EGD-e
uaguuaacgguuuucau

SEQ ID NO: 778371 - RNA, 15 nt, Listeria monocytogenes EGD-e
uagugcaucuucuaa

SEQ ID NO: 778372 - RNA, 19 nt, Listeria monocytogenes EGD-e
uagugcaucuucuaagaaa

SEQ ID NO: 778373 - RNA, 22 nt, Listeria monocytogenes EGD-e
uagugcaucuucuaagaaaaaa

SEQ ID NO: 778374 - RNA, 13 nt, Listeria monocytogenes EGD-e
uagugucaguccu

SEQ ID NO: 778375 - RNA, 20 nt, Listeria monocytogenes EGD-e
uauaaagaacuagauuuaau

SEQ ID NO: 778376 - RNA, 21 nt, Listeria monocytogenes EGD-e
uauaaagaacuagauuuaaua

SEQ ID NO: 778377 - RNA, 13 nt, Listeria monocytogenes EGD-e
uauaaaaauacau

SEQ ID NO: 778378 - RNA, 11 nt, Listeria monocytogenes EGD-e
uaguuuuaaau

SEQ ID NO: 778379 - RNA, 17 nt, Listeria monocytogenes EGD-e
uaguuucgauaucuuca

SEQ ID NO: 778380 - RNA, 20 nt, Listeria monocytogenes EGD-e
uauacuuggaauaaacagcc

SEQ ID NO: 778381 - RNA, 18 nt, Listeria monocytogenes EGD-e
uauacuuuuaauuaaaag

SEQ ID NO: 778382 - RNA, 22 nt, Listeria monocytogenes EGD-e
uauacuuuuaauuaaaaguugu

SEQ ID NO: 778383 - RNA, 13 nt, Listeria monocytogenes EGD-e
uauacgcaaugcu

SEQ ID NO: 778384 - RNA, 16 nt, Listeria monocytogenes EGD-e
uauacaggaacuacau

SEQ ID NO: 778385 - RNA, 12 nt, Listeria monocytogenes EGD-e
uauaacucucau

SEQ ID NO: 778386 - RNA, 20 nt, Listeria monocytogenes EGD-e
uauaacucucauaagagaau

SEQ ID NO: 778387 - RNA, 23 nt, Listeria monocytogenes EGD-e
uaucaaugauaucaucaauaaua

SEQ ID NO: 778388 - RNA, 20 nt, Listeria monocytogenes EGD-e
uauauuccggaaugcgcgca

SEQ ID NO: 778389 - RNA, 18 nt, Listeria monocytogenes EGD-e
uauauucauuauuaaacu

SEQ ID NO: 778390 - RNA, 14 nt, Listeria monocytogenes EGD-e
uauccaccaaaaac

SEQ ID NO: 778391 - RNA, 21 nt, Listeria monocytogenes EGD-e
uaucauucauaauggaaaaau

SEQ ID NO: 778392 - RNA, 15 nt, Listeria monocytogenes EGD-e
uagccagacaucuuu

SEQ ID NO: 778393 - RNA, 21 nt, Listeria monocytogenes EGD-e
uagccagacaucuuugccauc

SEQ ID NO: 778394 - RNA, 12 nt, Listeria monocytogenes EGD-e
uagcuucaauca

SEQ ID NO: 778395 - RNA, 17 nt, Listeria monocytogenes EGD-e
uagcuucaaucaagccu

SEQ ID NO: 778396 - RNA, 14 nt, Listeria monocytogenes EGD-e
uagcucauuacaaa

SEQ ID NO: 778397 - RNA, 20 nt, Listeria monocytogenes EGD-e
uagcuauuuuuuugcuuuuu

SEQ ID NO: 778398 - RNA, 23 nt, Listeria monocytogenes EGD-e
uagcuauuuuuuugcuuuuuaag

SEQ ID NO: 778399 - RNA, 16 nt, Listeria monocytogenes EGD-e
uagcuacaauuaaaau

SEQ ID NO: 778400 - RNA, 15 nt, Listeria monocytogenes EGD-e
uaggauuaaaauaaa

SEQ ID NO: 778401 - RNA, 16 nt, Listeria monocytogenes EGD-e
uaggaauuucgaaauu

SEQ ID NO: 778402 - RNA, 17 nt, Listeria monocytogenes EGD-e
uaggaauuucgaaauua

SEQ ID NO: 778403 - RNA, 19 nt, Listeria monocytogenes EGD-e
uagcaacuucacuaacaaa

SEQ ID NO: 778404 - RNA, 22 nt, Listeria monocytogenes EGD-e
uagcaacuucacuaacaaaaua

SEQ ID NO: 778405 - RNA, 17 nt, Listeria monocytogenes EGD-e
uagauuugcaaguagau

SEQ ID NO: 778406 - RNA, 13 nt, Listeria monocytogenes EGD-e
uagauuuuaauuu

SEQ ID NO: 778407 - RNA, 17 nt, Listeria monocytogenes EGD-e
uagauuuuaauuucuuu

SEQ ID NO: 778408 - RNA, 19 nt, Listeria monocytogenes EGD-e
uagauuuuaauuucuuuug

SEQ ID NO: 778409 - RNA, 12 nt, Listeria monocytogenes EGD-e
uagcacuccuug

SEQ ID NO: 778410 - RNA, 20 nt, Listeria monocytogenes EGD-e
uagcauucacacgaacccca

SEQ ID NO: 778411 - RNA, 17 nt, Listeria monocytogenes EGD-e
uagagcgaauaagugaa

SEQ ID NO: 778412 - RNA, 13 nt, Listeria monocytogenes EGD-e
uagauauucucuu

SEQ ID NO: 778413 - RNA, 23 nt, Listeria monocytogenes EGD-e
uagauggagauucauaaacaaaa

SEQ ID NO: 778414 - RNA, 19 nt, Listeria monocytogenes EGD-e
uaccuaaugaauaagcaau

SEQ ID NO: 778415 - RNA, 15 nt, Listeria monocytogenes EGD-e
uaccuugaucaaaau

SEQ ID NO: 778416 - RNA, 21 nt, Listeria monocytogenes EGD-e
uaccuuauuuuauacgcaaug

SEQ ID NO: 778417 - RNA, 14 nt, Listeria monocytogenes EGD-e
uaccuguuucugcc

SEQ ID NO: 778418 - RNA, 15 nt, Listeria monocytogenes EGD-e
uaccugcaagcgaau

SEQ ID NO: 778419 - RNA, 16 nt, Listeria monocytogenes EGD-e
uaccugcaagcgaauu

SEQ ID NO: 778420 - RNA, 20 nt, Listeria monocytogenes EGD-e
uacgacaauaccauguuuau

SEQ ID NO: 778421 - RNA, 19 nt, Listeria monocytogenes EGD-e
uacgggugagcuucuuuuu

SEQ ID NO: 778422 - RNA, 17 nt, Listeria monocytogenes EGD-e
uacgguuaauuuccauu

SEQ ID NO: 778423 - RNA, 23 nt, Listeria monocytogenes EGD-e
uacuauacaagcguaugguucaa

SEQ ID NO: 778424 - RNA, 16 nt, Listeria monocytogenes EGD-e
uacguuguucuaacau

SEQ ID NO: 778425 - RNA, 21 nt, Listeria monocytogenes EGD-e
uacuauugaauguucuaaaau

SEQ ID NO: 778426 - RNA, 21 nt, Listeria monocytogenes EGD-e
uagaagcaauuagucccauua

SEQ ID NO: 778427 - RNA, 14 nt, Listeria monocytogenes EGD-e
uagacaaaaagaaa

SEQ ID NO: 778428 - RNA, 15 nt, Listeria monocytogenes EGD-e
uagaaaaauguuugc

SEQ ID NO: 778429 - RNA, 18 nt, Listeria monocytogenes EGD-e
uacuuuuuugcuuuugau

SEQ ID NO: 778430 - RNA, 13 nt, Listeria monocytogenes EGD-e
uacuuuuuaucug

SEQ ID NO: 778431 - RNA, 12 nt, Listeria monocytogenes EGD-e
uagaaaaucauu

SEQ ID NO: 778432 - RNA, 22 nt, Listeria monocytogenes EGD-e
uagaaaguuaguugcuuuuguu

SEQ ID NO: 778433 - RNA, 15 nt, Listeria monocytogenes EGD-e
uagaaagccuuuauu

SEQ ID NO: 778434 - RNA, 15 nt, Listeria monocytogenes EGD-e
uagaaauauguuuaa

SEQ ID NO: 778435 - RNA, 14 nt, Listeria monocytogenes EGD-e
uacugguucuucuu

SEQ ID NO: 778436 - RNA, 21 nt, Listeria monocytogenes EGD-e
uacugguucuucuuuuugauu

SEQ ID NO: 778437 - RNA, 16 nt, Listeria monocytogenes EGD-e
uacuguauauguuuua

SEQ ID NO: 778438 - RNA, 23 nt, Listeria monocytogenes EGD-e
uacuuuaccuugaucaaaauuca

SEQ ID NO: 778439 - RNA, 14 nt, Listeria monocytogenes EGD-e
uacuuuaauuucca

SEQ ID NO: 778440 - RNA, 15 nt, Listeria monocytogenes EGD-e
uacuuuaauuuccac

SEQ ID NO: 778441 - RNA, 16 nt, Listeria monocytogenes EGD-e
uacuuuaauuucuggg

SEQ ID NO: 778442 - RNA, 18 nt, Listeria monocytogenes EGD-e
uacuugugaaaguuuuau

SEQ ID NO: 778443 - RNA, 16 nt, Listeria monocytogenes EGD-e
uacuucggggcaaaaa

SEQ ID NO: 778444 - RNA, 17 nt, Listeria monocytogenes EGD-e
uacuucaugugcuuuuu

SEQ ID NO: 778445 - RNA, 14 nt, Listeria monocytogenes EGD-e
uacuuggaauaaac

SEQ ID NO: 778446 - RNA, 18 nt, Listeria monocytogenes EGD-e
uacuugcuuuuuuuaaac

SEQ ID NO: 778447 - RNA, 21 nt, Listeria monocytogenes EGD-e
uaaucucgugcuaauucuguu

SEQ ID NO: 778448 - RNA, 16 nt, Listeria monocytogenes EGD-e
uaaucugauuaaaagu

SEQ ID NO: 778449 - RNA, 15 nt, Listeria monocytogenes EGD-e
uaaucuacuguauau

SEQ ID NO: 778450 - RNA, 16 nt, Listeria monocytogenes EGD-e
uaaugaauaagcaauu

SEQ ID NO: 778451 - RNA, 20 nt, Listeria monocytogenes EGD-e
uaaugaauaagcaauuggaa

SEQ ID NO: 778452 - RNA, 15 nt, Listeria monocytogenes EGD-e
uaaucuguaaaaaua

SEQ ID NO: 778453 - RNA, 23 nt, Listeria monocytogenes EGD-e
uaauuucuggguguuuauucaua

SEQ ID NO: 778454 - RNA, 10 nt, Listeria monocytogenes EGD-e
uaauuuaauu

SEQ ID NO: 778455 - RNA, 11 nt, Listeria monocytogenes EGD-e
uaauuuaauug

SEQ ID NO: 778456 - RNA, 15 nt, Listeria monocytogenes EGD-e
uaauuuacuacuaau

SEQ ID NO: 778457 - RNA, 19 nt, Listeria monocytogenes EGD-e
uaauuuaggggcauaucuu

SEQ ID NO: 778458 - RNA, 20 nt, Listeria monocytogenes EGD-e
uaauuuauaaaagcuucuau

SEQ ID NO: 778459 - RNA, 13 nt, Listeria monocytogenes EGD-e
uaauuguauaagu

SEQ ID NO: 778460 - RNA, 21 nt, Listeria monocytogenes EGD-e
uaauugucgaaaaccuaaaua

SEQ ID NO: 778461 - RNA, 22 nt, Listeria monocytogenes EGD-e
uaauuggaauagagcuuuuaaa

SEQ ID NO: 778462 - RNA, 12 nt, Listeria monocytogenes EGD-e
uaauucuuuuuc

SEQ ID NO: 778463 - RNA, 21 nt, Listeria monocytogenes EGD-e
uaauucugcuaacagcugagc

SEQ ID NO: 778464 - RNA, 23 nt, Listeria monocytogenes EGD-e
uaauucugcgauuuuuucuucca

SEQ ID NO: 778465 - RNA, 13 nt, Listeria monocytogenes EGD-e
uaauucuaaauaa

SEQ ID NO: 778466 - RNA, 14 nt, Listeria monocytogenes EGD-e
uaauucggcaaaca

SEQ ID NO: 778467 - RNA, 20 nt, Listeria monocytogenes EGD-e
uaauuagcauaauauccaua

SEQ ID NO: 778468 - RNA, 20 nt, Listeria monocytogenes EGD-e
uaauuaacaaccauuuuguu

SEQ ID NO: 778469 - RNA, 14 nt, Listeria monocytogenes EGD-e
uacauuuuugcuug

SEQ ID NO: 778470 - RNA, 16 nt, Listeria monocytogenes EGD-e
uacauuaaguuuacaa

SEQ ID NO: 778471 - RNA, 13 nt, Listeria monocytogenes EGD-e
uacauaaaagcau

SEQ ID NO: 778472 - RNA, 14 nt, Listeria monocytogenes EGD-e
uacacauuauacga

SEQ ID NO: 778473 - RNA, 14 nt, Listeria monocytogenes EGD-e
uaauuuuacuucua

SEQ ID NO: 778474 - RNA, 15 nt, Listeria monocytogenes EGD-e
uaauuuuacuucuac

SEQ ID NO: 778475 - RNA, 13 nt, Listeria monocytogenes EGD-e
uacagaagcauuu

SEQ ID NO: 778476 - RNA, 19 nt, Listeria monocytogenes EGD-e
uacaccgaacuagcaucag

SEQ ID NO: 778477 - RNA, 13 nt, Listeria monocytogenes EGD-e
uacacccauaaua

SEQ ID NO: 778478 - RNA, 22 nt, Listeria monocytogenes EGD-e
uacaccauuuuguucuaagaau

SEQ ID NO: 778479 - RNA, 24 nt, Listeria monocytogenes EGD-e
uacacuaguauuccuaucacaaac

SEQ ID NO: 778480 - RNA, 21 nt, Listeria monocytogenes EGD-e
gugccccgcugauauccauug

SEQ ID NO: 778481 - RNA, 19 nt, Listeria monocytogenes EGD-e
aaauauagucuacuuuuaa

SEQ ID NO: 778482 - RNA, 15 nt, Listeria monocytogenes EGD-e
gugcaucuucuaaga

SEQ ID NO: 778483 - RNA, 17 nt, Listeria monocytogenes EGD-e
gugcaccugcauuucau

SEQ ID NO: 778484 - RNA, 18 nt, Listeria monocytogenes EGD-e
gugaugaaaccaaauaug

SEQ ID NO: 778485 - RNA, 13 nt, Listeria monocytogenes EGD-e
gugcucuuugcuu

SEQ ID NO: 778486 - RNA, 19 nt, Listeria monocytogenes EGD-e
gugcucuuugcuucaaucc

SEQ ID NO: 778487 - RNA, 20 nt, Listeria monocytogenes EGD-e
gugcuuuccccaccaggcaa

SEQ ID NO: 778488 - RNA, 22 nt, Listeria monocytogenes EGD-e
gugcuuuccccaccaggcaaaa

SEQ ID NO: 778489 - RNA, 15 nt, Listeria monocytogenes EGD-e
gugcugcuuuccuug

SEQ ID NO: 778490 - RNA, 18 nt, Listeria monocytogenes EGD-e
gugguaagccauuucucg

SEQ ID NO: 778491 - RNA, 18 nt, Listeria monocytogenes EGD-e
gugucccuugauaugcag

SEQ ID NO: 778492 - RNA, 18 nt, Listeria monocytogenes EGD-e
guguaguuucgauaucuu

SEQ ID NO: 778493 - RNA, 13 nt, Listeria monocytogenes EGD-e
guuaauaaaauca

SEQ ID NO: 778494 - RNA, 16 nt, Listeria monocytogenes EGD-e
guuaauagaagccaau

SEQ ID NO: 778495 - RNA, 16 nt, Listeria monocytogenes EGD-e
guuaaaggagaaaaag

SEQ ID NO: 778496 - RNA, 21 nt, Listeria monocytogenes EGD-e
guuauaaagaaauaacuacua

SEQ ID NO: 778497 - RNA, 17 nt, Listeria monocytogenes EGD-e
guucauuugaaaaaggg

SEQ ID NO: 778498 - RNA, 18 nt, Listeria monocytogenes EGD-e
guucauuugaaaaagggc

SEQ ID NO: 778499 - RNA, 20 nt, Listeria monocytogenes EGD-e
guuccaaaaauagcuuuccc

SEQ ID NO: 778500 - RNA, 18 nt, Listeria monocytogenes EGD-e
guucauucgguaagacca

SEQ ID NO: 778501 - RNA, 12 nt, Listeria monocytogenes EGD-e
guucaaaaagau

SEQ ID NO: 778502 - RNA, 14 nt, Listeria monocytogenes EGD-e
guucaagugauaca

SEQ ID NO: 778503 - RNA, 19 nt, Listeria monocytogenes EGD-e
guucuuuacauauuccaaa

SEQ ID NO: 778504 - RNA, 17 nt, Listeria monocytogenes EGD-e
guugaaaaguaguguau

SEQ ID NO: 778505 - RNA, 19 nt, Listeria monocytogenes EGD-e
guugaaaggaaauaauucc

SEQ ID NO: 778506 - RNA, 22 nt, Listeria monocytogenes EGD-e
guugaacgguuaacguuuuccc

SEQ ID NO: 778507 - RNA, 23 nt, Listeria monocytogenes EGD-e
guugcauagugagaguuccaucu

SEQ ID NO: 778508 - RNA, 18 nt, Listeria monocytogenes EGD-e
guuguuuucccagaaaaa

SEQ ID NO: 778509 - RNA, 15 nt, Listeria monocytogenes EGD-e
guuguucuugccaaa

SEQ ID NO: 778510 - RNA, 18 nt, Listeria monocytogenes EGD-e
guuguuccauuuugucaa

SEQ ID NO: 778511 - RNA, 19 nt, Listeria monocytogenes EGD-e
guugggcugcaacaacuaa

SEQ ID NO: 778512 - RNA, 20 nt, Listeria monocytogenes EGD-e
guuguaaaugcgacauacuu

SEQ ID NO: 778513 - RNA, 14 nt, Listeria monocytogenes EGD-e
uaaaccucuuuuuu

SEQ ID NO: 778514 - RNA, 13 nt, Listeria monocytogenes EGD-e
uaaaauucuauua

SEQ ID NO: 778515 - RNA, 15 nt, Listeria monocytogenes EGD-e
uaaaauucuauuaau

SEQ ID NO: 778516 - RNA, 16 nt, Listeria monocytogenes EGD-e
uaaaauucuauuaaua

SEQ ID NO: 778517 - RNA, 18 nt, Listeria monocytogenes EGD-e
uaaaauucuauuaauaau

SEQ ID NO: 778518 - RNA, 12 nt, Listeria monocytogenes EGD-e
uaaagcacuggc

SEQ ID NO: 778519 - RNA, 14 nt, Listeria monocytogenes EGD-e
uaaagcgguauccc

SEQ ID NO: 778520 - RNA, 13 nt, Listeria monocytogenes EGD-e
uaaaggauaaaaa

SEQ ID NO: 778521 - RNA, 15 nt, Listeria monocytogenes EGD-e
uaaaggauaaaaauu

SEQ ID NO: 778522 - RNA, 12 nt, Listeria monocytogenes EGD-e
uaaaggagaaaa

SEQ ID NO: 778523 - RNA, 13 nt, Listeria monocytogenes EGD-e
uaaaggagaaaaa

SEQ ID NO: 778524 - RNA, 19 nt, Listeria monocytogenes EGD-e
uaaaggcaacaaagaagaa

SEQ ID NO: 778525 - RNA, 22 nt, Listeria monocytogenes EGD-e
uaaauacucgucauagauacuc

SEQ ID NO: 778526 - RNA, 14 nt, Listeria monocytogenes EGD-e
uaaauacgaaaaac

SEQ ID NO: 778527 - RNA, 20 nt, Listeria monocytogenes EGD-e
uaaauacgaaaaacauuauu

SEQ ID NO: 778528 - RNA, 18 nt, Listeria monocytogenes EGD-e
uaaauagcacagcuacca

SEQ ID NO: 778529 - RNA, 23 nt, Listeria monocytogenes EGD-e
uaaauagccaagauuaaaaauag

SEQ ID NO: 778530 - RNA, 19 nt, Listeria monocytogenes EGD-e
uaaauaguaguuauuucuu

SEQ ID NO: 778531 - RNA, 13 nt, Listeria monocytogenes EGD-e
uaaauaaacaaau

SEQ ID NO: 778532 - RNA, 13 nt, Listeria monocytogenes EGD-e
uaacaacaagcaa

SEQ ID NO: 778533 - RNA, 19 nt, Listeria monocytogenes EGD-e
uaacaacaagcaaaacauu

SEQ ID NO: 778534 - RNA, 22 nt, Listeria monocytogenes EGD-e
uaacaacaagcaaaacauuuuc

SEQ ID NO: 778535 - RNA, 19 nt, Listeria monocytogenes EGD-e
uaaauuugcccaccgauaa

SEQ ID NO: 778536 - RNA, 17 nt, Listeria monocytogenes EGD-e
uaaauugucuacugcuu

SEQ ID NO: 778537 - RNA, 13 nt, Listeria monocytogenes EGD-e
uaaauuauacauu

SEQ ID NO: 778538 - RNA, 13 nt, Listeria monocytogenes EGD-e
uaaauuaucaucc

SEQ ID NO: 778539 - RNA, 14 nt, Listeria monocytogenes EGD-e
uaaauugauaccaa

SEQ ID NO: 778540 - RNA, 16 nt, Listeria monocytogenes EGD-e
uaaauugauaccaaau

SEQ ID NO: 778541 - RNA, 21 nt, Listeria monocytogenes EGD-e
uaaauuacugaauaaguaaua

SEQ ID NO: 778542 - RNA, 22 nt, Listeria monocytogenes EGD-e
uaaaugauuuuuaucuaaaucu

SEQ ID NO: 778543 - RNA, 14 nt, Listeria monocytogenes EGD-e
uaaaugaccaaugc

SEQ ID NO: 778544 - RNA, 16 nt, Listeria monocytogenes EGD-e
uaacauauaaucuacu

SEQ ID NO: 778545 - RNA, 13 nt, Listeria monocytogenes EGD-e
uaacauaaauuga

SEQ ID NO: 778546 - RNA, 15 nt, Listeria monocytogenes EGD-e
uaacauaaauugauu

SEQ ID NO: 778547 - RNA, 21 nt, Listeria monocytogenes EGD-e
uaacauaaaaagcugccacca

SEQ ID NO: 778548 - RNA, 20 nt, Listeria monocytogenes EGD-e
uaacauagcuacaauuaaaa

SEQ ID NO: 778549 - RNA, 21 nt, Listeria monocytogenes EGD-e
uaacauagcuacaauuaaaau

SEQ ID NO: 778550 - RNA, 16 nt, Listeria monocytogenes EGD-e
uaacauuaauucauuu

SEQ ID NO: 778551 - RNA, 18 nt, Listeria monocytogenes EGD-e
uaacauuaaaccucuuuu

SEQ ID NO: 778552 - RNA, 15 nt, Listeria monocytogenes EGD-e
uaacgaauuuuucaa

SEQ ID NO: 778553 - RNA, 23 nt, Listeria monocytogenes EGD-e
uaaccucgcaaaaaauaauaucu

SEQ ID NO: 778554 - RNA, 20 nt, Listeria monocytogenes EGD-e
uaaccgcuaucuacaugaau

SEQ ID NO: 778555 - RNA, 13 nt, Listeria monocytogenes EGD-e
uaaccccaaaaug

SEQ ID NO: 778556 - RNA, 17 nt, Listeria monocytogenes EGD-e
uaaccaaauuucuguua

SEQ ID NO: 778557 - RNA, 20 nt, Listeria monocytogenes EGD-e
uaaaaagcuuauuaaacaua

SEQ ID NO: 778558 - RNA, 23 nt, Listeria monocytogenes EGD-e
uaaaaagguauccuuauuaauag

SEQ ID NO: 778559 - RNA, 14 nt, Listeria monocytogenes EGD-e
uaaaaauaaauagg

SEQ ID NO: 778560 - RNA, 13 nt, Listeria monocytogenes EGD-e
uaaaaauacauuu

SEQ ID NO: 778561 - RNA, 18 nt, Listeria monocytogenes EGD-e
uaaaaacaguacuucuau

SEQ ID NO: 778562 - RNA, 15 nt, Listeria monocytogenes EGD-e
uaaaaaauauugaau

SEQ ID NO: 778563 - RNA, 16 nt, Listeria monocytogenes EGD-e
uaaaaaauauugaaua

SEQ ID NO: 778564 - RNA, 21 nt, Listeria monocytogenes EGD-e
uaaaaaauauugaauagaacu

SEQ ID NO: 778565 - RNA, 16 nt, Listeria monocytogenes EGD-e
uaaaaacaauaacauu

SEQ ID NO: 778566 - RNA, 12 nt, Listeria monocytogenes EGD-e
uaaaaaaauacc

SEQ ID NO: 778567 - RNA, 18 nt, Listeria monocytogenes EGD-e
uaaaaaagcacucgucua

SEQ ID NO: 778568 - RNA, 14 nt, Listeria monocytogenes EGD-e
guuuuucugcaucc

SEQ ID NO: 778569 - RNA, 20 nt, Listeria monocytogenes EGD-e
guuuuuuuaugcauaaaaaa

SEQ ID NO: 778570 - RNA, 16 nt, Listeria monocytogenes EGD-e
guuuuuuuaugcuaaa

SEQ ID NO: 778571 - RNA, 16 nt, Listeria monocytogenes EGD-e
guuuucccagaaaaaa

SEQ ID NO: 778572 - RNA, 20 nt, Listeria monocytogenes EGD-e
guuuucccagaaaaaaacaa

SEQ ID NO: 778573 - RNA, 18 nt, Listeria monocytogenes EGD-e
guuuuguuuuuuuuaguc

SEQ ID NO: 778574 - RNA, 22 nt, Listeria monocytogenes EGD-e
aaaucaugccuucaaacacuuc

SEQ ID NO: 778575 - RNA, 16 nt, Listeria monocytogenes EGD-e
aaaucaguaccugcaa

SEQ ID NO: 778576 - RNA, 16 nt, Listeria monocytogenes EGD-e
guuuucauauaagugu

SEQ ID NO: 778577 - RNA, 23 nt, Listeria monocytogenes EGD-e
guuucaaagcaucagcuuuugcu

SEQ ID NO: 778578 - RNA, 17 nt, Listeria monocytogenes EGD-e
guuucuuuuauuuuucu

SEQ ID NO: 778579 - RNA, 22 nt, Listeria monocytogenes EGD-e
guuucuuuuauuuuucuuucuu

SEQ ID NO: 778580 - RNA, 12 nt, Listeria monocytogenes EGD-e
guuucuuuuguu

SEQ ID NO: 778581 - RNA, 13 nt, Listeria monocytogenes EGD-e
guuucuuuuguuc

SEQ ID NO: 778582 - RNA, 13 nt, Listeria monocytogenes EGD-e
guuucuuuuugau

SEQ ID NO: 778583 - RNA, 23 nt, Listeria monocytogenes EGD-e
guuucuuuaccauacacauaggu

SEQ ID NO: 778584 - RNA, 17 nt, Listeria monocytogenes EGD-e
guuuuaaagcuugauuu

SEQ ID NO: 778585 - RNA, 16 nt, Listeria monocytogenes EGD-e
guuuggucaacaucau

SEQ ID NO: 778586 - RNA, 16 nt, Listeria monocytogenes EGD-e
uaaaacuaaauuaauu

SEQ ID NO: 778587 - RNA, 18 nt, Listeria monocytogenes EGD-e
uaaaacgacagauaaaua

SEQ ID NO: 778588 - RNA, 13 nt, Listeria monocytogenes EGD-e
uaaaagaggauuu

SEQ ID NO: 778589 - RNA, 15 nt, Listeria monocytogenes EGD-e
uaaaaccauucaucu

SEQ ID NO: 778590 - RNA, 19 nt, Listeria monocytogenes EGD-e
uaaaaccauucaucuaauu

SEQ ID NO: 778591 - RNA, 15 nt, Listeria monocytogenes EGD-e
uaaaaaucaucacuu

SEQ ID NO: 778592 - RNA, 23 nt, Listeria monocytogenes EGD-e
uaaaaaucaucacuuaauucuug

SEQ ID NO: 778593 - RNA, 13 nt, Listeria monocytogenes EGD-e
uaaaaauuuuggu

SEQ ID NO: 778594 - RNA, 23 nt, Listeria monocytogenes EGD-e
uaaaaguuugggcauuacgaaag

SEQ ID NO: 778595 - RNA, 20 nt, Listeria monocytogenes EGD-e
uaaaaggacacccauaauag

SEQ ID NO: 778596 - RNA, 15 nt, Listeria monocytogenes EGD-e
uaaaauaaaucugcu

SEQ ID NO: 778597 - RNA, 16 nt, Listeria monocytogenes EGD-e
uaaaauggauaaaaaa

SEQ ID NO: 778598 - RNA, 19 nt, Listeria monocytogenes EGD-e
uaaaaucauaauaggagac

SEQ ID NO: 778599 - RNA, 22 nt, Listeria monocytogenes EGD-e
uaaaauaucaucaauuaaauua

SEQ ID NO: 778600 - RNA, 18 nt, Listeria monocytogenes EGD-e
uaaaauccaauaauauga

SEQ ID NO: 778601 - RNA, 18 nt, Listeria monocytogenes EGD-e
uaaaaucauuaaagcuau

SEQ ID NO: 778602 - RNA, 13 nt, Listeria monocytogenes EGD-e
uaaaaucauucca

SEQ ID NO: 778603 - RNA, 20 nt, Listeria monocytogenes EGD-e
guacuuaaaucacuucuuaa

SEQ ID NO: 778604 - RNA, 19 nt, Listeria monocytogenes EGD-e
guacuugaaaaauuucauc

SEQ ID NO: 778605 - RNA, 18 nt, Listeria monocytogenes EGD-e
guacguuuuuuauuuuuu

SEQ ID NO: 778606 - RNA, 21 nt, Listeria monocytogenes EGD-e
guaguaagggugaagcuuccu

SEQ ID NO: 778607 - RNA, 14 nt, Listeria monocytogenes EGD-e
guaggccuagcuaa

SEQ ID NO: 778608 - RNA, 16 nt, Listeria monocytogenes EGD-e
guagcuucaaucaagc

SEQ ID NO: 778609 - RNA, 23 nt, Listeria monocytogenes EGD-e
guagcguuuaaagcguuuuucug

SEQ ID NO: 778610 - RNA, 19 nt, Listeria monocytogenes EGD-e
guauacccuuuuuuuacau

SEQ ID NO: 778611 - RNA, 21 nt, Listeria monocytogenes EGD-e
guaugaacacccgguccuuca

SEQ ID NO: 778612 - RNA, 16 nt, Listeria monocytogenes EGD-e
guauccagccgcaaau

SEQ ID NO: 778613 - RNA, 22 nt, Listeria monocytogenes EGD-e
guauccagccgcaaauaguugu

SEQ ID NO: 778614 - RNA, 13 nt, Listeria monocytogenes EGD-e
guauguuuucccu

SEQ ID NO: 778615 - RNA, 17 nt, Listeria monocytogenes EGD-e
guauucaaauucaauuu

SEQ ID NO: 778616 - RNA, 19 nt, Listeria monocytogenes EGD-e
guauuguuuuuugauuuuu

SEQ ID NO: 778617 - RNA, 12 nt, Listeria monocytogenes EGD-e
guauuucagcaa

SEQ ID NO: 778618 - RNA, 19 nt, Listeria monocytogenes EGD-e
gucacaaacgcuuuuucaa

SEQ ID NO: 778619 - RNA, 15 nt, Listeria monocytogenes EGD-e
gucaggauuaaaagu

SEQ ID NO: 778620 - RNA, 13 nt, Listeria monocytogenes EGD-e
gucaguguuuuug

SEQ ID NO: 778621 - RNA, 22 nt, Listeria monocytogenes EGD-e
gucccauuacugucgcaaaaau

SEQ ID NO: 778622 - RNA, 16 nt, Listeria monocytogenes EGD-e
guccgucaagcccagc

SEQ ID NO: 778623 - RNA, 12 nt, Listeria monocytogenes EGD-e
gucuaagaaauc

SEQ ID NO: 778624 - RNA, 16 nt, Listeria monocytogenes EGD-e
gguucaaaaagauacu

SEQ ID NO: 778625 - RNA, 11 nt, Listeria monocytogenes EGD-e
gguuauuucuu

SEQ ID NO: 778626 - RNA, 18 nt, Listeria monocytogenes EGD-e
gguguuuauucauauaaa

SEQ ID NO: 778627 - RNA, 13 nt, Listeria monocytogenes EGD-e
guaaaaaggaaag

SEQ ID NO: 778628 - RNA, 13 nt, Listeria monocytogenes EGD-e
guaaaaaacuguu

SEQ ID NO: 778629 - RNA, 23 nt, Listeria monocytogenes EGD-e
gguuuacucccuuuuuccacacu

SEQ ID NO: 778630 - RNA, 14 nt, Listeria monocytogenes EGD-e
gguugauaauaauc

SEQ ID NO: 778631 - RNA, 23 nt, Listeria monocytogenes EGD-e
gguucuuuacauauuccaaaauc

SEQ ID NO: 778632 - RNA, 12 nt, Listeria monocytogenes EGD-e
ggugagcuucuu

SEQ ID NO: 778633 - RNA, 17 nt, Listeria monocytogenes EGD-e
ggugcugggaaaucagg

SEQ ID NO: 778634 - RNA, 19 nt, Listeria monocytogenes EGD-e
guaccgcuugauguuuuug

SEQ ID NO: 778635 - RNA, 23 nt, Listeria monocytogenes EGD-e
guaccugcaagcgaauuaauaaa

SEQ ID NO: 778636 - RNA, 15 nt, Listeria monocytogenes EGD-e
guaccaucuuuuauc

SEQ ID NO: 778637 - RNA, 16 nt, Listeria monocytogenes EGD-e
guacaguagaagcaau

SEQ ID NO: 778638 - RNA, 19 nt, Listeria monocytogenes EGD-e
guaaucuguaaaaauaaau

SEQ ID NO: 778639 - RNA, 16 nt, Listeria monocytogenes EGD-e
guaauucgaauaagaa

SEQ ID NO: 778640 - RNA, 19 nt, Listeria monocytogenes EGD-e
guaauauauucaaaauggu

SEQ ID NO: 778641 - RNA, 13 nt, Listeria monocytogenes EGD-e
guaauauaaauuu

SEQ ID NO: 778642 - RNA, 16 nt, Listeria monocytogenes EGD-e
guaauauaaauuugcc

SEQ ID NO: 778643 - RNA, 20 nt, Listeria monocytogenes EGD-e
guaagguuuuuuuaugcaua

SEQ ID NO: 778644 - RNA, 12 nt, Listeria monocytogenes EGD-e
guaacucuucca

SEQ ID NO: 778645 - RNA, 12 nt, Listeria monocytogenes EGD-e
guaagaagaaaa

SEQ ID NO: 778646 - RNA, 22 nt, Listeria monocytogenes EGD-e
guaaacauuucucccucauccu

SEQ ID NO: 778647 - RNA, 14 nt, Listeria monocytogenes EGD-e
guaaaaucuuuuaa

SEQ ID NO: 778648 - RNA, 19 nt, Listeria monocytogenes EGD-e
guaaaaucuuuuaauaacu

SEQ ID NO: 778649 - RNA, 12 nt, Listeria monocytogenes EGD-e
guaaaauacguu

SEQ ID NO: 778650 - RNA, 22 nt, Listeria monocytogenes EGD-e
guaaauacucgucauagauacu

SEQ ID NO: 778651 - RNA, 15 nt, Listeria monocytogenes EGD-e
gcaagcgaauuaaua

SEQ ID NO: 778652 - RNA, 22 nt, Listeria monocytogenes EGD-e
gcaaucaauuuacguuguucua

SEQ ID NO: 778653 - RNA, 13 nt, Listeria monocytogenes EGD-e
gcaaucauuuauu

SEQ ID NO: 778654 - RNA, 18 nt, Listeria monocytogenes EGD-e
gcaauccauguuguuuua

SEQ ID NO: 778655 - RNA, 15 nt, Listeria monocytogenes EGD-e
gcaauuuuaaaucuu

SEQ ID NO: 778656 - RNA, 19 nt, Listeria monocytogenes EGD-e
gcaauuucggaagauccgc

SEQ ID NO: 778657 - RNA, 21 nt, Listeria monocytogenes EGD-e
gcacagcuaccacaagaaggg

SEQ ID NO: 778658 - RNA, 19 nt, Listeria monocytogenes EGD-e
gcacaugauaaccagaaac

SEQ ID NO: 778659 - RNA, 17 nt, Listeria monocytogenes EGD-e
gcacaaauuauuagaau

SEQ ID NO: 778660 - RNA, 21 nt, Listeria monocytogenes EGD-e
gcacgucaaauggcgcaggaa

SEQ ID NO: 778661 - RNA, 15 nt, Listeria monocytogenes EGD-e
gcagaaaacagaaag

SEQ ID NO: 778662 - RNA, 20 nt, Listeria monocytogenes EGD-e
gcacuuuuauugcacuauuu

SEQ ID NO: 778663 - RNA, 15 nt, Listeria monocytogenes EGD-e
gcacuggcaaauaac

SEQ ID NO: 778664 - RNA, 19 nt, Listeria monocytogenes EGD-e
gcagaaugagcuccuucaa

SEQ ID NO: 778665 - RNA, 19 nt, Listeria monocytogenes EGD-e
gcagauuuugcgaaagcug

SEQ ID NO: 778666 - RNA, 23 nt, Listeria monocytogenes EGD-e
gcaggcacgucaaauggcgcagg

SEQ ID NO: 778667 - RNA, 19 nt, Listeria monocytogenes EGD-e
gcagguucaccaaaugcuu

SEQ ID NO: 778668 - RNA, 13 nt, Listeria monocytogenes EGD-e
gcaugaauuuuug

SEQ ID NO: 778669 - RNA, 20 nt, Listeria monocytogenes EGD-e
gcaucuuuuucuugcuuucc

SEQ ID NO: 778670 - RNA, 21 nt, Listeria monocytogenes EGD-e
gcauuaaaaaggaauuuuucc

SEQ ID NO: 778671 - RNA, 17 nt, Listeria monocytogenes EGD-e
gcauucugugauggaag

SEQ ID NO: 778672 - RNA, 13 nt, Listeria monocytogenes EGD-e
gcaguaguuuacu

SEQ ID NO: 778673 - RNA, 16 nt, Listeria monocytogenes EGD-e
gcauacgaguucuacu

SEQ ID NO: 778674 - RNA, 16 nt, Listeria monocytogenes EGD-e
gcauaucaucaauaaa

SEQ ID NO: 778675 - RNA, 22 nt, Listeria monocytogenes EGD-e
gccaacugaagcgaugauuuuc

SEQ ID NO: 778676 - RNA, 16 nt, Listeria monocytogenes EGD-e
gccaagauuaaaaaua

SEQ ID NO: 778677 - RNA, 23 nt, Listeria monocytogenes EGD-e
gccaaccggaucaucacucccug

SEQ ID NO: 778678 - RNA, 12 nt, Listeria monocytogenes EGD-e
gccacuaacaua

SEQ ID NO: 778679 - RNA, 17 nt, Listeria monocytogenes EGD-e
gccaugaauauuagaaa

SEQ ID NO: 778680 - RNA, 22 nt, Listeria monocytogenes EGD-e
gccauuugccaucgcagcagaa

SEQ ID NO: 778681 - RNA, 13 nt, Listeria monocytogenes EGD-e
gccauucccgucc

SEQ ID NO: 778682 - RNA, 19 nt, Listeria monocytogenes EGD-e
aaagcguuuuuuauuuuuc

SEQ ID NO: 778683 - RNA, 17 nt, Listeria monocytogenes EGD-e
gccgccuauuauuucug

SEQ ID NO: 778684 - RNA, 15 nt, Listeria monocytogenes EGD-e
gccggaccugaaaga

SEQ ID NO: 778685 - RNA, 21 nt, Listeria monocytogenes EGD-e
gcgaaaaaugaaaagaaaaac

SEQ ID NO: 778686 - RNA, 18 nt, Listeria monocytogenes EGD-e
gcgcuuccaguggcugaa

SEQ ID NO: 778687 - RNA, 18 nt, Listeria monocytogenes EGD-e
gcgcuuucacaucuucaa

SEQ ID NO: 778688 - RNA, 21 nt, Listeria monocytogenes EGD-e
gcgguuucuuuuauuuuucuu

SEQ ID NO: 778689 - RNA, 16 nt, Listeria monocytogenes EGD-e
gcuaagcauuauaaaa

SEQ ID NO: 778690 - RNA, 14 nt, Listeria monocytogenes EGD-e
gcuaaauauuuaau

SEQ ID NO: 778691 - RNA, 14 nt, Listeria monocytogenes EGD-e
gcuaaaacuaaaac

SEQ ID NO: 778692 - RNA, 15 nt, Listeria monocytogenes EGD-e
gcuaaaggcaacaaa

SEQ ID NO: 778693 - RNA, 16 nt, Listeria monocytogenes EGD-e
gcuacaauuaaaauag

SEQ ID NO: 778694 - RNA, 21 nt, Listeria monocytogenes EGD-e
gcguuuaaagcguuuuucugc

SEQ ID NO: 778695 - RNA, 19 nt, Listeria monocytogenes EGD-e
gcguuccacccauguuuuc

SEQ ID NO: 778696 - RNA, 19 nt, Listeria monocytogenes EGD-e
gcuacuucggggcaaaaag

SEQ ID NO: 778697 - RNA, 20 nt, Listeria monocytogenes EGD-e
gcuacuucggggcaaaaagg

SEQ ID NO: 778698 - RNA, 19 nt, Listeria monocytogenes EGD-e
gcuagacuguaugaaacuu

SEQ ID NO: 778699 - RNA, 17 nt, Listeria monocytogenes EGD-e
gcuagcgaagucaauuu

SEQ ID NO: 778700 - RNA, 22 nt, Listeria monocytogenes EGD-e
gcucguucuuaguuaauucuuu

SEQ ID NO: 778701 - RNA, 17 nt, Listeria monocytogenes EGD-e
gcucuuccuuuuguuuu

SEQ ID NO: 778702 - RNA, 19 nt, Listeria monocytogenes EGD-e
gcugaugacuaacuaguug

SEQ ID NO: 778703 - RNA, 13 nt, Listeria monocytogenes EGD-e
gcuguaaaugaau

SEQ ID NO: 778704 - RNA, 19 nt, Listeria monocytogenes EGD-e
gcuguaacaaaaucuuuuu

SEQ ID NO: 778705 - RNA, 23 nt, Listeria monocytogenes EGD-e
gcuguaacaaaaucuuuuuguuu

SEQ ID NO: 778706 - RNA, 14 nt, Listeria monocytogenes EGD-e
gcuggugcuuuuuu

SEQ ID NO: 778707 - RNA, 14 nt, Listeria monocytogenes EGD-e
gcugucuuggaaga

SEQ ID NO: 778708 - RNA, 20 nt, Listeria monocytogenes EGD-e
aaagcuguuuucaacaaaac

SEQ ID NO: 778709 - RNA, 21 nt, Listeria monocytogenes EGD-e
aaagcuguuuucaacaaaaca

SEQ ID NO: 778710 - RNA, 16 nt, Listeria monocytogenes EGD-e
gcuggauaaagaccua

SEQ ID NO: 778711 - RNA, 20 nt, Listeria monocytogenes EGD-e
gcuuuuuaagucgaaagaau

SEQ ID NO: 778712 - RNA, 19 nt, Listeria monocytogenes EGD-e
gcuuuugaaaccauuccgu

SEQ ID NO: 778713 - RNA, 17 nt, Listeria monocytogenes EGD-e
gcuuuuguuuuccuuug

SEQ ID NO: 778714 - RNA, 21 nt, Listeria monocytogenes EGD-e
gcuuugucuuaaaugacaaag

SEQ ID NO: 778715 - RNA, 14 nt, Listeria monocytogenes EGD-e
gcuuuguuuagccu

SEQ ID NO: 778716 - RNA, 15 nt, Listeria monocytogenes EGD-e
gcuuuuaacuuucuu

SEQ ID NO: 778717 - RNA, 14 nt, Listeria monocytogenes EGD-e
gcuuuuaaauauac

SEQ ID NO: 778718 - RNA, 12 nt, Listeria monocytogenes EGD-e
gcuuucuuuuuu

SEQ ID NO: 778719 - RNA, 16 nt, Listeria monocytogenes EGD-e
ggaagaaccuucaagc

SEQ ID NO: 778720 - RNA, 20 nt, Listeria monocytogenes EGD-e
ggacauacuucaugugcuuu

SEQ ID NO: 778721 - RNA, 17 nt, Listeria monocytogenes EGD-e
aaaguaaaaucuuuuaa

SEQ ID NO: 778722 - RNA, 12 nt, Listeria monocytogenes EGD-e
ggagacauuaaa

SEQ ID NO: 778723 - RNA, 20 nt, Listeria monocytogenes EGD-e
ggauagcuucgcaaaaaguc

SEQ ID NO: 778724 - RNA, 22 nt, Listeria monocytogenes EGD-e
ggcaaauaacguugcauuaaaa

SEQ ID NO: 778725 - RNA, 13 nt, Listeria monocytogenes EGD-e
ggcaacaaagaag

SEQ ID NO: 778726 - RNA, 14 nt, Listeria monocytogenes EGD-e
ggcaacaaagaaga

SEQ ID NO: 778727 - RNA, 17 nt, Listeria monocytogenes EGD-e
ggcaacaaagaagaaaa

SEQ ID NO: 778728 - RNA, 19 nt, Listeria monocytogenes EGD-e
ggcaacaaagaagaaaaag

SEQ ID NO: 778729 - RNA, 21 nt, Listeria monocytogenes EGD-e
aaaguggaccccgaucaauag

SEQ ID NO: 778730 - RNA, 20 nt, Listeria monocytogenes EGD-e
aaagugcguaagauuuuugc

SEQ ID NO: 778731 - RNA, 15 nt, Listeria monocytogenes EGD-e
aaaguguauuuacaa

SEQ ID NO: 778732 - RNA, 15 nt, Listeria monocytogenes EGD-e
aaaguuagauuaaaa

SEQ ID NO: 778733 - RNA, 17 nt, Listeria monocytogenes EGD-e
aaaguuuuaugacaauu

SEQ ID NO: 778734 - RNA, 21 nt, Listeria monocytogenes EGD-e
aaaguuuuaugacaauuaaaa

SEQ ID NO: 778735 - RNA, 18 nt, Listeria monocytogenes EGD-e
aaaguuucuuuuugauua

SEQ ID NO: 778736 - RNA, 17 nt, Listeria monocytogenes EGD-e
ggccgugauaaauaaca

SEQ ID NO: 778737 - RNA, 21 nt, Listeria monocytogenes EGD-e
aaauaaauaggcccauuaaaa

SEQ ID NO: 778738 - RNA, 12 nt, Listeria monocytogenes EGD-e
aaauaaacaaau

SEQ ID NO: 778739 - RNA, 16 nt, Listeria monocytogenes EGD-e
aaauaccgaaugcaau

SEQ ID NO: 778740 - RNA, 21 nt, Listeria monocytogenes EGD-e
ggcuagcgcauacgaguucua

SEQ ID NO: 778741 - RNA, 21 nt, Listeria monocytogenes EGD-e
ggcuagcaacaaucgcaucca

SEQ ID NO: 778742 - RNA, 17 nt, Listeria monocytogenes EGD-e
ggcuaauaacauuaaac

SEQ ID NO: 778743 - RNA, 22 nt, Listeria monocytogenes EGD-e
ggcuaauaacauuaaaccucuu

SEQ ID NO: 778744 - RNA, 15 nt, Listeria monocytogenes EGD-e
ggcguaauaaauggu

SEQ ID NO: 778745 - RNA, 15 nt, Listeria monocytogenes EGD-e
ggcguacuuaaauca

SEQ ID NO: 778746 - RNA, 15 nt, Listeria monocytogenes EGD-e
gaagaagacgaaaag

SEQ ID NO: 778747 - RNA, 12 nt, Listeria monocytogenes EGD-e
gaagcauuuuca

SEQ ID NO: 778748 - RNA, 12 nt, Listeria monocytogenes EGD-e
gaauaaaucaag

SEQ ID NO: 778749 - RNA, 15 nt, Listeria monocytogenes EGD-e
gaauauccguuucau

SEQ ID NO: 778750 - RNA, 20 nt, Listeria monocytogenes EGD-e
gaauacuaacgcuuuuucag

SEQ ID NO: 778751 - RNA, 16 nt, Listeria monocytogenes EGD-e
gacaagcgacaaacca

SEQ ID NO: 778752 - RNA, 12 nt, Listeria monocytogenes EGD-e
gacaaaugguuc

SEQ ID NO: 778753 - RNA, 18 nt, Listeria monocytogenes EGD-e
gaauuucgaaauuaaaag

SEQ ID NO: 778754 - RNA, 22 nt, Listeria monocytogenes EGD-e
gacauaaucccacaaaaaauac

SEQ ID NO: 778755 - RNA, 14 nt, Listeria monocytogenes EGD-e
gaccuaaacgaagc

SEQ ID NO: 778756 - RNA, 13 nt, Listeria monocytogenes EGD-e
gacuguuguuuca

SEQ ID NO: 778757 - RNA, 13 nt, Listeria monocytogenes EGD-e
gacuuacuuguuu

SEQ ID NO: 778758 - RNA, 20 nt, Listeria monocytogenes EGD-e
gacuuacuuguuuauauuca

SEQ ID NO: 778759 - RNA, 19 nt, Listeria monocytogenes EGD-e
gagaaaaaguggcgcuucc

SEQ ID NO: 778760 - RNA, 17 nt, Listeria monocytogenes EGD-e
gacuuuugcagcuggaa

SEQ ID NO: 778761 - RNA, 17 nt, Listeria monocytogenes EGD-e
aaagcaaaugcauuucu

SEQ ID NO: 778762 - RNA, 16 nt, Listeria monocytogenes EGD-e
gagaaucauuaauaua

SEQ ID NO: 778763 - RNA, 22 nt, Listeria monocytogenes EGD-e
gagagugacguaaggcauguau

SEQ ID NO: 778764 - RNA, 20 nt, Listeria monocytogenes EGD-e
gagaguuauaaagaaauaac

SEQ ID NO: 778765 - RNA, 20 nt, Listeria monocytogenes EGD-e
gagagcuagaaagccuuuau

SEQ ID NO: 778766 - RNA, 17 nt, Listeria monocytogenes EGD-e
gagcagggcuauuuuuc

SEQ ID NO: 778767 - RNA, 16 nt, Listeria monocytogenes EGD-e
gagccauaaaauuagu

SEQ ID NO: 778768 - RNA, 17 nt, Listeria monocytogenes EGD-e
gaggaaguaauucaucc

SEQ ID NO: 778769 - RNA, 16 nt, Listeria monocytogenes EGD-e
gagcgaauaagugaau

SEQ ID NO: 778770 - RNA, 19 nt, Listeria monocytogenes EGD-e
gagcuucuguuuuuucuuu

SEQ ID NO: 778771 - RNA, 19 nt, Listeria monocytogenes EGD-e
gaguugcugcuaaaggcaa

SEQ ID NO: 778772 - RNA, 16 nt, Listeria monocytogenes EGD-e
gaguuauaaagaaaua

SEQ ID NO: 778773 - RNA, 13 nt, Listeria monocytogenes EGD-e
gauaaauuacuga

SEQ ID NO: 778774 - RNA, 11 nt, Listeria monocytogenes EGD-e
gauaaguuuuc

SEQ ID NO: 778775 - RNA, 16 nt, Listeria monocytogenes EGD-e
gauaaguuuucauaua

SEQ ID NO: 778776 - RNA, 22 nt, Listeria monocytogenes EGD-e
gauaauacgcgccaaagacuga

SEQ ID NO: 778777 - RNA, 23 nt, Listeria monocytogenes EGD-e
gauaauacgcgccaaagacugaa

SEQ ID NO: 778778 - RNA, 20 nt, Listeria monocytogenes EGD-e
gauaaugugaccuuaaauua

SEQ ID NO: 778779 - RNA, 17 nt, Listeria monocytogenes EGD-e
aaagcaguagacuaaau

SEQ ID NO: 778780 - RNA, 13 nt, Listeria monocytogenes EGD-e
aaagcaucgaaua

SEQ ID NO: 778781 - RNA, 17 nt, Listeria monocytogenes EGD-e
gauaguuccuucuaaua

SEQ ID NO: 778782 - RNA, 14 nt, Listeria monocytogenes EGD-e
gaucaaaaugggca

SEQ ID NO: 778783 - RNA, 14 nt, Listeria monocytogenes EGD-e
gaucaauagcagaa

SEQ ID NO: 778784 - RNA, 16 nt, Listeria monocytogenes EGD-e
gauauccaguauuucc

SEQ ID NO: 778785 - RNA, 17 nt, Listeria monocytogenes EGD-e
gaaaucucacuaaacau

SEQ ID NO: 778786 - RNA, 14 nt, Listeria monocytogenes EGD-e
aaagagccauaaaa

SEQ ID NO: 778787 - RNA, 15 nt, Listeria monocytogenes EGD-e
aaagagccauaaaau

SEQ ID NO: 778788 - RNA, 18 nt, Listeria monocytogenes EGD-e
aaagagccauaaaauuag

SEQ ID NO: 778789 - RNA, 14 nt, Listeria monocytogenes EGD-e
gaaauuaaaagcua

SEQ ID NO: 778790 - RNA, 20 nt, Listeria monocytogenes EGD-e
gaaauuaaaagcuaauuauu

SEQ ID NO: 778791 - RNA, 23 nt, Listeria monocytogenes EGD-e
aaagagcggaagauguuuaaaca

SEQ ID NO: 778792 - RNA, 19 nt, Listeria monocytogenes EGD-e
gaacaacaugcguaaacuu

SEQ ID NO: 778793 - RNA, 18 nt, Listeria monocytogenes EGD-e
gaacacccgguccuucaa

SEQ ID NO: 778794 - RNA, 18 nt, Listeria monocytogenes EGD-e
gaaauaguuuugucaaac

SEQ ID NO: 778795 - RNA, 16 nt, Listeria monocytogenes EGD-e
gaaaguuuuaugacaa

SEQ ID NO: 778796 - RNA, 17 nt, Listeria monocytogenes EGD-e
gaaacuuucuuuucuug

SEQ ID NO: 778797 - RNA, 15 nt, Listeria monocytogenes EGD-e
gaaacuuguuuuugu

SEQ ID NO: 778798 - RNA, 21 nt, Listeria monocytogenes EGD-e
gaaaaauaaucacguuuuugc

SEQ ID NO: 778799 - RNA, 15 nt, Listeria monocytogenes EGD-e
gaaaaauguuugcau

SEQ ID NO: 778800 - RNA, 17 nt, Listeria monocytogenes EGD-e
gaaaaguaguguauaac

SEQ ID NO: 778801 - RNA, 18 nt, Listeria monocytogenes EGD-e
gaaacauagucagggaau

SEQ ID NO: 778802 - RNA, 21 nt, Listeria monocytogenes EGD-e
gaaaccauuccguugaaagag

SEQ ID NO: 778803 - RNA, 16 nt, Listeria monocytogenes EGD-e
gaaaccaucgcaaaag

SEQ ID NO: 778804 - RNA, 14 nt, Listeria monocytogenes EGD-e
cuuuuugcuuuaaa

SEQ ID NO: 778805 - RNA, 15 nt, Listeria monocytogenes EGD-e
cuuuuugcuuuaaaa

SEQ ID NO: 778806 - RNA, 17 nt, Listeria monocytogenes EGD-e
cuuuuugauuaaugauu

SEQ ID NO: 778807 - RNA, 19 nt, Listeria monocytogenes EGD-e
gaaaaaaguguauuuacaa

SEQ ID NO: 778808 - RNA, 12 nt, Listeria monocytogenes EGD-e
cuuuuuuuaaac

SEQ ID NO: 778809 - RNA, 19 nt, Listeria monocytogenes EGD-e
cuuuuuuuaaacuauuuuu

SEQ ID NO: 778810 - RNA, 18 nt, Listeria monocytogenes EGD-e
cuuuuuuuaguaaacauu

SEQ ID NO: 778811 - RNA, 12 nt, Listeria monocytogenes EGD-e
cuuuuauaaaaa

SEQ ID NO: 778812 - RNA, 15 nt, Listeria monocytogenes EGD-e
cuuuuauaaaaauac

SEQ ID NO: 778813 - RNA, 22 nt, Listeria monocytogenes EGD-e
cuuuugaucugugggaaucaga

SEQ ID NO: 778814 - RNA, 18 nt, Listeria monocytogenes EGD-e
cuuuugguuuaauuuccu

SEQ ID NO: 778815 - RNA, 11 nt, Listeria monocytogenes EGD-e
cuuuuuaaguc

SEQ ID NO: 778816 - RNA, 17 nt, Listeria monocytogenes EGD-e
aaagaaauguugcgaaa

SEQ ID NO: 778817 - RNA, 13 nt, Listeria monocytogenes EGD-e
aaagaagaaaaag

SEQ ID NO: 778818 - RNA, 14 nt, Listeria monocytogenes EGD-e
aaagaagaaaaagu

SEQ ID NO: 778819 - RNA, 14 nt, Listeria monocytogenes EGD-e
cuuguuucgcguuu

SEQ ID NO: 778820 - RNA, 21 nt, Listeria monocytogenes EGD-e
cuuuaaaaacaguacuucuau

SEQ ID NO: 778821 - RNA, 22 nt, Listeria monocytogenes EGD-e
cuuuaaaauccaauaauaugau

SEQ ID NO: 778822 - RNA, 23 nt, Listeria monocytogenes EGD-e
cuuuaaaagcuuccucauucaca

SEQ ID NO: 778823 - RNA, 12 nt, Listeria monocytogenes EGD-e
cuuguuccauua

SEQ ID NO: 778824 - RNA, 22 nt, Listeria monocytogenes EGD-e
aaagaaauaacuacuauuuaaa

SEQ ID NO: 778825 - RNA, 20 nt, Listeria monocytogenes EGD-e
aaacuuuuucucaaaaauau

SEQ ID NO: 778826 - RNA, 16 nt, Listeria monocytogenes EGD-e
cuuguacacauuauac

SEQ ID NO: 778827 - RNA, 13 nt, Listeria monocytogenes EGD-e
cuuggaauaaaca

SEQ ID NO: 778828 - RNA, 23 nt, Listeria monocytogenes EGD-e
cuuggacggcgcaauuuggcucu

SEQ ID NO: 778829 - RNA, 19 nt, Listeria monocytogenes EGD-e
cuuggacuguuuccccguc

SEQ ID NO: 778830 - RNA, 13 nt, Listeria monocytogenes EGD-e
aaagaauuuuuag

SEQ ID NO: 778831 - RNA, 12 nt, Listeria monocytogenes EGD-e
aaagaauaaaac

SEQ ID NO: 778832 - RNA, 16 nt, Listeria monocytogenes EGD-e
aaagaauaaaacaaaa

SEQ ID NO: 778833 - RNA, 18 nt, Listeria monocytogenes EGD-e
cuuuacauaauucauuga

SEQ ID NO: 778834 - RNA, 17 nt, Listeria monocytogenes EGD-e
cuuuaucuuucccauca

SEQ ID NO: 778835 - RNA, 23 nt, Listeria monocytogenes EGD-e
cuuuaugaagugauguaucuaau

SEQ ID NO: 778836 - RNA, 19 nt, Listeria monocytogenes EGD-e
cuuuauaacucucauaaga

SEQ ID NO: 778837 - RNA, 20 nt, Listeria monocytogenes EGD-e
cuuuacuugcaaaugcuuua

SEQ ID NO: 778838 - RNA, 17 nt, Listeria monocytogenes EGD-e
cuuuauuuuuuauuuua

SEQ ID NO: 778839 - RNA, 21 nt, Listeria monocytogenes EGD-e
cuucugccgauuauccuguaa

SEQ ID NO: 778840 - RNA, 14 nt, Listeria monocytogenes EGD-e
cuucucuccaauca

SEQ ID NO: 778841 - RNA, 21 nt, Listeria monocytogenes EGD-e
cuucucagcuucgauuuuuuc

SEQ ID NO: 778842 - RNA, 17 nt, Listeria monocytogenes EGD-e
cuucuauuugucaaucu

SEQ ID NO: 778843 - RNA, 22 nt, Listeria monocytogenes EGD-e
cuucuauauuaaugucaauuau

SEQ ID NO: 778844 - RNA, 13 nt, Listeria monocytogenes EGD-e
cuucuacuuuuac

SEQ ID NO: 778845 - RNA, 20 nt, Listeria monocytogenes EGD-e
cuucuaccguuccuucaagc

SEQ ID NO: 778846 - RNA, 15 nt, Listeria monocytogenes EGD-e
cuucuacuagugaaa

SEQ ID NO: 778847 - RNA, 14 nt, Listeria monocytogenes EGD-e
cuucuaagaaaaaa

SEQ ID NO: 778848 - RNA, 22 nt, Listeria monocytogenes EGD-e
cuucuaagaaaaaaaguuauau

SEQ ID NO: 778849 - RNA, 12 nt, Listeria monocytogenes EGD-e
cuucuaacaauu

SEQ ID NO: 778850 - RNA, 14 nt, Listeria monocytogenes EGD-e
cuucuaaaauaaca

SEQ ID NO: 778851 - RNA, 19 nt, Listeria monocytogenes EGD-e
cuucuguuuuuucuuuguc

SEQ ID NO: 778852 - RNA, 21 nt, Listeria monocytogenes EGD-e
cuucuucagacgcaauuucaa

SEQ ID NO: 778853 - RNA, 22 nt, Listeria monocytogenes EGD-e
cuucuucagacgcaauuucaau

SEQ ID NO: 778854 - RNA, 18 nt, Listeria monocytogenes EGD-e
cuucuugcuucacgugcu

SEQ ID NO: 778855 - RNA, 19 nt, Listeria monocytogenes EGD-e
cuucuuuuugcuuuaaaaa

SEQ ID NO: 778856 - RNA, 13 nt, Listeria monocytogenes EGD-e
cuucuuuuuucuu

SEQ ID NO: 778857 - RNA, 15 nt, Listeria monocytogenes EGD-e
cuucuuugauuuuuu

SEQ ID NO: 778858 - RNA, 19 nt, Listeria monocytogenes EGD-e
cuucuuugauuuuuucuuc

SEQ ID NO: 778859 - RNA, 15 nt, Listeria monocytogenes EGD-e
cuugaauguuuucaa

SEQ ID NO: 778860 - RNA, 19 nt, Listeria monocytogenes EGD-e
cuugacgcguggaaagaau

SEQ ID NO: 778861 - RNA, 15 nt, Listeria monocytogenes EGD-e
cuugauaauuuuuuu

SEQ ID NO: 778862 - RNA, 14 nt, Listeria monocytogenes EGD-e
cuugcaaaugcuuu

SEQ ID NO: 778863 - RNA, 15 nt, Listeria monocytogenes EGD-e
cuugcacuuggaacg

SEQ ID NO: 778864 - RNA, 22 nt, Listeria monocytogenes EGD-e
cuugcaucaagggaagcuuuug

SEQ ID NO: 778865 - RNA, 20 nt, Listeria monocytogenes EGD-e
cuugcauagauggaagaagu

SEQ ID NO: 778866 - RNA, 22 nt, Listeria monocytogenes EGD-e
cuugcaucuucuguuaacauuu

SEQ ID NO: 778867 - RNA, 15 nt, Listeria monocytogenes EGD-e
cuugcuuuaauuugg

SEQ ID NO: 778868 - RNA, 14 nt, Listeria monocytogenes EGD-e
cuguuuuuucuuug

SEQ ID NO: 778869 - RNA, 13 nt, Listeria monocytogenes EGD-e
cuuaaaaauuuug

SEQ ID NO: 778870 - RNA, 17 nt, Listeria monocytogenes EGD-e
cuuaaauacgaaaaaca

SEQ ID NO: 778871 - RNA, 15 nt, Listeria monocytogenes EGD-e
cuuaaagguuuuguu

SEQ ID NO: 778872 - RNA, 16 nt, Listeria monocytogenes EGD-e
cuuaaaucacuucuua

SEQ ID NO: 778873 - RNA, 15 nt, Listeria monocytogenes EGD-e
cuuaacgaauuuuuc

SEQ ID NO: 778874 - RNA, 17 nt, Listeria monocytogenes EGD-e
cuuaacgaauuuuucaa

SEQ ID NO: 778875 - RNA, 17 nt, Listeria monocytogenes EGD-e
cuguuucauuuuuccaa

SEQ ID NO: 778876 - RNA, 15 nt, Listeria monocytogenes EGD-e
cuguucguacauuuu

SEQ ID NO: 778877 - RNA, 18 nt, Listeria monocytogenes EGD-e
cuuaucaaguaauaagaa

SEQ ID NO: 778878 - RNA, 20 nt, Listeria monocytogenes EGD-e
cuuauccgguuuuugcucca

SEQ ID NO: 778879 - RNA, 13 nt, Listeria monocytogenes EGD-e
cuucauuuuucua

SEQ ID NO: 778880 - RNA, 16 nt, Listeria monocytogenes EGD-e
cuucggggcaaaaagg

SEQ ID NO: 778881 - RNA, 14 nt, Listeria monocytogenes EGD-e
cuucagccaauucu

SEQ ID NO: 778882 - RNA, 16 nt, Listeria monocytogenes EGD-e
cuucauuagacaaaaa

SEQ ID NO: 778883 - RNA, 20 nt, Listeria monocytogenes EGD-e
cuucaauugcuucuuuuuuc

SEQ ID NO: 778884 - RNA, 18 nt, Listeria monocytogenes EGD-e
cuucaaucggaacaccaa

SEQ ID NO: 778885 - RNA, 14 nt, Listeria monocytogenes EGD-e
cuucaccaagaaga

SEQ ID NO: 778886 - RNA, 22 nt, Listeria monocytogenes EGD-e
cuucaaacgcagguucaccaaa

SEQ ID NO: 778887 - RNA, 14 nt, Listeria monocytogenes EGD-e
cuucaaaacucucu

SEQ ID NO: 778888 - RNA, 12 nt, Listeria monocytogenes EGD-e
cuuauuuuauac

SEQ ID NO: 778889 - RNA, 11 nt, Listeria monocytogenes EGD-e
cuucaagacca

SEQ ID NO: 778890 - RNA, 14 nt, Listeria monocytogenes EGD-e
cuucaaucaagccu

SEQ ID NO: 778891 - RNA, 14 nt, Listeria monocytogenes EGD-e
cuucaagcauuuca

SEQ ID NO: 778892 - RNA, 18 nt, Listeria monocytogenes EGD-e
cuucaagcauuucauaau

SEQ ID NO: 778893 - RNA, 20 nt, Listeria monocytogenes EGD-e
cgggcacgaguaacuccacc

SEQ ID NO: 778894 - RNA, 17 nt, Listeria monocytogenes EGD-e
cgguacaguagaagcaa

SEQ ID NO: 778895 - RNA, 15 nt, Listeria monocytogenes EGD-e
cgguagcuucaauca

SEQ ID NO: 778896 - RNA, 16 nt, Listeria monocytogenes EGD-e
aaacuacugguucuuc

SEQ ID NO: 778897 - RNA, 15 nt, Listeria monocytogenes EGD-e
cggggaaauaguuuu

SEQ ID NO: 778898 - RNA, 21 nt, Listeria monocytogenes EGD-e
cgucccauugcgaauaacaag

SEQ ID NO: 778899 - RNA, 23 nt, Listeria monocytogenes EGD-e
cguauuaucaauuacgcuuuagu

SEQ ID NO: 778900 - RNA, 17 nt, Listeria monocytogenes EGD-e
cguaauauauucaaaau

SEQ ID NO: 778901 - RNA, 16 nt, Listeria monocytogenes EGD-e
cgguuaauuuccauuu

SEQ ID NO: 778902 - RNA, 15 nt, Listeria monocytogenes EGD-e
cgguugauaauaauc

SEQ ID NO: 778903 - RNA, 17 nt, Listeria monocytogenes EGD-e
cgguugauaauaaucag

SEQ ID NO: 778904 - RNA, 17 nt, Listeria monocytogenes EGD-e
cgguuuuugcuccauug

SEQ ID NO: 778905 - RNA, 21 nt, Listeria monocytogenes EGD-e
cgguuuucaugaagcaaacca

SEQ ID NO: 778906 - RNA, 23 nt, Listeria monocytogenes EGD-e
cgguuuucaugaagcaaaccauu

SEQ ID NO: 778907 - RNA, 17 nt, Listeria monocytogenes EGD-e
cguguugauaaagauaa

SEQ ID NO: 778908 - RNA, 23 nt, Listeria monocytogenes EGD-e
cguucauucgguaagaccaccaa

SEQ ID NO: 778909 - RNA, 17 nt, Listeria monocytogenes EGD-e
cguuccaguuaaacaaa

SEQ ID NO: 778910 - RNA, 13 nt, Listeria monocytogenes EGD-e
cguuucaacccac

SEQ ID NO: 778911 - RNA, 13 nt, Listeria monocytogenes EGD-e
cguuuaucaauaa

SEQ ID NO: 778912 - RNA, 20 nt, Listeria monocytogenes EGD-e
cguuuaauucggcuucaaaa

SEQ ID NO: 778913 - RNA, 16 nt, Listeria monocytogenes EGD-e
cuaaaguuagauuaaa

SEQ ID NO: 778914 - RNA, 20 nt, Listeria monocytogenes EGD-e
cuaaaguuagauuaaaaauc

SEQ ID NO: 778915 - RNA, 14 nt, Listeria monocytogenes EGD-e
cuaaauaaauauuu

SEQ ID NO: 778916 - RNA, 20 nt, Listeria monocytogenes EGD-e
cuaaauaaaaccauucaucu

SEQ ID NO: 778917 - RNA, 15 nt, Listeria monocytogenes EGD-e
cuaaauacguauuac

SEQ ID NO: 778918 - RNA, 14 nt, Listeria monocytogenes EGD-e
cuaaauagucccca

SEQ ID NO: 778919 - RNA, 17 nt, Listeria monocytogenes EGD-e
cuaaaggcaacaaagaa

SEQ ID NO: 778920 - RNA, 17 nt, Listeria monocytogenes EGD-e
cuaaauugauaccaaau

SEQ ID NO: 778921 - RNA, 13 nt, Listeria monocytogenes EGD-e
cuaaaucuuuucg

SEQ ID NO: 778922 - RNA, 13 nt, Listeria monocytogenes EGD-e
cuaaaauaacauc

SEQ ID NO: 778923 - RNA, 20 nt, Listeria monocytogenes EGD-e
cuaaacguucuuccuuuuuc

SEQ ID NO: 778924 - RNA, 17 nt, Listeria monocytogenes EGD-e
cuaaaacaggcguaaua

SEQ ID NO: 778925 - RNA, 17 nt, Listeria monocytogenes EGD-e
cuaaaaagguauccuua

SEQ ID NO: 778926 - RNA, 20 nt, Listeria monocytogenes EGD-e
cuacuggguaaguagcauuu

SEQ ID NO: 778927 - RNA, 18 nt, Listeria monocytogenes EGD-e
cuacuagugaaauagaau

SEQ ID NO: 778928 - RNA, 18 nt, Listeria monocytogenes EGD-e
cuaacauuaauucauuua

SEQ ID NO: 778929 - RNA, 12 nt, Listeria monocytogenes EGD-e
cuagcuauacau

SEQ ID NO: 778930 - RNA, 17 nt, Listeria monocytogenes EGD-e
cuaggccuacuuuuuug

SEQ ID NO: 778931 - RNA, 15 nt, Listeria monocytogenes EGD-e
cuagauuuaauaaau

SEQ ID NO: 778932 - RNA, 18 nt, Listeria monocytogenes EGD-e
cuacuucuaaauaguccc

SEQ ID NO: 778933 - RNA, 13 nt, Listeria monocytogenes EGD-e
cuaugucuuuuug

SEQ ID NO: 778934 - RNA, 23 nt, Listeria monocytogenes EGD-e
cuagguucuuuuuuaugaaaaaa

SEQ ID NO: 778935 - RNA, 13 nt, Listeria monocytogenes EGD-e
cuagguucuuuuu

SEQ ID NO: 778936 - RNA, 13 nt, Listeria monocytogenes EGD-e
cuaucaaccacuu

SEQ ID NO: 778937 - RNA, 15 nt, Listeria monocytogenes EGD-e
cucaccuucuuuuug

SEQ ID NO: 778938 - RNA, 22 nt, Listeria monocytogenes EGD-e
cuauuaaugguugcauuuggag

SEQ ID NO: 778939 - RNA, 12 nt, Listeria monocytogenes EGD-e
cuauuaauaaug

SEQ ID NO: 778940 - RNA, 21 nt, Listeria monocytogenes EGD-e
cucauauuuggccaauuaaaa

SEQ ID NO: 778941 - RNA, 18 nt, Listeria monocytogenes EGD-e
cucaucaccagcuucuaa

SEQ ID NO: 778942 - RNA, 19 nt, Listeria monocytogenes EGD-e
cucagauccuucaauaaua

SEQ ID NO: 778943 - RNA, 17 nt, Listeria monocytogenes EGD-e
cucauaagcuucauaaa

SEQ ID NO: 778944 - RNA, 14 nt, Listeria monocytogenes EGD-e
cucauguucaaucu

SEQ ID NO: 778945 - RNA, 16 nt, Listeria monocytogenes EGD-e
cucgauaacguguuua

SEQ ID NO: 778946 - RNA, 14 nt, Listeria monocytogenes EGD-e
cucgacuucaagga

SEQ ID NO: 778947 - RNA, 20 nt, Listeria monocytogenes EGD-e
cucgaauaccagcaguuuuc

SEQ ID NO: 778948 - RNA, 17 nt, Listeria monocytogenes EGD-e
cucguauuaucaauuac

SEQ ID NO: 778949 - RNA, 19 nt, Listeria monocytogenes EGD-e
cucuauaauuuauaaaagc

SEQ ID NO: 778950 - RNA, 20 nt, Listeria monocytogenes EGD-e
cucucuuucugccuaccaaa

SEQ ID NO: 778951 - RNA, 21 nt, Listeria monocytogenes EGD-e
cucuuaugagaguuauaaaga

SEQ ID NO: 778952 - RNA, 18 nt, Listeria monocytogenes EGD-e
cucuucgccaccuucaau

SEQ ID NO: 778953 - RNA, 15 nt, Listeria monocytogenes EGD-e
cucuuccaaaaucau

SEQ ID NO: 778954 - RNA, 20 nt, Listeria monocytogenes EGD-e
cucuuugcuucaaucccagc

SEQ ID NO: 778955 - RNA, 22 nt, Listeria monocytogenes EGD-e
cucuuuggagugaggauuuuuu

SEQ ID NO: 778956 - RNA, 18 nt, Listeria monocytogenes EGD-e
cucuuucugccuaccaaa

SEQ ID NO: 778957 - RNA, 20 nt, Listeria monocytogenes EGD-e
cugaaacauagucagggaau

SEQ ID NO: 778958 - RNA, 15 nt, Listeria monocytogenes EGD-e
cucuuuuuuuauacc

SEQ ID NO: 778959 - RNA, 17 nt, Listeria monocytogenes EGD-e
cucuuuuuuuauaccuu

SEQ ID NO: 778960 - RNA, 23 nt, Listeria monocytogenes EGD-e
cugaagcgaugauuuucauuaaa

SEQ ID NO: 778961 - RNA, 22 nt, Listeria monocytogenes EGD-e
cugaugcauggaacgguauaca

SEQ ID NO: 778962 - RNA, 22 nt, Listeria monocytogenes EGD-e
cugcaagcgaauuaauaaaaga

SEQ ID NO: 778963 - RNA, 11 nt, Listeria monocytogenes EGD-e
cugcuuuuuca

SEQ ID NO: 778964 - RNA, 21 nt, Listeria monocytogenes EGD-e
cuggauuucuccguaagaaga

SEQ ID NO: 778965 - RNA, 23 nt, Listeria monocytogenes EGD-e
cuggaucauauucuucuaaaaua

SEQ ID NO: 778966 - RNA, 14 nt, Listeria monocytogenes EGD-e
cuggaucacuauau

SEQ ID NO: 778967 - RNA, 23 nt, Listeria monocytogenes EGD-e
cuggauuuucuagguucuuuuuu

SEQ ID NO: 778968 - RNA, 18 nt, Listeria monocytogenes EGD-e
cugcugaaauagcauuca

SEQ ID NO: 778969 - RNA, 12 nt, Listeria monocytogenes EGD-e
cugcuaaaacca

SEQ ID NO: 778970 - RNA, 21 nt, Listeria monocytogenes EGD-e
cugcuaaaggcaacaaagaag

SEQ ID NO: 778971 - RNA, 19 nt, Listeria monocytogenes EGD-e
cugcguguuuuuuuaugcu

SEQ ID NO: 778972 - RNA, 21 nt, Listeria monocytogenes EGD-e
cugcauuucauuuuaaucauu

SEQ ID NO: 778973 - RNA, 22 nt, Listeria monocytogenes EGD-e
cugcauccaagcggguuuucuc

SEQ ID NO: 778974 - RNA, 18 nt, Listeria monocytogenes EGD-e
cugcauaaaaaacauucg

SEQ ID NO: 778975 - RNA, 20 nt, Listeria monocytogenes EGD-e
cugcaauuucaaccaauucu

SEQ ID NO: 778976 - RNA, 22 nt, Listeria monocytogenes EGD-e
cugcaaucauuuauuuucccuc

SEQ ID NO: 778977 - RNA, 12 nt, Listeria monocytogenes EGD-e
cugccaaauugg

SEQ ID NO: 778978 - RNA, 17 nt, Listeria monocytogenes EGD-e
aaaaacaugauauauuu

SEQ ID NO: 778979 - RNA, 22 nt, Listeria monocytogenes EGD-e
aaaaacauuauuuugcuaaaga

SEQ ID NO: 778980 - RNA, 14 nt, Listeria monocytogenes EGD-e
aaaaacaauaacau

SEQ ID NO: 778981 - RNA, 19 nt, Listeria monocytogenes EGD-e
aaaaacaguauuccucaau

SEQ ID NO: 778982 - RNA, 18 nt, Listeria monocytogenes EGD-e
aaaaaacaucuugacuuu

SEQ ID NO: 778983 - RNA, 22 nt, Listeria monocytogenes EGD-e
aaaaaacagaaacgcuuuguuu

SEQ ID NO: 778984 - RNA, 11 nt, Listeria monocytogenes EGD-e
aaaaaaaguua

SEQ ID NO: 778985 - RNA, 18 nt, Listeria monocytogenes EGD-e
aaaaaaaguuauauuuaa

SEQ ID NO: 778986 - RNA, 14 nt, Listeria monocytogenes EGD-e
aaacaaacacaaaa

SEQ ID NO: 778987 - RNA, 14 nt, Listeria monocytogenes EGD-e
aaacaaaguaccaa

SEQ ID NO: 778988 - RNA, 21 nt, Listeria monocytogenes EGD-e
aaacaaauuugccaaagagaa

SEQ ID NO: 778989 - RNA, 17 nt, Listeria monocytogenes EGD-e
aaacaacccauuugcau

SEQ ID NO: 778990 - RNA, 20 nt, Listeria monocytogenes EGD-e
aaaauucaguuuauaaauac

SEQ ID NO: 778991 - RNA, 16 nt, Listeria monocytogenes EGD-e
aaaauuugucuuuacu

SEQ ID NO: 778992 - RNA, 15 nt, Listeria monocytogenes EGD-e
aaaaucuacaacuag

SEQ ID NO: 778993 - RNA, 22 nt, Listeria monocytogenes EGD-e
aaaaugcuaauuuauuuagaaa

SEQ ID NO: 778994 - RNA, 22 nt, Listeria monocytogenes EGD-e
aaaaucaagcguaccauucacu

SEQ ID NO: 778995 - RNA, 14 nt, Listeria monocytogenes EGD-e
aaaauaaguccaaa

SEQ ID NO: 778996 - RNA, 17 nt, Listeria monocytogenes EGD-e
aaaauaauaucuucuau

SEQ ID NO: 778997 - RNA, 21 nt, Listeria monocytogenes EGD-e
aaaaguugaccgcaaauagag

SEQ ID NO: 778998 - RNA, 20 nt, Listeria monocytogenes EGD-e
aaaaguuauauuuaaauagu

SEQ ID NO: 778999 - RNA, 15 nt, Listeria monocytogenes EGD-e
aaaaguuaagaagcg

SEQ ID NO: 779000 - RNA, 16 nt, Listeria monocytogenes EGD-e
aaaaccaacaaucgua

SEQ ID NO: 779001 - RNA, 16 nt, Listeria monocytogenes EGD-e
aaaacuaaauuaauuu

SEQ ID NO: 779002 - RNA, 15 nt, Listeria monocytogenes EGD-e
aaaacugaacaaaga

SEQ ID NO: 779003 - RNA, 18 nt, Listeria monocytogenes EGD-e
aaaacugaacaaagaaga

SEQ ID NO: 779004 - RNA, 14 nt, Listeria monocytogenes EGD-e
aaaagaaaaaacaa

SEQ ID NO: 779005 - RNA, 20 nt, Listeria monocytogenes EGD-e
aaaagcacucgucuaaaaaa

SEQ ID NO: 779006 - RNA, 15 nt, Listeria monocytogenes EGD-e
aaaagcaaaaaagua

SEQ ID NO: 779007 - RNA, 21 nt, Listeria monocytogenes EGD-e
aaaagauacuuugaauuaaga

SEQ ID NO: 779008 - RNA, 17 nt, Listeria monocytogenes EGD-e
aaaaauaauaucuucua

SEQ ID NO: 779009 - RNA, 12 nt, Listeria monocytogenes EGD-e
aaaaauaagucc

SEQ ID NO: 779010 - RNA, 17 nt, Listeria monocytogenes EGD-e
aaaaacccgaauaacuc

SEQ ID NO: 779011 - RNA, 16 nt, Listeria monocytogenes EGD-e
aaaaacaguuucuuua

SEQ ID NO: 779012 - RNA, 22 nt, Listeria monocytogenes EGD-e
aaaaacaucuugacuuuguuaa

SEQ ID NO: 779013 - RNA, 21 nt, Listeria monocytogenes EGD-e
aaaaacaugauauauuuauaa

SEQ ID NO: 779014 - RNA, 17 nt, Listeria monocytogenes EGD-e
aaaaauacguaucuuau

SEQ ID NO: 779015 - RNA, 18 nt, Listeria monocytogenes EGD-e
aaaaaucauuaaauuuag

SEQ ID NO: 779016 - RNA, 13 nt, Listeria monocytogenes EGD-e
aaaaaucauuaaa

SEQ ID NO: 779017 - RNA, 18 nt, Listeria monocytogenes EGD-e
aaaaauagcuuucccuuu

SEQ ID NO: 779018 - RNA, 17 nt, Listeria monocytogenes EGD-e
aaaacaaggaagaauag

SEQ ID NO: 779019 - RNA, 20 nt, Listeria monocytogenes EGD-e
aaaacaaggaagaauaguac

SEQ ID NO: 779020 - RNA, 23 nt, Listeria monocytogenes EGD-e
aaaacaagaggcuuauuccucca

SEQ ID NO: 779021 - RNA, 19 nt, Listeria monocytogenes EGD-e
aaaaauuucaucguuuucu

SEQ ID NO: 779022 - RNA, 21 nt, Listeria monocytogenes EGD-e
aaaacaauaacauuuucucuu

SEQ ID NO: 779023 - RNA, 19 nt, Listeria monocytogenes EGD-e
aaaacauuauuuugcuaaa

SEQ ID NO: 779024 - RNA, 21 nt, Listeria monocytogenes EGD-e
aaaacauuuucauucuuuccc

SEQ ID NO: 779025 - RNA, 20 nt, Listeria monocytogenes EGD-e
aaacguuccgauacaacaaa

SEQ ID NO: 779026 - RNA, 22 nt, Listeria monocytogenes EGD-e
aaacguuccgauacaacaaaau

SEQ ID NO: 779027 - RNA, 23 nt, Listeria monocytogenes EGD-e
aaaccugcuuggauggacauaau

SEQ ID NO: 779028 - RNA, 13 nt, Listeria monocytogenes EGD-e
aaacgaagcguuc

SEQ ID NO: 779029 - RNA, 12 nt, Listeria monocytogenes EGD-e
aaacgaauaaaa

SEQ ID NO: 779030 - RNA, 18 nt, Listeria monocytogenes EGD-e
aaacgcagguucaccaaa

SEQ ID NO: 779031 - RNA, 21 nt, Listeria monocytogenes EGD-e
aaacugaacaaagaagaagac

SEQ ID NO: 779032 - RNA, 15 nt, Listeria monocytogenes EGD-e
aaacuacugguucuu

SEQ ID NO: 779033 - RNA, 14 nt, Listeria monocytogenes EGD-e
aaacuaucaauaaa

SEQ ID NO: 779034 - RNA, 18 nt, Listeria monocytogenes EGD-e
aaacuaucaauaaaucca

SEQ ID NO: 779035 - RNA, 13 nt, Listeria monocytogenes EGD-e
aaacuguuguucu

SEQ ID NO: 779036 - RNA, 14 nt, Listeria monocytogenes EGD-e
aaacuguuguucuu

SEQ ID NO: 779037 - RNA, 12 nt, Listeria monocytogenes EGD-e
aaacuuucacaa

SEQ ID NO: 779038 - RNA, 14 nt, Listeria monocytogenes EGD-e
aaacuuuaacaaaa

SEQ ID NO: 779039 - RNA, 18 nt, Listeria monocytogenes EGD-e
aaacuuuaacaaaaguca

SEQ ID NO: 779040 - RNA, 18 nt, Listeria monocytogenes EGD-e
aaacuuaucucuucauuu

SEQ ID NO: 779041 - RNA, 13 nt, Listeria monocytogenes EGD-e
aaacuuucuuuuc

SEQ ID NO: 779042 - RNA, 15 nt, Listeria monocytogenes EGD-e
aaacuuucuuuucuu

SEQ ID NO: 779043 - RNA, 21 nt, Listeria monocytogenes EGD-e
aaagaauauccguuucauuuu

SEQ ID NO: 779044 - RNA, 14 nt, Listeria monocytogenes EGD-e
aaagcaaacaaagu

SEQ ID NO: 779045 - RNA, 16 nt, Listeria monocytogenes EGD-e
aaagauacuuugaauu

SEQ ID NO: 779046 - RNA, 17 nt, Listeria monocytogenes EGD-e
aaagauacuuugaauua

SEQ ID NO: 779047 - RNA, 18 nt, Listeria monocytogenes EGD-e
aaagauacuuugaauuaa

SEQ ID NO: 779048 - RNA, 15 nt, Listeria monocytogenes EGD-e
aaagcaugaauuuuu

SEQ ID NO: 779049 - RNA, 17 nt, Listeria monocytogenes EGD-e
aaagcaugaauuuuuau

SEQ ID NO: 779050 - RNA, 17 nt, Listeria monocytogenes EGD-e
aaagcuguuuucaacaa

SEQ ID NO: 779051 - RNA, 18 nt, Listeria monocytogenes EGD-e
aaaggaauugcuucuccg

SEQ ID NO: 779052 - RNA, 15 nt, Listeria monocytogenes EGD-e
aaaggacaagcccag

SEQ ID NO: 779053 - RNA, 14 nt, Listeria monocytogenes EGD-e
aaaggcaacaaaga

SEQ ID NO: 779054 - RNA, 15 nt, Listeria monocytogenes EGD-e
aaaggcaacaaagaa

SEQ ID NO: 779055 - RNA, 16 nt, Listeria monocytogenes EGD-e
aaaggcaacaaagaag

SEQ ID NO: 779056 - RNA, 18 nt, Listeria monocytogenes EGD-e
aaaggcaacaaagaagaa

SEQ ID NO: 779057 - RNA, 21 nt, Listeria monocytogenes EGD-e
aaagcguuuuucugcauccaa

SEQ ID NO: 779058 - RNA, 17 nt, Listeria monocytogenes EGD-e
aaagcuaagcauuauaa

SEQ ID NO: 779059 - RNA, 19 nt, Listeria monocytogenes EGD-e
aaagcuaagcauuauaaaa

SEQ ID NO: 779060 - RNA, 18 nt, Listeria monocytogenes EGD-e
aaagggaugaaaaucuac

SEQ ID NO: 779061 - RNA, 18 nt, Listeria monocytogenes EGD-e
aaaucaagcguaccauuc

SEQ ID NO: 779062 - RNA, 19 nt, Listeria monocytogenes EGD-e
aaaucaagcguaccauuca

SEQ ID NO: 779063 - RNA, 18 nt, Listeria monocytogenes EGD-e
aaaucaccacaaaggaca

SEQ ID NO: 779064 - RNA, 17 nt, Listeria monocytogenes EGD-e
aaaucauaacguuucau

SEQ ID NO: 779065 - RNA, 19 nt, Listeria monocytogenes EGD-e
aaaucacuucuuaagaauu

SEQ ID NO: 779066 - RNA, 24 nt, Listeria monocytogenes EGD-e
aaauauuuugcagugaugguggaa

SEQ ID NO: 779067 - RNA, 21 nt, Listeria monocytogenes EGD-e
aaauaguaguuauuucuuuau

SEQ ID NO: 779068 - RNA, 16 nt, Listeria monocytogenes EGD-e
aaauaggcaaaucuuu

SEQ ID NO: 779069 - RNA, 12 nt, Listeria monocytogenes EGD-e
aaauaauaccag

SEQ ID NO: 779070 - RNA, 20 nt, Listeria monocytogenes EGD-e
aaauaacguugcauuaaaaa

SEQ ID NO: 779071 - RNA, 18 nt, Listeria monocytogenes EGD-e
aaauaacuacuauuuaaa

SEQ ID NO: 779072 - RNA, 12 nt, Listeria monocytogenes EGD-e
aaauaaaaccau

SEQ ID NO: 779073 - RNA, 12 nt, Listeria monocytogenes EGD-e
aaauaaccauuc

SEQ ID NO: 779074 - RNA, 17 nt, Listeria monocytogenes EGD-e
aaauagccaagauuaaa

SEQ ID NO: 779075 - RNA, 15 nt, Listeria monocytogenes EGD-e
aaauacuuggagagu

SEQ ID NO: 779076 - RNA, 16 nt, Listeria monocytogenes EGD-e
aaauagcuuucccuuu

SEQ ID NO: 779077 - RNA, 23 nt, Listeria monocytogenes EGD-e
aaauagcuuugucuuaaaugaca

SEQ ID NO: 779078 - RNA, 16 nt, Listeria monocytogenes EGD-e
aaauaggauuaaaaua

SEQ ID NO: 779079 - RNA, 18 nt, Listeria monocytogenes EGD-e
aaauaggauuaaaauaaa

SEQ ID NO: 779080 - RNA, 12 nt, Listeria monocytogenes EGD-e
aaauaauccuuc

SEQ ID NO: 779081 - RNA, 16 nt, Listeria monocytogenes EGD-e
aaauacgccucuaaag

SEQ ID NO: 779082 - RNA, 16 nt, Listeria monocytogenes EGD-e
aaaucucaugaaacuu

SEQ ID NO: 779083 - RNA, 18 nt, Listeria monocytogenes EGD-e
aaaucgcgcaaacaguua

SEQ ID NO: 779084 - RNA, 21 nt, Listeria monocytogenes EGD-e
aaaucgcgcaaacaguuagaa

SEQ ID NO: 779085 - RNA, 18 nt, Listeria monocytogenes EGD-e
aaaucgcggauaauaauc

SEQ ID NO: 779086 - RNA, 15 nt, Listeria monocytogenes EGD-e
aaaucaugccuucaa

SEQ ID NO: 779087 - RNA, 22 nt, Listeria monocytogenes EGD-e
aaaucauuucgauaagcacaaa

SEQ ID NO: 779088 - RNA, 13 nt, Listeria monocytogenes EGD-e
aaaucauuuaaac

SEQ ID NO: 779089 - RNA, 16 nt, Listeria monocytogenes EGD-e
aaaucauuuaaacacg

SEQ ID NO: 779090 - RNA, 19 nt, Listeria monocytogenes EGD-e
aaaucuuuuuguuuugcuu

SEQ ID NO: 779091 - RNA, 21 nt, Listeria monocytogenes EGD-e
aaaugauuuuuaucuaaaucu

SEQ ID NO: 779092 - RNA, 21 nt, Listeria monocytogenes EGD-e
aaaugaagagauaaguuuuca

SEQ ID NO: 779093 - RNA, 19 nt, Listeria monocytogenes EGD-e
aaaugcuucgacguuuaau

SEQ ID NO: 779094 - RNA, 16 nt, Listeria monocytogenes EGD-e
aaaugcucaucaagaa

SEQ ID NO: 779095 - RNA, 14 nt, Listeria monocytogenes EGD-e
aaauuaauuugacc

SEQ ID NO: 779096 - RNA, 19 nt, Listeria monocytogenes EGD-e
aaaaagcuuauuaaacaua

SEQ ID NO: 779097 - RNA, 16 nt, Listeria monocytogenes EGD-e
aaauggauaaaaaaau

SEQ ID NO: 779098 - RNA, 22 nt, Listeria monocytogenes EGD-e
aaauggaugcacuuuuaauuua

SEQ ID NO: 779099 - RNA, 17 nt, Listeria monocytogenes EGD-e
aaauggauugcagguaa

SEQ ID NO: 779100 - RNA, 11 nt, Listeria monocytogenes EGD-e
aaauuaacuuc

SEQ ID NO: 779101 - RNA, 19 nt, Listeria monocytogenes EGD-e
aaauucuauuaauaaugau

SEQ ID NO: 779102 - RNA, 15 nt, Listeria monocytogenes EGD-e
aaauucaauuuauau

SEQ ID NO: 779103 - RNA, 17 nt, Listeria monocytogenes EGD-e
aaauuacguuucacuuu

SEQ ID NO: 779104 - RNA, 22 nt, Listeria monocytogenes EGD-e
aaauuaccuaaugaauaagcaa

SEQ ID NO: 779105 - RNA, 15 nt, Listeria monocytogenes EGD-e
aaauuauuagaauuc

SEQ ID NO: 779106 - RNA, 17 nt, Listeria monocytogenes EGD-e
augcaauccauguuguu

SEQ ID NO: 779107 - RNA, 18 nt, Listeria monocytogenes EGD-e
augcaaaaccucuuuuuu

SEQ ID NO: 779108 - RNA, 15 nt, Listeria monocytogenes EGD-e
augauuuucauuaaa

SEQ ID NO: 779109 - RNA, 16 nt, Listeria monocytogenes EGD-e
augauuuguuucuggu

SEQ ID NO: 779110 - RNA, 23 nt, Listeria monocytogenes EGD-e
augauuucuauaaaaaugauaau

SEQ ID NO: 779111 - RNA, 23 nt, Listeria monocytogenes EGD-e
augauucaaagcuacuuuucgaa

SEQ ID NO: 779112 - RNA, 22 nt, Listeria monocytogenes EGD-e
augaugguuuuggguauauuuu

SEQ ID NO: 779113 - RNA, 16 nt, Listeria monocytogenes EGD-e
augagcccaaaaauaa

SEQ ID NO: 779114 - RNA, 14 nt, Listeria monocytogenes EGD-e
augaugaaaagaca

SEQ ID NO: 779115 - RNA, 12 nt, Listeria monocytogenes EGD-e
augaucuuuucg

SEQ ID NO: 779116 - RNA, 15 nt, Listeria monocytogenes EGD-e
augcgacauacuuuu

SEQ ID NO: 779117 - RNA, 21 nt, Listeria monocytogenes EGD-e
augcagauuaacccaauuuug

SEQ ID NO: 779118 - RNA, 19 nt, Listeria monocytogenes EGD-e
augcuucgacguuuaauuc

SEQ ID NO: 779119 - RNA, 18 nt, Listeria monocytogenes EGD-e
auggaaguaaugguguaa

SEQ ID NO: 779120 - RNA, 12 nt, Listeria monocytogenes EGD-e
auggaaccauuc

SEQ ID NO: 779121 - RNA, 14 nt, Listeria monocytogenes EGD-e
auggaaaaauccac

SEQ ID NO: 779122 - RNA, 19 nt, Listeria monocytogenes EGD-e
auggaguuuguaacaacua

SEQ ID NO: 779123 - RNA, 13 nt, Listeria monocytogenes EGD-e
auggcauaaaaaa

SEQ ID NO: 779124 - RNA, 14 nt, Listeria monocytogenes EGD-e
auggcauaaaaaau

SEQ ID NO: 779125 - RNA, 17 nt, Listeria monocytogenes EGD-e
auggccucguaaucuug

SEQ ID NO: 779126 - RNA, 21 nt, Listeria monocytogenes EGD-e
auggcugggaguuuuuuauua

SEQ ID NO: 779127 - RNA, 15 nt, Listeria monocytogenes EGD-e
augguucaaaaagau

SEQ ID NO: 779128 - RNA, 13 nt, Listeria monocytogenes EGD-e
auuauugcuuuuu

SEQ ID NO: 779129 - RNA, 14 nt, Listeria monocytogenes EGD-e
auuauuuugcuaaa

SEQ ID NO: 779130 - RNA, 14 nt, Listeria monocytogenes EGD-e
auuauuuuuguaau

SEQ ID NO: 779131 - RNA, 15 nt, Listeria monocytogenes EGD-e
auucaaagcuacuuu

SEQ ID NO: 779132 - RNA, 17 nt, Listeria monocytogenes EGD-e
auuaccucgcuuuaaua

SEQ ID NO: 779133 - RNA, 16 nt, Listeria monocytogenes EGD-e
auuacuagcuuugucu

SEQ ID NO: 779134 - RNA, 14 nt, Listeria monocytogenes EGD-e
auuacucgguucaa

SEQ ID NO: 779135 - RNA, 16 nt, Listeria monocytogenes EGD-e
auuacuccaaaauaaa

SEQ ID NO: 779136 - RNA, 19 nt, Listeria monocytogenes EGD-e
auuacuccaaaauaaaaug

SEQ ID NO: 779137 - RNA, 19 nt, Listeria monocytogenes EGD-e
auuacauuaaguuuacaau

SEQ ID NO: 779138 - RNA, 14 nt, Listeria monocytogenes EGD-e
aaaagcaaugagac

SEQ ID NO: 779139 - RNA, 15 nt, Listeria monocytogenes EGD-e
auuagacaaaaagaa

SEQ ID NO: 779140 - RNA, 23 nt, Listeria monocytogenes EGD-e
auuagacauauaucuuaggaauu

SEQ ID NO: 779141 - RNA, 14 nt, Listeria monocytogenes EGD-e
auuagaaaaucauu

SEQ ID NO: 779142 - RNA, 12 nt, Listeria monocytogenes EGD-e
auuacuuuaauu

SEQ ID NO: 779143 - RNA, 15 nt, Listeria monocytogenes EGD-e
augugaccuuaaauu

SEQ ID NO: 779144 - RNA, 14 nt, Listeria monocytogenes EGD-e
augucuuuuugugu

SEQ ID NO: 779145 - RNA, 21 nt, Listeria monocytogenes EGD-e
augucguaugcuuuaugaagu

SEQ ID NO: 779146 - RNA, 16 nt, Listeria monocytogenes EGD-e
auguuaaauucauuua

SEQ ID NO: 779147 - RNA, 17 nt, Listeria monocytogenes EGD-e
auuaaaaagcuuauuaa

SEQ ID NO: 779148 - RNA, 19 nt, Listeria monocytogenes EGD-e
auuaaaaaggaauuuuucc

SEQ ID NO: 779149 - RNA, 20 nt, Listeria monocytogenes EGD-e
auuaaaaaggaauuuuucca

SEQ ID NO: 779150 - RNA, 13 nt, Listeria monocytogenes EGD-e
auuaaauuauaca

SEQ ID NO: 779151 - RNA, 13 nt, Listeria monocytogenes EGD-e
aaaaggaaagugc

SEQ ID NO: 779152 - RNA, 17 nt, Listeria monocytogenes EGD-e
aaaaggacaagcccagc

SEQ ID NO: 779153 - RNA, 15 nt, Listeria monocytogenes EGD-e
auucaucuaauuuag

SEQ ID NO: 779154 - RNA, 21 nt, Listeria monocytogenes EGD-e
auuccguucauuugaaaaagg

SEQ ID NO: 779155 - RNA, 23 nt, Listeria monocytogenes EGD-e
auuccguucauuugaaaaagggc

SEQ ID NO: 779156 - RNA, 11 nt, Listeria monocytogenes EGD-e
auuccuccaau

SEQ ID NO: 779157 - RNA, 13 nt, Listeria monocytogenes EGD-e
auuccucaaugag

SEQ ID NO: 779158 - RNA, 15 nt, Listeria monocytogenes EGD-e
auuccucaaugagga

SEQ ID NO: 779159 - RNA, 22 nt, Listeria monocytogenes EGD-e
auucccacagaucaaaagcaaa

SEQ ID NO: 779160 - RNA, 14 nt, Listeria monocytogenes EGD-e
auuccaaaaucgca

SEQ ID NO: 779161 - RNA, 18 nt, Listeria monocytogenes EGD-e
auucugaaaugauuuuua

SEQ ID NO: 779162 - RNA, 19 nt, Listeria monocytogenes EGD-e
auucugaaaugauuuuuau

SEQ ID NO: 779163 - RNA, 14 nt, Listeria monocytogenes EGD-e
auucugcuaacagc

SEQ ID NO: 779164 - RNA, 17 nt, Listeria monocytogenes EGD-e
auucuugaauguuuuca

SEQ ID NO: 779165 - RNA, 21 nt, Listeria monocytogenes EGD-e
auucuucuaaaauaacauccg

SEQ ID NO: 779166 - RNA, 11 nt, Listeria monocytogenes EGD-e
auugauggauu

SEQ ID NO: 779167 - RNA, 13 nt, Listeria monocytogenes EGD-e
auucuuuuucuuc

SEQ ID NO: 779168 - RNA, 15 nt, Listeria monocytogenes EGD-e
auucuuuuucuucuu

SEQ ID NO: 779169 - RNA, 13 nt, Listeria monocytogenes EGD-e
auugcgucacaau

SEQ ID NO: 779170 - RNA, 19 nt, Listeria monocytogenes EGD-e
auuguaccgcuugauguuu

SEQ ID NO: 779171 - RNA, 21 nt, Listeria monocytogenes EGD-e
auuguagcucauuacaaaauu

SEQ ID NO: 779172 - RNA, 22 nt, Listeria monocytogenes EGD-e
auuguagcucauuacaaaauuu

SEQ ID NO: 779173 - RNA, 22 nt, Listeria monocytogenes EGD-e
aaaagguauccuuauuaauagu

SEQ ID NO: 779174 - RNA, 22 nt, Listeria monocytogenes EGD-e
auugguuuuacaccauuuuguu

SEQ ID NO: 779175 - RNA, 21 nt, Listeria monocytogenes EGD-e
auuguucuuuaaaaacaguac

SEQ ID NO: 779176 - RNA, 22 nt, Listeria monocytogenes EGD-e
auuguuccagcuguaucaauga

SEQ ID NO: 779177 - RNA, 14 nt, Listeria monocytogenes EGD-e
auuuaucaaacaaa

SEQ ID NO: 779178 - RNA, 14 nt, Listeria monocytogenes EGD-e
auuuaauaaauuag

SEQ ID NO: 779179 - RNA, 20 nt, Listeria monocytogenes EGD-e
auuuaacaucagauuaaaua

SEQ ID NO: 779180 - RNA, 23 nt, Listeria monocytogenes EGD-e
auuuaacaucagauuaaauauag

SEQ ID NO: 779181 - RNA, 20 nt, Listeria monocytogenes EGD-e
auuuaauaguagcacuccuu

SEQ ID NO: 779182 - RNA, 21 nt, Listeria monocytogenes EGD-e
auuucaaucgcagcagauuuu

SEQ ID NO: 779183 - RNA, 22 nt, Listeria monocytogenes EGD-e
auuucaaucgcagcagauuuug

SEQ ID NO: 779184 - RNA, 15 nt, Listeria monocytogenes EGD-e
auuuauuuucccucc

SEQ ID NO: 779185 - RNA, 13 nt, Listeria monocytogenes EGD-e
auuugaaaaaggg

SEQ ID NO: 779186 - RNA, 23 nt, Listeria monocytogenes EGD-e
auuucuggguguuuauucauaua

SEQ ID NO: 779187 - RNA, 18 nt, Listeria monocytogenes EGD-e
auuuuaacggcuucaaaa

SEQ ID NO: 779188 - RNA, 14 nt, Listeria monocytogenes EGD-e
auuugauacauauu

SEQ ID NO: 779189 - RNA, 15 nt, Listeria monocytogenes EGD-e
auuuuagcuuauuaa

SEQ ID NO: 779190 - RNA, 20 nt, Listeria monocytogenes EGD-e
auuuucaucccuuuuuucau

SEQ ID NO: 779191 - RNA, 22 nt, Listeria monocytogenes EGD-e
auuuuaucugguacguuuuuua

SEQ ID NO: 779192 - RNA, 21 nt, Listeria monocytogenes EGD-e
auuuuauuuuuauuauaaaaa

SEQ ID NO: 779193 - RNA, 12 nt, Listeria monocytogenes EGD-e
auuuuauuuuua

SEQ ID NO: 779194 - RNA, 23 nt, Listeria monocytogenes EGD-e
auuuuucgauuggcgauucuuca

SEQ ID NO: 779195 - RNA, 12 nt, Listeria monocytogenes EGD-e
auuuuucuucug

SEQ ID NO: 779196 - RNA, 16 nt, Listeria monocytogenes EGD-e
auuuuucuuucuuuug

SEQ ID NO: 779197 - RNA, 17 nt, Listeria monocytogenes EGD-e
auuuuguucuaagaauu

SEQ ID NO: 779198 - RNA, 15 nt, Listeria monocytogenes EGD-e
auuuuucaaaucaau

SEQ ID NO: 779199 - RNA, 16 nt, Listeria monocytogenes EGD-e
auuuucauuuguuucu

SEQ ID NO: 779200 - RNA, 16 nt, Listeria monocytogenes EGD-e
auuuucuauuccuccu

SEQ ID NO: 779201 - RNA, 22 nt, Listeria monocytogenes EGD-e
caauucucguaauguugcauag

SEQ ID NO: 779202 - RNA, 19 nt, Listeria monocytogenes EGD-e
caauuucgccguuggaagu

SEQ ID NO: 779203 - RNA, 18 nt, Listeria monocytogenes EGD-e
caauggaaugacaaaauu

SEQ ID NO: 779204 - RNA, 16 nt, Listeria monocytogenes EGD-e
caaugaccuaguuaau

SEQ ID NO: 779205 - RNA, 13 nt, Listeria monocytogenes EGD-e
caauguauacagg

SEQ ID NO: 779206 - RNA, 16 nt, Listeria monocytogenes EGD-e
cacagcaauggccgga

SEQ ID NO: 779207 - RNA, 16 nt, Listeria monocytogenes EGD-e
cacagcagaaacuuuc

SEQ ID NO: 779208 - RNA, 22 nt, Listeria monocytogenes EGD-e
cacaagaagggcuuuuuuccuu

SEQ ID NO: 779209 - RNA, 15 nt, Listeria monocytogenes EGD-e
cacaaguuccaaaaa

SEQ ID NO: 779210 - RNA, 14 nt, Listeria monocytogenes EGD-e
cacaaguaacucuu

SEQ ID NO: 779211 - RNA, 22 nt, Listeria monocytogenes EGD-e
caauuucuucgugcgcaacauu

SEQ ID NO: 779212 - RNA, 21 nt, Listeria monocytogenes EGD-e
cacauccgcaugaauuuuugc

SEQ ID NO: 779213 - RNA, 18 nt, Listeria monocytogenes EGD-e
cacaucacgagaaagcca

SEQ ID NO: 779214 - RNA, 20 nt, Listeria monocytogenes EGD-e
cacagcguauccaccaaaaa

SEQ ID NO: 779215 - RNA, 18 nt, Listeria monocytogenes EGD-e
caccaacaauuacuucca

SEQ ID NO: 779216 - RNA, 21 nt, Listeria monocytogenes EGD-e
aaaauaaaauggauaaaaaaa

SEQ ID NO: 779217 - RNA, 19 nt, Listeria monocytogenes EGD-e
aaaaguuaagaagcggaag

SEQ ID NO: 779218 - RNA, 13 nt, Listeria monocytogenes EGD-e
caccacuucuucc

SEQ ID NO: 779219 - RNA, 20 nt, Listeria monocytogenes EGD-e
caccacucuuuuauaaaaau

SEQ ID NO: 779220 - RNA, 21 nt, Listeria monocytogenes EGD-e
aaaauagacgaccauauaauc

SEQ ID NO: 779221 - RNA, 24 nt, Listeria monocytogenes EGD-e
caauaauaguugauauauucacau

SEQ ID NO: 779222 - RNA, 20 nt, Listeria monocytogenes EGD-e
caaguuuuuuaauuuuucuu

SEQ ID NO: 779223 - RNA, 12 nt, Listeria monocytogenes EGD-e
caauaaaguuaa

SEQ ID NO: 779224 - RNA, 21 nt, Listeria monocytogenes EGD-e
caaguucaugacgcgcaucuu

SEQ ID NO: 779225 - RNA, 17 nt, Listeria monocytogenes EGD-e
caagcuucccguuaauc

SEQ ID NO: 779226 - RNA, 23 nt, Listeria monocytogenes EGD-e
caaggagcggcucagauccuuca

SEQ ID NO: 779227 - RNA, 15 nt, Listeria monocytogenes EGD-e
caagugcuaaaauaa

SEQ ID NO: 779228 - RNA, 17 nt, Listeria monocytogenes EGD-e
caaguccgucaagccca

SEQ ID NO: 779229 - RNA, 18 nt, Listeria monocytogenes EGD-e
caaguccgucaagcccag

SEQ ID NO: 779230 - RNA, 20 nt, Listeria monocytogenes EGD-e
caagugaacguacaacuaaa

SEQ ID NO: 779231 - RNA, 21 nt, Listeria monocytogenes EGD-e
caaucaauuuacguuguucua

SEQ ID NO: 779232 - RNA, 17 nt, Listeria monocytogenes EGD-e
caauaucuuuauuuuuu

SEQ ID NO: 779233 - RNA, 18 nt, Listeria monocytogenes EGD-e
caaucgccaguugcugaa

SEQ ID NO: 779234 - RNA, 14 nt, Listeria monocytogenes EGD-e
caaucgcagcagau

SEQ ID NO: 779235 - RNA, 13 nt, Listeria monocytogenes EGD-e
caauccauuuuuc

SEQ ID NO: 779236 - RNA, 16 nt, Listeria monocytogenes EGD-e
caaucccagcuuuucc

SEQ ID NO: 779237 - RNA, 14 nt, Listeria monocytogenes EGD-e
caacuucacuaaca

SEQ ID NO: 779238 - RNA, 14 nt, Listeria monocytogenes EGD-e
caacuucaaaauua

SEQ ID NO: 779239 - RNA, 17 nt, Listeria monocytogenes EGD-e
caacuucaaaauuacua

SEQ ID NO: 779240 - RNA, 20 nt, Listeria monocytogenes EGD-e
caagaauaaugacgccacca

SEQ ID NO: 779241 - RNA, 22 nt, Listeria monocytogenes EGD-e
caagcgacauuaaauagccuga

SEQ ID NO: 779242 - RNA, 23 nt, Listeria monocytogenes EGD-e
caagccuaggcucucuucgccac

SEQ ID NO: 779243 - RNA, 16 nt, Listeria monocytogenes EGD-e
caagccguauucuguu

SEQ ID NO: 779244 - RNA, 19 nt, Listeria monocytogenes EGD-e
caacucucuucagaaagug

SEQ ID NO: 779245 - RNA, 22 nt, Listeria monocytogenes EGD-e
caacguguaccuuauuaacuaa

SEQ ID NO: 779246 - RNA, 23 nt, Listeria monocytogenes EGD-e
caacgguaaacaacccauuugca

SEQ ID NO: 779247 - RNA, 20 nt, Listeria monocytogenes EGD-e
caacgcgcguauccacauaa

SEQ ID NO: 779248 - RNA, 20 nt, Listeria monocytogenes EGD-e
caaauuguaccgcuugaugu

SEQ ID NO: 779249 - RNA, 20 nt, Listeria monocytogenes EGD-e
caaauucugaaaugauuuuu

SEQ ID NO: 779250 - RNA, 17 nt, Listeria monocytogenes EGD-e
caaaucuggauaaaaau

SEQ ID NO: 779251 - RNA, 18 nt, Listeria monocytogenes EGD-e
caaaucuggauaaaaaua

SEQ ID NO: 779252 - RNA, 19 nt, Listeria monocytogenes EGD-e
caaaucuggauaaaaauaa

SEQ ID NO: 779253 - RNA, 22 nt, Listeria monocytogenes EGD-e
caaaugcacagcagaaacuuuc

SEQ ID NO: 779254 - RNA, 16 nt, Listeria monocytogenes EGD-e
caaccauuuuguucuc

SEQ ID NO: 779255 - RNA, 15 nt, Listeria monocytogenes EGD-e
caacauucaaaucac

SEQ ID NO: 779256 - RNA, 16 nt, Listeria monocytogenes EGD-e
caacauucaaaucacc

SEQ ID NO: 779257 - RNA, 21 nt, Listeria monocytogenes EGD-e
caacauucaaaucaccacaaa

SEQ ID NO: 779258 - RNA, 18 nt, Listeria monocytogenes EGD-e
caacaugcguaaacuuuu

SEQ ID NO: 779259 - RNA, 23 nt, Listeria monocytogenes EGD-e
caaauuucuguuaugaacagaag

SEQ ID NO: 779260 - RNA, 13 nt, Listeria monocytogenes EGD-e
caacaaagaagaa

SEQ ID NO: 779261 - RNA, 14 nt, Listeria monocytogenes EGD-e
caacaaagaagaaa

SEQ ID NO: 779262 - RNA, 15 nt, Listeria monocytogenes EGD-e
caaacaaaguaccaa

SEQ ID NO: 779263 - RNA, 15 nt, Listeria monocytogenes EGD-e
caaaccaaauaccga

SEQ ID NO: 779264 - RNA, 15 nt, Listeria monocytogenes EGD-e
caaacgcuuuuucaa

SEQ ID NO: 779265 - RNA, 14 nt, Listeria monocytogenes EGD-e
caaagaagaagacg

SEQ ID NO: 779266 - RNA, 19 nt, Listeria monocytogenes EGD-e
caaagacgcuuuuuucaaa

SEQ ID NO: 779267 - RNA, 17 nt, Listeria monocytogenes EGD-e
caaaaggacaagcccag

SEQ ID NO: 779268 - RNA, 17 nt, Listeria monocytogenes EGD-e
caaaaguggaaauguuc

SEQ ID NO: 779269 - RNA, 12 nt, Listeria monocytogenes EGD-e
caaaagucacag

SEQ ID NO: 779270 - RNA, 22 nt, Listeria monocytogenes EGD-e
caaaaucgcauccucaaacguc

SEQ ID NO: 779271 - RNA, 17 nt, Listeria monocytogenes EGD-e
caaaauuacuauuugga

SEQ ID NO: 779272 - RNA, 15 nt, Listeria monocytogenes EGD-e
caaaauucaguuuau

SEQ ID NO: 779273 - RNA, 15 nt, Listeria monocytogenes EGD-e
caaaaugguuucuua

SEQ ID NO: 779274 - RNA, 19 nt, Listeria monocytogenes EGD-e
caaaaugguuucuuaaaua

SEQ ID NO: 779275 - RNA, 15 nt, Listeria monocytogenes EGD-e
caaaaucuuuaaaca

SEQ ID NO: 779276 - RNA, 20 nt, Listeria monocytogenes EGD-e
caaaaccucuuuuuuuauac

SEQ ID NO: 779277 - RNA, 23 nt, Listeria monocytogenes EGD-e
caaaaagauuauggaaaaaucca

SEQ ID NO: 779278 - RNA, 17 nt, Listeria monocytogenes EGD-e
caaaacucucuuucugc

SEQ ID NO: 779279 - RNA, 16 nt, Listeria monocytogenes EGD-e
caaaagcaaaaaagua

SEQ ID NO: 779280 - RNA, 23 nt, Listeria monocytogenes EGD-e
aucaugccagcuucuuccauuug

SEQ ID NO: 779281 - RNA, 14 nt, Listeria monocytogenes EGD-e
aucaucuucucgaa

SEQ ID NO: 779282 - RNA, 13 nt, Listeria monocytogenes EGD-e
aucauaaucccag

SEQ ID NO: 779283 - RNA, 20 nt, Listeria monocytogenes EGD-e
aucauggaaacgacauccuu

SEQ ID NO: 779284 - RNA, 15 nt, Listeria monocytogenes EGD-e
aucaugccuucaaac

SEQ ID NO: 779285 - RNA, 16 nt, Listeria monocytogenes EGD-e
aucaugccuucaaaca

SEQ ID NO: 779286 - RNA, 16 nt, Listeria monocytogenes EGD-e
aaaacugaacaaagaa

SEQ ID NO: 779287 - RNA, 14 nt, Listeria monocytogenes EGD-e
auccagcgucuaaa

SEQ ID NO: 779288 - RNA, 16 nt, Listeria monocytogenes EGD-e
auccagcguuaaucuu

SEQ ID NO: 779289 - RNA, 17 nt, Listeria monocytogenes EGD-e
auccacgauggaaccau

SEQ ID NO: 779290 - RNA, 16 nt, Listeria monocytogenes EGD-e
aucauugcuuuguguu

SEQ ID NO: 779291 - RNA, 13 nt, Listeria monocytogenes EGD-e
auccauuuuucuu

SEQ ID NO: 779292 - RNA, 13 nt, Listeria monocytogenes EGD-e
aucccacaaaaaa

SEQ ID NO: 779293 - RNA, 15 nt, Listeria monocytogenes EGD-e
aucccacaaaaaaua

SEQ ID NO: 779294 - RNA, 18 nt, Listeria monocytogenes EGD-e
auccgucacgucccauug

SEQ ID NO: 779295 - RNA, 19 nt, Listeria monocytogenes EGD-e
auccuaacuccugcauugu

SEQ ID NO: 779296 - RNA, 17 nt, Listeria monocytogenes EGD-e
auccucaaacgucauuc

SEQ ID NO: 779297 - RNA, 22 nt, Listeria monocytogenes EGD-e
auccucauauuuggccaauuaa

SEQ ID NO: 779298 - RNA, 20 nt, Listeria monocytogenes EGD-e
auccuucagccaauucuucc

SEQ ID NO: 779299 - RNA, 23 nt, Listeria monocytogenes EGD-e
aucgauguuaccacgaguugcuu

SEQ ID NO: 779300 - RNA, 13 nt, Listeria monocytogenes EGD-e
aucgcagggcaga

SEQ ID NO: 779301 - RNA, 18 nt, Listeria monocytogenes EGD-e
aucgcagggcagaaaaca

SEQ ID NO: 779302 - RNA, 21 nt, Listeria monocytogenes EGD-e
aucgcagggcagaaaacagaa

SEQ ID NO: 779303 - RNA, 12 nt, Listeria monocytogenes EGD-e
aucguugugcuu

SEQ ID NO: 779304 - RNA, 15 nt, Listeria monocytogenes EGD-e
aucguuuuaaagcuu

SEQ ID NO: 779305 - RNA, 21 nt, Listeria monocytogenes EGD-e
aucuaagucaucggcuuuuuu

SEQ ID NO: 779306 - RNA, 19 nt, Listeria monocytogenes EGD-e
aucuccgaauacuuucaau

SEQ ID NO: 779307 - RNA, 15 nt, Listeria monocytogenes EGD-e
aucuggauaaaaaua

SEQ ID NO: 779308 - RNA, 16 nt, Listeria monocytogenes EGD-e
aucuggauaaaaauaa

SEQ ID NO: 779309 - RNA, 16 nt, Listeria monocytogenes EGD-e
aucucuucauuuuucu

SEQ ID NO: 779310 - RNA, 13 nt, Listeria monocytogenes EGD-e
aucuucuugcuuc

SEQ ID NO: 779311 - RNA, 13 nt, Listeria monocytogenes EGD-e
aucuguaaaaaua

SEQ ID NO: 779312 - RNA, 16 nt, Listeria monocytogenes EGD-e
aucuguaaaaauaaau

SEQ ID NO: 779313 - RNA, 14 nt, Listeria monocytogenes EGD-e
aucuguuccuuugc

SEQ ID NO: 779314 - RNA, 18 nt, Listeria monocytogenes EGD-e
aucuucuagcgucacaau

SEQ ID NO: 779315 - RNA, 22 nt, Listeria monocytogenes EGD-e
aucuguucuaaacguucuuccu

SEQ ID NO: 779316 - RNA, 13 nt, Listeria monocytogenes EGD-e
aucuuuuccuucu

SEQ ID NO: 779317 - RNA, 15 nt, Listeria monocytogenes EGD-e
aucuuuugagauaau

SEQ ID NO: 779318 - RNA, 16 nt, Listeria monocytogenes EGD-e
aucuuuaaacaagcuu

SEQ ID NO: 779319 - RNA, 14 nt, Listeria monocytogenes EGD-e
aucuuuauaaaaug

SEQ ID NO: 779320 - RNA, 18 nt, Listeria monocytogenes EGD-e
aucuuggcaugaugaaaa

SEQ ID NO: 779321 - RNA, 13 nt, Listeria monocytogenes EGD-e
augaauagauauu

SEQ ID NO: 779322 - RNA, 20 nt, Listeria monocytogenes EGD-e
augaauauuagaaaaucauu

SEQ ID NO: 779323 - RNA, 11 nt, Listeria monocytogenes EGD-e
augaauuacuu

SEQ ID NO: 779324 - RNA, 13 nt, Listeria monocytogenes EGD-e
augaauucugggu

SEQ ID NO: 779325 - RNA, 17 nt, Listeria monocytogenes EGD-e
augaauucugggugaua

SEQ ID NO: 779326 - RNA, 22 nt, Listeria monocytogenes EGD-e
aucuuuuucuugcuuuccagca

SEQ ID NO: 779327 - RNA, 21 nt, Listeria monocytogenes EGD-e
augaaacuuuaacaaaaguca

SEQ ID NO: 779328 - RNA, 18 nt, Listeria monocytogenes EGD-e
augagaguuauaaagaaa

SEQ ID NO: 779329 - RNA, 19 nt, Listeria monocytogenes EGD-e
augagaguuauaaagaaau

SEQ ID NO: 779330 - RNA, 21 nt, Listeria monocytogenes EGD-e
augagaguuauaaagaaauaa

SEQ ID NO: 779331 - RNA, 16 nt, Listeria monocytogenes EGD-e
augacgcucuucuaca

SEQ ID NO: 779332 - RNA, 17 nt, Listeria monocytogenes EGD-e
auauggacauacuucau

SEQ ID NO: 779333 - RNA, 22 nt, Listeria monocytogenes EGD-e
auauggacauacuucaugugcu

SEQ ID NO: 779334 - RNA, 22 nt, Listeria monocytogenes EGD-e
auaugcagguaaaacagcaagu

SEQ ID NO: 779335 - RNA, 19 nt, Listeria monocytogenes EGD-e
auauuaaugucaauuauuc

SEQ ID NO: 779336 - RNA, 16 nt, Listeria monocytogenes EGD-e
auauuagaaaaucauu

SEQ ID NO: 779337 - RNA, 23 nt, Listeria monocytogenes EGD-e
aucaacgggcgcuuucacaucuu

SEQ ID NO: 779338 - RNA, 15 nt, Listeria monocytogenes EGD-e
aucaaccacuuuugc

SEQ ID NO: 779339 - RNA, 15 nt, Listeria monocytogenes EGD-e
aucaaaugcacagca

SEQ ID NO: 779340 - RNA, 23 nt, Listeria monocytogenes EGD-e
aucaaaugcacagcagaaacuuu

SEQ ID NO: 779341 - RNA, 13 nt, Listeria monocytogenes EGD-e
aucaaauaaccau

SEQ ID NO: 779342 - RNA, 22 nt, Listeria monocytogenes EGD-e
aucaaauaaccauuauuuggaa

SEQ ID NO: 779343 - RNA, 17 nt, Listeria monocytogenes EGD-e
aucaaauccaagcacau

SEQ ID NO: 779344 - RNA, 22 nt, Listeria monocytogenes EGD-e
aucaaauccaagcacaugucca

SEQ ID NO: 779345 - RNA, 13 nt, Listeria monocytogenes EGD-e
auauucuucuaaa

SEQ ID NO: 779346 - RNA, 23 nt, Listeria monocytogenes EGD-e
auauucuucugucacaucuguuc

SEQ ID NO: 779347 - RNA, 16 nt, Listeria monocytogenes EGD-e
aaaacgacagauaaau

SEQ ID NO: 779348 - RNA, 15 nt, Listeria monocytogenes EGD-e
aaaacggaucuuucu

SEQ ID NO: 779349 - RNA, 17 nt, Listeria monocytogenes EGD-e
aaaacggaucuuucuca

SEQ ID NO: 779350 - RNA, 16 nt, Listeria monocytogenes EGD-e
aucacuaauuagcaua

SEQ ID NO: 779351 - RNA, 20 nt, Listeria monocytogenes EGD-e
aucaccaacaauuacuucca

SEQ ID NO: 779352 - RNA, 13 nt, Listeria monocytogenes EGD-e
auaauuauuuuug

SEQ ID NO: 779353 - RNA, 13 nt, Listeria monocytogenes EGD-e
auaauuccauuua

SEQ ID NO: 779354 - RNA, 21 nt, Listeria monocytogenes EGD-e
auaauucggcaaacagcuuuu

SEQ ID NO: 779355 - RNA, 13 nt, Listeria monocytogenes EGD-e
auacauugaaaaa

SEQ ID NO: 779356 - RNA, 23 nt, Listeria monocytogenes EGD-e
auacccggcugggaguuuuuuau

SEQ ID NO: 779357 - RNA, 19 nt, Listeria monocytogenes EGD-e
auagaagguauugagugcu

SEQ ID NO: 779358 - RNA, 23 nt, Listeria monocytogenes EGD-e
auagaagguauugagugcuuucg

SEQ ID NO: 779359 - RNA, 19 nt, Listeria monocytogenes EGD-e
auacuguuuuugauuuaau

SEQ ID NO: 779360 - RNA, 12 nt, Listeria monocytogenes EGD-e
auacccuuuuuu

SEQ ID NO: 779361 - RNA, 21 nt, Listeria monocytogenes EGD-e
auacgugaaaaucuuguugcg

SEQ ID NO: 779362 - RNA, 13 nt, Listeria monocytogenes EGD-e
auacucuuuaaau

SEQ ID NO: 779363 - RNA, 21 nt, Listeria monocytogenes EGD-e
auauagucuacuuuuaaaauu

SEQ ID NO: 779364 - RNA, 11 nt, Listeria monocytogenes EGD-e
auauagcuuca

SEQ ID NO: 779365 - RNA, 15 nt, Listeria monocytogenes EGD-e
auauaauuuuuucau

SEQ ID NO: 779366 - RNA, 19 nt, Listeria monocytogenes EGD-e
auagucuacuuuuaaaauu

SEQ ID NO: 779367 - RNA, 13 nt, Listeria monocytogenes EGD-e
auauauucaaaau

SEQ ID NO: 779368 - RNA, 10 nt, Listeria monocytogenes EGD-e
auauauguag

SEQ ID NO: 779369 - RNA, 16 nt, Listeria monocytogenes EGD-e
auauccuaacuccugc

SEQ ID NO: 779370 - RNA, 17 nt, Listeria monocytogenes EGD-e
auauccuaacuccugca

SEQ ID NO: 779371 - RNA, 16 nt, Listeria monocytogenes EGD-e
auaucaccaacaauua

SEQ ID NO: 779372 - RNA, 15 nt, Listeria monocytogenes EGD-e
auaggaauuuggugc

SEQ ID NO: 779373 - RNA, 16 nt, Listeria monocytogenes EGD-e
auagcuuuaucuuuuc

SEQ ID NO: 779374 - RNA, 13 nt, Listeria monocytogenes EGD-e
auagcuucaaacg

SEQ ID NO: 779375 - RNA, 14 nt, Listeria monocytogenes EGD-e
auagcuuugucuua

SEQ ID NO: 779376 - RNA, 22 nt, Listeria monocytogenes EGD-e
auagguugggcugcaacaacua

SEQ ID NO: 779377 - RNA, 15 nt, Listeria monocytogenes EGD-e
auaguaaaaaaacua

SEQ ID NO: 779378 - RNA, 17 nt, Listeria monocytogenes EGD-e
auagguaacaucuucca

SEQ ID NO: 779379 - RNA, 24 nt, Listeria monocytogenes EGD-e
auagucauaagcuaacaacaagca

SEQ ID NO: 779380 - RNA, 21 nt, Listeria monocytogenes EGD-e
agucacagcguauccaccaaa

SEQ ID NO: 779381 - RNA, 15 nt, Listeria monocytogenes EGD-e
aguccaaagagccau

SEQ ID NO: 779382 - RNA, 15 nt, Listeria monocytogenes EGD-e
aguccaccagcuacu

SEQ ID NO: 779383 - RNA, 19 nt, Listeria monocytogenes EGD-e
agucaugacagcaucuuuu

SEQ ID NO: 779384 - RNA, 20 nt, Listeria monocytogenes EGD-e
agucaugacagcaucuuuuu

SEQ ID NO: 779385 - RNA, 13 nt, Listeria monocytogenes EGD-e
agucuauuucagc

SEQ ID NO: 779386 - RNA, 15 nt, Listeria monocytogenes EGD-e
aguggcugaaacaau

SEQ ID NO: 779387 - RNA, 19 nt, Listeria monocytogenes EGD-e
agugggcaaccuaguuuua

SEQ ID NO: 779388 - RNA, 12 nt, Listeria monocytogenes EGD-e
aguuaagaagcg

SEQ ID NO: 779389 - RNA, 15 nt, Listeria monocytogenes EGD-e
aguuaacgguuuuca

SEQ ID NO: 779390 - RNA, 23 nt, Listeria monocytogenes EGD-e
aguuaaacaaacacaaaaugcuc

SEQ ID NO: 779391 - RNA, 22 nt, Listeria monocytogenes EGD-e
agugugguuuacucccuuuuuc

SEQ ID NO: 779392 - RNA, 19 nt, Listeria monocytogenes EGD-e
aguguaaucuugaugccau

SEQ ID NO: 779393 - RNA, 19 nt, Listeria monocytogenes EGD-e
aguugcuuuuguuuuccuu

SEQ ID NO: 779394 - RNA, 18 nt, Listeria monocytogenes EGD-e
aguugcugcuaaaggcaa

SEQ ID NO: 779395 - RNA, 20 nt, Listeria monocytogenes EGD-e
aguugcuaguugcauaccua

SEQ ID NO: 779396 - RNA, 22 nt, Listeria monocytogenes EGD-e
aguuaggcuuccuuguuuuuug

SEQ ID NO: 779397 - RNA, 17 nt, Listeria monocytogenes EGD-e
aguucaacuacuucaac

SEQ ID NO: 779398 - RNA, 21 nt, Listeria monocytogenes EGD-e
aguucaacuacuucaacuaaa

SEQ ID NO: 779399 - RNA, 20 nt, Listeria monocytogenes EGD-e
aguuauagcggucaaucauu

SEQ ID NO: 779400 - RNA, 12 nt, Listeria monocytogenes EGD-e
aguuauuucuuu

SEQ ID NO: 779401 - RNA, 22 nt, Listeria monocytogenes EGD-e
auaaacguuccaguuaaacaaa

SEQ ID NO: 779402 - RNA, 22 nt, Listeria monocytogenes EGD-e
auaaacuaauuacuaaaaaggu

SEQ ID NO: 779403 - RNA, 17 nt, Listeria monocytogenes EGD-e
auaaagcuaagcauuau

SEQ ID NO: 779404 - RNA, 16 nt, Listeria monocytogenes EGD-e
auaaauuacugaauaa

SEQ ID NO: 779405 - RNA, 13 nt, Listeria monocytogenes EGD-e
auaaaguuaacuu

SEQ ID NO: 779406 - RNA, 13 nt, Listeria monocytogenes EGD-e
auaaaguuuuuug

SEQ ID NO: 779407 - RNA, 14 nt, Listeria monocytogenes EGD-e
auaaauauuuugca

SEQ ID NO: 779408 - RNA, 20 nt, Listeria monocytogenes EGD-e
aguuguaaaccguaacuguu

SEQ ID NO: 779409 - RNA, 17 nt, Listeria monocytogenes EGD-e
aguugguaguuuuaaau

SEQ ID NO: 779410 - RNA, 20 nt, Listeria monocytogenes EGD-e
auaaaaaaagccaaugaccu

SEQ ID NO: 779411 - RNA, 20 nt, Listeria monocytogenes EGD-e
auaaaacaaaagauagacac

SEQ ID NO: 779412 - RNA, 14 nt, Listeria monocytogenes EGD-e
auaaaaauacauuu

SEQ ID NO: 779413 - RNA, 21 nt, Listeria monocytogenes EGD-e
auaaaaaguaacauagcuaca

SEQ ID NO: 779414 - RNA, 23 nt, Listeria monocytogenes EGD-e
auaaaaaguaacauagcuacaau

SEQ ID NO: 779415 - RNA, 18 nt, Listeria monocytogenes EGD-e
auaaaagaggauuuucca

SEQ ID NO: 779416 - RNA, 16 nt, Listeria monocytogenes EGD-e
auaaaagcaugaauuu

SEQ ID NO: 779417 - RNA, 21 nt, Listeria monocytogenes EGD-e
auaaaaccauucaucuaauuu

SEQ ID NO: 779418 - RNA, 18 nt, Listeria monocytogenes EGD-e
auaaucuccgcaaucauu

SEQ ID NO: 779419 - RNA, 21 nt, Listeria monocytogenes EGD-e
auaaugauuucuauaaaaaug

SEQ ID NO: 779420 - RNA, 16 nt, Listeria monocytogenes EGD-e
auaaugcagauuaacc

SEQ ID NO: 779421 - RNA, 11 nt, Listeria monocytogenes EGD-e
auaauuaacaa

SEQ ID NO: 779422 - RNA, 20 nt, Listeria monocytogenes EGD-e
auaaugugaccuuaaauuau

SEQ ID NO: 779423 - RNA, 18 nt, Listeria monocytogenes EGD-e
auaauauccauaaagcua

SEQ ID NO: 779424 - RNA, 16 nt, Listeria monocytogenes EGD-e
auaaguacuugaaaaa

SEQ ID NO: 779425 - RNA, 14 nt, Listeria monocytogenes EGD-e
auaaucaaauacau

SEQ ID NO: 779426 - RNA, 20 nt, Listeria monocytogenes EGD-e
auaauauuauaguuuucuac

SEQ ID NO: 779427 - RNA, 19 nt, Listeria monocytogenes EGD-e
auaaucaauaucuuuauuu

SEQ ID NO: 779428 - RNA, 15 nt, Listeria monocytogenes EGD-e
auaaucaagauuuug

SEQ ID NO: 779429 - RNA, 21 nt, Listeria monocytogenes EGD-e
auaaucaauccgccaaccagu

SEQ ID NO: 779430 - RNA, 16 nt, Listeria monocytogenes EGD-e
auaagcacaaauuauu

SEQ ID NO: 779431 - RNA, 14 nt, Listeria monocytogenes EGD-e
auaagcuucauaaa

SEQ ID NO: 779432 - RNA, 19 nt, Listeria monocytogenes EGD-e
auaagcggguguccaaaaa

SEQ ID NO: 779433 - RNA, 13 nt, Listeria monocytogenes EGD-e
auaacuacuauuu

SEQ ID NO: 779434 - RNA, 16 nt, Listeria monocytogenes EGD-e
auaacgaguaauggag

SEQ ID NO: 779435 - RNA, 15 nt, Listeria monocytogenes EGD-e
auaacuuuccagcgg

SEQ ID NO: 779436 - RNA, 15 nt, Listeria monocytogenes EGD-e
auaacuuuuuuucuu

SEQ ID NO: 779437 - RNA, 19 nt, Listeria monocytogenes EGD-e
auaacuuucaccaguuugu

SEQ ID NO: 779438 - RNA, 22 nt, Listeria monocytogenes EGD-e
auaacuugacgcguggaaagaa

SEQ ID NO: 779439 - RNA, 15 nt, Listeria monocytogenes EGD-e
auaagagaauaucua

SEQ ID NO: 779440 - RNA, 20 nt, Listeria monocytogenes EGD-e
agcucuuuuuuuauuuucau

SEQ ID NO: 779441 - RNA, 21 nt, Listeria monocytogenes EGD-e
agcuguuuucaacaaaacaaa

SEQ ID NO: 779442 - RNA, 16 nt, Listeria monocytogenes EGD-e
agcugcaacagauagu

SEQ ID NO: 779443 - RNA, 17 nt, Listeria monocytogenes EGD-e
agcuuuugaaaccauuc

SEQ ID NO: 779444 - RNA, 23 nt, Listeria monocytogenes EGD-e
aggaaacgaauaaaaucauaaua

SEQ ID NO: 779445 - RNA, 22 nt, Listeria monocytogenes EGD-e
aggauauuuuuuucgaaagaaa

SEQ ID NO: 779446 - RNA, 19 nt, Listeria monocytogenes EGD-e
aggcaaaucuuucggcaca

SEQ ID NO: 779447 - RNA, 14 nt, Listeria monocytogenes EGD-e
aggauuaaaauaaa

SEQ ID NO: 779448 - RNA, 20 nt, Listeria monocytogenes EGD-e
aggcucuuccuuuuguuuua

SEQ ID NO: 779449 - RNA, 16 nt, Listeria monocytogenes EGD-e
aggcucucuucgccac

SEQ ID NO: 779450 - RNA, 12 nt, Listeria monocytogenes EGD-e
aggcguaucuuu

SEQ ID NO: 779451 - RNA, 21 nt, Listeria monocytogenes EGD-e
aggcguaucuuuuccaaaaug

SEQ ID NO: 779452 - RNA, 15 nt, Listeria monocytogenes EGD-e
agggcagaaaacaga

SEQ ID NO: 779453 - RNA, 17 nt, Listeria monocytogenes EGD-e
agggcagaaaacagaaa

SEQ ID NO: 779454 - RNA, 18 nt, Listeria monocytogenes EGD-e
agggcagaaaacagaaag

SEQ ID NO: 779455 - RNA, 16 nt, Listeria monocytogenes EGD-e
aggucaggauuaaaag

SEQ ID NO: 779456 - RNA, 22 nt, Listeria monocytogenes EGD-e
agguuuuuuuaugcauaaaaaa

SEQ ID NO: 779457 - RNA, 22 nt, Listeria monocytogenes EGD-e
aguaacuaaaaaucauuuaaac

SEQ ID NO: 779458 - RNA, 16 nt, Listeria monocytogenes EGD-e
aguaacucuuccaaaa

SEQ ID NO: 779459 - RNA, 19 nt, Listeria monocytogenes EGD-e
aguaacucuuccaaaauca

SEQ ID NO: 779460 - RNA, 13 nt, Listeria monocytogenes EGD-e
aguaacuuuauca

SEQ ID NO: 779461 - RNA, 19 nt, Listeria monocytogenes EGD-e
aguaacuuuaucaagaaca

SEQ ID NO: 779462 - RNA, 13 nt, Listeria monocytogenes EGD-e
aguacaauuauag

SEQ ID NO: 779463 - RNA, 16 nt, Listeria monocytogenes EGD-e
accaacuucgagcagc

SEQ ID NO: 779464 - RNA, 13 nt, Listeria monocytogenes EGD-e
accaagaagagcu

SEQ ID NO: 779465 - RNA, 22 nt, Listeria monocytogenes EGD-e
accagugugguuuacucccuuu

SEQ ID NO: 779466 - RNA, 17 nt, Listeria monocytogenes EGD-e
accaucuuuuaucuucc

SEQ ID NO: 779467 - RNA, 21 nt, Listeria monocytogenes EGD-e
acccauaauauuauaguuuuc

SEQ ID NO: 779468 - RNA, 21 nt, Listeria monocytogenes EGD-e
accuaaauacguauuaccucg

SEQ ID NO: 779469 - RNA, 11 nt, Listeria monocytogenes EGD-e
accuaaagcau

SEQ ID NO: 779470 - RNA, 19 nt, Listeria monocytogenes EGD-e
accuauuugguacuuguga

SEQ ID NO: 779471 - RNA, 19 nt, Listeria monocytogenes EGD-e
accuucaucguuuaacaua

SEQ ID NO: 779472 - RNA, 20 nt, Listeria monocytogenes EGD-e
accuuugaaaacugaacaaa

SEQ ID NO: 779473 - RNA, 23 nt, Listeria monocytogenes EGD-e
accuuugaaaacugaacaaagaa

SEQ ID NO: 779474 - RNA, 14 nt, Listeria monocytogenes EGD-e
acgagcuacagcug

SEQ ID NO: 779475 - RNA, 18 nt, Listeria monocytogenes EGD-e
acgaccauauaaucaaua

SEQ ID NO: 779476 - RNA, 13 nt, Listeria monocytogenes EGD-e
acgaauccuugga

SEQ ID NO: 779477 - RNA, 14 nt, Listeria monocytogenes EGD-e
acgaauccuuggaa

SEQ ID NO: 779478 - RNA, 18 nt, Listeria monocytogenes EGD-e
acgaaucaagauuuugcu

SEQ ID NO: 779479 - RNA, 22 nt, Listeria monocytogenes EGD-e
acgaaagcaacaacugcuuucg

SEQ ID NO: 779480 - RNA, 22 nt, Listeria monocytogenes EGD-e
acgacaaaugguucacuuucuu

SEQ ID NO: 779481 - RNA, 16 nt, Listeria monocytogenes EGD-e
acgaucagccauuuua

SEQ ID NO: 779482 - RNA, 17 nt, Listeria monocytogenes EGD-e
acgccucgagauaaauu

SEQ ID NO: 779483 - RNA, 20 nt, Listeria monocytogenes EGD-e
acgcgcaucuucguauauuu

SEQ ID NO: 779484 - RNA, 14 nt, Listeria monocytogenes EGD-e
acgcgacaaaguaa

SEQ ID NO: 779485 - RNA, 18 nt, Listeria monocytogenes EGD-e
acggucuuuuuuucuuua

SEQ ID NO: 779486 - RNA, 18 nt, Listeria monocytogenes EGD-e
acguuccaguuaaacaaa

SEQ ID NO: 779487 - RNA, 23 nt, Listeria monocytogenes EGD-e
acguuccgauacaacaaaauaau

SEQ ID NO: 779488 - RNA, 15 nt, Listeria monocytogenes EGD-e
acucaaaguaacuuu

SEQ ID NO: 779489 - RNA, 22 nt, Listeria monocytogenes EGD-e
acuccaccaccuuugguaaaaa

SEQ ID NO: 779490 - RNA, 13 nt, Listeria monocytogenes EGD-e
acuccaaaauaaa

SEQ ID NO: 779491 - RNA, 18 nt, Listeria monocytogenes EGD-e
acucccuuuuuccacacu

SEQ ID NO: 779492 - RNA, 19 nt, Listeria monocytogenes EGD-e
acucggggugaaaaugagc

SEQ ID NO: 779493 - RNA, 14 nt, Listeria monocytogenes EGD-e
acugcaaucauuua

SEQ ID NO: 779494 - RNA, 16 nt, Listeria monocytogenes EGD-e
acugacuagaaauuaa

SEQ ID NO: 779495 - RNA, 16 nt, Listeria monocytogenes EGD-e
acucucauaagagaau

SEQ ID NO: 779496 - RNA, 16 nt, Listeria monocytogenes EGD-e
acugaacaaagaagaa

SEQ ID NO: 779497 - RNA, 23 nt, Listeria monocytogenes EGD-e
acugaacaaagaagaagacgaaa

SEQ ID NO: 779498 - RNA, 23 nt, Listeria monocytogenes EGD-e
acugguuuuuugaugcgaaaaau

SEQ ID NO: 779499 - RNA, 16 nt, Listeria monocytogenes EGD-e
acugugcucuuugcuu

SEQ ID NO: 779500 - RNA, 17 nt, Listeria monocytogenes EGD-e
acugucgcaaaaaucau

SEQ ID NO: 779501 - RNA, 14 nt, Listeria monocytogenes EGD-e
acuguuguuuaaua

SEQ ID NO: 779502 - RNA, 14 nt, Listeria monocytogenes EGD-e
acuguuuuugauuu

SEQ ID NO: 779503 - RNA, 15 nt, Listeria monocytogenes EGD-e
agcaacgguaaacaa

SEQ ID NO: 779504 - RNA, 15 nt, Listeria monocytogenes EGD-e
agcaacuucacuaac

SEQ ID NO: 779505 - RNA, 19 nt, Listeria monocytogenes EGD-e
agcaagagcaccaauaaaa

SEQ ID NO: 779506 - RNA, 20 nt, Listeria monocytogenes EGD-e
agcaagagcaccaauaaaac

SEQ ID NO: 779507 - RNA, 21 nt, Listeria monocytogenes EGD-e
agcaauuggaacaucuuugua

SEQ ID NO: 779508 - RNA, 13 nt, Listeria monocytogenes EGD-e
agcacagcuacca

SEQ ID NO: 779509 - RNA, 17 nt, Listeria monocytogenes EGD-e
agcagaagccccuugga

SEQ ID NO: 779510 - RNA, 20 nt, Listeria monocytogenes EGD-e
agcacuuacugcaaucauuu

SEQ ID NO: 779511 - RNA, 22 nt, Listeria monocytogenes EGD-e
aaaaccuaaauacguauuaccu

SEQ ID NO: 779512 - RNA, 17 nt, Listeria monocytogenes EGD-e
agcagggcuauuuuucc

SEQ ID NO: 779513 - RNA, 16 nt, Listeria monocytogenes EGD-e
agcaucgaauacuaac

SEQ ID NO: 779514 - RNA, 16 nt, Listeria monocytogenes EGD-e
agcauuauaaaaagua

SEQ ID NO: 779515 - RNA, 19 nt, Listeria monocytogenes EGD-e
agcauguccaagcacagca

SEQ ID NO: 779516 - RNA, 17 nt, Listeria monocytogenes EGD-e
agcaucuaguagcaauu

SEQ ID NO: 779517 - RNA, 16 nt, Listeria monocytogenes EGD-e
agccaaugaccuaguu

SEQ ID NO: 779518 - RNA, 20 nt, Listeria monocytogenes EGD-e
agccgcucgucuaaauugag

SEQ ID NO: 779519 - RNA, 16 nt, Listeria monocytogenes EGD-e
agccuccgcuuugguu

SEQ ID NO: 779520 - RNA, 12 nt, Listeria monocytogenes EGD-e
agcgaagucaau

SEQ ID NO: 779521 - RNA, 23 nt, Listeria monocytogenes EGD-e
agccuaaguuaaaccauaaaaau

SEQ ID NO: 779522 - RNA, 18 nt, Listeria monocytogenes EGD-e
agcguaccauucacuucg

SEQ ID NO: 779523 - RNA, 19 nt, Listeria monocytogenes EGD-e
agcguauccaccaaaaacu

SEQ ID NO: 779524 - RNA, 17 nt, Listeria monocytogenes EGD-e
agcgcuuaaaaauuuug

SEQ ID NO: 779525 - RNA, 22 nt, Listeria monocytogenes EGD-e
agcgcagaaugaagccauuccc

SEQ ID NO: 779526 - RNA, 17 nt, Listeria monocytogenes EGD-e
agagaaacuuuuucuca

SEQ ID NO: 779527 - RNA, 14 nt, Listeria monocytogenes EGD-e
agauccuucaauaa

SEQ ID NO: 779528 - RNA, 18 nt, Listeria monocytogenes EGD-e
agauccuucaauaauaua

SEQ ID NO: 779529 - RNA, 21 nt, Listeria monocytogenes EGD-e
agaugcacuagaaaaaugaag

SEQ ID NO: 779530 - RNA, 19 nt, Listeria monocytogenes EGD-e
agauuaaaaaucuagauuu

SEQ ID NO: 779531 - RNA, 14 nt, Listeria monocytogenes EGD-e
agauuaaauauagu

SEQ ID NO: 779532 - RNA, 13 nt, Listeria monocytogenes EGD-e
agauaaauuacug

SEQ ID NO: 779533 - RNA, 15 nt, Listeria monocytogenes EGD-e
agaucaaaagcaaaa

SEQ ID NO: 779534 - RNA, 18 nt, Listeria monocytogenes EGD-e
agaucaaaagcaaaaaag

SEQ ID NO: 779535 - RNA, 19 nt, Listeria monocytogenes EGD-e
agaucaaaagcaaaaaagu

SEQ ID NO: 779536 - RNA, 15 nt, Listeria monocytogenes EGD-e
agauaaucaagauuu

SEQ ID NO: 779537 - RNA, 20 nt, Listeria monocytogenes EGD-e
agauaaucaagauuuuguac

SEQ ID NO: 779538 - RNA, 21 nt, Listeria monocytogenes EGD-e
agaacgaauguuaaauucauu

SEQ ID NO: 779539 - RNA, 15 nt, Listeria monocytogenes EGD-e
agaacgauuuuggua

SEQ ID NO: 779540 - RNA, 21 nt, Listeria monocytogenes EGD-e
agaaauguugcgaaacaacug

SEQ ID NO: 779541 - RNA, 20 nt, Listeria monocytogenes EGD-e
agaaauggauugcagguaau

SEQ ID NO: 779542 - RNA, 22 nt, Listeria monocytogenes EGD-e
agaaauggauugcagguaauuu

SEQ ID NO: 779543 - RNA, 15 nt, Listeria monocytogenes EGD-e
agaaauuaaugccag

SEQ ID NO: 779544 - RNA, 22 nt, Listeria monocytogenes EGD-e
agaaaucgccuugauguggaua

SEQ ID NO: 779545 - RNA, 19 nt, Listeria monocytogenes EGD-e
agaaaucucaugaaacuuu

SEQ ID NO: 779546 - RNA, 23 nt, Listeria monocytogenes EGD-e
aaaacagaaagcuguuuucaaca

SEQ ID NO: 779547 - RNA, 19 nt, Listeria monocytogenes EGD-e
agaauaucuauucauuccc

SEQ ID NO: 779548 - RNA, 17 nt, Listeria monocytogenes EGD-e
agaauauggacauacuu

SEQ ID NO: 779549 - RNA, 20 nt, Listeria monocytogenes EGD-e
agaauauggacauacuucau

SEQ ID NO: 779550 - RNA, 14 nt, Listeria monocytogenes EGD-e
agaauaaaacaaaa

SEQ ID NO: 779551 - RNA, 16 nt, Listeria monocytogenes EGD-e
agaagcaugagaguga

SEQ ID NO: 779552 - RNA, 14 nt, Listeria monocytogenes EGD-e
agaaaaaacaagga

SEQ ID NO: 779553 - RNA, 14 nt, Listeria monocytogenes EGD-e
agaaaaaaacaaau

SEQ ID NO: 779554 - RNA, 21 nt, Listeria monocytogenes EGD-e
acuuuuuuuauuuaccuugcu

SEQ ID NO: 779555 - RNA, 17 nt, Listeria monocytogenes EGD-e
acuuuuuucuauauuca

SEQ ID NO: 779556 - RNA, 14 nt, Listeria monocytogenes EGD-e
acuuuuucucaaaa

SEQ ID NO: 779557 - RNA, 22 nt, Listeria monocytogenes EGD-e
acuuuuucucaaaaauaugcuu

SEQ ID NO: 779558 - RNA, 18 nt, Listeria monocytogenes EGD-e
acuuuuauugcacuauuu

SEQ ID NO: 779559 - RNA, 17 nt, Listeria monocytogenes EGD-e
acuuuuaauuaaaaguu

SEQ ID NO: 779560 - RNA, 13 nt, Listeria monocytogenes EGD-e
acuuucugccaaa

SEQ ID NO: 779561 - RNA, 21 nt, Listeria monocytogenes EGD-e
acuuugcuuguguaacauaaa

SEQ ID NO: 779562 - RNA, 18 nt, Listeria monocytogenes EGD-e
acuuuuaaaauucuauua

SEQ ID NO: 779563 - RNA, 18 nt, Listeria monocytogenes EGD-e
acuuuuaaaggaaaacuc

SEQ ID NO: 779564 - RNA, 20 nt, Listeria monocytogenes EGD-e
acuuuaucccagaaagaauu

SEQ ID NO: 779565 - RNA, 18 nt, Listeria monocytogenes EGD-e
acuugcaucuucuguuaa

SEQ ID NO: 779566 - RNA, 16 nt, Listeria monocytogenes EGD-e
acuuauaugaaaacuu

SEQ ID NO: 779567 - RNA, 13 nt, Listeria monocytogenes EGD-e
acuugugaaaguu

SEQ ID NO: 779568 - RNA, 19 nt, Listeria monocytogenes EGD-e
acuugugaaaguuuuauga

SEQ ID NO: 779569 - RNA, 23 nt, Listeria monocytogenes EGD-e
acuugugaaaguuuuaugacaau

SEQ ID NO: 779570 - RNA, 12 nt, Listeria monocytogenes EGD-e
accaaaaauacg

SEQ ID NO: 779571 - RNA, 12 nt, Listeria monocytogenes EGD-e
acauuuuugcuu

SEQ ID NO: 779572 - RNA, 20 nt, Listeria monocytogenes EGD-e
accaaaucugcgaauaacag

SEQ ID NO: 779573 - RNA, 20 nt, Listeria monocytogenes EGD-e
acauccgcaugaauuuuugc

SEQ ID NO: 779574 - RNA, 22 nt, Listeria monocytogenes EGD-e
acauccgcaugaauuuuugcau

SEQ ID NO: 779575 - RNA, 15 nt, Listeria monocytogenes EGD-e
acauaaucccacaaa

SEQ ID NO: 779576 - RNA, 19 nt, Listeria monocytogenes EGD-e
acauaaucccacaaaaaau

SEQ ID NO: 779577 - RNA, 15 nt, Listeria monocytogenes EGD-e
acaucuguuccuuug

SEQ ID NO: 779578 - RNA, 19 nt, Listeria monocytogenes EGD-e
acaucugcuauuuuugaau

SEQ ID NO: 779579 - RNA, 16 nt, Listeria monocytogenes EGD-e
acaugaauuacuucac

SEQ ID NO: 779580 - RNA, 13 nt, Listeria monocytogenes EGD-e
acaguauuccuca

SEQ ID NO: 779581 - RNA, 18 nt, Listeria monocytogenes EGD-e
acagcaauggccggauau

SEQ ID NO: 779582 - RNA, 20 nt, Listeria monocytogenes EGD-e
acacggugaugaaaccaaau

SEQ ID NO: 779583 - RNA, 15 nt, Listeria monocytogenes EGD-e
acaaugaugguuuug

SEQ ID NO: 779584 - RNA, 16 nt, Listeria monocytogenes EGD-e
acaaguaacucuucca

SEQ ID NO: 779585 - RNA, 23 nt, Listeria monocytogenes EGD-e
acacaaaaugcucaucaagaaau

SEQ ID NO: 779586 - RNA, 14 nt, Listeria monocytogenes EGD-e
acacccauaauauu

SEQ ID NO: 779587 - RNA, 14 nt, Listeria monocytogenes EGD-e
acaacaaaauaauc

SEQ ID NO: 779588 - RNA, 13 nt, Listeria monocytogenes EGD-e
acaacaagcaaaa

SEQ ID NO: 779589 - RNA, 22 nt, Listeria monocytogenes EGD-e
acaacaugcguaaacuuuuguu

SEQ ID NO: 779590 - RNA, 12 nt, Listeria monocytogenes EGD-e
acaaccaucaaa

SEQ ID NO: 779591 - RNA, 14 nt, Listeria monocytogenes EGD-e
acaaccauuuuguu

SEQ ID NO: 779592 - RNA, 16 nt, Listeria monocytogenes EGD-e
acaaaugguucacuuu

SEQ ID NO: 779593 - RNA, 15 nt, Listeria monocytogenes EGD-e
acaaauuauuagaau

SEQ ID NO: 779594 - RNA, 19 nt, Listeria monocytogenes EGD-e
acaaauucuccuuaaauaa

SEQ ID NO: 779595 - RNA, 22 nt, Listeria monocytogenes EGD-e
acaaauucuccuuaaauaaaaa

SEQ ID NO: 779596 - RNA, 18 nt, Listeria monocytogenes EGD-e
acaaauucugaaaugauu

SEQ ID NO: 779597 - RNA, 16 nt, Listeria monocytogenes EGD-e
acaaaguaacuaaaaa

SEQ ID NO: 779598 - RNA, 18 nt, Listeria monocytogenes EGD-e
acaaaguaacuaaaaauc

SEQ ID NO: 779599 - RNA, 15 nt, Listeria monocytogenes EGD-e
acaaaauuugucuuu

SEQ ID NO: 779600 - RNA, 13 nt, Listeria monocytogenes EGD-e
acaaacacaaaau

SEQ ID NO: 779601 - RNA, 21 nt, Listeria monocytogenes EGD-e
acaaacuuuuccuucuacauu

SEQ ID NO: 779602 - RNA, 21 nt, Listeria monocytogenes EGD-e
acaaacguucuugaaaucaag

SEQ ID NO: 779603 - RNA, 12 nt, Listeria monocytogenes EGD-e
acaaagaagaaa

SEQ ID NO: 779604 - RNA, 12 nt, Listeria monocytogenes EGD-e
acaaagaagaag

SEQ ID NO: 779605 - RNA, 17 nt, Listeria monocytogenes EGD-e
acaaaaguggaaauguu

SEQ ID NO: 779606 - RNA, 20 nt, Listeria monocytogenes EGD-e
acaaaauccagcguuaaucu

SEQ ID NO: 779607 - RNA, 17 nt, Listeria monocytogenes EGD-e
acaaaaucuuuaaacaa

SEQ ID NO: 779608 - RNA, 19 nt, Listeria monocytogenes EGD-e
acaaaaucuuuaaacaagc

SEQ ID NO: 779609 - RNA, 21 nt, Listeria monocytogenes EGD-e
acaaaaugcucaucaagaaau

SEQ ID NO: 779610 - RNA, 14 nt, Listeria monocytogenes EGD-e
acaaaaagaaaaaa

SEQ ID NO: 779611 - RNA, 17 nt, Listeria monocytogenes EGD-e
acaaaaagaaaaaacaa

SEQ ID NO: 779612 - RNA, 15 nt, Listeria monocytogenes EGD-e
aauuuuuuugaaaaa

SEQ ID NO: 779613 - RNA, 16 nt, Listeria monocytogenes EGD-e
aauuuuuuugaaaaaa

SEQ ID NO: 779614 - RNA, 18 nt, Listeria monocytogenes EGD-e
aauuuuuuugaaaaaaca

SEQ ID NO: 779615 - RNA, 18 nt, Listeria monocytogenes EGD-e
aaugcgacauacuuuuua

SEQ ID NO: 779616 - RNA, 15 nt, Listeria monocytogenes EGD-e
aaugcacagcagaaa

SEQ ID NO: 779617 - RNA, 13 nt, Listeria monocytogenes EGD-e
aaugcacaugaua

SEQ ID NO: 779618 - RNA, 13 nt, Listeria monocytogenes EGD-e
aaucuucuugcuu

SEQ ID NO: 779619 - RNA, 13 nt, Listeria monocytogenes EGD-e
aaugcuuuaacug

SEQ ID NO: 779620 - RNA, 20 nt, Listeria monocytogenes EGD-e
aaugcuucgacguuuaauuc

SEQ ID NO: 779621 - RNA, 15 nt, Listeria monocytogenes EGD-e
aauggauaaaaaaau

SEQ ID NO: 779622 - RNA, 24 nt, Listeria monocytogenes EGD-e
aauggcgcgggaugguauacuaua

SEQ ID NO: 779623 - RNA, 16 nt, Listeria monocytogenes EGD-e
aauggcgagauguuuu

SEQ ID NO: 779624 - RNA, 20 nt, Listeria monocytogenes EGD-e
aaugugaccuuaaauuauac

SEQ ID NO: 779625 - RNA, 22 nt, Listeria monocytogenes EGD-e
aaugugaccuuaaauuauacua

SEQ ID NO: 779626 - RNA, 13 nt, Listeria monocytogenes EGD-e
aauuaaaauaguu

SEQ ID NO: 779627 - RNA, 21 nt, Listeria monocytogenes EGD-e
aauuaaagguaacgucuacuu

SEQ ID NO: 779628 - RNA, 20 nt, Listeria monocytogenes EGD-e
aauugcuucuccguuuucca

SEQ ID NO: 779629 - RNA, 21 nt, Listeria monocytogenes EGD-e
aauugcuucuccguuuuccac

SEQ ID NO: 779630 - RNA, 16 nt, Listeria monocytogenes EGD-e
aaaacaaggaagaaua

SEQ ID NO: 779631 - RNA, 10 nt, Listeria monocytogenes EGD-e
aauuguauaa

SEQ ID NO: 779632 - RNA, 21 nt, Listeria monocytogenes EGD-e
aauuguaauuccgugaaauuc

SEQ ID NO: 779633 - RNA, 15 nt, Listeria monocytogenes EGD-e
aauugucauaaaacu

SEQ ID NO: 779634 - RNA, 15 nt, Listeria monocytogenes EGD-e
aauuuaagucguuau

SEQ ID NO: 779635 - RNA, 21 nt, Listeria monocytogenes EGD-e
aauucuauuaauaaugauuuc

SEQ ID NO: 779636 - RNA, 14 nt, Listeria monocytogenes EGD-e
aauuauacuauaaa

SEQ ID NO: 779637 - RNA, 16 nt, Listeria monocytogenes EGD-e
aauuauccaguguaau

SEQ ID NO: 779638 - RNA, 22 nt, Listeria monocytogenes EGD-e
aaucagagaaaccgcuaacgcc

SEQ ID NO: 779639 - RNA, 18 nt, Listeria monocytogenes EGD-e
aaucacuauugaauguca

SEQ ID NO: 779640 - RNA, 16 nt, Listeria monocytogenes EGD-e
aaucaauaaagaagca

SEQ ID NO: 779641 - RNA, 19 nt, Listeria monocytogenes EGD-e
aaucaauaaagaagcauga

SEQ ID NO: 779642 - RNA, 19 nt, Listeria monocytogenes EGD-e
aaucaauuuacguuguucu

SEQ ID NO: 779643 - RNA, 16 nt, Listeria monocytogenes EGD-e
aaucaagauuuuguac

SEQ ID NO: 779644 - RNA, 15 nt, Listeria monocytogenes EGD-e
aauagccaagauuaa

SEQ ID NO: 779645 - RNA, 18 nt, Listeria monocytogenes EGD-e
aauaugcgcagaaaguug

SEQ ID NO: 779646 - RNA, 20 nt, Listeria monocytogenes EGD-e
aauauguuuaaucuaaaucu

SEQ ID NO: 779647 - RNA, 21 nt, Listeria monocytogenes EGD-e
aauaugggggcagcugauuuu

SEQ ID NO: 779648 - RNA, 18 nt, Listeria monocytogenes EGD-e
aauauuagaaaaucauuu

SEQ ID NO: 779649 - RNA, 12 nt, Listeria monocytogenes EGD-e
aaucgcagcaga

SEQ ID NO: 779650 - RNA, 17 nt, Listeria monocytogenes EGD-e
aaucucacaauuuaagu

SEQ ID NO: 779651 - RNA, 14 nt, Listeria monocytogenes EGD-e
aaucucaucaccag

SEQ ID NO: 779652 - RNA, 16 nt, Listeria monocytogenes EGD-e
aaucucaucaccagcu

SEQ ID NO: 779653 - RNA, 13 nt, Listeria monocytogenes EGD-e
aaucuguaaaaau

SEQ ID NO: 779654 - RNA, 17 nt, Listeria monocytogenes EGD-e
aaucuggauaaaaauaa

SEQ ID NO: 779655 - RNA, 15 nt, Listeria monocytogenes EGD-e
aaucugauuaaaagu

SEQ ID NO: 779656 - RNA, 17 nt, Listeria monocytogenes EGD-e
aaucugauuaaaaguuu

SEQ ID NO: 779657 - RNA, 14 nt, Listeria monocytogenes EGD-e
aaucugaacugacu

SEQ ID NO: 779658 - RNA, 13 nt, Listeria monocytogenes EGD-e
aauccgaauucca

SEQ ID NO: 779659 - RNA, 16 nt, Listeria monocytogenes EGD-e
aaucccuauaaaaaca

SEQ ID NO: 779660 - RNA, 17 nt, Listeria monocytogenes EGD-e
aaucccuauaaaaacau

SEQ ID NO: 779661 - RNA, 19 nt, Listeria monocytogenes EGD-e
aaucccuauaaaaacauga

SEQ ID NO: 779662 - RNA, 22 nt, Listeria monocytogenes EGD-e
aaucccuauaaaaacaugauau

SEQ ID NO: 779663 - RNA, 16 nt, Listeria monocytogenes EGD-e
aauccuuggaaaaaug

SEQ ID NO: 779664 - RNA, 12 nt, Listeria monocytogenes EGD-e
aauccauuuuuc

SEQ ID NO: 779665 - RNA, 18 nt, Listeria monocytogenes EGD-e
aaucaucuuaucaaguaa

SEQ ID NO: 779666 - RNA, 15 nt, Listeria monocytogenes EGD-e
aaucauuuauuuucc

SEQ ID NO: 779667 - RNA, 16 nt, Listeria monocytogenes EGD-e
aaucauuuauuuuccc

SEQ ID NO: 779668 - RNA, 15 nt, Listeria monocytogenes EGD-e
aaucauggaaacaaa

SEQ ID NO: 779669 - RNA, 14 nt, Listeria monocytogenes EGD-e
aaucaugccuucaa

SEQ ID NO: 779670 - RNA, 18 nt, Listeria monocytogenes EGD-e
aaucaugccuucaaacac

SEQ ID NO: 779671 - RNA, 19 nt, Listeria monocytogenes EGD-e
aaaaagugaccuuugaaaa

SEQ ID NO: 779672 - RNA, 18 nt, Listeria monocytogenes EGD-e
aaauucugaaaugauuuu

SEQ ID NO: 779673 - RNA, 20 nt, Listeria monocytogenes EGD-e
aaauucugaaaugauuuuua

SEQ ID NO: 779674 - RNA, 22 nt, Listeria monocytogenes EGD-e
aacaauaacauuuucucuugua

SEQ ID NO: 779675 - RNA, 23 nt, Listeria monocytogenes EGD-e
aacaaucgcgucuacuuuuccga

SEQ ID NO: 779676 - RNA, 12 nt, Listeria monocytogenes EGD-e
aacacuucuaaa

SEQ ID NO: 779677 - RNA, 15 nt, Listeria monocytogenes EGD-e
aacacuucuaaaaca

SEQ ID NO: 779678 - RNA, 17 nt, Listeria monocytogenes EGD-e
aacacuucuaaaacagg

SEQ ID NO: 779679 - RNA, 19 nt, Listeria monocytogenes EGD-e
aacagauaguuguuccauu

SEQ ID NO: 779680 - RNA, 19 nt, Listeria monocytogenes EGD-e
aacauucaaaucaccacaa

SEQ ID NO: 779681 - RNA, 17 nt, Listeria monocytogenes EGD-e
aacauuaaaccucuuuu

SEQ ID NO: 779682 - RNA, 13 nt, Listeria monocytogenes EGD-e
aacccuugauuuc

SEQ ID NO: 779683 - RNA, 20 nt, Listeria monocytogenes EGD-e
aaccgccaaaaagcaggaug

SEQ ID NO: 779684 - RNA, 22 nt, Listeria monocytogenes EGD-e
aacccacccaauuguuuuacca

SEQ ID NO: 779685 - RNA, 18 nt, Listeria monocytogenes EGD-e
aaccauuccguugaaaga

SEQ ID NO: 779686 - RNA, 15 nt, Listeria monocytogenes EGD-e
aaccauuauuuggaa

SEQ ID NO: 779687 - RNA, 23 nt, Listeria monocytogenes EGD-e
aacgauguucauuacuucagcca

SEQ ID NO: 779688 - RNA, 22 nt, Listeria monocytogenes EGD-e
aacggagagcuagaaagccuuu

SEQ ID NO: 779689 - RNA, 14 nt, Listeria monocytogenes EGD-e
aacggguuucccug

SEQ ID NO: 779690 - RNA, 19 nt, Listeria monocytogenes EGD-e
aacuaacacuuauaugaaa

SEQ ID NO: 779691 - RNA, 22 nt, Listeria monocytogenes EGD-e
aacuagauagaguaagauauaa

SEQ ID NO: 779692 - RNA, 18 nt, Listeria monocytogenes EGD-e
aacuagauuuaauaaauu

SEQ ID NO: 779693 - RNA, 18 nt, Listeria monocytogenes EGD-e
aacguaacgggucgcugu

SEQ ID NO: 779694 - RNA, 19 nt, Listeria monocytogenes EGD-e
aacguuccgauacaacaaa

SEQ ID NO: 779695 - RNA, 22 nt, Listeria monocytogenes EGD-e
aacguuccgauacaacaaaaua

SEQ ID NO: 779696 - RNA, 13 nt, Listeria monocytogenes EGD-e
aacugaacaaaga

SEQ ID NO: 779697 - RNA, 21 nt, Listeria monocytogenes EGD-e
aacucuuucugaaaauguugc

SEQ ID NO: 779698 - RNA, 11 nt, Listeria monocytogenes EGD-e
aacuauuuuuu

SEQ ID NO: 779699 - RNA, 18 nt, Listeria monocytogenes EGD-e
aacugguuccauuaaauc

SEQ ID NO: 779700 - RNA, 21 nt, Listeria monocytogenes EGD-e
aacugguuccauuaaaucaua

SEQ ID NO: 779701 - RNA, 13 nt, Listeria monocytogenes EGD-e
aacuuaucucuuc

SEQ ID NO: 779702 - RNA, 12 nt, Listeria monocytogenes EGD-e
aacuucaaaauu

SEQ ID NO: 779703 - RNA, 13 nt, Listeria monocytogenes EGD-e
aacuucaaaauua

SEQ ID NO: 779704 - RNA, 19 nt, Listeria monocytogenes EGD-e
aacuucaaaauuacuauuu

SEQ ID NO: 779705 - RNA, 14 nt, Listeria monocytogenes EGD-e
aacuucaccacuuc

SEQ ID NO: 779706 - RNA, 19 nt, Listeria monocytogenes EGD-e
aacuucaccacuucuucca

SEQ ID NO: 779707 - RNA, 15 nt, Listeria monocytogenes EGD-e
aacuugcaucuucug

SEQ ID NO: 779708 - RNA, 12 nt, Listeria monocytogenes EGD-e
aagaaccuucaa

SEQ ID NO: 779709 - RNA, 17 nt, Listeria monocytogenes EGD-e
aagaacagcaauuuguu

SEQ ID NO: 779710 - RNA, 12 nt, Listeria monocytogenes EGD-e
aagaaauuaaau

SEQ ID NO: 779711 - RNA, 21 nt, Listeria monocytogenes EGD-e
aagaaauuaaauuuuuuugaa

SEQ ID NO: 779712 - RNA, 16 nt, Listeria monocytogenes EGD-e
aagaagauauuuugcu

SEQ ID NO: 779713 - RNA, 16 nt, Listeria monocytogenes EGD-e
aagaagagcugcaaca

SEQ ID NO: 779714 - RNA, 22 nt, Listeria monocytogenes EGD-e
aagaacugcggcuaauaacauu

SEQ ID NO: 779715 - RNA, 14 nt, Listeria monocytogenes EGD-e
aagaauaguacaua

SEQ ID NO: 779716 - RNA, 14 nt, Listeria monocytogenes EGD-e
aagaauaaugacgc

SEQ ID NO: 779717 - RNA, 11 nt, Listeria monocytogenes EGD-e
aagaagcuuuu

SEQ ID NO: 779718 - RNA, 18 nt, Listeria monocytogenes EGD-e
aagaagggcuuuuuuccu

SEQ ID NO: 779719 - RNA, 19 nt, Listeria monocytogenes EGD-e
aagaagggcuuuuuuccuu

SEQ ID NO: 779720 - RNA, 15 nt, Listeria monocytogenes EGD-e
aagaaguacaauaaa

SEQ ID NO: 779721 - RNA, 14 nt, Listeria monocytogenes EGD-e
aaguuuuuugguua

SEQ ID NO: 779722 - RNA, 21 nt, Listeria monocytogenes EGD-e
aauaaaauggauaaaaaaaua

SEQ ID NO: 779723 - RNA, 23 nt, Listeria monocytogenes EGD-e
aauaaaaucauuccacuuuuaaa

SEQ ID NO: 779724 - RNA, 17 nt, Listeria monocytogenes EGD-e
aauaaaaccauucaucu

SEQ ID NO: 779725 - RNA, 22 nt, Listeria monocytogenes EGD-e
aauaaagaacuuacagaagcau

SEQ ID NO: 779726 - RNA, 18 nt, Listeria monocytogenes EGD-e
aauaaaguuguaagauaa

SEQ ID NO: 779727 - RNA, 13 nt, Listeria monocytogenes EGD-e
aauaacaagaaua

SEQ ID NO: 779728 - RNA, 12 nt, Listeria monocytogenes EGD-e
aauaacaaucca

SEQ ID NO: 779729 - RNA, 18 nt, Listeria monocytogenes EGD-e
aauaaccgccaaaaagca

SEQ ID NO: 779730 - RNA, 16 nt, Listeria monocytogenes EGD-e
aaguuagauuaaaaau

SEQ ID NO: 779731 - RNA, 23 nt, Listeria monocytogenes EGD-e
aaguucuguuggcgcagaaauau

SEQ ID NO: 779732 - RNA, 22 nt, Listeria monocytogenes EGD-e
aaguuuacaauggaaugacaaa

SEQ ID NO: 779733 - RNA, 18 nt, Listeria monocytogenes EGD-e
aagugcugcgccaacaaa

SEQ ID NO: 779734 - RNA, 14 nt, Listeria monocytogenes EGD-e
aaguaacuaaaaau

SEQ ID NO: 779735 - RNA, 14 nt, Listeria monocytogenes EGD-e
aauacgcauuucac

SEQ ID NO: 779736 - RNA, 21 nt, Listeria monocytogenes EGD-e
aauacuaacgcuuuuucagca

SEQ ID NO: 779737 - RNA, 15 nt, Listeria monocytogenes EGD-e
aauaccgaaugcaau

SEQ ID NO: 779738 - RNA, 15 nt, Listeria monocytogenes EGD-e
aauacgacaauacca

SEQ ID NO: 779739 - RNA, 20 nt, Listeria monocytogenes EGD-e
aauacuguuuuugauuuaau

SEQ ID NO: 779740 - RNA, 22 nt, Listeria monocytogenes EGD-e
aauagagcuuuuaaauauaccg

SEQ ID NO: 779741 - RNA, 20 nt, Listeria monocytogenes EGD-e
aauacuuuuuucuauauuca

SEQ ID NO: 779742 - RNA, 12 nt, Listeria monocytogenes EGD-e
aauaauucugcu

SEQ ID NO: 779743 - RNA, 17 nt, Listeria monocytogenes EGD-e
aauacaaacuuuuccuu

SEQ ID NO: 779744 - RNA, 17 nt, Listeria monocytogenes EGD-e
aauaaugugguucguua

SEQ ID NO: 779745 - RNA, 17 nt, Listeria monocytogenes EGD-e
aauaauccuuccaucaa

SEQ ID NO: 779746 - RNA, 17 nt, Listeria monocytogenes EGD-e
aauaaucacguuuuugc

SEQ ID NO: 779747 - RNA, 14 nt, Listeria monocytogenes EGD-e
aaaaauauugaaua

SEQ ID NO: 779748 - RNA, 21 nt, Listeria monocytogenes EGD-e
aauaauaccaggaucaaaaug

SEQ ID NO: 779749 - RNA, 20 nt, Listeria monocytogenes EGD-e
aagauuauggaaaaauccac

SEQ ID NO: 779750 - RNA, 14 nt, Listeria monocytogenes EGD-e
aagauuaaaaauag

SEQ ID NO: 779751 - RNA, 17 nt, Listeria monocytogenes EGD-e
aagaugcacuagaaaaa

SEQ ID NO: 779752 - RNA, 19 nt, Listeria monocytogenes EGD-e
aagcaacgguaaacaaccc

SEQ ID NO: 779753 - RNA, 13 nt, Listeria monocytogenes EGD-e
aagcaaaaaagua

SEQ ID NO: 779754 - RNA, 15 nt, Listeria monocytogenes EGD-e
aagcaaaaaaguagg

SEQ ID NO: 779755 - RNA, 14 nt, Listeria monocytogenes EGD-e
aagcaaacaaagua

SEQ ID NO: 779756 - RNA, 17 nt, Listeria monocytogenes EGD-e
aagauuuuguacauaaa

SEQ ID NO: 779757 - RNA, 16 nt, Listeria monocytogenes EGD-e
aagauuuuugcucagu

SEQ ID NO: 779758 - RNA, 20 nt, Listeria monocytogenes EGD-e
aagcacaaauuauuagaauu

SEQ ID NO: 779759 - RNA, 17 nt, Listeria monocytogenes EGD-e
aagcaggauggcuacua

SEQ ID NO: 779760 - RNA, 23 nt, Listeria monocytogenes EGD-e
aagcaucuaguagcaauuuuaaa

SEQ ID NO: 779761 - RNA, 22 nt, Listeria monocytogenes EGD-e
aagcccagcacaaguuccaaaa

SEQ ID NO: 779762 - RNA, 13 nt, Listeria monocytogenes EGD-e
aagggugaagcuu

SEQ ID NO: 779763 - RNA, 14 nt, Listeria monocytogenes EGD-e
aaggauuugucacu

SEQ ID NO: 779764 - RNA, 21 nt, Listeria monocytogenes EGD-e
aaggauuugucacuuggaaaa

SEQ ID NO: 779765 - RNA, 19 nt, Listeria monocytogenes EGD-e
aaggcaacaaagaagaaaa

SEQ ID NO: 779766 - RNA, 14 nt, Listeria monocytogenes EGD-e
aagcguuuuucugc

SEQ ID NO: 779767 - RNA, 22 nt, Listeria monocytogenes EGD-e
aaggagcggcucagauccuuca

SEQ ID NO: 779768 - RNA, 14 nt, Listeria monocytogenes EGD-e
aaggagcagaaaaa

SEQ ID NO: 779769 - RNA, 17 nt, Listeria monocytogenes EGD-e
aaggagcagaaaaacug

SEQ ID NO: 779770 - RNA, 14 nt, Listeria monocytogenes EGD-e
aaggagaaaaagug

SEQ ID NO: 779771 - RNA, 18 nt, Listeria monocytogenes EGD-e
aaggaaacgaauaaaauc

SEQ ID NO: 779772 - RNA, 18 nt, Listeria monocytogenes EGD-e
aaggaaaacucucccauu

SEQ ID NO: 779773 - RNA, 18 nt, Listeria monocytogenes EGD-e
cggccuccuguugcacca

SEQ ID NO: 779774 - RNA, 13 nt, Listeria monocytogenes EGD-e
cgcuaaucuucuu

SEQ ID NO: 779775 - RNA, 20 nt, Listeria monocytogenes EGD-e
cgcuuucaaacgaucagcca

SEQ ID NO: 779776 - RNA, 16 nt, Listeria monocytogenes EGD-e
cgcuuucacaucuuca

SEQ ID NO: 779777 - RNA, 21 nt, Listeria monocytogenes EGD-e
cggaaauucccggucauuuuc

SEQ ID NO: 779778 - RNA, 14 nt, Listeria monocytogenes EGD-e
cggaccuuuugcuu

SEQ ID NO: 779779 - RNA, 20 nt, Listeria monocytogenes EGD-e
cggaucgcgguagcuucaau

SEQ ID NO: 779780 - RNA, 18 nt, Listeria monocytogenes EGD-e
cggauaaauauagcuuca

SEQ ID NO: 779781 - RNA, 12 nt, Listeria monocytogenes EGD-e
cggauaauaauc

SEQ ID NO: 779782 - RNA, 14 nt, Listeria monocytogenes EGD-e
cggauaauaaucag

SEQ ID NO: 779783 - RNA, 14 nt, Listeria monocytogenes EGD-e
cggauuuuucaaau

SEQ ID NO: 779784 - RNA, 22 nt, Listeria monocytogenes EGD-e
cgcggcauuucaaucgcagcag

SEQ ID NO: 779785 - RNA, 16 nt, Listeria monocytogenes EGD-e
aaacguucuuccuuuu

SEQ ID NO: 779786 - RNA, 20 nt, Listeria monocytogenes EGD-e
aaacguuccaguuaaacaaa

SEQ ID NO: 779787 - RNA, 21 nt, Listeria monocytogenes EGD-e
aaacguuccaguuaaacaaac

SEQ ID NO: 779788 - RNA, 19 nt, Listeria monocytogenes EGD-e
cgaugugggaaugaauaga

SEQ ID NO: 779789 - RNA, 16 nt, Listeria monocytogenes EGD-e
cgauguucauuacuuc

SEQ ID NO: 779790 - RNA, 22 nt, Listeria monocytogenes EGD-e
cgauguucauuacuucagccac

SEQ ID NO: 779791 - RNA, 20 nt, Listeria monocytogenes EGD-e
cgauugcuucaccaagaaga

SEQ ID NO: 779792 - RNA, 17 nt, Listeria monocytogenes EGD-e
cgauauuuuuuuguucu

SEQ ID NO: 779793 - RNA, 18 nt, Listeria monocytogenes EGD-e
cgauauuuuuuuguucug

SEQ ID NO: 779794 - RNA, 13 nt, Listeria monocytogenes EGD-e
cgauggaaccauu

SEQ ID NO: 779795 - RNA, 22 nt, Listeria monocytogenes EGD-e
cgcaauuuuaggcguaucuuuu

SEQ ID NO: 779796 - RNA, 13 nt, Listeria monocytogenes EGD-e
cgcaggaauagca

SEQ ID NO: 779797 - RNA, 17 nt, Listeria monocytogenes EGD-e
cgcauaucaucaauaaa

SEQ ID NO: 779798 - RNA, 12 nt, Listeria monocytogenes EGD-e
cgcauuuuucuc

SEQ ID NO: 779799 - RNA, 19 nt, Listeria monocytogenes EGD-e
cgccaccaacuucgagcag

SEQ ID NO: 779800 - RNA, 15 nt, Listeria monocytogenes EGD-e
cgaauagcauaauag

SEQ ID NO: 779801 - RNA, 17 nt, Listeria monocytogenes EGD-e
cgacguuuaucaauaau

SEQ ID NO: 779802 - RNA, 15 nt, Listeria monocytogenes EGD-e
cgauaauuuucauuu

SEQ ID NO: 779803 - RNA, 18 nt, Listeria monocytogenes EGD-e
cgauaaagcgguaucccu

SEQ ID NO: 779804 - RNA, 19 nt, Listeria monocytogenes EGD-e
cgaguuaccugucgcuguu

SEQ ID NO: 779805 - RNA, 11 nt, Listeria monocytogenes EGD-e
ccagcuucacg

SEQ ID NO: 779806 - RNA, 14 nt, Listeria monocytogenes EGD-e
ccaggcaaaacaag

SEQ ID NO: 779807 - RNA, 21 nt, Listeria monocytogenes EGD-e
ccagcggucgcguucuugucu

SEQ ID NO: 779808 - RNA, 19 nt, Listeria monocytogenes EGD-e
ccauaagacauaacaagua

SEQ ID NO: 779809 - RNA, 10 nt, Listeria monocytogenes EGD-e
ccauaauagc

SEQ ID NO: 779810 - RNA, 21 nt, Listeria monocytogenes EGD-e
ccauacuuucugccaaauugg

SEQ ID NO: 779811 - RNA, 12 nt, Listeria monocytogenes EGD-e
ccauaucaccaa

SEQ ID NO: 779812 - RNA, 13 nt, Listeria monocytogenes EGD-e
ccaguuaaacaaa

SEQ ID NO: 779813 - RNA, 12 nt, Listeria monocytogenes EGD-e
aaacaauaacau

SEQ ID NO: 779814 - RNA, 21 nt, Listeria monocytogenes EGD-e
aaacaaguccgucaagcccag

SEQ ID NO: 779815 - RNA, 20 nt, Listeria monocytogenes EGD-e
aaacaagaggcuuauuccuc

SEQ ID NO: 779816 - RNA, 17 nt, Listeria monocytogenes EGD-e
ccauuauuuggaaucuc

SEQ ID NO: 779817 - RNA, 19 nt, Listeria monocytogenes EGD-e
ccauucacugauuuauuau

SEQ ID NO: 779818 - RNA, 19 nt, Listeria monocytogenes EGD-e
aaacacgaacauaccaaua

SEQ ID NO: 779819 - RNA, 19 nt, Listeria monocytogenes EGD-e
cccggucauuuucacugca

SEQ ID NO: 779820 - RNA, 19 nt, Listeria monocytogenes EGD-e
cccgcuaagaagaguccgc

SEQ ID NO: 779821 - RNA, 20 nt, Listeria monocytogenes EGD-e
cccgcgcuaaucuucuugcu

SEQ ID NO: 779822 - RNA, 13 nt, Listeria monocytogenes EGD-e
cccuuucggaccu

SEQ ID NO: 779823 - RNA, 21 nt, Listeria monocytogenes EGD-e
aaacaucuugacuuuguuaac

SEQ ID NO: 779824 - RNA, 21 nt, Listeria monocytogenes EGD-e
aaacaugauauauuuauaaac

SEQ ID NO: 779825 - RNA, 11 nt, Listeria monocytogenes EGD-e
aaacaguacuu

SEQ ID NO: 779826 - RNA, 23 nt, Listeria monocytogenes EGD-e
aaacaguuagaagaacugcggcu

SEQ ID NO: 779827 - RNA, 18 nt, Listeria monocytogenes EGD-e
aaacauuuucauucuuuc

SEQ ID NO: 779828 - RNA, 13 nt, Listeria monocytogenes EGD-e
aaacauuugauac

SEQ ID NO: 779829 - RNA, 23 nt, Listeria monocytogenes EGD-e
aaacauuugauacauauuugaac

SEQ ID NO: 779830 - RNA, 24 nt, Listeria monocytogenes EGD-e
aaaccaaauaugcuauacaacaca

SEQ ID NO: 779831 - RNA, 12 nt, Listeria monocytogenes EGD-e
aaacauuugaua

SEQ ID NO: 779832 - RNA, 22 nt, Listeria monocytogenes EGD-e
aaaccgauaauuuucauuuguu

SEQ ID NO: 779833 - RNA, 21 nt, Listeria monocytogenes EGD-e
ccgcggaaaguuucgaaguga

SEQ ID NO: 779834 - RNA, 21 nt, Listeria monocytogenes EGD-e
ccgcucuuuuuuaugaucuuu

SEQ ID NO: 779835 - RNA, 17 nt, Listeria monocytogenes EGD-e
ccgcugccuuaagcaag

SEQ ID NO: 779836 - RNA, 17 nt, Listeria monocytogenes EGD-e
aaaccguaacuguugaa

SEQ ID NO: 779837 - RNA, 17 nt, Listeria monocytogenes EGD-e
ccguaauauauucaaaa

SEQ ID NO: 779838 - RNA, 23 nt, Listeria monocytogenes EGD-e
ccgugagaacgacaaaugguuca

SEQ ID NO: 779839 - RNA, 19 nt, Listeria monocytogenes EGD-e
ccgugaaauucuucgcuug

SEQ ID NO: 779840 - RNA, 21 nt, Listeria monocytogenes EGD-e
ccucauuacucgguucaauua

SEQ ID NO: 779841 - RNA, 21 nt, Listeria monocytogenes EGD-e
ccucuaagucugcuuuuucaa

SEQ ID NO: 779842 - RNA, 14 nt, Listeria monocytogenes EGD-e
ccucuuuuuuuagu

SEQ ID NO: 779843 - RNA, 13 nt, Listeria monocytogenes EGD-e
ccugaaagaacug

SEQ ID NO: 779844 - RNA, 18 nt, Listeria monocytogenes EGD-e
ccugaugaugccgcaaga

SEQ ID NO: 779845 - RNA, 13 nt, Listeria monocytogenes EGD-e
ccugcuaaaacca

SEQ ID NO: 779846 - RNA, 14 nt, Listeria monocytogenes EGD-e
ccugcuaaaaccau

SEQ ID NO: 779847 - RNA, 15 nt, Listeria monocytogenes EGD-e
ccuuaaauaaaaacu

SEQ ID NO: 779848 - RNA, 18 nt, Listeria monocytogenes EGD-e
ccuucaucguuuaacaua

SEQ ID NO: 779849 - RNA, 20 nt, Listeria monocytogenes EGD-e
ccuucuaauacgacaccaau

SEQ ID NO: 779850 - RNA, 21 nt, Listeria monocytogenes EGD-e
ccuucuaauacgacaccaauu

SEQ ID NO: 779851 - RNA, 23 nt, Listeria monocytogenes EGD-e
cgaaaaacauuauuuugcuaaag

SEQ ID NO: 779852 - RNA, 14 nt, Listeria monocytogenes EGD-e
cgaaaaaugaaaag

SEQ ID NO: 779853 - RNA, 16 nt, Listeria monocytogenes EGD-e
cgaaaaaugaaaagaa

SEQ ID NO: 779854 - RNA, 19 nt, Listeria monocytogenes EGD-e
ccuuugaauugauuuuuuu

SEQ ID NO: 779855 - RNA, 21 nt, Listeria monocytogenes EGD-e
ccuuugaauugauuuuuuuga

SEQ ID NO: 779856 - RNA, 14 nt, Listeria monocytogenes EGD-e
ccuuucuuuuuuaa

SEQ ID NO: 779857 - RNA, 15 nt, Listeria monocytogenes EGD-e
ccuuucuuuuuuaau

SEQ ID NO: 779858 - RNA, 13 nt, Listeria monocytogenes EGD-e
cgaaagaauaaaa

SEQ ID NO: 779859 - RNA, 23 nt, Listeria monocytogenes EGD-e
cgaaauggaugcacuuuuaauuu

SEQ ID NO: 779860 - RNA, 19 nt, Listeria monocytogenes EGD-e
cgaaagugcgcuuauuuuu

SEQ ID NO: 779861 - RNA, 17 nt, Listeria monocytogenes EGD-e
cgaaagcaaaugcauuu

SEQ ID NO: 779862 - RNA, 15 nt, Listeria monocytogenes EGD-e
cgaaauuaaaagcua

SEQ ID NO: 779863 - RNA, 19 nt, Listeria monocytogenes EGD-e
cgaagucccgccguauucg

SEQ ID NO: 779864 - RNA, 21 nt, Listeria monocytogenes EGD-e
cgaacgcuugcaucaagggaa

SEQ ID NO: 779865 - RNA, 18 nt, Listeria monocytogenes EGD-e
caucuuccacuccagcug

SEQ ID NO: 779866 - RNA, 16 nt, Listeria monocytogenes EGD-e
caucuucuaagaaaaa

SEQ ID NO: 779867 - RNA, 19 nt, Listeria monocytogenes EGD-e
caucuucuagcgucacaau

SEQ ID NO: 779868 - RNA, 18 nt, Listeria monocytogenes EGD-e
caugucguaugcuuuaug

SEQ ID NO: 779869 - RNA, 23 nt, Listeria monocytogenes EGD-e
caugugcuuguaagaagcuuuua

SEQ ID NO: 779870 - RNA, 22 nt, Listeria monocytogenes EGD-e
cauuacugucgcaaaaaucauc

SEQ ID NO: 779871 - RNA, 12 nt, Listeria monocytogenes EGD-e
cauuacuuuaau

SEQ ID NO: 779872 - RNA, 18 nt, Listeria monocytogenes EGD-e
cauucgaguuucuguucu

SEQ ID NO: 779873 - RNA, 15 nt, Listeria monocytogenes EGD-e
cauucgaaagcaaau

SEQ ID NO: 779874 - RNA, 12 nt, Listeria monocytogenes EGD-e
cauucaaaucac

SEQ ID NO: 779875 - RNA, 14 nt, Listeria monocytogenes EGD-e
cauucaaaucacca

SEQ ID NO: 779876 - RNA, 18 nt, Listeria monocytogenes EGD-e
cauucaaaucaccacaaa

SEQ ID NO: 779877 - RNA, 14 nt, Listeria monocytogenes EGD-e
cauucaauacuuuu

SEQ ID NO: 779878 - RNA, 22 nt, Listeria monocytogenes EGD-e
cauuagcuaggccuacuuuuuu

SEQ ID NO: 779879 - RNA, 17 nt, Listeria monocytogenes EGD-e
cauugcacuuuuauugc

SEQ ID NO: 779880 - RNA, 17 nt, Listeria monocytogenes EGD-e
cauucgguccuuguacu

SEQ ID NO: 779881 - RNA, 20 nt, Listeria monocytogenes EGD-e
cauuuaacaucagauuaaau

SEQ ID NO: 779882 - RNA, 13 nt, Listeria monocytogenes EGD-e
cauuggaccagaa

SEQ ID NO: 779883 - RNA, 23 nt, Listeria monocytogenes EGD-e
cauuguagcgauucccuuuuuuu

SEQ ID NO: 779884 - RNA, 16 nt, Listeria monocytogenes EGD-e
cauuugaaaaagggcu

SEQ ID NO: 779885 - RNA, 17 nt, Listeria monocytogenes EGD-e
cauuucuuacuauuuuc

SEQ ID NO: 779886 - RNA, 18 nt, Listeria monocytogenes EGD-e
cauuucauaaucaaauac

SEQ ID NO: 779887 - RNA, 20 nt, Listeria monocytogenes EGD-e
cauuucauaaucaaauacau

SEQ ID NO: 779888 - RNA, 15 nt, Listeria monocytogenes EGD-e
cauuucaucuuuuuu

SEQ ID NO: 779889 - RNA, 16 nt, Listeria monocytogenes EGD-e
cauuucaucuuuuuuu

SEQ ID NO: 779890 - RNA, 18 nt, Listeria monocytogenes EGD-e
cauuuccaagucuauuuc

SEQ ID NO: 779891 - RNA, 23 nt, Listeria monocytogenes EGD-e
cauuuccaaguguuuuagugcac

SEQ ID NO: 779892 - RNA, 22 nt, Listeria monocytogenes EGD-e
cauuucauucuuuuuuauacgc

SEQ ID NO: 779893 - RNA, 14 nt, Listeria monocytogenes EGD-e
cauuucgauaacuu

SEQ ID NO: 779894 - RNA, 15 nt, Listeria monocytogenes EGD-e
cauuuucacugcaua

SEQ ID NO: 779895 - RNA, 20 nt, Listeria monocytogenes EGD-e
cauuuucacaaguaacucuu

SEQ ID NO: 779896 - RNA, 20 nt, Listeria monocytogenes EGD-e
ccaaauaugcuauacaacac

SEQ ID NO: 779897 - RNA, 14 nt, Listeria monocytogenes EGD-e
ccaagcacagcaau

SEQ ID NO: 779898 - RNA, 13 nt, Listeria monocytogenes EGD-e
ccaaguucuguug

SEQ ID NO: 779899 - RNA, 16 nt, Listeria monocytogenes EGD-e
ccaaucauggaaacaa

SEQ ID NO: 779900 - RNA, 23 nt, Listeria monocytogenes EGD-e
ccaaucauggaaacaaaguauug

SEQ ID NO: 779901 - RNA, 10 nt, Listeria monocytogenes EGD-e
ccaauuuuac

SEQ ID NO: 779902 - RNA, 12 nt, Listeria monocytogenes EGD-e
ccaauuguuuua

SEQ ID NO: 779903 - RNA, 15 nt, Listeria monocytogenes EGD-e
ccaauuguuuuacca

SEQ ID NO: 779904 - RNA, 21 nt, Listeria monocytogenes EGD-e
ccacagaucaaaagcaaaaaa

SEQ ID NO: 779905 - RNA, 18 nt, Listeria monocytogenes EGD-e
ccaccauuuguuuuauuu

SEQ ID NO: 779906 - RNA, 12 nt, Listeria monocytogenes EGD-e
ccaccagucaca

SEQ ID NO: 779907 - RNA, 17 nt, Listeria monocytogenes EGD-e
ccaccaggcaaaacaag

SEQ ID NO: 779908 - RNA, 21 nt, Listeria monocytogenes EGD-e
ccacgcggcauuucaaucgca

SEQ ID NO: 779909 - RNA, 15 nt, Listeria monocytogenes EGD-e
caguuaaacaaacac

SEQ ID NO: 779910 - RNA, 19 nt, Listeria monocytogenes EGD-e
caguuaaacaaacacaaaa

SEQ ID NO: 779911 - RNA, 22 nt, Listeria monocytogenes EGD-e
cagugugguuuacucccuuuuu

SEQ ID NO: 779912 - RNA, 17 nt, Listeria monocytogenes EGD-e
caguucaacuacuucaa

SEQ ID NO: 779913 - RNA, 16 nt, Listeria monocytogenes EGD-e
caguuucuuuuugcug

SEQ ID NO: 779914 - RNA, 17 nt, Listeria monocytogenes EGD-e
caguuuauaaauaccug

SEQ ID NO: 779915 - RNA, 21 nt, Listeria monocytogenes EGD-e
cauaaccucgcaaaaaauaau

SEQ ID NO: 779916 - RNA, 20 nt, Listeria monocytogenes EGD-e
cauaaaaagcugccaccacu

SEQ ID NO: 779917 - RNA, 22 nt, Listeria monocytogenes EGD-e
cauaaacauuugauacauauuu

SEQ ID NO: 779918 - RNA, 14 nt, Listeria monocytogenes EGD-e
cauaaaucgccaca

SEQ ID NO: 779919 - RNA, 12 nt, Listeria monocytogenes EGD-e
cauaauuauuuu

SEQ ID NO: 779920 - RNA, 18 nt, Listeria monocytogenes EGD-e
cauaauaggagacauuaa

SEQ ID NO: 779921 - RNA, 17 nt, Listeria monocytogenes EGD-e
cauaauagaaagccauc

SEQ ID NO: 779922 - RNA, 17 nt, Listeria monocytogenes EGD-e
cauaaucccacaaaaaa

SEQ ID NO: 779923 - RNA, 20 nt, Listeria monocytogenes EGD-e
cauaaucccacaaaaaauac

SEQ ID NO: 779924 - RNA, 14 nt, Listeria monocytogenes EGD-e
cauaaucaaauaca

SEQ ID NO: 779925 - RNA, 21 nt, Listeria monocytogenes EGD-e
cauacgaguucuacuugcgaa

SEQ ID NO: 779926 - RNA, 20 nt, Listeria monocytogenes EGD-e
cauauaaucaauaucuuuau

SEQ ID NO: 779927 - RNA, 10 nt, Listeria monocytogenes EGD-e
cauaucacca

SEQ ID NO: 779928 - RNA, 20 nt, Listeria monocytogenes EGD-e
cauaucaccaacaauuacuu

SEQ ID NO: 779929 - RNA, 18 nt, Listeria monocytogenes EGD-e
cauaucuacaggcuauuc

SEQ ID NO: 779930 - RNA, 20 nt, Listeria monocytogenes EGD-e
cauauguuucgccaauuugc

SEQ ID NO: 779931 - RNA, 13 nt, Listeria monocytogenes EGD-e
caucauaaacauu

SEQ ID NO: 779932 - RNA, 13 nt, Listeria monocytogenes EGD-e
caucauaucuaca

SEQ ID NO: 779933 - RNA, 22 nt, Listeria monocytogenes EGD-e
caucgaauacuaacgcuuuuuc

SEQ ID NO: 779934 - RNA, 19 nt, Listeria monocytogenes EGD-e
caucgccgccuauuauuuc

SEQ ID NO: 779935 - RNA, 21 nt, Listeria monocytogenes EGD-e
cauccggugcugggaaaucag

SEQ ID NO: 779936 - RNA, 16 nt, Listeria monocytogenes EGD-e
caucguuuucuacugu

SEQ ID NO: 779937 - RNA, 23 nt, Listeria monocytogenes EGD-e
caucuguuccuuugcuaucaacc

SEQ ID NO: 779938 - RNA, 21 nt, Listeria monocytogenes EGD-e
caucuuaucaaguaauaagaa

SEQ ID NO: 779939 - RNA, 16 nt, Listeria monocytogenes EGD-e
caucugcuauuuuuga

SEQ ID NO: 779940 - RNA, 15 nt, Listeria monocytogenes EGD-e
cacucgucuaaaaaa

SEQ ID NO: 779941 - RNA, 15 nt, Listeria monocytogenes EGD-e
cacuaacauaaauug

SEQ ID NO: 779942 - RNA, 22 nt, Listeria monocytogenes EGD-e
cacuaacuuaucuuucaaacgu

SEQ ID NO: 779943 - RNA, 21 nt, Listeria monocytogenes EGD-e
cacuaaugcucaccuucuuuu

SEQ ID NO: 779944 - RNA, 20 nt, Listeria monocytogenes EGD-e
cacguuccccaccaagguaa

SEQ ID NO: 779945 - RNA, 19 nt, Listeria monocytogenes EGD-e
cacuagaaaaaugaagaga

SEQ ID NO: 779946 - RNA, 15 nt, Listeria monocytogenes EGD-e
cacuucuuaagaauu

SEQ ID NO: 779947 - RNA, 16 nt, Listeria monocytogenes EGD-e
cacuucuaccguuccu

SEQ ID NO: 779948 - RNA, 20 nt, Listeria monocytogenes EGD-e
cacuucuaccguuccuucaa

SEQ ID NO: 779949 - RNA, 23 nt, Listeria monocytogenes EGD-e
cacuucuaccguuccuucaagca

SEQ ID NO: 779950 - RNA, 19 nt, Listeria monocytogenes EGD-e
aaaauauugaauagaacua

SEQ ID NO: 779951 - RNA, 21 nt, Listeria monocytogenes EGD-e
cacuuuaucccagaaagaauu

SEQ ID NO: 779952 - RNA, 16 nt, Listeria monocytogenes EGD-e
cagaaacuuucuuuuc

SEQ ID NO: 779953 - RNA, 14 nt, Listeria monocytogenes EGD-e
cagauaguuguucc

SEQ ID NO: 779954 - RNA, 22 nt, Listeria monocytogenes EGD-e
aaaaucgcauccucaaacguca

SEQ ID NO: 779955 - RNA, 21 nt, Listeria monocytogenes EGD-e
cagcagauuuugcgaaagcug

SEQ ID NO: 779956 - RNA, 18 nt, Listeria monocytogenes EGD-e
aaaaugguuucuuaaaua

SEQ ID NO: 779957 - RNA, 19 nt, Listeria monocytogenes EGD-e
aaaaugguuucuuaaauac

SEQ ID NO: 779958 - RNA, 18 nt, Listeria monocytogenes EGD-e
aaaaugggcaguuacuuu

SEQ ID NO: 779959 - RNA, 23 nt, Listeria monocytogenes EGD-e
aaaaugguacguugguuguucuu

SEQ ID NO: 779960 - RNA, 17 nt, Listeria monocytogenes EGD-e
cagauuaacccaauuuu

SEQ ID NO: 779961 - RNA, 15 nt, Listeria monocytogenes EGD-e
cagauccuucaauaa

SEQ ID NO: 779962 - RNA, 21 nt, Listeria monocytogenes EGD-e
cagauccuucaauaauauaau

SEQ ID NO: 779963 - RNA, 20 nt, Listeria monocytogenes EGD-e
aaaaugcucaucaagaaauu

SEQ ID NO: 779964 - RNA, 21 nt, Listeria monocytogenes EGD-e
aaaaugcuaauuuauuuagaa

SEQ ID NO: 779965 - RNA, 22 nt, Listeria monocytogenes EGD-e
aaaaugauucuaguuuguccca

SEQ ID NO: 779966 - RNA, 21 nt, Listeria monocytogenes EGD-e
aaaaugagcccaaaaauaagu

SEQ ID NO: 779967 - RNA, 12 nt, Listeria monocytogenes EGD-e
cagcugauuuuu

SEQ ID NO: 779968 - RNA, 18 nt, Listeria monocytogenes EGD-e
cagcuucuaagucaaaac

SEQ ID NO: 779969 - RNA, 15 nt, Listeria monocytogenes EGD-e
cagcuucgauuuuuu

SEQ ID NO: 779970 - RNA, 18 nt, Listeria monocytogenes EGD-e
cagcuucgauuuuuucaa

SEQ ID NO: 779971 - RNA, 17 nt, Listeria monocytogenes EGD-e
caggauggcuacuagaa

SEQ ID NO: 779972 - RNA, 21 nt, Listeria monocytogenes EGD-e
caggaguuucuuuaccauaca

SEQ ID NO: 779973 - RNA, 23 nt, Listeria monocytogenes EGD-e
aaaauuucaucguuuucuacugu

SEQ ID NO: 779974 - RNA, 23 nt, Listeria monocytogenes EGD-e
caggcacgucaaauggcgcagga

SEQ ID NO: 779975 - RNA, 17 nt, Listeria monocytogenes EGD-e
caggguuuguuccaccg

SEQ ID NO: 779976 - RNA, 16 nt, Listeria monocytogenes EGD-e
cagguaaaacagcaag

SEQ ID NO: 779977 - RNA, 14 nt, Listeria monocytogenes EGD-e
cagccauuuuggaa

SEQ ID NO: 779978 - RNA, 19 nt, Listeria monocytogenes EGD-e
cagcccaaccuauuuggua

SEQ ID NO: 779979 - RNA, 17 nt, Listeria monocytogenes EGD-e
cagcgucuaaaaaugca

SEQ ID NO: 779980 - RNA, 14 nt, Human
uagacccucaugcu

SEQ ID NO: 779981 - RNA, 12 nt, Human
gcuaucgccauc

SEQ ID NO: 779982 - RNA, 13 nt, Human
gcuauguuguugc

SEQ ID NO: 779983 - RNA, 16 nt, Human
guuggaaaaugugcaa

SEQ ID NO: 779984 - RNA, 15 nt, Human
gcugaggcgggugga

SEQ ID NO: 779985 - RNA, 18 nt, Human
guuccuaaccagccuggu

SEQ ID NO: 779986 - RNA, 13 nt, Human
gccugggugacag

SEQ ID NO: 779987 - RNA, 16 nt, Human
gcgcgccaccacgccc

SEQ ID NO: 779988 - RNA, 13 nt, Human
gcgcgcgccacca

SEQ ID NO: 779989 - RNA, 13 nt, Human
gcgacagugagac

SEQ ID NO: 779990 - RNA, 15 nt, Human
uggagacaccaccac

SEQ ID NO: 779991 - RNA, 22 nt, Human
ugcuugccaucccucccuccac

SEQ ID NO: 779992 - RNA, 21 nt, Human
uggaaaaaaaggaagaaauuc

SEQ ID NO: 779993 - RNA, 18 nt, Human
uggcgcgcgccaccacgc

SEQ ID NO: 779994 - RNA, 21 nt, Human
uggcccaggaguuuggccaga

SEQ ID NO: 779995 - RNA, 24 nt, Human
uguugccaaggcuggagugcagug

SEQ ID NO: 779996 - RNA, 18 nt, Human
uguugguacuagauacug

SEQ ID NO: 779997 - RNA, 12 nt, Human
ugcuaucgccau

SEQ ID NO: 779998 - RNA, 20 nt, Human
ugccaucccucccuccaccu

SEQ ID NO: 779999 - RNA, 13 nt, Human
uccacuacugcua

SEQ ID NO: 780000 - RNA, 16 nt, Human
ucaguccaugaagaug

SEQ ID NO: 780001 - RNA, 18 nt, Human
ugacuauuauagaaugga

SEQ ID NO: 780002 - RNA, 14 nt, Human
ugagcaccugcagg

SEQ ID NO: 780003 - RNA, 17 nt, Human
ugaggcauuugcagcug

SEQ ID NO: 780004 - RNA, 15 nt, Human
ugaucucagaaauug

SEQ ID NO: 780005 - RNA, 14 nt, Human
gaaagaggaaugaa

SEQ ID NO: 780006 - RNA, 12 nt, Human
gaagucaaggcu

SEQ ID NO: 780007 - RNA, 20 nt, Human
gaagucaaggcuuagacccu

SEQ ID NO: 780008 - RNA, 18 nt, Human
gaaguuaagcaacaucua

SEQ ID NO: 780009 - RNA, 18 nt, Human
gaagccacagaccuagga

SEQ ID NO: 780010 - RNA, 16 nt, Human
gacgugacuggccugc

SEQ ID NO: 780011 - RNA, 19 nt, Human
gacgugacuggccugcugg

SEQ ID NO: 780012 - RNA, 13 nt, Human
gacuaaaaaacaa

SEQ ID NO: 780013 - RNA, 20 nt, Human
gacgggguuugccaugcugg

SEQ ID NO: 780014 - RNA, 16 nt, Human
gaauuggagcucgugg

SEQ ID NO: 780015 - RNA, 14 nt, Human
gacagugagacucu

SEQ ID NO: 780016 - RNA, 23 nt, Human
gacauguuuacaaaccucaagcc

SEQ ID NO: 780017 - RNA, 22 nt, Human
cuuucacauuggcuauuuaaag

SEQ ID NO: 780018 - RNA, 23 nt, Human
cuucccuuuuacauacugcuguc

SEQ ID NO: 780019 - RNA, 11 nt, Human
cugcaaccugu

SEQ ID NO: 780020 - RNA, 15 nt, Human
cuggaauguaaucaa

SEQ ID NO: 780021 - RNA, 22 nt, Human
cuggacuuuccagagaccagua

SEQ ID NO: 780022 - RNA, 21 nt, Human
cuggucccagccagcaguuca

SEQ ID NO: 780023 - RNA, 15 nt, Human
cuggucucgaacugc

SEQ ID NO: 780024 - RNA, 15 nt, Human
gauaugccuuuuccc

SEQ ID NO: 780025 - RNA, 19 nt, Human
gagacgggguuugccaugc

SEQ ID NO: 780026 - RNA, 16 nt, Human
gagaaaauaaaagcac

SEQ ID NO: 780027 - RNA, 19 nt, Human
gagcaccugcaggcgugac

SEQ ID NO: 780028 - RNA, 19 nt, Human
gagcuguuuucccugaccu

SEQ ID NO: 780029 - RNA, 17 nt, Human
gaggacuugggcgggac

SEQ ID NO: 780030 - RNA, 23 nt, Human
gccaacugggguggguggggcag

SEQ ID NO: 780031 - RNA, 16 nt, Human
gccaccacgcccagcu

SEQ ID NO: 780032 - RNA, 16 nt, Human
gccaucccucccucca

SEQ ID NO: 780033 - RNA, 19 nt, Human
gccccuguacuccagccug

SEQ ID NO: 780034 - RNA, 16 nt, Human
gcccucuccugggcag

SEQ ID NO: 780035 - RNA, 17 nt, Human
gcccucuccugggcagc

SEQ ID NO: 780036 - RNA, 14 nt, Human
gcacuccagccuga

SEQ ID NO: 780037 - RNA, 14 nt, Human
gcaccugcaggcgu

SEQ ID NO: 780038 - RNA, 19 nt, Human
gcagagguugcagugagcc

SEQ ID NO: 780039 - RNA, 21 nt, Human
gcacuuauuuauuguuguugg

SEQ ID NO: 780040 - RNA, 15 nt, Human
gcaguucagagcugc

SEQ ID NO: 780041 - RNA, 19 nt, Human
gcagugcuuggcccaggag

SEQ ID NO: 780042 - RNA, 19 nt, Human
gcaggucacacaaccuguc

SEQ ID NO: 780043 - RNA, 20 nt, Human
gcaggcaugagucagucuga

SEQ ID NO: 780044 - RNA, 18 nt, Human
cuauuacgugcaauacuu

SEQ ID NO: 780045 - RNA, 15 nt, Human
cucagaaacaucagu

SEQ ID NO: 780046 - RNA, 12 nt, Human
cuaggccgggcg

SEQ ID NO: 780047 - RNA, 13 nt, Human
cucauccugcagg

SEQ ID NO: 780048 - RNA, 15 nt, Human
cucacaagcacuuuc

SEQ ID NO: 780049 - RNA, 16 nt, Human
cucccaaagugcuggg

SEQ ID NO: 780050 - RNA, 16 nt, Human
cuccugggcagcugcc

SEQ ID NO: 780051 - RNA, 13 nt, Human
cugaagaagcacc

SEQ ID NO: 780052 - RNA, 23 nt, Human
cugagaccagccaaccugggggc

SEQ ID NO: 780053 - RNA, 23 nt, Human
cugauauauguguuuuucacauu

SEQ ID NO: 780054 - RNA, 24 nt, Human
cuacucuguuccuucacauccugu

SEQ ID NO: 780055 - RNA, 20 nt, Human
cgggaggcagagguugcagu

SEQ ID NO: 780056 - RNA, 22 nt, Human
cgggacacaggcuccaaacugg

SEQ ID NO: 780057 - RNA, 13 nt, Human
cgggcaugguggc

SEQ ID NO: 780058 - RNA, 19 nt, Human
cgucucccaaagugcuggg

SEQ ID NO: 780059 - RNA, 13 nt, Human
cgugagccaccaa

SEQ ID NO: 780060 - RNA, 21 nt, Human
cgcccagcuaauuuguguauu

SEQ ID NO: 780061 - RNA, 13 nt, Human
cgcgcgccaccac

SEQ ID NO: 780062 - RNA, 19 nt, Human
uugggaggcugaggcgggu

SEQ ID NO: 780063 - RNA, 12 nt, Human
cccucaugcugc

SEQ ID NO: 780064 - RNA, 13 nt, Human
cccucaugcugcc

SEQ ID NO: 780065 - RNA, 15 nt, Human
cccucaugcugccaa

SEQ ID NO: 780066 - RNA, 20 nt, Human
uuagacccucaugcugccaa

SEQ ID NO: 780067 - RNA, 16 nt, Human
ccuggucaacauggug

SEQ ID NO: 780068 - RNA, 21 nt, Human
cgaagucuuccauagagacuu

SEQ ID NO: 780069 - RNA, 20 nt, Human
cgagaaccuaaguuucaguu

SEQ ID NO: 780070 - RNA, 14 nt, Human
ccugagaccagcca

SEQ ID NO: 780071 - RNA, 15 nt, Human
ccugcaggcgugacc

SEQ ID NO: 780072 - RNA, 14 nt, Human
ccuaaccagccugg

SEQ ID NO: 780073 - RNA, 18 nt, Human
ccgggcgcgguggcucac

SEQ ID NO: 780074 - RNA, 18 nt, Human
ccucuccugggcagcugc

SEQ ID NO: 780075 - RNA, 22 nt, Human
ccgggaguggcgcgcgccacca

SEQ ID NO: 780076 - RNA, 21 nt, Human
aaauguucaucaaugaaugaa

SEQ ID NO: 780077 - RNA, 17 nt, Human
aagacccaaaaggcaga

SEQ ID NO: 780078 - RNA, 21 nt, Human
aagaugaaggcaaagcacgaa

SEQ ID NO: 780079 - RNA, 20 nt, Human
aaauacuucuugaagccgag

SEQ ID NO: 780080 - RNA, 17 nt, Human
aaguauccuucagccug

SEQ ID NO: 780081 - RNA, 16 nt, Human
aagugaaauaagccag

SEQ ID NO: 780082 - RNA, 16 nt, Human
guccacugguucuucu

SEQ ID NO: 780083 - RNA, 16 nt, Human
ggaggcugaggcgggu

SEQ ID NO: 780084 - RNA, 17 nt, Human
guauccuucagccugaa

SEQ ID NO: 780085 - RNA, 16 nt, Human
guauccuucagccuga

SEQ ID NO: 780086 - RNA, 14 nt, Human
ggacgaaccuugaa

SEQ ID NO: 780087 - RNA, 13 nt, Human
ggagacaccacca

SEQ ID NO: 780088 - RNA, 15 nt, Human
ggagacaccaccacc

SEQ ID NO: 780089 - RNA, 9 nt, Human
uaugugcaa

SEQ ID NO: 780090 - RNA, 12 nt, Human
ugcuggccaggc

SEQ ID NO: 780091 - RNA, 16 nt, Human
ugccuaagugcagccc

SEQ ID NO: 780092 - RNA, 12 nt, Human
ugagcaccugca

SEQ ID NO: 780093 - RNA, 16 nt, Human
uccugagaccagccaa

SEQ ID NO: 780094 - RNA, 19 nt, Human
ugaaaaaguucugcagaua

SEQ ID NO: 780095 - RNA, 13 nt, Human
uccugggcagcug

SEQ ID NO: 780096 - RNA, 21 nt, Human
ucccagccagcaguucagagc

SEQ ID NO: 780097 - RNA, 15 nt, Human
ucccucccuccaccu

SEQ ID NO: 780098 - RNA, 17 nt, Human
ugggacaguuccugaga

SEQ ID NO: 780099 - RNA, 17 nt, Human
uggagugcaguggcgca

SEQ ID NO: 780100 - RNA, 20 nt, Human
uggcccaggaguuuggccag

SEQ ID NO: 780101 - RNA, 17 nt, Human
uggaauuggagcucgug

SEQ ID NO: 780102 - RNA, 12 nt, Human
ugucaaugcagc

SEQ ID NO: 780103 - RNA, 20 nt, Human
gacaguuccugagaccagcc

SEQ ID NO: 780104 - RNA, 16 nt, Human
gacaaguccagccugg

SEQ ID NO: 780105 - RNA, 20 nt, Human
gaagaguggguuucacaagu

SEQ ID NO: 780106 - RNA, 19 nt, Human
gaggagaaacuggaacucu

SEQ ID NO: 780107 - RNA, 18 nt, Human
gaggcagagguugcagug

SEQ ID NO: 780108 - RNA, 23 nt, Human
gcccaacuguuauagguuguugg

SEQ ID NO: 780109 - RNA, 17 nt, Human
gccaugcuggccaggcu

SEQ ID NO: 780110 - RNA, 23 nt, Human
gccaugcuggccaggcuggucuc

SEQ ID NO: 780111 - RNA, 18 nt, Human
gccccgugggguuccucc

SEQ ID NO: 780112 - RNA, 20 nt, Human
gccccuguacuccagccugg

SEQ ID NO: 780113 - RNA, 12 nt, Human
gaggcugagaug

SEQ ID NO: 780114 - RNA, 21 nt, Human
gaguggcauguaugacgugac

SEQ ID NO: 780115 - RNA, 16 nt, Human
gcuuuagggaccugcu

SEQ ID NO: 780116 - RNA, 14 nt, Human
gcugggaguggcau

SEQ ID NO: 780117 - RNA, 15 nt, Human
gcuuagacccucaug

SEQ ID NO: 780118 - RNA, 20 nt, Human
gcuuagacccucaugcugcc

SEQ ID NO: 780119 - RNA, 18 nt, Human
gcugcccucuccugggca

SEQ ID NO: 780120 - RNA, 22 nt, Human
gccugcuggauguggagggggc

SEQ ID NO: 780121 - RNA, 15 nt, Human
gccgggcgcgguggc

SEQ ID NO: 780122 - RNA, 12 nt, Human
cgugagccacca

SEQ ID NO: 780123 - RNA, 14 nt, Human
cgugagccaccaaa

SEQ ID NO: 780124 - RNA, 17 nt, Human
cuaaaaauugugaucag

SEQ ID NO: 780125 - RNA, 22 nt, Human
cugcuugccaucccucccucca

SEQ ID NO: 780126 - RNA, 18 nt, Human
cugccuaagugcagcccc

SEQ ID NO: 780127 - RNA, 18 nt, Human
cugccucuaaaaggccug

SEQ ID NO: 780128 - RNA, 18 nt, Human
cugcccucuccugggcag

SEQ ID NO: 780129 - RNA, 23 nt, Human
cugcccucuccugggcagcugcc

SEQ ID NO: 780130 - RNA, 23 nt, Human
cgggguuugccaugcuggccagg

SEQ ID NO: 780131 - RNA, 14 nt, Human
cuugaugaagaagu

SEQ ID NO: 780132 - RNA, 23 nt, Human
cuuggcccaggaguuuggccaga

SEQ ID NO: 780133 - RNA, 13 nt, Human
cuggccugcugga

SEQ ID NO: 780134 - RNA, 19 nt, Human
cuggucucgaacugcugga

SEQ ID NO: 780135 - RNA, 21 nt, Human
cuguugccaaggcuggagugc

SEQ ID NO: 780136 - RNA, 23 nt, Human
auguggagggggcgcgugcaggc

SEQ ID NO: 780137 - RNA, 12 nt, Human
auguaccaugua

SEQ ID NO: 780138 - RNA, 23 nt, Human
caaccaugagaccacuguuauca

SEQ ID NO: 780139 - RNA, 17 nt, Human
cacaaccacucauucaa

SEQ ID NO: 780140 - RNA, 21 nt, Human
cacaacuauauuaucaugcaa

SEQ ID NO: 780141 - RNA, 22 nt, Human
cagcaggauagagugggacagu

SEQ ID NO: 780142 - RNA, 17 nt, Human
cagcaguucagagcugc

SEQ ID NO: 780143 - RNA, 20 nt, Human
cagcaguucagagcugcccu

SEQ ID NO: 780144 - RNA, 14 nt, Human
cacacugaagaagc

SEQ ID NO: 780145 - RNA, 20 nt, Human
cauggaauuggagcucgugg

SEQ ID NO: 780146 - RNA, 15 nt, Human
cauccugcaggcagc

SEQ ID NO: 780147 - RNA, 22 nt, Human
cauccugccccugagcccaugg

SEQ ID NO: 780148 - RNA, 19 nt, Human
cauccuuccucacaccagg

SEQ ID NO: 780149 - RNA, 19 nt, Human
caugcugccaauauccuaa

SEQ ID NO: 780150 - RNA, 18 nt, Human
cagcugccuccccuccuc

SEQ ID NO: 780151 - RNA, 18 nt, Human
cagccugaaagaggaaug

SEQ ID NO: 780152 - RNA, 16 nt, Human
ccuucuggguucaagc

SEQ ID NO: 780153 - RNA, 13 nt, Human
ccugggcagcugc

SEQ ID NO: 780154 - RNA, 15 nt, Human
cgcagccaugugauu

SEQ ID NO: 780155 - RNA, 14 nt, Human
ccugcaggcgugac

SEQ ID NO: 780156 - RNA, 12 nt, Human
ccucuuucaaag

SEQ ID NO: 780157 - RNA, 16 nt, Human
ccugcaauaaaauggg

SEQ ID NO: 780158 - RNA, 21 nt, Human
ccgggaguggcgcgcgccacc

SEQ ID NO: 780159 - RNA, 16 nt, Human
ccuacaugagguacug

SEQ ID NO: 780160 - RNA, 20 nt, Human
ccucauggaauuggagcucg

SEQ ID NO: 780161 - RNA, 14 nt, Human
ccauagggugacac

SEQ ID NO: 780162 - RNA, 22 nt, Human
cccagcacuuugggaggcugag

SEQ ID NO: 780163 - RNA, 15 nt, Human
cccagccagcaguuc

SEQ ID NO: 780164 - RNA, 19 nt, Human
ccagggccuggcugggagu

SEQ ID NO: 780165 - RNA, 19 nt, Human
ccaggaguuuggccagaag

SEQ ID NO: 780166 - RNA, 19 nt, Human
ccagcaguucagagcugcc

SEQ ID NO: 780167 - RNA, 22 nt, Human
ccagccagcaguucagagcugc

SEQ ID NO: 780168 - RNA, 14 nt, Human
ccagaagucaaggc

SEQ ID NO: 780169 - RNA, 14 nt, Human
ccacuacugcuacc

SEQ ID NO: 780170 - RNA, 14 nt, Human
ccacaggaaccaca

SEQ ID NO: 780171 - RNA, 14 nt, Human
ccaccaaacccggc

SEQ ID NO: 780172 - RNA, 19 nt, Human
cccucuccugggcagcugc

SEQ ID NO: 780173 - RNA, 20 nt, Human
ccccgggaguggcgcgcgcc

SEQ ID NO: 780174 - RNA, 18 nt, Human
cccugccuggaucucaca

SEQ ID NO: 780175 - RNA, 22 nt, Human
ccggagccccuugggcagguca

SEQ ID NO: 780176 - RNA, 20 nt, Human
acuugaaugugucaggugac

SEQ ID NO: 780177 - RNA, 15 nt, Human
acuuugggaggcuga

SEQ ID NO: 780178 - RNA, 12 nt, Human
agacagcagguc

SEQ ID NO: 780179 - RNA, 21 nt, Human
agcaacccaaauguucaucaa

SEQ ID NO: 780180 - RNA, 21 nt, Human
aggcuuagacccucaugcugc

SEQ ID NO: 780181 - RNA, 16 nt, Human
aggcuugccugcaggc

SEQ ID NO: 780182 - RNA, 15 nt, Human
agggacuugaaccca

SEQ ID NO: 780183 - RNA, 15 nt, Human
aucccauagccagga

SEQ ID NO: 780184 - RNA, 23 nt, Human
agugacauguuuacaaaccucaa

SEQ ID NO: 780185 - RNA, 13 nt, Human
agugcaguggcgc

SEQ ID NO: 780186 - RNA, 14 nt, Human
agucagaagaccug

SEQ ID NO: 780187 - RNA, 15 nt, Human
agugcuuggcccagg

SEQ ID NO: 780188 - RNA, 18 nt, Human
acaaaaauuagccgggca

SEQ ID NO: 780189 - RNA, 22 nt, Human
aacauuugguaaggggaauuga

SEQ ID NO: 780190 - RNA, 16 nt, Human
acugcauacaaucuga

SEQ ID NO: 780191 - RNA, 14 nt, Human
acacuuauaaguga

SEQ ID NO: 780192 - RNA, 14 nt, Human
accugggcugaggc

SEQ ID NO: 780193 - RNA, 11 nt, Human
accugagcccc

SEQ ID NO: 780194 - RNA, 20 nt, Human
acaaccuaaauuugguucua

SEQ ID NO: 780195 - RNA, 16 nt, Human
ucugcuugccaucccu

SEQ ID NO: 780196 - RNA, 21 nt, Human
ucuagguucuaaaaauuguga

SEQ ID NO: 780197 - RNA, 16 nt, Human
uggucaacauggugaa

SEQ ID NO: 780198 - RNA, 23 nt, Human
uggucucagugucaaugcagccc

SEQ ID NO: 780199 - RNA, 23 nt, Human
uggggcagugcuuggcccaggag

SEQ ID NO: 780200 - RNA, 14 nt, Human
uucagagcugcccu

SEQ ID NO: 780201 - RNA, 22 nt, Human
uuggcccaggaguuuggccaga

SEQ ID NO: 780202 - RNA, 22 nt, Human
uugggaggcugaggcgggugga

SEQ ID NO: 780203 - RNA, 21 nt, Human
gucucccucuguugccaaggc

SEQ ID NO: 780204 - RNA, 22 nt, Human
gugauccgcccaucuccgucuc

SEQ ID NO: 780205 - RNA, 15 nt, Human
gugcuuggcccagga

SEQ ID NO: 780206 - RNA, 23 nt, Human
gugcuuuaauggcaugucagaca

SEQ ID NO: 780207 - RNA, 16 nt, Human
gucccagccagcaguu

SEQ ID NO: 780208 - RNA, 19 nt, Human
gucccagccagcaguucag

SEQ ID NO: 780209 - RNA, 19 nt, Human
uacaaaaauuagccgggca

SEQ ID NO: 780210 - RNA, 23 nt, Human
uacaggcgugagccaccaaaccc

SEQ ID NO: 780211 - RNA, 16 nt, Human
uacaguucucccaagg

SEQ ID NO: 780212 - RNA, 23 nt, Human
gugcugggaauuacaggcgugag

SEQ ID NO: 780213 - RNA, 18 nt, Human
guggcauguaugacguga

SEQ ID NO: 780214 - RNA, 18 nt, Human
ucccucuguugccaaggc

SEQ ID NO: 780215 - RNA, 23 nt, Human
ucccuggaagagaucaagccauc

SEQ ID NO: 780216 - RNA, 17 nt, Human
uccccaaaaagaauggg

SEQ ID NO: 780217 - RNA, 12 nt, Human
ggagcucgugga

SEQ ID NO: 780218 - RNA, 12 nt, Human
ggagcucguggg

SEQ ID NO: 780219 - RNA, 13 nt, Human
ggcagaagcaacc

SEQ ID NO: 780220 - RNA, 13 nt, Human
ggcacuugggaca

SEQ ID NO: 780221 - RNA, 13 nt, Human
gcuggagugcagu

SEQ ID NO: 780222 - RNA, 20 nt, Human
gcuuguauuuuacuuuucca

SEQ ID NO: 780223 - RNA, 13 nt, Human
gggcugaugcagu

SEQ ID NO: 780224 - RNA, 16 nt, Human
ggggccaugaaucacc

SEQ ID NO: 780225 - RNA, 12 nt, Human
ggggcgcgugca

SEQ ID NO: 780226 - RNA, 18 nt, Human
gggcagugcuuggcccag

SEQ ID NO: 780227 - RNA, 17 nt, Human
gggguggguggggcagu

SEQ ID NO: 780228 - RNA, 14 nt, Human
ggguggggcagugc

SEQ ID NO: 780229 - RNA, 21 nt, Human
guacauuuccaaauucacaag

SEQ ID NO: 780230 - RNA, 16 nt, Human
gguucuaggccgggcg

SEQ ID NO: 780231 - RNA, 21 nt, Human
gguuucacaagugaaaaacau

SEQ ID NO: 780232 - RNA, 16 nt, Human
gggauuguaaaauggu

SEQ ID NO: 780233 - RNA, 12 nt, Human
gggaguggcgcg

SEQ ID NO: 780234 - RNA, 15 nt, Human
ggcugaggcgggugg

SEQ ID NO: 780235 - RNA, 16 nt, Human
ggcuauuuaaagacaa

SEQ ID NO: 780236 - RNA, 16 nt, Human
auuugcugagcaugua

SEQ ID NO: 780237 - RNA, 11 nt, Human
auuugguucua

SEQ ID NO: 780238 - RNA, 13 nt, Human
auuuucaccuguu

SEQ ID NO: 780239 - RNA, 14 nt, Human
caaacgaaaaacau

SEQ ID NO: 780240 - RNA, 14 nt, Human
caccucccugcaau

SEQ ID NO: 780241 - RNA, 16 nt, Human
caccucauggaauugg

SEQ ID NO: 780242 - RNA, 24 nt, Human
aucucaggagauuucaugccuggu

SEQ ID NO: 780243 - RNA, 17 nt, Human
aucccucccuccaccuc

SEQ ID NO: 780244 - RNA, 19 nt, Human
aucccucccuccaccuccc

SEQ ID NO: 780245 - RNA, 21 nt, Human
auccuaauaaaaaggugacca

SEQ ID NO: 780246 - RNA, 21 nt, Human
auccucugagugugaccaggc

SEQ ID NO: 780247 - RNA, 21 nt, Human
auucagccccgggaguggcgc

SEQ ID NO: 780248 - RNA, 20 nt, Human
auugagcaccugcaggcgug

SEQ ID NO: 780249 - RNA, 11 nt, Human
acaggcgugag

SEQ ID NO: 780250 - RNA, 16 nt, Human
acagcccaaggguggg

SEQ ID NO: 780251 - RNA, 15 nt, Human
accagggccuggcug

SEQ ID NO: 780252 - RNA, 18 nt, Human
agcagggacuugaaccca

SEQ ID NO: 780253 - RNA, 16 nt, Human
agccaccaaacccggc

SEQ ID NO: 780254 - RNA, 17 nt, Human
agcccacuggcucccug

SEQ ID NO: 780255 - RNA, 21 nt, Human
aggcagagguugcagugagcc

SEQ ID NO: 780256 - RNA, 22 nt, Human
agcugcccucuccugggcagcu

SEQ ID NO: 780257 - RNA, 19 nt, Human
agcuucucauccugcaggc

SEQ ID NO: 780258 - RNA, 15 nt, Human
auaacucaucauaaa

SEQ ID NO: 780259 - RNA, 14 nt, Human
aguucagagcugcc

SEQ ID NO: 780260 - RNA, 14 nt, Human
acuugggaggcuga

SEQ ID NO: 780261 - RNA, 16 nt, Human
aagugaaaaacaucca

SEQ ID NO: 780262 - RNA, 19 nt, Human
acugggguggguggggcag

SEQ ID NO: 780263 - RNA, 13 nt, Human
acugacaacuuga

SEQ ID NO: 780264 - RNA, 13 nt, Human
acuggccugcugg

SEQ ID NO: 780265 - RNA, 22 nt, Human
acuguacccaaauggaaaguaa

SEQ ID NO: 780266 - RNA, 18 nt, Human
acgugacuggccugcugg

SEQ ID NO: 780267 - RNA, 21 nt, Human
acgugacuggccugcuggaug

SEQ ID NO: 780268 - RNA, 20 nt, Human
acucaucaaucaaauaagua

SEQ ID NO: 780269 - RNA, 13 nt, Human
accuguccccgaa

SEQ ID NO: 780270 - RNA, 14 nt, Human
acacagugucuggc

SEQ ID NO: 780271 - RNA, 21 nt, Human
acaggacagcccuucuuucca

SEQ ID NO: 780272 - RNA, 20 nt, Human
cagugagacucugucucagu

SEQ ID NO: 780273 - RNA, 20 nt, Human
caguucagagcugcccucuc

SEQ ID NO: 780274 - RNA, 19 nt, Human
cauccugccccugagccca

SEQ ID NO: 780275 - RNA, 18 nt, Human
cauagcaucucaggagau

SEQ ID NO: 780276 - RNA, 15 nt, Human
caguucugaagaaga

SEQ ID NO: 780277 - RNA, 21 nt, Human
cagccaggcggcuggaauuga

SEQ ID NO: 780278 - RNA, 16 nt, Human
caggcuugccugcagg

SEQ ID NO: 780279 - RNA, 17 nt, Human
caggaguuuggccagaa

SEQ ID NO: 780280 - RNA, 22 nt, Human
caggcgugaccugacagcccaa

SEQ ID NO: 780281 - RNA, 18 nt, Human
cauggaauuggagcucgu

SEQ ID NO: 780282 - RNA, 14 nt, Human
caugggcacugugg

SEQ ID NO: 780283 - RNA, 19 nt, Human
caugagagacagcaggucu

SEQ ID NO: 780284 - RNA, 19 nt, Human
cauguaugacgugacuggc

SEQ ID NO: 780285 - RNA, 13 nt, Human
ccaaagugcuggg

SEQ ID NO: 780286 - RNA, 15 nt, Human
ccaccaaacccggcc

SEQ ID NO: 780287 - RNA, 16 nt, Human
ccacuuauaggaauug

SEQ ID NO: 780288 - RNA, 21 nt, Human
ccaggaguuuggccagaaguc

SEQ ID NO: 780289 - RNA, 21 nt, Human
cccaaggguggguggggugag

SEQ ID NO: 780290 - RNA, 15 nt, Human
ccauggagguuaagc

SEQ ID NO: 780291 - RNA, 20 nt, Human
ccaugauguuuagaaacaca

SEQ ID NO: 780292 - RNA, 22 nt, Human
ccagcaguucagagcugcccuc

SEQ ID NO: 780293 - RNA, 19 nt, Human
auuugguucuaggccgggc

SEQ ID NO: 780294 - RNA, 16 nt, Human
caaaaauuagccgggc

SEQ ID NO: 780295 - RNA, 17 nt, Human
caacugggguggguggg

SEQ ID NO: 780296 - RNA, 20 nt, Human
cacagccucuuagaugcagu

SEQ ID NO: 780297 - RNA, 23 nt, Human
caccaggcuugccugcaggcaug

SEQ ID NO: 780298 - RNA, 15 nt, Human
cacuaaaaaggcaug

SEQ ID NO: 780299 - RNA, 14 nt, Human
cacuuaaaaauggu

SEQ ID NO: 780300 - RNA, 17 nt, Human
cagaccauaauguuaca

SEQ ID NO: 780301 - RNA, 21 nt, Human
cacuuuaacacagugucuggc

SEQ ID NO: 780302 - RNA, 19 nt, Human
cagaaauuuaauucauguu

SEQ ID NO: 780303 - RNA, 13 nt, Human
cagaagucaaggc

SEQ ID NO: 780304 - RNA, 22 nt, Human
auaaccaugcccaagaaugaga

SEQ ID NO: 780305 - RNA, 13 nt, Human
aguucagagcugc

SEQ ID NO: 780306 - RNA, 17 nt, Human
aguucagagcugcccuc

SEQ ID NO: 780307 - RNA, 14 nt, Human
aucacuugaacccg

SEQ ID NO: 780308 - RNA, 17 nt, Human
auccaguuacugccggu

SEQ ID NO: 780309 - RNA, 19 nt, Human
auauuauuuugaauccaga

SEQ ID NO: 780310 - RNA, 17 nt, Human
augaaguacucauacau

SEQ ID NO: 780311 - RNA, 16 nt, Human
agucagucugaugaga

SEQ ID NO: 780312 - RNA, 13 nt, Human
agggaccugcugu

SEQ ID NO: 780313 - RNA, 13 nt, Human
aggaauugaccca

SEQ ID NO: 780314 - RNA, 12 nt, Human
agcuguggccag

SEQ ID NO: 780315 - RNA, 13 nt, Human
ugcccaagaauga

SEQ ID NO: 780316 - RNA, 17 nt, Human
ugcccucuccugggcag

SEQ ID NO: 780317 - RNA, 19 nt, Human
ugcccucuccugggcagcu

SEQ ID NO: 780318 - RNA, 17 nt, Human
agccccuugggcagguc

SEQ ID NO: 780319 - RNA, 22 nt, Human
agccuggcaaggguucaccugg

SEQ ID NO: 780320 - RNA, 16 nt, Human
agcgacagugagacuc

SEQ ID NO: 780321 - RNA, 15 nt, Human
agccggagccccuug

SEQ ID NO: 780322 - RNA, 11 nt, Human
agccugaccac

SEQ ID NO: 780323 - RNA, 16 nt, Human
gccaacuaggcagcca

SEQ ID NO: 780324 - RNA, 21 nt, Human
gcaugguggcgcgcaccugua

SEQ ID NO: 780325 - RNA, 19 nt, Human
gcagucagaagaccugguc

SEQ ID NO: 780326 - RNA, 18 nt, Human
gcagugcuuggcccagga

SEQ ID NO: 780327 - RNA, 15 nt, Human
gcaccugcaggcgug

SEQ ID NO: 780328 - RNA, 23 nt, Human
gcagcucuaaaugucaaucagcc

SEQ ID NO: 780329 - RNA, 16 nt, Human
gaccagccaaccuggg

SEQ ID NO: 780330 - RNA, 20 nt, Human
gacgugacuggccugcugga

SEQ ID NO: 780331 - RNA, 13 nt, Human
agcaccugcaggc

SEQ ID NO: 780332 - RNA, 21 nt, Human
agcagcuuauucacaagaccc

SEQ ID NO: 780333 - RNA, 17 nt, Human
agcagugcuugaaugaa

SEQ ID NO: 780334 - RNA, 15 nt, Human
agcaguucagagcug

SEQ ID NO: 780335 - RNA, 18 nt, Human
agcaguucagagcugccc

SEQ ID NO: 780336 - RNA, 16 nt, Human
agagacagaaagcaga

SEQ ID NO: 780337 - RNA, 21 nt, Human
agacaugagagacagcagguc

SEQ ID NO: 780338 - RNA, 21 nt, Human
cugcagacaugagagacagca

SEQ ID NO: 780339 - RNA, 16 nt, Human
cucuccugggcagcug

SEQ ID NO: 780340 - RNA, 12 nt, Human
cucccuccaccu

SEQ ID NO: 780341 - RNA, 21 nt, Human
cucccuccaccucccugcaau

SEQ ID NO: 780342 - RNA, 12 nt, Human
cuccagccuggg

SEQ ID NO: 780343 - RNA, 19 nt, Human
cucauugcaaccuccaccu

SEQ ID NO: 780344 - RNA, 19 nt, Human
cucauggaauuggagcucg

SEQ ID NO: 780345 - RNA, 21 nt, Human
caguuccugagaccagccaac

SEQ ID NO: 780346 - RNA, 23 nt, Human
cagacaugagagacagcaggucu

SEQ ID NO: 780347 - RNA, 16 nt, Human
gccaccaaacccggcc

SEQ ID NO: 780348 - RNA, 15 nt, Human
gccaccacgcccagc

SEQ ID NO: 780349 - RNA, 22 nt, Human
gccagcaguucagagcugcccu

SEQ ID NO: 780350 - RNA, 15 nt, Human
ggccgggcgcggugg

SEQ ID NO: 780351 - RNA, 17 nt, Human
ggcgcgcgccaccacgc

SEQ ID NO: 780352 - RNA, 14 nt, Human
ggcgcgguggcuca

SEQ ID NO: 780353 - RNA, 14 nt, Human
gcucauggaauugg

SEQ ID NO: 780354 - RNA, 20 nt, Human
ggcacuugggacaaaaacaa

SEQ ID NO: 780355 - RNA, 22 nt, Human
ggcagcaggauagagugggaca

SEQ ID NO: 780356 - RNA, 12 nt, Human
gugcuuggccca

SEQ ID NO: 780357 - RNA, 20 nt, Human
gugcugggaauuacaggcgu

SEQ ID NO: 780358 - RNA, 16 nt, Human
gugucaaugcagcccc

SEQ ID NO: 780359 - RNA, 21 nt, Human
ggcuggucucgaacugcugga

SEQ ID NO: 780360 - RNA, 21 nt, Human
ggcuuagacccucaugcugcc

SEQ ID NO: 780361 - RNA, 17 nt, Human
gggcagugcuuggccca

SEQ ID NO: 780362 - RNA, 16 nt, Human
guuccuaaccagccug

SEQ ID NO: 780363 - RNA, 12 nt, Human
uacauacugcug

SEQ ID NO: 780364 - RNA, 13 nt, Human
ucaacaauaguga

SEQ ID NO: 780365 - RNA, 13 nt, Human
ucagaagaaauuc

SEQ ID NO: 780366 - RNA, 19 nt, Human
ucucuuuuuagagaaauuu

SEQ ID NO: 780367 - RNA, 11 nt, Human
ucauuucaaaa

SEQ ID NO: 780368 - RNA, 18 nt, Human
cagcuacuugggaggcug

SEQ ID NO: 780369 - RNA, 17 nt, Human
agacuuugugaaaaaaa

SEQ ID NO: 780370 - RNA, 18 nt, Human
uuauuacuguaagaaaau

SEQ ID NO: 780371 - RNA, 16 nt, Human
acugaauguaaacaaa

SEQ ID NO: 780372 - RNA, 23 nt, Human
cauuguggucacaggaaguagag

SEQ ID NO: 780373 - RNA, 18 nt, Human
cuuuccacagaagcucca

SEQ ID NO: 780374 - RNA, 14 nt, Human
cuuaaaauguaauu

SEQ ID NO: 780375 - RNA, 23 nt, Human
uauguuaaaacugggacagggga

SEQ ID NO: 780376 - RNA, 18 nt, Human
uaacuggcaguuuuccau

SEQ ID NO: 780377 - RNA, 20 nt, Human
agcaguucagagcugcccuc

SEQ ID NO: 780378 - RNA, 20 nt, Human
agagauuuuuaaauaaagaa

SEQ ID NO: 780379 - RNA, 20 nt, Human
auguuauuuuuuaauuauua

SEQ ID NO: 780380 - RNA, 13 nt, Human
uuaacauuauuua

SEQ ID NO: 780381 - RNA, 16 nt, Human
auagaauuaauggaau

SEQ ID NO: 780382 - RNA, 13 nt, Human
gccuggcugggag

SEQ ID NO: 780383 - RNA, 17 nt, Human
gacaguguuuucuggga

SEQ ID NO: 780384 - RNA, 23 nt, Human
cucuacuaaaaauacaaaaaaaa

SEQ ID NO: 780385 - RNA, 22 nt, Human
augggaugaucauguauuuauu

SEQ ID NO: 780386 - RNA, 14 nt, Human
auuucuaugaaaua

SEQ ID NO: 780387 - RNA, 12 nt, Human
aauugcagagua

SEQ ID NO: 780388 - RNA, 19 nt, Human
ccaugcuggccaggcuggu

SEQ ID NO: 780389 - RNA, 16 nt, Human
uaauuuaagauuuugu

SEQ ID NO: 780390 - RNA, 22 nt, Human
uagauacugaauguaaacaaag

SEQ ID NO: 780391 - RNA, 18 nt, Human
gauggguuugacaagguu

SEQ ID NO: 780392 - RNA, 17 nt, Human
uuguuagcaaaauggau

SEQ ID NO: 780393 - RNA, 17 nt, Human
uuauaaucuuucacagg

SEQ ID NO: 780394 - RNA, 17 nt, Human
agcucugcccauccugc

SEQ ID NO: 780395 - RNA, 18 nt, Human
uaaaauccauacauuugu

SEQ ID NO: 780396 - RNA, 22 nt, Human
agugacuuaguguacaugaaag

SEQ ID NO: 780397 - RNA, 15 nt, Human
cuguacuuuuuccag

SEQ ID NO: 780398 - RNA, 23 nt, Human
auagcauauguuuuuguaaguuu

SEQ ID NO: 780399 - RNA, 21 nt, Human
caucauaaaauaaaguauaua

SEQ ID NO: 780400 - RNA, 19 nt, Human
uguugacaacugugacugu

SEQ ID NO: 780401 - RNA, 16 nt, Human
ucugcagauaaacagu

SEQ ID NO: 780402 - RNA, 13 nt, Human
gagcaccugcagg

SEQ ID NO: 780403 - RNA, 11 nt, Human
uccauuguaau

SEQ ID NO: 780404 - RNA, 22 nt, Human
uaugcaaccuuuggaugcacuu

SEQ ID NO: 780405 - RNA, 16 nt, Human
augacuaaaaaacaaa

SEQ ID NO: 780406 - RNA, 16 nt, Human
ugcaaauugucacagg

SEQ ID NO: 780407 - RNA, 21 nt, Human
ucucuggcgacaguuuuccuu

SEQ ID NO: 780408 - RNA, 15 nt, Human
gagauuucaugccug

SEQ ID NO: 780409 - RNA, 15 nt, Human
gacgugacuggccug

SEQ ID NO: 780410 - RNA, 16 nt, Human
aaaguauaaauaaaau

SEQ ID NO: 780411 - RNA, 15 nt, Human
auuaucaauaucuaa

SEQ ID NO: 780412 - RNA, 13 nt, Human
gcaguucagagcu

SEQ ID NO: 780413 - RNA, 13 nt, Human
ggggcucugggau

SEQ ID NO: 780414 - RNA, 17 nt, Human
uuugaauccagaaauaa

SEQ ID NO: 780415 - RNA, 14 nt, Human
acuggccugcugga

SEQ ID NO: 780416 - RNA, 22 nt, Human
aucauaaaauaaaguauauaua

SEQ ID NO: 780417 - RNA, 19 nt, Human
ucuccugggcagcugccuc

SEQ ID NO: 780418 - RNA, 15 nt, Human
cagcugccuccccuc

SEQ ID NO: 780419 - RNA, 14 nt, Human
ggaaguagaggagg

SEQ ID NO: 780420 - RNA, 16 nt, Human
aucagucauaacuaaa

SEQ ID NO: 780421 - RNA, 15 nt, Human
gcuguugagcuguuu

SEQ ID NO: 780422 - RNA, 15 nt, Human
cacccuugccaugga

SEQ ID NO: 780423 - RNA, 15 nt, Human
aaucaaauuccagaa

SEQ ID NO: 780424 - RNA, 17 nt, Human
aagcugaauacauucug

SEQ ID NO: 780425 - RNA, 22 nt, Human
agcuuguauuccuuuuucucuc

SEQ ID NO: 780426 - RNA, 12 nt, Human
aauuuuucucua

SEQ ID NO: 780427 - RNA, 18 nt, Human
uguggucacaggaaguag

SEQ ID NO: 780428 - RNA, 14 nt, Human
ccacccuugccaug

SEQ ID NO: 780429 - RNA, 15 nt, Human
cugccuccccuccuc

SEQ ID NO: 780430 - RNA, 22 nt, Human
uacaguuagagauuuuuaaaua

SEQ ID NO: 780431 - RNA, 19 nt, Human
gcugcccucuccugggcag

SEQ ID NO: 780432 - RNA, 22 nt, Human
uuuuuccccaaaaagaauggga

SEQ ID NO: 780433 - RNA, 20 nt, Human
augaaguuguagguaauauu

SEQ ID NO: 780434 - RNA, 12 nt, Human
cuauuauagaau

SEQ ID NO: 780435 - RNA, 16 nt, Human
agacaccaccacccuu

SEQ ID NO: 780436 - RNA, 15 nt, Human
ccuuccagugucucg

SEQ ID NO: 780437 - RNA, 17 nt, Human
cuuguuagcaaaaugga

SEQ ID NO: 780438 - RNA, 17 nt, Human
cuggcugggaguggcau

SEQ ID NO: 780439 - RNA, 16 nt, Human
uugccauaauuacuau

SEQ ID NO: 780440 - RNA, 14 nt, Human
caaggcuagaacca

SEQ ID NO: 780441 - RNA, 23 nt, Human
aaaauguguauuuuauuacaucu

SEQ ID NO: 780442 - RNA, 13 nt, Human
gcgugcaggcagc

SEQ ID NO: 780443 - RNA, 18 nt, Human
gaacgauuuagaaagaag

SEQ ID NO: 780444 - RNA, 13 nt, Human
uggcaguuuucca

SEQ ID NO: 780445 - RNA, 16 nt, Human
agauaaagauuucuug

SEQ ID NO: 780446 - RNA, 21 nt, Human
auuguugacaacugugacugu

SEQ ID NO: 780447 - RNA, 17 nt, Human
cauagagacuuugugaa

SEQ ID NO: 780448 - RNA, 15 nt, Human
uuuaaagacaaagac

SEQ ID NO: 780449 - RNA, 15 nt, Human
aacaucuagcaaaug

SEQ ID NO: 780450 - RNA, 20 nt, Human
aauuuaugaguuuuugauag

SEQ ID NO: 780451 - RNA, 18 nt, Human
auugaaaggcauucucug

SEQ ID NO: 780452 - RNA, 22 nt, Human
uagcagacaguguuuucuggga

SEQ ID NO: 780453 - RNA, 13 nt, Human
auugucuagugaa

SEQ ID NO: 780454 - RNA, 23 nt, Human
aguucugucuggacuuuccagag

SEQ ID NO: 780455 - RNA, 18 nt, Human
cuccagccugagcgacag

SEQ ID NO: 780456 - RNA, 21 nt, Human
aguuucaguugauuuuacaau

SEQ ID NO: 780457 - RNA, 19 nt, Human
ccucaacccccauuucuau

SEQ ID NO: 780458 - RNA, 20 nt, Human
acuaaauaaagcuugcaaca

SEQ ID NO: 780459 - RNA, 21 nt, Human
ucucacaagcacuuucccucu

SEQ ID NO: 780460 - RNA, 19 nt, Human
aagcuuguauuccuuuuuc

SEQ ID NO: 780461 - RNA, 14 nt, Human
acccaaaaggcaga

SEQ ID NO: 780462 - RNA, 16 nt, Human
caugguuuagaaagcu

SEQ ID NO: 780463 - RNA, 21 nt, Human
caacccccauuucuauuuauu

SEQ ID NO: 780464 - RNA, 22 nt, Human
cuccugccuaagugcagccccg

SEQ ID NO: 780465 - RNA, 16 nt, Human
auuguuugucugucuu

SEQ ID NO: 780466 - RNA, 20 nt, Human
uaagauuuuguuuuuaaacu

SEQ ID NO: 780467 - RNA, 16 nt, Human
ucucuaggaaauauuu

SEQ ID NO: 780468 - RNA, 23 nt, Human
aauagaaacguguauauuuuuua

SEQ ID NO: 780469 - RNA, 15 nt, Human
uuuaccugugaaaua

SEQ ID NO: 780470 - RNA, 23 nt, Human
uuaucagucauaacuaaauaaag

SEQ ID NO: 780471 - RNA, 19 nt, Human
uuagacccucaugcugcca

SEQ ID NO: 780472 - RNA, 16 nt, Human
auuauaauuuuuuuca

SEQ ID NO: 780473 - RNA, 16 nt, Human
uuuguaauauuucucu

SEQ ID NO: 780474 - RNA, 23 nt, Human
ucaaccaaauggagugacuuagu

SEQ ID NO: 780475 - RNA, 15 nt, Human
cuggccaggcugguc

SEQ ID NO: 780476 - RNA, 16 nt, Human
aucaauuuaaaaaaaa

SEQ ID NO: 780477 - RNA, 19 nt, Human
agcaucucaggagauuuca

SEQ ID NO: 780478 - RNA, 16 nt, Human
ugggucucaguguccu

SEQ ID NO: 780479 - RNA, 18 nt, Human
ucuuugguggagauaaag

SEQ ID NO: 780480 - RNA, 15 nt, Human
cuagauacugaaugu

SEQ ID NO: 780481 - RNA, 16 nt, Human
cgccuguaaucccagc

SEQ ID NO: 780482 - RNA, 15 nt, Human
uauguauuuauaaau

SEQ ID NO: 780483 - RNA, 13 nt, Human
cccugcacuccag

SEQ ID NO: 780484 - RNA, 13 nt, Human
auaaacucagaaa

SEQ ID NO: 780485 - RNA, 21 nt, Human
uaucuaauauauaugaauaaa

SEQ ID NO: 780486 - RNA, 16 nt, Human
uuuacaauugaaauga

SEQ ID NO: 780487 - RNA, 13 nt, Human
ucugcuugccauc

SEQ ID NO: 780488 - RNA, 16 nt, Human
ccuguacuccagccug

SEQ ID NO: 780489 - RNA, 19 nt, Human
aacuauauuaucaugcaaa

SEQ ID NO: 780490 - RNA, 16 nt, Human
gugacuggccugcugg

SEQ ID NO: 780491 - RNA, 22 nt, Human
gaagugaaaaucuacacuccag

SEQ ID NO: 780492 - RNA, 12 nt, Human
cuggccaggcug

SEQ ID NO: 780493 - RNA, 21 nt, Human
aucaagccaucggagcugcua

SEQ ID NO: 780494 - RNA, 14 nt, Human
uguggcuguaucuu

SEQ ID NO: 780495 - RNA, 21 nt, Human
guggccagcuuguuauuuaua

SEQ ID NO: 780496 - RNA, 21 nt, Human
uuguaauucuaaaugaauguu

SEQ ID NO: 780497 - RNA, 23 nt, Human
ccagagggaauugcagaguacug

SEQ ID NO: 780498 - RNA, 20 nt, Human
aucuguaaaauggagacacc

SEQ ID NO: 780499 - RNA, 21 nt, Human
cuggcuuaaaauguaauuaau

SEQ ID NO: 780500 - RNA, 22 nt, Human
cuccagccugagcgacagugag

SEQ ID NO: 780501 - RNA, 11 nt, Human
gagaagagaau

SEQ ID NO: 780502 - RNA, 14 nt, Human
uggacaguuuucug

SEQ ID NO: 780503 - RNA, 12 nt, Human
caucuucucugg

SEQ ID NO: 780504 - RNA, 16 nt, Human
ugcuggauucaaguga

SEQ ID NO: 780505 - RNA, 18 nt, Human
caaccuccaccuucuggg

SEQ ID NO: 780506 - RNA, 22 nt, Human
cagacuuuuuuuuuuuuuuaaa

SEQ ID NO: 780507 - RNA, 19 nt, Human
auuauggcugguaacauag

SEQ ID NO: 780508 - RNA, 21 nt, Human
cugcuugccaucccucccucc

SEQ ID NO: 780509 - RNA, 14 nt, Human
cagucugaugagaa

SEQ ID NO: 780510 - RNA, 13 nt, Human
aauaaaaagguga

SEQ ID NO: 780511 - RNA, 13 nt, Human
ccucugcuugcca

SEQ ID NO: 780512 - RNA, 11 nt, Human
ggguuucucca

SEQ ID NO: 780513 - RNA, 14 nt, Human
uugaauaaauaaau

SEQ ID NO: 780514 - RNA, 20 nt, Human
uccagagggaauugcagagu

SEQ ID NO: 780515 - RNA, 15 nt, Human
acuggcucccuggaa

SEQ ID NO: 780516 - RNA, 14 nt, Human
ucccucuguugcca

SEQ ID NO: 780517 - RNA, 15 nt, Human
ggcuuagacccucau

SEQ ID NO: 780518 - RNA, 19 nt, Human
caccuguaaucccagcuac

SEQ ID NO: 780519 - RNA, 20 nt, Human
aaaucucuauuaggaaauau

SEQ ID NO: 780520 - RNA, 16 nt, Human
uuauaagcuguuuuua

SEQ ID NO: 780521 - RNA, 15 nt, Human
guacuggcugaugga

SEQ ID NO: 780522 - RNA, 16 nt, Human
ugaauuaguuuuauau

SEQ ID NO: 780523 - RNA, 13 nt, Human
caucccucccucc

SEQ ID NO: 780524 - RNA, 23 nt, Human
uagacacacaugaaguccaagca

SEQ ID NO: 780525 - RNA, 15 nt, Human
caaaacuuucuuuuc

SEQ ID NO: 780526 - RNA, 14 nt, Human
ugcauuaaauauaa

SEQ ID NO: 780527 - RNA, 11 nt, Human
gugaaaaaaaa

SEQ ID NO: 780528 - RNA, 22 nt, Human
ccacagcuguaugauucccagc

SEQ ID NO: 780529 - RNA, 13 nt, Human
auccugcaggcag

SEQ ID NO: 780530 - RNA, 18 nt, Human
guaaauagaaacguguau

SEQ ID NO: 780531 - RNA, 17 nt, Human
caauuauaucaguccuc

SEQ ID NO: 780532 - RNA, 16 nt, Human
ucccugcaauaaaaug

SEQ ID NO: 780533 - RNA, 19 nt, Human
agaccuaggauuucaugau

SEQ ID NO: 780534 - RNA, 19 nt, Human
uacaguuagagauuuuuaa

SEQ ID NO: 780535 - RNA, 20 nt, Human
auuuuuaccuuuuuccuucc

SEQ ID NO: 780536 - RNA, 18 nt, Human
ugucuggacuuuccagag

SEQ ID NO: 780537 - RNA, 13 nt, Human
acacacaugaagu

SEQ ID NO: 780538 - RNA, 13 nt, Human
uuacaauugaaau

SEQ ID NO: 780539 - RNA, 22 nt, Human
aauuguauuuuaguaagagauu

SEQ ID NO: 780540 - RNA, 11 nt, Human
guaaugaaaau

SEQ ID NO: 780541 - RNA, 10 nt, Human
acauauuucu

SEQ ID NO: 780542 - RNA, 15 nt, Human
uccgaagucuuccau

SEQ ID NO: 780543 - RNA, 22 nt, Human
caucccucccuccaccucccug

SEQ ID NO: 780544 - RNA, 17 nt, Human
uuagccgggcauggugg

SEQ ID NO: 780545 - RNA, 13 nt, Human
uuauugagcaccu

SEQ ID NO: 780546 - RNA, 23 nt, Human
acucuauguucuaagaagugaaa

SEQ ID NO: 780547 - RNA, 22 nt, Human
agcauauguuuuuguaaguuua

SEQ ID NO: 780548 - RNA, 20 nt, Human
uacugccgguuugaaaauau

SEQ ID NO: 780549 - RNA, 17 nt, Human
cccucugggucucagug

SEQ ID NO: 780550 - RNA, 22 nt, Human
cuuccauuccaagccugaccac

SEQ ID NO: 780551 - RNA, 15 nt, Human
ugagagacagcaggu

SEQ ID NO: 780552 - RNA, 17 nt, Human
augcacuuuauauuauu

SEQ ID NO: 780553 - RNA, 21 nt, Human
ugggcauucuuguuucaauuc

SEQ ID NO: 780554 - RNA, 15 nt, Human
auauuuauuaccucu

SEQ ID NO: 780555 - RNA, 19 nt, Human
cgaucuuugacucuuuugc

SEQ ID NO: 780556 - RNA, 20 nt, Human
gugugcuggcuuaaaaugua

SEQ ID NO: 780557 - RNA, 18 nt, Human
uaaaucuauuuauuaaua

SEQ ID NO: 780558 - RNA, 22 nt, Human
uagaauauuuauuaccucugau

SEQ ID NO: 780559 - RNA, 23 nt, Human
cuaaauaaagcuugcaacaaaau

SEQ ID NO: 780560 - RNA, 19 nt, Human
gugacuuaaugccacuaaa

SEQ ID NO: 780561 - RNA, 21 nt, Human
agaaauuugccaauuuacuuu

SEQ ID NO: 780562 - RNA, 16 nt, Human
auuuguauaaaauaau

SEQ ID NO: 780563 - RNA, 17 nt, Human
ugcccaagaaugagaag

SEQ ID NO: 780564 - RNA, 20 nt, Human
ugagcagugcuugaaugaag

SEQ ID NO: 780565 - RNA, 22 nt, Human
caccagucugacuguuuccauc

SEQ ID NO: 780566 - RNA, 18 nt, Human
uauuuaagguauauaaau

SEQ ID NO: 780567 - RNA, 22 nt, Human
cccaugauguuuagaaacacaa

SEQ ID NO: 780568 - RNA, 16 nt, Human
gagaaacuggaacucu

SEQ ID NO: 780569 - RNA, 15 nt, Human
aagaaauaugcacaa

SEQ ID NO: 780570 - RNA, 11 nt, Human
ggucacaggaa

SEQ ID NO: 780571 - RNA, 22 nt, Human
caaauuuacagagacagaaagc

SEQ ID NO: 780572 - RNA, 15 nt, Human
cugacucuuaagaag

SEQ ID NO: 780573 - RNA, 13 nt, Human
acaugagagacag

SEQ ID NO: 780574 - RNA, 13 nt, Human
aagaauuuuaaaa

SEQ ID NO: 780575 - RNA, 19 nt, Human
uaauacagggcauuuuggu

SEQ ID NO: 780576 - RNA, 17 nt, Human
auuuacuuuguuauuuu

SEQ ID NO: 780577 - RNA, 23 nt, Human
aaugcuuaugaaacuaagauuug

SEQ ID NO: 780578 - RNA, 21 nt, Human
cugcuggauucaagugauccg

SEQ ID NO: 780579 - RNA, 21 nt, Human
cuagauacugaauguaaacaa

SEQ ID NO: 780580 - RNA, 13 nt, Human
caacaucuaguga

SEQ ID NO: 780581 - RNA, 16 nt, Human
auauccugugacuguc

SEQ ID NO: 780582 - RNA, 16 nt, Human
aguccucuuucaaagg

SEQ ID NO: 780583 - RNA, 20 nt, Human
agccuaguugaucagcuuau

SEQ ID NO: 780584 - RNA, 15 nt, Human
gaucauguauuuauu

SEQ ID NO: 780585 - RNA, 21 nt, Human
accuccaccuucuggguucaa

SEQ ID NO: 780586 - RNA, 15 nt, Human
cuauauccugugacu

SEQ ID NO: 780587 - RNA, 16 nt, Human
gccuaucagcauuuua

SEQ ID NO: 780588 - RNA, 18 nt, Human
agucagucugaugagaac

SEQ ID NO: 780589 - RNA, 15 nt, Human
gcgugagccaccaaa

SEQ ID NO: 780590 - RNA, 21 nt, Human
uccguggcacugcauacaauc

SEQ ID NO: 780591 - RNA, 19 nt, Human
uauguaacugcauugagaa

SEQ ID NO: 780592 - RNA, 18 nt, Human
aaaucuaaaucuauuuau

SEQ ID NO: 780593 - RNA, 16 nt, Human
ucuguauugcauuaaa

SEQ ID NO: 780594 - RNA, 19 nt, Human
uggugagugccuguaauca

SEQ ID NO: 780595 - RNA, 12 nt, Human
aaaacaaagaag

SEQ ID NO: 780596 - RNA, 22 nt, Human
guaauuuaagauuuuguuuuua

SEQ ID NO: 780597 - RNA, 13 nt, Human
uugggacaaaaac

SEQ ID NO: 780598 - RNA, 15 nt, Human
aggcuccaaacugga

SEQ ID NO: 780599 - RNA, 16 nt, Human
cacuguuaucaaaacu

SEQ ID NO: 780600 - RNA, 15 nt, Human
auaaauauauuuaag

SEQ ID NO: 780601 - RNA, 18 nt, Human
gaugaacucuuaaucaaa

SEQ ID NO: 780602 - RNA, 16 nt, Human
uaugacacaucucuga

SEQ ID NO: 780603 - RNA, 17 nt, Human
aaggccugucccugcag

SEQ ID NO: 780604 - RNA, 22 nt, Human
uauauauuuauaacucaucaua

SEQ ID NO: 780605 - RNA, 22 nt, Human
cuacuugggaggcugaggcaag

SEQ ID NO: 780606 - RNA, 16 nt, Human
ugcgaaugguuccauu

SEQ ID NO: 780607 - RNA, 13 nt, Human
ccucuccugggca

SEQ ID NO: 780608 - RNA, 18 nt, Human
ggauagcugacccagccc

SEQ ID NO: 780609 - RNA, 21 nt, Human
guuuuuauauaugugaaauaa

SEQ ID NO: 780610 - RNA, 15 nt, Human
auauuuaacauuauu

SEQ ID NO: 780611 - RNA, 20 nt, Human
uuuauaacucaucauaaaau

SEQ ID NO: 780612 - RNA, 17 nt, Human
ucaaaaguugaaauuaa

SEQ ID NO: 780613 - RNA, 20 nt, Human
auucagccccgggaguggcg

SEQ ID NO: 780614 - RNA, 14 nt, Human
auuuauugagcacc

SEQ ID NO: 780615 - RNA, 17 nt, Human
caagaaaugaaagcagg

SEQ ID NO: 780616 - RNA, 17 nt, Human
uaaauaaagaauuuuaa

SEQ ID NO: 780617 - RNA, 17 nt, Human
uugugaagcaaaauuuu

SEQ ID NO: 780618 - RNA, 12 nt, Human
ccugucccagcg

SEQ ID NO: 780619 - RNA, 23 nt, Human
cggagauaucccaggaaaauuaa

SEQ ID NO: 780620 - RNA, 22 nt, Human
aaauccuuuacuguuagucauu

SEQ ID NO: 780621 - RNA, 15 nt, Human
ucuuauagaauauuu

SEQ ID NO: 780622 - RNA, 15 nt, Human
uugccaugagcuaga

SEQ ID NO: 780623 - RNA, 23 nt, Human
auugcagaguacuggcugaugga

SEQ ID NO: 780624 - RNA, 14 nt, Human
gaaacauuacaguu

SEQ ID NO: 780625 - RNA, 19 nt, Human
ggaucuggggcucugggau

SEQ ID NO: 780626 - RNA, 19 nt, Human
uuuaugcauacaguaauuu

SEQ ID NO: 780627 - RNA, 23 nt, Human
ucaggaguuccuaaccagccugg

SEQ ID NO: 780628 - RNA, 12 nt, Human
aucauuuucaaa

SEQ ID NO: 780629 - RNA, 21 nt, Human
aauaauguuucaaacauauau

SEQ ID NO: 780630 - RNA, 14 nt, Human
agagacagaaagca

SEQ ID NO: 780631 - RNA, 23 nt, Human
cuaaguugcaccaacuuugaagu

SEQ ID NO: 780632 - RNA, 11 nt, Human
caguucagagc

SEQ ID NO: 780633 - RNA, 22 nt, Human
uuaugugcaauaaaauguauuu

SEQ ID NO: 780634 - RNA, 21 nt, Human
cuugccaucccucccuccacc

SEQ ID NO: 780635 - RNA, 22 nt, Human
acauuacaguuagagauuuuua

SEQ ID NO: 780636 - RNA, 23 nt, Human
ugacguaggaacgguaaauuucu

SEQ ID NO: 780637 - RNA, 22 nt, Human
uuuaauuauuauucuucauaac

SEQ ID NO: 780638 - RNA, 20 nt, Human
aguucagagcugcccucucc

SEQ ID NO: 780639 - RNA, 15 nt, Human
acuuuggcaaaugag

SEQ ID NO: 780640 - RNA, 15 nt, Human
caccuguaaucccag

SEQ ID NO: 780641 - RNA, 21 nt, Human
cccugcagacaugagagacag

SEQ ID NO: 780642 - RNA, 18 nt, Human
gaaaggccagcaaauucg

SEQ ID NO: 780643 - RNA, 13 nt, Human
auacuauccaguu

SEQ ID NO: 780644 - RNA, 16 nt, Human
auggagguuaagcacu

SEQ ID NO: 780645 - RNA, 16 nt, Human
uccugcaauuccacuu

SEQ ID NO: 780646 - RNA, 15 nt, Human
uauguauuauuuaua

SEQ ID NO: 780647 - RNA, 16 nt, Human
cauaauguuacauuau

SEQ ID NO: 780648 - RNA, 16 nt, Human
aguaacggaacaguau

SEQ ID NO: 780649 - RNA, 16 nt, Human
uuuucucuaggaaaua

SEQ ID NO: 780650 - RNA, 16 nt, Human
cuggccugcuggaugu

SEQ ID NO: 780651 - RNA, 17 nt, Human
uccuacaagcuaaaauu

SEQ ID NO: 780652 - RNA, 14 nt, Human
uuuguaauauuucu

SEQ ID NO: 780653 - RNA, 13 nt, Human
gcagaacagugau

SEQ ID NO: 780654 - RNA, 22 nt, Human
uacugagagugaacaaauuuac

SEQ ID NO: 780655 - RNA, 17 nt, Human
cccuccaccucccugca

SEQ ID NO: 780656 - RNA, 18 nt, Human
uguuauuuuuuaauuauu

SEQ ID NO: 780657 - RNA, 22 nt, Human
aaaagauuaugaucucagaaau

SEQ ID NO: 780658 - RNA, 18 nt, Human
ugaauccagaaauaauga

SEQ ID NO: 780659 - RNA, 17 nt, Human
ucucaaaaaauaaaaau

SEQ ID NO: 780660 - RNA, 17 nt, Human
cuauauccugugacugu

SEQ ID NO: 780661 - RNA, 16 nt, Human
uggaaaaugugcaaua

SEQ ID NO: 780662 - RNA, 14 nt, Human
ucugcuugccaucc

SEQ ID NO: 780663 - RNA, 14 nt, Human
ucaaugcagccccc

SEQ ID NO: 780664 - RNA, 10 nt, Human
ccugagcccc

SEQ ID NO: 780665 - RNA, 12 nt, Human
accagccaaccu

SEQ ID NO: 780666 - RNA, 13 nt, Human
ccuacaccauucc

SEQ ID NO: 780667 - RNA, 15 nt, Human
aauuguaucuuaguu

SEQ ID NO: 780668 - RNA, 12 nt, Human
cagaacagugau

SEQ ID NO: 780669 - RNA, 22 nt, Human
gacagggaaagggucucccucu

SEQ ID NO: 780670 - RNA, 20 nt, Human
cuuuugcugccucuaaaagg

SEQ ID NO: 780671 - RNA, 20 nt, Human
aaaguaacucauuuguuaaa

SEQ ID NO: 780672 - RNA, 15 nt, Human
guggguggggcagug

SEQ ID NO: 780673 - RNA, 12 nt, Human
auguauuauuua

SEQ ID NO: 780674 - RNA, 19 nt, Human
uucucuaacucagaaacau

SEQ ID NO: 780675 - RNA, 15 nt, Human
aaucccuuaaacuca

SEQ ID NO: 780676 - RNA, 14 nt, Human
uuaaaguuaaauaa

SEQ ID NO: 780677 - RNA, 15 nt, Human
uccaaauucacaagu

SEQ ID NO: 780678 - RNA, 20 nt, Human
aucccucccuccaccucccu

SEQ ID NO: 780679 - RNA, 16 nt, Human
ccuccaccucccugca

SEQ ID NO: 780680 - RNA, 17 nt, Human
gaauaucuauuaauaua

SEQ ID NO: 780681 - RNA, 18 nt, Human
uucucuaggaaauauuua

SEQ ID NO: 780682 - RNA, 13 nt, Human
ugccaaggcugga

SEQ ID NO: 780683 - RNA, 13 nt, Human
auuuuaaaagaau

SEQ ID NO: 780684 - RNA, 21 nt, Human
auuugaguguuuuaagauaaa

SEQ ID NO: 780685 - RNA, 13 nt, Human
auugcaaggcaaa

SEQ ID NO: 780686 - RNA, 19 nt, Human
ggcaaggguucaccugggc

SEQ ID NO: 780687 - RNA, 22 nt, Human
uggugugcuggcuuaaaaugua

SEQ ID NO: 780688 - RNA, 14 nt, Human
aauaaaguauauau

SEQ ID NO: 780689 - RNA, 18 nt, Human
aggugacccugaugaaaa

SEQ ID NO: 780690 - RNA, 21 nt, Human
ggcaaaucucuauuaggaaau

SEQ ID NO: 780691 - RNA, 19 nt, Human
ugucuggcacuugggacaa

SEQ ID NO: 780692 - RNA, 16 nt, Human
gcuugaacccaggaga

SEQ ID NO: 780693 - RNA, 21 nt, Human
agcuaaguugcaccaacuuug

SEQ ID NO: 780694 - RNA, 17 nt, Human
agauagguuaccaguaa

SEQ ID NO: 780695 - RNA, 16 nt, Human
aaauuagccgggcaug

SEQ ID NO: 780696 - RNA, 17 nt, Human
uucuagguucuaaaaau

SEQ ID NO: 780697 - RNA, 14 nt, Human
gaaugauuaugaau

SEQ ID NO: 780698 - RNA, 15 nt, Human
auuuguuuguauuuu

SEQ ID NO: 780699 - RNA, 19 nt, Human
aaagaagacaacauuaaaa

SEQ ID NO: 780700 - RNA, 16 nt, Human
cugauggguuucucca

SEQ ID NO: 780701 - RNA, 14 nt, Human
acauauauaacaau

SEQ ID NO: 780702 - RNA, 15 nt, Human
auguaaacaaaggaa

SEQ ID NO: 780703 - RNA, 13 nt, Human
cagugcuuggccc

SEQ ID NO: 780704 - RNA, 19 nt, Human
auuuauaaauggacaaaug

SEQ ID NO: 780705 - RNA, 18 nt, Human
uggccaggcuggucucga

SEQ ID NO: 780706 - RNA, 16 nt, Human
auuuaacauuauuuau

SEQ ID NO: 780707 - RNA, 20 nt, Human
aaucucuauuaggaaauauu

SEQ ID NO: 780708 - RNA, 21 nt, Human
cuggucucgaacugcuggauu

SEQ ID NO: 780709 - RNA, 17 nt, Human
agaaaggccagcaaauu

SEQ ID NO: 780710 - RNA, 19 nt, Human
cgauuuagaaagaagccca

SEQ ID NO: 780711 - RNA, 21 nt, Human
uguaauuaaucuuguaaauau

SEQ ID NO: 780712 - RNA, 23 nt, Human
aguguccucaucuguaaaaugga

SEQ ID NO: 780713 - RNA, 14 nt, Human
ugacacuuaaaaau

SEQ ID NO: 780714 - RNA, 21 nt, Human
uagcagacaguguuuucuggg

SEQ ID NO: 780715 - RNA, 17 nt, Human
uguuaucagucauaacu

SEQ ID NO: 780716 - RNA, 16 nt, Human
gaugaucauguauuua

SEQ ID NO: 780717 - RNA, 16 nt, Human
aaugaaagcagggacu

SEQ ID NO: 780718 - RNA, 12 nt, Human
acccuauauuuu

SEQ ID NO: 780719 - RNA, 17 nt, Human
ucugggauagcugaccc

SEQ ID NO: 780720 - RNA, 14 nt, Human
uuaaguguaacugg

SEQ ID NO: 780721 - RNA, 23 nt, Human
ugauggguuucuccagagggaau

SEQ ID NO: 780722 - RNA, 14 nt, Human
acacugaagaagca

SEQ ID NO: 780723 - RNA, 21 nt, Human
caccagggccuggcugggagu

SEQ ID NO: 780724 - RNA, 17 nt, Human
cucgugggacagucacc

SEQ ID NO: 780725 - RNA, 19 nt, Human
aagguauuuauugagcacc

SEQ ID NO: 780726 - RNA, 20 nt, Human
ugcauugagaacugcauaug

SEQ ID NO: 780727 - RNA, 19 nt, Human
uaagcaacaucuagcaaau

SEQ ID NO: 780728 - RNA, 21 nt, Human
aaaucuauuuauuaauauuua

SEQ ID NO: 780729 - RNA, 13 nt, Human
acaguuuuccuuc

SEQ ID NO: 780730 - RNA, 23 nt, Human
gacuuuuuuuuuuuuuuaaacaa

SEQ ID NO: 780731 - RNA, 15 nt, Human
ugcagauaaacagua

SEQ ID NO: 780732 - RNA, 15 nt, Human
cuaguaauuggaaag

SEQ ID NO: 780733 - RNA, 11 nt, Human
cagcaaauucg

SEQ ID NO: 780734 - RNA, 22 nt, Human
ugaaaaaguucugcagauaaac

SEQ ID NO: 780735 - RNA, 22 nt, Human
gaacuuuccacauucagagcuu

SEQ ID NO: 780736 - RNA, 17 nt, Human
acuuuauauuauuuuga

SEQ ID NO: 780737 - RNA, 14 nt, Human
gaccuagaauaaua

SEQ ID NO: 780738 - RNA, 21 nt, Human
ccugcaauaaaauggguuuua

SEQ ID NO: 780739 - RNA, 15 nt, Human
cauguccacugguuc

SEQ ID NO: 780740 - RNA, 15 nt, Human
ugccuccccuccucu

SEQ ID NO: 780741 - RNA, 20 nt, Human
guuuaugcauacaguaauuu

SEQ ID NO: 780742 - RNA, 19 nt, Human
auaaaauaaaguauauaua

SEQ ID NO: 780743 - RNA, 13 nt, Human
cuuccaaacagaa

SEQ ID NO: 780744 - RNA, 12 nt, Human
caaauuccagaa

SEQ ID NO: 780745 - RNA, 14 nt, Human
uugcuggagcucug

SEQ ID NO: 780746 - RNA, 19 nt, Human
cuuugguggagauaaagau

SEQ ID NO: 780747 - RNA, 16 nt, Human
auuuugguaaaauacu

SEQ ID NO: 780748 - RNA, 22 nt, Human
cgucucccaaagugcugggaau

SEQ ID NO: 780749 - RNA, 21 nt, Human
acuccuaguaauuuaagauuu

SEQ ID NO: 780750 - RNA, 15 nt, Human
acauguuuucuuugc

SEQ ID NO: 780751 - RNA, 16 nt, Human
ucacaagugaaaaaca

SEQ ID NO: 780752 - RNA, 15 nt, Human
ucaguccucuuucaa

SEQ ID NO: 780753 - RNA, 20 nt, Human
augaauaucuauuaauauau

SEQ ID NO: 780754 - RNA, 21 nt, Human
auuauauuuauuacuguaaga

SEQ ID NO: 780755 - RNA, 17 nt, Human
augagccggagccccuu

SEQ ID NO: 780756 - RNA, 18 nt, Human
agaaccuaaguuucaguu

SEQ ID NO: 780757 - RNA, 22 nt, Human
uaaucagggaggucauuuuggu

SEQ ID NO: 780758 - RNA, 17 nt, Human
agaugggagaaucacuu

SEQ ID NO: 780759 - RNA, 23 nt, Human
agcucugcccauccugccccuga

SEQ ID NO: 780760 - RNA, 23 nt, Human
caggcaugagucagucugaugag

SEQ ID NO: 780761 - RNA, 15 nt, Human
caggaaguagaggag

SEQ ID NO: 780762 - RNA, 22 nt, Human
ugagacucugucucaguccaug

SEQ ID NO: 780763 - RNA, 18 nt, Human
agaagcaacccaaauguu

SEQ ID NO: 780764 - RNA, 14 nt, Human
ccuccaccucccug

SEQ ID NO: 780765 - RNA, 17 nt, Human
gaagcaccaaucaugaa

SEQ ID NO: 780766 - RNA, 19 nt, Human
agccagcaguucagagcug

SEQ ID NO: 780767 - RNA, 21 nt, Human
agggugauauuaaccaggggc

SEQ ID NO: 780768 - RNA, 13 nt, Human
gguggggugaggg

SEQ ID NO: 780769 - RNA, 18 nt, Human
gaagcaccaaucaugaau

SEQ ID NO: 780770 - RNA, 11 nt, Human
uccucugggaa

SEQ ID NO: 780771 - RNA, 17 nt, Human
cuuugaugauuaauuca

SEQ ID NO: 780772 - RNA, 19 nt, Human
ucacaagugaaaaacaucc

SEQ ID NO: 780773 - RNA, 13 nt, Human
acccucugggucu

SEQ ID NO: 780774 - RNA, 19 nt, Human
ucauaacaauuuuaggagg

SEQ ID NO: 780775 - RNA, 13 nt, Human
uacuauauuuaug

SEQ ID NO: 780776 - RNA, 21 nt, Human
uuaaaauauuuuuaugugcaa

SEQ ID NO: 780777 - RNA, 15 nt, Human
uucauguacauccau

SEQ ID NO: 780778 - RNA, 20 nt, Human
augcuucuguuuuauaauuu

SEQ ID NO: 780779 - RNA, 21 nt, Human
uuuuuuuaaacaaaaaaagca

SEQ ID NO: 780780 - RNA, 14 nt, Human
ugaagauguagagg

SEQ ID NO: 780781 - RNA, 21 nt, Human
guuacucugaagggcaucaug

SEQ ID NO: 780782 - RNA, 14 nt, Human
uuccugagccagug

SEQ ID NO: 780783 - RNA, 19 nt, Human
cuacuaaaaauacaaaaau

SEQ ID NO: 780784 - RNA, 15 nt, Human
acuagaauuuauuca

SEQ ID NO: 780785 - RNA, 18 nt, Human
cgaugguacauauuucuu

SEQ ID NO: 780786 - RNA, 16 nt, Human
acagagacagaaagca

SEQ ID NO: 780787 - RNA, 14 nt, Human
aaaauuggacuuaa

SEQ ID NO: 780788 - RNA, 23 nt, Human
ggaugaauuaaguuuuuuuuuaa

SEQ ID NO: 780789 - RNA, 17 nt, Human
gugccuguaaucacagc

SEQ ID NO: 780790 - RNA, 17 nt, Human
gcuccaaacuggagcuu

SEQ ID NO: 780791 - RNA, 21 nt, Human
aggcaugagucagucugauga

SEQ ID NO: 780792 - RNA, 23 nt, Human
uacuucauuuaaaauauuuuuau

SEQ ID NO: 780793 - RNA, 18 nt, Human
uugggcgggacacaggcu

SEQ ID NO: 780794 - RNA, 13 nt, Human
acacuuaaaaaug

SEQ ID NO: 780795 - RNA, 15 nt, Human
caaagaagacaacau

SEQ ID NO: 780796 - RNA, 23 nt, Human
caacugugacuguacccaaaugg

SEQ ID NO: 780797 - RNA, 15 nt, Human
cuaagugcagccccg

SEQ ID NO: 780798 - RNA, 14 nt, Human
gagcccauggcacu

SEQ ID NO: 780799 - RNA, 20 nt, Human
acuccagugagacagcucug

SEQ ID NO: 780800 - RNA, 19 nt, Human
uuuauaauuccuauauccu

SEQ ID NO: 780801 - RNA, 22 nt, Human
uuacauguuuucuuugcuuuaa

SEQ ID NO: 780802 - RNA, 15 nt, Human
ugaauaucuauuaau

SEQ ID NO: 780803 - RNA, 15 nt, Human
auauacuauauuuau

SEQ ID NO: 780804 - RNA, 16 nt, Human
acuaugaggaauauuu

SEQ ID NO: 780805 - RNA, 14 nt, Human
uuaugaaacauuac

SEQ ID NO: 780806 - RNA, 16 nt, Human
cauuuguauaaaauaa

SEQ ID NO: 780807 - RNA, 13 nt, Human
aggcuagauguau

SEQ ID NO: 780808 - RNA, 14 nt, Human
auaaaauaauuuuu

SEQ ID NO: 780809 - RNA, 20 nt, Human
aucaaauuccagaaugauuu

SEQ ID NO: 780810 - RNA, 18 nt, Human
cccucuccugggcagcug

SEQ ID NO: 780811 - RNA, 15 nt, Human
uuguuauuuaaagaa

SEQ ID NO: 780812 - RNA, 21 nt, Human
aaacauuacaguuagagauuu

SEQ ID NO: 780813 - RNA, 19 nt, Human
guauuuaagguauauaaau

SEQ ID NO: 780814 - RNA, 20 nt, Human
gccaauauccuaauaaaaag

SEQ ID NO: 780815 - RNA, 21 nt, Human
acuggcucccuggaagagauc

SEQ ID NO: 780816 - RNA, 22 nt, Human
uaucaaaacuuucuuuucugga

SEQ ID NO: 780817 - RNA, 11 nt, Human
cuguuuuauaa

SEQ ID NO: 780818 - RNA, 17 nt, Human
agagcugcccucuccug

SEQ ID NO: 780819 - RNA, 21 nt, Human
uuaucagucauaacuaaauaa

SEQ ID NO: 780820 - RNA, 15 nt, Human
agcaaaauggauaug

SEQ ID NO: 780821 - RNA, 19 nt, Human
caaucaaauaaguauuuau

SEQ ID NO: 780822 - RNA, 17 nt, Human
acugauacccuuugaaa

SEQ ID NO: 780823 - RNA, 23 nt, Human
ucaaucaaauaaguauuuauaau

SEQ ID NO: 780824 - RNA, 17 nt, Human
uuuacuacuuuaaaaaa

SEQ ID NO: 780825 - RNA, 23 nt, Human
uuuuccuuccuuaucacugacac

SEQ ID NO: 780826 - RNA, 13 nt, Human
ugaaagcguaaag

SEQ ID NO: 780827 - RNA, 17 nt, Human
acaagaaaugaaagcag

SEQ ID NO: 780828 - RNA, 23 nt, Human
agaaugauuaugaauuacauuug

SEQ ID NO: 780829 - RNA, 17 nt, Human
cuucuagguucuaaaaa

SEQ ID NO: 780830 - RNA, 18 nt, Human
auuuuaauuuugaauaaa

SEQ ID NO: 780831 - RNA, 16 nt, Human
aaauaguuuaugauuc

SEQ ID NO: 780832 - RNA, 15 nt, Human
aagcacgaaauguua

SEQ ID NO: 780833 - RNA, 13 nt, Human
uaaguuucuggga

SEQ ID NO: 780834 - RNA, 15 nt, Human
aaguauauauagaau

SEQ ID NO: 780835 - RNA, 10 nt, Human
uucccugccu

SEQ ID NO: 780836 - RNA, 14 nt, Human
uuaauuauuauucu

SEQ ID NO: 780837 - RNA, 12 nt, Human
uaaguauuuaua

SEQ ID NO: 780838 - RNA, 16 nt, Human
cagcuucucauccugc

SEQ ID NO: 780839 - RNA, 16 nt, Human
agaacucugagcagug

SEQ ID NO: 780840 - RNA, 14 nt, Human
uggccugcuggaug

SEQ ID NO: 780841 - RNA, 22 nt, Human
uaaaauaauuuuuauauuugaa

SEQ ID NO: 780842 - RNA, 16 nt, Human
aggcuugccugcaggc

SEQ ID NO: 780843 - RNA, 14 nt, Human
auuuauuauuuuca

SEQ ID NO: 780844 - RNA, 13 nt, Human
ccuccaccucccu

SEQ ID NO: 780845 - RNA, 15 nt, Human
accuguaaucauaua

SEQ ID NO: 780846 - RNA, 15 nt, Human
ucugucucaguccau

SEQ ID NO: 780847 - RNA, 16 nt, Human
cuuaaagaauuuucaa

SEQ ID NO: 780848 - RNA, 22 nt, Human
ucccuuuugcugccucuaaaag

SEQ ID NO: 780849 - RNA, 16 nt, Human
aauuucagaagaaauu

SEQ ID NO: 780850 - RNA, 16 nt, Human
aauaugcacaauagca

SEQ ID NO: 780851 - RNA, 23 nt, Human
uaaguuuuuuuuuaaaaaagaaa

SEQ ID NO: 780852 - RNA, 18 nt, Human
acaucuagcaaauguuau

SEQ ID NO: 780853 - RNA, 20 nt, Human
acuaaauugacacuuaaaaa

SEQ ID NO: 780854 - RNA, 17 nt, Human
uucucuaggaaauauuu

SEQ ID NO: 780855 - RNA, 23 nt, Human
cugauaucaugccccuguacucc

SEQ ID NO: 780856 - RNA, 18 nt, Human
uauguauuuauaaauaua

SEQ ID NO: 780857 - RNA, 16 nt, Human
uauauuuuuuaugaaa

SEQ ID NO: 780858 - RNA, 13 nt, Human
acacagugucugg

SEQ ID NO: 780859 - RNA, 22 nt, Human
aauugacccacaagaaaugaaa

SEQ ID NO: 780860 - RNA, 13 nt, Human
aauucuaaaugaa

SEQ ID NO: 780861 - RNA, 20 nt, Human
ugccuccccuccucugcuug

SEQ ID NO: 780862 - RNA, 17 nt, Human
caauacuucauuuaaaa

SEQ ID NO: 780863 - RNA, 20 nt, Human
acagcuucucauccugcagg

SEQ ID NO: 780864 - RNA, 21 nt, Human
gaaaaguauguuagugcaaau

SEQ ID NO: 780865 - RNA, 20 nt, Human
uuucuagggaaaugaaagaa

SEQ ID NO: 780866 - RNA, 22 nt, Human
cuagauacugaauguaaacaaa

SEQ ID NO: 780867 - RNA, 20 nt, Human
caagaaugagaagaaugacu

SEQ ID NO: 780868 - RNA, 19 nt, Human
ccaccugccuauauuuuuu

SEQ ID NO: 780869 - RNA, 18 nt, Human
ucacaaccacucauucaa

SEQ ID NO: 780870 - RNA, 22 nt, Human
acaagcuuuuuuuuuuuuucuu

SEQ ID NO: 780871 - RNA, 21 nt, Human
gauaaguaaguuugauuucau

SEQ ID NO: 780872 - RNA, 22 nt, Human
ugaaacagagaaaauaaaagca

SEQ ID NO: 780873 - RNA, 14 nt, Human
auaucuaauauaua

SEQ ID NO: 780874 - RNA, 20 nt, Human
uauuuuguguucaguacaau

SEQ ID NO: 780875 - RNA, 15 nt, Human
acuacuuuaaaaaaa

SEQ ID NO: 780876 - RNA, 21 nt, Human
gccaucccucccuccaccucc

SEQ ID NO: 780877 - RNA, 22 nt, Human
agacucugucucaguccaugaa

SEQ ID NO: 780878 - RNA, 23 nt, Human
aaaauaucacuugucaauaaaau

SEQ ID NO: 780879 - RNA, 19 nt, Human
aauaaauguaucuuauuca

SEQ ID NO: 780880 - RNA, 21 nt, Human
ccuuuacauccagauagguua

SEQ ID NO: 780881 - RNA, 21 nt, Human
cuugaaauagugucugaugaa

SEQ ID NO: 780882 - RNA, 19 nt, Human
cucugucucaaaaaauaaa

SEQ ID NO: 780883 - RNA, 14 nt, Human
uagcugacccagcc

SEQ ID NO: 780884 - RNA, 21 nt, Human
aaucaccaaggcugauuaaac

SEQ ID NO: 780885 - RNA, 23 nt, Human
uaaauauaauaugcacacagugc

SEQ ID NO: 780886 - RNA, 14 nt, Human
aaguaauuucagaa

SEQ ID NO: 780887 - RNA, 16 nt, Human
ccacuguuaucaaaac

SEQ ID NO: 780888 - RNA, 22 nt, Human
ucaacuccaaacugacucuuaa

SEQ ID NO: 780889 - RNA, 14 nt, Human
cgcuaccuuuugcu

SEQ ID NO: 780890 - RNA, 17 nt, Human
cugcccucuccugggca

SEQ ID NO: 780891 - RNA, 15 nt, Human
uaauauugcaaggca

SEQ ID NO: 780892 - RNA, 18 nt, Human
aggaagaaauuccaggaa

SEQ ID NO: 780893 - RNA, 15 nt, Human
gcagcugccuccccu

SEQ ID NO: 780894 - RNA, 17 nt, Human
uccugccugcaauauuu

SEQ ID NO: 780895 - RNA, 16 nt, Human
guaucuuguuuuucca

SEQ ID NO: 780896 - RNA, 17 nt, Human
caaacauauauaacaau

SEQ ID NO: 780897 - RNA, 22 nt, Human
aaacaaggaugaauuaaguuuu

SEQ ID NO: 780898 - RNA, 13 nt, Human
guuugauuucauu

SEQ ID NO: 780899 - RNA, 17 nt, Human
cagcaggauagaguggg

SEQ ID NO: 780900 - RNA, 17 nt, Human
auucaaaaguugaaauu

SEQ ID NO: 780901 - RNA, 23 nt, Human
cugagaccagccaaccugggggc

SEQ ID NO: 780902 - RNA, 13 nt, Human
aacuaauagaauu

SEQ ID NO: 780903 - RNA, 16 nt, Human
guuacauuauuaucaa

SEQ ID NO: 780904 - RNA, 16 nt, Human
gaaagggucucccucu

SEQ ID NO: 780905 - RNA, 18 nt, Human
cauauaauaaauguacau

SEQ ID NO: 780906 - RNA, 23 nt, Human
acuuugugaaaaaaaauuuuaua

SEQ ID NO: 780907 - RNA, 14 nt, Human
uaugugaaauaaaa

SEQ ID NO: 780908 - RNA, 18 nt, Human
ggucacacaaccuguccc

SEQ ID NO: 780909 - RNA, 20 nt, Human
aacaaacgaaaaacauuuca

SEQ ID NO: 780910 - RNA, 17 nt, Human
agggccuggcugggagu

SEQ ID NO: 780911 - RNA, 16 nt, Human
aauuuucccaaaacug

SEQ ID NO: 780912 - RNA, 14 nt, Human
aguucagagcugcc

SEQ ID NO: 780913 - RNA, 19 nt, Human
gacagucaccucauggaau

SEQ ID NO: 780914 - RNA, 18 nt, Human
acauguuuucuuugcuuu

SEQ ID NO: 780915 - RNA, 22 nt, Human
agaauggaacucaaggaaaucu

SEQ ID NO: 780916 - RNA, 17 nt, Human
aaaauuggacuuaaaau

SEQ ID NO: 780917 - RNA, 22 nt, Human
aguauguuagugcaaauuguca

SEQ ID NO: 780918 - RNA, 21 nt, Human
cuauucacaaccacucauuca

SEQ ID NO: 780919 - RNA, 18 nt, Human
cccaggaguuuggccaga

SEQ ID NO: 780920 - RNA, 18 nt, Human
uugaaaaaguauaaauaa

SEQ ID NO: 780921 - RNA, 16 nt, Human
cucauccugcaggcag

SEQ ID NO: 780922 - RNA, 19 nt, Human
cuuugaaaaaguauaaaua

SEQ ID NO: 780923 - RNA, 19 nt, Human
cccaggaguuuggccagaa

SEQ ID NO: 780924 - RNA, 17 nt, Human
gaaaaucaggcuggcca

SEQ ID NO: 780925 - RNA, 23 nt, Human
uaauuuguaguguuggagaagaa

SEQ ID NO: 780926 - RNA, 16 nt, Human
cagaagaaauucugca

SEQ ID NO: 780927 - RNA, 20 nt, Human
acgugacuggccugcuggau

SEQ ID NO: 780928 - RNA, 21 nt, Human
agccucuuagaugcaguucug

SEQ ID NO: 780929 - RNA, 15 nt, Human
gacaaaugcuuauga

SEQ ID NO: 780930 - RNA, 21 nt, Human
acuuuuuuucuuuucucugcc

SEQ ID NO: 780931 - RNA, 19 nt, Human
caccuguuuuuaagcuguu

SEQ ID NO: 780932 - RNA, 21 nt, Human
cuaaauugacacuuaaaaaug

SEQ ID NO: 780933 - RNA, 20 nt, Human
ccagauacacccaaaguauc

SEQ ID NO: 780934 - RNA, 19 nt, Human
ucaauucuauuacgugcaa

SEQ ID NO: 780935 - RNA, 21 nt, Human
aguuguugcccacagcuguau

SEQ ID NO: 780936 - RNA, 17 nt, Human
ccugcaggcaugaguca

SEQ ID NO: 780937 - RNA, 14 nt, Human
agcucguggaacag

SEQ ID NO: 780938 - RNA, 13 nt, Human
aauauuuaacauu

SEQ ID NO: 780939 - RNA, 23 nt, Human
ucuggcacuugggacaaaaacaa

SEQ ID NO: 780940 - RNA, 17 nt, Human
aaaaucuaauucaaacu

SEQ ID NO: 780941 - RNA, 13 nt, Human
ucuuauucacauc

SEQ ID NO: 780942 - RNA, 18 nt, Human
uguugauagcaagugaau

SEQ ID NO: 780943 - RNA, 16 nt, Human
accuguuuuuaagcug

SEQ ID NO: 780944 - RNA, 11 nt, Human
uaugugcaaua

SEQ ID NO: 780945 - RNA, 16 nt, Human
uugcuaggucacagag

SEQ ID NO: 780946 - RNA, 14 nt, Human
gcuggagcucugcc

SEQ ID NO: 780947 - RNA, 14 nt, Human
cuaaauuugguucu

SEQ ID NO: 780948 - RNA, 17 nt, Human
auggaacucaaggaaau

SEQ ID NO: 780949 - RNA, 23 nt, Human
cugacuaauuaggcaaggcuaug

SEQ ID NO: 780950 - RNA, 20 nt, Human
cacuggcucccuggaagaga

SEQ ID NO: 780951 - RNA, 23 nt, Human
guauuugaguguuuuaagauaaa

SEQ ID NO: 780952 - RNA, 15 nt, Human
auugcugaaugacua

SEQ ID NO: 780953 - RNA, 14 nt, Human
ucuuguuuuuccac

SEQ ID NO: 780954 - RNA, 21 nt, Human
aggcagcaggauagaguggga

SEQ ID NO: 780955 - RNA, 15 nt, Human
uuaacauuauuuaua

SEQ ID NO: 780956 - RNA, 15 nt, Human
gccuaagugcagccc

SEQ ID NO: 780957 - RNA, 13 nt, Human
aaaugaaagcagg

SEQ ID NO: 780958 - RNA, 16 nt, Human
uaaaauccauacauuu

SEQ ID NO: 780959 - RNA, 14 nt, Human
ccuugaugaagaag

SEQ ID NO: 780960 - RNA, 21 nt, Human
caauuuuguuauguauauuuu

SEQ ID NO: 780961 - RNA, 19 nt, Human
uguauuuauaaauauauuu

SEQ ID NO: 780962 - RNA, 16 nt, Human
ugugauuacccucugg

SEQ ID NO: 780963 - RNA, 19 nt, Human
cuccugggcagcugccucc

SEQ ID NO: 780964 - RNA, 19 nt, Human
uuuccuaaaucaauucuau

SEQ ID NO: 780965 - RNA, 16 nt, Human
uuauagaauauuuauu

SEQ ID NO: 780966 - RNA, 18 nt, Human
aaagaaaaucaggcuggc

SEQ ID NO: 780967 - RNA, 13 nt, Human
cuugacuuuggca

SEQ ID NO: 780968 - RNA, 20 nt, Human
cuguaaaauggagacaccac

SEQ ID NO: 780969 - RNA, 14 nt, Human
aacuaagauuugua

SEQ ID NO: 780970 - RNA, 17 nt, Human
auaagggaggaaaaaaa

SEQ ID NO: 780971 - RNA, 23 nt, Human
auaagcuguuuuuauauauguga

SEQ ID NO: 780972 - RNA, 23 nt, Human
caacuuugaagucugauuuuccu

SEQ ID NO: 780973 - RNA, 19 nt, Human
uuuuuuaugaaacauuaca

SEQ ID NO: 780974 - RNA, 21 nt, Human
aaaaaguucugcagauaaaca

SEQ ID NO: 780975 - RNA, 14 nt, Human
cgcccaucuccguc

SEQ ID NO: 780976 - RNA, 15 nt, Human
auuuaacauuauuua

SEQ ID NO: 780977 - RNA, 22 nt, Human
aucccucccuccaccucccugc

SEQ ID NO: 780978 - RNA, 16 nt, Human
auacaauuauuuuuac

SEQ ID NO: 780979 - RNA, 17 nt, Human
acugugacuguacccaa

SEQ ID NO: 780980 - RNA, 20 nt, Human
uucauuuaaaauauuuuuau

SEQ ID NO: 780981 - RNA, 17 nt, Human
cagugcuugaaugaagu

SEQ ID NO: 780982 - RNA, 20 nt, Human
augcaguuguugcccacagc

SEQ ID NO: 780983 - RNA, 18 nt, Human
uucaauaucuuuuuuuua

SEQ ID NO: 780984 - RNA, 19 nt, Human
agcagcuuauucacaagac

SEQ ID NO: 780985 - RNA, 22 nt, Human
uccuuuucgaugguacauauuu

SEQ ID NO: 780986 - RNA, 16 nt, Human
caaaaaccaaauuugu

SEQ ID NO: 780987 - RNA, 21 nt, Human
ucaccugggcugaggcauccu

SEQ ID NO: 780988 - RNA, 21 nt, Human
gcuaaguugcaccaacuuuga

SEQ ID NO: 780989 - RNA, 18 nt, Human
aguaauuucagaagaaau

SEQ ID NO: 780990 - RNA, 12 nt, Human
ccuucagccuga

SEQ ID NO: 780991 - RNA, 22 nt, Human
uaaauaaagcuugcaacaaaau

SEQ ID NO: 780992 - RNA, 21 nt, Human
aagauuaugaucucagaaauu

SEQ ID NO: 780993 - RNA, 19 nt, Human
uucccuugaugaagaaguu

SEQ ID NO: 780994 - RNA, 17 nt, Human
aacaguuaccucugccu

SEQ ID NO: 780995 - RNA, 13 nt, Human
agcaguucagagc

SEQ ID NO: 780996 - RNA, 23 nt, Human
augaauuaaguuuuuuuuuaaaa

SEQ ID NO: 780997 - RNA, 16 nt, Human
uauuugcaagacauag

SEQ ID NO: 780998 - RNA, 22 nt, Human
cugagcagugcuugaaugaagu

SEQ ID NO: 780999 - RNA, 16 nt, Human
uaucaaaagaaagaaa

SEQ ID NO: 781000 - RNA, 15 nt, Human
uaacugcuacaaaua

SEQ ID NO: 781001 - RNA, 18 nt, Human
auauauuuauaacucauc

SEQ ID NO: 781002 - RNA, 16 nt, Human
aguugcagugagcuga

SEQ ID NO: 781003 - RNA, 13 nt, Human
uuaguguacauga

SEQ ID NO: 781004 - RNA, 21 nt, Human
augaggcauuugcagcugugc

SEQ ID NO: 781005 - RNA, 13 nt, Human
gacauaagcaaag

SEQ ID NO: 781006 - RNA, 18 nt, Human
ugguucuaauagaacuca

SEQ ID NO: 781007 - RNA, 15 nt, Human
gaaaacaaggaugaa

SEQ ID NO: 781008 - RNA, 21 nt, Human
caagacugcacaucaaaauau

SEQ ID NO: 781009 - RNA, 22 nt, Human
uauuuauaaauauauuuaagau

SEQ ID NO: 781010 - RNA, 22 nt, Human
gccuccccuccucugcuugcca

SEQ ID NO: 781011 - RNA, 19 nt, Human
ccaaucauuuuaauuauua

SEQ ID NO: 781012 - RNA, 21 nt, Human
gaccuggucgucgucuugacu

SEQ ID NO: 781013 - RNA, 17 nt, Human
acaugaaagcguaaaga

SEQ ID NO: 781014 - RNA, 20 nt, Human
gagauaucccaggaaaauua

SEQ ID NO: 781015 - RNA, 18 nt, Human
auaaaguauauauagaau

SEQ ID NO: 781016 - RNA, 19 nt, Human
guacugagagugaacaaau

SEQ ID NO: 781017 - RNA, 18 nt, Human
uuuccuucucaucuguga

SEQ ID NO: 781018 - RNA, 13 nt, Human
gggaguggcgcgc

SEQ ID NO: 781019 - RNA, 15 nt, Human
gauuccugagccagu

SEQ ID NO: 781020 - RNA, 22 nt, Human
ugaaaccccgucucuacuaaaa

SEQ ID NO: 781021 - RNA, 15 nt, Human
aauuuuuuucaucuu

SEQ ID NO: 781022 - RNA, 21 nt, Human
caagcuuuuuuuuuuuuucuu

SEQ ID NO: 781023 - RNA, 17 nt, Human
gguccgaagucuuccau

SEQ ID NO: 781024 - RNA, 14 nt, Human
cugccgcaacaguu

SEQ ID NO: 781025 - RNA, 14 nt, Human
ggacaguuuucugc

SEQ ID NO: 781026 - RNA, 23 nt, Human
cuccuguacuuuuuccagacacu

SEQ ID NO: 781027 - RNA, 14 nt, Human
cccacuggcucccu

SEQ ID NO: 781028 - RNA, 18 nt, Human
auauguauuuauaaauau

SEQ ID NO: 781029 - RNA, 15 nt, Human
aauugacccacaaga

SEQ ID NO: 781030 - RNA, 19 nt, Human
uagcuuuauuuuuuaagua

SEQ ID NO: 781031 - RNA, 22 nt, Human
uugacccacaagaaaugaaagc

SEQ ID NO: 781032 - RNA, 19 nt, Human
uaaacuggaaauaaaagau

SEQ ID NO: 781033 - RNA, 22 nt, Human
uauuucuaugaaauauuauguu

SEQ ID NO: 781034 - RNA, 14 nt, Human
aaaagaaacauuug

SEQ ID NO: 781035 - RNA, 14 nt, Human
aucaaaagaaagaa

SEQ ID NO: 781036 - RNA, 20 nt, Human
auuuugguaaaauacuucuu

SEQ ID NO: 781037 - RNA, 17 nt, Human
ccccauuucuauuuauu

SEQ ID NO: 781038 - RNA, 15 nt, Human
accuguaaucccagc

SEQ ID NO: 781039 - RNA, 12 nt, Human
guauuauuuaua

SEQ ID NO: 781040 - RNA, 16 nt, Human
auuuaagguauauaaa

SEQ ID NO: 781041 - RNA, 21 nt, Human
uaaaauaaaguauauauagaa

SEQ ID NO: 781042 - RNA, 15 nt, Human
acucaucaaucaaau

SEQ ID NO: 781043 - RNA, 13 nt, Human
aaagccaaaaacc

SEQ ID NO: 781044 - RNA, 20 nt, Human
acaguuagagauuuuuaaau

SEQ ID NO: 781045 - RNA, 15 nt, Human
uccagauccuggaaa

SEQ ID NO: 781046 - RNA, 12 nt, Human
cuuccucacacc

SEQ ID NO: 781047 - RNA, 18 nt, Human
agagauuuuuaaauaaag

SEQ ID NO: 781048 - RNA, 21 nt, Human
auucccuccugcuacucuguu

SEQ ID NO: 781049 - RNA, 14 nt, Human
aaguagaauaaaca

SEQ ID NO: 781050 - RNA, 13 nt, Human
ugcuugccauccc

SEQ ID NO: 781051 - RNA, 16 nt, Human
ucacuuaauccuuugu

SEQ ID NO: 781052 - RNA, 19 nt, Human
uaaauauauuuaagauaau

SEQ ID NO: 781053 - RNA, 22 nt, Human
ugacuaugcaaccuuuggaugc

SEQ ID NO: 781054 - RNA, 22 nt, Human
aauuuuuucucuaggaaauauu

SEQ ID NO: 781055 - RNA, 18 nt, Human
cugggcagcugccucccc

SEQ ID NO: 781056 - RNA, 14 nt, Human
ugcuuguuagcaaa

SEQ ID NO: 781057 - RNA, 16 nt, Human
accuguaaucauauaa

SEQ ID NO: 781058 - RNA, 23 nt, Human
agaguuuagcuggaaaaguaugu

SEQ ID NO: 781059 - RNA, 23 nt, Human
cugcaaucugagccagugcuuua

SEQ ID NO: 781060 - RNA, 18 nt, Human
cucuacuaaaaauacaaa

SEQ ID NO: 781061 - RNA, 17 nt, Human
cuuuacuguuagucauu

SEQ ID NO: 781062 - RNA, 15 nt, Human
auauauguauuuaua

SEQ ID NO: 781063 - RNA, 22 nt, Human
aauguuauuuuuuaauuauuau

SEQ ID NO: 781064 - RNA, 20 nt, Human
agaagaacugaaaucauacu

SEQ ID NO: 781065 - RNA, 12 nt, Human
gcuauucacaac

SEQ ID NO: 781066 - RNA, 12 nt, Human
gaauuggagcuc

SEQ ID NO: 781067 - RNA, 20 nt, Human
gcagacaguguuuucuggga

SEQ ID NO: 781068 - RNA, 17 nt, Human
guacauuuccaaauuca

SEQ ID NO: 781069 - RNA, 23 nt, Human
aauagcagacaguguuuucuggg

SEQ ID NO: 781070 - RNA, 20 nt, Human
uuucagaagaaauucugcaa

SEQ ID NO: 781071 - RNA, 13 nt, Human
gguauuugagugu

SEQ ID NO: 781072 - RNA, 17 nt, Human
auuauuuauauauguau

SEQ ID NO: 781073 - RNA, 12 nt, Human
gaagucuuccau

SEQ ID NO: 781074 - RNA, 20 nt, Human
caggcuccaaacuggagcuu

SEQ ID NO: 781075 - RNA, 12 nt, Human
ccccuugccaua

SEQ ID NO: 781076 - RNA, 15 nt, Human
ugguuuagaaagcuu

SEQ ID NO: 781077 - RNA, 14 nt, Human
auagcaucucagga

SEQ ID NO: 781078 - RNA, 21 nt, Human
uuuuaaguaauuucagaagaa

SEQ ID NO: 781079 - RNA, 13 nt, Human
cagcaguucagag

SEQ ID NO: 781080 - RNA, 17 nt, Human
ugguucccuugaugaag

SEQ ID NO: 781081 - RNA, 15 nt, Human
cugccucuaaaaggc

SEQ ID NO: 781082 - RNA, 16 nt, Human
aagacaaagacaaauu

SEQ ID NO: 781083 - RNA, 23 nt, Human
agacagcuucucauccugcaggc

SEQ ID NO: 781084 - RNA, 18 nt, Human
gacuauuauagaauggaa

SEQ ID NO: 781085 - RNA, 17 nt, Human
cugauuaaaguuaaaua

SEQ ID NO: 781086 - RNA, 20 nt, Human
uauauauguauuuauaaaua

SEQ ID NO: 781087 - RNA, 22 nt, Human
aaauguugacaugggacauuug

SEQ ID NO: 781088 - RNA, 22 nt, Human
aucccagcacuuugggaggcug

SEQ ID NO: 781089 - RNA, 12 nt, Human
ucaauauuuauu

SEQ ID NO: 781090 - RNA, 13 nt, Human
cuccaccucccug

SEQ ID NO: 781091 - RNA, 22 nt, Human
uauaagcuguuuuuauauaugu

SEQ ID NO: 781092 - RNA, 21 nt, Human
uagcaucucaggagauuucau

SEQ ID NO: 781093 - RNA, 15 nt, Human
uguaacuuaugaacc

SEQ ID NO: 781094 - RNA, 17 nt, Human
ucuagguucuaaaaauu

SEQ ID NO: 781095 - RNA, 20 nt, Human
auugaaucccuuaaacucag

SEQ ID NO: 781096 - RNA, 13 nt, Human
uguauugcauuaa

SEQ ID NO: 781097 - RNA, 16 nt, Human
gaagauguagaggaga

SEQ ID NO: 781098 - RNA, 14 nt, Human
ucccuccaccuccc

SEQ ID NO: 781099 - RNA, 18 nt, Human
uuaacuagaauuuauuca

SEQ ID NO: 781100 - RNA, 13 nt, Human
ccaccugccuaua

SEQ ID NO: 781101 - RNA, 15 nt, Human
cuacaagcuaaaauu

SEQ ID NO: 781102 - RNA, 23 nt, Human
accuguaaucauauaauaaaugu

SEQ ID NO: 781103 - RNA, 14 nt, Human
caguaacggaacag

SEQ ID NO: 781104 - RNA, 22 nt, Human
cugcuugccaucccucccucca

SEQ ID NO: 781105 - RNA, 17 nt, Human
gaaugagagacacacug

SEQ ID NO: 781106 - RNA, 16 nt, Human
cacuuuuuuucuuuuc

SEQ ID NO: 781107 - RNA, 22 nt, Human
auacugaauguaaacaaaggaa

SEQ ID NO: 781108 - RNA, 16 nt, Human
ucaaaaaauaaaaaua

SEQ ID NO: 781109 - RNA, 13 nt, Human
uuuguaauauuuc

SEQ ID NO: 781110 - RNA, 24 nt, Human
uugccaaggcuggagugcaguggc

SEQ ID NO: 781111 - RNA, 16 nt, Human
ugacaagcucacagac

SEQ ID NO: 781112 - RNA, 14 nt, Human
gcauucucugaaga

SEQ ID NO: 781113 - RNA, 16 nt, Human
gccaugugcuaguaau

SEQ ID NO: 781114 - RNA, 20 nt, Human
accuuuugcuguggcaaaug

SEQ ID NO: 781115 - RNA, 14 nt, Human
uauuugaauuuuaa

SEQ ID NO: 781116 - RNA, 15 nt, Human
augcuggccaggcug

SEQ ID NO: 781117 - RNA, 15 nt, Human
ucuaugaaauauuau

SEQ ID NO: 781118 - RNA, 14 nt, Human
auauuaucaugcaa

SEQ ID NO: 781119 - RNA, 17 nt, Human
cugcaggcgugaccuga

SEQ ID NO: 781120 - RNA, 21 nt, Human
cagccugggugacagagcaag

SEQ ID NO: 781121 - RNA, 20 nt, Human
agcagagacgggguuugcca

SEQ ID NO: 781122 - RNA, 16 nt, Human
accucaagccagccuu

SEQ ID NO: 781123 - RNA, 14 nt, Human
uguuucuuaaaugg

SEQ ID NO: 781124 - RNA, 20 nt, Human
agagacacacugaagaagca

SEQ ID NO: 781125 - RNA, 19 nt, Human
acagugauuaccagggacu

SEQ ID NO: 781126 - RNA, 13 nt, Human
cugccuccccucc

SEQ ID NO: 781127 - RNA, 18 nt, Human
ccuaacugcuacaaauac

SEQ ID NO: 781128 - RNA, 22 nt, Human
cuuacuauuuauugcugaauga

SEQ ID NO: 781129 - RNA, 15 nt, Human
gccucuuagaugcag

SEQ ID NO: 781130 - RNA, 21 nt, Human
auuuauauggggaauauauuu

SEQ ID NO: 781131 - RNA, 18 nt, Human
auguuaaaacugggacag

SEQ ID NO: 781132 - RNA, 16 nt, Human
cuguaucuuguuuuuc

SEQ ID NO: 781133 - RNA, 19 nt, Human
gagacuuugugaaaaaaaa

SEQ ID NO: 781134 - RNA, 19 nt, Human
uaaaucuauuuauuaauau

SEQ ID NO: 781135 - RNA, 17 nt, Human
ccuguaaucccagcacu

SEQ ID NO: 781136 - RNA, 14 nt, Human
uucacaagugaaaa

SEQ ID NO: 781137 - RNA, 18 nt, Human
cacuccagugagacagcu

SEQ ID NO: 781138 - RNA, 19 nt, Human
agggaauugcagaguacug

SEQ ID NO: 781139 - RNA, 15 nt, Human
auguguggcauuuuc

SEQ ID NO: 781140 - RNA, 19 nt, Human
cugcccucuccugggcagc

SEQ ID NO: 781141 - RNA, 15 nt, Human
acucuuuugccauua

SEQ ID NO: 781142 - RNA, 15 nt, Human
uccagacacuuuuuu

SEQ ID NO: 781143 - RNA, 12 nt, Human
caggacagcccu

SEQ ID NO: 781144 - RNA, 19 nt, Human
uaaauuuucccaaaacuga

SEQ ID NO: 781145 - RNA, 15 nt, Human
aagaauuuuaaaacu

SEQ ID NO: 781146 - RNA, 20 nt, Human
auaagccagacaucaacaga

SEQ ID NO: 781147 - RNA, 23 nt, Human
uaucaauagaaggauguacauuu

SEQ ID NO: 781148 - RNA, 18 nt, Human
gaacucugagcagugcuu

SEQ ID NO: 781149 - RNA, 22 nt, Human
acuggccugcuggauguggagg

SEQ ID NO: 781150 - RNA, 16 nt, Human
ggcagcuuuuucucuc

SEQ ID NO: 781151 - RNA, 12 nt, Human
acaugagguacu

SEQ ID NO: 781152 - RNA, 16 nt, Human
auaugugaaauaaaag

SEQ ID NO: 781153 - RNA, 17 nt, Human
aauauuuuuaugugcaa

SEQ ID NO: 781154 - RNA, 15 nt, Human
auuugaguguuuuaa

SEQ ID NO: 781155 - RNA, 12 nt, Human
cagauuuuccug

SEQ ID NO: 781156 - RNA, 19 nt, Human
cauggaauuggagcucgug

SEQ ID NO: 781157 - RNA, 16 nt, Human
guaauucuaaaugaau

SEQ ID NO: 781158 - RNA, 22 nt, Human
cuuguaaaguacagacuuuuuu

SEQ ID NO: 781159 - RNA, 14 nt, Human
uacuuuguccuuuu

SEQ ID NO: 781160 - RNA, 12 nt, Human
gccaaggcugga

SEQ ID NO: 781161 - RNA, 17 nt, Human
cugccucagaaaacaag

SEQ ID NO: 781162 - RNA, 13 nt, Human
uggccaggcuggu

SEQ ID NO: 781163 - RNA, 18 nt, Human
cagauagguuaccaguaa

SEQ ID NO: 781164 - RNA, 15 nt, Human
uguuacauuauuauc

SEQ ID NO: 781165 - RNA, 23 nt, Human
uaguaccaaucauuuuaauuauu

SEQ ID NO: 781166 - RNA, 18 nt, Human
aagacaacauuaaaacaa

SEQ ID NO: 781167 - RNA, 18 nt, Human
caaagacuaugaggaaua

SEQ ID NO: 781168 - RNA, 19 nt, Human
uaaagaacacccuauauuu

SEQ ID NO: 781169 - RNA, 13 nt, Human
auagaguguuauc

SEQ ID NO: 781170 - RNA, 20 nt, Human
auuuauauauuuauaacuca

SEQ ID NO: 781171 - RNA, 14 nt, Human
uaacaauuuuagga

SEQ ID NO: 781172 - RNA, 20 nt, Human
auaacucaucauaaaauaaa

SEQ ID NO: 781173 - RNA, 12 nt, Human
ugcccucuccug

SEQ ID NO: 781174 - RNA, 12 nt, Human
auauuauaauuu

SEQ ID NO: 781175 - RNA, 19 nt, Human
auuaaguuuuuuuuuaaaa

SEQ ID NO: 781176 - RNA, 16 nt, Human
ugacacuuaaaaaugg

SEQ ID NO: 781177 - RNA, 14 nt, Human
ccaaauuuguauuu

SEQ ID NO: 781178 - RNA, 17 nt, Human
cucguggaacaguuacc

SEQ ID NO: 781179 - RNA, 15 nt, Human
acaaagacaaauucu

SEQ ID NO: 781180 - RNA, 14 nt, Human
aaaaacauuucaaa

SEQ ID NO: 781181 - RNA, 19 nt, Human
gcuugccaucccucccucc

SEQ ID NO: 781182 - RNA, 22 nt, Human
agaaugagagacacacugaaga

SEQ ID NO: 781183 - RNA, 19 nt, Human
auuuacagagacagaaagc

SEQ ID NO: 781184 - RNA, 14 nt, Human
agggcuugaggacu

SEQ ID NO: 781185 - RNA, 17 nt, Human
caucccucccuccaccu

SEQ ID NO: 781186 - RNA, 22 nt, Human
cugucuggacuuuccagagacc

SEQ ID NO: 781187 - RNA, 17 nt, Human
uuuuccacuacugcuac

SEQ ID NO: 781188 - RNA, 19 nt, Human
aaucuuaacucauugcaac

SEQ ID NO: 781189 - RNA, 21 nt, Human
ugcaggcagcuuuuucucucc

SEQ ID NO: 781190 - RNA, 17 nt, Human
cauuugcacuauuggaa

SEQ ID NO: 781191 - RNA, 14 nt, Human
ucuccugggcagcu

SEQ ID NO: 781192 - RNA, 15 nt, Human
aagaagcuaaauccu

SEQ ID NO: 781193 - RNA, 13 nt, Human
aaaaaauaaaaau

SEQ ID NO: 781194 - RNA, 20 nt, Human
uaaaauuaucaauaucuaau

SEQ ID NO: 781195 - RNA, 15 nt, Human
uuuuaagauaaauua

SEQ ID NO: 781196 - RNA, 19 nt, Human
uugccaucccucccuccac

SEQ ID NO: 781197 - RNA, 16 nt, Human
cucuaggacauaaauu

SEQ ID NO: 781198 - RNA, 14 nt, Human
ccugggcagcugcc

SEQ ID NO: 781199 - RNA, 21 nt, Human
aaugaauggcuaagcaaaaug

SEQ ID NO: 781200 - RNA, 17 nt, Human
uuuaagauaauuauaau

SEQ ID NO: 781201 - RNA, 20 nt, Human
auaguucaaagccaaguuua

SEQ ID NO: 781202 - RNA, 14 nt, Human
cuggaauguaauca

SEQ ID NO: 781203 - RNA, 21 nt, Human
aaauaaagcuugcaacaaaau

SEQ ID NO: 781204 - RNA, 20 nt, Human
acaagacccaaaaggcagaa

SEQ ID NO: 781205 - RNA, 22 nt, Human
gaccuguaaucauauaauaaau

SEQ ID NO: 781206 - RNA, 16 nt, Human
aacaguauccaguacu

SEQ ID NO: 781207 - RNA, 14 nt, Human
gccgggcauggugg

SEQ ID NO: 781208 - RNA, 22 nt, Human
aaguaacucauuuguuaaaauu

SEQ ID NO: 781209 - RNA, 21 nt, Human
gaagugaaaaucuacacucca

SEQ ID NO: 781210 - RNA, 19 nt, Human
aucggagcugcuagaguuc

SEQ ID NO: 781211 - RNA, 13 nt, Human
ucuaagaagugaa

SEQ ID NO: 781212 - RNA, 21 nt, Human
uaccaaucauuuuaauuauua

SEQ ID NO: 781213 - RNA, 15 nt, Human
augagaccacuguua

SEQ ID NO: 781214 - RNA, 22 nt, Human
auaacaaugcuguauuuuaaaa

SEQ ID NO: 781215 - RNA, 19 nt, Human
cugucucaaaaaauaaaaa

SEQ ID NO: 781216 - RNA, 18 nt, Human
auggugaaaugcagaguc

SEQ ID NO: 781217 - RNA, 17 nt, Human
agucugacuguuuccau

SEQ ID NO: 781218 - RNA, 16 nt, Human
augaaagcguaaagag

SEQ ID NO: 781219 - RNA, 22 nt, Human
uagcaguugaaacaagaagcca

SEQ ID NO: 781220 - RNA, 15 nt, Human
ugcuucuguuuuaua

SEQ ID NO: 781221 - RNA, 17 nt, Human
ugugaacgauuuagaaa

SEQ ID NO: 781222 - RNA, 14 nt, Human
aacagaagcuucca

SEQ ID NO: 781223 - RNA, 17 nt, Human
uuaaauggucaauuuug

SEQ ID NO: 781224 - RNA, 15 nt, Human
aguuuuugauagcuu

SEQ ID NO: 781225 - RNA, 23 nt, Human
aaauugugaucagaccauaaugu

SEQ ID NO: 781226 - RNA, 17 nt, Human
ucauccugcaggcagcu

SEQ ID NO: 781227 - RNA, 14 nt, Human
cucugcuugccauc

SEQ ID NO: 781228 - RNA, 22 nt, Human
auucuaaaugaauguuuacacu

SEQ ID NO: 781229 - RNA, 18 nt, Human
auuuugaauccagaaaua

SEQ ID NO: 781230 - RNA, 21 nt, Human
caaauuaaggcauaagaaaac

SEQ ID NO: 781231 - RNA, 18 nt, Human
uuagagauuuuuaaauaa

SEQ ID NO: 781232 - RNA, 21 nt, Human
caguuacugccgguuugaaaa

SEQ ID NO: 781233 - RNA, 20 nt, Human
uuguagguaauauugcaagg

SEQ ID NO: 781234 - RNA, 14 nt, Human
ugcuguauuuuaaa

SEQ ID NO: 781235 - RNA, 14 nt, Human
acuaaaaauacaaa

SEQ ID NO: 781236 - RNA, 15 nt, Human
uuauauuauuuugaa

SEQ ID NO: 781237 - RNA, 12 nt, Human
guagacacacau

SEQ ID NO: 781238 - RNA, 15 nt, Human
uaauauacuauauuu

SEQ ID NO: 781239 - RNA, 17 nt, Human
accugagccccaaaagg

SEQ ID NO: 781240 - RNA, 20 nt, Human
agccuuggggcugaugcagu

SEQ ID NO: 781241 - RNA, 16 nt, Human
ggaaagggucucccuc

SEQ ID NO: 781242 - RNA, 14 nt, Human
auuauaauauacua

SEQ ID NO: 781243 - RNA, 16 nt, Human
ccccugcacuccagcc

SEQ ID NO: 781244 - RNA, 18 nt, Human
acuucaauacuucauuua

SEQ ID NO: 781245 - RNA, 12 nt, Human
uaacuuaugaac

SEQ ID NO: 781246 - RNA, 17 nt, Human
ggaaaaaaaggaagaaa

SEQ ID NO: 781247 - RNA, 23 nt, Human
cauagagacuuugugaaaaaaaa

SEQ ID NO: 781248 - RNA, 13 nt, Human
uuccccuaaccuc

SEQ ID NO: 781249 - RNA, 18 nt, Human
auauuuuuaugugcaaua

SEQ ID NO: 781250 - RNA, 12 nt, Human
ggaggcugagau

SEQ ID NO: 781251 - RNA, 15 nt, Human
aaaaaagaaacauuu

SEQ ID NO: 781252 - RNA, 14 nt, Human
aaaaauaaaaauaa

SEQ ID NO: 781253 - RNA, 20 nt, Human
ucaggaggaaggcuuacacc

SEQ ID NO: 781254 - RNA, 22 nt, Human
acacagugucuggcacuuggga

SEQ ID NO: 781255 - RNA, 23 nt, Human
aucagcauuuuacuacuuuaaaa

SEQ ID NO: 781256 - RNA, 21 nt, Human
caacuuuuguguaaugaaaau

SEQ ID NO: 781257 - RNA, 14 nt, Human
auuuucccaaaacu

SEQ ID NO: 781258 - RNA, 15 nt, Human
ucagucauaacuaaa

SEQ ID NO: 781259 - RNA, 18 nt, Human
auuuauuuacugagcuuc

SEQ ID NO: 781260 - RNA, 19 nt, Human
ccauccugccccugagccc

SEQ ID NO: 781261 - RNA, 17 nt, Human
aaagaaacauuugguaa

SEQ ID NO: 781262 - RNA, 23 nt, Human
gcagccaugugauuacccucugg

SEQ ID NO: 781263 - RNA, 20 nt, Human
auuuauauggggaauauauu

SEQ ID NO: 781264 - RNA, 14 nt, Human
agaaugagaagaau

SEQ ID NO: 781265 - RNA, 18 nt, Human
gccugagcgacagugaga

SEQ ID NO: 781266 - RNA, 17 nt, Human
auguugacaugggacau

SEQ ID NO: 781267 - RNA, 21 nt, Human
ucuuuucuggaauguaaucaa

SEQ ID NO: 781268 - RNA, 20 nt, Human
aacucaucauaaaauaaagu

SEQ ID NO: 781269 - RNA, 16 nt, Human
accucugccucagaaa

SEQ ID NO: 781270 - RNA, 13 nt, Human
accgaguggcccu

SEQ ID NO: 781271 - RNA, 18 nt, Human
aagucugauuuuccugga

SEQ ID NO: 781272 - RNA, 13 nt, Human
ucaucauaaaaua

SEQ ID NO: 781273 - RNA, 12 nt, Human
auacuauauuua

SEQ ID NO: 781274 - RNA, 17 nt, Human
gccuaagugcagccccg

SEQ ID NO: 781275 - RNA, 18 nt, Human
gaugcaguucugaagaag

SEQ ID NO: 781276 - RNA, 19 nt, Human
aauuuucuuccaaacagaa

SEQ ID NO: 781277 - RNA, 24 nt, Human
uuuucgaugguacauauuucuuug

SEQ ID NO: 781278 - RNA, 13 nt, Human
cccaaaaggcaga

SEQ ID NO: 781279 - RNA, 17 nt, Human
uuucaaaacucauuucc

SEQ ID NO: 781280 - RNA, 17 nt, Human
cuaaaauuagaugaacu

SEQ ID NO: 781281 - RNA, 23 nt, Human
uuuaguaagagauuccugagcca

SEQ ID NO: 781282 - RNA, 14 nt, Human
aacauuauuuauau

SEQ ID NO: 781283 - RNA, 15 nt, Human
aaaauggguuuuacu

SEQ ID NO: 781284 - RNA, 15 nt, Human
ucugcccugcuuuug

SEQ ID NO: 781285 - RNA, 21 nt, Human
aagaagcccaauauuauaauu

SEQ ID NO: 781286 - RNA, 22 nt, Human
gaauaauacuagucuuauaaua

SEQ ID NO: 781287 - RNA, 19 nt, Human
ucaauauuuauuauuuuca

SEQ ID NO: 781288 - RNA, 14 nt, Human
cacuguuaucaaaa

SEQ ID NO: 781289 - RNA, 21 nt, Human
ucuuucacauuggcuauuuaa

SEQ ID NO: 781290 - RNA, 16 nt, Human
uauuuauuaauauuua

SEQ ID NO: 781291 - RNA, 14 nt, Human
uuucugcuuuaauu

SEQ ID NO: 781292 - RNA, 13 nt, Human
uuauagaauauuu

SEQ ID NO: 781293 - RNA, 21 nt, Human
uuuauaauagcaacuuuugug

SEQ ID NO: 781294 - RNA, 14 nt, Human
augaaccuuuacau

SEQ ID NO: 781295 - RNA, 21 nt, Human
auaauuuuuauauuugaaaua

SEQ ID NO: 781296 - RNA, 23 nt, Human
ccaccucccugcaauaaaauggg

SEQ ID NO: 781297 - RNA, 15 nt, Human
cuuuucccaacucca

SEQ ID NO: 781298 - RNA, 15 nt, Human
uauuagccacaaaau

SEQ ID NO: 781299 - RNA, 20 nt, Human
uccaagccucauguccacug

SEQ ID NO: 781300 - RNA, 16 nt, Human
auccuccacaauagca

SEQ ID NO: 781301 - RNA, 17 nt, Human
caaaauuggacuuaaaa

SEQ ID NO: 781302 - RNA, 21 nt, Human
auuccuauauccugugacugu

SEQ ID NO: 781303 - RNA, 16 nt, Human
auugagcaccugcagg

SEQ ID NO: 781304 - RNA, 20 nt, Human
ucuucauagcagauuuuaau

SEQ ID NO: 781305 - RNA, 23 nt, Human
ucauauaauaaauguacauuaau

SEQ ID NO: 781306 - RNA, 16 nt, Human
auacaguaauuuuaag

SEQ ID NO: 781307 - RNA, 14 nt, Human
accuucuggguuca

SEQ ID NO: 781308 - RNA, 17 nt, Human
caaucuuaacucauugc

SEQ ID NO: 781309 - RNA, 21 nt, Human
uccaccucccugcaauaaaau

SEQ ID NO: 781310 - RNA, 20 nt, Human
aauucuaaaugaauguuuac

SEQ ID NO: 781311 - RNA, 20 nt, Human
gggaggcagagguugcagug

SEQ ID NO: 781312 - RNA, 22 nt, Human
ucccagccagcaguucagagcu

SEQ ID NO: 781313 - RNA, 20 nt, Human
agcuuauugucuagugaaac

SEQ ID NO: 781314 - RNA, 18 nt, Human
gccuaucagcauuuuacu

SEQ ID NO: 781315 - RNA, 12 nt, Human
uuuuuguaaguu

SEQ ID NO: 781316 - RNA, 21 nt, Human
cggccugauuaaaguuaaaua

SEQ ID NO: 781317 - RNA, 13 nt, Human
gcugcccucuccu

SEQ ID NO: 781318 - RNA, 21 nt, Human
aauuuuuuucaucuucucugg

SEQ ID NO: 781319 - RNA, 20 nt, Human
uuauuaccucugauaccuca

SEQ ID NO: 781320 - RNA, 21 nt, Human
agauacugaauguaaacaaag

SEQ ID NO: 781321 - RNA, 20 nt, Human
acagcccuucuuuccacaga

SEQ ID NO: 781322 - RNA, 15 nt, Human
uaucuaauauauaug

SEQ ID NO: 781323 - RNA, 17 nt, Human
cauucaaaaguugaaau

SEQ ID NO: 781324 - RNA, 16 nt, Human
ugcuguauuuuaaaag

SEQ ID NO: 781325 - RNA, 13 nt, Human
gcuugccaucccu

SEQ ID NO: 781326 - RNA, 15 nt, Human
cagacagaacuugaa

SEQ ID NO: 781327 - RNA, 17 nt, Human
cugcauauguuucgcug

SEQ ID NO: 781328 - RNA, 13 nt, Human
uaaguaauuucag

SEQ ID NO: 781329 - RNA, 14 nt, Human
cuccaccucccugc

SEQ ID NO: 781330 - RNA, 12 nt, Human
uaucuaauauau

SEQ ID NO: 781331 - RNA, 19 nt, Human
gcuuguauuccuuuuucuc

SEQ ID NO: 781332 - RNA, 19 nt, Human
ugauuacaaggcuuuaucu

SEQ ID NO: 781333 - RNA, 14 nt, Human
uuguaauucuaaau

SEQ ID NO: 781334 - RNA, 14 nt, Human
agcuuuucaaaauu

SEQ ID NO: 781335 - RNA, 18 nt, Human
aauagcagacaguguuuu

SEQ ID NO: 781336 - RNA, 19 nt, Human
uaucucauuuccaagcaag

SEQ ID NO: 781337 - RNA, 20 nt, Human
ccauaauguuacauuauuau

SEQ ID NO: 781338 - RNA, 18 nt, Human
ugcugccucuaaaaggcc

SEQ ID NO: 781339 - RNA, 16 nt, Human
aguaagagauuccuga

SEQ ID NO: 781340 - RNA, 16 nt, Human
auaucuauuaauauau

SEQ ID NO: 781341 - RNA, 21 nt, Human
caaucugaggccuccucucuc

SEQ ID NO: 781342 - RNA, 16 nt, Human
gcuugccugcaggcau

SEQ ID NO: 781343 - RNA, 15 nt, Human
aaucuaaaucuauuu

SEQ ID NO: 781344 - RNA, 16 nt, Human
aacucuuaaucaaaua

SEQ ID NO: 781345 - RNA, 15 nt, Human
uuuguaauauuucuc

SEQ ID NO: 781346 - RNA, 19 nt, Human
uauauuuuuuaugaaacau

SEQ ID NO: 781347 - RNA, 19 nt, Human
uaagauuuuguuuuuaaac

SEQ ID NO: 781348 - RNA, 18 nt, Human
agcuuacuuaaaauugua

SEQ ID NO: 781349 - RNA, 11 nt, Human
ucuuuucucug

SEQ ID NO: 781350 - RNA, 15 nt, Human
ucucauccugcaggc

SEQ ID NO: 781351 - RNA, 22 nt, Human
ccuguugaagaugcuuguauuu

SEQ ID NO: 781352 - RNA, 20 nt, Human
uuaaguuuuuuuuuaaaaaa

SEQ ID NO: 781353 - RNA, 20 nt, Human
ccaccuucuggguucaagcg

SEQ ID NO: 781354 - RNA, 23 nt, Human
gaaacguguauauuuuuuaugaa

SEQ ID NO: 781355 - RNA, 23 nt, Human
gaagccgagccucaagaugaagg

SEQ ID NO: 781356 - RNA, 15 nt, Human
gaugcacuuuauauu

SEQ ID NO: 781357 - RNA, 19 nt, Human
cugacagcccaaggguggg

SEQ ID NO: 781358 - RNA, 12 nt, Human
acuauggaaaaa

SEQ ID NO: 781359 - RNA, 23 nt, Human
agcuuccauuccaagccugacca

SEQ ID NO: 781360 - RNA, 16 nt, Human
uuaaauauaauaugca

SEQ ID NO: 781361 - RNA, 12 nt, Human
caccuguuuuua

SEQ ID NO: 781362 - RNA, 15 nt, Human
gacucaucaaucaaa

SEQ ID NO: 781363 - RNA, 14 nt, Human
agcuugaaauagug

SEQ ID NO: 781364 - RNA, 13 nt, Human
uguaauucuaaau

SEQ ID NO: 781365 - RNA, 20 nt, Human
uuuaugaaacauuacaguua

SEQ ID NO: 781366 - RNA, 16 nt, Human
uaaauguacauuaauu

SEQ ID NO: 781367 - RNA, 22 nt, Human
uagacacacaugaaguccaagc

SEQ ID NO: 781368 - RNA, 17 nt, Human
ugcaagacauagaauag

SEQ ID NO: 781369 - RNA, 23 nt, Human
augaaacuaagauuuguaauauu

SEQ ID NO: 781370 - RNA, 15 nt, Human
uugaaauagugucug

SEQ ID NO: 781371 - RNA, 23 nt, Human
ggaggcagagguugcagugagcc

SEQ ID NO: 781372 - RNA, 14 nt, Human
agcugaacuuguug

SEQ ID NO: 781373 - RNA, 20 nt, Human
aaaagacauaagcaaagacu

SEQ ID NO: 781374 - RNA, 14 nt, Human
guuaagcaacaucu

SEQ ID NO: 781375 - RNA, 18 nt, Human
aaauauuuauuuuaauaa

SEQ ID NO: 781376 - RNA, 21 nt, Human
ucucagaaauuguaucuuagu

SEQ ID NO: 781377 - RNA, 20 nt, Human
ccauuguggucacaggaagu

SEQ ID NO: 781378 - RNA, 11 nt, Human
cagcaguucag

SEQ ID NO: 781379 - RNA, 16 nt, Human
auaaaaugagcaaaag

SEQ ID NO: 781380 - RNA, 22 nt, Human
auuucuugaguuuuguuuuaaa

SEQ ID NO: 781381 - RNA, 16 nt, Human
ugccuuuauaaucuuu

SEQ ID NO: 781382 - RNA, 21 nt, Human
aggcagcuuuuucucucccac

SEQ ID NO: 781383 - RNA, 13 nt, Human
aaaaaugguuuaa

SEQ ID NO: 781384 - RNA, 14 nt, Human
uuuauaauuccuau

SEQ ID NO: 781385 - RNA, 17 nt, Human
ccugcaauaaaaugggu

SEQ ID NO: 781386 - RNA, 23 nt, Human
agcuuuuuuuuuuuuucuuaaag

SEQ ID NO: 781387 - RNA, 15 nt, Human
ucaaccaaauggagu

SEQ ID NO: 781388 - RNA, 12 nt, Human
gcuggauucaag

SEQ ID NO: 781389 - RNA, 16 nt, Human
cccuccaccucccugc

SEQ ID NO: 781390 - RNA, 11 nt, Human
ugcagugagcc

SEQ ID NO: 781391 - RNA, 14 nt, Human
ucucccucuguugc

SEQ ID NO: 781392 - RNA, 22 nt, Human
uuauaaucuuuuauacaguguc

SEQ ID NO: 781393 - RNA, 14 nt, Human
aacucaguuuuaac

SEQ ID NO: 781394 - RNA, 13 nt, Human
gucucaguguccu

SEQ ID NO: 781395 - RNA, 15 nt, Human
ggauagagugggaca

SEQ ID NO: 781396 - RNA, 17 nt, Human
cauucugcuuucaucuu

SEQ ID NO: 781397 - RNA, 20 nt, Human
uauuagcuuuacuguuuguu

SEQ ID NO: 781398 - RNA, 15 nt, Human
uaaagaauuuucaaa

SEQ ID NO: 781399 - RNA, 17 nt, Human
gacagucaccucaugga

SEQ ID NO: 781400 - RNA, 14 nt, Human
auaaagaauuuuaa

SEQ ID NO: 781401 - RNA, 20 nt, Human
aaucauauaauaaauguaca

SEQ ID NO: 781402 - RNA, 21 nt, Human
cagcauuuuacuacuuuaaaa

SEQ ID NO: 781403 - RNA, 23 nt, Human
aaauuuacagagacagaaagcag

SEQ ID NO: 781404 - RNA, 12 nt, Human
agcuugcaacaa

SEQ ID NO: 781405 - RNA, 17 nt, Human
cuacacuccagugagac

SEQ ID NO: 781406 - RNA, 22 nt, Human
aauuacauuuguauaaaauaau

SEQ ID NO: 781407 - RNA, 16 nt, Human
auaauguuguuauuua

SEQ ID NO: 781408 - RNA, 19 nt, Human
aagacucuacccauauuac

SEQ ID NO: 781409 - RNA, 22 nt, Human
acagagaaaauaaaagcacuua

SEQ ID NO: 781410 - RNA, 20 nt, Human
aagaaauucugcaagcuuuu

SEQ ID NO: 781411 - RNA, 13 nt, Human
agcugccuccccu

SEQ ID NO: 781412 - RNA, 15 nt, Human
acccggccugauuaa

SEQ ID NO: 781413 - RNA, 16 nt, Human
uuacagagaaaagaca

SEQ ID NO: 781414 - RNA, 13 nt, Human
cuggcuuaaaaug

SEQ ID NO: 781415 - RNA, 15 nt, Human
gugcaggcagcagga

SEQ ID NO: 781416 - RNA, 20 nt, Human
guaucaaaagaaagaaaauc

SEQ ID NO: 781417 - RNA, 16 nt, Human
ugacaagguucuuccc

SEQ ID NO: 781418 - RNA, 15 nt, Human
gaaauaguucaaagc

SEQ ID NO: 781419 - RNA, 21 nt, Human
uuacaguuagagauuuuuaaa

SEQ ID NO: 781420 - RNA, 12 nt, Human
cuaagaagugaa

SEQ ID NO: 781421 - RNA, 14 nt, Human
uaguaucaaaagaa

SEQ ID NO: 781422 - RNA, 23 nt, Human
auuaauggaauauguaaauagaa

SEQ ID NO: 781423 - RNA, 14 nt, Human
guuacucugaaggg

SEQ ID NO: 781424 - RNA, 14 nt, Human
aggcaagagaauug

SEQ ID NO: 781425 - RNA, 18 nt, Human
ucacacaaccugucccag

SEQ ID NO: 781426 - RNA, 16 nt, Human
uuaaacuggaaauaaa

SEQ ID NO: 781427 - RNA, 13 nt, Human
gcuuuaaguguaa

SEQ ID NO: 781428 - RNA, 17 nt, Human
aguuccugagaccagcc

SEQ ID NO: 781429 - RNA, 22 nt, Human
uccaaacagaacuauggaaaaa

SEQ ID NO: 781430 - RNA, 18 nt, Human
gcuugaggacuugggcgg

SEQ ID NO: 781431 - RNA, 17 nt, Human
auucccuuuugcugccu

SEQ ID NO: 781432 - RNA, 18 nt, Human
caguauucccuuuugcug

SEQ ID NO: 781433 - RNA, 11 nt, Human
aauaucuauua

SEQ ID NO: 781434 - RNA, 20 nt, Human
uaugugaaauaaaaguagaa

SEQ ID NO: 781435 - RNA, 22 nt, Human
augugcaauaugugauguggca

SEQ ID NO: 781436 - RNA, 17 nt, Human
auuugcacuauuggaag

SEQ ID NO: 781437 - RNA, 16 nt, Human
uucuggguucaagcga

SEQ ID NO: 781438 - RNA, 16 nt, Human
ugcaugguuuagaaag

SEQ ID NO: 781439 - RNA, 14 nt, Human
uuaugaaccuuuac

SEQ ID NO: 781440 - RNA, 13 nt, Human
uuuugcuguggca

SEQ ID NO: 781441 - RNA, 13 nt, Human
uaauuuuuauauu

SEQ ID NO: 781442 - RNA, 19 nt, Human
auauuuuuuaugaaacauu

SEQ ID NO: 781443 - RNA, 23 nt, Human
gccaucccucccuccaccucccu

SEQ ID NO: 781444 - RNA, 23 nt, Human
uugauagcaagugaauuuuucuc

SEQ ID NO: 781445 - RNA, 19 nt, Human
aaaacaaagaagacaacau

SEQ ID NO: 781446 - RNA, 14 nt, Human
aaaguauaaauaaa

SEQ ID NO: 781447 - RNA, 17 nt, Human
augcauacaguaauuuu

SEQ ID NO: 781448 - RNA, 23 nt, Human
uccuuaucacugacacaaaaagu

SEQ ID NO: 781449 - RNA, 13 nt, Human
auuuauuugagac

SEQ ID NO: 781450 - RNA, 20 nt, Human
aacuaauagaauuaauggaa

SEQ ID NO: 781451 - RNA, 15 nt, Human
aauauaauaugcaca

SEQ ID NO: 781452 - RNA, 18 nt, Human
agaaauaugcacaauagc

SEQ ID NO: 781453 - RNA, 16 nt, Human
cagggccuggcuggga

SEQ ID NO: 781454 - RNA, 12 nt, Human
aaggccuguccc

SEQ ID NO: 781455 - RNA, 21 nt, Human
gaaacagagaaaauaaaagca

SEQ ID NO: 781456 - RNA, 17 nt, Human
ggaauauguaaauagaa

SEQ ID NO: 781457 - RNA, 23 nt, Human
uguugcccacagcuguaugauuc

SEQ ID NO: 781458 - RNA, 15 nt, Human
uuuuuaaauaaagaa

SEQ ID NO: 781459 - RNA, 20 nt, Human
uauauguguuuuucacauuu

SEQ ID NO: 781460 - RNA, 18 nt, Human
gagaccacuguuaucaaa

SEQ ID NO: 781461 - RNA, 16 nt, Human
auaauuauaauauacu

SEQ ID NO: 781462 - RNA, 21 nt, Human
uuguuuuaaaauuaaagcuaa

SEQ ID NO: 781463 - RNA, 21 nt, Human
ucaugccccuguacuccagcc

SEQ ID NO: 781464 - RNA, 13 nt, Human
ucucacuuaaucc

SEQ ID NO: 781465 - RNA, 16 nt, Human
aaggguggguggggug

SEQ ID NO: 781466 - RNA, 14 nt, Human
cagcagagacgggg

SEQ ID NO: 781467 - RNA, 23 nt, Human
uaaguaaguuugauuucauuaau

SEQ ID NO: 781468 - RNA, 15 nt, Human
agaauaccacaggaa

SEQ ID NO: 781469 - RNA, 16 nt, Human
caggcuugccugcagg

SEQ ID NO: 781470 - RNA, 21 nt, Human
cauuuuacuacuuuaaaaaaa

SEQ ID NO: 781471 - RNA, 22 nt, Human
ugauuuuacggagauaucccag

SEQ ID NO: 781472 - RNA, 12 nt, Human
uuuuuuuuaaaa

SEQ ID NO: 781473 - RNA, 17 nt, Human
ucagagcugcccucucc

SEQ ID NO: 781474 - RNA, 18 nt, Human
cuguaucuuguuuuucca

SEQ ID NO: 781475 - RNA, 14 nt, Human
augaaacauuacag

SEQ ID NO: 781476 - RNA, 12 nt, Human
cauuugcugagc

SEQ ID NO: 781477 - RNA, 13 nt, Human
uuugguucuaaua

SEQ ID NO: 781478 - RNA, 10 nt, Human
accugagccc

SEQ ID NO: 781479 - RNA, 15 nt, Human
ucacaggacagcccu

SEQ ID NO: 781480 - RNA, 13 nt, Human
cuaugaaauauua

SEQ ID NO: 781481 - RNA, 13 nt, Human
uuaugaaacauua

SEQ ID NO: 781482 - RNA, 12 nt, Human
auuuuaaaagaa

SEQ ID NO: 781483 - RNA, 18 nt, Human
aaacccggccugauuaaa

SEQ ID NO: 781484 - RNA, 23 nt, Human
gccccugcacuccagccugagcg

SEQ ID NO: 781485 - RNA, 14 nt, Human
gcaaaugcuguauu

SEQ ID NO: 781486 - RNA, 14 nt, Human
gagccagugucagg

SEQ ID NO: 781487 - RNA, 14 nt, Human
uaauuauuauucuu

SEQ ID NO: 781488 - RNA, 22 nt, Human
aaacuggaaauaaaagauugua

SEQ ID NO: 781489 - RNA, 14 nt, Human
agccagcaguucag

SEQ ID NO: 781490 - RNA, 18 nt, Human
aacaaugcuguauuuuaa

SEQ ID NO: 781491 - RNA, 22 nt, Human
gcccaucuccgucucccaaagu

SEQ ID NO: 781492 - RNA, 14 nt, Human
ccucaucuguaaaa

SEQ ID NO: 781493 - RNA, 15 nt, Human
ugccaucccucccuc

SEQ ID NO: 781494 - RNA, 16 nt, Human
auuucaugauuucauu

SEQ ID NO: 781495 - RNA, 21 nt, Human
uuauaauauacuauauuuaug

SEQ ID NO: 781496 - RNA, 21 nt, Human
uccugagaccagccaaccugg

SEQ ID NO: 781497 - RNA, 17 nt, Human
guaucuuguuuuuccac

SEQ ID NO: 781498 - RNA, 20 nt, Human
ugagaacugcauauguuucg

SEQ ID NO: 781499 - RNA, 15 nt, Human
uuauacagugucuua

SEQ ID NO: 781500 - RNA, 21 nt, Human
aaugacacuagcuaauaucaa

SEQ ID NO: 781501 - RNA, 15 nt, Human
uauaauauacuauau

SEQ ID NO: 781502 - RNA, 19 nt, Human
auucccagccagcacagcc

SEQ ID NO: 781503 - RNA, 17 nt, Human
uuaaggcuucucuuaaa

SEQ ID NO: 781504 - RNA, 19 nt, Human
cauuuuacuacuuuaaaaa

SEQ ID NO: 781505 - RNA, 20 nt, Human
uccccaaaaagaaugggaug

SEQ ID NO: 781506 - RNA, 15 nt, Human
uaccuuuuuccuucc

SEQ ID NO: 781507 - RNA, 17 nt, Human
ccaaaaaucucaauauu

SEQ ID NO: 781508 - RNA, 15 nt, Human
auuuucaaaaucaaa

SEQ ID NO: 781509 - RNA, 12 nt, Human
aaugcagccccc

SEQ ID NO: 781510 - RNA, 14 nt, Human
ggcagcugccuccc

SEQ ID NO: 781511 - RNA, 18 nt, Human
ggggcgcgugcaggcagc

SEQ ID NO: 781512 - RNA, 18 nt, Human
uaaauugacacuuaaaaa

SEQ ID NO: 781513 - RNA, 14 nt, Human
gaaggcuuacaccc

SEQ ID NO: 781514 - RNA, 22 nt, Human
aaauauauuuaagauaauuaua

SEQ ID NO: 781515 - RNA, 22 nt, Human
ugucucuacuaaaaauacaaaa

SEQ ID NO: 781516 - RNA, 19 nt, Human
uugugccccugcacuccag

SEQ ID NO: 781517 - RNA, 15 nt, Human
auauuuuuuguuaaa

SEQ ID NO: 781518 - RNA, 15 nt, Human
ucaauuccucuggga

SEQ ID NO: 781519 - RNA, 16 nt, Human
aucaaauaaguauuua

SEQ ID NO: 781520 - RNA, 13 nt, Human
auaacuggaaacu

SEQ ID NO: 781521 - RNA, 19 nt, Human
auuuugugaagcaaaauuu

SEQ ID NO: 781522 - RNA, 13 nt, Human
ggucucccucugu

SEQ ID NO: 781523 - RNA, 16 nt, Human
cauuuugguaaaauac

SEQ ID NO: 781524 - RNA, 14 nt, Human
auacaguaauuuua

SEQ ID NO: 781525 - RNA, 21 nt, Human
aaaauuuuuucucuaggaaau

SEQ ID NO: 781526 - RNA, 14 nt, Human
ucuauuaggaaaua

SEQ ID NO: 781527 - RNA, 23 nt, Human
agaaugagaagaaugacuaugca

SEQ ID NO: 781528 - RNA, 23 nt, Human
gcuuuuuuuuuuuuucuuaaaga

SEQ ID NO: 781529 - RNA, 22 nt, Human
aaccaugagaccacuguuauca

SEQ ID NO: 781530 - RNA, 22 nt, Human
gaaaauguguauuuuauuacau

SEQ ID NO: 781531 - RNA, 21 nt, Human
acucugucucaaaaaauaaaa

SEQ ID NO: 781532 - RNA, 20 nt, Human
cuuugacaaccaugagacca

SEQ ID NO: 781533 - RNA, 15 nt, Human
ccuugccaugugcua

SEQ ID NO: 781534 - RNA, 23 nt, Human
aguaauuggaaaggcagcucuaa

SEQ ID NO: 781535 - RNA, 20 nt, Human
agaggagaaacuggaacucu

SEQ ID NO: 781536 - RNA, 15 nt, Human
ucucugccuugguau

SEQ ID NO: 781537 - RNA, 15 nt, Human
agacaccaccacccu

SEQ ID NO: 781538 - RNA, 19 nt, Human
augaauuacauuuguauaa

SEQ ID NO: 781539 - RNA, 14 nt, Human
gacuggccugcugg

SEQ ID NO: 781540 - RNA, 13 nt, Human
agcucugcccauc

SEQ ID NO: 781541 - RNA, 14 nt, Human
ugcucauggaauug

SEQ ID NO: 781542 - RNA, 21 nt, Human
agagacuuugugaaaaaaaau

SEQ ID NO: 781543 - RNA, 21 nt, Human
cucaaaacuucagacauagaa

SEQ ID NO: 781544 - RNA, 14 nt, Human
uccaccucccugca

SEQ ID NO: 781545 - RNA, 21 nt, Human
uacauaagggaggaaaaaaaa

SEQ ID NO: 781546 - RNA, 21 nt, Human
uguaaaauggugugaccacug

SEQ ID NO: 781547 - RNA, 16 nt, Human
caaccuaaauuugguu

SEQ ID NO: 781548 - RNA, 16 nt, Human
augcuaagugaaauaa

SEQ ID NO: 781549 - RNA, 13 nt, Human
gcauacaguaauu

SEQ ID NO: 781550 - RNA, 20 nt, Human
agcugcccucuccugggcag

SEQ ID NO: 781551 - RNA, 14 nt, Human
ugagcaaaaguuga

SEQ ID NO: 781552 - RNA, 22 nt, Human
uuugagacagggaaagggucuc

SEQ ID NO: 781553 - RNA, 18 nt, Human
uaaaaugagcaaaaguug

SEQ ID NO: 781554 - RNA, 17 nt, Human
caagaaugagaagaaug

SEQ ID NO: 781555 - RNA, 15 nt, Human
aaugaauggcuaagc

SEQ ID NO: 781556 - RNA, 22 nt, Human
acucauuuccuauguaacugca

SEQ ID NO: 781557 - RNA, 19 nt, Human
cuauuuauuuauuuauuug

SEQ ID NO: 781558 - RNA, 18 nt, Human
ugaucagaccauaauguu

SEQ ID NO: 781559 - RNA, 20 nt, Human
aaauuaaggcauaagaaaac

SEQ ID NO: 781560 - RNA, 19 nt, Human
uucuagggaaaugaaagaa

SEQ ID NO: 781561 - RNA, 19 nt, Human
caccaacuuugaagucuga

SEQ ID NO: 781562 - RNA, 19 nt, Human
agagacgggguuugccaug

SEQ ID NO: 781563 - RNA, 21 nt, Human
cuguuccuucacauccugugu

SEQ ID NO: 781564 - RNA, 23 nt, Human
aagugauccgcccaucuccgucu

SEQ ID NO: 781565 - RNA, 22 nt, Human
caaucaaauaaguauuuauaau

SEQ ID NO: 781566 - RNA, 17 nt, Human
gacaaaugcuuaugaaa

SEQ ID NO: 781567 - RNA, 15 nt, Human
agucaccucauggaa

SEQ ID NO: 781568 - RNA, 11 nt, Human
uucccugccug

SEQ ID NO: 781569 - RNA, 12 nt, Human
acuuguugagau

SEQ ID NO: 781570 - RNA, 15 nt, Human
cuaagcaaaauguga

SEQ ID NO: 781571 - RNA, 15 nt, Human
uuaccuuuuuccuuc

SEQ ID NO: 781572 - RNA, 15 nt, Human
aacauagguuuuuag

SEQ ID NO: 781573 - RNA, 21 nt, Human
ugcaauaaaauggguuuuacu

SEQ ID NO: 781574 - RNA, 16 nt, Human
uuuucaaaauuggacu

SEQ ID NO: 781575 - RNA, 13 nt, Human
aguuuuccuucuc

SEQ ID NO: 781576 - RNA, 13 nt, Human
guccucuuucaaa

SEQ ID NO: 781577 - RNA, 17 nt, Human
uagagugggacaguucc

SEQ ID NO: 781578 - RNA, 17 nt, Human
ucuccugggcagcugcc

SEQ ID NO: 781579 - RNA, 16 nt, Human
ugcacaucaaaauaug

SEQ ID NO: 781580 - RNA, 16 nt, Human
ucuuacugaagguaaa

SEQ ID NO: 781581 - RNA, 21 nt, Human
ucaaauuccagaaugauuuua

SEQ ID NO: 781582 - RNA, 19 nt, Human
uccagaaagugacaagcuc

SEQ ID NO: 781583 - RNA, 14 nt, Human
cugucucaguccau

SEQ ID NO: 781584 - RNA, 13 nt, Human
ccagcacagccuc

SEQ ID NO: 781585 - RNA, 18 nt, Human
uuuuaaaaaagaaacauu

SEQ ID NO: 781586 - RNA, 14 nt, Human
cauuuccaaauuca

SEQ ID NO: 781587 - RNA, 15 nt, Human
ugcaauuccacuuau

SEQ ID NO: 781588 - RNA, 14 nt, Human
uuucaauauuuauu

SEQ ID NO: 781589 - RNA, 20 nt, Human
cugaagggcaucaugcaucu

SEQ ID NO: 781590 - RNA, 13 nt, Human
gaaugagaagaau

SEQ ID NO: 781591 - RNA, 15 nt, Human
aaccugggggcuuua

SEQ ID NO: 781592 - RNA, 17 nt, Human
agauccccguguuacug

SEQ ID NO: 781593 - RNA, 19 nt, Human
auugaggacacugauaugg

SEQ ID NO: 781594 - RNA, 20 nt, Human
ucuuaacucauugcaaccuc

SEQ ID NO: 781595 - RNA, 17 nt, Human
acucuacccauauuaca

SEQ ID NO: 781596 - RNA, 19 nt, Human
gucaaauugugugaaaggu

SEQ ID NO: 781597 - RNA, 16 nt, Human
uaagauaaauuauaag

SEQ ID NO: 781598 - RNA, 19 nt, Human
gugcaauaaaauguauuug

SEQ ID NO: 781599 - RNA, 18 nt, Human
cuuuucccaacuccagaa

SEQ ID NO: 781600 - RNA, 17 nt, Human
auucacaaccacucauu

SEQ ID NO: 781601 - RNA, 22 nt, Human
uugaauaauacaccagagauaa

SEQ ID NO: 781602 - RNA, 15 nt, Human
guugcagugagcuga

SEQ ID NO: 781603 - RNA, 21 nt, Human
auauacuccuaguaauuuaag

SEQ ID NO: 781604 - RNA, 24 nt, Human
guccucaucuguaaaauggagaca

SEQ ID NO: 781605 - RNA, 18 nt, Human
ccucccuccaccucccug

SEQ ID NO: 781606 - RNA, 20 nt, Human
auaaauggcuuccuggcaau

SEQ ID NO: 781607 - RNA, 21 nt, Human
gcacuguggguagacacacau

SEQ ID NO: 781608 - RNA, 15 nt, Human
ucuuguuuuuccacu

SEQ ID NO: 781609 - RNA, 16 nt, Human
uauuuuacuuuuccau

SEQ ID NO: 781610 - RNA, 12 nt, Human
cauauaauguug

SEQ ID NO: 781611 - RNA, 20 nt, Human
aauaucuuuuuuuuaauaaa

SEQ ID NO: 781612 - RNA, 18 nt, Human
ugcuacucuguuccuuca

SEQ ID NO: 781613 - RNA, 17 nt, Human
cuuguuauuuauaacaa

SEQ ID NO: 781614 - RNA, 14 nt, Human
aagggucucccucu

SEQ ID NO: 781615 - RNA, 16 nt, Human
ucaccugggcugaggc

SEQ ID NO: 781616 - RNA, 15 nt, Human
ccagauccuggaaau

SEQ ID NO: 781617 - RNA, 17 nt, Human
uaaaaaaaaaaaaaaag

SEQ ID NO: 781618 - RNA, 17 nt, Human
ucccaaagugcugggaa

SEQ ID NO: 781619 - RNA, 16 nt, Human
ucuuggucucaguguc

SEQ ID NO: 781620 - RNA, 20 nt, Human
acaccaccacccuugccaug

SEQ ID NO: 781621 - RNA, 16 nt, Human
guuggaaaaugugcaa

SEQ ID NO: 781622 - RNA, 11 nt, Human
uauuauuuaua

SEQ ID NO: 781623 - RNA, 18 nt, Human
cugcagacaugagagaca

SEQ ID NO: 781624 - RNA, 21 nt, Human
uuaacuagaauuuauucaauu

SEQ ID NO: 781625 - RNA, 21 nt, Human
auuccuuuuucucuccucucc

SEQ ID NO: 781626 - RNA, 15 nt, Human
uccgucucccaaagu

SEQ ID NO: 781627 - RNA, 19 nt, Human
uuccucccuucucuucaca

SEQ ID NO: 781628 - RNA, 15 nt, Human
acaauuauaagcugu

SEQ ID NO: 781629 - RNA, 22 nt, Human
cagaagcuuccauuccaagccu

SEQ ID NO: 781630 - RNA, 19 nt, Human
aucuauuuauuaauauuua

SEQ ID NO: 781631 - RNA, 18 nt, Human
gaauucuuacauguuuuc

SEQ ID NO: 781632 - RNA, 17 nt, Human
uauaagcuguuuuuaua

SEQ ID NO: 781633 - RNA, 14 nt, Human
uguaaguuuaugca

SEQ ID NO: 781634 - RNA, 19 nt, Human
acuagacaaguccagccug

SEQ ID NO: 781635 - RNA, 14 nt, Human
guugccaaggcugg

SEQ ID NO: 781636 - RNA, 13 nt, Human
accuagaauaaua

SEQ ID NO: 781637 - RNA, 14 nt, Human
aaaacuucagacau

SEQ ID NO: 781638 - RNA, 14 nt, Human
auuuaugaguuuuu

SEQ ID NO: 781639 - RNA, 13 nt, Human
accucaguuuuau

SEQ ID NO: 781640 - RNA, 17 nt, Human
acauguucacuuauuga

SEQ ID NO: 781641 - RNA, 13 nt, Human
cucagaaaacaag

SEQ ID NO: 781642 - RNA, 22 nt, Human
cuccugggcagcugccuccccu

SEQ ID NO: 781643 - RNA, 17 nt, Human
ucagaccauaauguuac

SEQ ID NO: 781644 - RNA, 11 nt, Human
aaauauauuua

SEQ ID NO: 781645 - RNA, 17 nt, Human
gagauaucccaggaaaa

SEQ ID NO: 781646 - RNA, 12 nt, Human
aguuuuccuucu

SEQ ID NO: 781647 - RNA, 13 nt, Human
cauuuucacuuuu

SEQ ID NO: 781648 - RNA, 20 nt, Human
augccugcaaucugagccag

SEQ ID NO: 781649 - RNA, 21 nt, Human
accugacagcccaaggguggg

SEQ ID NO: 781650 - RNA, 15 nt, Human
auugugaucagacca

SEQ ID NO: 781651 - RNA, 17 nt, Human
agaaaugaaagcaggga

SEQ ID NO: 781652 - RNA, 19 nt, Human
auaaugaaauaacuaggcg

SEQ ID NO: 781653 - RNA, 23 nt, Human
aaauuaaggcuucucuuaaacac

SEQ ID NO: 781654 - RNA, 13 nt, Human
gaucauguauuua

SEQ ID NO: 781655 - RNA, 17 nt, Human
uuuuuccagacacuuuu

SEQ ID NO: 781656 - RNA, 22 nt, Human
gaauaguguuggaaaaugugca

SEQ ID NO: 781657 - RNA, 17 nt, Human
cuaucagcauuuuacua

SEQ ID NO: 781658 - RNA, 16 nt, Human
uucacauccuguguuu

SEQ ID NO: 781659 - RNA, 18 nt, Human
cauaguaccaaucauuuu

SEQ ID NO: 781660 - RNA, 22 nt, Human
gaugguucccuugaugaagaag

SEQ ID NO: 781661 - RNA, 21 nt, Human
uucacaaccacucauucaaaa

SEQ ID NO: 781662 - RNA, 21 nt, Human
gaacuuuccacauucagagcu

SEQ ID NO: 781663 - RNA, 22 nt, Human
uaugcauacaguaauuuuaagu

SEQ ID NO: 781664 - RNA, 15 nt, Human
cagaucauuucaaaa

SEQ ID NO: 781665 - RNA, 15 nt, Human
auuaaauauaauaug

SEQ ID NO: 781666 - RNA, 19 nt, Human
uacauucugcuuucaucuu

SEQ ID NO: 781667 - RNA, 15 nt, Human
aauguuacauuauua

SEQ ID NO: 781668 - RNA, 15 nt, Human
gucaaugcagccccc

SEQ ID NO: 781669 - RNA, 20 nt, Human
accucauggaauuggagcuc

SEQ ID NO: 781670 - RNA, 19 nt, Human
cucuccugggcagcugccu

SEQ ID NO: 781671 - RNA, 17 nt, Human
aauaaguauuuauaaua

SEQ ID NO: 781672 - RNA, 18 nt, Human
cuuugaagucugauuuuc

SEQ ID NO: 781673 - RNA, 14 nt, Human
acucagaaauuuaa

SEQ ID NO: 781674 - RNA, 22 nt, Human
ucaguugauuuuacaauugaaa

SEQ ID NO: 781675 - RNA, 16 nt, Human
uucucuaggaaauauu

SEQ ID NO: 781676 - RNA, 16 nt, Human
gaguggguuucacaag

SEQ ID NO: 781677 - RNA, 21 nt, Human
guaaucauauaauaaauguac

SEQ ID NO: 781678 - RNA, 18 nt, Human
gauagguuaccaguaacg

SEQ ID NO: 781679 - RNA, 12 nt, Human
uacccucugggu

SEQ ID NO: 781680 - RNA, 15 nt, Human
ugugggcuuuuauug

SEQ ID NO: 781681 - RNA, 16 nt, Human
aaucauuuuaauuauu

SEQ ID NO: 781682 - RNA, 17 nt, Human
uuuucaccuguuuuuaa

SEQ ID NO: 781683 - RNA, 13 nt, Human
gcaggcagcagga

SEQ ID NO: 781684 - RNA, 17 nt, Human
aguauuucuaugaaaua

SEQ ID NO: 781685 - RNA, 14 nt, Human
guacuccagccugg

SEQ ID NO: 781686 - RNA, 18 nt, Human
uucauagcagauuuuaau

SEQ ID NO: 781687 - RNA, 14 nt, Human
cccucuccugggca

SEQ ID NO: 781688 - RNA, 19 nt, Human
aaccaaauuuguauuuaag

SEQ ID NO: 781689 - RNA, 22 nt, Human
acuucacuuuuuuucuuuucuc

SEQ ID NO: 781690 - RNA, 17 nt, Human
aauauugcaaggcaaag

SEQ ID NO: 781691 - RNA, 23 nt, Human
auacuucauuuaaaauauuuuua

SEQ ID NO: 781692 - RNA, 15 nt, Human
uuuaaguaauuucag

SEQ ID NO: 781693 - RNA, 20 nt, Human
ccuccugccuaagugcagcc

SEQ ID NO: 781694 - RNA, 23 nt, Human
auucuuacauguuuucuuugcuu

SEQ ID NO: 781695 - RNA, 16 nt, Human
acugauggguuucucc

SEQ ID NO: 781696 - RNA, 21 nt, Human
auuuuuaugugcaauaaaaug

SEQ ID NO: 781697 - RNA, 19 nt, Human
acuuaaaaucuaauucaaa

SEQ ID NO: 781698 - RNA, 12 nt, Human
auuuauauaugu

SEQ ID NO: 781699 - RNA, 16 nt, Human
auaauguuacauuauu

SEQ ID NO: 781700 - RNA, 22 nt, Human
aagacccaaaaggcagaagcaa

SEQ ID NO: 781701 - RNA, 14 nt, Human
auuuauuuuaauaa

SEQ ID NO: 781702 - RNA, 19 nt, Human
auauugcaaggcaaagacu

SEQ ID NO: 781703 - RNA, 21 nt, Human
augugaaauaaaaguagaaua

SEQ ID NO: 781704 - RNA, 17 nt, Human
uugugaaaaaaaauuuu

SEQ ID NO: 781705 - RNA, 15 nt, Human
cgacaguuuuccuuc

SEQ ID NO: 781706 - RNA, 22 nt, Human
gugauuacccucugggucucag

SEQ ID NO: 781707 - RNA, 18 nt, Human
ucaaggguacacugccuu

SEQ ID NO: 781708 - RNA, 14 nt, Human
uuuucaauauuuau

SEQ ID NO: 781709 - RNA, 20 nt, Human
aaucuauuuauuaauauuua

SEQ ID NO: 781710 - RNA, 15 nt, Human
cugaaagaggaauga

SEQ ID NO: 781711 - RNA, 13 nt, Human
uagauaaacucag

SEQ ID NO: 781712 - RNA, 18 nt, Human
acagcuucucauccugca

SEQ ID NO: 781713 - RNA, 15 nt, Human
cagccagcacagccu

SEQ ID NO: 781714 - RNA, 20 nt, Human
ucagagcugcccucuccugg

SEQ ID NO: 781715 - RNA, 14 nt, Human
guuacauuauuauc

SEQ ID NO: 781716 - RNA, 14 nt, Human
cuuguauuuuacuu

SEQ ID NO: 781717 - RNA, 21 nt, Human
acguaggaacgguaaauuucu

SEQ ID NO: 781718 - RNA, 21 nt, Human
ccaaucauuuuaauuauuauu

SEQ ID NO: 781719 - RNA, 14 nt, Human
ucuaucuauuuauu

SEQ ID NO: 781720 - RNA, 21 nt, Human
cucugucucaaaaaauaaaaa

SEQ ID NO: 781721 - RNA, 14 nt, Human
uuaauuucaugaaa

SEQ ID NO: 781722 - RNA, 13 nt, Human
agaaaugaaagca

SEQ ID NO: 781723 - RNA, 20 nt, Human
gcugcccucuccugggcagc

SEQ ID NO: 781724 - RNA, 17 nt, Human
cgugacuggccugcugg

SEQ ID NO: 781725 - RNA, 14 nt, Human
uccaaacagaacua

SEQ ID NO: 781726 - RNA, 22 nt, Human
auuacaguuagagauuuuuaaa

SEQ ID NO: 781727 - RNA, 21 nt, Human
gcuggaauugaauucccugcc

SEQ ID NO: 781728 - RNA, 19 nt, Human
gcacuuuaacacagugucu

SEQ ID NO: 781729 - RNA, 18 nt, Human
gccaucccucccuccacc

SEQ ID NO: 781730 - RNA, 16 nt, Human
cagcuuuccucaaaac

SEQ ID NO: 781731 - RNA, 22 nt, Human
ucucuuaaacacuaaaaaggca

SEQ ID NO: 781732 - RNA, 21 nt, Human
cucuccugggcagcugccucc

SEQ ID NO: 781733 - RNA, 19 nt, Human
uggagggggcgcgugcagg

SEQ ID NO: 781734 - RNA, 16 nt, Human
uucccaacuccagaaa

SEQ ID NO: 781735 - RNA, 18 nt, Human
caaggcuagaaccaccug

SEQ ID NO: 781736 - RNA, 13 nt, Human
uaugaaauauuau

SEQ ID NO: 781737 - RNA, 15 nt, Human
auccugccccugagc

SEQ ID NO: 781738 - RNA, 17 nt, Human
aaccuagggugauauua

SEQ ID NO: 781739 - RNA, 20 nt, Human
uuaugugcaauaaaauguau

SEQ ID NO: 781740 - RNA, 23 nt, Human
uguagauaaacucagaaauuuaa

SEQ ID NO: 781741 - RNA, 20 nt, Human
uugcaaccuccaccuucugg

SEQ ID NO: 781742 - RNA, 18 nt, Human
aagaagacaacauuaaaa

SEQ ID NO: 781743 - RNA, 15 nt, Human
uuccugagaccagcc

SEQ ID NO: 781744 - RNA, 23 nt, Human
uguaaucccagcacuuugggagg

SEQ ID NO: 781745 - RNA, 14 nt, Human
ugugcaauauguga

SEQ ID NO: 781746 - RNA, 20 nt, Human
aaauaauuuuuauauuugaa

SEQ ID NO: 781747 - RNA, 15 nt, Human
uggaguaaaucgcua

SEQ ID NO: 781748 - RNA, 14 nt, Human
aaugaacacuuaua

SEQ ID NO: 781749 - RNA, 20 nt, Human
aauaauuuuuauauuugaaa

SEQ ID NO: 781750 - RNA, 11 nt, Human
aagccaaaaac

SEQ ID NO: 781751 - RNA, 18 nt, Human
gccagcaguucagagcug

SEQ ID NO: 781752 - RNA, 22 nt, Human
ccucuaauuuaucuugucucug

SEQ ID NO: 781753 - RNA, 21 nt, Human
cuggagcuugaaauagugucu

SEQ ID NO: 781754 - RNA, 23 nt, Human
caccucauggaauuggagcucgu

SEQ ID NO: 781755 - RNA, 16 nt, Human
ccugagcgacagugag

SEQ ID NO: 781756 - RNA, 15 nt, Human
acuugugcaguguug

SEQ ID NO: 781757 - RNA, 22 nt, Human
accaaucaugaauuaguuuuau

SEQ ID NO: 781758 - RNA, 19 nt, Human
uguuacauuauuaucaaca

SEQ ID NO: 781759 - RNA, 19 nt, Human
cuagaguuuagcuggaaaa

SEQ ID NO: 781760 - RNA, 16 nt, Human
uaccuuuugcuguggc

SEQ ID NO: 781761 - RNA, 21 nt, Human
uagggugauauuaaccagggg

SEQ ID NO: 781762 - RNA, 20 nt, Human
auuaaggcauaagaaaacua

SEQ ID NO: 781763 - RNA, 13 nt, Human
cacacugaagaag

SEQ ID NO: 781764 - RNA, 12 nt, Human
gcugaugcaguu

SEQ ID NO: 781765 - RNA, 22 nt, Human
caguguccucaucuguaaaaug

SEQ ID NO: 781766 - RNA, 22 nt, Human
gcaaccuccaccuucuggguuc

SEQ ID NO: 781767 - RNA, 14 nt, Human
uucuagguucuaaa

SEQ ID NO: 781768 - RNA, 17 nt, Human
agaaacaucaguuacuc

SEQ ID NO: 781769 - RNA, 18 nt, Human
aaaugugcaauaugugau

SEQ ID NO: 781770 - RNA, 22 nt, Human
aaucugcacugugggcuuuuau

SEQ ID NO: 781771 - RNA, 14 nt, Human
uccaagccugacca

SEQ ID NO: 781772 - RNA, 17 nt, Human
auguacaugaagaagcu

SEQ ID NO: 781773 - RNA, 12 nt, Human
agacucugucuc

SEQ ID NO: 781774 - RNA, 14 nt, Human
uaaagaauuuuaaa

SEQ ID NO: 781775 - RNA, 11 nt, Human
uacgugcaaua

SEQ ID NO: 781776 - RNA, 20 nt, Human
gcagcugccuccccuccucu

SEQ ID NO: 781777 - RNA, 15 nt, Human
uaucaauuuaaaaaa

SEQ ID NO: 781778 - RNA, 15 nt, Human
uugaauccagaaaua

SEQ ID NO: 781779 - RNA, 16 nt, Human
ugaaguccaagcauuu

SEQ ID NO: 781780 - RNA, 20 nt, Human
ccaaucauuuuaauuauuau

SEQ ID NO: 781781 - RNA, 20 nt, Human
auauauguguuuuucacauu

SEQ ID NO: 781782 - RNA, 23 nt, Human
auauaacaaugcuguauuuuaaa

SEQ ID NO: 781783 - RNA, 12 nt, Human
ucagaaauuuaa

SEQ ID NO: 781784 - RNA, 16 nt, Human
gaaucacuugaacccg

SEQ ID NO: 781785 - RNA, 14 nt, Human
ccugggcugaggca

SEQ ID NO: 781786 - RNA, 15 nt, Human
cucgaacugcuggau

SEQ ID NO: 781787 - RNA, 22 nt, Human
auugacuauuauagaauggaac

SEQ ID NO: 781788 - RNA, 18 nt, Human
cauuuccuauguaacugc

SEQ ID NO: 781789 - RNA, 14 nt, Human
uuauaaguuacaua

SEQ ID NO: 781790 - RNA, 17 nt, Human
cccaaagugcugggaau

SEQ ID NO: 781791 - RNA, 16 nt, Human
uuuaagauuuuguuuu

SEQ ID NO: 781792 - RNA, 21 nt, Human
uaaguuuaugcauacaguaau

SEQ ID NO: 781793 - RNA, 16 nt, Human
uaggauguugaaaaag

SEQ ID NO: 781794 - RNA, 16 nt, Human
aaauuuucccaaaacu

SEQ ID NO: 781795 - RNA, 16 nt, Human
gauguggagggggcgc

SEQ ID NO: 781796 - RNA, 19 nt, Human
caauuauaucaguccucuu

SEQ ID NO: 781797 - RNA, 19 nt, Human
agaccuguaaucauauaau

SEQ ID NO: 781798 - RNA, 15 nt, Human
ucaguuacucugaag

SEQ ID NO: 781799 - RNA, 18 nt, Human
aauuuuuuucaauauuua

SEQ ID NO: 781800 - RNA, 20 nt, Human
uaagaaauaugcacaauagc

SEQ ID NO: 781801 - RNA, 14 nt, Human
cuuuauauuauuuu

SEQ ID NO: 781802 - RNA, 13 nt, Human
acccuugccaugg

SEQ ID NO: 781803 - RNA, 13 nt, Human
gauuguaaaaugg

SEQ ID NO: 781804 - RNA, 18 nt, Human
uaucaaaagaaagaaaau

SEQ ID NO: 781805 - RNA, 17 nt, Human
auguauuuauaaauaua

SEQ ID NO: 781806 - RNA, 15 nt, Human
uaauuauuauuuaua

SEQ ID NO: 781807 - RNA, 15 nt, Human
uguauuuuaaaagaa

SEQ ID NO: 781808 - RNA, 16 nt, Human
cauccuuccucacacc

SEQ ID NO: 781809 - RNA, 17 nt, Human
cuacaagcuaaaauuag

SEQ ID NO: 781810 - RNA, 14 nt, Human
uagggaccugcugu

SEQ ID NO: 781811 - RNA, 15 nt, Human
uaggaaauauuuauu

SEQ ID NO: 781812 - RNA, 16 nt, Human
ugguacuagauacuga

SEQ ID NO: 781813 - RNA, 22 nt, Human
cagcaggauagagugggacagu

SEQ ID NO: 781814 - RNA, 22 nt, Human
acuucauuuaaaauauuuuuau

SEQ ID NO: 781815 - RNA, 18 nt, Human
caagugauccgcccaucu

SEQ ID NO: 781816 - RNA, 17 nt, Human
uuauaucaauuuaaaaa

SEQ ID NO: 781817 - RNA, 14 nt, Human
uugaauuuuaaauc

SEQ ID NO: 781818 - RNA, 23 nt, Human
gggucucccucuguugccaaggc

SEQ ID NO: 781819 - RNA, 13 nt, Human
cagucugaugaga

SEQ ID NO: 781820 - RNA, 17 nt, Human
gccuccccuccucugcu

SEQ ID NO: 781821 - RNA, 18 nt, Human
ugaauaucuauuaauaua

SEQ ID NO: 781822 - RNA, 15 nt, Human
ugacuggccugcugg

SEQ ID NO: 781823 - RNA, 23 nt, Human
caacggggugaaacccugucucu

SEQ ID NO: 781824 - RNA, 23 nt, Human
ccagcuacuugggaggcugaggc

SEQ ID NO: 781825 - RNA, 12 nt, Human
acaguuuuccuu

SEQ ID NO: 781826 - RNA, 18 nt, Human
guauuuguuuguauuuug

SEQ ID NO: 781827 - RNA, 16 nt, Human
gauagcuuuauuuuuu

SEQ ID NO: 781828 - RNA, 19 nt, Human
cuaauuuguguauuuucag

SEQ ID NO: 781829 - RNA, 16 nt, Human
ccuacaugagguacug

SEQ ID NO: 781830 - RNA, 14 nt, Human
aaagagaacuucca

SEQ ID NO: 781831 - RNA, 21 nt, Human
uacaugagguacugagaguga

SEQ ID NO: 781832 - RNA, 15 nt, Human
gaaauucugcaagcu

SEQ ID NO: 781833 - RNA, 20 nt, Human
uuccacagaagcuccaggua

SEQ ID NO: 781834 - RNA, 16 nt, Human
aacucaucauaaaaua

SEQ ID NO: 781835 - RNA, 12 nt, Human
auuuauuaauau

SEQ ID NO: 781836 - RNA, 17 nt, Human
auuuuacaauugaaaug

SEQ ID NO: 781837 - RNA, 17 nt, Human
ugaaauaagccagacau

SEQ ID NO: 781838 - RNA, 21 nt, Human
caagacucugucucaaaaaau

SEQ ID NO: 781839 - RNA, 15 nt, Human
ugccucuaaaaggcc

SEQ ID NO: 781840 - RNA, 17 nt, Human
aauuugguucuaggccg

SEQ ID NO: 781841 - RNA, 22 nt, Human
aaguuguagguaauauugcaag

SEQ ID NO: 781842 - RNA, 16 nt, Human
aaacaaacgaaaaaca

SEQ ID NO: 781843 - RNA, 17 nt, Human
agcauuuauaaauggac

SEQ ID NO: 781844 - RNA, 13 nt, Human
ccaaaagguauuu

SEQ ID NO: 781845 - RNA, 16 nt, Human
uuacaucuuucacauu

SEQ ID NO: 781846 - RNA, 14 nt, Human
aaaaggaagaaauu

SEQ ID NO: 781847 - RNA, 12 nt, Human
gcgcagccaugu

SEQ ID NO: 781848 - RNA, 17 nt, Human
aaugacuaaaaaacaaa

SEQ ID NO: 781849 - RNA, 21 nt, Human
uguacauuuccaaauucacaa

SEQ ID NO: 781850 - RNA, 15 nt, Human
cuaauauauaugaau

SEQ ID NO: 781851 - RNA, 15 nt, Human
agacagcucugcaua

SEQ ID NO: 781852 - RNA, 16 nt, Human
ugaauccagaaauaau

SEQ ID NO: 781853 - RNA, 17 nt, Human
cuccugggcagcugccu

SEQ ID NO: 781854 - RNA, 14 nt, Human
auauuuauuauuuu

SEQ ID NO: 781855 - RNA, 12 nt, Human
cuggcugggagu

SEQ ID NO: 781856 - RNA, 18 nt, Human
agcaacaucuagcaaaug

SEQ ID NO: 781857 - RNA, 22 nt, Human
cagagcugcccucuccugggca

SEQ ID NO: 781858 - RNA, 21 nt, Human
auuuuuucucuaggaaauauu

SEQ ID NO: 781859 - RNA, 18 nt, Human
caacaguuuuuuaugcua

SEQ ID NO: 781860 - RNA, 17 nt, Human
uauagcauauguuuuug

SEQ ID NO: 781861 - RNA, 22 nt, Human
gaaaaugaauaucuauuaauau

SEQ ID NO: 781862 - RNA, 17 nt, Human
ccaccucccugcaauaa

SEQ ID NO: 781863 - RNA, 16 nt, Human
gcaucuuacugaaggu

SEQ ID NO: 781864 - RNA, 14 nt, Human
caaacgaaaaacau

SEQ ID NO: 781865 - RNA, 19 nt, Human
gggaccugcuguuuccuag

SEQ ID NO: 781866 - RNA, 19 nt, Human
aauguuacauuauuaucaa

SEQ ID NO: 781867 - RNA, 15 nt, Human
uaaaaucuaauucaa

SEQ ID NO: 781868 - RNA, 22 nt, Human
auuacuguaagaaaauaucacu

SEQ ID NO: 781869 - RNA, 18 nt, Human
acucuuaagaagacugca

SEQ ID NO: 781870 - RNA, 13 nt, Human
acauuaaaacaau

SEQ ID NO: 781871 - RNA, 20 nt, Human
cagcuuguuauuuauaacaa

SEQ ID NO: 781872 - RNA, 14 nt, Human
ccagacacuuuuuu

SEQ ID NO: 781873 - RNA, 14 nt, Human
cuauggaaaaaaag

SEQ ID NO: 781874 - RNA, 19 nt, Human
caguuagagauuuuuaaau

SEQ ID NO: 781875 - RNA, 15 nt, Human
uaagauaauuauaau

SEQ ID NO: 781876 - RNA, 16 nt, Human
auccuugaagauuuac

SEQ ID NO: 781877 - RNA, 16 nt, Human
aaauauuuauuuuaau

SEQ ID NO: 781878 - RNA, 15 nt, Human
uuuaagauaauuaua

SEQ ID NO: 781879 - RNA, 14 nt, Human
uauuauuuauauau

SEQ ID NO: 781880 - RNA, 22 nt, Human
gucucuacuaaaaauacaaaaa

SEQ ID NO: 781881 - RNA, 19 nt, Human
uauuuauugcugaaugacu

SEQ ID NO: 781882 - RNA, 22 nt, Human
uguuugccuucuacuuuuaagu

SEQ ID NO: 781883 - RNA, 12 nt, Human
accaaucauuuu

SEQ ID NO: 781884 - RNA, 16 nt, Human
gaacucaaggaaaucu

SEQ ID NO: 781885 - RNA, 19 nt, Human
ccgggcgugguggugagug

SEQ ID NO: 781886 - RNA, 17 nt, Human
uuagcuuuacuguuugu

SEQ ID NO: 781887 - RNA, 16 nt, Human
ugugcuggcuuaaaau

SEQ ID NO: 781888 - RNA, 21 nt, Human
aggacagcccuucuuuccaca

SEQ ID NO: 781889 - RNA, 22 nt, Human
cuccgucucccaaagugcuggg

SEQ ID NO: 781890 - RNA, 20 nt, Human
uuaaugccacuaaauugaca

SEQ ID NO: 781891 - RNA, 12 nt, Human
aucaacaauagu

SEQ ID NO: 781892 - RNA, 18 nt, Human
uguauuuuuaccuuuuuc

SEQ ID NO: 781893 - RNA, 23 nt, Human
ccuaaccucauuccccaaccacu

SEQ ID NO: 781894 - RNA, 20 nt, Human
gcccaucuccgucucccaaa

SEQ ID NO: 781895 - RNA, 22 nt, Human
gggcagugcuuggcccaggagu

SEQ ID NO: 781896 - RNA, 13 nt, Human
aucaggcuggcca

SEQ ID NO: 781897 - RNA, 14 nt, Human
ucuugucucugggc

SEQ ID NO: 781898 - RNA, 20 nt, Human
ccaaauguucaucaaugaau

SEQ ID NO: 781899 - RNA, 16 nt, Human
cacuaguauuucuaug

SEQ ID NO: 781900 - RNA, 17 nt, Human
caguccucuuucaaagg

SEQ ID NO: 781901 - RNA, 16 nt, Human
cuuuaaguguaacugg

SEQ ID NO: 781902 - RNA, 13 nt, Human
auguggcuguauc

SEQ ID NO: 781903 - RNA, 16 nt, Human
guacccaaauggaaag

SEQ ID NO: 781904 - RNA, 20 nt, Human
ucuugggaauuuucuuccaa

SEQ ID NO: 781905 - RNA, 16 nt, Human
ugacuauuauagaaug

SEQ ID NO: 781906 - RNA, 18 nt, Human
ucuucagaccuagaauaa

SEQ ID NO: 781907 - RNA, 15 nt, Human
uugacacuuaaaaau

SEQ ID NO: 781908 - RNA, 14 nt, Human
agaccagccaaccu

SEQ ID NO: 781909 - RNA, 21 nt, Human
accaccugccuauauuuuuug

SEQ ID NO: 781910 - RNA, 14 nt, Human
gcugauuaaaccaa

SEQ ID NO: 781911 - RNA, 16 nt, Human
uuaauauauguauuau

SEQ ID NO: 781912 - RNA, 23 nt, Human
uuuuaaacaaaaaaagcauugua

SEQ ID NO: 781913 - RNA, 21 nt, Human
ugggucucaguguccucaucu

SEQ ID NO: 781914 - RNA, 18 nt, Human
cugccuccccuccucugc

SEQ ID NO: 781915 - RNA, 18 nt, Human
acggagauaucccaggaa

SEQ ID NO: 781916 - RNA, 15 nt, Human
ugaaacccugucucu

SEQ ID NO: 781917 - RNA, 14 nt, Human
cuacuuuaaaaaaa

SEQ ID NO: 781918 - RNA, 13 nt, Human
uacauguuuucuu

SEQ ID NO: 781919 - RNA, 16 nt, Human
aagauuuguaauauuu

SEQ ID NO: 781920 - RNA, 18 nt, Human
auagcaagugaauuuuuc

SEQ ID NO: 781921 - RNA, 18 nt, Human
cagaaagcagaacaguga

SEQ ID NO: 781922 - RNA, 16 nt, Human
agguugcagugagccg

SEQ ID NO: 781923 - RNA, 15 nt, Human
uaauguuacauuauu

SEQ ID NO: 781924 - RNA, 20 nt, Human
auagagacuuugugaaaaaa

SEQ ID NO: 781925 - RNA, 14 nt, Human
gagccaccaaaccc

SEQ ID NO: 781926 - RNA, 17 nt, Human
ggaaauauuuauuuuaa

SEQ ID NO: 781927 - RNA, 23 nt, Human
ccagcaguucagagcugcccucu

SEQ ID NO: 781928 - RNA, 17 nt, Human
cuggcaaggguucaccu

SEQ ID NO: 781929 - RNA, 16 nt, Human
agcauauguuuuugua

SEQ ID NO: 781930 - RNA, 19 nt, Human
acaauagcagacaguguuu

SEQ ID NO: 781931 - RNA, 19 nt, Human
cuguauuuuuaccuuuuuc

SEQ ID NO: 781932 - RNA, 15 nt, Human
gauagguuaccagua

SEQ ID NO: 781933 - RNA, 14 nt, Human
uuuuaaaaaagaaa

SEQ ID NO: 781934 - RNA, 18 nt, Human
uuuccuauguaacugcau

SEQ ID NO: 781935 - RNA, 13 nt, Human
uauuuauuaauau

SEQ ID NO: 781936 - RNA, 13 nt, Human
uuuauauuauuuu

SEQ ID NO: 781937 - RNA, 23 nt, Human
aguguacaugaaagcguaaagag

SEQ ID NO: 781938 - RNA, 13 nt, Human
gcuguugagcugu

SEQ ID NO: 781939 - RNA, 22 nt, Human
gaaaggagaaguuaagcaacau

SEQ ID NO: 781940 - RNA, 21 nt, Human
ugccuaucagcauuuuacuac

SEQ ID NO: 781941 - RNA, 23 nt, Human
aucacagcuacuugggaggcuga

SEQ ID NO: 781942 - RNA, 19 nt, Human
aguaauuucagaagaaauu

SEQ ID NO: 781943 - RNA, 15 nt, Human
ucuuuugccauuaaa

SEQ ID NO: 781944 - RNA, 22 nt, Human
uuggucuugauaagcuauguug

SEQ ID NO: 781945 - RNA, 23 nt, Human
aucccucccuccaccucccugca

SEQ ID NO: 781946 - RNA, 18 nt, Human
caugaagauguagaggag

SEQ ID NO: 781947 - RNA, 22 nt, Human
gcagagacgggguuugccaugc

SEQ ID NO: 781948 - RNA, 16 nt, Human
uugggcugagcaguca

SEQ ID NO: 781949 - RNA, 18 nt, Human
auuugcuggagcucugcc

SEQ ID NO: 781950 - RNA, 21 nt, Human
cucugcuugccaucccucccu

SEQ ID NO: 781951 - RNA, 23 nt, Human
auuacaucuuucacauuggcuau

SEQ ID NO: 781952 - RNA, 19 nt, Human
aacuauggaaaaaaaggaa

SEQ ID NO: 781953 - RNA, 15 nt, Human
cucuacuaaaaauac

SEQ ID NO: 781954 - RNA, 20 nt, Human
cuugccauaauuacuauguc

SEQ ID NO: 781955 - RNA, 13 nt, Human
cgggaggcagagg

SEQ ID NO: 781956 - RNA, 20 nt, Human
uuaauauuuaacauuauuua

SEQ ID NO: 781957 - RNA, 22 nt, Human
uccaaacuggagcuugaaauag

SEQ ID NO: 781958 - RNA, 15 nt, Human
gauuaaaguuaaaua

SEQ ID NO: 781959 - RNA, 11 nt, Human
agguauuuauu

SEQ ID NO: 781960 - RNA, 20 nt, Human
gauugugccccugcacucca

SEQ ID NO: 781961 - RNA, 22 nt, Human
aaggcaaagcacgaaauguuau

SEQ ID NO: 781962 - RNA, 17 nt, Human
uuuauuacaucuuucac

SEQ ID NO: 781963 - RNA, 22 nt, Human
gggacaguuccugagaccagcc

SEQ ID NO: 781964 - RNA, 16 nt, Human
cuguaaucccagcacu

SEQ ID NO: 781965 - RNA, 17 nt, Human
auaucaauuuaaaaaaa

SEQ ID NO: 781966 - RNA, 18 nt, Human
cuaauuuaucuugucucu

SEQ ID NO: 781967 - RNA, 14 nt, Human
uaugaauuacauuu

SEQ ID NO: 781968 - RNA, 19 nt, Human
uauuuuaauaauguuucaa

SEQ ID NO: 781969 - RNA, 14 nt, Human
aagcaacccaaaug

SEQ ID NO: 781970 - RNA, 16 nt, Human
cccucccuccaccucc

SEQ ID NO: 781971 - RNA, 18 nt, Human
ccauaauguuacauuauu

SEQ ID NO: 781972 - RNA, 13 nt, Human
cuuacagagaaaa

SEQ ID NO: 781973 - RNA, 21 nt, Human
ucccugcaauaaaauggguuu

SEQ ID NO: 781974 - RNA, 18 nt, Human
cagcuuauugucuaguga

SEQ ID NO: 781975 - RNA, 18 nt, Human
agcugccuccccuccucu

SEQ ID NO: 781976 - RNA, 18 nt, Human
cgggaguggcgcgcgcca

SEQ ID NO: 781977 - RNA, 21 nt, Human
ucacuuaauccuuuguuuucu

SEQ ID NO: 781978 - RNA, 12 nt, Human
aaugaaagaaag

SEQ ID NO: 781979 - RNA, 14 nt, Human
ggcgcgugcaggca

SEQ ID NO: 781980 - RNA, 23 nt, Human
aggcuuacacccacaguggaaag

SEQ ID NO: 781981 - RNA, 20 nt, Human
ugugcuggcuuaaaauguaa

SEQ ID NO: 781982 - RNA, 19 nt, Human
ugaaacauuacaguuagag

SEQ ID NO: 781983 - RNA, 16 nt, Human
ucuauuuauuaauauu

SEQ ID NO: 781984 - RNA, 22 nt, Human
agugucugaugaauguuaaauu

SEQ ID NO: 781985 - RNA, 21 nt, Human
guauuuuuaccuuuuuccuuc

SEQ ID NO: 781986 - RNA, 15 nt, Human
ccccaaaaagaaugg

SEQ ID NO: 781987 - RNA, 19 nt, Human
agucaaugaacuuuccaca

SEQ ID NO: 781988 - RNA, 13 nt, Human
cuugucucugggc

SEQ ID NO: 781989 - RNA, 13 nt, Human
uuuaagauaaauu

SEQ ID NO: 781990 - RNA, 17 nt, Human
uuauuacuguaagaaaa

SEQ ID NO: 781991 - RNA, 16 nt, Human
caacaguuuuuuaugc

SEQ ID NO: 781992 - RNA, 19 nt, Human
cuucuggguucaagcgauu

SEQ ID NO: 781993 - RNA, 21 nt, Human
acuaauagaauuaauggaaua

SEQ ID NO: 781994 - RNA, 14 nt, Human
ugguauguuuucag

SEQ ID NO: 781995 - RNA, 14 nt, Human
agaguacuggcuga

SEQ ID NO: 781996 - RNA, 18 nt, Human
uuuggcuuguaaaguaca

SEQ ID NO: 781997 - RNA, 13 nt, Human
ccacuucacuuuu

SEQ ID NO: 781998 - RNA, 23 nt, Human
ggaugguucccuugaugaagaag

SEQ ID NO: 781999 - RNA, 17 nt, Human
cauuuguauaaaauaau

SEQ ID NO: 782000 - RNA, 19 nt, Human
aaauuggacuuaaaaucua

SEQ ID NO: 782001 - RNA, 14 nt, Human
auuuauauauguau

SEQ ID NO: 782002 - RNA, 14 nt, Human
cacaagaaaugaaa

SEQ ID NO: 782003 - RNA, 15 nt, Human
auggaauauguaaau

SEQ ID NO: 782004 - RNA, 17 nt, Human
auuuuaauaauguuuca

SEQ ID NO: 782005 - RNA, 12 nt, Human
cuuagacccuca

SEQ ID NO: 782006 - RNA, 23 nt, Human
ucaauaucuaauauauaugaaua

SEQ ID NO: 782007 - RNA, 18 nt, Human
cagagacagaaagcagaa

SEQ ID NO: 782008 - RNA, 22 nt, Human
cugcacugugggcuuuuauugc

SEQ ID NO: 782009 - RNA, 22 nt, Human
cuccagagggaauugcagagua

SEQ ID NO: 782010 - RNA, 23 nt, Human
gggcagcugccuccccuccucug

SEQ ID NO: 782011 - RNA, 19 nt, Human
auugaaaggcauucucuga

SEQ ID NO: 782012 - RNA, 15 nt, Human
gauccugcaauucca

SEQ ID NO: 782013 - RNA, 15 nt, Human
gcuguauuuuaaaag

SEQ ID NO: 782014 - RNA, 15 nt, Human
aguauuuauauauuu

SEQ ID NO: 782015 - RNA, 19 nt, Human
cuuuuuuuuuuuuuuaaac

SEQ ID NO: 782016 - RNA, 21 nt, Human
uuuucaggcuagauguaugua

SEQ ID NO: 782017 - RNA, 14 nt, Human
auuaauauauguau

SEQ ID NO: 782018 - RNA, 14 nt, Human
uaauuucaugaaaa

SEQ ID NO: 782019 - RNA, 14 nt, Human
cucccucuaauuua

SEQ ID NO: 782020 - RNA, 12 nt, Human
uucuaaaugaau

SEQ ID NO: 782021 - RNA, 21 nt, Human
uugccaaggcuggagugcagu

SEQ ID NO: 782022 - RNA, 12 nt, Human
uacuaaaaauac

SEQ ID NO: 782023 - RNA, 19 nt, Human
uuucacaagugaaaaacau

SEQ ID NO: 782024 - RNA, 15 nt, Human
uggcgcgcaccugua

SEQ ID NO: 782025 - RNA, 17 nt, Human
gaaguugcagugagcug

SEQ ID NO: 782026 - RNA, 17 nt, Human
ugaaaugacuaaaaaac

SEQ ID NO: 782027 - RNA, 14 nt, Human
cuaagcauuccaac

SEQ ID NO: 782028 - RNA, 19 nt, Human
gaucucagaaauuguaucu

SEQ ID NO: 782029 - RNA, 17 nt, Human
ucauacuucuuaggguu

SEQ ID NO: 782030 - RNA, 21 nt, Human
augucauuugcuggagcucug

SEQ ID NO: 782031 - RNA, 16 nt, Human
uguauuauuuauaauu

SEQ ID NO: 782032 - RNA, 15 nt, Human
ucuugagaagagaau

SEQ ID NO: 782033 - RNA, 14 nt, Human
auuuguauaaaaua

SEQ ID NO: 782034 - RNA, 20 nt, Human
gacauaagcaaagacuauga

SEQ ID NO: 782035 - RNA, 14 nt, Human
ucaucauaaaauaa

SEQ ID NO: 782036 - RNA, 23 nt, Human
agagcaagacucugucucaaaaa

SEQ ID NO: 782037 - RNA, 16 nt, Human
acugacaacuugaaua

SEQ ID NO: 782038 - RNA, 19 nt, Human
aaaaagcauuguaacuuau

SEQ ID NO: 782039 - RNA, 19 nt, Human
cugucccagcgagggacac

SEQ ID NO: 782040 - RNA, 13 nt, Human
uagucuuauaaua

SEQ ID NO: 782041 - RNA, 19 nt, Human
ugccaucccucccuccacc

SEQ ID NO: 782042 - RNA, 15 nt, Human
uucauuuaaaauauu

SEQ ID NO: 782043 - RNA, 15 nt, Human
gccagugucaggagg

SEQ ID NO: 782044 - RNA, 18 nt, Human
uuuauauaugugaaauaa

SEQ ID NO: 782045 - RNA, 15 nt, Human
uguuuuaaaauuaaa

SEQ ID NO: 782046 - RNA, 12 nt, Human
uuauauacaauu

SEQ ID NO: 782047 - RNA, 12 nt, Human
aaguuucuggga

SEQ ID NO: 782048 - RNA, 14 nt, Human
aaauuuucccaaaa

SEQ ID NO: 782049 - RNA, 15 nt, Human
uuugguaaaauacuu

SEQ ID NO: 782050 - RNA, 12 nt, Human
guccucuuucaa

SEQ ID NO: 782051 - RNA, 21 nt, Human
ugugauuacccucugggucuc

SEQ ID NO: 782052 - RNA, 23 nt, Human
cucugcuugccaucccucccucc

SEQ ID NO: 782053 - RNA, 16 nt, Human
auuccaccuacaugag

SEQ ID NO: 782054 - RNA, 14 nt, Human
agaugcuuguauuu

SEQ ID NO: 782055 - RNA, 15 nt, Human
uuuuuaaacaaaaaa

SEQ ID NO: 782056 - RNA, 19 nt, Human
cuugccugcaggcaugagu

SEQ ID NO: 782057 - RNA, 15 nt, Human
ucaaucaaauaagua

SEQ ID NO: 782058 - RNA, 13 nt, Human
aacuggaaauaaa

SEQ ID NO: 782059 - RNA, 21 nt, Human
aaaagcauuguaacuuaugaa

SEQ ID NO: 782060 - RNA, 14 nt, Human
cucauccugcaggc

SEQ ID NO: 782061 - RNA, 19 nt, Human
aguaacucauuuguuaaaa

SEQ ID NO: 782062 - RNA, 16 nt, Human
uuagagauuuuuaaau

SEQ ID NO: 782063 - RNA, 16 nt, Human
cauuuuacuacuuuaa

SEQ ID NO: 782064 - RNA, 21 nt, Human
aucggagcugcuagaguucug

SEQ ID NO: 782065 - RNA, 18 nt, Human
agugcuuggcccaggagu

SEQ ID NO: 782066 - RNA, 13 nt, Human
cacaacuauauug

SEQ ID NO: 782067 - RNA, 14 nt, Human
gaauuuucuuccaa

SEQ ID NO: 782068 - RNA, 17 nt, Human
uaaauccuuuacuguua

SEQ ID NO: 782069 - RNA, 21 nt, Human
gugaaauaguucaaagccaag

SEQ ID NO: 782070 - RNA, 15 nt, Human
uaaguauuuauauau

SEQ ID NO: 782071 - RNA, 16 nt, Human
acuccuaguaauuuaa

SEQ ID NO: 782072 - RNA, 18 nt, Human
ggaaagacagcuucucau

SEQ ID NO: 782073 - RNA, 14 nt, Human
uauaauuccuauau

SEQ ID NO: 782074 - RNA, 13 nt, Human
augaacuuuccac

SEQ ID NO: 782075 - RNA, 23 nt, Human
cagccaugugauuacccucuggg

SEQ ID NO: 782076 - RNA, 23 nt, Human
cacaagaaaugaaagcagggacu

SEQ ID NO: 782077 - RNA, 17 nt, Human
uuucugcuuuaauuuca

SEQ ID NO: 782078 - RNA, 14 nt, Human
aguuuuuuuuuaaa

SEQ ID NO: 782079 - RNA, 12 nt, Human
uuuacuuuucca

SEQ ID NO: 782080 - RNA, 19 nt, Human
uauaacucaucauaaaaua

SEQ ID NO: 782081 - RNA, 18 nt, Human
cucauccugcaggcagcu

SEQ ID NO: 782082 - RNA, 13 nt, Human
agugucuggcacu

SEQ ID NO: 782083 - RNA, 14 nt, Human
ugaaacaagaagcc

SEQ ID NO: 782084 - RNA, 14 nt, Human
aauuccucugggaa

SEQ ID NO: 782085 - RNA, 22 nt, Human
cacuaguauuucuaugaaauau

SEQ ID NO: 782086 - RNA, 17 nt, Human
gccugcuggauguggag

SEQ ID NO: 782087 - RNA, 16 nt, Human
acgggguuugccaugc

SEQ ID NO: 782088 - RNA, 17 nt, Human
aauguaucuuauucaca

SEQ ID NO: 782089 - RNA, 17 nt, Human
cacgccuguaaucccag

SEQ ID NO: 782090 - RNA, 18 nt, Human
agugucuuacagagaaaa

SEQ ID NO: 782091 - RNA, 12 nt, Human
cuaaaucuauuu

SEQ ID NO: 782092 - RNA, 19 nt, Human
cagaaagcagaacagugau

SEQ ID NO: 782093 - RNA, 23 nt, Human
acauagaauaguguuggaaaaug

SEQ ID NO: 782094 - RNA, 14 nt, Human
ggcacuugggacaa

SEQ ID NO: 782095 - RNA, 20 nt, Human
uagguucuaaaaauugugau

SEQ ID NO: 782096 - RNA, 20 nt, Human
uuucccucuuggugccucag

SEQ ID NO: 782097 - RNA, 15 nt, Human
auaaagaauuuuaaa

SEQ ID NO: 782098 - RNA, 17 nt, Human
gcgccaccacgcccagc

SEQ ID NO: 782099 - RNA, 11 nt, Human
accucccugca

SEQ ID NO: 782100 - RNA, 18 nt, Human
aaaacuuucuuuucugga

SEQ ID NO: 782101 - RNA, 12 nt, Human
gggcgcgguggc

SEQ ID NO: 782102 - RNA, 19 nt, Human
cuccgucucccaaagugcu

SEQ ID NO: 782103 - RNA, 18 nt, Human
aaguugauaugccuuuuc

SEQ ID NO: 782104 - RNA, 16 nt, Human
caguucagagcugccc

SEQ ID NO: 782105 - RNA, 12 nt, Human
uuucuauuuauu

SEQ ID NO: 782106 - RNA, 16 nt, Human
auaaagaauuuuaaaa

SEQ ID NO: 782107 - RNA, 20 nt, Human
aagaauuuucaaaaucaaau

SEQ ID NO: 782108 - RNA, 13 nt, Human
cacuuuuuuucuu

SEQ ID NO: 782109 - RNA, 18 nt, Human
gccuuggggcugaugcag

SEQ ID NO: 782110 - RNA, 14 nt, Human
cagauccuggaaau

SEQ ID NO: 782111 - RNA, 16 nt, Human
ucuaguacuugggaga

SEQ ID NO: 782112 - RNA, 16 nt, Human
cuccugggcagcugcc

SEQ ID NO: 782113 - RNA, 18 nt, Human
cugaugaauguuaaauua

SEQ ID NO: 782114 - RNA, 24 nt, Human
ucccugcagacaugagagacagca

SEQ ID NO: 782115 - RNA, 21 nt, Human
ggcuuguaaaguacagacuuu

SEQ ID NO: 782116 - RNA, 24 nt, Human
uauuuauaaauauauuuaagauaa

SEQ ID NO: 782117 - RNA, 14 nt, Human
auaaauauauuuaa

SEQ ID NO: 782118 - RNA, 17 nt, Human
augaucauguauuuauu

SEQ ID NO: 782119 - RNA, 19 nt, Human
ugcaccaacuuugaagucu

SEQ ID NO: 782120 - RNA, 17 nt, Human
gacuuuccuaaaucaau

SEQ ID NO: 782121 - RNA, 20 nt, Human
auaaccaugcccaagaauga

SEQ ID NO: 782122 - RNA, 19 nt, Human
auuguugacaacugugacu

SEQ ID NO: 782123 - RNA, 21 nt, Human
aaacaaaaaaagcauuguaac

SEQ ID NO: 782124 - RNA, 17 nt, Human
gacuauuauagaaugga

SEQ ID NO: 782125 - RNA, 16 nt, Human
cugcacuccagccuga

SEQ ID NO: 782126 - RNA, 16 nt, Human
ucaucuuggucacaua

SEQ ID NO: 782127 - RNA, 23 nt, Human
auaauguuacauuauuaucaaca

SEQ ID NO: 782128 - RNA, 14 nt, Human
uauuuaaagacaaa

SEQ ID NO: 782129 - RNA, 15 nt, Human
aaguauuuauauauu

SEQ ID NO: 782130 - RNA, 16 nt, Human
ucuucccuuuuacaua

SEQ ID NO: 782131 - RNA, 20 nt, Human
accucugccucagaaaacaa

SEQ ID NO: 782132 - RNA, 20 nt, Human
auauguauuuauaaauauau

SEQ ID NO: 782133 - RNA, 14 nt, Human
ccuaaccagccugg

SEQ ID NO: 782134 - RNA, 15 nt, Human
aucucacaagcacuu

SEQ ID NO: 782135 - RNA, 22 nt, Human
agcacagccucuuagaugcagu

SEQ ID NO: 782136 - RNA, 14 nt, Human
cuccagugagacag

SEQ ID NO: 782137 - RNA, 20 nt, Human
cuaauucaaacuaauagaau

SEQ ID NO: 782138 - RNA, 18 nt, Human
guaauauugcaaggcaaa

SEQ ID NO: 782139 - RNA, 21 nt, Human
acaguuaccucugccucagaa

SEQ ID NO: 782140 - RNA, 11 nt, Human
acuaaaaauac

SEQ ID NO: 782141 - RNA, 13 nt, Human
uugccaucccucc

SEQ ID NO: 782142 - RNA, 15 nt, Human
aaauauuuauuuuaa

SEQ ID NO: 782143 - RNA, 15 nt, Human
ucuggggcucuggga

SEQ ID NO: 782144 - RNA, 15 nt, Human
gcaacccaaauguuc

SEQ ID NO: 782145 - RNA, 13 nt, Human
agcgacagugaga

SEQ ID NO: 782146 - RNA, 20 nt, Human
caguuagagauuuuuaaaua

SEQ ID NO: 782147 - RNA, 12 nt, Human
uuaucauuuuca

SEQ ID NO: 782148 - RNA, 17 nt, Human
aaauuccaggaaaaucu

SEQ ID NO: 782149 - RNA, 19 nt, Human
ugacaagguucuucccuuu

SEQ ID NO: 782150 - RNA, 13 nt, Human
uauauuuuuagac

SEQ ID NO: 782151 - RNA, 19 nt, Human
aagacuaugaggaauauuu

SEQ ID NO: 782152 - RNA, 22 nt, Human
gaagggcaucaugcaucuuacu

SEQ ID NO: 782153 - RNA, 13 nt, Human
cugcuuucaucuu

SEQ ID NO: 782154 - RNA, 17 nt, Human
auuaauggaauauguaa

SEQ ID NO: 782155 - RNA, 21 nt, Human
cauauguuuuuguaaguuuau

SEQ ID NO: 782156 - RNA, 13 nt, Human
uguuagcaaaaug

SEQ ID NO: 782157 - RNA, 17 nt, Human
aaauuaaggcauaagaa

SEQ ID NO: 782158 - RNA, 13 nt, Human
uuuaaaaaagaaa

SEQ ID NO: 782159 - RNA, 16 nt, Human
cugcuggauucaagug

SEQ ID NO: 782160 - RNA, 14 nt, Human
uaugcauacaguaa

SEQ ID NO: 782161 - RNA, 20 nt, Human
agaugcaguucugaagaaga

SEQ ID NO: 782162 - RNA, 18 nt, Human
ugccuccccuccucugcu

SEQ ID NO: 782163 - RNA, 20 nt, Human
acuagaguuuagcuggaaaa

SEQ ID NO: 782164 - RNA, 19 nt, Human
aaaauugugaucagaccau

SEQ ID NO: 782165 - RNA, 20 nt, Human
uauuuauaaauauauuuaag

SEQ ID NO: 782166 - RNA, 23 nt, Human
acuuauuuauuguuguuggaggc

SEQ ID NO: 782167 - RNA, 15 nt, Human
caccuucuggguuca

SEQ ID NO: 782168 - RNA, 14 nt, Human
uuauauauguauuu

SEQ ID NO: 782169 - RNA, 11 nt, Human
caucuagugag

SEQ ID NO: 782170 - RNA, 19 nt, Human
uggcgcgcgccaccacgcc

SEQ ID NO: 782171 - RNA, 22 nt, Human
caccaaacccggccugauuaaa

SEQ ID NO: 782172 - RNA, 15 nt, Human
ccagcacagccucuu

SEQ ID NO: 782173 - RNA, 17 nt, Human
aaacaaaaaaagcauug

SEQ ID NO: 782174 - RNA, 20 nt, Human
uucgugaaguauacuguauu

SEQ ID NO: 782175 - RNA, 19 nt, Human
gcacuaguauuucuaugaa

SEQ ID NO: 782176 - RNA, 23 nt, Human
cuuguaaaguacagacuuuuuuu

SEQ ID NO: 782177 - RNA, 16 nt, Human
cugagcgacagugaga

SEQ ID NO: 782178 - RNA, 19 nt, Human
aggucuaccaaaaaucuca

SEQ ID NO: 782179 - RNA, 20 nt, Human
aggagauggaaguugcagug

SEQ ID NO: 782180 - RNA, 17 nt, Human
agacgggguuugccaug

SEQ ID NO: 782181 - RNA, 14 nt, Human
acuuccucagcugu

SEQ ID NO: 782182 - RNA, 19 nt, Human
gcauccuuccucacaccag

SEQ ID NO: 782183 - RNA, 22 nt, Human
gaaaauaugccugcaaucugag

SEQ ID NO: 782184 - RNA, 16 nt, Human
cagcuuuuucucuccc

SEQ ID NO: 782185 - RNA, 13 nt, Human
agcuguggccagc

SEQ ID NO: 782186 - RNA, 12 nt, Human
acugaaaucaua

SEQ ID NO: 782187 - RNA, 23 nt, Human
uucagcagagacgggguuugcca

SEQ ID NO: 782188 - RNA, 20 nt, Human
uuuaguaagagauuccugag

SEQ ID NO: 782189 - RNA, 22 nt, Human
gaagugauacuauccaguuacu

SEQ ID NO: 782190 - RNA, 18 nt, Human
ucaaauuccagaaugauu

SEQ ID NO: 782191 - RNA, 18 nt, Human
caugcccaagaaugagaa

SEQ ID NO: 782192 - RNA, 14 nt, Human
caauuccucuggga

SEQ ID NO: 782193 - RNA, 19 nt, Human
uagcaagugaauuuuucuc

SEQ ID NO: 782194 - RNA, 20 nt, Human
uuccuaaccagccuggucaa

SEQ ID NO: 782195 - RNA, 15 nt, Human
auggaacucaaggaa

SEQ ID NO: 782196 - RNA, 13 nt, Human
uacagagacagaa

SEQ ID NO: 782197 - RNA, 13 nt, Human
auuuauugcugaa

SEQ ID NO: 782198 - RNA, 17 nt, Human
ugaccacugcagaagac

SEQ ID NO: 782199 - RNA, 17 nt, Human
cugagcgacagugagac

SEQ ID NO: 782200 - RNA, 18 nt, Human
ucuucuagguucuaaaaa

SEQ ID NO: 782201 - RNA, 15 nt, Human
uuugaguguuuuaag

SEQ ID NO: 782202 - RNA, 18 nt, Human
ccaaguuuauauacaauu

SEQ ID NO: 782203 - RNA, 13 nt, Human
ucuacuaaaaaua

SEQ ID NO: 782204 - RNA, 20 nt, Human
aacaaugcuguauuuuaaaa

SEQ ID NO: 782205 - RNA, 13 nt, Human
uguaaaguacaga

SEQ ID NO: 782206 - RNA, 20 nt, Human
gauguagauaaacucagaaa

SEQ ID NO: 782207 - RNA, 20 nt, Human
aaaagauuaugaucucagaa

SEQ ID NO: 782208 - RNA, 16 nt, Human
cuuauagaauauuuau

SEQ ID NO: 782209 - RNA, 18 nt, Human
gaaaauaucacuugucaa

SEQ ID NO: 782210 - RNA, 15 nt, Human
gaccagagcuacuga

SEQ ID NO: 782211 - RNA, 18 nt, Human
guagccacuucacuuuuu

SEQ ID NO: 782212 - RNA, 23 nt, Human
cuucacuuuuuuucuuuucucug

SEQ ID NO: 782213 - RNA, 19 nt, Human
uucagagcugcccucuccu

SEQ ID NO: 782214 - RNA, 13 nt, Human
cuagaauuuauuc

SEQ ID NO: 782215 - RNA, 20 nt, Human
uugcaagacauagaauagug

SEQ ID NO: 782216 - RNA, 16 nt, Human
uauaauaaauguacau

SEQ ID NO: 782217 - RNA, 16 nt, Human
auauggggaauauauu

SEQ ID NO: 782218 - RNA, 20 nt, Human
ccacauggcuucaccugucc

SEQ ID NO: 782219 - RNA, 16 nt, Human
gggcuuuagggaccug

SEQ ID NO: 782220 - RNA, 19 nt, Human
gcaugggccuagcccacug

SEQ ID NO: 782221 - RNA, 17 nt, Human
caguauucccuuuugcu

SEQ ID NO: 782222 - RNA, 20 nt, Human
aacucauuuguuaaaauuau

SEQ ID NO: 782223 - RNA, 16 nt, Human
ucaaucaaauaaguau

SEQ ID NO: 782224 - RNA, 20 nt, Human
uguaagaaaauaucacuugu

SEQ ID NO: 782225 - RNA, 20 nt, Human
cuuuuuuuuuuuuuuaaaca

SEQ ID NO: 782226 - RNA, 20 nt, Human
uaaaauguaauuaaucuugu

SEQ ID NO: 782227 - RNA, 12 nt, Human
gccaucccuccc

SEQ ID NO: 782228 - RNA, 18 nt, Human
acugccgguuugaaaaua

SEQ ID NO: 782229 - RNA, 16 nt, Human
agcaagacucugucuc

SEQ ID NO: 782230 - RNA, 17 nt, Human
acaccagagauaauaug

SEQ ID NO: 782231 - RNA, 22 nt, Human
cccuugccauggagguuaagca

SEQ ID NO: 782232 - RNA, 18 nt, Human
uacauuuguauaaaauaa

SEQ ID NO: 782233 - RNA, 23 nt, Human
ggucucagugucaaugcagcccc

SEQ ID NO: 782234 - RNA, 22 nt, Human
auauauaacaaugcuguauuuu

SEQ ID NO: 782235 - RNA, 19 nt, Human
auauuugcaagacauagaa

SEQ ID NO: 782236 - RNA, 11 nt, Human
uaaaaauaaau

SEQ ID NO: 782237 - RNA, 14 nt, Human
aaauaaguauuuau

SEQ ID NO: 782238 - RNA, 18 nt, Human
caaggcugauuaaaccaa

SEQ ID NO: 782239 - RNA, 18 nt, Human
gaaaugaaagcagggacu

SEQ ID NO: 782240 - RNA, 21 nt, Human
uagaaagaagcccaauauuau

SEQ ID NO: 782241 - RNA, 16 nt, Human
auuaauucaccuucca

SEQ ID NO: 782242 - RNA, 17 nt, Human
auuuuaaaucuaaaucu

SEQ ID NO: 782243 - RNA, 21 nt, Human
uuucgaugguacauauuucuu

SEQ ID NO: 782244 - RNA, 20 nt, Human
caaagcacgaaauguuauuu

SEQ ID NO: 782245 - RNA, 18 nt, Human
ugaguggaugauguuucg

SEQ ID NO: 782246 - RNA, 19 nt, Human
uaaaaauaaaaauaaauuu

SEQ ID NO: 782247 - RNA, 19 nt, Human
ugugcuggcuuaaaaugua

SEQ ID NO: 782248 - RNA, 16 nt, Human
acuuuaacacaguguc

SEQ ID NO: 782249 - RNA, 15 nt, Human
gggcucuggaaacca

SEQ ID NO: 782250 - RNA, 23 nt, Human
gauguacauuuccaaauucacaa

SEQ ID NO: 782251 - RNA, 14 nt, Human
cagagguugcagug

SEQ ID NO: 782252 - RNA, 14 nt, Human
auuacaucuuucac

SEQ ID NO: 782253 - RNA, 22 nt, Human
cagaguacuggcugauggagua

SEQ ID NO: 782254 - RNA, 14 nt, Human
agaagaaugacuau

SEQ ID NO: 782255 - RNA, 15 nt, Human
ucucagaaauuguau

SEQ ID NO: 782256 - RNA, 15 nt, Human
gggacaguuccugag

SEQ ID NO: 782257 - RNA, 18 nt, Human
accuguaaucauauaaua

SEQ ID NO: 782258 - RNA, 16 nt, Human
gacauuugcucaugga

SEQ ID NO: 782259 - RNA, 18 nt, Human
ccugcagacaugagagac

SEQ ID NO: 782260 - RNA, 22 nt, Human
aagacauaagcaaagacuauga

SEQ ID NO: 782261 - RNA, 19 nt, Human
aauagcauaaguuucuggg

SEQ ID NO: 782262 - RNA, 20 nt, Human
agauaucccaggaaaauuaa

SEQ ID NO: 782263 - RNA, 11 nt, Human
gcaugguuuag

SEQ ID NO: 782264 - RNA, 19 nt, Human
aucuguaaaauggagacac

SEQ ID NO: 782265 - RNA, 12 nt, Human
auuuucaaaaug

SEQ ID NO: 782266 - RNA, 16 nt, Human
agugagacagcucugc

SEQ ID NO: 782267 - RNA, 20 nt, Human
uacaguuagagauuuuuaaa

SEQ ID NO: 782268 - RNA, 23 nt, Human
uucucucuccuguacuuuuucca

SEQ ID NO: 782269 - RNA, 21 nt, Human
cuauuuauuuauuuauuugag

SEQ ID NO: 782270 - RNA, 13 nt, Human
uucuaggccgggc

SEQ ID NO: 782271 - RNA, 18 nt, Human
ugcuuguuagcaaaaugg

SEQ ID NO: 782272 - RNA, 18 nt, Human
gccuagcccacuggcucc

SEQ ID NO: 782273 - RNA, 22 nt, Human
auuaugaucucagaaauuguau

SEQ ID NO: 782274 - RNA, 15 nt, Human
uuucuugaguuuugu

SEQ ID NO: 782275 - RNA, 18 nt, Human
gcaauaaaauggguuuua

SEQ ID NO: 782276 - RNA, 20 nt, Human
ccagcacuuugggaggcuga

SEQ ID NO: 782277 - RNA, 15 nt, Human
acugcuggauucaag

SEQ ID NO: 782278 - RNA, 15 nt, Human
aagaagugaaaaucu

SEQ ID NO: 782279 - RNA, 17 nt, Human
cugaagggcaucaugca

SEQ ID NO: 782280 - RNA, 14 nt, Human
aauaaaaauaaauu

SEQ ID NO: 782281 - RNA, 14 nt, Human
uacuguauuuuuac

SEQ ID NO: 782282 - RNA, 13 nt, Human
uuguauuuuacuu

SEQ ID NO: 782283 - RNA, 18 nt, Human
ugacuuaguguacaugaa

SEQ ID NO: 782284 - RNA, 19 nt, Human
cucugccucagaaaacaag

SEQ ID NO: 782285 - RNA, 16 nt, Human
auguuauuuuuuaauu

SEQ ID NO: 782286 - RNA, 23 nt, Human
auguuaaaacugggacaggggag

SEQ ID NO: 782287 - RNA, 21 nt, Human
gucucagugucaaugcagccc

SEQ ID NO: 782288 - RNA, 18 nt, Human
acauguuacaacacggac

SEQ ID NO: 782289 - RNA, 18 nt, Human
caucccucccuccaccuc

SEQ ID NO: 782290 - RNA, 15 nt, Human
cuugaaaacuuuaug

SEQ ID NO: 782291 - RNA, 20 nt, Human
acuucuuaggguuaugauua

SEQ ID NO: 782292 - RNA, 15 nt, Human
cuauuuauugcugaa

SEQ ID NO: 782293 - RNA, 14 nt, Human
ugagcauguacuga

SEQ ID NO: 782294 - RNA, 24 nt, Human
cugauauauguguuuuucacauuu

SEQ ID NO: 782295 - RNA, 23 nt, Human
uauaugugaaauaaaaguagaau

SEQ ID NO: 782296 - RNA, 20 nt, Human
acugucucacuuaauccuuu

SEQ ID NO: 782297 - RNA, 21 nt, Human
cacuugaacccgggaggcaga

SEQ ID NO: 782298 - RNA, 17 nt, Human
agcgacagugagacucu

SEQ ID NO: 782299 - RNA, 16 nt, Human
guuuauuucacuugau

SEQ ID NO: 782300 - RNA, 20 nt, Human
ucugcuugccaucccucccu

SEQ ID NO: 782301 - RNA, 15 nt, Human
auagcagauuuuaau

SEQ ID NO: 782302 - RNA, 14 nt, Human
uuuuaauuuugaau

SEQ ID NO: 782303 - RNA, 21 nt, Human
aucuuuuuuuuaauaaaccau

SEQ ID NO: 782304 - RNA, 23 nt, Human
uguuauagguuguuggauaaauc

SEQ ID NO: 782305 - RNA, 21 nt, Human
ugcccauccugccccugagcc

SEQ ID NO: 782306 - RNA, 15 nt, Human
accugggcauucuug

SEQ ID NO: 782307 - RNA, 15 nt, Human
ucuuuucucugccuu

SEQ ID NO: 782308 - RNA, 13 nt, Human
uaauuuuuuucaa

SEQ ID NO: 782309 - RNA, 16 nt, Human
uaugaaccuuuacauc

SEQ ID NO: 782310 - RNA, 15 nt, Human
agagacagaaagcag

SEQ ID NO: 782311 - RNA, 15 nt, Human
auuucauucaauauc

SEQ ID NO: 782312 - RNA, 15 nt, Human
guguacaugaaagcg

SEQ ID NO: 782313 - RNA, 13 nt, Human
cuauuuauuaaua

SEQ ID NO: 782314 - RNA, 17 nt, Human
agcugccuccccuccuc

SEQ ID NO: 782315 - RNA, 18 nt, Human
acauuguuugucugucuu

SEQ ID NO: 782316 - RNA, 12 nt, Human
agauaucccagg

SEQ ID NO: 782317 - RNA, 19 nt, Human
gauugauagaguguuauca

SEQ ID NO: 782318 - RNA, 11 nt, Human
uuauauuuauu

SEQ ID NO: 782319 - RNA, 18 nt, Human
acugggguggguggggca

SEQ ID NO: 782320 - RNA, 12 nt, Human
gagugggacagu

SEQ ID NO: 782321 - RNA, 23 nt, Human
uaggauggcuaguaucaaaagaa

SEQ ID NO: 782322 - RNA, 12 nt, Human
aaucaauguuuc

SEQ ID NO: 782323 - RNA, 12 nt, Human
uuaauaaaccau

SEQ ID NO: 782324 - RNA, 15 nt, Human
gguggggcagugcuu

SEQ ID NO: 782325 - RNA, 20 nt, Human
aauuaaguuuuuuuuuaaaa

SEQ ID NO: 782326 - RNA, 10 nt, Human
aaaauguaau

SEQ ID NO: 782327 - RNA, 15 nt, Human
aguacagacuuuuuu

SEQ ID NO: 782328 - RNA, 17 nt, Human
acuugaaugugucaggu

SEQ ID NO: 782329 - RNA, 13 nt, Human
aaauccuugaaga

SEQ ID NO: 782330 - RNA, 19 nt, Human
uauaauuuuuuucaauauu

SEQ ID NO: 782331 - RNA, 11 nt, Human
ccugagcccca

SEQ ID NO: 782332 - RNA, 13 nt, Human
acaguaauuuuaa

SEQ ID NO: 782333 - RNA, 19 nt, Human
gucaaucagccuaguugau

SEQ ID NO: 782334 - RNA, 12 nt, Human
ucaacaugguga

SEQ ID NO: 782335 - RNA, 20 nt, Human
cccgggaguggcgcgcgcca

SEQ ID NO: 782336 - RNA, 20 nt, Human
cauagaauaguguuggaaaa

SEQ ID NO: 782337 - RNA, 16 nt, Human
uaaaaucuaauucaaa

SEQ ID NO: 782338 - RNA, 16 nt, Human
cuggaucucacaagca

SEQ ID NO: 782339 - RNA, 16 nt, Human
gcaagcuuuucaaaau

SEQ ID NO: 782340 - RNA, 16 nt, Human
aacugcuggauucaag

SEQ ID NO: 782341 - RNA, 19 nt, Human
cccauggcacucuauguuc

SEQ ID NO: 782342 - RNA, 19 nt, Human
acaguuagagauuuuuaaa

SEQ ID NO: 782343 - RNA, 10 nt, Human
acaccaccac

SEQ ID NO: 782344 - RNA, 19 nt, Human
uggguuucacaagugaaaa

SEQ ID NO: 782345 - RNA, 11 nt, Human
ccaaggcugga

SEQ ID NO: 782346 - RNA, 20 nt, Human
cugcacuccagccugagcga

SEQ ID NO: 782347 - RNA, 14 nt, Human
agguucuucccuuu

SEQ ID NO: 782348 - RNA, 14 nt, Human
cuccaccuucuggg

SEQ ID NO: 782349 - RNA, 15 nt, Human
uauuuauuaauauuu

SEQ ID NO: 782350 - RNA, 20 nt, Human
gcugauauauguguuuuuca

SEQ ID NO: 782351 - RNA, 14 nt, Human
gaaagcuguggcca

SEQ ID NO: 782352 - RNA, 22 nt, Human
uucuaauagaacucaguuuuaa

SEQ ID NO: 782353 - RNA, 14 nt, Human
cuggcuuaaaaugu

SEQ ID NO: 782354 - RNA, 15 nt, Human
uuuguccuuuuuguu

SEQ ID NO: 782355 - RNA, 19 nt, Human
gugucaggugacccugaug

SEQ ID NO: 782356 - RNA, 14 nt, Human
uagcauauguuuuu

SEQ ID NO: 782357 - RNA, 13 nt, Human
aaaggaagaaauu

SEQ ID NO: 782358 - RNA, 15 nt, Human
cuuaagaagacugca

SEQ ID NO: 782359 - RNA, 23 nt, Human
gauuuuguuuuuaaacuggaaau

SEQ ID NO: 782360 - RNA, 19 nt, Human
uauuauucuucauaacaau

SEQ ID NO: 782361 - RNA, 14 nt, Human
augaagaagcuaaa

SEQ ID NO: 782362 - RNA, 22 nt, Human
caaaaacaaacaaacgaaaaac

SEQ ID NO: 782363 - RNA, 14 nt, Human
uauauuauuuugaa

SEQ ID NO: 782364 - RNA, 16 nt, Human
gcagcugccuccccuc

SEQ ID NO: 782365 - RNA, 17 nt, Human
uauaauaaauguacauu

SEQ ID NO: 782366 - RNA, 14 nt, Human
ucucaaaaaauaaa

SEQ ID NO: 782367 - RNA, 16 nt, Human
gaauggcuaagcaaaa

SEQ ID NO: 782368 - RNA, 17 nt, Human
ggagcucguggaacagu

SEQ ID NO: 782369 - RNA, 19 nt, Human
acuuauugacuauuauaga

SEQ ID NO: 782370 - RNA, 15 nt, Human
aucaauuuaaaaaaa

SEQ ID NO: 782371 - RNA, 21 nt, Human
gcaaaauuuuuucucuaggaa

SEQ ID NO: 782372 - RNA, 20 nt, Human
aaaaaccugagccccaaaag

SEQ ID NO: 782373 - RNA, 23 nt, Human
aauguauuuguuuguauuuugug

SEQ ID NO: 782374 - RNA, 21 nt, Human
uagauaaacucagaaauuuaa

SEQ ID NO: 782375 - RNA, 21 nt, Human
accagggccuggcugggagug

SEQ ID NO: 782376 - RNA, 17 nt, Human
aaagcagggacuugaac

SEQ ID NO: 782377 - RNA, 23 nt, Human
gaaugagagacacacugaagaag

SEQ ID NO: 782378 - RNA, 17 nt, Human
caguucagagcugcccu

SEQ ID NO: 782379 - RNA, 14 nt, Human
uagcaaauguuaug

SEQ ID NO: 782380 - RNA, 16 nt, Human
uggagacaccaccacc

SEQ ID NO: 782381 - RNA, 21 nt, Human
aaacaucaguuacucugaagg

SEQ ID NO: 782382 - RNA, 15 nt, Human
cugcccucuccuggg

SEQ ID NO: 782383 - RNA, 14 nt, Human
uaagcuguuuccau

SEQ ID NO: 782384 - RNA, 22 nt, Human
cuucagccugaaagaggaauga

SEQ ID NO: 782385 - RNA, 17 nt, Human
gcuucucauccugcagg

SEQ ID NO: 782386 - RNA, 19 nt, Human
ucacgccuguaaucccagc

SEQ ID NO: 782387 - RNA, 14 nt, Human
ugagacucugucuc

SEQ ID NO: 782388 - RNA, 20 nt, Human
ggagauggaaguugcaguga

SEQ ID NO: 782389 - RNA, 13 nt, Human
aaucauauaauaa

SEQ ID NO: 782390 - RNA, 16 nt, Human
uguacaugaagaagcu

SEQ ID NO: 782391 - RNA, 22 nt, Human
uacagugucuuacagagaaaag

SEQ ID NO: 782392 - RNA, 17 nt, Human
cacuagacaaguccagc

SEQ ID NO: 782393 - RNA, 23 nt, Human
ugaauuacauuuguauaaaauaa

SEQ ID NO: 782394 - RNA, 22 nt, Human
agaguggaaccaacacuaacau

SEQ ID NO: 782395 - RNA, 16 nt, Human
aaaggccugucccugc

SEQ ID NO: 782396 - RNA, 14 nt, Human
agacaucaacagau

SEQ ID NO: 782397 - RNA, 19 nt, Human
ccuguaaucauauaauaaa

SEQ ID NO: 782398 - RNA, 16 nt, Human
accaggcuugccugca

SEQ ID NO: 782399 - RNA, 15 nt, Human
aguguaaguucacaa

SEQ ID NO: 782400 - RNA, 22 nt, Human
uguaauuaaucuuguaaauaua

SEQ ID NO: 782401 - RNA, 17 nt, Human
caagaagccacagaccu

SEQ ID NO: 782402 - RNA, 13 nt, Human
ugugacuuuccua

SEQ ID NO: 782403 - RNA, 14 nt, Human
guauacuguauuuu

SEQ ID NO: 782404 - RNA, 16 nt, Human
gccucuaaaaggccug

SEQ ID NO: 782405 - RNA, 22 nt, Human
aauaaauguaucuuauucacau

SEQ ID NO: 782406 - RNA, 12 nt, Human
uauaaauaaaau

SEQ ID NO: 782407 - RNA, 22 nt, Human
gcaugaauuuuuuucaucuucu

SEQ ID NO: 782408 - RNA, 13 nt, Human
agcuguugagcug

SEQ ID NO: 782409 - RNA, 19 nt, Human
cagcuacuugggaggcuga

SEQ ID NO: 782410 - RNA, 21 nt, Human
acucugaagggcaucaugcau

SEQ ID NO: 782411 - RNA, 17 nt, Human
ugugcaauaugugaugu

SEQ ID NO: 782412 - RNA, 19 nt, Human
auauuuaacauuauuuaua

SEQ ID NO: 782413 - RNA, 16 nt, Human
ucaaauaaguauuuau

SEQ ID NO: 782414 - RNA, 15 nt, Human
caggcagcuuuuucu

SEQ ID NO: 782415 - RNA, 22 nt, Human
agaaagugacaagcucacagac

SEQ ID NO: 782416 - RNA, 18 nt, Human
auauacuccuaguaauuu

SEQ ID NO: 782417 - RNA, 15 nt, Human
caagcucacagaccu

SEQ ID NO: 782418 - RNA, 15 nt, Human
uagauaggccauggg

SEQ ID NO: 782419 - RNA, 17 nt, Human
cuccaccucccugcaau

SEQ ID NO: 782420 - RNA, 12 nt, Human
ucaccccuugcc

SEQ ID NO: 782421 - RNA, 14 nt, Human
ggccaacuaggcag

SEQ ID NO: 782422 - RNA, 20 nt, Human
ugcuggauucaagugauccg

SEQ ID NO: 782423 - RNA, 20 nt, Human
cagagacgggguuugccaug

SEQ ID NO: 782424 - RNA, 11 nt, Human
augugcaauaa

SEQ ID NO: 782425 - RNA, 14 nt, Human
gcugccuccccucc

SEQ ID NO: 782426 - RNA, 17 nt, Human
aggguguguaaguagau

SEQ ID NO: 782427 - RNA, 21 nt, Human
gaggcugaggcggguggauca

SEQ ID NO: 782428 - RNA, 23 nt, Human
gcugucuauguggcuguaucuug

SEQ ID NO: 782429 - RNA, 15 nt, Human
gcuugccaucccucc

SEQ ID NO: 782430 - RNA, 19 nt, Human
uacuucuuaggguuaugau

SEQ ID NO: 782431 - RNA, 23 nt, Human
uacugccuaucagcauuuuacua

SEQ ID NO: 782432 - RNA, 13 nt, Human
ucauccugcaggc

SEQ ID NO: 782433 - RNA, 17 nt, Human
ucaaauaaguauuuaua

SEQ ID NO: 782434 - RNA, 18 nt, Human
auguguggcauuuucacu

SEQ ID NO: 782435 - RNA, 17 nt, Human
caagacccaaaaggcag

SEQ ID NO: 782436 - RNA, 23 nt, Human
uaauccuuuguuuucugacuaau

SEQ ID NO: 782437 - RNA, 15 nt, Human
cuaaaaaacaaagaa

SEQ ID NO: 782438 - RNA, 16 nt, Human
uacuuuguuauuuuuc

SEQ ID NO: 782439 - RNA, 17 nt, Human
aguaauuucagaagaaa

SEQ ID NO: 782440 - RNA, 16 nt, Human
ucuauuaggaaauauu

SEQ ID NO: 782441 - RNA, 17 nt, Human
agcagucagaagaccug

SEQ ID NO: 782442 - RNA, 18 nt, Human
aaucauauaauaaaugua

SEQ ID NO: 782443 - RNA, 18 nt, Human
ccugccuaagugcagccc

SEQ ID NO: 782444 - RNA, 15 nt, Human
cuccugguuccuagg

SEQ ID NO: 782445 - RNA, 18 nt, Human
uuuauggcacuaguauuu

SEQ ID NO: 782446 - RNA, 14 nt, Human
auccagaaauaaug

SEQ ID NO: 782447 - RNA, 21 nt, Human
cuuuauuuuuuaaguauuuau

SEQ ID NO: 782448 - RNA, 15 nt, Human
ugauuucauucaaua

SEQ ID NO: 782449 - RNA, 21 nt, Human
cuuucaucuuggucacauaca

SEQ ID NO: 782450 - RNA, 18 nt, Human
guaauuucagaagaaauu

SEQ ID NO: 782451 - RNA, 16 nt, Human
acauuugcucauggaa

SEQ ID NO: 782452 - RNA, 23 nt, Human
aauuauggcugguaacauagguu

SEQ ID NO: 782453 - RNA, 18 nt, Human
aucuucagaccuagaaua

SEQ ID NO: 782454 - RNA, 21 nt, Human
caguauucccuuuugcugccu

SEQ ID NO: 782455 - RNA, 18 nt, Human
ccaauauuauaauuuuuu

SEQ ID NO: 782456 - RNA, 11 nt, Human
ggcacuuggga

SEQ ID NO: 782457 - RNA, 18 nt, Human
auaaauggacaaaugcuu

SEQ ID NO: 782458 - RNA, 15 nt, Human
gcagagacgggguuu

SEQ ID NO: 782459 - RNA, 15 nt, Human
uaaaucuaaaucuau

SEQ ID NO: 782460 - RNA, 17 nt, Human
ucucauccugcaggcag

SEQ ID NO: 782461 - RNA, 22 nt, Human
guacacugccuucucaacucca

SEQ ID NO: 782462 - RNA, 18 nt, Human
guuuccuagcgcagccau

SEQ ID NO: 782463 - RNA, 21 nt, Human
caguucagagcugcccucucc

SEQ ID NO: 782464 - RNA, 14 nt, Human
agugugaccaggca

SEQ ID NO: 782465 - RNA, 13 nt, Human
aaauaaaguauau

SEQ ID NO: 782466 - RNA, 17 nt, Human
agaaucacuugaacccg

SEQ ID NO: 782467 - RNA, 20 nt, Human
ugauccgcccaucuccgucu

SEQ ID NO: 782468 - RNA, 17 nt, Human
ugaagguaaaauugaaa

SEQ ID NO: 782469 - RNA, 18 nt, Human
ucuccuguacuuuuucca

SEQ ID NO: 782470 - RNA, 21 nt, Human
acagugauuaccagggacuga

SEQ ID NO: 782471 - RNA, 11 nt, Human
accauuuuuac

SEQ ID NO: 782472 - RNA, 15 nt, Human
gccaucccucccucc

SEQ ID NO: 782473 - RNA, 20 nt, Human
aguuuaugcauacaguaauu

SEQ ID NO: 782474 - RNA, 21 nt, Human
aaauaauuuuuauauuugaaa

SEQ ID NO: 782475 - RNA, 23 nt, Human
uuguaacuuaugaaccuuuacau

SEQ ID NO: 782476 - RNA, 19 nt, Human
auuguauuuuaguaagaga

SEQ ID NO: 782477 - RNA, 12 nt, Human
uccugcaggcag

SEQ ID NO: 782478 - RNA, 14 nt, Human
agcuguugagcugu

SEQ ID NO: 782479 - RNA, 21 nt, Human
gaaagcagggacuugaaccca

SEQ ID NO: 782480 - RNA, 20 nt, Human
uuugcaagccagauuuuccu

SEQ ID NO: 782481 - RNA, 21 nt, Human
ucuagcaaauguuaugcauaa

SEQ ID NO: 782482 - RNA, 16 nt, Human
aggguguguaaguaga

SEQ ID NO: 782483 - RNA, 17 nt, Human
agcugacccagccccuu

SEQ ID NO: 782484 - RNA, 16 nt, Human
ucugcuuuaauuucau

SEQ ID NO: 782485 - RNA, 13 nt, Human
aauuaaucuugua

SEQ ID NO: 782486 - RNA, 19 nt, Human
aaugaaauggugaaaugca

SEQ ID NO: 782487 - RNA, 15 nt, Human
uuccuucucaucugu

SEQ ID NO: 782488 - RNA, 14 nt, Human
cagcugccuccccu

SEQ ID NO: 782489 - RNA, 17 nt, Human
uagaagcaucacagguu

SEQ ID NO: 782490 - RNA, 16 nt, Human
cuuuaacacagugucu

SEQ ID NO: 782491 - RNA, 14 nt, Human
cugagcauguacug

SEQ ID NO: 782492 - RNA, 20 nt, Human
ugagagugaacaaauuuaca

SEQ ID NO: 782493 - RNA, 16 nt, Human
auuuuacuuuuccauu

SEQ ID NO: 782494 - RNA, 18 nt, Human
uccugccugcaauauuug

SEQ ID NO: 782495 - RNA, 15 nt, Human
gaaacauuacaguua

SEQ ID NO: 782496 - RNA, 15 nt, Human
ucuaaaucuauuuau

SEQ ID NO: 782497 - RNA, 19 nt, Human
cauuguuugucugucuuca

SEQ ID NO: 782498 - RNA, 17 nt, Human
cacaggcuccaaacugg

SEQ ID NO: 782499 - RNA, 11 nt, Human
uuguuuuucca

SEQ ID NO: 782500 - RNA, 22 nt, Human
uguugcccacagcuguaugauu

SEQ ID NO: 782501 - RNA, 19 nt, Human
uauaauauacuauauuuau

SEQ ID NO: 782502 - RNA, 21 nt, Human
acaauuauaagcuguuuuuau

SEQ ID NO: 782503 - RNA, 19 nt, Human
gugucuggcacuugggaca

SEQ ID NO: 782504 - RNA, 17 nt, Human
cuggagggaagccuugg

SEQ ID NO: 782505 - RNA, 19 nt, Human
uagcaacuuuuguguaaug

SEQ ID NO: 782506 - RNA, 12 nt, Human
gccccugagccc

SEQ ID NO: 782507 - RNA, 18 nt, Human
ucuuauagaauauuuauu

SEQ ID NO: 782508 - RNA, 19 nt, Human
gaggacuugggcgggacac

SEQ ID NO: 782509 - RNA, 18 nt, Human
uccagauacacccaaagu

SEQ ID NO: 782510 - RNA, 21 nt, Human
caauucuauuacgugcaauac

SEQ ID NO: 782511 - RNA, 22 nt, Human
gcacagccucuuagaugcaguu

SEQ ID NO: 782512 - RNA, 13 nt, Human
uguaacuuaugaa

SEQ ID NO: 782513 - RNA, 22 nt, Human
aaagggucucccucuguugcca

SEQ ID NO: 782514 - RNA, 15 nt, Human
acacuaacauauaau

SEQ ID NO: 782515 - RNA, 14 nt, Human
gcugggaauuacag

SEQ ID NO: 782516 - RNA, 16 nt, Human
aguauucccuuuugcu

SEQ ID NO: 782517 - RNA, 13 nt, Human
aauuucaugaaaa

SEQ ID NO: 782518 - RNA, 23 nt, Human
ccagcacuuugggaggcugaggc

SEQ ID NO: 782519 - RNA, 16 nt, Human
gauaaacucagaaauu

SEQ ID NO: 782520 - RNA, 14 nt, Human
uaagcuguuuuuau

SEQ ID NO: 782521 - RNA, 17 nt, Human
cuuuuuuuuuuuuucuu

SEQ ID NO: 782522 - RNA, 21 nt, Human
guuugccaugcuggccaggcu

SEQ ID NO: 782523 - RNA, 20 nt, Human
uaacugcauugagaacugca

SEQ ID NO: 782524 - RNA, 17 nt, Human
cugagcagugcuugaau

SEQ ID NO: 782525 - RNA, 13 nt, Human
aauuuuuauauuu

SEQ ID NO: 782526 - RNA, 21 nt, Human
auugcuuguuagcaaaaugga

SEQ ID NO: 782527 - RNA, 14 nt, Human
aaaaauacaaaaau

SEQ ID NO: 782528 - RNA, 20 nt, Human
cuggacuuuccagagaccag

SEQ ID NO: 782529 - RNA, 16 nt, Human
cucccaaagugcuggg

SEQ ID NO: 782530 - RNA, 19 nt, Human
gagggaauugcagaguacu

SEQ ID NO: 782531 - RNA, 19 nt, Human
auguacauuuccaaauuca

SEQ ID NO: 782532 - RNA, 13 nt, Human
gcagccaaccuaa

SEQ ID NO: 782533 - RNA, 14 nt, Human
acaggcgugagcca

SEQ ID NO: 782534 - RNA, 17 nt, Human
uaucuuuuuuuuaauaa

SEQ ID NO: 782535 - RNA, 15 nt, Human
uguuaaaugauuuca

SEQ ID NO: 782536 - RNA, 20 nt, Human
gugagccaccaaacccggcc

SEQ ID NO: 782537 - RNA, 14 nt, Human
uguuauuuuuuaau

SEQ ID NO: 782538 - RNA, 19 nt, Human
gauccgcccaucuccgucu

SEQ ID NO: 782539 - RNA, 14 nt, Human
auagagugggacag

SEQ ID NO: 782540 - RNA, 14 nt, Human
agaaauaaugaaau

SEQ ID NO: 782541 - RNA, 22 nt, Human
uuccuagcgcagccaugugauu

SEQ ID NO: 782542 - RNA, 17 nt, Human
uggcgcaaucuuaacuc

SEQ ID NO: 782543 - RNA, 23 nt, Human
ucuaccaaaaaucucaauauuuc

SEQ ID NO: 782544 - RNA, 16 nt, Human
cagacaugagagacag

SEQ ID NO: 782545 - RNA, 21 nt, Human
gcuaaaguaucuguauugcau

SEQ ID NO: 782546 - RNA, 14 nt, Human
uauuugaaauauug

SEQ ID NO: 782547 - RNA, 20 nt, Human
guuauuuauaacaaccuaaa

SEQ ID NO: 782548 - RNA, 11 nt, Human
cagccagcagu

SEQ ID NO: 782549 - RNA, 15 nt, Human
ugcaaccuccaccuu

SEQ ID NO: 782550 - RNA, 13 nt, Human
augauuccaccua

SEQ ID NO: 782551 - RNA, 20 nt, Human
uugauagaguguuaucaguc

SEQ ID NO: 782552 - RNA, 15 nt, Human
augagaagaaugacu

SEQ ID NO: 782553 - RNA, 22 nt, Human
ugggcacuguggguagacacac

SEQ ID NO: 782554 - RNA, 12 nt, Human
uuuuuuuuaaac

SEQ ID NO: 782555 - RNA, 21 nt, Human
gcccaagggugggugggguga

SEQ ID NO: 782556 - RNA, 12 nt, Human
ggcugaugcagu

SEQ ID NO: 782557 - RNA, 15 nt, Human
agugacaagcucaca

SEQ ID NO: 782558 - RNA, 17 nt, Human
aaaaagcauuguaacuu

SEQ ID NO: 782559 - RNA, 24 nt, Human
aaaggccugucccugcagacauga

SEQ ID NO: 782560 - RNA, 13 nt, Human
ucugauuuuccug

SEQ ID NO: 782561 - RNA, 18 nt, Human
cgcgccaccacgcccagc

SEQ ID NO: 782562 - RNA, 18 nt, Human
auuuucuuccaaacagaa

SEQ ID NO: 782563 - RNA, 13 nt, Human
uauuucuaugaaa

SEQ ID NO: 782564 - RNA, 13 nt, Human
ucauuuaaaauau

SEQ ID NO: 782565 - RNA, 22 nt, Human
caaugcuguauuuuaaaagaau

SEQ ID NO: 782566 - RNA, 14 nt, Human
augauguuuagaaa

SEQ ID NO: 782567 - RNA, 21 nt, Human
caauuauaagcuguuuuuaua

SEQ ID NO: 782568 - RNA, 16 nt, Human
ugacuuaaugccacua

SEQ ID NO: 782569 - RNA, 13 nt, Human
acaucuuucacau

SEQ ID NO: 782570 - RNA, 14 nt, Human
gugggacaguuccu

SEQ ID NO: 782571 - RNA, 22 nt, Human
aaacagaacuauggaaaaaaag

SEQ ID NO: 782572 - RNA, 19 nt, Human
gccaucccucccuccaccu

SEQ ID NO: 782573 - RNA, 17 nt, Human
auuuugaauaaauaaau

SEQ ID NO: 782574 - RNA, 19 nt, Human
acuuuuuuuuuuuuuuaaa

SEQ ID NO: 782575 - RNA, 15 nt, Human
gacuuacuauuuauu

SEQ ID NO: 782576 - RNA, 16 nt, Human
cauggugaaaccccgu

SEQ ID NO: 782577 - RNA, 17 nt, Human
ucccugcaauaaaaugg

SEQ ID NO: 782578 - RNA, 14 nt, Human
uaacauuauuuaua

SEQ ID NO: 782579 - RNA, 18 nt, Human
ucaauacuucauuuaaaa

SEQ ID NO: 782580 - RNA, 14 nt, Human
uucagccugaaaga

SEQ ID NO: 782581 - RNA, 15 nt, Human
uccuguacuuuuucc

SEQ ID NO: 782582 - RNA, 15 nt, Human
ucaaaagguauuuau

SEQ ID NO: 782583 - RNA, 12 nt, Human
auaaaauggguu

SEQ ID NO: 782584 - RNA, 23 nt, Human
uagagacuuugugaaaaaaaauu

SEQ ID NO: 782585 - RNA, 21 nt, Human
cgacagugagacucugucuca

SEQ ID NO: 782586 - RNA, 12 nt, Human
gagaaauuugcc

SEQ ID NO: 782587 - RNA, 16 nt, Human
ugcaauacuucaauac

SEQ ID NO: 782588 - RNA, 17 nt, Human
uaagauuuguaauauuu

SEQ ID NO: 782589 - RNA, 16 nt, Human
cagagcugcccucucc

SEQ ID NO: 782590 - RNA, 15 nt, Human
ggcagcuuuuucucu

SEQ ID NO: 782591 - RNA, 14 nt, Human
cuagcgcagccaug

SEQ ID NO: 782592 - RNA, 17 nt, Human
acacaaccugucccagc

SEQ ID NO: 782593 - RNA, 23 nt, Human
aauagcaguugaaacaagaagcc

SEQ ID NO: 782594 - RNA, 12 nt, Human
ucuuaaagaauu

SEQ ID NO: 782595 - RNA, 21 nt, Human
aguauacuguauuuuuaccuu

SEQ ID NO: 782596 - RNA, 19 nt, Human
augaaguacucauacaugu

SEQ ID NO: 782597 - RNA, 19 nt, Human
ugaauaucuauuaauauau

SEQ ID NO: 782598 - RNA, 16 nt, Human
ccuuuauaaucuuuua

SEQ ID NO: 782599 - RNA, 16 nt, Human
uacccucugggucuca

SEQ ID NO: 782600 - RNA, 13 nt, Human
gccaugcuggcca

SEQ ID NO: 782601 - RNA, 23 nt, Human
agaccauaauguuacauuauuau

SEQ ID NO: 782602 - RNA, 18 nt, Human
cuggggccuguugaagau

SEQ ID NO: 782603 - RNA, 12 nt, Human
ucauucaaaagu

SEQ ID NO: 782604 - RNA, 14 nt, Human
aaucuuguaaauau

SEQ ID NO: 782605 - RNA, 15 nt, Human
uuacagagacagaaa

SEQ ID NO: 782606 - RNA, 20 nt, Human
ucaaaacuucagacauagaa

SEQ ID NO: 782607 - RNA, 21 nt, Human
cuauuauagaauggaacucaa

SEQ ID NO: 782608 - RNA, 17 nt, Human
gaaagaagcccaauauu

SEQ ID NO: 782609 - RNA, 19 nt, Human
uccaaagcugaauacauuc

SEQ ID NO: 782610 - RNA, 21 nt, Human
accaacacuaacauauaaugu

SEQ ID NO: 782611 - RNA, 20 nt, Human
uauacuguauuuuuaccuuu

SEQ ID NO: 782612 - RNA, 14 nt, Human
gaagaaauucugca

SEQ ID NO: 782613 - RNA, 17 nt, Human
augauuucauuucaacu

SEQ ID NO: 782614 - RNA, 15 nt, Human
auuuauaacucauca

SEQ ID NO: 782615 - RNA, 13 nt, Human
caaaaaaagcauu

SEQ ID NO: 782616 - RNA, 20 nt, Human
aguuccugagaccagccaac

SEQ ID NO: 782617 - RNA, 15 nt, Human
caggaggaaggcuua

SEQ ID NO: 782618 - RNA, 17 nt, Human
aauauuugaauuuuaaa

SEQ ID NO: 782619 - RNA, 20 nt, Human
agacgggguuugccaugcug

SEQ ID NO: 782620 - RNA, 17 nt, Human
auauuuuuuaugaaaca

SEQ ID NO: 782621 - RNA, 16 nt, Human
uguagauaaacucaga

SEQ ID NO: 782622 - RNA, 17 nt, Human
ucuauuagccacaaaau

SEQ ID NO: 782623 - RNA, 16 nt, Human
gugagacagcucugca

SEQ ID NO: 782624 - RNA, 23 nt, Human
gaaaaaguucugcagauaaacag

SEQ ID NO: 782625 - RNA, 14 nt, Human
accauuuuuacuug

SEQ ID NO: 782626 - RNA, 17 nt, Human
uggugaaaugcagaguc

SEQ ID NO: 782627 - RNA, 16 nt, Human
guauuuauaaauauau

SEQ ID NO: 782628 - RNA, 23 nt, Human
acaguguuuucugggauaaguaa

SEQ ID NO: 782629 - RNA, 18 nt, Human
aaaaugugcaauauguga

SEQ ID NO: 782630 - RNA, 13 nt, Human
uacagacuuuuuu

SEQ ID NO: 782631 - RNA, 16 nt, Human
auauccaaagcugaau

SEQ ID NO: 782632 - RNA, 16 nt, Human
ucauuuugguaaaaua

SEQ ID NO: 782633 - RNA, 13 nt, Human
agagauuccugag

SEQ ID NO: 782634 - RNA, 19 nt, Human
uacuucauuuaaaauauuu

SEQ ID NO: 782635 - RNA, 20 nt, Human
gcuguaucuuguuuuuccac

SEQ ID NO: 782636 - RNA, 17 nt, Human
auuugcagcugugccau

SEQ ID NO: 782637 - RNA, 19 nt, Human
uggggcagugcuuggccca

SEQ ID NO: 782638 - RNA, 15 nt, Human
cagaacuauggaaaa

SEQ ID NO: 782639 - RNA, 15 nt, Human
aauuccaggaaaauc

SEQ ID NO: 782640 - RNA, 21 nt, Human
auguacaugaagaagcuaaau

SEQ ID NO: 782641 - RNA, 22 nt, Human
gcgacucuauagacucuaggac

SEQ ID NO: 782642 - RNA, 12 nt, Human
guauaaauaaaa

SEQ ID NO: 782643 - RNA, 17 nt, Human
guugcugggggggauug

SEQ ID NO: 782644 - RNA, 20 nt, Human
ucccuuuugcugccucuaaa

SEQ ID NO: 782645 - RNA, 14 nt, Human
gcugcaaaauguua

SEQ ID NO: 782646 - RNA, 18 nt, Human
ucuauuaggaaauauucu

SEQ ID NO: 782647 - RNA, 17 nt, Human
aucaugccccuguacuc

SEQ ID NO: 782648 - RNA, 21 nt, Human
uuuauauaagcuuguauuccu

SEQ ID NO: 782649 - RNA, 21 nt, Human
uauaacucaucauaaaauaaa

SEQ ID NO: 782650 - RNA, 20 nt, Human
uaaagaauuuucaaaaucaa

SEQ ID NO: 782651 - RNA, 18 nt, Human
aauucaaacuaauagaau

SEQ ID NO: 782652 - RNA, 18 nt, Human
uuuuuagacucaucaauc

SEQ ID NO: 782653 - RNA, 23 nt, Human
augguauuugaguguuuuaagau

SEQ ID NO: 782654 - RNA, 19 nt, Human
acugcuggauucaagugau

SEQ ID NO: 782655 - RNA, 15 nt, Human
uuuaugcauacagua

SEQ ID NO: 782656 - RNA, 17 nt, Human
acuucauuuaaaauauu

SEQ ID NO: 782657 - RNA, 22 nt, Human
auguacauuuccaaauucacaa

SEQ ID NO: 782658 - RNA, 15 nt, Human
ccuugguauagcaua

SEQ ID NO: 782659 - RNA, 20 nt, Human
gcugccuccccuccucugcu

SEQ ID NO: 782660 - RNA, 14 nt, Human
ucuaggaaauauuu

SEQ ID NO: 782661 - RNA, 19 nt, Human
auuuuccuggacaguuuuc

SEQ ID NO: 782662 - RNA, 18 nt, Human
caguuguugcccacagcu

SEQ ID NO: 782663 - RNA, 15 nt, Human
caccgaguggcccuu

SEQ ID NO: 782664 - RNA, 14 nt, Human
cugacccagccccu

SEQ ID NO: 782665 - RNA, 21 nt, Human
uuuccauugguuuaccuguga

SEQ ID NO: 782666 - RNA, 12 nt, Human
aaaagaaagaaa

SEQ ID NO: 782667 - RNA, 22 nt, Human
cucugggauagcugacccagcc

SEQ ID NO: 782668 - RNA, 23 nt, Human
cagaaauuuaauucauguuucuu

SEQ ID NO: 782669 - RNA, 15 nt, Human
accccuucauccucu

SEQ ID NO: 782670 - RNA, 15 nt, Human
guugccaaggcugga

SEQ ID NO: 782671 - RNA, 17 nt, Human
aucuauuaauauaugua

SEQ ID NO: 782672 - RNA, 22 nt, Human
aggauggcuaguaucaaaagaa

SEQ ID NO: 782673 - RNA, 12 nt, Human
gaauaucuauua

SEQ ID NO: 782674 - RNA, 19 nt, Human
ggaucucacaagcacuuuc

SEQ ID NO: 782675 - RNA, 20 nt, Human
uagagacuuugugaaaaaaa

SEQ ID NO: 782676 - RNA, 15 nt, Human
auaauuuugugaagc

SEQ ID NO: 782677 - RNA, 12 nt, Human
acagagacagaa

SEQ ID NO: 782678 - RNA, 17 nt, Human
uuauauuugaaauauug

SEQ ID NO: 782679 - RNA, 19 nt, Human
acuaucucauuuccaagca

SEQ ID NO: 782680 - RNA, 19 nt, Human
gcucauggaauuggagcuc

SEQ ID NO: 782681 - RNA, 15 nt, Human
cuucucuucacaguc

SEQ ID NO: 782682 - RNA, 13 nt, Human
cacaccaggcuug

SEQ ID NO: 782683 - RNA, 22 nt, Human
auucuugaaagcuguggccagc

SEQ ID NO: 782684 - RNA, 16 nt, Human
ucuacuuuuaaguugc

SEQ ID NO: 782685 - RNA, 22 nt, Human
auaucuuuuuuuuaauaaacca

SEQ ID NO: 782686 - RNA, 16 nt, Human
agauaauuauaauaua

SEQ ID NO: 782687 - RNA, 16 nt, Human
aucaaaagaaagaaaa

SEQ ID NO: 782688 - RNA, 15 nt, Human
uuuucugcuuuaauu

SEQ ID NO: 782689 - RNA, 15 nt, Human
cuuugaugauuaauu

SEQ ID NO: 782690 - RNA, 23 nt, Human
aauagugucugaugaauguuaaa

SEQ ID NO: 782691 - RNA, 16 nt, Human
ccuauauccugugacu

SEQ ID NO: 782692 - RNA, 14 nt, Human
ucuuuuuuuuaaua

SEQ ID NO: 782693 - RNA, 18 nt, Human
ccugccugcaauauuuga

SEQ ID NO: 782694 - RNA, 23 nt, Human
ccagccugggugacagagcaaga

SEQ ID NO: 782695 - RNA, 21 nt, Human
agcaguucagagcugcccucu

SEQ ID NO: 782696 - RNA, 20 nt, Human
auuauuuugaauccagaaau

SEQ ID NO: 782697 - RNA, 18 nt, Human
cugcaggcgugaccugac

SEQ ID NO: 782698 - RNA, 15 nt, Human
auuucagaagaaauu

SEQ ID NO: 782699 - RNA, 14 nt, Human
uuucuaugaaauau

SEQ ID NO: 782700 - RNA, 20 nt, Human
cuuaacucauugcaaccucc

SEQ ID NO: 782701 - RNA, 15 nt, Human
auuucuaugaaauau

SEQ ID NO: 782702 - RNA, 14 nt, Human
uccuaguaauuuaa

SEQ ID NO: 782703 - RNA, 16 nt, Human
acuaguuucccuugca

SEQ ID NO: 782704 - RNA, 21 nt, Human
gugacauguuuacaaaccuca

SEQ ID NO: 782705 - RNA, 16 nt, Human
uccaccucccugcaau

SEQ ID NO: 782706 - RNA, 11 nt, Human
ggcuuguaaag

SEQ ID NO: 782707 - RNA, 20 nt, Human
gccauggagguuaagcacuu

SEQ ID NO: 782708 - RNA, 18 nt, Human
ugccauaauuacuauguc

SEQ ID NO: 782709 - RNA, 19 nt, Human
aucauuuuaauuauuauuc

SEQ ID NO: 782710 - RNA, 12 nt, Human
aagcauuguaac

SEQ ID NO: 782711 - RNA, 15 nt, Human
cucccuccaccuccc

SEQ ID NO: 782712 - RNA, 18 nt, Human
ccauccugccccugagcc

SEQ ID NO: 782713 - RNA, 17 nt, Human
uaacugcauugagaacu

SEQ ID NO: 782714 - RNA, 15 nt, Human
agaaauuguaucuua

SEQ ID NO: 782715 - RNA, 17 nt, Human
auggcuaguaucaaaag

SEQ ID NO: 782716 - RNA, 22 nt, Human
aaugcuuaugaaacuaagauuu

SEQ ID NO: 782717 - RNA, 18 nt, Human
gccccgggaguggcgcgc

SEQ ID NO: 782718 - RNA, 13 nt, Human
caaaaagaauggg

SEQ ID NO: 782719 - RNA, 16 nt, Human
uguaugacgugacugg

SEQ ID NO: 782720 - RNA, 20 nt, Human
aaacagaacuauggaaaaaa

SEQ ID NO: 782721 - RNA, 23 nt, Human
ucaauaucuuuuuuuuaauaaac

SEQ ID NO: 782722 - RNA, 21 nt, Human
uacuucauuuaaaauauuuuu

SEQ ID NO: 782723 - RNA, 18 nt, Human
acagaaagcagaacagug

SEQ ID NO: 782724 - RNA, 19 nt, Human
cugcuggauguggaggggg

SEQ ID NO: 782725 - RNA, 24 nt, Human
cucaucuguaaaauggagacacca

SEQ ID NO: 782726 - RNA, 19 nt, Human
acaaucugaggccuccucu

SEQ ID NO: 782727 - RNA, 16 nt, Human
gacaaagacaaauucu

SEQ ID NO: 782728 - RNA, 16 nt, Human
uuuauaacucaucaua

SEQ ID NO: 782729 - RNA, 21 nt, Human
uuacaggcgugagccaccaaa

SEQ ID NO: 782730 - RNA, 11 nt, Human
gcuguuuccau

SEQ ID NO: 782731 - RNA, 21 nt, Human
cuuuuaaguugcugaugaacu

SEQ ID NO: 782732 - RNA, 17 nt, Human
ccagcaguucagagcug

SEQ ID NO: 782733 - RNA, 17 nt, Human
cagacaucaacagauaa

SEQ ID NO: 782734 - RNA, 14 nt, Human
cugggcagcugccu

SEQ ID NO: 782735 - RNA, 16 nt, Human
ugccucaccccuugcc

SEQ ID NO: 782736 - RNA, 17 nt, Human
cacuggcucccuggaag

SEQ ID NO: 782737 - RNA, 21 nt, Human
acuugggcgggacacaggcuc

SEQ ID NO: 782738 - RNA, 15 nt, Human
caaauucuguuucuu

SEQ ID NO: 782739 - RNA, 18 nt, Human
caugagaccacuguuauc

SEQ ID NO: 782740 - RNA, 15 nt, Human
augauaacuggaaac

SEQ ID NO: 782741 - RNA, 12 nt, Human
uacagagaaaag

SEQ ID NO: 782742 - RNA, 23 nt, Human
gucuccaaaaucggaucuggggc

SEQ ID NO: 782743 - RNA, 18 nt, Human
acuagaauuuauucaauu

SEQ ID NO: 782744 - RNA, 22 nt, Human
cugcuagaguucugucuggacu

SEQ ID NO: 782745 - RNA, 13 nt, Human
gcucuggaaacca

SEQ ID NO: 782746 - RNA, 20 nt, Human
acuaaaaaggcauguaauug

SEQ ID NO: 782747 - RNA, 21 nt, Human
gacagcuucucauccugcagg

SEQ ID NO: 782748 - RNA, 14 nt, Human
uauuuuuuaugaaa

SEQ ID NO: 782749 - RNA, 16 nt, Human
uauacuguauuuuuac

SEQ ID NO: 782750 - RNA, 21 nt, Human
caccagucugacuguuuccau

SEQ ID NO: 782751 - RNA, 12 nt, Human
uucccugaccuc

SEQ ID NO: 782752 - RNA, 19 nt, Human
agaaauucugcaagcuuuu

SEQ ID NO: 782753 - RNA, 17 nt, Human
caaagcacgaaauguua

SEQ ID NO: 782754 - RNA, 19 nt, Human
uuauggcacuaguauuucu

SEQ ID NO: 782755 - RNA, 15 nt, Human
acauuuccaaauuca

SEQ ID NO: 782756 - RNA, 13 nt, Human
ugccaauauccua

SEQ ID NO: 782757 - RNA, 14 nt, Human
ucccucccuccacc

SEQ ID NO: 782758 - RNA, 20 nt, Human
uagcauauguuuuuguaagu

SEQ ID NO: 782759 - RNA, 14 nt, Human
acacuaacauauaa

SEQ ID NO: 782760 - RNA, 19 nt, Human
ucagugucaaugcagcccc

SEQ ID NO: 782761 - RNA, 13 nt, Human
aguguccucaucu

SEQ ID NO: 782762 - RNA, 21 nt, Human
uccugggcagcugccuccccu

SEQ ID NO: 782763 - RNA, 13 nt, Human
ggaaagggucucc

SEQ ID NO: 782764 - RNA, 19 nt, Human
ucaacauggugaaaccccg

SEQ ID NO: 782765 - RNA, 21 nt, Human
uuacauuuguauaaaauaauu

SEQ ID NO: 782766 - RNA, 21 nt, Human
uuaucuaucuaucuauuuauu

SEQ ID NO: 782767 - RNA, 22 nt, Human
gugaacaaauuuacagagacag

SEQ ID NO: 782768 - RNA, 21 nt, Human
cauuucaaaagguauuuauug

SEQ ID NO: 782769 - RNA, 14 nt, Human
ucaccuguuuuuaa

SEQ ID NO: 782770 - RNA, 22 nt, Human
caguauggcagcuuuccucaaa

SEQ ID NO: 782771 - RNA, 21 nt, Human
aauguuauuuuuuaauuauua

SEQ ID NO: 782772 - RNA, 21 nt, Human
auugaaaggcauucucugaag

SEQ ID NO: 782773 - RNA, 13 nt, Human
aaaaagccaaaaa

SEQ ID NO: 782774 - RNA, 16 nt, Human
agguacuucaaauccu

SEQ ID NO: 782775 - RNA, 21 nt, Human
uaaaaaggcauguaauugcuu

SEQ ID NO: 782776 - RNA, 14 nt, Human
accugcuguuuccu

SEQ ID NO: 782777 - RNA, 16 nt, Human
gaugaauguuaaauua

SEQ ID NO: 782778 - RNA, 19 nt, Human
auuugcaagacauagaaua

SEQ ID NO: 782779 - RNA, 15 nt, Human
uagaaggauguacau

SEQ ID NO: 782780 - RNA, 23 nt, Human
aaaucucuauuaggaaauauucu

SEQ ID NO: 782781 - RNA, 19 nt, Human
uauuauaauuuuuuucaau

SEQ ID NO: 782782 - RNA, 17 nt, Human
uuuccguggcacugcau

SEQ ID NO: 782783 - RNA, 21 nt, Human
ccugucccugcagacaugaga

SEQ ID NO: 782784 - RNA, 16 nt, Human
gucagaagaccugguc

SEQ ID NO: 782785 - RNA, 15 nt, Human
uccaagccucauguc

SEQ ID NO: 782786 - RNA, 15 nt, Human
ucauuuaaaauauuu

SEQ ID NO: 782787 - RNA, 22 nt, Human
uccugaccuaugaaacagagaa

SEQ ID NO: 782788 - RNA, 19 nt, Human
auauauuuauaacucauca

SEQ ID NO: 782789 - RNA, 13 nt, Human
acaugaagaagcu

SEQ ID NO: 782790 - RNA, 14 nt, Human
agcaaguauuagaa

SEQ ID NO: 782791 - RNA, 14 nt, Human
ggcgcgcgccacca

SEQ ID NO: 782792 - RNA, 22 nt, Human
ccggagccccuugggcagguca

SEQ ID NO: 782793 - RNA, 16 nt, Human
agagggaauugcagag

SEQ ID NO: 782794 - RNA, 16 nt, Human
uguggcauuuucacuu

SEQ ID NO: 782795 - RNA, 16 nt, Human
ucuaaaucuauuuauu

SEQ ID NO: 782796 - RNA, 22 nt, Human
aauaguguuggaaaaugugcaa

SEQ ID NO: 782797 - RNA, 18 nt, Human
uuuuuaauuauuauuuau

SEQ ID NO: 782798 - RNA, 13 nt, Human
cuaagaaauaugc

SEQ ID NO: 782799 - RNA, 21 nt, Human
uuccuggacaguuuucugcuu

SEQ ID NO: 782800 - RNA, 14 nt, Human
aagcacuuucccuc

SEQ ID NO: 782801 - RNA, 16 nt, Human
caccuguaaucccagc

SEQ ID NO: 782802 - RNA, 21 nt, Human
auauuucuuugccuuuauaau

SEQ ID NO: 782803 - RNA, 18 nt, Human
cugaccucccucuaauuu

SEQ ID NO: 782804 - RNA, 23 nt, Human
ugcaauauuugaauuuuaaaucu

SEQ ID NO: 782805 - RNA, 15 nt, Human
guaaggggaauugag

SEQ ID NO: 782806 - RNA, 17 nt, Human
aagcuugcaacaaaauu

SEQ ID NO: 782807 - RNA, 13 nt, Human
aaauaaaaauaaa

SEQ ID NO: 782808 - RNA, 14 nt, Human
cuguaaucacagcu

SEQ ID NO: 782809 - RNA, 21 nt, Human
aacuuuuguguaaugaaaaug

SEQ ID NO: 782810 - RNA, 18 nt, Human
aucuacacuccagugaga

SEQ ID NO: 782811 - RNA, 22 nt, Human
augagaccacuguuaucaaaac

SEQ ID NO: 782812 - RNA, 14 nt, Human
uauaauaugcacac

SEQ ID NO: 782813 - RNA, 16 nt, Human
cuuagacccucaugcu

SEQ ID NO: 782814 - RNA, 13 nt, Human
uuuuuuacuuccu

SEQ ID NO: 782815 - RNA, 20 nt, Human
uguauuuguuuguauuuugu

SEQ ID NO: 782816 - RNA, 15 nt, Human
aucaaccaaauggag

SEQ ID NO: 782817 - RNA, 13 nt, Human
ggccuggcuggga

SEQ ID NO: 782818 - RNA, 23 nt, Human
gcuauucacaaccacucauucaa

SEQ ID NO: 782819 - RNA, 23 nt, Human
cugcaauaaaauggguuuuacug

SEQ ID NO: 782820 - RNA, 13 nt, Human
uugcaaccuccac

SEQ ID NO: 782821 - RNA, 19 nt, Human
cauauguuuuuguaaguuu

SEQ ID NO: 782822 - RNA, 18 nt, Human
acagugucuuacagagaa

SEQ ID NO: 782823 - RNA, 16 nt, Human
uaugugcaauaaaaug

SEQ ID NO: 782824 - RNA, 14 nt, Human
uugacccacaagaa

SEQ ID NO: 782825 - RNA, 16 nt, Human
gcaggauagaguggga

SEQ ID NO: 782826 - RNA, 21 nt, Human
auuuauauauuuauaacucau

SEQ ID NO: 782827 - RNA, 21 nt, Human
ucaaaauuggacuuaaaaucu

SEQ ID NO: 782828 - RNA, 17 nt, Human
agugauuaccagggacu

SEQ ID NO: 782829 - RNA, 15 nt, Human
uuuccaaauucacaa

SEQ ID NO: 782830 - RNA, 16 nt, Human
aguucagagcugcccu

SEQ ID NO: 782831 - RNA, 12 nt, Human
agaccagccaac

SEQ ID NO: 782832 - RNA, 17 nt, Human
cugagaugggagaauca

SEQ ID NO: 782833 - RNA, 21 nt, Human
uuuuauggcacuaguauuucu

SEQ ID NO: 782834 - RNA, 19 nt, Human
uacauguuuucuuugcuuu

SEQ ID NO: 782835 - RNA, 15 nt, Human
aaauacaaaaauuag

SEQ ID NO: 782836 - RNA, 18 nt, Human
auuaugaucucagaaauu

SEQ ID NO: 782837 - RNA, 20 nt, Human
ugcuugccaucccucccucc

SEQ ID NO: 782838 - RNA, 19 nt, Human
auaauuuuuauauuugaaa

SEQ ID NO: 782839 - RNA, 16 nt, Human
cucaguguccucaucu

SEQ ID NO: 782840 - RNA, 14 nt, Human
aagacuaugaggaa

SEQ ID NO: 782841 - RNA, 12 nt, Human
uuauuauuuaua

SEQ ID NO: 782842 - RNA, 21 nt, Human
ugugauguggcaaaucucuau

SEQ ID NO: 782843 - RNA, 21 nt, Human
uauuacuguaagaaaauauca

SEQ ID NO: 782844 - RNA, 22 nt, Human
aaugggcacaggguuuauguuu

SEQ ID NO: 782845 - RNA, 19 nt, Human
agcuucucauccugcaggc

SEQ ID NO: 782846 - RNA, 14 nt, Human
uuuuaauuauuauu

SEQ ID NO: 782847 - RNA, 16 nt, Human
ggcagcugccuccccu

SEQ ID NO: 782848 - RNA, 17 nt, Human
auuuuaauuauuauucu

SEQ ID NO: 782849 - RNA, 11 nt, Human
augcugccaau

SEQ ID NO: 782850 - RNA, 23 nt, Human
uuuccaucaaggguacacugccu

SEQ ID NO: 782851 - RNA, 19 nt, Human
cuacuugggaggcugaggc

SEQ ID NO: 782852 - RNA, 13 nt, Human
cuauuuaaagaca

SEQ ID NO: 782853 - RNA, 14 nt, Human
cucuaggacauaaa

SEQ ID NO: 782854 - RNA, 22 nt, Human
gaugcaguuguugcccacagcu

SEQ ID NO: 782855 - RNA, 22 nt, Human
uacucugaagggcaucaugcau

SEQ ID NO: 782856 - RNA, 16 nt, Human
gacuggccugcuggau

SEQ ID NO: 782857 - RNA, 21 nt, Human
guuugacaagguucuucccuu

SEQ ID NO: 782858 - RNA, 23 nt, Human
aaaucuauuuauuaauauuuaac

SEQ ID NO: 782859 - RNA, 14 nt, Human
uguuguuauuuaaa

SEQ ID NO: 782860 - RNA, 15 nt, Human
cagugucaggaggaa

SEQ ID NO: 782861 - RNA, 15 nt, Human
acuucauuuaaaaua

SEQ ID NO: 782862 - RNA, 22 nt, Human
gaagaguggguuucacaaguga

SEQ ID NO: 782863 - RNA, 12 nt, Human
ucuacacuccag

SEQ ID NO: 782864 - RNA, 23 nt, Human
cagagguugcagugagccgagau

SEQ ID NO: 782865 - RNA, 23 nt, Human
aauauugcaaggcaaagacuauu

SEQ ID NO: 782866 - RNA, 23 nt, Human
cuugauaaauggcuuccuggcaa

SEQ ID NO: 782867 - RNA, 22 nt, Human
caagacucugucucaaaaaaua

SEQ ID NO: 782868 - RNA, 18 nt, Human
aaaaguucugcagauaaa

SEQ ID NO: 782869 - RNA, 17 nt, Human
gaacucugagcagugcu

SEQ ID NO: 782870 - RNA, 14 nt, Human
ggaguuccuaacca

SEQ ID NO: 782871 - RNA, 21 nt, Human
auaauuuuuuucaauauuuau

SEQ ID NO: 782872 - RNA, 20 nt, Human
ucauuccccaaccacuucau

SEQ ID NO: 782873 - RNA, 21 nt, Human
cacaacuauauuaucaugcaa

SEQ ID NO: 782874 - RNA, 12 nt, Human
cauuauauuuau

SEQ ID NO: 782875 - RNA, 18 nt, Human
ugaaaaaguucugcagau

SEQ ID NO: 782876 - RNA, 16 nt, Human
augcauacaguaauuu

SEQ ID NO: 782877 - RNA, 22 nt, Human
ucuacuaaaaauacaaaaaaaa

SEQ ID NO: 782878 - RNA, 11 nt, Human
aauaaauaaau

SEQ ID NO: 782879 - RNA, 19 nt, Human
ugggacaggggagaaccua

SEQ ID NO: 782880 - RNA, 13 nt, Human
gcugggaguggca

SEQ ID NO: 782881 - RNA, 17 nt, Human
agagacagaaagcagaa

SEQ ID NO: 782882 - RNA, 14 nt, Human
auuuaaaauauuuu

SEQ ID NO: 782883 - RNA, 15 nt, Human
gcacagccucuuaga

SEQ ID NO: 782884 - RNA, 23 nt, Human
ccuucauccucugagugugacca

SEQ ID NO: 782885 - RNA, 20 nt, Human
agcaaagacuaugaggaaua

SEQ ID NO: 782886 - RNA, 22 nt, Human
caaggcuuagacccucaugcug

SEQ ID NO: 782887 - RNA, 18 nt, Human
acucuaggacauaaauua

SEQ ID NO: 782888 - RNA, 14 nt, Human
gacaguuuuccuuc

SEQ ID NO: 782889 - RNA, 12 nt, Human
cucuaacucaga

SEQ ID NO: 782890 - RNA, 16 nt, Human
cuggacuuuccagaga

SEQ ID NO: 782891 - RNA, 22 nt, Human
ucauugcaaccuccaccuucug

SEQ ID NO: 782892 - RNA, 17 nt, Human
ggacacaggcuccaaac

SEQ ID NO: 782893 - RNA, 22 nt, Human
uaaacuggaaauaaaagauugu

SEQ ID NO: 782894 - RNA, 22 nt, Human
uuuaauaauguuucaaacauau

SEQ ID NO: 782895 - RNA, 23 nt, Human
caaggcuggagugcaguggcgca

SEQ ID NO: 782896 - RNA, 18 nt, Human
agugucaaugcagccccc

SEQ ID NO: 782897 - RNA, 15 nt, Human
uaacauagguuuuua

SEQ ID NO: 782898 - RNA, 19 nt, Human
ggcagugcuuggcccagga

SEQ ID NO: 782899 - RNA, 21 nt, Human
ugggaggcugagaugggagaa

SEQ ID NO: 782900 - RNA, 23 nt, Human
aauauuuuuaugugcaauaaaau

SEQ ID NO: 782901 - RNA, 15 nt, Human
ugcuguauuuuaaaa

SEQ ID NO: 782902 - RNA, 19 nt, Human
uccaccucccugcaauaaa

SEQ ID NO: 782903 - RNA, 16 nt, Human
uauguauuauuuauaa

SEQ ID NO: 782904 - RNA, 13 nt, Human
auagcauauguuu

SEQ ID NO: 782905 - RNA, 14 nt, Human
aaccugagccccaa

SEQ ID NO: 782906 - RNA, 18 nt, Human
auuucaugauuucauuuc

SEQ ID NO: 782907 - RNA, 22 nt, Human
auuuuuuaaguauuuauauauu

SEQ ID NO: 782908 - RNA, 19 nt, Human
guuagagauuuuuaaauaa

SEQ ID NO: 782909 - RNA, 21 nt, Human
cuaagauuuguaauauuucuc

SEQ ID NO: 782910 - RNA, 15 nt, Human
ccucuaaaaggccug

SEQ ID NO: 782911 - RNA, 19 nt, Human
ugaacaaauuuacagagac

SEQ ID NO: 782912 - RNA, 14 nt, Human
aauaguuuaugauu

SEQ ID NO: 782913 - RNA, 13 nt, Human
cuauggaaaaaaa

SEQ ID NO: 782914 - RNA, 13 nt, Human
cacuuucccucuu

SEQ ID NO: 782915 - RNA, 18 nt, Human
gcagugcuuggcccagga

SEQ ID NO: 782916 - RNA, 16 nt, Human
gacaaccaugagacca

SEQ ID NO: 782917 - RNA, 19 nt, Human
cuucauuuaaaauauuuuu

SEQ ID NO: 782918 - RNA, 13 nt, Human
aagugcugggaau

SEQ ID NO: 782919 - RNA, 14 nt, Human
agaugaacucaacu

SEQ ID NO: 782920 - RNA, 21 nt, Human
uucgcugauauauguguuuuu

SEQ ID NO: 782921 - RNA, 17 nt, Human
uaaaaggccugucccug

SEQ ID NO: 782922 - RNA, 15 nt, Human
aguucugaagaagau

SEQ ID NO: 782923 - RNA, 15 nt, Human
gacaguauggcagcu

SEQ ID NO: 782924 - RNA, 16 nt, Human
auauguaccauguaca

SEQ ID NO: 782925 - RNA, 18 nt, Human
gaaacguguauauuuuuu

SEQ ID NO: 782926 - RNA, 14 nt, Human
guauuuuaaaagaa

SEQ ID NO: 782927 - RNA, 20 nt, Human
cagccugagcgacagugaga

SEQ ID NO: 782928 - RNA, 15 nt, Human
augaauuaaguuuuu

SEQ ID NO: 782929 - RNA, 15 nt, Human
aauaaugaaauaacu

SEQ ID NO: 782930 - RNA, 18 nt, Human
caguuagagauuuuuaaa

SEQ ID NO: 782931 - RNA, 13 nt, Human
ggaaaauguguau

SEQ ID NO: 782932 - RNA, 17 nt, Human
agaaggauguacauuuc

SEQ ID NO: 782933 - RNA, 23 nt, Human
aucaccaaggcugauuaaaccaa

SEQ ID NO: 782934 - RNA, 13 nt, Human
aucucaauauuuc

SEQ ID NO: 782935 - RNA, 17 nt, Human
ugccuccccuccucugc

SEQ ID NO: 782936 - RNA, 22 nt, Human
cauuaaaacaauauuguuucua

SEQ ID NO: 782937 - RNA, 15 nt, Human
uguaccauguacaug

SEQ ID NO: 782938 - RNA, 19 nt, Human
uuuccugaaaacccuugcc

SEQ ID NO: 782939 - RNA, 19 nt, Human
uaguuuaugauuccaccua

SEQ ID NO: 782940 - RNA, 16 nt, Human
aauaucuauuaauaua

SEQ ID NO: 782941 - RNA, 17 nt, Human
auuucaugaaaagauua

SEQ ID NO: 782942 - RNA, 20 nt, Human
caggugacccugaugaaaac

SEQ ID NO: 782943 - RNA, 19 nt, Human
aguguuaucagucauaacu

SEQ ID NO: 782944 - RNA, 17 nt, Human
aaaccuuauuguaccuc

SEQ ID NO: 782945 - RNA, 15 nt, Human
acaaaaacaaacaaa

SEQ ID NO: 782946 - RNA, 18 nt, Human
cauaagggaggaaaaaaa

SEQ ID NO: 782947 - RNA, 17 nt, Human
auaguguuggaaaaugu

SEQ ID NO: 782948 - RNA, 15 nt, Human
acaagacccaaaagg

SEQ ID NO: 782949 - RNA, 20 nt, Human
aaguaaguuugauuucauua

SEQ ID NO: 782950 - RNA, 18 nt, Human
gcacuccagccugagcga

SEQ ID NO: 782951 - RNA, 15 nt, Human
auaucaauuuaaaaa

SEQ ID NO: 782952 - RNA, 21 nt, Human
uauuuauaacaaccuaaauuu

SEQ ID NO: 782953 - RNA, 23 nt, Human
guuucacaagugaaaaacaucca

SEQ ID NO: 782954 - RNA, 20 nt, Human
uuaaauggucaauuuuguua

SEQ ID NO: 782955 - RNA, 15 nt, Human
uuaauauuuaacauu

SEQ ID NO: 782956 - RNA, 18 nt, Human
ucacauuggcuauuuaaa

SEQ ID NO: 782957 - RNA, 19 nt, Human
aauauuauguuaaaacugg

SEQ ID NO: 782958 - RNA, 23 nt, Human
uuauaaauauauuuaagauaauu

SEQ ID NO: 782959 - RNA, 22 nt, Human
gagcugcccucuccugggcagc

SEQ ID NO: 782960 - RNA, 23 nt, Human
cucauguccacugguucuucuug

SEQ ID NO: 782961 - RNA, 14 nt, Human
cucugccucagaaa

SEQ ID NO: 782962 - RNA, 14 nt, Human
uaaauaguuuauga

SEQ ID NO: 782963 - RNA, 16 nt, Human
caaggguggguggggu

SEQ ID NO: 782964 - RNA, 17 nt, Human
acuuccagauccuggaa

SEQ ID NO: 782965 - RNA, 13 nt, Human
aaaaauacaaaaa

SEQ ID NO: 782966 - RNA, 13 nt, Human
uuuaaaaaaaaac

SEQ ID NO: 782967 - RNA, 16 nt, Human
uauauguguuuuucac

SEQ ID NO: 782968 - RNA, 17 nt, Human
uauugcugaaugacuac

SEQ ID NO: 782969 - RNA, 11 nt, Human
ugcuugccauc

SEQ ID NO: 782970 - RNA, 15 nt, Human
accaaucauuuuaau

SEQ ID NO: 782971 - RNA, 19 nt, Human
uaaauguaucuuauucaca

SEQ ID NO: 782972 - RNA, 17 nt, Human
caccagggccuggcugg

SEQ ID NO: 782973 - RNA, 21 nt, Human
uugccaugcuggccaggcugg

SEQ ID NO: 782974 - RNA, 18 nt, Human
ccucuccugggcagcugc

SEQ ID NO: 782975 - RNA, 18 nt, Human
gguuaagcacuuuaacac

SEQ ID NO: 782976 - RNA, 11 nt, Human
cgaaauguuau

SEQ ID NO: 782977 - RNA, 12 nt, Human
uuguuuuuccac

SEQ ID NO: 782978 - RNA, 16 nt, Human
ucaguguccucaucug

SEQ ID NO: 782979 - RNA, 18 nt, Human
guuggaaaaugugcaaua

SEQ ID NO: 782980 - RNA, 18 nt, Human
caguucauauguaccaug

SEQ ID NO: 782981 - RNA, 18 nt, Human
uggaauauguaaauagaa

SEQ ID NO: 782982 - RNA, 19 nt, Human
aauucuaaaugaauguuua

SEQ ID NO: 782983 - RNA, 18 nt, Human
cugggaauuacaggcgug

SEQ ID NO: 782984 - RNA, 23 nt, Human
uccguggcacugcauacaaucug

SEQ ID NO: 782985 - RNA, 13 nt, Human
acuucacuuuuuu

SEQ ID NO: 782986 - RNA, 13 nt, Human
uugcaagacauag

SEQ ID NO: 782987 - RNA, 16 nt, Human
uauaucaauuuaaaaa

SEQ ID NO: 782988 - RNA, 18 nt, Human
aucauuucaaaacucauu

SEQ ID NO: 782989 - RNA, 19 nt, Human
uacugagccuuguaauucu

SEQ ID NO: 782990 - RNA, 13 nt, Human
ugagccaccaaac

SEQ ID NO: 782991 - RNA, 15 nt, Human
cugcuggauguggag

SEQ ID NO: 782992 - RNA, 18 nt, Human
gagcgacagugagacucu

SEQ ID NO: 782993 - RNA, 17 nt, Human
uggcuaagcaaaaugug

SEQ ID NO: 782994 - RNA, 18 nt, Human
ccuguaaucauauaauaa

SEQ ID NO: 782995 - RNA, 20 nt, Human
aaucuuucacaggggacagg

SEQ ID NO: 782996 - RNA, 16 nt, Human
acuuaaaaucuaauuc

SEQ ID NO: 782997 - RNA, 20 nt, Human
aauauauguauuauuuauaa

SEQ ID NO: 782998 - RNA, 17 nt, Human
aagcccaauauuauaau

SEQ ID NO: 782999 - RNA, 22 nt, Human
gaguggcgcgcgccaccacgcc

SEQ ID NO: 783000 - RNA, 21 nt, Human
uauaauaaauguacauuaauu

SEQ ID NO: 783001 - RNA, 19 nt, Human
uuaaacaaaaaaagcauug

SEQ ID NO: 783002 - RNA, 12 nt, Human
gcaguuuuccau

SEQ ID NO: 783003 - RNA, 21 nt, Human
aauuaggcaaggcuaugugau

SEQ ID NO: 783004 - RNA, 20 nt, Human
aauuuuuucucuaggaaaua

SEQ ID NO: 783005 - RNA, 15 nt, Human
ucuauuuauuaauau

SEQ ID NO: 783006 - RNA, 15 nt, Human
uuuaccuuuuuccuu

SEQ ID NO: 783007 - RNA, 19 nt, Human
uagaaaaagcaguaacuga

SEQ ID NO: 783008 - RNA, 18 nt, Human
uaguaucaaaagaaagaa

SEQ ID NO: 783009 - RNA, 17 nt, Human
cuccuguacuuuuucca

SEQ ID NO: 783010 - RNA, 22 nt, Human
agugucuuacagagaaaagaca

SEQ ID NO: 783011 - RNA, 23 nt, Human
cugggguggguggggcagugcuu

SEQ ID NO: 783012 - RNA, 17 nt, Human
aacguguauauuuuuua

SEQ ID NO: 783013 - RNA, 17 nt, Human
cauggagguuaagcacu

SEQ ID NO: 783014 - RNA, 18 nt, Human
acucauugcaaccuccac

SEQ ID NO: 783015 - RNA, 21 nt, Human
uuucaaaacucauuuccuaug

SEQ ID NO: 783016 - RNA, 22 nt, Human
gucacaggaaguagaggaggcc

SEQ ID NO: 783017 - RNA, 23 nt, Human
uaaauauacuccuaguaauuuaa

SEQ ID NO: 783018 - RNA, 18 nt, Human
cagagcugcccucuccug

SEQ ID NO: 783019 - RNA, 18 nt, Human
uuauuuagggaacugcuu

SEQ ID NO: 783020 - RNA, 14 nt, Human
acucagaaacauca

SEQ ID NO: 783021 - RNA, 21 nt, Human
auauuuauaacucaucauaaa

SEQ ID NO: 783022 - RNA, 16 nt, Human
cagcugccuccccucc

SEQ ID NO: 783023 - RNA, 14 nt, Human
acaguaauuuuaag

SEQ ID NO: 783024 - RNA, 17 nt, Human
cauuguuugucugucuu

SEQ ID NO: 783025 - RNA, 21 nt, Human
ucaauagaaggauguacauuu

SEQ ID NO: 783026 - RNA, 16 nt, Human
gccuaagugcagcccc

SEQ ID NO: 783027 - RNA, 21 nt, Human
uggcuuaaaauguaauuaauc

SEQ ID NO: 783028 - RNA, 15 nt, Human
cagaccauaauguua

SEQ ID NO: 783029 - RNA, 23 nt, Human
auaucuuuuuuuuaauaaaccau

SEQ ID NO: 783030 - RNA, 15 nt, Human
acagaagcuuccauu

SEQ ID NO: 783031 - RNA, 23 nt, Human
cgggguuugccaugcuggccagg

SEQ ID NO: 783032 - RNA, 18 nt, Human
gccuggucaacaugguga

SEQ ID NO: 783033 - RNA, 20 nt, Human
auaacaaugcuguauuuuaa

SEQ ID NO: 783034 - RNA, 18 nt, Human
ucuaugaaauauuauguu

SEQ ID NO: 783035 - RNA, 21 nt, Human
auugaaaugacuaaaaaacaa

SEQ ID NO: 783036 - RNA, 17 nt, Human
cuuuagggaccugcugu

SEQ ID NO: 783037 - RNA, 18 nt, Human
gaagcaaaauuuuuucuc

SEQ ID NO: 783038 - RNA, 19 nt, Human
cagcuuuuucucucccacu

SEQ ID NO: 783039 - RNA, 23 nt, Human
caucauaaaauaaaguauauaua

SEQ ID NO: 783040 - RNA, 14 nt, Human
uauaaucuuuuaua

SEQ ID NO: 783041 - RNA, 15 nt, Human
uaugaaacauuacag

SEQ ID NO: 783042 - RNA, 12 nt, Human
aauuagaugaac

SEQ ID NO: 783043 - RNA, 13 nt, Human
acuaaaaaacaaa

SEQ ID NO: 783044 - RNA, 16 nt, Human
ugccuccccuccucug

SEQ ID NO: 783045 - RNA, 13 nt, Human
cugagagugaaca

SEQ ID NO: 783046 - RNA, 14 nt, Human
auuggacuuaaaau

SEQ ID NO: 783047 - RNA, 17 nt, Human
aaauaaagaauuuuaaa

SEQ ID NO: 783048 - RNA, 16 nt, Human
uaacucagaaacauca

SEQ ID NO: 783049 - RNA, 23 nt, Human
auucaauaucuuuuuuuuaauaa

SEQ ID NO: 783050 - RNA, 20 nt, Human
ggcaggucacacaaccuguc

SEQ ID NO: 783051 - RNA, 17 nt, Human
auagaauggaacucaag

SEQ ID NO: 783052 - RNA, 14 nt, Human
accacaagacugca

SEQ ID NO: 783053 - RNA, 16 nt, Human
auuucuauuuauuuac

SEQ ID NO: 783054 - RNA, 15 nt, Human
gaaaugaaagcaggg

SEQ ID NO: 783055 - RNA, 17 nt, Human
uucaaaaguugaaauua

SEQ ID NO: 783056 - RNA, 23 nt, Human
ccacuucauucuugaaagcugug

SEQ ID NO: 783057 - RNA, 21 nt, Human
cucagugucaaugcagccccc

SEQ ID NO: 783058 - RNA, 23 nt, Human
ucgcugauauauguguuuuucac

SEQ ID NO: 783059 - RNA, 22 nt, Human
uugcaagacauagaauaguguu

SEQ ID NO: 783060 - RNA, 22 nt, Human
aguguugacaguucauauguac

SEQ ID NO: 783061 - RNA, 20 nt, Human
uaauaaauguacauuaauua

SEQ ID NO: 783062 - RNA, 18 nt, Human
gaggcugaggcgggugga

SEQ ID NO: 783063 - RNA, 19 nt, Human
ugugaaaaaaaauuuuaua

SEQ ID NO: 783064 - RNA, 23 nt, Human
cugcccucuccugggcagcugcc

SEQ ID NO: 783065 - RNA, 14 nt, Human
agaauauuagcuuu

SEQ ID NO: 783066 - RNA, 12 nt, Human
gcgugcaggcag

SEQ ID NO: 783067 - RNA, 18 nt, Human
cuaaaaaggcauguaauu

SEQ ID NO: 783068 - RNA, 15 nt, Human
acaaccugucccagc

SEQ ID NO: 783069 - RNA, 20 nt, Human
aagaugguaccaccagucug

SEQ ID NO: 783070 - RNA, 18 nt, Human
aaaagccaaaaaccaaau

SEQ ID NO: 783071 - RNA, 21 nt, Human
acagcccuucuuuccacagaa

SEQ ID NO: 783072 - RNA, 15 nt, Human
acucugagcagugcu

SEQ ID NO: 783073 - RNA, 14 nt, Human
uccagauccuggaa

SEQ ID NO: 783074 - RNA, 17 nt, Human
cugaugaauguuaaauu

SEQ ID NO: 783075 - RNA, 20 nt, Human
auugguuuaccugugaaaua

SEQ ID NO: 783076 - RNA, 18 nt, Human
augcccaagaaugagaag

SEQ ID NO: 783077 - RNA, 20 nt, Human
caauucuauuacgugcaaua

SEQ ID NO: 783078 - RNA, 13 nt, Human
gccucaguuuccu

SEQ ID NO: 783079 - RNA, 20 nt, Human
uauaauaaauguacauuaau

SEQ ID NO: 783080 - RNA, 18 nt, Human
caagccucauguccacug

SEQ ID NO: 783081 - RNA, 18 nt, Human
cacuuuuggcuuguaaag

SEQ ID NO: 783082 - RNA, 15 nt, Human
ggcugggaguggcau

SEQ ID NO: 783083 - RNA, 9 nt, Human
uccucugcu

SEQ ID NO: 783084 - RNA, 15 nt, Human
aaagaaagaaaauca

SEQ ID NO: 783085 - RNA, 18 nt, Human
gagcccuucaugcauuug

SEQ ID NO: 783086 - RNA, 19 nt, Human
gaauggaacucaaggaaau

SEQ ID NO: 783087 - RNA, 16 nt, Human
aaauaaugaaauaacu

SEQ ID NO: 783088 - RNA, 17 nt, Human
uugccaucccucccucc

SEQ ID NO: 783089 - RNA, 23 nt, Human
caucaacagauaaauaguuuaug

SEQ ID NO: 783090 - RNA, 14 nt, Human
uguaacugcauuga

SEQ ID NO: 783091 - RNA, 23 nt, Human
cauucucucuccuguacuuuuuc

SEQ ID NO: 783092 - RNA, 19 nt, Human
uuaauauauguauuauuua

SEQ ID NO: 783093 - RNA, 23 nt, Human
cagacuuuuuuuuuuuuuuaaac

SEQ ID NO: 783094 - RNA, 13 nt, Human
uauuuauuuuaau

SEQ ID NO: 783095 - RNA, 23 nt, Human
ccugacagcccaagggugggugg

SEQ ID NO: 783096 - RNA, 18 nt, Human
aauucacaaguuguguuu

SEQ ID NO: 783097 - RNA, 22 nt, Human
cuaauugaaucccuuaaacuca

SEQ ID NO: 783098 - RNA, 16 nt, Human
gagcucgugggacagu

SEQ ID NO: 783099 - RNA, 21 nt, Human
uccucugcuugccaucccucc

SEQ ID NO: 783100 - RNA, 21 nt, Human
ucuuuguaagaguggaaccaa

SEQ ID NO: 783101 - RNA, 11 nt, Human
ugggcagcugc

SEQ ID NO: 783102 - RNA, 11 nt, Human
aggaguuuggc

SEQ ID NO: 783103 - RNA, 18 nt, Human
aauuccaccugcaaucaa

SEQ ID NO: 783104 - RNA, 14 nt, Human
ucuacuuuuaaguu

SEQ ID NO: 783105 - RNA, 21 nt, Human
ggaaaggaguagaaaaagcag

SEQ ID NO: 783106 - RNA, 16 nt, Human
aaucuaauucaaacua

SEQ ID NO: 783107 - RNA, 15 nt, Human
accacuguuaucaaa

SEQ ID NO: 783108 - RNA, 14 nt, Human
uugaggacuugggc

SEQ ID NO: 783109 - RNA, 16 nt, Human
auaacuggaaacuuca

SEQ ID NO: 783110 - RNA, 14 nt, Human
auuccaccugcaau

SEQ ID NO: 783111 - RNA, 20 nt, Human
agugauacuauccaguuacu

SEQ ID NO: 783112 - RNA, 22 nt, Human
ugaagcaaaauuuuuucucuag

SEQ ID NO: 783113 - RNA, 17 nt, Human
aagaaaggccagcaaau

SEQ ID NO: 783114 - RNA, 14 nt, Human
aacugcuggauuca

SEQ ID NO: 783115 - RNA, 15 nt, Human
uccccuccucugcuu

SEQ ID NO: 783116 - RNA, 16 nt, Human
ucccuccaccucccug

SEQ ID NO: 783117 - RNA, 18 nt, Human
cuggaaacuucagcgguu

SEQ ID NO: 783118 - RNA, 19 nt, Human
aagcgauucucuuuauuca

SEQ ID NO: 783119 - RNA, 22 nt, Human
agacucugucucaaaaaauaaa

SEQ ID NO: 783120 - RNA, 12 nt, Human
agcaguaacuga

SEQ ID NO: 783121 - RNA, 15 nt, Human
ggucucgaacugcug

SEQ ID NO: 783122 - RNA, 16 nt, Human
agugucaaugcagccc

SEQ ID NO: 783123 - RNA, 19 nt, Human
cuaaaauuagaugaacuca

SEQ ID NO: 783124 - RNA, 18 nt, Human
cuuguaauucuaaaugaa

SEQ ID NO: 783125 - RNA, 14 nt, Human
uuauuuuuuaagua

SEQ ID NO: 783126 - RNA, 21 nt, Human
cuaccuuuugcuguggcaaau

SEQ ID NO: 783127 - RNA, 23 nt, Human
ugccucuaaaaggccugucccug

SEQ ID NO: 783128 - RNA, 19 nt, Human
gguauuuauugagcaccug

SEQ ID NO: 783129 - RNA, 18 nt, Human
ucugaugagaacucugag

SEQ ID NO: 783130 - RNA, 17 nt, Human
aauuucaugaaaagauu

SEQ ID NO: 783131 - RNA, 16 nt, Human
uuaaagaauuuucaaa

SEQ ID NO: 783132 - RNA, 21 nt, Human
ccauccugccccugagcccau

SEQ ID NO: 783133 - RNA, 13 nt, Human
caaauuuguauuu

SEQ ID NO: 783134 - RNA, 17 nt, Human
uauaauuuuuuucaaua

SEQ ID NO: 783135 - RNA, 14 nt, Human
uucaauauuuauua

SEQ ID NO: 783136 - RNA, 17 nt, Human
gucauaacuaaauaaag

SEQ ID NO: 783137 - RNA, 13 nt, Human
uuauucacaagac

SEQ ID NO: 783138 - RNA, 19 nt, Human
gagugacuuaguguacaug

SEQ ID NO: 783139 - RNA, 15 nt, Human
gcagagguugcagug

SEQ ID NO: 783140 - RNA, 14 nt, Human
aucaccaaggcuga

SEQ ID NO: 783141 - RNA, 19 nt, Human
ugcuuguuagcaaaaugga

SEQ ID NO: 783142 - RNA, 14 nt, Human
auuaauucaccuuc

SEQ ID NO: 783143 - RNA, 14 nt, Human
aauggcuaagcaaa

SEQ ID NO: 783144 - RNA, 12 nt, Human
guguauauuuuu

SEQ ID NO: 783145 - RNA, 17 nt, Human
cugggucucaguguccu

SEQ ID NO: 783146 - RNA, 15 nt, Human
uauaauuuuuuucaa

SEQ ID NO: 783147 - RNA, 15 nt, Human
caucaguuacucuga

SEQ ID NO: 783148 - RNA, 13 nt, Human
aguuaccucugcc

SEQ ID NO: 783149 - RNA, 17 nt, Human
ugaucagaccauaaugu

SEQ ID NO: 783150 - RNA, 16 nt, Human
caaauggaaaguaacu

SEQ ID NO: 783151 - RNA, 22 nt, Human
gaaacuaccagcccuacaccau

SEQ ID NO: 783152 - RNA, 14 nt, Human
aaaggccugucccu

SEQ ID NO: 783153 - RNA, 23 nt, Human
gauauuaaccaggggccaugaau

SEQ ID NO: 783154 - RNA, 15 nt, Human
gccuccccuccucug

SEQ ID NO: 783155 - RNA, 21 nt, Human
aauuaaguuuuuuuuuaaaaa

SEQ ID NO: 783156 - RNA, 23 nt, Human
cuaguaauuggaaaggcagcucu

SEQ ID NO: 783157 - RNA, 20 nt, Human
aagggcuguuauaaucuuuc

SEQ ID NO: 783158 - RNA, 13 nt, Human
gaggcaagagaau

SEQ ID NO: 783159 - RNA, 20 nt, Human
cugcaauauuugaauuuuaa

SEQ ID NO: 783160 - RNA, 21 nt, Human
ugaauuuuucucuaacucaga

SEQ ID NO: 783161 - RNA, 21 nt, Human
gccugauuaaaguuaaauaaa

SEQ ID NO: 783162 - RNA, 13 nt, Human
ugaaaugcagagu

SEQ ID NO: 783163 - RNA, 13 nt, Human
cauuuguauaaaa

SEQ ID NO: 783164 - RNA, 22 nt, Human
ggacagcccuucuuuccacaga

SEQ ID NO: 783165 - RNA, 14 nt, Human
aaaagaaagaaaau

SEQ ID NO: 783166 - RNA, 16 nt, Human
uugucaauaaaaucca

SEQ ID NO: 783167 - RNA, 20 nt, Human
auauguaccauguacaugaa

SEQ ID NO: 783168 - RNA, 22 nt, Human
augcccaagaaugagaagaaug

SEQ ID NO: 783169 - RNA, 13 nt, Human
auuucaacuguuu

SEQ ID NO: 783170 - RNA, 20 nt, Human
ugagaccacuguuaucaaaa

SEQ ID NO: 783171 - RNA, 16 nt, Human
ccaucccucccuccac

SEQ ID NO: 783172 - RNA, 21 nt, Human
cgaaguauccuucagccugaa

SEQ ID NO: 783173 - RNA, 13 nt, Human
gcuugccugcagg

SEQ ID NO: 783174 - RNA, 12 nt, Human
auagaauauuua

SEQ ID NO: 783175 - RNA, 18 nt, Human
auaauguuguuauuuaaa

SEQ ID NO: 783176 - RNA, 23 nt, Human
cuugccaucccucccuccaccuc

SEQ ID NO: 783177 - RNA, 16 nt, Human
aaguaauuucagaaga

SEQ ID NO: 783178 - RNA, 23 nt, Human
ucuuagaugcaguucugaagaag

SEQ ID NO: 783179 - RNA, 17 nt, Human
aaucuuucacaggggac

SEQ ID NO: 783180 - RNA, 20 nt, Human
cagcaggucucaugggggug

SEQ ID NO: 783181 - RNA, 18 nt, Human
cucuauguucuaagaagu

SEQ ID NO: 783182 - RNA, 18 nt, Human
guuuaugcauacaguaau

SEQ ID NO: 783183 - RNA, 15 nt, Human
ucugcagauaaacag

SEQ ID NO: 783184 - RNA, 18 nt, Human
ccugaaagaggaaugaag

SEQ ID NO: 783185 - RNA, 22 nt, Human
auuacaggcgugagccaccaaa

SEQ ID NO: 783186 - RNA, 19 nt, Human
uuuaaaaaaaaaaaaaaag

SEQ ID NO: 783187 - RNA, 14 nt, Human
uaguuucccuugca

SEQ ID NO: 783188 - RNA, 14 nt, Human
acuuauugacuauu

SEQ ID NO: 783189 - RNA, 13 nt, Human
guuacucugaagg

SEQ ID NO: 783190 - RNA, 15 nt, Human
gcugcccucuccugg

SEQ ID NO: 783191 - RNA, 14 nt, Human
gaugcuuguauuuu

SEQ ID NO: 783192 - RNA, 15 nt, Human
ccuguacuccagccu

SEQ ID NO: 783193 - RNA, 24 nt, Human
uucacuuuuggcuuguaaaguaca

SEQ ID NO: 783194 - RNA, 22 nt, Human
guaaguuuaugcauacaguaau

SEQ ID NO: 783195 - RNA, 17 nt, Human
gccugagcgacagugag

SEQ ID NO: 783196 - RNA, 21 nt, Human
ugaacugauggguuucuccag

SEQ ID NO: 783197 - RNA, 18 nt, Human
uauuuauuuuuuuacuuc

SEQ ID NO: 783198 - RNA, 14 nt, Human
aauguaucuuauuc

SEQ ID NO: 783199 - RNA, 17 nt, Human
gacaguuccugagacca

SEQ ID NO: 783200 - RNA, 16 nt, Human
cugccuccccuccucu

SEQ ID NO: 783201 - RNA, 19 nt, Human
gcuaccuuuugcuguggca

SEQ ID NO: 783202 - RNA, 18 nt, Human
cugauauauguguuuuuc

SEQ ID NO: 783203 - RNA, 17 nt, Human
auugagcaccugcaggc

SEQ ID NO: 783204 - RNA, 16 nt, Human
aguagauuaagagaug

SEQ ID NO: 783205 - RNA, 14 nt, Human
caagacucugucuc

SEQ ID NO: 783206 - RNA, 23 nt, Human
cauagauguagauaaacucagaa

SEQ ID NO: 783207 - RNA, 18 nt, Human
agcaaauguuaugcauaa

SEQ ID NO: 783208 - RNA, 12 nt, Human
acacuuaaaaau

SEQ ID NO: 783209 - RNA, 19 nt, Human
gaacacccuauauuuugca

SEQ ID NO: 783210 - RNA, 22 nt, Human
ugccuccccuccucugcuugcc

SEQ ID NO: 783211 - RNA, 18 nt, Human
cuuaguguacaugaaagc

SEQ ID NO: 783212 - RNA, 20 nt, Human
ggcuggagugcaguggcgca

SEQ ID NO: 783213 - RNA, 13 nt, Human
uauuuauauauuu

SEQ ID NO: 783214 - RNA, 15 nt, Human
caagacucugucuca

SEQ ID NO: 783215 - RNA, 23 nt, Human
uauuucucucuuuuuagagaaau

SEQ ID NO: 783216 - RNA, 14 nt, Human
aaauaaaagcacuu

SEQ ID NO: 783217 - RNA, 17 nt, Human
guguauuuucagcagag

SEQ ID NO: 783218 - RNA, 16 nt, Human
cugauacuuuuuucau

SEQ ID NO: 783219 - RNA, 21 nt, Human
auuuguauaaaauaauuuuua

SEQ ID NO: 783220 - RNA, 22 nt, Human
cugaggcauccuuccucacacc

SEQ ID NO: 783221 - RNA, 22 nt, Human
auuuauauggggaauauauuuu

SEQ ID NO: 783222 - RNA, 22 nt, Human
gucucccucuguugccaaggcu

SEQ ID NO: 783223 - RNA, 15 nt, Human
guuuccuagcgcagc

SEQ ID NO: 783224 - RNA, 20 nt, Human
ugaccaggcauccuccacaa

SEQ ID NO: 783225 - RNA, 22 nt, Human
cugauauauguguuuuucacau

SEQ ID NO: 783226 - RNA, 23 nt, Human
ccucuguugccaaggcuggagug

SEQ ID NO: 783227 - RNA, 14 nt, Human
agguugcagugagc

SEQ ID NO: 783228 - RNA, 16 nt, Human
ucaucaaucaaauaag

SEQ ID NO: 783229 - RNA, 14 nt, Human
auauuuaacauuau

SEQ ID NO: 783230 - RNA, 20 nt, Human
auuacuguaagaaaauauca

SEQ ID NO: 783231 - RNA, 16 nt, Human
uauguaccauguacau

SEQ ID NO: 783232 - RNA, 16 nt, Human
ccuaagugcagccccg

SEQ ID NO: 783233 - RNA, 16 nt, Human
uagagugggacaguuc

SEQ ID NO: 783234 - RNA, 16 nt, Human
auugcugaaugacuac

SEQ ID NO: 783235 - RNA, 15 nt, Human
cauagccaggaaacu

SEQ ID NO: 783236 - RNA, 17 nt, Human
uagcauaaguuucuggg

SEQ ID NO: 783237 - RNA, 14 nt, Human
cacaaaauugggaa

SEQ ID NO: 783238 - RNA, 18 nt, Human
aggaaggcuuacacccac

SEQ ID NO: 783239 - RNA, 14 nt, Human
auggugugcuggcu

SEQ ID NO: 783240 - RNA, 22 nt, Human
caagagaauugcuugaacccag

SEQ ID NO: 783241 - RNA, 18 nt, Human
aaauugaaaggcauucuc

SEQ ID NO: 783242 - RNA, 18 nt, Human
auuuuuaaauaaagaauu

SEQ ID NO: 783243 - RNA, 11 nt, Human
guuuuaucauu

SEQ ID NO: 783244 - RNA, 13 nt, Human
ugccugcaggcau

SEQ ID NO: 783245 - RNA, 17 nt, Human
acacuaagagagaauga

SEQ ID NO: 783246 - RNA, 21 nt, Human
augcaucuuacugaagguaaa

SEQ ID NO: 783247 - RNA, 13 nt, Human
gaaaauaugccug

SEQ ID NO: 783248 - RNA, 17 nt, Human
guguaaugaaaaugaau

SEQ ID NO: 783249 - RNA, 15 nt, Human
uaucuauuaauauau

SEQ ID NO: 783250 - RNA, 16 nt, Human
gaagagaaaccaggga

SEQ ID NO: 783251 - RNA, 18 nt, Human
ggacacaggcuccaaacu

SEQ ID NO: 783252 - RNA, 15 nt, Human
uguguuuauuucacu

SEQ ID NO: 783253 - RNA, 22 nt, Human
uuuauggcacuaguauuucuau

SEQ ID NO: 783254 - RNA, 17 nt, Human
ugguaaaauacuucuug

SEQ ID NO: 783255 - RNA, 19 nt, Human
cuaguaucaaaagaaagaa

SEQ ID NO: 783256 - RNA, 15 nt, Human
uuugaaaauaugccu

SEQ ID NO: 783257 - RNA, 16 nt, Human
aaaaauacaaaaauua

SEQ ID NO: 783258 - RNA, 14 nt, Human
acucuauagacucu

SEQ ID NO: 783259 - RNA, 19 nt, Human
gauuuuuaaauaaagaauu

SEQ ID NO: 783260 - RNA, 13 nt, Human
ccuccccuccucu

SEQ ID NO: 783261 - RNA, 18 nt, Human
ugugaccacugcagaaga

SEQ ID NO: 783262 - RNA, 20 nt, Human
uaggaauugacccacaagaa

SEQ ID NO: 783263 - RNA, 21 nt, Human
gaagaaauuccaggaaaaucu

SEQ ID NO: 783264 - RNA, 21 nt, Human
aauacuucauuuaaaauauuu

SEQ ID NO: 783265 - RNA, 11 nt, Human
aaggcuggagu

SEQ ID NO: 783266 - RNA, 18 nt, Human
ccuguuuuuaagcuguuu

SEQ ID NO: 783267 - RNA, 13 nt, Human
aacacaacuauau

SEQ ID NO: 783268 - RNA, 12 nt, Human
uagggaccugcu

SEQ ID NO: 783269 - RNA, 21 nt, Human
uauauauguauuuauaaauau

SEQ ID NO: 783270 - RNA, 17 nt, Human
aaaaguauaaauaaaau

SEQ ID NO: 783271 - RNA, 18 nt, Human
acuuuuguguaaugaaaa

SEQ ID NO: 783272 - RNA, 14 nt, Human
uuucacaagugaaa

SEQ ID NO: 783273 - RNA, 14 nt, Human
ugcuucuguuuuau

SEQ ID NO: 783274 - RNA, 20 nt, Human
caccagagauaauaugagaa

SEQ ID NO: 783275 - RNA, 15 nt, Human
acuuaugaaccuuua

SEQ ID NO: 783276 - RNA, 19 nt, Human
uacaaaaaaaaaaaaaaau

SEQ ID NO: 783277 - RNA, 12 nt, Human
gcuguugagcug

SEQ ID NO: 783278 - RNA, 14 nt, Human
uugccugcaggcau

SEQ ID NO: 783279 - RNA, 17 nt, Human
uauuucuuugccuuuau

SEQ ID NO: 783280 - RNA, 14 nt, Human
aaacaaaaaaagca

SEQ ID NO: 783281 - RNA, 15 nt, Human
aucuaauauauauga

SEQ ID NO: 783282 - RNA, 12 nt, Human
aaaugaaagcag

SEQ ID NO: 783283 - RNA, 22 nt, Human
uacuccuaguaauuuaagauuu

SEQ ID NO: 783284 - RNA, 15 nt, Human
ccuccccuccucugc

SEQ ID NO: 783285 - RNA, 14 nt, Human
cuggagcucugccc

SEQ ID NO: 783286 - RNA, 17 nt, Human
gagggggcgcgugcagg

SEQ ID NO: 783287 - RNA, 16 nt, Human
acuucacuuuuuuucu

SEQ ID NO: 783288 - RNA, 14 nt, Human
aauugcagaguacu

SEQ ID NO: 783289 - RNA, 17 nt, Human
aauauuuauuaccucug

SEQ ID NO: 783290 - RNA, 13 nt, Human
uuuaaacaaaaaa

SEQ ID NO: 783291 - RNA, 12 nt, Human
cuucucuuaaac

SEQ ID NO: 783292 - RNA, 18 nt, Human
auuuauuacuguaagaaa

SEQ ID NO: 783293 - RNA, 13 nt, Human
agagcaagacucu

SEQ ID NO: 783294 - RNA, 15 nt, Human
cugaggcaagagaau

SEQ ID NO: 783295 - RNA, 18 nt, Human
uaauuuugaauaaauaaa

SEQ ID NO: 783296 - RNA, 15 nt, Human
acaucaacagauaaa

SEQ ID NO: 783297 - RNA, 21 nt, Human
auucauagcagcuuauucaca

SEQ ID NO: 783298 - RNA, 21 nt, Human
gacagaaagcagaacagugau

SEQ ID NO: 783299 - RNA, 15 nt, Human
auuuuaaaagaauga

SEQ ID NO: 783300 - RNA, 20 nt, Human
aaauccuugaagauuuacca

SEQ ID NO: 783301 - RNA, 15 nt, Human
cugcagauaaacagu

SEQ ID NO: 783302 - RNA, 22 nt, Human
gccaauauccuaauaaaaaggu

SEQ ID NO: 783303 - RNA, 13 nt, Human
auaucuaauauau

SEQ ID NO: 783304 - RNA, 20 nt, Human
augguuuagaaagcuugccc

SEQ ID NO: 783305 - RNA, 15 nt, Human
uuaaagacaaagaca

SEQ ID NO: 783306 - RNA, 23 nt, Human
uuuguauaaaauaauuuuuauau

SEQ ID NO: 783307 - RNA, 22 nt, Human
aaugaaagaaaggccagcaaau

SEQ ID NO: 783308 - RNA, 17 nt, Human
ugaaauggugaaaugca

SEQ ID NO: 783309 - RNA, 20 nt, Human
ggcuuagacccucaugcugc

SEQ ID NO: 783310 - RNA, 19 nt, Human
ggaaaggagaaguuaagca

SEQ ID NO: 783311 - RNA, 10 nt, Human
auaacucauc

SEQ ID NO: 783312 - RNA, 21 nt, Human
auucagagcuuacuuaaaauu

SEQ ID NO: 783313 - RNA, 16 nt, Human
caccacccuugccaug

SEQ ID NO: 783314 - RNA, 16 nt, Human
uguauuuauuuuuuua

SEQ ID NO: 783315 - RNA, 20 nt, Human
cagaaacaucaguuacucug

SEQ ID NO: 783316 - RNA, 20 nt, Human
ugagagacacacugaagaag

SEQ ID NO: 783317 - RNA, 17 nt, Human
aucaaggguacacugcc

SEQ ID NO: 783318 - RNA, 14 nt, Human
uaccuuuuuccuuc

SEQ ID NO: 783319 - RNA, 13 nt, Human
cauuucuauuuau

SEQ ID NO: 783320 - RNA, 20 nt, Human
acuuaccugggcauucuugu

SEQ ID NO: 783321 - RNA, 20 nt, Human
acuuugugaaaaaaaauuuu

SEQ ID NO: 783322 - RNA, 17 nt, Human
gcuuuauuuuuuaagua

SEQ ID NO: 783323 - RNA, 13 nt, Human
uaauuuuaaguaa

SEQ ID NO: 783324 - RNA, 17 nt, Human
ggcgcgugcaggcagca

SEQ ID NO: 783325 - RNA, 19 nt, Human
auuacagaugggcaaauua

SEQ ID NO: 783326 - RNA, 19 nt, Human
aguauuucuaugaaauauu

SEQ ID NO: 783327 - RNA, 11 nt, Human
aacugcuggau

SEQ ID NO: 783328 - RNA, 13 nt, Human
aaauaaagaauuu

SEQ ID NO: 783329 - RNA, 20 nt, Human
guucugcagauaaacaguag

SEQ ID NO: 783330 - RNA, 14 nt, Human
gccaugcuggccag

SEQ ID NO: 783331 - RNA, 21 nt, Human
ugaaaaugaauaucuauuaau

SEQ ID NO: 783332 - RNA, 17 nt, Human
uucaguugauuuuacaa

SEQ ID NO: 783333 - RNA, 20 nt, Human
uaccagcccuacaccauucc

SEQ ID NO: 783334 - RNA, 19 nt, Human
aaauuagaggucuccaaaa

SEQ ID NO: 783335 - RNA, 15 nt, Human
auuuuuuaaguauuu

SEQ ID NO: 783336 - RNA, 20 nt, Human
acaagcuuuuuuuuuuuuuc

SEQ ID NO: 783337 - RNA, 14 nt, Human
uauuuuuaccuuuu

SEQ ID NO: 783338 - RNA, 17 nt, Human
auuuauaacaaccuaaa

SEQ ID NO: 783339 - RNA, 19 nt, Human
uccagaaauaaugaaauaa

SEQ ID NO: 783340 - RNA, 17 nt, Human
uguucuaagaagugaaa

SEQ ID NO: 783341 - RNA, 19 nt, Human
cagagcugcccucuccugg

SEQ ID NO: 783342 - RNA, 18 nt, Human
cgccuguaaucccagcac

SEQ ID NO: 783343 - RNA, 19 nt, Human
acucugucucaguccauga

SEQ ID NO: 783344 - RNA, 19 nt, Human
auucaaaaguugaaauuaa

SEQ ID NO: 783345 - RNA, 23 nt, Human
aggcaugagucagucugaugaga

SEQ ID NO: 783346 - RNA, 15 nt, Human
uauuauuuauauaug

SEQ ID NO: 783347 - RNA, 19 nt, Human
gaaaauaaaagcacuuauu

SEQ ID NO: 783348 - RNA, 14 nt, Human
ucuauuuauuuacu

SEQ ID NO: 783349 - RNA, 19 nt, Human
gaggcagagguugcaguga

SEQ ID NO: 783350 - RNA, 13 nt, Human
cucuaacucagaa

SEQ ID NO: 783351 - RNA, 13 nt, Human
guuggaggcugca

SEQ ID NO: 783352 - RNA, 14 nt, Human
cauuuuaauuauua

SEQ ID NO: 783353 - RNA, 17 nt, Human
aaauucugcaagcuuuu

SEQ ID NO: 783354 - RNA, 16 nt, Human
auguaaucaauguuuc

SEQ ID NO: 783355 - RNA, 18 nt, Human
gagccaacagaagcuucc

SEQ ID NO: 783356 - RNA, 17 nt, Human
cuggagugcaguggcgc

SEQ ID NO: 783357 - RNA, 18 nt, Human
uagagacuuugugaaaaa

SEQ ID NO: 783358 - RNA, 23 nt, Human
uacuugggagaccuguaaucaua

SEQ ID NO: 783359 - RNA, 20 nt, Human
uuugugaaaaaaaauuuuau

SEQ ID NO: 783360 - RNA, 17 nt, Human
uaaacaaaaaaagcauu

SEQ ID NO: 783361 - RNA, 12 nt, Human
guauauauagaa

SEQ ID NO: 783362 - RNA, 15 nt, Human
accaaggcugauuaa

SEQ ID NO: 783363 - RNA, 22 nt, Human
ucaggagauuucaugccuggug

SEQ ID NO: 783364 - RNA, 17 nt, Human
agugagacagcucugca

SEQ ID NO: 783365 - RNA, 13 nt, Human
aauguuacauuau

SEQ ID NO: 783366 - RNA, 15 nt, Human
ugucaauaaaaucca

SEQ ID NO: 783367 - RNA, 23 nt, Human
ggcgacucuauagacucuaggac

SEQ ID NO: 783368 - RNA, 22 nt, Human
cuggggcucugggauagcugac

SEQ ID NO: 783369 - RNA, 20 nt, Human
ugccaugcuggccaggcugg

SEQ ID NO: 783370 - RNA, 16 nt, Human
caggaaguagaggagg

SEQ ID NO: 783371 - RNA, 17 nt, Human
aucccagcacuuuggga

SEQ ID NO: 783372 - RNA, 16 nt, Human
ccucuccugggcagcu

SEQ ID NO: 783373 - RNA, 20 nt, Human
ucaauaaaauccauacauuu

SEQ ID NO: 783374 - RNA, 23 nt, Human
cugaaaucauacuucuuaggguu

SEQ ID NO: 783375 - RNA, 20 nt, Human
auuugccaauuuacuuuguu

SEQ ID NO: 783376 - RNA, 15 nt, Human
aucugagccagugcu

SEQ ID NO: 783377 - RNA, 21 nt, Human
uuuuaaauaaagaauuuuaaa

SEQ ID NO: 783378 - RNA, 12 nt, Human
uugccugcaggc

SEQ ID NO: 783379 - RNA, 19 nt, Human
gaauguaaucaauguuucu

SEQ ID NO: 783380 - RNA, 15 nt, Human
cuaugaggaauauuu

SEQ ID NO: 783381 - RNA, 23 nt, Human
agauuaugaucucagaaauugua

SEQ ID NO: 783382 - RNA, 19 nt, Human
uauauguguuuuucacauu

SEQ ID NO: 783383 - RNA, 15 nt, Human
uggggcuuccuaacu

SEQ ID NO: 783384 - RNA, 14 nt, Human
uugagaagagaaua

SEQ ID NO: 783385 - RNA, 18 nt, Human
auucaaacuaauagaauu

SEQ ID NO: 783386 - RNA, 23 nt, Human
aauauuuauuuuaauaauguuuc

SEQ ID NO: 783387 - RNA, 18 nt, Human
gauaauaugagaaucaga

SEQ ID NO: 783388 - RNA, 17 nt, Human
gcaugguuuagaaagcu

SEQ ID NO: 783389 - RNA, 15 nt, Human
caaauaaguauuuau

SEQ ID NO: 783390 - RNA, 19 nt, Human
uauauuuuuuguuaaauga

SEQ ID NO: 783391 - RNA, 15 nt, Human
uauuaucaugcaaau

SEQ ID NO: 783392 - RNA, 19 nt, Human
uagugagcagucaggaaag

SEQ ID NO: 783393 - RNA, 18 nt, Human
aaaugacuaaaaaacaaa

SEQ ID NO: 783394 - RNA, 16 nt, Human
ccacuuauaggaauug

SEQ ID NO: 783395 - RNA, 12 nt, Human
uacaauugaaau

SEQ ID NO: 783396 - RNA, 19 nt, Human
acaaggcuuuaucucaggg

SEQ ID NO: 783397 - RNA, 22 nt, Human
gaauuaaguuuuuuuuuaaaaa

SEQ ID NO: 783398 - RNA, 16 nt, Human
gcugccuccccuccuc

SEQ ID NO: 783399 - RNA, 18 nt, Human
uggaugcacuuuauauua

SEQ ID NO: 783400 - RNA, 13 nt, Human
uauuuauuuuuuu

SEQ ID NO: 783401 - RNA, 18 nt, Human
uguuucuugagaagagaa

SEQ ID NO: 783402 - RNA, 14 nt, Human
aucuuguuuuucca

SEQ ID NO: 783403 - RNA, 23 nt, Human
uuuagaaagaagcccaauauuau

SEQ ID NO: 783404 - RNA, 17 nt, Human
gauuuuuaaauaaagaa

SEQ ID NO: 783405 - RNA, 12 nt, Human
auaacuggaaac

SEQ ID NO: 783406 - RNA, 23 nt, Human
caaagacuaugaggaauauuugc

SEQ ID NO: 783407 - RNA, 20 nt, Human
cacuguggguagacacacau

SEQ ID NO: 783408 - RNA, 21 nt, Human
cagugagacagcucugcauac

SEQ ID NO: 783409 - RNA, 18 nt, Human
auccuucagccugaaaga

SEQ ID NO: 783410 - RNA, 22 nt, Human
cuaacauauaauguuguuauuu

SEQ ID NO: 783411 - RNA, 15 nt, Human
cugaagaguggguuu

SEQ ID NO: 783412 - RNA, 15 nt, Human
ccaucccucccucca

SEQ ID NO: 783413 - RNA, 17 nt, Human
cugauggguuucuccag

SEQ ID NO: 783414 - RNA, 19 nt, Human
gcaccugcaggcgugaccu

SEQ ID NO: 783415 - RNA, 17 nt, Human
agacauagaauaguguu

SEQ ID NO: 783416 - RNA, 19 nt, Human
auaaaguauauauagaauc

SEQ ID NO: 783417 - RNA, 16 nt, Human
aagaaugacuaugcaa

SEQ ID NO: 783418 - RNA, 14 nt, Human
caguucugaagaag

SEQ ID NO: 783419 - RNA, 11 nt, Human
cagcugccucc

SEQ ID NO: 783420 - RNA, 13 nt, Human
ccgggaguggcgc

SEQ ID NO: 783421 - RNA, 18 nt, Human
accucccugcaauaaaau

SEQ ID NO: 783422 - RNA, 23 nt, Human
uaaucauauaauaaauguacauu

SEQ ID NO: 783423 - RNA, 20 nt, Human
uuuaauuuugaauaaauaaa

SEQ ID NO: 783424 - RNA, 18 nt, Human
cacuuucccucuuggugc

SEQ ID NO: 783425 - RNA, 22 nt, Human
agaauucuuacauguuuucuuu

SEQ ID NO: 783426 - RNA, 20 nt, Human
cuguauuuuuaccuuuuucc

SEQ ID NO: 783427 - RNA, 19 nt, Human
aaguccuacaagcuaaaau

SEQ ID NO: 783428 - RNA, 13 nt, Human
cuggccugcugga

SEQ ID NO: 783429 - RNA, 23 nt, Human
ccuugggcaggucacacaaccug

SEQ ID NO: 783430 - RNA, 21 nt, Human
auggcagcuuuccucaaaacu

SEQ ID NO: 783431 - RNA, 17 nt, Human
uaagaaauaugcacaau

SEQ ID NO: 783432 - RNA, 14 nt, Human
aauauuauguuaaa

SEQ ID NO: 783433 - RNA, 15 nt, Human
auuugguaaggggaa

SEQ ID NO: 783434 - RNA, 14 nt, Human
uauauuuauaacuc

SEQ ID NO: 783435 - RNA, 18 nt, Human
cauauguaccauguacau

SEQ ID NO: 783436 - RNA, 14 nt, Human
auauuugaaauauu

SEQ ID NO: 783437 - RNA, 18 nt, Human
aagacucugucucaaaaa

SEQ ID NO: 783438 - RNA, 15 nt, Human
cugagcauguacuga

SEQ ID NO: 783439 - RNA, 12 nt, Human
uuuauaaauaua

SEQ ID NO: 783440 - RNA, 17 nt, Human
uaucuauuaauauaugu

SEQ ID NO: 783441 - RNA, 22 nt, Human
gaauuuuucucuaacucagaaa

SEQ ID NO: 783442 - RNA, 12 nt, Human
ggacgagaauga

SEQ ID NO: 783443 - RNA, 14 nt, Human
aauuauaauauacu

SEQ ID NO: 783444 - RNA, 14 nt, Human
accaggcauccucc

SEQ ID NO: 783445 - RNA, 20 nt, Human
auaaauuuucccaaaacuga

SEQ ID NO: 783446 - RNA, 19 nt, Human
acaaauuuacagagacaga

SEQ ID NO: 783447 - RNA, 19 nt, Human
auuuugguaaaauacuucu

SEQ ID NO: 783448 - RNA, 17 nt, Human
ucacaagugaaaaacau

SEQ ID NO: 783449 - RNA, 12 nt, Human
ugcaggcagcag

SEQ ID NO: 783450 - RNA, 16 nt, Human
uacauuuguauaaaau

SEQ ID NO: 783451 - RNA, 12 nt, Human
ucaugcugccaa

SEQ ID NO: 783452 - RNA, 12 nt, Human
ugagagacacac

SEQ ID NO: 783453 - RNA, 13 nt, Human
ccucauggaauug

SEQ ID NO: 783454 - RNA, 19 nt, Human
acaguuuuccuucucaucu

SEQ ID NO: 783455 - RNA, 20 nt, Human
uggacuuuccagagaccagu

SEQ ID NO: 783456 - RNA, 22 nt, Human
uucuuaaaugggcuacuuuguc

SEQ ID NO: 783457 - RNA, 20 nt, Human
auauaauguuguuauuuaaa

SEQ ID NO: 783458 - RNA, 17 nt, Human
agacacacugaagaagc

SEQ ID NO: 783459 - RNA, 15 nt, Human
uuuauacagugucuu

SEQ ID NO: 783460 - RNA, 16 nt, Human
cuucacuuuuuuucuu

SEQ ID NO: 783461 - RNA, 20 nt, Human
cucuacuaaaaauacaaaaa

SEQ ID NO: 783462 - RNA, 13 nt, Human
auugcauuaaaua

SEQ ID NO: 783463 - RNA, 21 nt, Human
caucccucccuccaccucccu

SEQ ID NO: 783464 - RNA, 21 nt, Human
cuuugaaaaaguauaaauaaa

SEQ ID NO: 783465 - RNA, 19 nt, Human
auuacaguuagagauuuuu

SEQ ID NO: 783466 - RNA, 16 nt, Human
aauauauaugaauaaa

SEQ ID NO: 783467 - RNA, 15 nt, Human
ucauuuguuaaaauu

SEQ ID NO: 783468 - RNA, 21 nt, Human
ugaagguaaaauugaaaggca

SEQ ID NO: 783469 - RNA, 16 nt, Human
cucgaacugcuggauu

SEQ ID NO: 783470 - RNA, 16 nt, Human
ccucaaaacuucagac

SEQ ID NO: 783471 - RNA, 14 nt, Human
uaaaauccauacau

SEQ ID NO: 783472 - RNA, 16 nt, Human
uacauuuccaaauuca

SEQ ID NO: 783473 - RNA, 15 nt, Human
aucuagcaaauguua

SEQ ID NO: 783474 - RNA, 18 nt, Human
auagucaaauugugugaa

SEQ ID NO: 783475 - RNA, 18 nt, Human
ccacauucagagcuuacu

SEQ ID NO: 783476 - RNA, 14 nt, Human
cuuuccagagacca

SEQ ID NO: 783477 - RNA, 22 nt, Human
uacauaagggaggaaaaaaaau

SEQ ID NO: 783478 - RNA, 21 nt, Human
aauaaaguauauauagaaucu

SEQ ID NO: 783479 - RNA, 16 nt, Human
uaauuucaugaaaaga

SEQ ID NO: 783480 - RNA, 17 nt, Human
accagggccuggcuggg

SEQ ID NO: 783481 - RNA, 22 nt, Human
auuuuauuacaucuuucacauu

SEQ ID NO: 783482 - RNA, 15 nt, Human
uaucaguccucuuuc

SEQ ID NO: 783483 - RNA, 15 nt, Human
gaggucaggaguucc

SEQ ID NO: 783484 - RNA, 16 nt, Human
cacuuaaaaaugguuu

SEQ ID NO: 783485 - RNA, 15 nt, Human
aaugauuaugaauua

SEQ ID NO: 783486 - RNA, 15 nt, Human
aagucugauuuuccu

SEQ ID NO: 783487 - RNA, 18 nt, Human
acugccuucucaacucca

SEQ ID NO: 783488 - RNA, 19 nt, Human
ucaccaaggcugauuaaac

SEQ ID NO: 783489 - RNA, 22 nt, Human
aagacucugucucaaaaaauaa

SEQ ID NO: 783490 - RNA, 15 nt, Human
aagccagauuuuccu

SEQ ID NO: 783491 - RNA, 14 nt, Human
cauuuucaaaaugg

SEQ ID NO: 783492 - RNA, 16 nt, Human
ccugggcagcugccuc

SEQ ID NO: 783493 - RNA, 12 nt, Human
caggucucaugg

SEQ ID NO: 783494 - RNA, 18 nt, Human
agcaaaauuuuuucucua

SEQ ID NO: 783495 - RNA, 19 nt, Human
auaauguuacauuauuauc

SEQ ID NO: 783496 - RNA, 18 nt, Human
uucacaagugaaaaacau

SEQ ID NO: 783497 - RNA, 13 nt, Human
agccuugcuccug

SEQ ID NO: 783498 - RNA, 19 nt, Human
aaaugaauaucuauuaaua

SEQ ID NO: 783499 - RNA, 20 nt, Human
cuuaaagaauuuucaaaauc

SEQ ID NO: 783500 - RNA, 20 nt, Human
ccagcuacuugggaggcuga

SEQ ID NO: 783501 - RNA, 21 nt, Human
cuauguucuaagaagugaaaa

SEQ ID NO: 783502 - RNA, 14 nt, Human
cuuaugaaccuuua

SEQ ID NO: 783503 - RNA, 20 nt, Human
aaacuuuaugcuaagugaaa

SEQ ID NO: 783504 - RNA, 15 nt, Human
auuuauuuuuuuacu

SEQ ID NO: 783505 - RNA, 14 nt, Human
gaaaggagaaguua

SEQ ID NO: 783506 - RNA, 14 nt, Human
uguacuuuuuccag

SEQ ID NO: 783507 - RNA, 13 nt, Human
uaagugcagcccc

SEQ ID NO: 783508 - RNA, 16 nt, Human
gauaauuauaauauac

SEQ ID NO: 783509 - RNA, 20 nt, Human
auuaaggcuucucuuaaaca

SEQ ID NO: 783510 - RNA, 13 nt, Human
ugggaggcugaga

SEQ ID NO: 783511 - RNA, 13 nt, Human
uuaaacaaaaaaa

SEQ ID NO: 783512 - RNA, 20 nt, Human
gcaaaucucuauuaggaaau

SEQ ID NO: 783513 - RNA, 14 nt, Human
auguaaauagaaac

SEQ ID NO: 783514 - RNA, 22 nt, Human
acuggcaguuuuccauugguuu

SEQ ID NO: 783515 - RNA, 18 nt, Human
acagaccuaggauuucau

SEQ ID NO: 783516 - RNA, 12 nt, Human
gcaguucagagc

SEQ ID NO: 783517 - RNA, 23 nt, Human
uccaaacugacucuuaagaagac

SEQ ID NO: 783518 - RNA, 18 nt, Human
uaauucaaacuaauagaa

SEQ ID NO: 783519 - RNA, 19 nt, Human
cauccauggugugcuggcu

SEQ ID NO: 783520 - RNA, 19 nt, Human
gccagcaguucagagcugc

SEQ ID NO: 783521 - RNA, 14 nt, Human
ggccagaagucaag

SEQ ID NO: 783522 - RNA, 17 nt, Human
uaaagaauuuucaaaau

SEQ ID NO: 783523 - RNA, 13 nt, Human
auguaucuuauuc

SEQ ID NO: 783524 - RNA, 13 nt, Human
cuugccugcaggc

SEQ ID NO: 783525 - RNA, 22 nt, Human
aauuuaaaaaaaaaccugagcc

SEQ ID NO: 783526 - RNA, 18 nt, Human
uaauuauuauucuucaua

SEQ ID NO: 783527 - RNA, 21 nt, Human
uacauuauuaucaacaauagu

SEQ ID NO: 783528 - RNA, 16 nt, Human
gccuggcugggagugg

SEQ ID NO: 783529 - RNA, 13 nt, Human
uuaaaaaagaaac

SEQ ID NO: 783530 - RNA, 16 nt, Human
aaauauuauguuaaaa

SEQ ID NO: 783531 - RNA, 20 nt, Human
gaauccagaaauaaugaaau

SEQ ID NO: 783532 - RNA, 23 nt, Human
ggagggggcgcgugcaggcagca

SEQ ID NO: 783533 - RNA, 13 nt, Human
uuuuaaaaaagaa

SEQ ID NO: 783534 - RNA, 21 nt, Human
aauuuacagagacagaaagca

SEQ ID NO: 783535 - RNA, 22 nt, Human
uccauggugugcuggcuuaaaa

SEQ ID NO: 783536 - RNA, 23 nt, Human
uccagguagaggguguguaagua

SEQ ID NO: 783537 - RNA, 21 nt, Human
auuuuccugaaaacccuugcc

SEQ ID NO: 783538 - RNA, 18 nt, Human
augguauuugaguguuuu

SEQ ID NO: 783539 - RNA, 13 nt, Human
ugcuuggcccagg

SEQ ID NO: 783540 - RNA, 15 nt, Human
aagauuucuugaguu

SEQ ID NO: 783541 - RNA, 18 nt, Human
uuuuauaucaauuuaaaa

SEQ ID NO: 783542 - RNA, 22 nt, Human
cucuccugggcagcugccuccc

SEQ ID NO: 783543 - RNA, 16 nt, Human
cuagaaccaccugccu

SEQ ID NO: 783544 - RNA, 21 nt, Human
ucaguuuccugaccuaugaaa

SEQ ID NO: 783545 - RNA, 14 nt, Human
aauaaaauggguuu

SEQ ID NO: 783546 - RNA, 21 nt, Human
gugcuuaucccauagccagga

SEQ ID NO: 783547 - RNA, 17 nt, Human
ccucccuccaccucccu

SEQ ID NO: 783548 - RNA, 14 nt, Human
auaauuauaauaua

SEQ ID NO: 783549 - RNA, 23 nt, Human
caguuagagauuuuuaaauaaag

SEQ ID NO: 783550 - RNA, 15 nt, Human
cuuaaaauguaauua

SEQ ID NO: 783551 - RNA, 20 nt, Human
uagauaaacucagaaauuua

SEQ ID NO: 783552 - RNA, 22 nt, Human
cauguacauccauggugugcug

SEQ ID NO: 783553 - RNA, 19 nt, Human
uggaacaguuaccucugcc

SEQ ID NO: 783554 - RNA, 21 nt, Human
cuaguaucaaaagaaagaaaa

SEQ ID NO: 783555 - RNA, 20 nt, Human
cuuauucacaagacccaaaa

SEQ ID NO: 783556 - RNA, 20 nt, Human
uagcuuuacuguuuguuaug

SEQ ID NO: 783557 - RNA, 19 nt, Human
cacuuuauauuauuuugaa

SEQ ID NO: 783558 - RNA, 13 nt, Human
aaaaauuuuauag

SEQ ID NO: 783559 - RNA, 23 nt, Human
ggcaaagacuauucccuucuaac

SEQ ID NO: 783560 - RNA, 16 nt, Human
gcacuuuaaacauuua

SEQ ID NO: 783561 - RNA, 19 nt, Human
cucauugcaaccuccaccu

SEQ ID NO: 783562 - RNA, 15 nt, Human
uaauauauguauuau

SEQ ID NO: 783563 - RNA, 13 nt, Human
aacucuuaaucaa

SEQ ID NO: 783564 - RNA, 18 nt, Human
ucugggucucaguguccu

SEQ ID NO: 783565 - RNA, 22 nt, Human
uauuucagauaaucacaauaca

SEQ ID NO: 783566 - RNA, 22 nt, Human
uuaagcacuuuaacacaguguc

SEQ ID NO: 783567 - RNA, 20 nt, Human
aucucugauacuuuuuucau

SEQ ID NO: 783568 - RNA, 23 nt, Human
ucauuucaaaacucauuuccuau

SEQ ID NO: 783569 - RNA, 11 nt, Human
uucacagggga

SEQ ID NO: 783570 - RNA, 15 nt, Human
caucauaaaauaaag

SEQ ID NO: 783571 - RNA, 21 nt, Human
uggcuguaucuuguuuuucca

SEQ ID NO: 783572 - RNA, 20 nt, Human
agcuugcaacaaaauucucu

SEQ ID NO: 783573 - RNA, 19 nt, Human
guccaggucuaccaaaaau

SEQ ID NO: 783574 - RNA, 16 nt, Human
auccuuuguuuucuga

SEQ ID NO: 783575 - RNA, 13 nt, Human
auuacccucuggg

SEQ ID NO: 783576 - RNA, 15 nt, Human
guggcgcgcaccugu

SEQ ID NO: 783577 - RNA, 20 nt, Human
aauuuugugaagcaaaauuu

SEQ ID NO: 783578 - RNA, 16 nt, Human
acuuuggcaaaugagc

SEQ ID NO: 783579 - RNA, 19 nt, Human
cucugcauacucauuagga

SEQ ID NO: 783580 - RNA, 13 nt, Human
aagauuuguaaua

SEQ ID NO: 783581 - RNA, 13 nt, Human
agaauuuauucaa

SEQ ID NO: 783582 - RNA, 15 nt, Human
uacaucuuucacauu

SEQ ID NO: 783583 - RNA, 15 nt, Human
uauuguaccucucuu

SEQ ID NO: 783584 - RNA, 14 nt, Human
aacugcauugagaa

SEQ ID NO: 783585 - RNA, 16 nt, Human
uugacaguucauaugu

SEQ ID NO: 783586 - RNA, 13 nt, Human
uguauauuuuaua

SEQ ID NO: 783587 - RNA, 15 nt, Human
caauauuugaauuuu

SEQ ID NO: 783588 - RNA, 16 nt, Human
aauuacauuuguauaa

SEQ ID NO: 783589 - RNA, 13 nt, Human
auaauuauaauau

SEQ ID NO: 783590 - RNA, 12 nt, Human
aacucagaaauu

SEQ ID NO: 783591 - RNA, 23 nt, Human
ugagucagucugaugagaacucu

SEQ ID NO: 783592 - RNA, 12 nt, Human
cccucuccuggg

SEQ ID NO: 783593 - RNA, 22 nt, Human
agaagcaccaaucaugaauuag

SEQ ID NO: 783594 - RNA, 21 nt, Human
aauuuuuauauuugaaauauu

SEQ ID NO: 783595 - RNA, 14 nt, Human
aaagaauuuuaaaa

SEQ ID NO: 783596 - RNA, 19 nt, Human
accucaguuuuaucauuuu

SEQ ID NO: 783597 - RNA, 22 nt, Human
aaagcacgaaauguuauuuuuu

SEQ ID NO: 783598 - RNA, 14 nt, Human
uaacucagaaacau

SEQ ID NO: 783599 - RNA, 16 nt, Human
uauauaaauuuuccca

SEQ ID NO: 783600 - RNA, 19 nt, Human
cacaggaaccacaagacug

SEQ ID NO: 783601 - RNA, 17 nt, Human
cuguauugcauuaaaua

SEQ ID NO: 783602 - RNA, 18 nt, Human
cucucuuauagaauauuu

SEQ ID NO: 783603 - RNA, 17 nt, Human
uaugcuaagugaaauaa

SEQ ID NO: 783604 - RNA, 15 nt, Human
cacuucacuuuuuuu

SEQ ID NO: 783605 - RNA, 23 nt, Human
ccaagaaugagaagaaugacuau

SEQ ID NO: 783606 - RNA, 20 nt, Human
aaaugaauaucuauuaauau

SEQ ID NO: 783607 - RNA, 16 nt, Human
aaaauccauacauuug

SEQ ID NO: 783608 - RNA, 22 nt, Human
gugccucaccccuugccauaau

SEQ ID NO: 783609 - RNA, 19 nt, Human
uucaauacuucauuuaaaa

SEQ ID NO: 783610 - RNA, 16 nt, Human
cuacacuccagugaga

SEQ ID NO: 783611 - RNA, 21 nt, Human
uaaauaaauguaucuuauuca

SEQ ID NO: 783612 - RNA, 16 nt, Human
uaagaaauaugcacaa

SEQ ID NO: 783613 - RNA, 15 nt, Human
cuuacuauuuauugc

SEQ ID NO: 783614 - RNA, 16 nt, Human
gaaccuuuacauccag

SEQ ID NO: 783615 - RNA, 15 nt, Human
aggcgugagccacca

SEQ ID NO: 783616 - RNA, 20 nt, Human
aauaagccagacaucaacag

SEQ ID NO: 783617 - RNA, 15 nt, Human
uaaaaguagaauaaa

SEQ ID NO: 783618 - RNA, 16 nt, Human
gacaaaaacaaacaaa

SEQ ID NO: 783619 - RNA, 22 nt, Human
aacuuucuuuucuggaauguaa

SEQ ID NO: 783620 - RNA, 13 nt, Human
cugcaauaaaaug

SEQ ID NO: 783621 - RNA, 16 nt, Human
uuacauguuuucuuug

SEQ ID NO: 783622 - RNA, 19 nt, Human
uagagauuuuuaaauaaag

SEQ ID NO: 783623 - RNA, 14 nt, Human
agaaaugaaagcag

SEQ ID NO: 783624 - RNA, 23 nt, Human
cucuccugggcagcugccucccc

SEQ ID NO: 783625 - RNA, 13 nt, Human
uuugccaugcugg

SEQ ID NO: 783626 - RNA, 19 nt, Human
uguuaugcauaaagucagu

SEQ ID NO: 783627 - RNA, 19 nt, Human
auuggagcucgugggacag

SEQ ID NO: 783628 - RNA, 17 nt, Human
aggcuagaaccaccugc

SEQ ID NO: 783629 - RNA, 15 nt, Human
ggaauuuucuuccaa

SEQ ID NO: 783630 - RNA, 19 nt, Human
aaauggugaaaugcagagu

SEQ ID NO: 783631 - RNA, 14 nt, Human
cgcgcgccaccacg

SEQ ID NO: 783632 - RNA, 19 nt, Human
gaaauaaaaguagaauaaa

SEQ ID NO: 783633 - RNA, 15 nt, Human
ccacaggaaccacaa

SEQ ID NO: 783634 - RNA, 22 nt, Human
auccagauagguuaccaguaac

SEQ ID NO: 783635 - RNA, 15 nt, Human
uugacccacaagaaa

SEQ ID NO: 783636 - RNA, 21 nt, Human
ugagccagugucaggaggaag

SEQ ID NO: 783637 - RNA, 21 nt, Human
auaguuguaccgcaaugugac

SEQ ID NO: 783638 - RNA, 15 nt, Human
agaauuuuaaaacuc

SEQ ID NO: 783639 - RNA, 16 nt, Human
aaguugcagugagcug

SEQ ID NO: 783640 - RNA, 19 nt, Human
gagguacugagagugaaca

SEQ ID NO: 783641 - RNA, 19 nt, Human
cuuccagauccuggaaauc

SEQ ID NO: 783642 - RNA, 22 nt, Human
guacauuaauuaccuugagcca

SEQ ID NO: 783643 - RNA, 16 nt, Human
caguguccucaucugu

SEQ ID NO: 783644 - RNA, 15 nt, Human
gccuguaaucccagc

SEQ ID NO: 783645 - RNA, 21 nt, Human
cucaguccaugaagauguaga

SEQ ID NO: 783646 - RNA, 18 nt, Human
uacuuuuuucauuauugg

SEQ ID NO: 783647 - RNA, 16 nt, Human
auuuuaauaauguuuc

SEQ ID NO: 783648 - RNA, 19 nt, Human
aaauggagugacuuagugu

SEQ ID NO: 783649 - RNA, 21 nt, Human
aaggaagaaauuccaggaaaa

SEQ ID NO: 783650 - RNA, 17 nt, Human
uacuauuuauugcugaa

SEQ ID NO: 783651 - RNA, 21 nt, Human
uccuucagccugaaagaggaa

SEQ ID NO: 783652 - RNA, 22 nt, Human
aagcacuuuaacacagugucug

SEQ ID NO: 783653 - RNA, 11 nt, Human
cccucccucca

SEQ ID NO: 783654 - RNA, 14 nt, Human
ggcgggacacaggc

SEQ ID NO: 783655 - RNA, 17 nt, Human
auauuugaaauauugac

SEQ ID NO: 783656 - RNA, 12 nt, Human
agugcagccccg

SEQ ID NO: 783657 - RNA, 12 nt, Human
auaaaaauaaau

SEQ ID NO: 783658 - RNA, 22 nt, Human
cuuuccacagaagcuccaggua

SEQ ID NO: 783659 - RNA, 21 nt, Human
cuccugggcagcugccucccc

SEQ ID NO: 783660 - RNA, 16 nt, Human
uacagggcauuuuggu

SEQ ID NO: 783661 - RNA, 14 nt, Human
cacuuauaggaauu

SEQ ID NO: 783662 - RNA, 17 nt, Human
uaaguugcugaugaacu

SEQ ID NO: 783663 - RNA, 14 nt, Human
cuacaaauacucuu

SEQ ID NO: 783664 - RNA, 22 nt, Human
guauuuuuaccuuuuuccuucc

SEQ ID NO: 783665 - RNA, 19 nt, Human
agaguuuagcuggaaaagu

SEQ ID NO: 783666 - RNA, 14 nt, Human
uccuauguaacugc

SEQ ID NO: 783667 - RNA, 16 nt, Human
gcuuuuucucucccac

SEQ ID NO: 783668 - RNA, 22 nt, Human
agugagcagucaggaaagagaa

SEQ ID NO: 783669 - RNA, 23 nt, Human
augcuaaucagggaggucauuuu

SEQ ID NO: 783670 - RNA, 16 nt, Human
ucaggugacccugaug

SEQ ID NO: 783671 - RNA, 23 nt, Human
uccaacuaucucauuuccaagca

SEQ ID NO: 783672 - RNA, 15 nt, Human
cagugucuggcacuu

SEQ ID NO: 783673 - RNA, 15 nt, Human
gcaggcaugagucag

SEQ ID NO: 783674 - RNA, 18 nt, Human
cuuuaauuucaugaaaag

SEQ ID NO: 783675 - RNA, 13 nt, Human
acacaggcuccaa

SEQ ID NO: 783676 - RNA, 17 nt, Human
auuuguuaaaauuauca

SEQ ID NO: 783677 - RNA, 21 nt, Human
acucaucauaaaauaaaguau

SEQ ID NO: 783678 - RNA, 21 nt, Human
aauggauaugacacaucucug

SEQ ID NO: 783679 - RNA, 18 nt, Human
gaaauggugaaaugcaga

SEQ ID NO: 783680 - RNA, 12 nt, Human
agccagcaguuc

SEQ ID NO: 783681 - RNA, 14 nt, Human
auauuauuuugaau

SEQ ID NO: 783682 - RNA, 22 nt, Human
cucugcuugccaucccucccuc

SEQ ID NO: 783683 - RNA, 14 nt, Human
ugccaucccucccu

SEQ ID NO: 783684 - RNA, 20 nt, Human
uucgaugguacauauuucuu

SEQ ID NO: 783685 - RNA, 13 nt, Human
uaaauuugguucu

SEQ ID NO: 783686 - RNA, 20 nt, Human
auauaauaaauguacauuaa

SEQ ID NO: 783687 - RNA, 15 nt, Human
ggaaaugaaagaaag

SEQ ID NO: 783688 - RNA, 19 nt, Human
agcuugaaauagugucuga

SEQ ID NO: 783689 - RNA, 16 nt, Human
cuugccaucccucccu

SEQ ID NO: 783690 - RNA, 23 nt, Human
cuuaagaagacugcauuauauuu

SEQ ID NO: 783691 - RNA, 21 nt, Human
cagagucaaugaacuuuccac

SEQ ID NO: 783692 - RNA, 19 nt, Human
cucauggaauuggagcucg

SEQ ID NO: 783693 - RNA, 22 nt, Human
cauaaauguugacaugggacau

SEQ ID NO: 783694 - RNA, 14 nt, Human
accugggcauucuu

SEQ ID NO: 783695 - RNA, 18 nt, Human
uuugacaagguucuuccc

SEQ ID NO: 783696 - RNA, 18 nt, Human
agaacuauggaaaaaaag

SEQ ID NO: 783697 - RNA, 15 nt, Human
auggugaaaugcaga

SEQ ID NO: 783698 - RNA, 21 nt, Human
ucuauuaggaaauauucugua

SEQ ID NO: 783699 - RNA, 16 nt, Human
uaacauuauuuauaug

SEQ ID NO: 783700 - RNA, 13 nt, Human
uuuuuuuuuuucu

SEQ ID NO: 783701 - RNA, 16 nt, Human
gaaggcuuacacccac

SEQ ID NO: 783702 - RNA, 14 nt, Human
aauauuuauuuuaa

SEQ ID NO: 783703 - RNA, 22 nt, Human
aaagauuaugaucucagaaauu

SEQ ID NO: 783704 - RNA, 13 nt, Human
aaaugacuaaaaa

SEQ ID NO: 783705 - RNA, 19 nt, Human
uuguguaaugaaaaugaau

SEQ ID NO: 783706 - RNA, 14 nt, Human
caccaacuuugaag

SEQ ID NO: 783707 - RNA, 23 nt, Human
acaguucauauguaccauguaca

SEQ ID NO: 783708 - RNA, 22 nt, Human
gcgacaguuuuccuucucaucu

SEQ ID NO: 783709 - RNA, 16 nt, Human
agugggacaguuccug

SEQ ID NO: 783710 - RNA, 12 nt, Human
caugggaaguga

SEQ ID NO: 783711 - RNA, 18 nt, Human
guugaagaugcuuguauu

SEQ ID NO: 783712 - RNA, 15 nt, Human
ugccugcaggcauga

SEQ ID NO: 783713 - RNA, 19 nt, Human
caaaugcuuaugaaacuaa

SEQ ID NO: 783714 - RNA, 19 nt, Human
agcugauaucaugccccug

SEQ ID NO: 783715 - RNA, 23 nt, Human
auuacaguuagagauuuuuaaau

SEQ ID NO: 783716 - RNA, 18 nt, Human
acuuuaugcuaagugaaa

SEQ ID NO: 783717 - RNA, 21 nt, Human
aagacaacauuaaaacaauau

SEQ ID NO: 783718 - RNA, 14 nt, Human
aaugagcaaaaguu

SEQ ID NO: 783719 - RNA, 17 nt, Human
gcaugucagacagaacu

SEQ ID NO: 783720 - RNA, 14 nt, Human
aguauuuauauauu

SEQ ID NO: 783721 - RNA, 14 nt, Human
uuucuuaaagaauu

SEQ ID NO: 783722 - RNA, 19 nt, Human
cacuuuaacacagugucug

SEQ ID NO: 783723 - RNA, 12 nt, Human
aaugaauguuua

SEQ ID NO: 783724 - RNA, 11 nt, Human
cucaucauaaa

SEQ ID NO: 783725 - RNA, 21 nt, Human
accaaucauuuuaauuauuau

SEQ ID NO: 783726 - RNA, 19 nt, Human
agccuggucaacaugguga

SEQ ID NO: 783727 - RNA, 13 nt, Human
uaccuuuuuccuu

SEQ ID NO: 783728 - RNA, 13 nt, Human
aagcauuccaacu

SEQ ID NO: 783729 - RNA, 15 nt, Human
accugggcugaggca

SEQ ID NO: 783730 - RNA, 22 nt, Human
aauuaucuaucuaucuauuuau

SEQ ID NO: 783731 - RNA, 22 nt, Human
ugaaacuaagauuuguaauauu

SEQ ID NO: 783732 - RNA, 17 nt, Human
guugauagcaagugaau

SEQ ID NO: 783733 - RNA, 19 nt, Human
ucucuuaaacacuaaaaag

SEQ ID NO: 783734 - RNA, 23 nt, Human
caauauuugaauuuuaaaucuaa

SEQ ID NO: 783735 - RNA, 15 nt, Human
agaagagaauauuag

SEQ ID NO: 783736 - RNA, 19 nt, Human
aauuuuuauauuugaaaua

SEQ ID NO: 783737 - RNA, 21 nt, Human
aaugacuaaaaaacaaagaag

SEQ ID NO: 783738 - RNA, 24 nt, Human
uggugugcuggcuuaaaauguaau

SEQ ID NO: 783739 - RNA, 13 nt, Human
acucugcauucua

SEQ ID NO: 783740 - RNA, 18 nt, Human
auuauaagcuguuuuuau

SEQ ID NO: 783741 - RNA, 17 nt, Human
aaaugcuguauucuucu

SEQ ID NO: 783742 - RNA, 15 nt, Human
ccacaagaaaugaaa

SEQ ID NO: 783743 - RNA, 18 nt, Human
gacauuugcucauggaau

SEQ ID NO: 783744 - RNA, 17 nt, Human
uuuuaucauuuucaaaa

SEQ ID NO: 783745 - RNA, 14 nt, Human
aggcugaggcaaga

SEQ ID NO: 783746 - RNA, 20 nt, Human
ucaaaauggagggaauaaua

SEQ ID NO: 783747 - RNA, 17 nt, Human
ucucuuaaacacuaaaa

SEQ ID NO: 783748 - RNA, 19 nt, Human
ccagcaguucagagcugcc

SEQ ID NO: 783749 - RNA, 14 nt, Human
aagaagugaaaauc

SEQ ID NO: 783750 - RNA, 14 nt, Human
guauuauuuauaau

SEQ ID NO: 783751 - RNA, 20 nt, Human
cuccaccucccugcaauaaa

SEQ ID NO: 783752 - RNA, 13 nt, Human
guauuuauauauu

SEQ ID NO: 783753 - RNA, 17 nt, Human
gccaucccucccuccac

SEQ ID NO: 783754 - RNA, 19 nt, Human
aaauguaauuaaucuugua

SEQ ID NO: 783755 - RNA, 16 nt, Human
guuuuuuuuuaaaaaa

SEQ ID NO: 783756 - RNA, 18 nt, Human
accaggcuugccugcagg

SEQ ID NO: 783757 - RNA, 15 nt, Human
acauaagggaggaaa

SEQ ID NO: 783758 - RNA, 15 nt, Human
ccucauguccacugg

SEQ ID NO: 783759 - RNA, 23 nt, Human
auuaaagcuaaaguaucuguauu

SEQ ID NO: 783760 - RNA, 23 nt, Human
aaaugaauaucuauuaauauaug

SEQ ID NO: 783761 - RNA, 15 nt, Human
gcaaccuccaccuuc

SEQ ID NO: 783762 - RNA, 21 nt, Human
ugcagaguacuggcugaugga

SEQ ID NO: 783763 - RNA, 19 nt, Human
acuucagcgguuuauauaa

SEQ ID NO: 783764 - RNA, 19 nt, Human
aauuuuguuauguauauuu

SEQ ID NO: 783765 - RNA, 13 nt, Human
auuuauugagcac

SEQ ID NO: 783766 - RNA, 23 nt, Human
gaugaaaacauagcaucucagga

SEQ ID NO: 783767 - RNA, 16 nt, Human
cuugccugcaggcaug

SEQ ID NO: 783768 - RNA, 11 nt, Human
uuuucaucuuc

SEQ ID NO: 783769 - RNA, 14 nt, Human
ugagaaaccuuauu

SEQ ID NO: 783770 - RNA, 21 nt, Human
ccuggugccucaccccuugcc

SEQ ID NO: 783771 - RNA, 16 nt, Human
auuuuuccccaaaaag

SEQ ID NO: 783772 - RNA, 20 nt, Human
uaugcuucuguuuuauaauu

SEQ ID NO: 783773 - RNA, 13 nt, Human
aauguaaacaaag

SEQ ID NO: 783774 - RNA, 15 nt, Human
uuuaauuucaugaaa

SEQ ID NO: 783775 - RNA, 21 nt, Human
uauaaaauaauuuuuauauuu

SEQ ID NO: 783776 - RNA, 19 nt, Human
uauccaaagcugaauacau

SEQ ID NO: 783777 - RNA, 22 nt, Human
gccucuaaaaggccugucccug

SEQ ID NO: 783778 - RNA, 15 nt, Human
ucuucagaccuagaa

SEQ ID NO: 783779 - RNA, 13 nt, Human
agggucucccucu

SEQ ID NO: 783780 - RNA, 15 nt, Human
agccccgggaguggc

SEQ ID NO: 783781 - RNA, 22 nt, Human
agaggauguguggcauuuucac

SEQ ID NO: 783782 - RNA, 13 nt, Human
uauauauagaauc

SEQ ID NO: 783783 - RNA, 16 nt, Human
ucaaaagguauuuauu

SEQ ID NO: 783784 - RNA, 13 nt, Human
uuacaaggcuuua

SEQ ID NO: 783785 - RNA, 12 nt, Human
uucagccugaaa

SEQ ID NO: 783786 - RNA, 18 nt, Human
uaauaauguuucaaacau

SEQ ID NO: 783787 - RNA, 13 nt, Human
ugcaguggcgcaa

SEQ ID NO: 783788 - RNA, 21 nt, Human
ucuuaaagaauuuucaaaauc

SEQ ID NO: 783789 - RNA, 23 nt, Human
agcagugcuugaaugaaguugua

SEQ ID NO: 783790 - RNA, 13 nt, Human
ccauuccaagccu

SEQ ID NO: 783791 - RNA, 14 nt, Human
agcgcagccaugug

SEQ ID NO: 783792 - RNA, 18 nt, Human
cccugaccucccucuaau

SEQ ID NO: 783793 - RNA, 21 nt, Human
aauggaauauguaaauagaaa

SEQ ID NO: 783794 - RNA, 18 nt, Human
caaauauuguugacaacu

SEQ ID NO: 783795 - RNA, 20 nt, Human
aguccuacaagcuaaaauua

SEQ ID NO: 783796 - RNA, 13 nt, Human
uuaugcuaaguga

SEQ ID NO: 783797 - RNA, 16 nt, Human
cuaaaucuauuuauua

SEQ ID NO: 783798 - RNA, 22 nt, Human
accuaacgaaguauccuucagc

SEQ ID NO: 783799 - RNA, 16 nt, Human
uagauacugaauguaa

SEQ ID NO: 783800 - RNA, 17 nt, Human
aucccucccuccaccuc

SEQ ID NO: 783801 - RNA, 15 nt, Human
acgaaauguuauuuu

SEQ ID NO: 783802 - RNA, 20 nt, Human
uuguaccucucuuauagaau

SEQ ID NO: 783803 - RNA, 18 nt, Human
accaccugccuauauuuu

SEQ ID NO: 783804 - RNA, 14 nt, Human
cacuaacauauaau

SEQ ID NO: 783805 - RNA, 13 nt, Human
ugagcgacaguga

SEQ ID NO: 783806 - RNA, 16 nt, Human
uuuggcuuguaaagua

SEQ ID NO: 783807 - RNA, 12 nt, Human
cacacagugcuu

SEQ ID NO: 783808 - RNA, 12 nt, Human
uaaaauugaaag

SEQ ID NO: 783809 - RNA, 16 nt, Human
ugaaguacucauacau

SEQ ID NO: 783810 - RNA, 22 nt, Human
caaacagaacuauggaaaaaaa

SEQ ID NO: 783811 - RNA, 18 nt, Human
uccagaaauaaugaaaua

SEQ ID NO: 783812 - RNA, 18 nt, Human
uucuggguucaagcgauu

SEQ ID NO: 783813 - RNA, 17 nt, Human
ucagucauaacuaaaua

SEQ ID NO: 783814 - RNA, 14 nt, Human
ugaggucaggaguu

SEQ ID NO: 783815 - RNA, 13 nt, Human
uaucuauuaauau

SEQ ID NO: 783816 - RNA, 15 nt, Human
cauccugcaggcagc

SEQ ID NO: 783817 - RNA, 13 nt, Human
acuguuugccuuc

SEQ ID NO: 783818 - RNA, 16 nt, Human
acuacuuuaaaaaaaa

SEQ ID NO: 783819 - RNA, 15 nt, Human
gacccugaugaaaac

SEQ ID NO: 783820 - RNA, 24 nt, Human
acauuugcgaaugguuccauucuc

SEQ ID NO: 783821 - RNA, 14 nt, Human
uuaugauuaaguaa

SEQ ID NO: 783822 - RNA, 17 nt, Human
uaaaucuauuuauuaau

SEQ ID NO: 783823 - RNA, 18 nt, Human
ugguuccauucucucucc

SEQ ID NO: 783824 - RNA, 21 nt, Human
auuuuuaaauaaagaauuuua

SEQ ID NO: 783825 - RNA, 14 nt, Human
uagaauauuuauua

SEQ ID NO: 783826 - RNA, 11 nt, Human
aagucuuccau

SEQ ID NO: 783827 - RNA, 22 nt, Human
gccaucccucccuccaccuccc

SEQ ID NO: 783828 - RNA, 22 nt, Human
ccaucccucccuccaccucccu

SEQ ID NO: 783829 - RNA, 15 nt, Human
uguauuuauaaauau

SEQ ID NO: 783830 - RNA, 14 nt, Human
uggagacaccacca

SEQ ID NO: 783831 - RNA, 18 nt, Human
agagaaugagagacacac

SEQ ID NO: 783832 - RNA, 14 nt, Human
cuguaaucccagcu

SEQ ID NO: 783833 - RNA, 16 nt, Human
cugggucucagugucc

SEQ ID NO: 783834 - RNA, 21 nt, Human
ccagcaguucagagcugcccu

SEQ ID NO: 783835 - RNA, 19 nt, Human
ucaguccaugaagauguag

SEQ ID NO: 783836 - RNA, 16 nt, Human
gucccagccagcaguu

SEQ ID NO: 783837 - RNA, 21 nt, Human
uuuguauaaaauaauuuuuau

SEQ ID NO: 783838 - RNA, 12 nt, Human
uguaacuuauga

SEQ ID NO: 783839 - RNA, 21 nt, Human
uucacaagugaaaaacaucca

SEQ ID NO: 783840 - RNA, 23 nt, Human
ucccagccagcaguucagagcug

SEQ ID NO: 783841 - RNA, 13 nt, Human
uaaggcuucucuu

SEQ ID NO: 783842 - RNA, 23 nt, Human
caaagcaugggccuagcccacug

SEQ ID NO: 783843 - RNA, 15 nt, Human
aaacauccagauaca

SEQ ID NO: 783844 - RNA, 22 nt, Human
cugucucacuuaauccuuuguu

SEQ ID NO: 783845 - RNA, 16 nt, Human
uaaggcauaagaaaac

SEQ ID NO: 783846 - RNA, 11 nt, Human
aauauuauaau

SEQ ID NO: 783847 - RNA, 14 nt, Human
auaaucuuuuauac

SEQ ID NO: 783848 - RNA, 11 nt, Human
acugggacagg

SEQ ID NO: 783849 - RNA, 21 nt, Human
ucauucaaaaguugaaauuaa

SEQ ID NO: 783850 - RNA, 19 nt, Human
aauauuucucucuuuuuag

SEQ ID NO: 783851 - RNA, 13 nt, Human
uagaauaauacua

SEQ ID NO: 783852 - RNA, 12 nt, Human
auacagugucuu

SEQ ID NO: 783853 - RNA, 19 nt, Human
auccauggugugcuggcuu

SEQ ID NO: 783854 - RNA, 20 nt, Human
accucccugcaauaaaaugg

SEQ ID NO: 783855 - RNA, 15 nt, Human
auuuuuuaauuauua

SEQ ID NO: 783856 - RNA, 20 nt, Human
aacauuauuuauauggggaa

SEQ ID NO: 783857 - RNA, 18 nt, Human
uaaguuuuuuuuuaaaaa

SEQ ID NO: 783858 - RNA, 16 nt, Human
cuuuggaugcacuuua

SEQ ID NO: 783859 - RNA, 16 nt, Human
auaucaauuuaaaaaa

SEQ ID NO: 783860 - RNA, 14 nt, Human
aucagucauaacua

SEQ ID NO: 783861 - RNA, 21 nt, Human
gcccaagaaugagaagaauga

SEQ ID NO: 783862 - RNA, 16 nt, Human
aagucugauuuuccug

SEQ ID NO: 783863 - RNA, 17 nt, Human
uauaauauacuauauuu

SEQ ID NO: 783864 - RNA, 18 nt, Human
uuguugacaacugugacu

SEQ ID NO: 783865 - RNA, 20 nt, Human
cucccuccaccucccugcaa

SEQ ID NO: 783866 - RNA, 20 nt, Human
auaaaguauauauagaaucu

SEQ ID NO: 783867 - RNA, 22 nt, Human
aaaaaaccugagccccaaaagg

SEQ ID NO: 783868 - RNA, 12 nt, Human
agcuaaaguauc

SEQ ID NO: 783869 - RNA, 19 nt, Human
auucugcaagcuuuucaaa

SEQ ID NO: 783870 - RNA, 21 nt, Human
auugggaaaggaguagaaaaa

SEQ ID NO: 783871 - RNA, 16 nt, Human
cuguacuccagccugg

SEQ ID NO: 783872 - RNA, 18 nt, Human
aguuuaugcauacaguaa

SEQ ID NO: 783873 - RNA, 18 nt, Human
uacagagaaaagacauaa

SEQ ID NO: 783874 - RNA, 20 nt, Human
gcccauccugccccugagcc

SEQ ID NO: 783875 - RNA, 21 nt, Human
cuucuaaccugaacugauggg

SEQ ID NO: 783876 - RNA, 21 nt, Human
gcugcccucuccugggcagcu

SEQ ID NO: 783877 - RNA, 23 nt, Human
auauauguauuuauaaauauauu

SEQ ID NO: 783878 - RNA, 13 nt, Human
aaaaugagcaaaa

SEQ ID NO: 783879 - RNA, 16 nt, Human
acuuuccagagaccag

SEQ ID NO: 783880 - RNA, 23 nt, Human
cagaaugauuuuacggagauauc

SEQ ID NO: 783881 - RNA, 15 nt, Human
aaacuaauagaauua

SEQ ID NO: 783882 - RNA, 14 nt, Human
aaagaggaaugaag

SEQ ID NO: 783883 - RNA, 14 nt, Human
auccuugaagauuu

SEQ ID NO: 783884 - RNA, 19 nt, Human
cauuucaaaagguauuuau

SEQ ID NO: 783885 - RNA, 22 nt, Human
guacaauuauaagcuguuuuua

SEQ ID NO: 783886 - RNA, 11 nt, Human
aaguauauaua

SEQ ID NO: 783887 - RNA, 21 nt, Human
uauguaaauagaaacguguau

SEQ ID NO: 783888 - RNA, 16 nt, Human
gaggacuugggcggga

SEQ ID NO: 783889 - RNA, 23 nt, Human
ucucugaagaguggguuucacaa

SEQ ID NO: 783890 - RNA, 13 nt, Human
uuuauagugucuu

SEQ ID NO: 783891 - RNA, 13 nt, Human
aauaaauguacau

SEQ ID NO: 783892 - RNA, 23 nt, Human
ggaacaguuaccucugccucaga

SEQ ID NO: 783893 - RNA, 14 nt, Human
cuguuuuuaagcug

SEQ ID NO: 783894 - RNA, 23 nt, Human
aaguaucuguauugcauuaaaua

SEQ ID NO: 783895 - RNA, 15 nt, Human
uagauguagauaaac

SEQ ID NO: 783896 - RNA, 20 nt, Human
acaugagguacugagaguga

SEQ ID NO: 783897 - RNA, 16 nt, Human
cuuguauuuuacuuuu

SEQ ID NO: 783898 - RNA, 14 nt, Human
uuuguauaaaauaa

SEQ ID NO: 783899 - RNA, 15 nt, Human
auuucaugaaaagau

SEQ ID NO: 783900 - RNA, 16 nt, Human
aucaguuacucugaag

SEQ ID NO: 783901 - RNA, 13 nt, Human
gaaccuaggguga

SEQ ID NO: 783902 - RNA, 14 nt, Human
uagaauuaauggaa

SEQ ID NO: 783903 - RNA, 12 nt, Human
acacugaagaag

SEQ ID NO: 783904 - RNA, 20 nt, Human
auauuuuauaucaauuuaaa

SEQ ID NO: 783905 - RNA, 17 nt, Human
uuugaguguuuuaagau

SEQ ID NO: 783906 - RNA, 14 nt, Human
cugauuuuccugga

SEQ ID NO: 783907 - RNA, 22 nt, Human
cuggcaaggguucaccugggcu

SEQ ID NO: 783908 - RNA, 13 nt, Human
gcccucuccuggg

SEQ ID NO: 783909 - RNA, 12 nt, Human
ucuccugggcag

SEQ ID NO: 783910 - RNA, 13 nt, Human
aauccagaaauaa

SEQ ID NO: 783911 - RNA, 17 nt, Human
uguuucgcugauauaug

SEQ ID NO: 783912 - RNA, 10 nt, Human
auagugucuu

SEQ ID NO: 783913 - RNA, 13 nt, Human
gccuccccuccuc

SEQ ID NO: 783914 - RNA, 20 nt, Human
caaauguucaucaaugaaug

SEQ ID NO: 783915 - RNA, 21 nt, Human
ucuuaggguuaugauuaagua

SEQ ID NO: 783916 - RNA, 22 nt, Human
gagacgggguuugccaugcugg

SEQ ID NO: 783917 - RNA, 21 nt, Human
cuucucuuaaacacuaaaaag

SEQ ID NO: 783918 - RNA, 21 nt, Human
cuguauuuuuaccuuuuuccu

SEQ ID NO: 783919 - RNA, 20 nt, Human
uuuguuauggcuuaaugaca

SEQ ID NO: 783920 - RNA, 19 nt, Human
auuugguucuaggccgggc

SEQ ID NO: 783921 - RNA, 19 nt, Human
uaauuccuauauccuguga

SEQ ID NO: 783922 - RNA, 21 nt, Human
uguuuuaagauaaauuauaag

SEQ ID NO: 783923 - RNA, 13 nt, Human
uguacuuuuucca

SEQ ID NO: 783924 - RNA, 15 nt, Human
caagguucuucccuu

SEQ ID NO: 783925 - RNA, 12 nt, Human
cucauggaauug

SEQ ID NO: 783926 - RNA, 15 nt, Human
cuauauuaucaugca

SEQ ID NO: 783927 - RNA, 13 nt, Human
uucaccuguuuuu

SEQ ID NO: 783928 - RNA, 19 nt, Human
gaauuacaggcgugagcca

SEQ ID NO: 783929 - RNA, 12 nt, Human
gcuggccaggcu

SEQ ID NO: 783930 - RNA, 16 nt, Human
auuuaagauaauuaua

SEQ ID NO: 783931 - RNA, 23 nt, Human
gcccuggugccucaccccuugcc

SEQ ID NO: 783932 - RNA, 17 nt, Human
acuugaacccauauuug

SEQ ID NO: 783933 - RNA, 17 nt, Human
cuaucucauuuccaagc

SEQ ID NO: 783934 - RNA, 21 nt, Human
uaauuuugaauaaauaaaugu

SEQ ID NO: 783935 - RNA, 18 nt, Human
cugcaauaaaauggguuu

SEQ ID NO: 783936 - RNA, 22 nt, Human
uuaauggaauauguaaauagaa

SEQ ID NO: 783937 - RNA, 17 nt, Human
cauguauuuauuuuuuu

SEQ ID NO: 783938 - RNA, 22 nt, Human
augaauuuuuuucaucuucucu

SEQ ID NO: 783939 - RNA, 14 nt, Human
acuauggaaaaaaa

SEQ ID NO: 783940 - RNA, 23 nt, Human
gauuacaaggcuuuaucucaggg

SEQ ID NO: 783941 - RNA, 16 nt, Human
ucaucaaugaaugaau

SEQ ID NO: 783942 - RNA, 16 nt, Human
uuuaauuucaugaaaa

SEQ ID NO: 783943 - RNA, 20 nt, Human
acuguuaucaaaacuuucuu

SEQ ID NO: 783944 - RNA, 21 nt, Human
cuugaggacuugggcgggaca

SEQ ID NO: 783945 - RNA, 16 nt, Human
ccaggaaacucugcau

SEQ ID NO: 783946 - RNA, 13 nt, Human
gaagaacugaaau

SEQ ID NO: 783947 - RNA, 16 nt, Human
ucuguuccuucacauc

SEQ ID NO: 783948 - RNA, 12 nt, Human
gguauuuuaauc

SEQ ID NO: 783949 - RNA, 13 nt, Human
aauaaaaauaaau

SEQ ID NO: 783950 - RNA, 13 nt, Human
ucucaaaaaauaa

SEQ ID NO: 783951 - RNA, 15 nt, Human
uugcucauggaauug

SEQ ID NO: 783952 - RNA, 15 nt, Human
cuuuggggagccaac

SEQ ID NO: 783953 - RNA, 13 nt, Human
cugccuucucaac

SEQ ID NO: 783954 - RNA, 22 nt, Human
aggguccuuugggaaaggagaa

SEQ ID NO: 783955 - RNA, 21 nt, Human
cuuuucaaaauuggacuuaaa

SEQ ID NO: 783956 - RNA, 14 nt, Human
gccugcaauauuug

SEQ ID NO: 783957 - RNA, 12 nt, Human
aaauauuuuuau

SEQ ID NO: 783958 - RNA, 14 nt, Human
uauguauauuuuau

SEQ ID NO: 783959 - RNA, 17 nt, Human
auuauaauauacuauau

SEQ ID NO: 783960 - RNA, 18 nt, Human
agauuaugaucucagaaa

SEQ ID NO: 783961 - RNA, 20 nt, Human
aauguuacauuauuaucaac

SEQ ID NO: 783962 - RNA, 20 nt, Human
ugcaauaaaauguauuuguu

SEQ ID NO: 783963 - RNA, 15 nt, Human
aagugaaaaucuaca

SEQ ID NO: 783964 - RNA, 18 nt, Human
auuaaguuuuuuuuuaaa

SEQ ID NO: 783965 - RNA, 14 nt, Human
uauuuauuuuaaua

SEQ ID NO: 783966 - RNA, 18 nt, Human
cauggaauuggagcucgu

SEQ ID NO: 783967 - RNA, 23 nt, Human
aauaugugauguggcaaaucucu

SEQ ID NO: 783968 - RNA, 18 nt, Human
aaaucuauuuauuaauau

SEQ ID NO: 783969 - RNA, 15 nt, Human
aaggguacacugccu

SEQ ID NO: 783970 - RNA, 10 nt, Human
caacauuaaa

SEQ ID NO: 783971 - RNA, 19 nt, Human
caucaaggguacacugccu

SEQ ID NO: 783972 - RNA, 18 nt, Human
aaaaauaaaaauaaaaau

SEQ ID NO: 783973 - RNA, 20 nt, Human
acggacgaaccuugaaaacu

SEQ ID NO: 783974 - RNA, 14 nt, Human
auagugucugauga

SEQ ID NO: 783975 - RNA, 18 nt, Human
cuggacaguuuucugcuu

SEQ ID NO: 783976 - RNA, 20 nt, Human
aauuaccuugagccaguaau

SEQ ID NO: 783977 - RNA, 21 nt, Human
gcccauccugccccugagccc

SEQ ID NO: 783978 - RNA, 17 nt, Human
agaaacguguauauuuu

SEQ ID NO: 783979 - RNA, 16 nt, Human
cagaagcaacccaaau

SEQ ID NO: 783980 - RNA, 22 nt, Human
aaaucaggguuaguauugucca

SEQ ID NO: 783981 - RNA, 13 nt, Human
gagaauauuagcu

SEQ ID NO: 783982 - RNA, 16 nt, Human
gacauagaauuaacac

SEQ ID NO: 783983 - RNA, 15 nt, Human
cucgugggacaguca

SEQ ID NO: 783984 - RNA, 19 nt, Human
ggucucaguguccucaucu

SEQ ID NO: 783985 - RNA, 22 nt, Human
aaccagggagccccuuugauga

SEQ ID NO: 783986 - RNA, 12 nt, Human
cuuuaauuucau

SEQ ID NO: 783987 - RNA, 23 nt, Human
auuagggugguauuuagucuauu

SEQ ID NO: 783988 - RNA, 19 nt, Human
aacucuuaaucaaauagca

SEQ ID NO: 783989 - RNA, 13 nt, Human
cuggccaggcugg

SEQ ID NO: 783990 - RNA, 22 nt, Human
gaggggagcaugggaagugacg

SEQ ID NO: 783991 - RNA, 19 nt, Human
uaaucauauaauaaaugua

SEQ ID NO: 783992 - RNA, 11 nt, Human
aauuauuauuu

SEQ ID NO: 783993 - RNA, 19 nt, Human
caaacagaacuauggaaaa

SEQ ID NO: 783994 - RNA, 20 nt, Human
gaaacauuugguaaggggaa

SEQ ID NO: 783995 - RNA, 19 nt, Human
ugccucaguuuccugaccu

SEQ ID NO: 783996 - RNA, 17 nt, Human
gaggcauccuuccucac

SEQ ID NO: 783997 - RNA, 13 nt, Human
ugcaacaaaauuc

SEQ ID NO: 783998 - RNA, 18 nt, Human
uggugugcuggcuuaaaa

SEQ ID NO: 783999 - RNA, 18 nt, Human
ucuccgucucccaaagug

SEQ ID NO: 784000 - RNA, 20 nt, Human
uagaugcaguucugaagaag

SEQ ID NO: 784001 - RNA, 21 nt, Human
auugugaucagaccauaaugu

SEQ ID NO: 784002 - RNA, 17 nt, Human
uguugacaacugugacu

SEQ ID NO: 784003 - RNA, 20 nt, Human
aaacugauacccuuugaaaa

SEQ ID NO: 784004 - RNA, 17 nt, Human
uuccaagccucaugucc

SEQ ID NO: 784005 - RNA, 15 nt, Human
ggauuccccuaaccu

SEQ ID NO: 784006 - RNA, 15 nt, Human
uucacaagugaaaaa

SEQ ID NO: 784007 - RNA, 16 nt, Human
uggcugggaguggcau

SEQ ID NO: 784008 - RNA, 21 nt, Human
agagauuuuuaaauaaagaau

SEQ ID NO: 784009 - RNA, 15 nt, Human
caacuuuuguguaau

SEQ ID NO: 784010 - RNA, 22 nt, Human
caaccaaauggagugacuuagu

SEQ ID NO: 784011 - RNA, 22 nt, Human
agcuacuugggaggcugaggca

SEQ ID NO: 784012 - RNA, 20 nt, Human
uagaauaguguuggaaaaug

SEQ ID NO: 784013 - RNA, 22 nt, Human
ccgggaggcagagguugcagug

SEQ ID NO: 784014 - RNA, 17 nt, Human
ccaaaagguauuuuaau

SEQ ID NO: 784015 - RNA, 11 nt, Human
auuauuauuua

SEQ ID NO: 784016 - RNA, 14 nt, Human
cauguaauugcuug

SEQ ID NO: 784017 - RNA, 19 nt, Human
aaaauggagggaauaauac

SEQ ID NO: 784018 - RNA, 13 nt, Human
ucccucccuccac

SEQ ID NO: 784019 - RNA, 23 nt, Human
gcaauaugugauguggcaaaucu

SEQ ID NO: 784020 - RNA, 21 nt, Human
cccccauuguggucacaggaa

SEQ ID NO: 784021 - RNA, 19 nt, Human
cacacuaugguauuugagu

SEQ ID NO: 784022 - RNA, 16 nt, Human
uaaugaaaaugaauau

SEQ ID NO: 784023 - RNA, 21 nt, Human
ccuccaccucccugcaauaaa

SEQ ID NO: 784024 - RNA, 20 nt, Human
auugcuugaacccaggagau

SEQ ID NO: 784025 - RNA, 23 nt, Human
uccaccucccugcaauaaaaugg

SEQ ID NO: 784026 - RNA, 17 nt, Human
uagagacuuugugaaaa

SEQ ID NO: 784027 - RNA, 22 nt, Human
uuuauaacucaucauaaaauaa

SEQ ID NO: 784028 - RNA, 22 nt, Human
aaacauuucaaaagguauuuau

SEQ ID NO: 784029 - RNA, 17 nt, Human
auauauguauuauuuau

SEQ ID NO: 784030 - RNA, 21 nt, Human
caagacccaaaaggcagaagc

SEQ ID NO: 784031 - RNA, 11 nt, Human
uuuuuaaacaa

SEQ ID NO: 784032 - RNA, 21 nt, Human
aaauccuuuacuguuagucau

SEQ ID NO: 784033 - RNA, 18 nt, Human
gacuuugugaaaaaaaau

SEQ ID NO: 784034 - RNA, 14 nt, Human
ucccuugaugaaga

SEQ ID NO: 784035 - RNA, 19 nt, Human
cuugccaucccucccucca

SEQ ID NO: 784036 - RNA, 23 nt, Human
uacauuguuugucugucuucaua

SEQ ID NO: 784037 - RNA, 22 nt, Human
cucccacuagacaaguccagcc

SEQ ID NO: 784038 - RNA, 17 nt, Human
cacuuuauauuauuuug

SEQ ID NO: 784039 - RNA, 19 nt, Human
auaauacaccagagauaau

SEQ ID NO: 784040 - RNA, 21 nt, Human
acaugagguacugagagugaa

SEQ ID NO: 784041 - RNA, 14 nt, Human
aaaaucaaauucca

SEQ ID NO: 784042 - RNA, 17 nt, Human
ucaacccccauuucuau

SEQ ID NO: 784043 - RNA, 15 nt, Human
uggaaauaaaagauu

SEQ ID NO: 784044 - RNA, 12 nt, Human
aaacaaaaaaag

SEQ ID NO: 784045 - RNA, 11 nt, Human
aauugcagagu

SEQ ID NO: 784046 - RNA, 17 nt, Human
uaauuuuuauauuugaa

SEQ ID NO: 784047 - RNA, 22 nt, Human
aaugaaauggugaaaugcagag

SEQ ID NO: 784048 - RNA, 12 nt, Human
uaagaagacugc

SEQ ID NO: 784049 - RNA, 15 nt, Human
auauguauuuauaaa

SEQ ID NO: 784050 - RNA, 22 nt, Human
uguaccucucuuauagaauauu

SEQ ID NO: 784051 - RNA, 18 nt, Human
auagaaacguguauauuu

SEQ ID NO: 784052 - RNA, 17 nt, Human
uguuuuuauauauguga

SEQ ID NO: 784053 - RNA, 23 nt, Human
ugagcugauaucaugccccugua

SEQ ID NO: 784054 - RNA, 16 nt, Human
uguuuccuagcgcagc

SEQ ID NO: 784055 - RNA, 19 nt, Human
uaguaccaaucauuuuaau

SEQ ID NO: 784056 - RNA, 21 nt, Human
guacauuuccaaauucacaag

SEQ ID NO: 784057 - RNA, 23 nt, Human
gccaaaaaccaaauuuguauuua

SEQ ID NO: 784058 - RNA, 15 nt, Human
aauugaauucccugc

SEQ ID NO: 784059 - RNA, 18 nt, Human
gccccugcacuccagccu

SEQ ID NO: 784060 - RNA, 13 nt, Human
cauacaguaauuu

SEQ ID NO: 784061 - RNA, 17 nt, Human
aggcaugagucagucug

SEQ ID NO: 784062 - RNA, 13 nt, Human
aucaaugaaugaa

SEQ ID NO: 784063 - RNA, 20 nt, Human
aaguauuuauauauuuauaa

SEQ ID NO: 784064 - RNA, 17 nt, Human
uagaauaguguuggaaa

SEQ ID NO: 784065 - RNA, 14 nt, Human
agauguagaggaga

SEQ ID NO: 784066 - RNA, 16 nt, Human
uuuccacuacugcuac

SEQ ID NO: 784067 - RNA, 24 nt, Human
aaagacagcuucucauccugcagg

SEQ ID NO: 784068 - RNA, 17 nt, Human
ucugucucaaaaaauaa

SEQ ID NO: 784069 - RNA, 19 nt, Human
ugacacuagcuaauaucaa

SEQ ID NO: 784070 - RNA, 22 nt, Human
aauaugccccauucaacaucua

SEQ ID NO: 784071 - RNA, 19 nt, Human
accugucccagcgagggac

SEQ ID NO: 784072 - RNA, 20 nt, Human
aggcugagaugggagaauca

SEQ ID NO: 784073 - RNA, 20 nt, Human
uauauagauggcgagaaccu

SEQ ID NO: 784074 - RNA, 17 nt, Human
aagaagccacagaccua

SEQ ID NO: 784075 - RNA, 16 nt, Human
augcuguauuuuaaaa

SEQ ID NO: 784076 - RNA, 15 nt, Human
caauaaaauggguuu

SEQ ID NO: 784077 - RNA, 20 nt, Human
cuggauguggagggggcgcg

SEQ ID NO: 784078 - RNA, 23 nt, Human
cuuaaagaauuuucaaaaucaaa

SEQ ID NO: 784079 - RNA, 21 nt, Human
uguauaaaauaauuuuuauau

SEQ ID NO: 784080 - RNA, 16 nt, Human
uauguucuaagaagug

SEQ ID NO: 784081 - RNA, 19 nt, Human
aaauuugccaauuuacuuu

SEQ ID NO: 784082 - RNA, 18 nt, Human
agacuuugugaaaaaaaa

SEQ ID NO: 784083 - RNA, 18 nt, Human
aaaggcauucucugaaga

SEQ ID NO: 784084 - RNA, 22 nt, Human
ucucuacuaaaaauacaaaaau

SEQ ID NO: 784085 - RNA, 13 nt, Human
agggaccugcugu

SEQ ID NO: 784086 - RNA, 22 nt, Human
agacuuugugaaaaaaaauuuu

SEQ ID NO: 784087 - RNA, 18 nt, Human
agaaaacuaagaaauaug

SEQ ID NO: 784088 - RNA, 15 nt, Human
ggacaguuccugaga

SEQ ID NO: 784089 - RNA, 13 nt, Human
gaccuagaauaau

SEQ ID NO: 784090 - RNA, 15 nt, Human
acuuuccagagacca

SEQ ID NO: 784091 - RNA, 19 nt, Human
uuaucaauaucuaauauau

SEQ ID NO: 784092 - RNA, 19 nt, Human
auuacaggcgugagccacc

SEQ ID NO: 784093 - RNA, 17 nt, Human
cagugcuuggcccagga

SEQ ID NO: 784094 - RNA, 13 nt, Human
acagcccuucuuu

SEQ ID NO: 784095 - RNA, 18 nt, Human
acauuugcucauggaauu

SEQ ID NO: 784096 - RNA, 15 nt, Human
uauauuuuuuaugaa

SEQ ID NO: 784097 - RNA, 17 nt, Human
cugcacuccagccugag

SEQ ID NO: 784098 - RNA, 15 nt, Human
gcuuuucaaaauugg

SEQ ID NO: 784099 - RNA, 18 nt, Human
uuccauagagacuuugug

SEQ ID NO: 784100 - RNA, 21 nt, Human
gacagucaccucauggaauug

SEQ ID NO: 784101 - RNA, 15 nt, Human
uuacuacuuuaaaaa

SEQ ID NO: 784102 - RNA, 15 nt, Human
ugacaacuugaauaa

SEQ ID NO: 784103 - RNA, 10 nt, Human
gcuugccauc

SEQ ID NO: 784104 - RNA, 14 nt, Human
gugagccaccaaac

SEQ ID NO: 784105 - RNA, 19 nt, Human
ugaguuuuugauagcuuua

SEQ ID NO: 784106 - RNA, 14 nt, Human
gacagcaggucuca

SEQ ID NO: 784107 - RNA, 12 nt, Human
aauuauuauuua

SEQ ID NO: 784108 - RNA, 16 nt, Human
caaauuccagaaugau

SEQ ID NO: 784109 - RNA, 22 nt, Human
cgcaccuguaaucccagcuacu

SEQ ID NO: 784110 - RNA, 14 nt, Human
cuuugugaaaaaaa

SEQ ID NO: 784111 - RNA, 16 nt, Human
uauuauuuauauaugu

SEQ ID NO: 784112 - RNA, 20 nt, Human
cuccacaauagcagacagug

SEQ ID NO: 784113 - RNA, 15 nt, Human
uggcucacgccugua

SEQ ID NO: 784114 - RNA, 13 nt, Human
cucgaacugcugg

SEQ ID NO: 784115 - RNA, 18 nt, Human
uuaaacacuaaaaaggca

SEQ ID NO: 784116 - RNA, 15 nt, Human
gagauuccugagcca

SEQ ID NO: 784117 - RNA, 18 nt, Human
guugccaaggcuggagug

SEQ ID NO: 784118 - RNA, 15 nt, Human
aaaauacaaaaaaaa

SEQ ID NO: 784119 - RNA, 22 nt, Human
uuuccaagcaaguauuagaaua

SEQ ID NO: 784120 - RNA, 22 nt, Human
uguugagcuguuuucccugacc

SEQ ID NO: 784121 - RNA, 17 nt, Human
ccucugggucucagugu

SEQ ID NO: 784122 - RNA, 17 nt, Human
acaaaugcuuaugaaac

SEQ ID NO: 784123 - RNA, 17 nt, Human
cuuugggaggcugaggc

SEQ ID NO: 784124 - RNA, 14 nt, Human
acaucuuucacauu

SEQ ID NO: 784125 - RNA, 18 nt, Human
gcaagacauagaauagug

SEQ ID NO: 784126 - RNA, 10 nt, Human
uauaacucau

SEQ ID NO: 784127 - RNA, 20 nt, Human
auucccagccagcacagccu

SEQ ID NO: 784128 - RNA, 14 nt, Human
cuucucuucacagu

SEQ ID NO: 784129 - RNA, 17 nt, Human
auauauguauuuauaaa

SEQ ID NO: 784130 - RNA, 13 nt, Human
cagcugccucccc

SEQ ID NO: 784131 - RNA, 15 nt, Human
cucguggaacaguua

SEQ ID NO: 784132 - RNA, 17 nt, Human
uaaaauaaaguauauau

SEQ ID NO: 784133 - RNA, 16 nt, Human
acaaggaugaauuaag

SEQ ID NO: 784134 - RNA, 20 nt, Human
gccaaggcuggagugcagug

SEQ ID NO: 784135 - RNA, 18 nt, Human
uuauauggggaauauauu

SEQ ID NO: 784136 - RNA, 22 nt, Human
uagaauggaacucaaggaaauc

SEQ ID NO: 784137 - RNA, 14 nt, Human
cccugaugaaaaca

SEQ ID NO: 784138 - RNA, 23 nt, Human
uugccugcaggcaugagucaguc

SEQ ID NO: 784139 - RNA, 13 nt, Human
aagcuguggccag

SEQ ID NO: 784140 - RNA, 12 nt, Human
acaacugugacu

SEQ ID NO: 784141 - RNA, 21 nt, Human
cgggguuugccaugcuggcca

SEQ ID NO: 784142 - RNA, 16 nt, Human
cguggacuuacuauuu

SEQ ID NO: 784143 - RNA, 21 nt, Human
gagggaauaauaccuaagccu

SEQ ID NO: 784144 - RNA, 14 nt, Human
auauuuaagauaau

SEQ ID NO: 784145 - RNA, 18 nt, Human
uaagaaaacuaagaaaua

SEQ ID NO: 784146 - RNA, 19 nt, Human
uauuuacugagcuucucug

SEQ ID NO: 784147 - RNA, 16 nt, Human
cagggacuugaaccca

SEQ ID NO: 784148 - RNA, 13 nt, Human
cucaaaaaauaaa

SEQ ID NO: 784149 - RNA, 17 nt, Human
augcuggccaggcuggu

SEQ ID NO: 784150 - RNA, 14 nt, Human
caaucaaauaagua

SEQ ID NO: 784151 - RNA, 14 nt, Human
uccuguacuuuuuc

SEQ ID NO: 784152 - RNA, 16 nt, Human
cuuugaugauuaauuc

SEQ ID NO: 784153 - RNA, 14 nt, Human
guauucuucuuugg

SEQ ID NO: 784154 - RNA, 18 nt, Human
ucauuauugguugggcug

SEQ ID NO: 784155 - RNA, 16 nt, Human
cauucucucuccugua

SEQ ID NO: 784156 - RNA, 13 nt, Human
agaauauuuauua

SEQ ID NO: 784157 - RNA, 18 nt, Human
gagugacauguuuacaaa

SEQ ID NO: 784158 - RNA, 20 nt, Human
auuuuuaaauaaagaauuuu

SEQ ID NO: 784159 - RNA, 22 nt, Human
agcauuuuacuacuuuaaaaaa

SEQ ID NO: 784160 - RNA, 14 nt, Human
ggcaauagucaaau

SEQ ID NO: 784161 - RNA, 19 nt, Human
aggcauccuccacaauagc

SEQ ID NO: 784162 - RNA, 20 nt, Human
caugagagacagcaggucuc

SEQ ID NO: 784163 - RNA, 15 nt, Human
uaugugaaauaaaag

SEQ ID NO: 784164 - RNA, 20 nt, Human
ugcauacaguaauuuuaagu

SEQ ID NO: 784165 - RNA, 17 nt, Human
gucucccaaagugcugg

SEQ ID NO: 784166 - RNA, 23 nt, Human
uuacauuauuaucaacaauagug

SEQ ID NO: 784167 - RNA, 13 nt, Human
ugggacaguuccu

SEQ ID NO: 784168 - RNA, 18 nt, Human
uucagagcugcccucucc

SEQ ID NO: 784169 - RNA, 23 nt, Human
accuuuguagccacuucacuuuu

SEQ ID NO: 784170 - RNA, 12 nt, Human
augagagacagc

SEQ ID NO: 784171 - RNA, 16 nt, Human
uuaacauuauuuauau

SEQ ID NO: 784172 - RNA, 21 nt, Human
aggguucaccugggcugaggc

SEQ ID NO: 784173 - RNA, 20 nt, Human
cugaagaguggguuucacaa

SEQ ID NO: 784174 - RNA, 22 nt, Human
aucccagcuacuugggaggcug

SEQ ID NO: 784175 - RNA, 12 nt, Human
uaucuuauucac

SEQ ID NO: 784176 - RNA, 15 nt, Human
cccucccuccaccuc

SEQ ID NO: 784177 - RNA, 22 nt, Human
caauuauaagcuguuuuuauau

SEQ ID NO: 784178 - RNA, 15 nt, Human
cacaggcuccaaacu

SEQ ID NO: 784179 - RNA, 14 nt, Human
cucaccccuugcca

SEQ ID NO: 784180 - RNA, 20 nt, Human
uacaguaauuuuaaguaauu

SEQ ID NO: 784181 - RNA, 22 nt, Human
auagaauauuuauuaccucuga

SEQ ID NO: 784182 - RNA, 22 nt, Human
auaaagcuugcaacaaaauucu

SEQ ID NO: 784183 - RNA, 17 nt, Human
gcaccuguaaucccagc

SEQ ID NO: 784184 - RNA, 18 nt, Human
uuacuguaagaaaauauc

SEQ ID NO: 784185 - RNA, 16 nt, Human
uaauacuagucuuaua

SEQ ID NO: 784186 - RNA, 15 nt, Human
auccuaauaaaaagg

SEQ ID NO: 784187 - RNA, 21 nt, Human
uaaacuuaccugggcauucuu

SEQ ID NO: 784188 - RNA, 12 nt, Human
ucagaagaccug

SEQ ID NO: 784189 - RNA, 14 nt, Human
gccuccccuccucu

SEQ ID NO: 784190 - RNA, 23 nt, Human
ccaggagauggaaguugcaguga

SEQ ID NO: 784191 - RNA, 18 nt, Human
cuugggaauuuucuucca

SEQ ID NO: 784192 - RNA, 18 nt, Human
auucuuacauguuuucuu

SEQ ID NO: 784193 - RNA, 19 nt, Human
ugacuuaguguacaugaaa

SEQ ID NO: 784194 - RNA, 21 nt, Human
ugcccucuccugggcagcugc

SEQ ID NO: 784195 - RNA, 21 nt, Human
uuucaaaaucaaauuccagaa

SEQ ID NO: 784196 - RNA, 21 nt, Human
cugggauagcugacccagccc

SEQ ID NO: 784197 - RNA, 19 nt, Human
uugggaaaggaguagaaaa

SEQ ID NO: 784198 - RNA, 18 nt, Human
gauuaugaucucagaaau

SEQ ID NO: 784199 - RNA, 18 nt, Human
ucccuccaccucccugca

SEQ ID NO: 784200 - RNA, 18 nt, Human
guucaaagccaaguuuau

SEQ ID NO: 784201 - RNA, 16 nt, Human
ucaaaagaaagaaaau

SEQ ID NO: 784202 - RNA, 22 nt, Human
cauguauuuauuuuuuuacuuc

SEQ ID NO: 784203 - RNA, 18 nt, Human
uggucaauuuuguuaugu

SEQ ID NO: 784204 - RNA, 18 nt, Human
uuuucucuccucucccca

SEQ ID NO: 784205 - RNA, 19 nt, Human
gaccugacagcccaagggu

SEQ ID NO: 784206 - RNA, 19 nt, Human
acagucaccucauggaauu

SEQ ID NO: 784207 - RNA, 14 nt, Human
gagaagagaauauu

SEQ ID NO: 784208 - RNA, 18 nt, Human
auauaauguuguuauuua

SEQ ID NO: 784209 - RNA, 15 nt, Human
ccacuucacuuuuuu

SEQ ID NO: 784210 - RNA, 15 nt, Human
aaucucaauauuuca

SEQ ID NO: 784211 - RNA, 15 nt, Human
caguuuuaucauuuu

SEQ ID NO: 784212 - RNA, 15 nt, Human
guucugcagauaaac

SEQ ID NO: 784213 - RNA, 20 nt, Human
gccucuaaaaggccuguccc

SEQ ID NO: 784214 - RNA, 23 nt, Human
caugcugucuacacuaagagaga

SEQ ID NO: 784215 - RNA, 22 nt, Human
caaaacugauacccuuugaaaa

SEQ ID NO: 784216 - RNA, 20 nt, Human
uauaacucaucauaaaauaa

SEQ ID NO: 784217 - RNA, 19 nt, Human
gaggcugaggcaagagaau

SEQ ID NO: 784218 - RNA, 21 nt, Human
acuaagauuuguaauauuucu

SEQ ID NO: 784219 - RNA, 23 nt, Human
acaaauacucuuaggaagagaaa

SEQ ID NO: 784220 - RNA, 14 nt, Human
caacacuaacauau

SEQ ID NO: 784221 - RNA, 17 nt, Human
auuuuuaccuuuuuccu

SEQ ID NO: 784222 - RNA, 21 nt, Human
ugccuguaaucacagcuacuu

SEQ ID NO: 784223 - RNA, 13 nt, Human
agcagauuuuaau

SEQ ID NO: 784224 - RNA, 15 nt, Human
acugaagaagcacca

SEQ ID NO: 784225 - RNA, 19 nt, Human
aaaaguauaaauaaaauga

SEQ ID NO: 784226 - RNA, 22 nt, Human
ggcagcuuuccucaaaacuuca

SEQ ID NO: 784227 - RNA, 19 nt, Human
aucccucccuccaccuccc

SEQ ID NO: 784228 - RNA, 16 nt, Human
caaccacuucauucuu

SEQ ID NO: 784229 - RNA, 20 nt, Human
acaucucugauacuuuuuuc

SEQ ID NO: 784230 - RNA, 22 nt, Human
gcagccaugugauuacccucug

SEQ ID NO: 784231 - RNA, 19 nt, Human
cauaagaaaacuaagaaau

SEQ ID NO: 784232 - RNA, 21 nt, Human
ccuucacauccuguguuucua

SEQ ID NO: 784233 - RNA, 15 nt, Human
ugugucaguggaugc

SEQ ID NO: 784234 - RNA, 15 nt, Human
gggcuugaggacuug

SEQ ID NO: 784235 - RNA, 21 nt, Human
gcugccuccccuccucugcuu

SEQ ID NO: 784236 - RNA, 16 nt, Human
guaaucauauaauaaa

SEQ ID NO: 784237 - RNA, 24 nt, Human
uuaaacaaaaaaagcauuguaacu

SEQ ID NO: 784238 - RNA, 21 nt, Human
uauggaaaaaaaggaagaaau

SEQ ID NO: 784239 - RNA, 20 nt, Human
acuaauagaauuaauggaau

SEQ ID NO: 784240 - RNA, 13 nt, Human
auaauaaauguac

SEQ ID NO: 784241 - RNA, 21 nt, Human
ccuggaucucacaagcacuuu

SEQ ID NO: 784242 - RNA, 19 nt, Human
agaaacaucaguuacucug

SEQ ID NO: 784243 - RNA, 12 nt, Human
aucccucccucc

SEQ ID NO: 784244 - RNA, 17 nt, Human
ucuuauagaauauuuau

SEQ ID NO: 784245 - RNA, 16 nt, Human
aaagcauuguaacuua

SEQ ID NO: 784246 - RNA, 19 nt, Human
aaauaugccccauucaaca

SEQ ID NO: 784247 - RNA, 18 nt, Human
gaagaugcuuguauuuua

SEQ ID NO: 784248 - RNA, 12 nt, Human
uguaaauagaaa

SEQ ID NO: 784249 - RNA, 21 nt, Human
aggguuaugauuaaguaauga

SEQ ID NO: 784250 - RNA, 13 nt, Human
gcugccuccccuc

SEQ ID NO: 784251 - RNA, 19 nt, Human
aaugaauggcuaagcaaaa

SEQ ID NO: 784252 - RNA, 21 nt, Human
aaaagguauuuuaaucaccaa

SEQ ID NO: 784253 - RNA, 13 nt, Human
uaaauaaagaauu

SEQ ID NO: 784254 - RNA, 17 nt, Human
acuuuuaaguugcugau

SEQ ID NO: 784255 - RNA, 15 nt, Human
augaggaauauuugc

SEQ ID NO: 784256 - RNA, 22 nt, Human
ucuccugggcagcugccucccc

SEQ ID NO: 784257 - RNA, 15 nt, Human
acaggguuuauguuu

SEQ ID NO: 784258 - RNA, 17 nt, Human
ccucaguuuuaucauuu

SEQ ID NO: 784259 - RNA, 18 nt, Human
uccuacaagcuaaaauua

SEQ ID NO: 784260 - RNA, 14 nt, Human
acccgggaggcaga

SEQ ID NO: 784261 - RNA, 13 nt, Human
ccuaaccagccug

SEQ ID NO: 784262 - RNA, 20 nt, Human
gccgggcgugguggugagug

SEQ ID NO: 784263 - RNA, 14 nt, Human
auuguccaggucua

SEQ ID NO: 784264 - RNA, 15 nt, Human
aaauaaguauuuaua

SEQ ID NO: 784265 - RNA, 17 nt, Human
agaaauuccaggaaaau

SEQ ID NO: 784266 - RNA, 13 nt, Human
aagugcagccccg

SEQ ID NO: 784267 - RNA, 15 nt, Human
uauuuauuuuaauaa

SEQ ID NO: 784268 - RNA, 15 nt, Human
gaccacugcagaaga

SEQ ID NO: 784269 - RNA, 16 nt, Human
uguucuaagaagugaa

SEQ ID NO: 784270 - RNA, 12 nt, Human
gguuuauauaag

SEQ ID NO: 784271 - RNA, 20 nt, Human
caauuauuuuuacaguucuc

SEQ ID NO: 784272 - RNA, 23 nt, Human
aggaugguucccuugaugaagaa

SEQ ID NO: 784273 - RNA, 13 nt, Human
aauaaaaauaaaa

SEQ ID NO: 784274 - RNA, 18 nt, Human
ucucuaggaaauauuuau

SEQ ID NO: 784275 - RNA, 22 nt, Human
uucuagcuguugagcuguuuuc

SEQ ID NO: 784276 - RNA, 17 nt, Human
gaacuuuccacauucag

SEQ ID NO: 784277 - RNA, 21 nt, Human
aauuuuucucuaacucagaaa

SEQ ID NO: 784278 - RNA, 23 nt, Human
auucucucuccuguacuuuuucc

SEQ ID NO: 784279 - RNA, 18 nt, Human
ugggcacaggguuuaugu

SEQ ID NO: 784280 - RNA, 22 nt, Human
ugaauuuuuuucaucuucucug

SEQ ID NO: 784281 - RNA, 20 nt, Human
accagccaaccugggggcuu

SEQ ID NO: 784282 - RNA, 16 nt, Human
gagaccuguaaucaua

SEQ ID NO: 784283 - RNA, 19 nt, Human
uacaauuauuuuuacaguu

SEQ ID NO: 784284 - RNA, 17 nt, Human
cugugacugucucacuu

SEQ ID NO: 784285 - RNA, 19 nt, Human
ggcuuuagggaccugcugu

SEQ ID NO: 784286 - RNA, 20 nt, Human
gcacuugggacaaaaacaaa

SEQ ID NO: 784287 - RNA, 19 nt, Human
aauuccaggaaaaucugca

SEQ ID NO: 784288 - RNA, 15 nt, Human
uuacaucuuucacau

SEQ ID NO: 784289 - RNA, 20 nt, Human
uccagccugagcgacaguga

SEQ ID NO: 784290 - RNA, 17 nt, Human
caacauggugaaacccc

SEQ ID NO: 784291 - RNA, 23 nt, Human
uagucauuugcugagcauguacu

SEQ ID NO: 784292 - RNA, 16 nt, Human
aucauauaauaaaugu

SEQ ID NO: 784293 - RNA, 18 nt, Human
agguauuuauugagcacc

SEQ ID NO: 784294 - RNA, 14 nt, Human
ccugccccugagcc

SEQ ID NO: 784295 - RNA, 13 nt, Human
agacagcucugca

SEQ ID NO: 784296 - RNA, 20 nt, Human
agauuuuuaaauaaagaauu

SEQ ID NO: 784297 - RNA, 14 nt, Human
caggaguuuggcca

SEQ ID NO: 784298 - RNA, 20 nt, Human
uuaacacaugauccugcaau

SEQ ID NO: 784299 - RNA, 16 nt, Human
gacaacugugacugua

SEQ ID NO: 784300 - RNA, 16 nt, Human
aucccucccuccaccu

SEQ ID NO: 784301 - RNA, 22 nt, Human
uuaccucugccucagaaaacaa

SEQ ID NO: 784302 - RNA, 11 nt, Human
aaccugagccc

SEQ ID NO: 784303 - RNA, 23 nt, Human
aguacucauacauguuacaacac

SEQ ID NO: 784304 - RNA, 18 nt, Human
aaccuuauuguaccucuc

SEQ ID NO: 784305 - RNA, 16 nt, Human
auugucuagugaaacu

SEQ ID NO: 784306 - RNA, 16 nt, Human
uuuauauuugaaauau

SEQ ID NO: 784307 - RNA, 22 nt, Human
gaauuaauggaauauguaaaua

SEQ ID NO: 784308 - RNA, 13 nt, Human
cuguacuuuuucc

SEQ ID NO: 784309 - RNA, 18 nt, Human
uuuguuaaaugauuucau

SEQ ID NO: 784310 - RNA, 13 nt, Human
cugcacuccagcc

SEQ ID NO: 784311 - RNA, 21 nt, Human
agcccuucuuuccacagaagc

SEQ ID NO: 784312 - RNA, 10 nt, Human
auguuuucag

SEQ ID NO: 784313 - RNA, 17 nt, Human
aaauguucaucaaugaa

SEQ ID NO: 784314 - RNA, 18 nt, Human
uggagggaagccuugggg

SEQ ID NO: 784315 - RNA, 18 nt, Human
acugagcuucucugugaa

SEQ ID NO: 784316 - RNA, 21 nt, Human
uauguauuauuuauaauuccu

SEQ ID NO: 784317 - RNA, 18 nt, Human
aacucagggagcauuuau

SEQ ID NO: 784318 - RNA, 12 nt, Human
uuuguaauauuu

SEQ ID NO: 784319 - RNA, 16 nt, Human
ugcuccuggcuggggc

SEQ ID NO: 784320 - RNA, 20 nt, Human
ccugggcagcugccuccccu

SEQ ID NO: 784321 - RNA, 14 nt, Human
ccagccagcaguuc

SEQ ID NO: 784322 - RNA, 16 nt, Human
aagaaugagaagaaug

SEQ ID NO: 784323 - RNA, 12 nt, Human
ggggcucuggga

SEQ ID NO: 784324 - RNA, 20 nt, Human
ccaggcauccuccacaauag

SEQ ID NO: 784325 - RNA, 19 nt, Human
aaucuacacuccagugaga

SEQ ID NO: 784326 - RNA, 20 nt, Human
cuaaaugucaaucagccuag

SEQ ID NO: 784327 - RNA, 23 nt, Human
uacuguauuuuuaccuuuuuccu

SEQ ID NO: 784328 - RNA, 13 nt, Human
uuaggcuauucac

SEQ ID NO: 784329 - RNA, 15 nt, Human
cagacaguguuuucu

SEQ ID NO: 784330 - RNA, 13 nt, Human
cuucucaacucca

SEQ ID NO: 784331 - RNA, 15 nt, Human
gagaaucagaucauu

SEQ ID NO: 784332 - RNA, 15 nt, Human
ggcaauagucaaauu

SEQ ID NO: 784333 - RNA, 19 nt, Human
cggagccccuugggcaggu

SEQ ID NO: 784334 - RNA, 16 nt, Human
uaaauggacaaaugcu

SEQ ID NO: 784335 - RNA, 14 nt, Human
cuggaaaucagggu

SEQ ID NO: 784336 - RNA, 14 nt, Human
cuuaggaagagaaa

SEQ ID NO: 784337 - RNA, 15 nt, Human
uacccuuugaaaaag

SEQ ID NO: 784338 - RNA, 20 nt, Human
auuaauauauguauuauuua

SEQ ID NO: 784339 - RNA, 20 nt, Human
uggucucgaacugcuggauu

SEQ ID NO: 784340 - RNA, 15 nt, Human
aacuauggaaaaaaa

SEQ ID NO: 784341 - RNA, 17 nt, Human
acaaguccagccuggca

SEQ ID NO: 784342 - RNA, 14 nt, Human
gaaagcagaacagu

SEQ ID NO: 784343 - RNA, 21 nt, Human
cuaaaucuauuuauuaauauu

SEQ ID NO: 784344 - RNA, 23 nt, Human
uuuucaaaaucaaauuccagaau

SEQ ID NO: 784345 - RNA, 20 nt, Human
aguuuuuuuuuaaaaaagaa

SEQ ID NO: 784346 - RNA, 14 nt, Human
aaucucaauauuuc

SEQ ID NO: 784347 - RNA, 19 nt, Human
ucagagcugcccucuccug

SEQ ID NO: 784348 - RNA, 20 nt, Human
uucuguaaucuucagaccua

SEQ ID NO: 784349 - RNA, 16 nt, Human
agccgagccucaagau

SEQ ID NO: 784350 - RNA, 22 nt, Human
agacucuacccauauuacagau

SEQ ID NO: 784351 - RNA, 18 nt, Human
ccuguaaucccagcuacu

SEQ ID NO: 784352 - RNA, 13 nt, Human
acaagaaaugaaa

SEQ ID NO: 784353 - RNA, 15 nt, Human
cacaagcacuuuccc

SEQ ID NO: 784354 - RNA, 17 nt, Human
ugcacaucaaaauaugc

SEQ ID NO: 784355 - RNA, 14 nt, Human
caacaguuuuuuau

SEQ ID NO: 784356 - RNA, 17 nt, Human
uuacagagacagaaagc

SEQ ID NO: 784357 - RNA, 17 nt, Human
ugaaaagauuaugaucu

SEQ ID NO: 784358 - RNA, 18 nt, Human
acugauggguuucuccag

SEQ ID NO: 784359 - RNA, 14 nt, Human
uauagaauauuuau

SEQ ID NO: 784360 - RNA, 22 nt, Human
auuaaggcuucucuuaaacacu

SEQ ID NO: 784361 - RNA, 23 nt, Human
uaggcguggacuuacuauuuauu

SEQ ID NO: 784362 - RNA, 21 nt, Human
guaaaauacuucuugaagccg

SEQ ID NO: 784363 - RNA, 17 nt, Human
gucacacaaccuguccc

SEQ ID NO: 784364 - RNA, 15 nt, Human
agaauuaauggaaua

SEQ ID NO: 784365 - RNA, 22 nt, Human
aucaccaaggcugauuaaacca

SEQ ID NO: 784366 - RNA, 15 nt, Human
caacauuaaaacaau

SEQ ID NO: 784367 - RNA, 15 nt, Human
uaaaaugagcaaaag

SEQ ID NO: 784368 - RNA, 16 nt, Human
gagcaccugcaggcgu

SEQ ID NO: 784369 - RNA, 19 nt, Human
aacuagaauuuauucaauu

SEQ ID NO: 784370 - RNA, 18 nt, Human
gugacuuuccuaaaucaa

SEQ ID NO: 784371 - RNA, 20 nt, Human
agaccagccaaccugggggc

SEQ ID NO: 784372 - RNA, 12 nt, Human
ugaugaaaacau

SEQ ID NO: 784373 - RNA, 12 nt, Human
acaagaaaugaa

SEQ ID NO: 784374 - RNA, 21 nt, Human
aauuucagaagaaauucugca

SEQ ID NO: 784375 - RNA, 18 nt, Human
auaaauguaucuuauuca

SEQ ID NO: 784376 - RNA, 14 nt, Human
uugcagugagcuga

SEQ ID NO: 784377 - RNA, 23 nt, Human
ggggagccaacagaagcuuccau

SEQ ID NO: 784378 - RNA, 14 nt, Human
aaauuggacuuaaa

SEQ ID NO: 784379 - RNA, 15 nt, Human
auauugacuuuuuau

SEQ ID NO: 784380 - RNA, 23 nt, Human
caaaagguauuuauugagcaccu

SEQ ID NO: 784381 - RNA, 17 nt, Human
gugacuguacccaaaug

SEQ ID NO: 784382 - RNA, 15 nt, Human
aauaucuaauauaua

SEQ ID NO: 784383 - RNA, 20 nt, Human
aucaaguccuacaagcuaaa

SEQ ID NO: 784384 - RNA, 19 nt, Human
aguucagagcugcccucuc

SEQ ID NO: 784385 - RNA, 15 nt, Human
aaauaauuuuuauau

SEQ ID NO: 784386 - RNA, 16 nt, Human
cuccucugcuugccau

SEQ ID NO: 784387 - RNA, 17 nt, Human
uaucaauuuaaaaaaaa

SEQ ID NO: 784388 - RNA, 18 nt, Human
uaugugauguggcaaauc

SEQ ID NO: 784389 - RNA, 19 nt, Human
cugcuggauucaagugauc

SEQ ID NO: 784390 - RNA, 18 nt, Human
caccuguccccgaaacua

SEQ ID NO: 784391 - RNA, 14 nt, Human
uugccaugugcuag

SEQ ID NO: 784392 - RNA, 20 nt, Human
ucaucugugauucccuccug

SEQ ID NO: 784393 - RNA, 13 nt, Human
ggaaguagaggag

SEQ ID NO: 784394 - RNA, 18 nt, Human
acugacucuuaagaagac

SEQ ID NO: 784395 - RNA, 21 nt, Human
uuaaaucuaaaucuauuuauu

SEQ ID NO: 784396 - RNA, 17 nt, Human
agaauugcuugaaccca

SEQ ID NO: 784397 - RNA, 14 nt, Human
uucuaugaaauauu

SEQ ID NO: 784398 - RNA, 14 nt, Human
auauuuauuuuaau

SEQ ID NO: 784399 - RNA, 21 nt, Human
ugaacaaauuuacagagacag

SEQ ID NO: 784400 - RNA, 16 nt, Human
auacauguuacaacac

SEQ ID NO: 784401 - RNA, 21 nt, Human
ugagggcuugaggacuugggc

SEQ ID NO: 784402 - RNA, 18 nt, Human
cuuuuuuuuuuuuuuaaa

SEQ ID NO: 784403 - RNA, 12 nt, Human
uuauuuuuuaau

SEQ ID NO: 784404 - RNA, 14 nt, Human
gccugucccugcag

SEQ ID NO: 784405 - RNA, 21 nt, Human
auaguaccaaucauuuuaauu

SEQ ID NO: 784406 - RNA, 16 nt, Human
aaauaaguauuuauaa

SEQ ID NO: 784407 - RNA, 16 nt, Human
ucucuauuaggaaaua

SEQ ID NO: 784408 - RNA, 17 nt, Human
ucagacauagaauuaac

SEQ ID NO: 784409 - RNA, 13 nt, Human
acaacauuaaaac

SEQ ID NO: 784410 - RNA, 21 nt, Human
accacccuugccauggagguu

SEQ ID NO: 784411 - RNA, 18 nt, Human
ccuccaccucccugcaau

SEQ ID NO: 784412 - RNA, 18 nt, Human
auauuauaauuuuuuuca

SEQ ID NO: 784413 - RNA, 21 nt, Human
auuaucuaucuaucuauuuau

SEQ ID NO: 784414 - RNA, 23 nt, Human
uuuauaugcuucuguuuuauaau

SEQ ID NO: 784415 - RNA, 15 nt, Human
auauaugugaaauaa

SEQ ID NO: 784416 - RNA, 14 nt, Human
gagagugaacaaau

SEQ ID NO: 784417 - RNA, 14 nt, Human
agucugacuguuuc

SEQ ID NO: 784418 - RNA, 23 nt, Human
acuggcucccuggaagagaucaa

SEQ ID NO: 784419 - RNA, 12 nt, Human
uauucacaagac

SEQ ID NO: 784420 - RNA, 11 nt, Human
augugcaauau

SEQ ID NO: 784421 - RNA, 15 nt, Human
aaaucuaaaucuauu

SEQ ID NO: 784422 - RNA, 23 nt, Human
ucaugcauuugcacuauuggaag

SEQ ID NO: 784423 - RNA, 15 nt, Human
uauccuaauaaaaag

SEQ ID NO: 784424 - RNA, 19 nt, Human
uauaucaguccucuuucaa

SEQ ID NO: 784425 - RNA, 16 nt, Human
uuucuuaaagaauuuu

SEQ ID NO: 784426 - RNA, 16 nt, Human
aacagaagcuuccauu

SEQ ID NO: 784427 - RNA, 20 nt, Human
ggucucaguguccucaucug

SEQ ID NO: 784428 - RNA, 15 nt, Human
agucugaugagaacu

SEQ ID NO: 784429 - RNA, 19 nt, Human
uaucacuugucaauaaaau

SEQ ID NO: 784430 - RNA, 22 nt, Human
cuggagcuugaaauagugucug

SEQ ID NO: 784431 - RNA, 14 nt, Human
uccuucacauccug

SEQ ID NO: 784432 - RNA, 17 nt, Human
ugggaauuuucuuccaa

SEQ ID NO: 784433 - RNA, 14 nt, Human
ggcugggaguggca

SEQ ID NO: 784434 - RNA, 16 nt, Human
gacaagcucacagacc

SEQ ID NO: 784435 - RNA, 21 nt, Human
auauuuaagauaauuauaaua

SEQ ID NO: 784436 - RNA, 13 nt, Human
accaaauggagug

SEQ ID NO: 784437 - RNA, 17 nt, Human
ugagaagagaauauuag

SEQ ID NO: 784438 - RNA, 21 nt, Human
gccuuuucccaacuccagaaa

SEQ ID NO: 784439 - RNA, 17 nt, Human
uccugccccugagccca

SEQ ID NO: 784440 - RNA, 14 nt, Human
ucuggcacuuggga

SEQ ID NO: 784441 - RNA, 23 nt, Human
aaguauccuucagccugaaagag

SEQ ID NO: 784442 - RNA, 23 nt, Human
aaacucagggagcauuuauaaau

SEQ ID NO: 784443 - RNA, 14 nt, Human
gccccgggaguggc

SEQ ID NO: 784444 - RNA, 22 nt, Human
gacucugucucaaaaaauaaaa

SEQ ID NO: 784445 - RNA, 19 nt, Human
accccuucauccucugagu

SEQ ID NO: 784446 - RNA, 14 nt, Human
gcaguucagagcug

SEQ ID NO: 784447 - RNA, 18 nt, Human
caugccccuguacuccag

SEQ ID NO: 784448 - RNA, 16 nt, Human
cuuguaauucuaaaug

SEQ ID NO: 784449 - RNA, 19 nt, Human
auuaucuaucuaucuauuu

SEQ ID NO: 784450 - RNA, 22 nt, Human
ucgucgucuugacuuuggcaaa

SEQ ID NO: 784451 - RNA, 21 nt, Human
aaugugacuuaaugccacuaa

SEQ ID NO: 784452 - RNA, 15 nt, Human
cagcaguucagagcu

SEQ ID NO: 784453 - RNA, 23 nt, Human
caagggaguuaggcuauucacaa

SEQ ID NO: 784454 - RNA, 15 nt, Human
auguuguuauuuaaa

SEQ ID NO: 784455 - RNA, 12 nt, Human
auuauuauuuau

SEQ ID NO: 784456 - RNA, 21 nt, Human
auuuuaguaagagauuccuga

SEQ ID NO: 784457 - RNA, 19 nt, Human
ucaucaaucaaauaaguau

SEQ ID NO: 784458 - RNA, 15 nt, Human
agccgggcauggugg

SEQ ID NO: 784459 - RNA, 16 nt, Human
ucaaagccaaguuuau

SEQ ID NO: 784460 - RNA, 16 nt, Human
auuuuaaguaauuuca

SEQ ID NO: 784461 - RNA, 15 nt, Human
auguauuuauaaaua

SEQ ID NO: 784462 - RNA, 22 nt, Human
aauaguucaaagccaaguuuau

SEQ ID NO: 784463 - RNA, 12 nt, Human
caacccaaaugu

SEQ ID NO: 784464 - RNA, 18 nt, Human
aaauauauuuaagauaau

SEQ ID NO: 784465 - RNA, 14 nt, Human
uauaaauuuuccca

SEQ ID NO: 784466 - RNA, 17 nt, Human
ucuauuaauauauguau

SEQ ID NO: 784467 - RNA, 12 nt, Human
uacaucuuucac

SEQ ID NO: 784468 - RNA, 14 nt, Human
caugagucagucug

SEQ ID NO: 784469 - RNA, 21 nt, Human
uaguauuucuaugaaauauua

SEQ ID NO: 784470 - RNA, 16 nt, Human
cuuuaugcuaagugaa

SEQ ID NO: 784471 - RNA, 16 nt, Human
acgccuguaaucccag

SEQ ID NO: 784472 - RNA, 18 nt, Human
ggccuggcugggaguggc

SEQ ID NO: 784473 - RNA, 14 nt, Human
uaaacaaaggaauu

SEQ ID NO: 784474 - RNA, 18 nt, Human
aacuagaauuuauucaau

SEQ ID NO: 784475 - RNA, 16 nt, Human
guaacauagguuuuua

SEQ ID NO: 784476 - RNA, 19 nt, Human
augaaagcagggacuugaa

SEQ ID NO: 784477 - RNA, 16 nt, Human
aauaaagaauuuuaaa

SEQ ID NO: 784478 - RNA, 13 nt, Human
ugauagcuuuauu

SEQ ID NO: 784479 - RNA, 18 nt, Human
uaaaauggagacaccacc

SEQ ID NO: 784480 - RNA, 23 nt, Human
uguaaucccagcuacuugggagg

SEQ ID NO: 784481 - RNA, 18 nt, Human
guuucaaacauauauaac

SEQ ID NO: 784482 - RNA, 22 nt, Human
gugugaccacugcagaagacag

SEQ ID NO: 784483 - RNA, 14 nt, Human
auuuuaaguaauuu

SEQ ID NO: 784484 - RNA, 18 nt, Human
uuucuuaaagaauuuuca

SEQ ID NO: 784485 - RNA, 15 nt, Human
uagggugauauuaac

SEQ ID NO: 784486 - RNA, 14 nt, Human
uaucuuguuuuucc

SEQ ID NO: 784487 - RNA, 16 nt, Human
aguguuggaaaaugug

SEQ ID NO: 784488 - RNA, 18 nt, Human
uauaacaaugcuguauuu

SEQ ID NO: 784489 - RNA, 18 nt, Human
uuccugagaccagccaac

SEQ ID NO: 784490 - RNA, 15 nt, Human
cacuaugguauuuga

SEQ ID NO: 784491 - RNA, 20 nt, Human
cccugcacuccagccugagc

SEQ ID NO: 784492 - RNA, 20 nt, Human
uacaucccuuaccugggaaa

SEQ ID NO: 784493 - RNA, 20 nt, Human
ccugccuaagugcagccccg

SEQ ID NO: 784494 - RNA, 17 nt, Human
uuuccacauucagagcu

SEQ ID NO: 784495 - RNA, 23 nt, Human
uuagaugcaguucugaagaagau

SEQ ID NO: 784496 - RNA, 19 nt, Human
aagauuaugaucucagaaa

SEQ ID NO: 784497 - RNA, 18 nt, Human
uucuagcuguugagcugu

SEQ ID NO: 784498 - RNA, 14 nt, Human
ugcuggagcucugc

SEQ ID NO: 784499 - RNA, 12 nt, Human
ucacauacaauu

SEQ ID NO: 784500 - RNA, 13 nt, Human
gcgggacacaggc

SEQ ID NO: 784501 - RNA, 14 nt, Human
augaaauaacuagg

SEQ ID NO: 784502 - RNA, 22 nt, Human
ugauaguuguaccgcaauguga

SEQ ID NO: 784503 - RNA, 20 nt, Human
ucaggugacccugaugaaaa

SEQ ID NO: 784504 - RNA, 16 nt, Human
uuuaacacagugucug

SEQ ID NO: 784505 - RNA, 15 nt, Human
auaucuauuaauaua

SEQ ID NO: 784506 - RNA, 13 nt, Human
uuuucaauauuua

SEQ ID NO: 784507 - RNA, 16 nt, Human
cuggauguggaggggg

SEQ ID NO: 784508 - RNA, 19 nt, Human
cugcuugccaucccucccu

SEQ ID NO: 784509 - RNA, 20 nt, Human
uuccugaccuaugaaacaga

SEQ ID NO: 784510 - RNA, 15 nt, Human
gaagauguagaggag

SEQ ID NO: 784511 - RNA, 13 nt, Human
aaaaaaagccaaa

SEQ ID NO: 784512 - RNA, 20 nt, Human
uaagugaaauaagccagaca

SEQ ID NO: 784513 - RNA, 16 nt, Human
auucugcaagcuuuuc

SEQ ID NO: 784514 - RNA, 20 nt, Human
cuaagaaauaugcacaauag

SEQ ID NO: 784515 - RNA, 22 nt, Human
ccagcaaauucgcugcaaccug

SEQ ID NO: 784516 - RNA, 15 nt, Human
uguuuuuaaacugga

SEQ ID NO: 784517 - RNA, 11 nt, Human
cuuugccuuua

SEQ ID NO: 784518 - RNA, 22 nt, Human
agaaaccuuauuguaccucucu

SEQ ID NO: 784519 - RNA, 11 nt, Human
uccucuuucaa

SEQ ID NO: 784520 - RNA, 20 nt, Human
gacauuugcucauggaauug

SEQ ID NO: 784521 - RNA, 19 nt, Human
aggucacacaaccuguccc

SEQ ID NO: 784522 - RNA, 15 nt, Human
agccugaaagaggaa

SEQ ID NO: 784523 - RNA, 16 nt, Human
aauuuaagauuuuguu

SEQ ID NO: 784524 - RNA, 14 nt, Human
uacagagaaaagac

SEQ ID NO: 784525 - RNA, 16 nt, Human
cuggcaguuuuccauu

SEQ ID NO: 784526 - RNA, 14 nt, Human
aauaucuauuaaua

SEQ ID NO: 784527 - RNA, 19 nt, Human
cagcuucucauccugcagg

SEQ ID NO: 784528 - RNA, 16 nt, Human
aauugacccacaagaa

SEQ ID NO: 784529 - RNA, 15 nt, Human
accagggagccccuu

SEQ ID NO: 784530 - RNA, 16 nt, Human
caucuagcaaauguua

SEQ ID NO: 784531 - RNA, 18 nt, Human
auagaauuaacacaugau

SEQ ID NO: 784532 - RNA, 14 nt, Human
uccucugcuugcca

SEQ ID NO: 784533 - RNA, 22 nt, Human
aguugguaucaaccaaauggag

SEQ ID NO: 784534 - RNA, 20 nt, Human
cugugguccgaagucuucca

SEQ ID NO: 784535 - RNA, 22 nt, Human
auuuuaauuuugaauaaauaaa

SEQ ID NO: 784536 - RNA, 20 nt, Human
uauuuauuacuguaagaaaa

SEQ ID NO: 784537 - RNA, 18 nt, Human
aaagcacuuauuuauugu

SEQ ID NO: 784538 - RNA, 18 nt, Human
ugcuggauucaagugauc

SEQ ID NO: 784539 - RNA, 19 nt, Human
uuguuaaaauuaucaauau

SEQ ID NO: 784540 - RNA, 20 nt, Human
cucuccugggcagcugccuc

SEQ ID NO: 784541 - RNA, 16 nt, Human
acaugaaguccaagca

SEQ ID NO: 784542 - RNA, 15 nt, Human
agccucaagaugaag

SEQ ID NO: 784543 - RNA, 19 nt, Human
gaauuuuuuucaucuucuc

SEQ ID NO: 784544 - RNA, 21 nt, Human
auaagcaaagacuaugaggaa

SEQ ID NO: 784545 - RNA, 13 nt, Human
caguauccaguac

SEQ ID NO: 784546 - RNA, 17 nt, Human
gagacaccaccacccuu

SEQ ID NO: 784547 - RNA, 14 nt, Human
cagugucaggagga

SEQ ID NO: 784548 - RNA, 16 nt, Human
acccagccccuugaga

SEQ ID NO: 784549 - RNA, 23 nt, Human
caagagaauugcuugaacccagg

SEQ ID NO: 784550 - RNA, 22 nt, Human
cugggacaggggagaaccuagg

SEQ ID NO: 784551 - RNA, 22 nt, Human
uuauuuauaacaaccuaaauuu

SEQ ID NO: 784552 - RNA, 20 nt, Human
cgaaauguuauuuuuuaauu

SEQ ID NO: 784553 - RNA, 12 nt, Human
ccuggcugggag

SEQ ID NO: 784554 - RNA, 21 nt, Human
ugugaucagaccauaauguua

SEQ ID NO: 784555 - RNA, 15 nt, Human
agagcugcccucucc

SEQ ID NO: 784556 - RNA, 17 nt, Human
ccucugcuugccauccc

SEQ ID NO: 784557 - RNA, 15 nt, Human
cccuguacuccagcc

SEQ ID NO: 784558 - RNA, 19 nt, Human
aaaacuaagaaauaugcac

SEQ ID NO: 784559 - RNA, 20 nt, Human
ccagugagacagcucugcau

SEQ ID NO: 784560 - RNA, 14 nt, Human
augcuguauucuuc

SEQ ID NO: 784561 - RNA, 24 nt, Human
aaucugaggccuccucucucaguu

SEQ ID NO: 784562 - RNA, 15 nt, Human
uuugaauaaauaaau

SEQ ID NO: 784563 - RNA, 22 nt, Human
gaaauaagccagacaucaacag

SEQ ID NO: 784564 - RNA, 23 nt, Human
caauuauaagcuguuuuuauaua

SEQ ID NO: 784565 - RNA, 20 nt, Human
uugaacccgggaggcagagg

SEQ ID NO: 784566 - RNA, 19 nt, Human
aucucugauacuuuuuuca

SEQ ID NO: 784567 - RNA, 23 nt, Human
ucacaccaggcuugccugcaggc

SEQ ID NO: 784568 - RNA, 20 nt, Human
ucaugcaaaugcuguauucu

SEQ ID NO: 784569 - RNA, 22 nt, Human
uauuccuuuuucucuccucucc

SEQ ID NO: 784570 - RNA, 21 nt, Human
acaauuauuuuuacaguucuc

SEQ ID NO: 784571 - RNA, 22 nt, Human
gcuucucauccugcaggcagcu

SEQ ID NO: 784572 - RNA, 13 nt, Human
aauuagaugaacu

SEQ ID NO: 784573 - RNA, 14 nt, Human
auugucuagugaaa

SEQ ID NO: 784574 - RNA, 20 nt, Human
auuacauuuguauaaaauaa

SEQ ID NO: 784575 - RNA, 20 nt, Human
auuauaauuuuuuucaauau

SEQ ID NO: 784576 - RNA, 16 nt, Human
accuuauuguaccucu

SEQ ID NO: 784577 - RNA, 17 nt, Human
augcacacagugcuuuc

SEQ ID NO: 784578 - RNA, 18 nt, Human
uauuuugcauaguaccaa

SEQ ID NO: 784579 - RNA, 15 nt, Human
acuggccugcuggau

SEQ ID NO: 784580 - RNA, 16 nt, Human
agucuuauaauagguu

SEQ ID NO: 784581 - RNA, 14 nt, Human
ugacagcccaaggg

SEQ ID NO: 784582 - RNA, 17 nt, Human
cccagccagcaguucag

SEQ ID NO: 784583 - RNA, 19 nt, Human
aagcauuccaacuaucuca

SEQ ID NO: 784584 - RNA, 23 nt, Human
caguucauauguaccauguacau

SEQ ID NO: 784585 - RNA, 23 nt, Human
ugagcaccugcaggcgugaccug

SEQ ID NO: 784586 - RNA, 17 nt, Human
ugacagcccaagggugg

SEQ ID NO: 784587 - RNA, 20 nt, Human
auuacaguuagagauuuuua

SEQ ID NO: 784588 - RNA, 15 nt, Human
auuccccuaaccuca

SEQ ID NO: 784589 - RNA, 20 nt, Human
gcuggaauugaauucccugc

SEQ ID NO: 784590 - RNA, 12 nt, Human
caucuuucacau

SEQ ID NO: 784591 - RNA, 17 nt, Human
aaggaaaucugugucag

SEQ ID NO: 784592 - RNA, 23 nt, Human
uagauguauagguugaugguggu

SEQ ID NO: 784593 - RNA, 16 nt, Human
agacaaauucuguuuc

SEQ ID NO: 784594 - RNA, 17 nt, Human
ccuccaccuucuggguu

SEQ ID NO: 784595 - RNA, 12 nt, Human
ccaucccucccu

SEQ ID NO: 784596 - RNA, 12 nt, Human
uuuuuaaauaaa

SEQ ID NO: 784597 - RNA, 15 nt, Human
gugaccacugcagaa

SEQ ID NO: 784598 - RNA, 22 nt, Human
gaugcaguucugaagaagaugg

SEQ ID NO: 784599 - RNA, 18 nt, Human
uacaguaauuuuaaguaa

SEQ ID NO: 784600 - RNA, 13 nt, Human
gcaaccuccaccu

SEQ ID NO: 784601 - RNA, 12 nt, Human
cauucucugaag

SEQ ID NO: 784602 - RNA, 17 nt, Human
ucuccuguacuuuuucc

SEQ ID NO: 784603 - RNA, 17 nt, Human
ccacugcagaagacagu

SEQ ID NO: 784604 - RNA, 17 nt, Human
cuuaaagaauuuucaaa

SEQ ID NO: 784605 - RNA, 21 nt, Human
cuaccaaaaaucucaauauuu

SEQ ID NO: 784606 - RNA, 14 nt, Human
cauagguuuuuagu

SEQ ID NO: 784607 - RNA, 15 nt, Human
cacaggacagcccuu

SEQ ID NO: 784608 - RNA, 15 nt, Human
gccccauucaacauc

SEQ ID NO: 784609 - RNA, 15 nt, Human
cacuuuaacacagug

SEQ ID NO: 784610 - RNA, 20 nt, Human
acaguggaaagacagcuucu

SEQ ID NO: 784611 - RNA, 12 nt, Human
ucauuuuaauua

SEQ ID NO: 784612 - RNA, 19 nt, Human
uccagccuggcaaggguuc

SEQ ID NO: 784613 - RNA, 18 nt, Human
uaacuagaauuuauucaa

SEQ ID NO: 784614 - RNA, 19 nt, Human
acauuuguauaaaauaauu

SEQ ID NO: 784615 - RNA, 18 nt, Human
uuuugugaagcaaaauuu

SEQ ID NO: 784616 - RNA, 16 nt, Human
gcuguuuuuauauaug

SEQ ID NO: 784617 - RNA, 15 nt, Human
cauuccaagccucau

SEQ ID NO: 784618 - RNA, 13 nt, Human
gagacagcucugc

SEQ ID NO: 784619 - RNA, 12 nt, Human
agcccaauauua

SEQ ID NO: 784620 - RNA, 17 nt, Human
gcaaauugucacaggac

SEQ ID NO: 784621 - RNA, 22 nt, Human
uucaauaucuuuuuuuuaauaa

SEQ ID NO: 784622 - RNA, 14 nt, Human
aaaauacaaaaaaa

SEQ ID NO: 784623 - RNA, 17 nt, Human
aucaauaucuaauauau

SEQ ID NO: 784624 - RNA, 24 nt, Human
accugcuguuuccuagcgcagcca

SEQ ID NO: 784625 - RNA, 14 nt, Human
auauuuauuaccuc

SEQ ID NO: 784626 - RNA, 16 nt, Human
uauuugaauuuuaaau

SEQ ID NO: 784627 - RNA, 21 nt, Human
ucuuugccuuuauaaucuuuu

SEQ ID NO: 784628 - RNA, 18 nt, Human
ucacagaggaucugcuug

SEQ ID NO: 784629 - RNA, 15 nt, Human
agucugauuuuccug

SEQ ID NO: 784630 - RNA, 22 nt, Human
ugaauggcuaagcaaaauguga

SEQ ID NO: 784631 - RNA, 22 nt, Human
uacaugagguacugagagugaa

SEQ ID NO: 784632 - RNA, 18 nt, Human
caugaauuaguuuuauau

SEQ ID NO: 784633 - RNA, 17 nt, Human
ugaaaaaaaauuuuaua

SEQ ID NO: 784634 - RNA, 23 nt, Human
aaauuaucaauaucuaauauaua

SEQ ID NO: 784635 - RNA, 13 nt, Human
agcauuuauaaau

SEQ ID NO: 784636 - RNA, 15 nt, Human
cauguacauccaugg

SEQ ID NO: 784637 - RNA, 18 nt, Human
uauuucucucuuuuuaga

SEQ ID NO: 784638 - RNA, 20 nt, Human
gcuacucuguuccuucacau

SEQ ID NO: 784639 - RNA, 15 nt, Human
auuuacugagcuucu

SEQ ID NO: 784640 - RNA, 12 nt, Human
cugauuuuccug

SEQ ID NO: 784641 - RNA, 22 nt, Human
auuucugugggagaauucuuac

SEQ ID NO: 784642 - RNA, 15 nt, Human
augaaccuuuacauc

SEQ ID NO: 784643 - RNA, 18 nt, Human
acagagacagaaagcaga

SEQ ID NO: 784644 - RNA, 16 nt, Human
acucagggagcauuua

SEQ ID NO: 784645 - RNA, 15 nt, Human
cugcacuccagccug

SEQ ID NO: 784646 - RNA, 18 nt, Human
uacauacugcugucuaug

SEQ ID NO: 784647 - RNA, 10 nt, Human
uguguauuuu

SEQ ID NO: 784648 - RNA, 20 nt, Human
uuaaguaauuucagaagaaa

SEQ ID NO: 784649 - RNA, 13 nt, Human
uaaguauuuauaa

SEQ ID NO: 784650 - RNA, 16 nt, Human
gaucucagaaauugua

SEQ ID NO: 784651 - RNA, 18 nt, Human
ucucaaaaaauaaaaaua

SEQ ID NO: 784652 - RNA, 21 nt, Human
ucuccugggcagcugccuccc

SEQ ID NO: 784653 - RNA, 14 nt, Human
uuuucaaaauggag

SEQ ID NO: 784654 - RNA, 19 nt, Human
uccucugcuugccaucccu

SEQ ID NO: 784655 - RNA, 20 nt, Human
aacucugcauucuaguacuu

SEQ ID NO: 784656 - RNA, 19 nt, Human
ccuggucgucgucuugacu

SEQ ID NO: 784657 - RNA, 20 nt, Human
agcaagugaauuuuucucua

SEQ ID NO: 784658 - RNA, 19 nt, Human
agcucugcccauccugccc

SEQ ID NO: 784659 - RNA, 22 nt, Human
ccugggcagcugccuccccucc

SEQ ID NO: 784660 - RNA, 19 nt, Human
ugagcaccugcaggcguga

SEQ ID NO: 784661 - RNA, 14 nt, Human
aauacucuuaggaa

SEQ ID NO: 784662 - RNA, 14 nt, Human
uacaguaauuuuaa

SEQ ID NO: 784663 - RNA, 18 nt, Human
guuaguauuguccagguc

SEQ ID NO: 784664 - RNA, 21 nt, Human
uuuucgaugguacauauuucu

SEQ ID NO: 784665 - RNA, 13 nt, Human
aagacucugucuc

SEQ ID NO: 784666 - RNA, 15 nt, Human
gccccugcacuccag

SEQ ID NO: 784667 - RNA, 13 nt, Human
acggggugaaacc

SEQ ID NO: 784668 - RNA, 14 nt, Human
aucauauaauaaau

SEQ ID NO: 784669 - RNA, 21 nt, Human
uuuucucuaacucagaaacau

SEQ ID NO: 784670 - RNA, 19 nt, Human
ccugccuaagugcagcccc

SEQ ID NO: 784671 - RNA, 16 nt, Human
agaaauaaugaaauaa

SEQ ID NO: 784672 - RNA, 21 nt, Human
ggggagccaacagaagcuucc

SEQ ID NO: 784673 - RNA, 18 nt, Human
uaaggcuucucuuaaaca

SEQ ID NO: 784674 - RNA, 17 nt, Human
uaauuuaugaguuuuug

SEQ ID NO: 784675 - RNA, 12 nt, Human
ucuuaagaagac

SEQ ID NO: 784676 - RNA, 17 nt, Human
uuuacuuuguuauuuuu

SEQ ID NO: 784677 - RNA, 18 nt, Human
auuuguauaaaauaauuu

SEQ ID NO: 784678 - RNA, 19 nt, Human
gaucauguauuuauuuuuu

SEQ ID NO: 784679 - RNA, 15 nt, Human
aggagauggaaguug

SEQ ID NO: 784680 - RNA, 14 nt, Human
ugagaccagccaac

SEQ ID NO: 784681 - RNA, 18 nt, Human
agcuucucauccugcagg

SEQ ID NO: 784682 - RNA, 16 nt, Human
cucuuuuuagagaaau

SEQ ID NO: 784683 - RNA, 19 nt, Human
uuuauaucaauuuaaaaaa

SEQ ID NO: 784684 - RNA, 20 nt, Human
aaauguuauuuuuuaauuau

SEQ ID NO: 784685 - RNA, 18 nt, Human
auaauauacuauauuuau

SEQ ID NO: 784686 - RNA, 19 nt, Human
uuacugccgguuugaaaau

SEQ ID NO: 784687 - RNA, 15 nt, Human
aaagcguaaagagga

SEQ ID NO: 784688 - RNA, 19 nt, Human
aauuaauggaauauguaaa

SEQ ID NO: 784689 - RNA, 19 nt, Human
gaaccuuuacauccagaua

SEQ ID NO: 784690 - RNA, 20 nt, Human
caggaguuccuaaccagccu

SEQ ID NO: 784691 - RNA, 13 nt, Human
gcuggagcucugc

SEQ ID NO: 784692 - RNA, 22 nt, Human
agcagcauaaauguugacaugg

SEQ ID NO: 784693 - RNA, 15 nt, Human
accugacagcccaag

SEQ ID NO: 784694 - RNA, 20 nt, Human
ucucuccuguacuuuuucca

SEQ ID NO: 784695 - RNA, 20 nt, Human
agaaugggaugaucauguau

SEQ ID NO: 784696 - RNA, 17 nt, Human
uucuaaaugaauguuua

SEQ ID NO: 784697 - RNA, 20 nt, Human
accaaucauuuuaauuauua

SEQ ID NO: 784698 - RNA, 16 nt, Human
aaacuggaaauaaaag

SEQ ID NO: 784699 - RNA, 19 nt, Human
uguaguguuggagaagaac

SEQ ID NO: 784700 - RNA, 14 nt, Human
aaauuccagaauga

SEQ ID NO: 784701 - RNA, 15 nt, Human
uuuuacaauugaaau

SEQ ID NO: 784702 - RNA, 16 nt, Human
aagacugcacaucaaa

SEQ ID NO: 784703 - RNA, 15 nt, Human
acaguucauauguac

SEQ ID NO: 784704 - RNA, 16 nt, Human
gucucccaaagugcug

SEQ ID NO: 784705 - RNA, 17 nt, Human
ggcuugaggacuugggc

SEQ ID NO: 784706 - RNA, 20 nt, Human
auaucaguccucuuucaaag

SEQ ID NO: 784707 - RNA, 22 nt, Human
ugcaauaaaauggguuuuacug

SEQ ID NO: 784708 - RNA, 18 nt, Human
cagaguacuggcugaugg

SEQ ID NO: 784709 - RNA, 22 nt, Human
acaugagguacugagagugaac

SEQ ID NO: 784710 - RNA, 12 nt, Human
aggcuggagugc

SEQ ID NO: 784711 - RNA, 13 nt, Human
gguggguggggca

SEQ ID NO: 784712 - RNA, 23 nt, Human
cuuuggcaaaugagccggagccc

SEQ ID NO: 784713 - RNA, 15 nt, Human
caaaaaccaaauuug

SEQ ID NO: 784714 - RNA, 16 nt, Human
agugauccgcccaucu

SEQ ID NO: 784715 - RNA, 17 nt, Human
augauuaaguaaugaua

SEQ ID NO: 784716 - RNA, 19 nt, Human
uuaaagcuaaaguaucugu

SEQ ID NO: 784717 - RNA, 18 nt, Human
ccuggaucucacaagcac

SEQ ID NO: 784718 - RNA, 20 nt, Human
ugauuuuacaauugaaauga

SEQ ID NO: 784719 - RNA, 19 nt, Human
agucaaauugugugaaagg

SEQ ID NO: 784720 - RNA, 14 nt, Human
uuaauuauuauuua

SEQ ID NO: 784721 - RNA, 22 nt, Human
auagagacuuugugaaaaaaaa

SEQ ID NO: 784722 - RNA, 14 nt, Human
aucaugcaucuuac

SEQ ID NO: 784723 - RNA, 22 nt, Human
cuaaauaaagcuugcaacaaaa

SEQ ID NO: 784724 - RNA, 15 nt, Human
auacuguauuuuuac

SEQ ID NO: 784725 - RNA, 19 nt, Human
gauuuuacaauugaaauga

SEQ ID NO: 784726 - RNA, 22 nt, Human
cuuaccugggcauucuuguuuc

SEQ ID NO: 784727 - RNA, 18 nt, Human
guauagcauauguuuuug

SEQ ID NO: 784728 - RNA, 16 nt, Human
aagcauuuagauguau

SEQ ID NO: 784729 - RNA, 13 nt, Human
gaauguaaucaau

SEQ ID NO: 784730 - RNA, 14 nt, Human
ucucuacuaaaaau

SEQ ID NO: 784731 - RNA, 18 nt, Human
ccugcuggauguggaggg

SEQ ID NO: 784732 - RNA, 20 nt, Human
aauuaauggaauauguaaau

SEQ ID NO: 784733 - RNA, 21 nt, Human
ucagaucauuucaaaacucau

SEQ ID NO: 784734 - RNA, 22 nt, Human
ucuccagagggaauugcagagu

SEQ ID NO: 784735 - RNA, 14 nt, Human
gccagcaguucaga

SEQ ID NO: 784736 - RNA, 13 nt, Human
aucuacacuccag

SEQ ID NO: 784737 - RNA, 21 nt, Human
uaauuauaauauacuauauuu

SEQ ID NO: 784738 - RNA, 14 nt, Human
aaugauuaugaauu

SEQ ID NO: 784739 - RNA, 18 nt, Human
cagccucuuagaugcagu

SEQ ID NO: 784740 - RNA, 12 nt, Human
uguuuuucacau

SEQ ID NO: 784741 - RNA, 17 nt, Human
cagcaguucagagcugc

SEQ ID NO: 784742 - RNA, 14 nt, Human
auacaaaaaaaaaa

SEQ ID NO: 784743 - RNA, 19 nt, Human
uauuugcaagacauagaau

SEQ ID NO: 784744 - RNA, 13 nt, Human
aaauaaaagauug

SEQ ID NO: 784745 - RNA, 12 nt, Human
uuuuauauuuga

SEQ ID NO: 784746 - RNA, 12 nt, Human
auuaauauaugu

SEQ ID NO: 784747 - RNA, 15 nt, Human
uaaauaaauguaucu

SEQ ID NO: 784748 - RNA, 14 nt, Human
aagaaugacuaugc

SEQ ID NO: 784749 - RNA, 15 nt, Human
uggcaguuuuccauu

SEQ ID NO: 784750 - RNA, 17 nt, Human
uguaaugaaaaugaaua

SEQ ID NO: 784751 - RNA, 17 nt, Human
uuaaacuggaaauaaaa

SEQ ID NO: 784752 - RNA, 16 nt, Human
ucagaccuagaauaau

SEQ ID NO: 784753 - RNA, 16 nt, Human
uccucacaccaggcuu

SEQ ID NO: 784754 - RNA, 21 nt, Human
cuguuuguuauggcuuaauga

SEQ ID NO: 784755 - RNA, 16 nt, Human
aaaaugugauauguac

SEQ ID NO: 784756 - RNA, 21 nt, Human
gaaauuccaggaaaaucugca

SEQ ID NO: 784757 - RNA, 18 nt, Human
ucacgccuguaaucccag

SEQ ID NO: 784758 - RNA, 12 nt, Human
uugggaggcuga

SEQ ID NO: 784759 - RNA, 22 nt, Human
ccucuccugggcagcugccucc

SEQ ID NO: 784760 - RNA, 18 nt, Human
cuuuacuguuagucauuu

SEQ ID NO: 784761 - RNA, 15 nt, Human
uuaauuuguaguguu

SEQ ID NO: 784762 - RNA, 21 nt, Human
aaaauaugccccauucaacau

SEQ ID NO: 784763 - RNA, 13 nt, Human
uuauaauauacua

SEQ ID NO: 784764 - RNA, 12 nt, Human
uucucuaggaaa

SEQ ID NO: 784765 - RNA, 18 nt, Human
gaaaacauagcaucucag

SEQ ID NO: 784766 - RNA, 20 nt, Human
uaccaacagugagagcccuu

SEQ ID NO: 784767 - RNA, 15 nt, Human
aggcuggagugcagu

SEQ ID NO: 784768 - RNA, 19 nt, Human
caccauuccuucugcccug

SEQ ID NO: 784769 - RNA, 16 nt, Human
aagggaggaaaaaaaa

SEQ ID NO: 784770 - RNA, 16 nt, Human
ugguagggggaaaaug

SEQ ID NO: 784771 - RNA, 16 nt, Human
acacaaccugucccag

SEQ ID NO: 784772 - RNA, 14 nt, Human
uaucauuuucaaaa

SEQ ID NO: 784773 - RNA, 19 nt, Human
gcuggagugcaguggcgca

SEQ ID NO: 784774 - RNA, 13 nt, Human
ucuaucuauuuau

SEQ ID NO: 784775 - RNA, 13 nt, Human
agaagacaacauu

SEQ ID NO: 784776 - RNA, 14 nt, Mycobacterium avium subsp. paratuberculosis
uuucgucggcggug

SEQ ID NO: 784777 - RNA, 18 nt, Mycobacterium avium subsp. paratuberculosis
uuucgucggugcgcgccg

SEQ ID NO: 784778 - RNA, 21 nt, Mycobacterium avium subsp. paratuberculosis
uuugcacccgccauggcggca

SEQ ID NO: 784779 - RNA, 19 nt, Mycobacterium avium subsp. paratuberculosis
uugguguccagcggcucgg

SEQ ID NO: 784780 - RNA, 17 nt, Mycobacterium avium subsp. paratuberculosis
uuggugcgccgucacgu

SEQ ID NO: 784781 - RNA, 15 nt, Mycobacterium avium subsp. paratuberculosis
uuggugguggcgugg

SEQ ID NO: 784782 - RNA, 17 nt, Mycobacterium avium subsp. paratuberculosis
uuggugguggucgucga

SEQ ID NO: 784783 - RNA, 13 nt, Mycobacterium avium subsp. paratuberculosis
uuggucgggcaca

SEQ ID NO: 784784 - RNA, 21 nt, Mycobacterium avium subsp. paratuberculosis
uuggugaacagguaggcggcg

SEQ ID NO: 784785 - RNA, 20 nt, Mycobacterium avium subsp. paratuberculosis
uuggucaccaggucgcggua

SEQ ID NO: 784786 - RNA, 15 nt, Mycobacterium avium subsp. paratuberculosis
uuggucaccaccaac

SEQ ID NO: 784787 - RNA, 13 nt, Mycobacterium avium subsp. paratuberculosis
uugggcucggcgc

SEQ ID NO: 784788 - RNA, 14 nt, Mycobacterium avium subsp. paratuberculosis
uuggggccggccgc

SEQ ID NO: 784789 - RNA, 15 nt, Mycobacterium avium subsp. paratuberculosis
uugggggcgccgcgg

SEQ ID NO: 784790 - RNA, 20 nt, Mycobacterium avium subsp. paratuberculosis
uugggucaucgacucgaaga

SEQ ID NO: 784791 - RNA, 23 nt, Mycobacterium avium subsp. paratuberculosis
uugggcggcggccaccucgccgc

SEQ ID NO: 784792 - RNA, 18 nt, Mycobacterium avium subsp. paratuberculosis
uugggcgggaucgcggcg

SEQ ID NO: 784793 - RNA, 19 nt, Mycobacterium avium subsp. paratuberculosis
uugggcgggaucgcggcgg

SEQ ID NO: 784794 - RNA, 21 nt, Mycobacterium avium subsp. paratuberculosis
uuggcgacgaagucgacggcg

SEQ ID NO: 784795 - RNA, 19 nt, Mycobacterium avium subsp. paratuberculosis
uuggccugcuugggcagca

SEQ ID NO: 784796 - RNA, 14 nt, Mycobacterium avium subsp. paratuberculosis
uuggcgacguccgg

SEQ ID NO: 784797 - RNA, 11 nt, Mycobacterium avium subsp. paratuberculosis
uuggccggccg

SEQ ID NO: 784798 - RNA, 20 nt, Mycobacterium avium subsp. paratuberculosis
uuggccggugcgccgaccgc

SEQ ID NO: 784799 - RNA, 23 nt, Mycobacterium avium subsp. paratuberculosis
uuggccguaggucgggucgagac

SEQ ID NO: 784800 - RNA, 13 nt, Mycobacterium avium subsp. paratuberculosis
uuggccucgggcg

SEQ ID NO: 784801 - RNA, 22 nt, Mycobacterium avium subsp. paratuberculosis
uuggccucgggcgacgacgcgg

SEQ ID NO: 784802 - RNA, 19 nt, Mycobacterium avium subsp. paratuberculosis
uuggccucgguggcggugg

SEQ ID NO: 784803 - RNA, 19 nt, Mycobacterium avium subsp. paratuberculosis
uugugcuucuggcucaaca

SEQ ID NO: 784804 - RNA, 24 nt, Mycobacterium avium subsp. paratuberculosis
uuguggcggcccaauucguaggcg

SEQ ID NO: 784805 - RNA, 12 nt, Mycobacterium avium subsp. paratuberculosis
uugguggcgccg

SEQ ID NO: 784806 - RNA, 15 nt, Mycobacterium avium subsp. paratuberculosis
uugucagcggccucg

SEQ ID NO: 784807 - RNA, 14 nt, Mycobacterium avium subsp. paratuberculosis
uugucucggcgccg

SEQ ID NO: 784808 - RNA, 18 nt, Mycobacterium avium subsp. paratuberculosis
uugugaaugggcugcgcg

SEQ ID NO: 784809 - RNA, 18 nt, Mycobacterium avium subsp. paratuberculosis
uugugacccgcucgggcg

SEQ ID NO: 784810 - RNA, 18 nt, Mycobacterium avium subsp. paratuberculosis
uuguccaggauccccguc

SEQ ID NO: 784811 - RNA, 14 nt, Mycobacterium avium subsp. paratuberculosis
uuuccuucggugcg

SEQ ID NO: 784812 - RNA, 16 nt, Mycobacterium avium subsp. paratuberculosis
uuccgguuccucggcg

SEQ ID NO: 784813 - RNA, 13 nt, Mycobacterium avium subsp. paratuberculosis
uuccucagcgccc

SEQ ID NO: 784814 - RNA, 18 nt, Mycobacterium avium subsp. paratuberculosis
uuccgucgguggcggugg

SEQ ID NO: 784815 - RNA, 14 nt, Mycobacterium avium subsp. paratuberculosis
uuccggugucgagc

SEQ ID NO: 784816 - RNA, 20 nt, Mycobacterium avium subsp. paratuberculosis
uuccggugucgagccggugc

SEQ ID NO: 784817 - RNA, 18 nt, Mycobacterium avium subsp. paratuberculosis
uugaacggcaccccgcgg

SEQ ID NO: 784818 - RNA, 13 nt, Mycobacterium avium subsp. paratuberculosis
uuccuccucggcg

SEQ ID NO: 784819 - RNA, 16 nt, Mycobacterium avium subsp. paratuberculosis
uugaccaccagguagg

SEQ ID NO: 784820 - RNA, 16 nt, Mycobacterium avium subsp. paratuberculosis
uugaccaccgagccgg

SEQ ID NO: 784821 - RNA, 14 nt, Mycobacterium avium subsp. paratuberculosis
uugaccacggcgcg

SEQ ID NO: 784822 - RNA, 12 nt, Mycobacterium avium subsp. paratuberculosis
uugaccgcccgg

SEQ ID NO: 784823 - RNA, 13 nt, Mycobacterium avium subsp. paratuberculosis
uugacccggccgg

SEQ ID NO: 784824 - RNA, 21 nt, Mycobacterium avium subsp. paratuberculosis
uugacccaggcccgggaucgg

SEQ ID NO: 784825 - RNA, 22 nt, Mycobacterium avium subsp. paratuberculosis
uugaccccggccccggccggcg

SEQ ID NO: 784826 - RNA, 22 nt, Mycobacterium avium subsp. paratuberculosis
uugaauggaaugugccugcggg

SEQ ID NO: 784827 - RNA, 21 nt, Mycobacterium avium subsp. paratuberculosis
uugaagcgcagaucgcgcauc

SEQ ID NO: 784828 - RNA, 19 nt, Mycobacterium avium subsp. paratuberculosis
uugagcagcagaccgccgg

SEQ ID NO: 784829 - RNA, 21 nt, Mycobacterium avium subsp. paratuberculosis
uugagcauguugaacgccgcg

SEQ ID NO: 784830 - RNA, 14 nt, Mycobacterium avium subsp. paratuberculosis
uugagccgccacgg

SEQ ID NO: 784831 - RNA, 16 nt, Mycobacterium avium subsp. paratuberculosis
uugagccgcucgccgg

SEQ ID NO: 784832 - RNA, 17 nt, Mycobacterium avium subsp. paratuberculosis
uugagccgcucgccggg

SEQ ID NO: 784833 - RNA, 16 nt, Mycobacterium avium subsp. paratuberculosis
uugagcuucccggcgg

SEQ ID NO: 784834 - RNA, 22 nt, Mycobacterium avium subsp. paratuberculosis
uugagcuucccggcggucgccg

SEQ ID NO: 784835 - RNA, 14 nt, Mycobacterium avium subsp. paratuberculosis
uugaggcggcggcg

SEQ ID NO: 784836 - RNA, 16 nt, Mycobacterium avium subsp. paratuberculosis
uugagcgugccgccgg

SEQ ID NO: 784837 - RNA, 12 nt, Mycobacterium avium subsp. paratuberculosis
uugagcucgcgg

SEQ ID NO: 784838 - RNA, 15 nt, Mycobacterium avium subsp. paratuberculosis
uugacggccgcggcg

SEQ ID NO: 784839 - RNA, 16 nt, Mycobacterium avium subsp. paratuberculosis
uugacggccgcggcgg

SEQ ID NO: 784840 - RNA, 15 nt, Mycobacterium avium subsp. paratuberculosis
uugacggccugggcg

SEQ ID NO: 784841 - RNA, 15 nt, Mycobacterium avium subsp. paratuberculosis
uugacgaugacgcgg

SEQ ID NO: 784842 - RNA, 13 nt, Mycobacterium avium subsp. paratuberculosis
uugacgccgacag

SEQ ID NO: 784843 - RNA, 14 nt, Mycobacterium avium subsp. paratuberculosis
uugacgggccgcgg

SEQ ID NO: 784844 - RNA, 17 nt, Mycobacterium avium subsp. paratuberculosis
uugacggugaccggcgc

SEQ ID NO: 784845 - RNA, 20 nt, Mycobacterium avium subsp. paratuberculosis
uugacguacuggcgccgguc

SEQ ID NO: 784846 - RNA, 15 nt, Mycobacterium avium subsp. paratuberculosis
uugacguccgcggga

SEQ ID NO: 784847 - RNA, 17 nt, Mycobacterium avium subsp. paratuberculosis
uugaucacccgggucga

SEQ ID NO: 784848 - RNA, 15 nt, Mycobacterium avium subsp. paratuberculosis
uugagucccucggcg

SEQ ID NO: 784849 - RNA, 15 nt, Mycobacterium avium subsp. paratuberculosis
uugaucagggcggcg

SEQ ID NO: 784850 - RNA, 21 nt, Mycobacterium avium subsp. paratuberculosis
uugaucgagcaccgggcgucg

SEQ ID NO: 784851 - RNA, 15 nt, Mycobacterium avium subsp. paratuberculosis
uugauccggccgcgg

SEQ ID NO: 784852 - RNA, 18 nt, Mycobacterium avium subsp. paratuberculosis
uugaucugggugccgcgg

SEQ ID NO: 784853 - RNA, 21 nt, Mycobacterium avium subsp. paratuberculosis
uugaugaaacuuccgcccggc

SEQ ID NO: 784854 - RNA, 21 nt, Mycobacterium avium subsp. paratuberculosis
uugaugaacgcguugaccaga

SEQ ID NO: 784855 - RNA, 14 nt, Mycobacterium avium subsp. paratuberculosis
uugaugccguccgg

SEQ ID NO: 784856 - RNA, 16 nt, Mycobacterium avium subsp. paratuberculosis
uugaugccgacgucgg

SEQ ID NO: 784857 - RNA, 21 nt, Mycobacterium avium subsp. paratuberculosis
uugcagcgccgcggcgcccuc

SEQ ID NO: 784858 - RNA, 13 nt, Mycobacterium avium subsp. paratuberculosis
uugcccgcugcgg

SEQ ID NO: 784859 - RNA, 20 nt, Mycobacterium avium subsp. paratuberculosis
uugcuuuuugaccaccggca

SEQ ID NO: 784860 - RNA, 18 nt, Mycobacterium avium subsp. paratuberculosis
uuggacgaaacccggcgg

SEQ ID NO: 784861 - RNA, 23 nt, Mycobacterium avium subsp. paratuberculosis
uuggcacccgaccgacgcccggc

SEQ ID NO: 784862 - RNA, 19 nt, Mycobacterium avium subsp. paratuberculosis
uuggccacgucgaagcccg

SEQ ID NO: 784863 - RNA, 24 nt, Mycobacterium avium subsp. paratuberculosis
uuggccagauacuccucggugacg

SEQ ID NO: 784864 - RNA, 13 nt, Mycobacterium avium subsp. paratuberculosis
uuggccaggcggg

SEQ ID NO: 784865 - RNA, 13 nt, Mycobacterium avium subsp. paratuberculosis
uuggccggcgggu

SEQ ID NO: 784866 - RNA, 22 nt, Mycobacterium avium subsp. paratuberculosis
uuggccggcuucucggcgugcc

SEQ ID NO: 784867 - RNA, 23 nt, Mycobacterium avium subsp. paratuberculosis
uuggccgcgggcgggccgaaccg

SEQ ID NO: 784868 - RNA, 21 nt, Mycobacterium avium subsp. paratuberculosis
uuggccggagccuuggucgcg

SEQ ID NO: 784869 - RNA, 14 nt, Mycobacterium avium subsp. paratuberculosis
uuggccggcacucg

SEQ ID NO: 784870 - RNA, 15 nt, Mycobacterium avium subsp. paratuberculosis
uuggccgcgacgccg

SEQ ID NO: 784871 - RNA, 15 nt, Mycobacterium avium subsp. paratuberculosis
uuggccgcgcagcuc

SEQ ID NO: 784872 - RNA, 19 nt, Mycobacterium avium subsp. paratuberculosis
uuggccgcgcagcucgggg

SEQ ID NO: 784873 - RNA, 20 nt, Mycobacterium avium subsp. paratuberculosis
uuggccgcaggcggccagca

SEQ ID NO: 784874 - RNA, 23 nt, Mycobacterium avium subsp. paratuberculosis
uuggccgagccgggcggccagcg

SEQ ID NO: 784875 - RNA, 13 nt, Mycobacterium avium subsp. paratuberculosis
uuggcccgcgcgg

SEQ ID NO: 784876 - RNA, 22 nt, Mycobacterium avium subsp. paratuberculosis
uugcugccgucgguuucggucg

SEQ ID NO: 784877 - RNA, 13 nt, Mycobacterium avium subsp. paratuberculosis
uugcucggcggcc

SEQ ID NO: 784878 - RNA, 14 nt, Mycobacterium avium subsp. paratuberculosis
uugcucggggcucg

SEQ ID NO: 784879 - RNA, 16 nt, Mycobacterium avium subsp. paratuberculosis
uugcgucugcucggcg

SEQ ID NO: 784880 - RNA, 16 nt, Mycobacterium avium subsp. paratuberculosis
uugcguugcgcggcgg

SEQ ID NO: 784881 - RNA, 13 nt, Mycobacterium avium subsp. paratuberculosis
uugcgcggcggcc

SEQ ID NO: 784882 - RNA, 16 nt, Mycobacterium avium subsp. paratuberculosis
uugcgccggguggccg

SEQ ID NO: 784883 - RNA, 22 nt, Mycobacterium avium subsp. paratuberculosis
uugcgccagcagcaacgcggug

SEQ ID NO: 784884 - RNA, 14 nt, Mycobacterium avium subsp. paratuberculosis
uugcgccccggcgg

SEQ ID NO: 784885 - RNA, 14 nt, Mycobacterium avium subsp. paratuberculosis
uugcgcagccgggc

SEQ ID NO: 784886 - RNA, 22 nt, Mycobacterium avium subsp. paratuberculosis
uugcgcuggaugaaggucgcgg

SEQ ID NO: 784887 - RNA, 23 nt, Mycobacterium avium subsp. paratuberculosis
uugcggcagcacaccuuccacca

SEQ ID NO: 784888 - RNA, 19 nt, Mycobacterium avium subsp. paratuberculosis
uugcggcaccagucgcgca

SEQ ID NO: 784889 - RNA, 13 nt, Mycobacterium avium subsp. paratuberculosis
uugcggccgccgg

SEQ ID NO: 784890 - RNA, 20 nt, Mycobacterium avium subsp. paratuberculosis
uugcggcgcagccagcucgg

SEQ ID NO: 784891 - RNA, 11 nt, Mycobacterium avium subsp. paratuberculosis
uugcggcggcc

SEQ ID NO: 784892 - RNA, 21 nt, Mycobacterium avium subsp. paratuberculosis
uugcggcccugcaggucgcgg

SEQ ID NO: 784893 - RNA, 13 nt, Mycobacterium avium subsp. paratuberculosis
uugcggcucaacg

SEQ ID NO: 784894 - RNA, 14 nt, Mycobacterium avium subsp. paratuberculosis
uugcgggucggugg

SEQ ID NO: 784895 - RNA, 21 nt, Mycobacterium avium subsp. paratuberculosis
uugccgauggcgguccaccac

SEQ ID NO: 784896 - RNA, 15 nt, Mycobacterium avium subsp. paratuberculosis
uugccgaucgccgcg

SEQ ID NO: 784897 - RNA, 20 nt, Mycobacterium avium subsp. paratuberculosis
uugccgaagaugucggugcc

SEQ ID NO: 784898 - RNA, 13 nt, Mycobacterium avium subsp. paratuberculosis
uugccgcgccggg

SEQ ID NO: 784899 - RNA, 17 nt, Mycobacterium avium subsp. paratuberculosis
uugccgcgcgcccgcgg

SEQ ID NO: 784900 - RNA, 15 nt, Mycobacterium avium subsp. paratuberculosis
uugccgccggcgcgg

SEQ ID NO: 784901 - RNA, 14 nt, Mycobacterium avium subsp. paratuberculosis
uugccgucggccgc

SEQ ID NO: 784902 - RNA, 16 nt, Mycobacterium avium subsp. paratuberculosis
uugccuuuccgcgcgg

SEQ ID NO: 784903 - RNA, 19 nt, Mycobacterium avium subsp. paratuberculosis
uugcgagccggucugggcg

SEQ ID NO: 784904 - RNA, 11 nt, Mycobacterium avium subsp. paratuberculosis
uugcgaccgcc

SEQ ID NO: 784905 - RNA, 12 nt, Mycobacterium avium subsp. paratuberculosis
uugccggauugc

SEQ ID NO: 784906 - RNA, 22 nt, Mycobacterium avium subsp. paratuberculosis
uugccggcccgcagcgccucgg

SEQ ID NO: 784907 - RNA, 12 nt, Mycobacterium avium subsp. paratuberculosis
uugccggcggcc

SEQ ID NO: 784908 - RNA, 16 nt, Mycobacterium avium subsp. paratuberculosis
uugccggcggccagca

SEQ ID NO: 784909 - RNA, 22 nt, Mycobacterium avium subsp. paratuberculosis
uugccggcggcgaagccggccc

SEQ ID NO: 784910 - RNA, 15 nt, Mycobacterium avium subsp. paratuberculosis
uuaggucgguggcca

SEQ ID NO: 784911 - RNA, 20 nt, Mycobacterium avium subsp. paratuberculosis
uuaaucgcccaacaacucga

SEQ ID NO: 784912 - RNA, 14 nt, Mycobacterium avium subsp. paratuberculosis
uguuggcgacggug

SEQ ID NO: 784913 - RNA, 16 nt, Mycobacterium avium subsp. paratuberculosis
uguugguaagcgacga

SEQ ID NO: 784914 - RNA, 12 nt, Mycobacterium avium subsp. paratuberculosis
uguugcucgggg

SEQ ID NO: 784915 - RNA, 19 nt, Mycobacterium avium subsp. paratuberculosis
uguugcgcagcgaacguca

SEQ ID NO: 784916 - RNA, 21 nt, Mycobacterium avium subsp. paratuberculosis
uucaggucuccguugucgagg

SEQ ID NO: 784917 - RNA, 13 nt, Mycobacterium avium subsp. paratuberculosis
uucaggucaccgc

SEQ ID NO: 784918 - RNA, 15 nt, Mycobacterium avium subsp. paratuberculosis
uucaccagcacgguc

SEQ ID NO: 784919 - RNA, 13 nt, Mycobacterium avium subsp. paratuberculosis
uucacgucgagcg

SEQ ID NO: 784920 - RNA, 22 nt, Mycobacterium avium subsp. paratuberculosis
uucacgucgaucacgccgccgg

SEQ ID NO: 784921 - RNA, 16 nt, Mycobacterium avium subsp. paratuberculosis
uucacgcucgcgugcg

SEQ ID NO: 784922 - RNA, 13 nt, Mycobacterium avium subsp. paratuberculosis
uucacgcucggcg

SEQ ID NO: 784923 - RNA, 14 nt, Mycobacterium avium subsp. paratuberculosis
uucacgcucggcga

SEQ ID NO: 784924 - RNA, 14 nt, Mycobacterium avium subsp. paratuberculosis
uucacgcucggcgg

SEQ ID NO: 784925 - RNA, 20 nt, Mycobacterium avium subsp. paratuberculosis
uucaacggccaaccgcccgg

SEQ ID NO: 784926 - RNA, 21 nt, Mycobacterium avium subsp. paratuberculosis
uucaaccccgcgcgcgggcca

SEQ ID NO: 784927 - RNA, 16 nt, Mycobacterium avium subsp. paratuberculosis
uuccagcacccggccc

SEQ ID NO: 784928 - RNA, 23 nt, Mycobacterium avium subsp. paratuberculosis
uuccagcacccggcccacgccgu

SEQ ID NO: 784929 - RNA, 23 nt, Mycobacterium avium subsp. paratuberculosis
uuccagcaccggcuggucggcgg

SEQ ID NO: 784930 - RNA, 11 nt, Mycobacterium avium subsp. paratuberculosis
uuccacgccgg

SEQ ID NO: 784931 - RNA, 14 nt, Mycobacterium avium subsp. paratuberculosis
uuccacgccgguga

SEQ ID NO: 784932 - RNA, 15 nt, Mycobacterium avium subsp. paratuberculosis
uuccaccguggucgg

SEQ ID NO: 784933 - RNA, 16 nt, Mycobacterium avium subsp. paratuberculosis
uuccacgaccuggcgg

SEQ ID NO: 784934 - RNA, 22 nt, Mycobacterium avium subsp. paratuberculosis
uuccaccagcggccgucgccgg

SEQ ID NO: 784935 - RNA, 20 nt, Mycobacterium avium subsp. paratuberculosis
uucccgaguggcgccgucgg

SEQ ID NO: 784936 - RNA, 10 nt, Mycobacterium avium subsp. paratuberculosis
uucccgccgc

SEQ ID NO: 784937 - RNA, 12 nt, Mycobacterium avium subsp. paratuberculosis
uucccgccgccg

SEQ ID NO: 784938 - RNA, 14 nt, Mycobacterium avium subsp. paratuberculosis
uucccgccgccgcg

SEQ ID NO: 784939 - RNA, 16 nt, Mycobacterium avium subsp. paratuberculosis
uucccgcuuggcgguc

SEQ ID NO: 784940 - RNA, 23 nt, Mycobacterium avium subsp. paratuberculosis
uucccggaugcugcgggucagca

SEQ ID NO: 784941 - RNA, 15 nt, Mycobacterium avium subsp. paratuberculosis
uucccggccgccggg

SEQ ID NO: 784942 - RNA, 12 nt, Mycobacterium avium subsp. paratuberculosis
uucccggcgggc

SEQ ID NO: 784943 - RNA, 20 nt, Mycobacterium avium subsp. paratuberculosis
uuccagcgccggcaccagca

SEQ ID NO: 784944 - RNA, 13 nt, Mycobacterium avium subsp. paratuberculosis
uuccagccggccc

SEQ ID NO: 784945 - RNA, 17 nt, Mycobacterium avium subsp. paratuberculosis
uuccagccauucgucgg

SEQ ID NO: 784946 - RNA, 12 nt, Mycobacterium avium subsp. paratuberculosis
uuccccggccga

SEQ ID NO: 784947 - RNA, 18 nt, Mycobacterium avium subsp. paratuberculosis
uuccccggcggccggccc

SEQ ID NO: 784948 - RNA, 16 nt, Mycobacterium avium subsp. paratuberculosis
uuccgggaagucgucg

SEQ ID NO: 784949 - RNA, 16 nt, Mycobacterium avium subsp. paratuberculosis
uuccgggcgaccccgg

SEQ ID NO: 784950 - RNA, 17 nt, Mycobacterium avium subsp. paratuberculosis
uuccgggcgaccccggc

SEQ ID NO: 784951 - RNA, 20 nt, Mycobacterium avium subsp. paratuberculosis
uuccgggccaccgucuucgg

SEQ ID NO: 784952 - RNA, 20 nt, Mycobacterium avium subsp. paratuberculosis
uuccggccggccgccggcgg

SEQ ID NO: 784953 - RNA, 19 nt, Mycobacterium avium subsp. paratuberculosis
uuccggcgcgaucggccgc

SEQ ID NO: 784954 - RNA, 13 nt, Mycobacterium avium subsp. paratuberculosis
uuccggcacccgc

SEQ ID NO: 784955 - RNA, 19 nt, Mycobacterium avium subsp. paratuberculosis
uuccgcgacaaggucgacc

SEQ ID NO: 784956 - RNA, 18 nt, Mycobacterium avium subsp. paratuberculosis
uggugucaggaucgccgg

SEQ ID NO: 784957 - RNA, 16 nt, Mycobacterium avium subsp. paratuberculosis
ugguucguccgguagg

SEQ ID NO: 784958 - RNA, 18 nt, Mycobacterium avium subsp. paratuberculosis
ugguugaaccgguacagg

SEQ ID NO: 784959 - RNA, 17 nt, Mycobacterium avium subsp. paratuberculosis
ugguguacacgucgcgg

SEQ ID NO: 784960 - RNA, 18 nt, Mycobacterium avium subsp. paratuberculosis
ugguguagcucagccacg

SEQ ID NO: 784961 - RNA, 22 nt, Mycobacterium avium subsp. paratuberculosis
ugguguaguccugcuucagcuc

SEQ ID NO: 784962 - RNA, 13 nt, Mycobacterium avium subsp. paratuberculosis
ugguggugcggac

SEQ ID NO: 784963 - RNA, 16 nt, Mycobacterium avium subsp. paratuberculosis
ugguugucgacgcugc

SEQ ID NO: 784964 - RNA, 17 nt, Mycobacterium avium subsp. paratuberculosis
ugguugcggcgggccgc

SEQ ID NO: 784965 - RNA, 22 nt, Mycobacterium avium subsp. paratuberculosis
ugguugcgguacaucccgccgg

SEQ ID NO: 784966 - RNA, 17 nt, Mycobacterium avium subsp. paratuberculosis
ugguugcguucgccggc

SEQ ID NO: 784967 - RNA, 13 nt, Mycobacterium avium subsp. paratuberculosis
ugguuggcccgca

SEQ ID NO: 784968 - RNA, 17 nt, Mycobacterium avium subsp. paratuberculosis
ugguuucagguggcgcc

SEQ ID NO: 784969 - RNA, 13 nt, Mycobacterium avium subsp. paratuberculosis
ugguuuccacugc

SEQ ID NO: 784970 - RNA, 14 nt, Mycobacterium avium subsp. paratuberculosis
ugguaccggguggc

SEQ ID NO: 784971 - RNA, 21 nt, Mycobacterium avium subsp. paratuberculosis
uggugcggucgaugacgccgc

SEQ ID NO: 784972 - RNA, 22 nt, Mycobacterium avium subsp. paratuberculosis
ugguggucgaacuggcgcaccg

SEQ ID NO: 784973 - RNA, 14 nt, Mycobacterium avium subsp. paratuberculosis
uggugggcgggcac

SEQ ID NO: 784974 - RNA, 13 nt, Mycobacterium avium subsp. paratuberculosis
uggugggcgccgg

SEQ ID NO: 784975 - RNA, 22 nt, Mycobacterium avium subsp. paratuberculosis
uggugggcgaacagcagcaccc

SEQ ID NO: 784976 - RNA, 14 nt, Mycobacterium avium subsp. paratuberculosis
ugguggcgccgguu

SEQ ID NO: 784977 - RNA, 19 nt, Mycobacterium avium subsp. paratuberculosis
uggugcgggccagcacgac

SEQ ID NO: 784978 - RNA, 20 nt, Mycobacterium avium subsp. paratuberculosis
ugguggccuugacgacggcc

SEQ ID NO: 784979 - RNA, 21 nt, Mycobacterium avium subsp. paratuberculosis
ugguggaugaugccggcggug

SEQ ID NO: 784980 - RNA, 15 nt, Mycobacterium avium subsp. paratuberculosis
uggugcucgccccgc

SEQ ID NO: 784981 - RNA, 20 nt, Mycobacterium avium subsp. paratuberculosis
uggugcucgccccgcccgau

SEQ ID NO: 784982 - RNA, 16 nt, Mycobacterium avium subsp. paratuberculosis
uggugcugcccggcgc

SEQ ID NO: 784983 - RNA, 17 nt, Mycobacterium avium subsp. paratuberculosis
uggugcugcccggcgcg

SEQ ID NO: 784984 - RNA, 16 nt, Mycobacterium avium subsp. paratuberculosis
ugucacccucgaggcc

SEQ ID NO: 784985 - RNA, 16 nt, Mycobacterium avium subsp. paratuberculosis
ugucaccgacgccagc

SEQ ID NO: 784986 - RNA, 22 nt, Mycobacterium avium subsp. paratuberculosis
ugucacguugaugaucgccgau

SEQ ID NO: 784987 - RNA, 16 nt, Mycobacterium avium subsp. paratuberculosis
uguaccgcgagaucag

SEQ ID NO: 784988 - RNA, 14 nt, Mycobacterium avium subsp. paratuberculosis
uguacucggcgucg

SEQ ID NO: 784989 - RNA, 20 nt, Mycobacterium avium subsp. paratuberculosis
uguagcacccggccggcgaa

SEQ ID NO: 784990 - RNA, 15 nt, Mycobacterium avium subsp. paratuberculosis
uguagcggucgugcg

SEQ ID NO: 784991 - RNA, 16 nt, Mycobacterium avium subsp. paratuberculosis
uguagcggauggcgac

SEQ ID NO: 784992 - RNA, 13 nt, Mycobacterium avium subsp. paratuberculosis
uguagcggcggcu

SEQ ID NO: 784993 - RNA, 21 nt, Mycobacterium avium subsp. paratuberculosis
uguagcggcggucggcgccga

SEQ ID NO: 784994 - RNA, 16 nt, Mycobacterium avium subsp. paratuberculosis
ugucauccgucgcccg

SEQ ID NO: 784995 - RNA, 16 nt, Mycobacterium avium subsp. paratuberculosis
uguccaccugcaccug

SEQ ID NO: 784996 - RNA, 19 nt, Mycobacterium avium subsp. paratuberculosis
uguccagcagcgccggcag

SEQ ID NO: 784997 - RNA, 12 nt, Mycobacterium avium subsp. paratuberculosis
uguccgaugacg

SEQ ID NO: 784998 - RNA, 15 nt, Mycobacterium avium subsp. paratuberculosis
uguccgacgccgucg

SEQ ID NO: 784999 - RNA, 14 nt, Mycobacterium avium subsp. paratuberculosis
uguccgagccgccc

SEQ ID NO: 785000 - RNA, 15 nt, Mycobacterium avium subsp. paratuberculosis
uguccgagcgggccg

SEQ ID NO: 785001 - RNA, 16 nt, Mycobacterium avium subsp. paratuberculosis
uguccgagcgggccgu

SEQ ID NO: 785002 - RNA, 14 nt, Mycobacterium avium subsp. paratuberculosis
ugucgagcacgucg

SEQ ID NO: 785003 - RNA, 19 nt, Mycobacterium avium subsp. paratuberculosis
ugucgagcacgucgacgcc

SEQ ID NO: 785004 - RNA, 23 nt, Mycobacterium avium subsp. paratuberculosis
ugucgagcacgucgacgccgguc

SEQ ID NO: 785005 - RNA, 22 nt, Mycobacterium avium subsp. paratuberculosis
ugucgagccggugccgaggcag

SEQ ID NO: 785006 - RNA, 12 nt, Mycobacterium avium subsp. paratuberculosis
ugucgacgacgu

SEQ ID NO: 785007 - RNA, 14 nt, Mycobacterium avium subsp. paratuberculosis
ugucgacgucggug

SEQ ID NO: 785008 - RNA, 17 nt, Mycobacterium avium subsp. paratuberculosis
ugucgagaugaccgucg

SEQ ID NO: 785009 - RNA, 17 nt, Mycobacterium avium subsp. paratuberculosis
ugucgagcaccgcgauc

SEQ ID NO: 785010 - RNA, 23 nt, Mycobacterium avium subsp. paratuberculosis
ugucgacgacacccuucaucagc

SEQ ID NO: 785011 - RNA, 21 nt, Mycobacterium avium subsp. paratuberculosis
ugucgacgcccuuggcgccca

SEQ ID NO: 785012 - RNA, 12 nt, Mycobacterium avium subsp. paratuberculosis
ugucgacgccgg

SEQ ID NO: 785013 - RNA, 21 nt, Mycobacterium avium subsp. paratuberculosis
ugucgacgccgugcugccgga

SEQ ID NO: 785014 - RNA, 22 nt, Mycobacterium avium subsp. paratuberculosis
ugucgacgcugagccgcucguc

SEQ ID NO: 785015 - RNA, 23 nt, Mycobacterium avium subsp. paratuberculosis
uguccgguaggccggccgcagcu

SEQ ID NO: 785016 - RNA, 19 nt, Mycobacterium avium subsp. paratuberculosis
uguuaagacuucggcgaac

SEQ ID NO: 785017 - RNA, 12 nt, Mycobacterium avium subsp. paratuberculosis
uguucaccccgu

SEQ ID NO: 785018 - RNA, 19 nt, Mycobacterium avium subsp. paratuberculosis
uguuccaccagcggccguc

SEQ ID NO: 785019 - RNA, 17 nt, Mycobacterium avium subsp. paratuberculosis
uguugaugucgcgcggc

SEQ ID NO: 785020 - RNA, 15 nt, Mycobacterium avium subsp. paratuberculosis
uguugagcguggcag

SEQ ID NO: 785021 - RNA, 16 nt, Mycobacterium avium subsp. paratuberculosis
uguugagcucgcggcg

SEQ ID NO: 785022 - RNA, 16 nt, Mycobacterium avium subsp. paratuberculosis
uguugaccuucucgac

SEQ ID NO: 785023 - RNA, 20 nt, Mycobacterium avium subsp. paratuberculosis
uguugacgggccgcggccag

SEQ ID NO: 785024 - RNA, 17 nt, Mycobacterium avium subsp. paratuberculosis
uguugaccacccgcagc

SEQ ID NO: 785025 - RNA, 16 nt, Mycobacterium avium subsp. paratuberculosis
uguucgccgucgcggg

SEQ ID NO: 785026 - RNA, 17 nt, Mycobacterium avium subsp. paratuberculosis
uguucgccgucgcgggu

SEQ ID NO: 785027 - RNA, 18 nt, Mycobacterium avium subsp. paratuberculosis
uguucgccgucgcgggug

SEQ ID NO: 785028 - RNA, 16 nt, Mycobacterium avium subsp. paratuberculosis
uguuccuugcggccgc

SEQ ID NO: 785029 - RNA, 14 nt, Mycobacterium avium subsp. paratuberculosis
uguucgcgccggua

SEQ ID NO: 785030 - RNA, 11 nt, Mycobacterium avium subsp. paratuberculosis
uguucgcggcu

SEQ ID NO: 785031 - RNA, 18 nt, Mycobacterium avium subsp. paratuberculosis
uguucguugucgagcgag

SEQ ID NO: 785032 - RNA, 12 nt, Mycobacterium avium subsp. paratuberculosis
ugugggccagca

SEQ ID NO: 785033 - RNA, 16 nt, Mycobacterium avium subsp. paratuberculosis
ugugggccagcgcggu

SEQ ID NO: 785034 - RNA, 17 nt, Mycobacterium avium subsp. paratuberculosis
uguggcgugugggcucg

SEQ ID NO: 785035 - RNA, 18 nt, Mycobacterium avium subsp. paratuberculosis
uguggcgugugggcucgc

SEQ ID NO: 785036 - RNA, 16 nt, Mycobacterium avium subsp. paratuberculosis
ugugccacuucgacgg

SEQ ID NO: 785037 - RNA, 21 nt, Mycobacterium avium subsp. paratuberculosis
ugugccacuucgacggcagcg

SEQ ID NO: 785038 - RNA, 12 nt, Mycobacterium avium subsp. paratuberculosis
ugugcaaggcga

SEQ ID NO: 785039 - RNA, 17 nt, Mycobacterium avium subsp. paratuberculosis
ugugguugcuggcgucg

SEQ ID NO: 785040 - RNA, 12 nt, Mycobacterium avium subsp. paratuberculosis
ugugggcgccgu

SEQ ID NO: 785041 - RNA, 14 nt, Mycobacterium avium subsp. paratuberculosis
ugugggcgccguca

SEQ ID NO: 785042 - RNA, 21 nt, Mycobacterium avium subsp. paratuberculosis
uguggggcccacugccugacc

SEQ ID NO: 785043 - RNA, 16 nt, Mycobacterium avium subsp. paratuberculosis
ugugacgcucgcgguu

SEQ ID NO: 785044 - RNA, 18 nt, Mycobacterium avium subsp. paratuberculosis
ugugaggcaccgaacgcc

SEQ ID NO: 785045 - RNA, 18 nt, Mycobacterium avium subsp. paratuberculosis
ugugaacccugggcggcg

SEQ ID NO: 785046 - RNA, 20 nt, Mycobacterium avium subsp. paratuberculosis
ugucgcuguuagccucgcca

SEQ ID NO: 785047 - RNA, 20 nt, Mycobacterium avium subsp. paratuberculosis
ugucgcuggcguacgccaug

SEQ ID NO: 785048 - RNA, 22 nt, Mycobacterium avium subsp. paratuberculosis
ugugacacagccaaagccuacg

SEQ ID NO: 785049 - RNA, 13 nt, Mycobacterium avium subsp. paratuberculosis
ugucgcgcaccgc

SEQ ID NO: 785050 - RNA, 23 nt, Mycobacterium avium subsp. paratuberculosis
ugucgaugaacgcacucggugug

SEQ ID NO: 785051 - RNA, 14 nt, Mycobacterium avium subsp. paratuberculosis
ugucgaugacggcg

SEQ ID NO: 785052 - RNA, 19 nt, Mycobacterium avium subsp. paratuberculosis
ugucgaugacggcggcgcc

SEQ ID NO: 785053 - RNA, 18 nt, Mycobacterium avium subsp. paratuberculosis
ugucgcgaaaaucggugg

SEQ ID NO: 785054 - RNA, 13 nt, Mycobacterium avium subsp. paratuberculosis
ugucgaggucggu

SEQ ID NO: 785055 - RNA, 18 nt, Mycobacterium avium subsp. paratuberculosis
ugucgcugaacgccccgu

SEQ ID NO: 785056 - RNA, 16 nt, Mycobacterium avium subsp. paratuberculosis
ugucgcugaccaccga

SEQ ID NO: 785057 - RNA, 18 nt, Mycobacterium avium subsp. paratuberculosis
ugucgcguucccgggccc

SEQ ID NO: 785058 - RNA, 15 nt, Mycobacterium avium subsp. paratuberculosis
ugucgcggcccagca

SEQ ID NO: 785059 - RNA, 13 nt, Mycobacterium avium subsp. paratuberculosis
uggcaacgccggu

SEQ ID NO: 785060 - RNA, 15 nt, Mycobacterium avium subsp. paratuberculosis
uggauugucggccgc

SEQ ID NO: 785061 - RNA, 13 nt, Mycobacterium avium subsp. paratuberculosis
uggauuccaccgu

SEQ ID NO: 785062 - RNA, 23 nt, Mycobacterium avium subsp. paratuberculosis
uggauuccaccguggucggcagc

SEQ ID NO: 785063 - RNA, 15 nt, Mycobacterium avium subsp. paratuberculosis
uggaucugcccgacc

SEQ ID NO: 785064 - RNA, 16 nt, Mycobacterium avium subsp. paratuberculosis
uggaucuugacggcga

SEQ ID NO: 785065 - RNA, 17 nt, Mycobacterium avium subsp. paratuberculosis
uggaucuugacggcgac

SEQ ID NO: 785066 - RNA, 13 nt, Mycobacterium avium subsp. paratuberculosis
uggaucccgaacu

SEQ ID NO: 785067 - RNA, 13 nt, Mycobacterium avium subsp. paratuberculosis
uggaucgcgcagg

SEQ ID NO: 785068 - RNA, 21 nt, Mycobacterium avium subsp. paratuberculosis
uggaugcccagggcgcgucca

SEQ ID NO: 785069 - RNA, 15 nt, Mycobacterium avium subsp. paratuberculosis
uggaugaugccggcg

SEQ ID NO: 785070 - RNA, 18 nt, Mycobacterium avium subsp. paratuberculosis
uggaugaaggucgcggac

SEQ ID NO: 785071 - RNA, 20 nt, Mycobacterium avium subsp. paratuberculosis
uggagaaguccuuguggccc

SEQ ID NO: 785072 - RNA, 13 nt, Mycobacterium avium subsp. paratuberculosis
uggagaccagguc

SEQ ID NO: 785073 - RNA, 21 nt, Mycobacterium avium subsp. paratuberculosis
uggagaucaccgcguagcgcc

SEQ ID NO: 785074 - RNA, 20 nt, Mycobacterium avium subsp. paratuberculosis
uggagcggguccgccccgag

SEQ ID NO: 785075 - RNA, 22 nt, Mycobacterium avium subsp. paratuberculosis
uggagcugaaguucaccaccgc

SEQ ID NO: 785076 - RNA, 11 nt, Mycobacterium avium subsp. paratuberculosis
uggagccgacc

SEQ ID NO: 785077 - RNA, 12 nt, Mycobacterium avium subsp. paratuberculosis
uggagccgacca

SEQ ID NO: 785078 - RNA, 13 nt, Mycobacterium avium subsp. paratuberculosis
uggagccgaccag

SEQ ID NO: 785079 - RNA, 15 nt, Mycobacterium avium subsp. paratuberculosis
uggagccgaccagcg

SEQ ID NO: 785080 - RNA, 23 nt, Mycobacterium avium subsp. paratuberculosis
uggagccgaccagcgcgaucucc

SEQ ID NO: 785081 - RNA, 15 nt, Mycobacterium avium subsp. paratuberculosis
uggagcggcccagcu

SEQ ID NO: 785082 - RNA, 21 nt, Mycobacterium avium subsp. paratuberculosis
uggagcggcccagcucgguga

SEQ ID NO: 785083 - RNA, 16 nt, Mycobacterium avium subsp. paratuberculosis
uggauauuucgcggcc

SEQ ID NO: 785084 - RNA, 17 nt, Mycobacterium avium subsp. paratuberculosis
uggauauuucgcggccg

SEQ ID NO: 785085 - RNA, 21 nt, Mycobacterium avium subsp. paratuberculosis
uggaggcgagcaacucuugcg

SEQ ID NO: 785086 - RNA, 15 nt, Mycobacterium avium subsp. paratuberculosis
uggaauaggccgcgu

SEQ ID NO: 785087 - RNA, 17 nt, Mycobacterium avium subsp. paratuberculosis
uggaagcgcaucgccgg

SEQ ID NO: 785088 - RNA, 20 nt, Mycobacterium avium subsp. paratuberculosis
uggaaggcgccggcgcgggg

SEQ ID NO: 785089 - RNA, 17 nt, Mycobacterium avium subsp. paratuberculosis
uggaacgcgucgcgcca

SEQ ID NO: 785090 - RNA, 14 nt, Mycobacterium avium subsp. paratuberculosis
uggaagccgcgauc

SEQ ID NO: 785091 - RNA, 20 nt, Mycobacterium avium subsp. paratuberculosis
uggaagagggccauccggcc

SEQ ID NO: 785092 - RNA, 22 nt, Mycobacterium avium subsp. paratuberculosis
uggaagagggccauccggccgg

SEQ ID NO: 785093 - RNA, 19 nt, Mycobacterium avium subsp. paratuberculosis
uggaaccgggucucgcgcc

SEQ ID NO: 785094 - RNA, 13 nt, Mycobacterium avium subsp. paratuberculosis
ugcggggugucga

SEQ ID NO: 785095 - RNA, 16 nt, Mycobacterium avium subsp. paratuberculosis
ugcggggugugcaggc

SEQ ID NO: 785096 - RNA, 19 nt, Mycobacterium avium subsp. paratuberculosis
ugcggggugugcaggccga

SEQ ID NO: 785097 - RNA, 15 nt, Mycobacterium avium subsp. paratuberculosis
ugcgggucacacccu

SEQ ID NO: 785098 - RNA, 14 nt, Mycobacterium avium subsp. paratuberculosis
ugcggggccgcggc

SEQ ID NO: 785099 - RNA, 16 nt, Mycobacterium avium subsp. paratuberculosis
ugcggggccggcggcg

SEQ ID NO: 785100 - RNA, 22 nt, Mycobacterium avium subsp. paratuberculosis
ugcggggccucgucgccgcggu

SEQ ID NO: 785101 - RNA, 14 nt, Mycobacterium avium subsp. paratuberculosis
ugcgggcugcacca

SEQ ID NO: 785102 - RNA, 16 nt, Mycobacterium avium subsp. paratuberculosis
ugcgggcugcaccagg

SEQ ID NO: 785103 - RNA, 13 nt, Mycobacterium avium subsp. paratuberculosis
ugcgggcggcagc

SEQ ID NO: 785104 - RNA, 19 nt, Mycobacterium avium subsp. paratuberculosis
ugcgggcgggccgccaggu

SEQ ID NO: 785105 - RNA, 16 nt, Mycobacterium avium subsp. paratuberculosis
uggacgaacgcggcga

SEQ ID NO: 785106 - RNA, 23 nt, Mycobacterium avium subsp. paratuberculosis
uggacgaugcggggccggcggcg

SEQ ID NO: 785107 - RNA, 12 nt, Mycobacterium avium subsp. paratuberculosis
uggacgacgucg

SEQ ID NO: 785108 - RNA, 16 nt, Mycobacterium avium subsp. paratuberculosis
uggacgagcagccgca

SEQ ID NO: 785109 - RNA, 12 nt, Mycobacterium avium subsp. paratuberculosis
uggacgcgacca

SEQ ID NO: 785110 - RNA, 20 nt, Mycobacterium avium subsp. paratuberculosis
uggacgccgcacgcgaccgc

SEQ ID NO: 785111 - RNA, 21 nt, Mycobacterium avium subsp. paratuberculosis
uggacgccgcacgcgaccgcg

SEQ ID NO: 785112 - RNA, 19 nt, Mycobacterium avium subsp. paratuberculosis
uggacgaggugaacgccgc

SEQ ID NO: 785113 - RNA, 19 nt, Mycobacterium avium subsp. paratuberculosis
uggacgaggugaccggcga

SEQ ID NO: 785114 - RNA, 20 nt, Mycobacterium avium subsp. paratuberculosis
uggacgagucccaugggcug

SEQ ID NO: 785115 - RNA, 18 nt, Mycobacterium avium subsp. paratuberculosis
uggacgaaacccggcgga

SEQ ID NO: 785116 - RNA, 19 nt, Mycobacterium avium subsp. paratuberculosis
uggaccggguggugggcga

SEQ ID NO: 785117 - RNA, 15 nt, Mycobacterium avium subsp. paratuberculosis
uggacgucaggccgu

SEQ ID NO: 785118 - RNA, 15 nt, Mycobacterium avium subsp. paratuberculosis
uggacguccagcggc

SEQ ID NO: 785119 - RNA, 19 nt, Mycobacterium avium subsp. paratuberculosis
uggacuccaccgccaccgc

SEQ ID NO: 785120 - RNA, 21 nt, Mycobacterium avium subsp. paratuberculosis
uggacgcccagaacugggccg

SEQ ID NO: 785121 - RNA, 14 nt, Mycobacterium avium subsp. paratuberculosis
uggacgcgcgcggc

SEQ ID NO: 785122 - RNA, 15 nt, Mycobacterium avium subsp. paratuberculosis
uggacgcgcgcggcg

SEQ ID NO: 785123 - RNA, 21 nt, Mycobacterium avium subsp. paratuberculosis
uggacgcgcgcggcgucaggg

SEQ ID NO: 785124 - RNA, 11 nt, Mycobacterium avium subsp. paratuberculosis
uggacgcgguc

SEQ ID NO: 785125 - RNA, 21 nt, Mycobacterium avium subsp. paratuberculosis
uggacgcgguggugcucgccc

SEQ ID NO: 785126 - RNA, 16 nt, Mycobacterium avium subsp. paratuberculosis
uggacggaucggugua

SEQ ID NO: 785127 - RNA, 16 nt, Mycobacterium avium subsp. paratuberculosis
uggacggcccgacgac

SEQ ID NO: 785128 - RNA, 23 nt, Mycobacterium avium subsp. paratuberculosis
uggacggcccgacgacgccguca

SEQ ID NO: 785129 - RNA, 15 nt, Mycobacterium avium subsp. paratuberculosis
uggacaccgcgauca

SEQ ID NO: 785130 - RNA, 22 nt, Mycobacterium avium subsp. paratuberculosis
uggacaccugcaguucgaucac

SEQ ID NO: 785131 - RNA, 17 nt, Mycobacterium avium subsp. paratuberculosis
uggacaccuuggcggcc

SEQ ID NO: 785132 - RNA, 14 nt, Mycobacterium avium subsp. paratuberculosis
uggacagccaccgu

SEQ ID NO: 785133 - RNA, 14 nt, Mycobacterium avium subsp. paratuberculosis
uggacagcgcgacg

SEQ ID NO: 785134 - RNA, 22 nt, Mycobacterium avium subsp. paratuberculosis
uggacagcucgacgaacuccgc

SEQ ID NO: 785135 - RNA, 15 nt, Mycobacterium avium subsp. paratuberculosis
uggacaugcagccgc

SEQ ID NO: 785136 - RNA, 15 nt, Mycobacterium avium subsp. paratuberculosis
uggacaggcccagcg

SEQ ID NO: 785137 - RNA, 14 nt, Mycobacterium avium subsp. paratuberculosis
uggacaggccggcg

SEQ ID NO: 785138 - RNA, 17 nt, Mycobacterium avium subsp. paratuberculosis
uggacaggccggcgacg

SEQ ID NO: 785139 - RNA, 23 nt, Mycobacterium avium subsp. paratuberculosis
uggacauucacgaggccgggcug

SEQ ID NO: 785140 - RNA, 22 nt, Mycobacterium avium subsp. paratuberculosis
uggaccagggcgguggcggcga

SEQ ID NO: 785141 - RNA, 22 nt, Mycobacterium avium subsp. paratuberculosis
uggacccgaagucgacgcacca

SEQ ID NO: 785142 - RNA, 14 nt, Mycobacterium avium subsp. paratuberculosis
uggaccgagcgcgc

SEQ ID NO: 785143 - RNA, 16 nt, Mycobacterium avium subsp. paratuberculosis
uggaccgcgugugccc

SEQ ID NO: 785144 - RNA, 18 nt, Mycobacterium avium subsp. paratuberculosis
uggcacgacgccgccgag

SEQ ID NO: 785145 - RNA, 18 nt, Mycobacterium avium subsp. paratuberculosis
uggcacgccacucgucga

SEQ ID NO: 785146 - RNA, 19 nt, Mycobacterium avium subsp. paratuberculosis
uggcacgccacucgucgac

SEQ ID NO: 785147 - RNA, 20 nt, Mycobacterium avium subsp. paratuberculosis
uggcagcggucggcggcuga

SEQ ID NO: 785148 - RNA, 14 nt, Mycobacterium avium subsp. paratuberculosis
uggcagcugccgaa

SEQ ID NO: 785149 - RNA, 24 nt, Mycobacterium avium subsp. paratuberculosis
uggcaggcgauggcgucggccagc

SEQ ID NO: 785150 - RNA, 13 nt, Mycobacterium avium subsp. paratuberculosis
uggcaggcgaugu

SEQ ID NO: 785151 - RNA, 17 nt, Mycobacterium avium subsp. paratuberculosis
uggcagcauccgccgac

SEQ ID NO: 785152 - RNA, 18 nt, Mycobacterium avium subsp. paratuberculosis
uggcagcauccgccgacg

SEQ ID NO: 785153 - RNA, 15 nt, Mycobacterium avium subsp. paratuberculosis
uggcagccggccggc

SEQ ID NO: 785154 - RNA, 23 nt, Mycobacterium avium subsp. paratuberculosis
uggcagcggacccggucggccgc

SEQ ID NO: 785155 - RNA, 16 nt, Mycobacterium avium subsp. paratuberculosis
uggcacccucggugcu

SEQ ID NO: 785156 - RNA, 22 nt, Mycobacterium avium subsp. paratuberculosis
uggcaccgggugggccgaccug

SEQ ID NO: 785157 - RNA, 18 nt, Mycobacterium avium subsp. paratuberculosis
uggcaauucgaccgucuc

SEQ ID NO: 785158 - RNA, 14 nt, Mycobacterium avium subsp. paratuberculosis
uggcaggucgcgcc

SEQ ID NO: 785159 - RNA, 14 nt, Mycobacterium avium subsp. paratuberculosis
uggcagggccagca

SEQ ID NO: 785160 - RNA, 12 nt, Mycobacterium avium subsp. paratuberculosis
uggcaucgccaa

SEQ ID NO: 785161 - RNA, 14 nt, Mycobacterium avium subsp. paratuberculosis
uggcaucgucggcg

SEQ ID NO: 785162 - RNA, 15 nt, Mycobacterium avium subsp. paratuberculosis
uggcaucgucggcgc

SEQ ID NO: 785163 - RNA, 16 nt, Mycobacterium avium subsp. paratuberculosis
uggcaucgucggcgcc

SEQ ID NO: 785164 - RNA, 23 nt, Mycobacterium avium subsp. paratuberculosis
uggccaaguagacucagcgucga

SEQ ID NO: 785165 - RNA, 22 nt, Mycobacterium avium subsp. paratuberculosis
uggccaccgaagccgacgucga

SEQ ID NO: 785166 - RNA, 13 nt, Mycobacterium avium subsp. paratuberculosis
uggccaccacggg

SEQ ID NO: 785167 - RNA, 24 nt, Mycobacterium avium subsp. paratuberculosis
uggccaccgccugcgcgaucgccg

SEQ ID NO: 785168 - RNA, 17 nt, Mycobacterium avium subsp. paratuberculosis
uggccaggcuggcgucg

SEQ ID NO: 785169 - RNA, 15 nt, Mycobacterium avium subsp. paratuberculosis
uggccagguugcgcc

SEQ ID NO: 785170 - RNA, 17 nt, Mycobacterium avium subsp. paratuberculosis
uggccagguugcgccgu

SEQ ID NO: 785171 - RNA, 16 nt, Mycobacterium avium subsp. paratuberculosis
uggccagcucggcggc

SEQ ID NO: 785172 - RNA, 17 nt, Mycobacterium avium subsp. paratuberculosis
uggccagcucggcggcc

SEQ ID NO: 785173 - RNA, 13 nt, Mycobacterium avium subsp. paratuberculosis
uggccagcucggu

SEQ ID NO: 785174 - RNA, 17 nt, Mycobacterium avium subsp. paratuberculosis
uggccagcuugcagcug

SEQ ID NO: 785175 - RNA, 15 nt, Mycobacterium avium subsp. paratuberculosis
uggccagcgucaggg

SEQ ID NO: 785176 - RNA, 17 nt, Mycobacterium avium subsp. paratuberculosis
uggccagcgcgacggcc

SEQ ID NO: 785177 - RNA, 18 nt, Mycobacterium avium subsp. paratuberculosis
uggccagccgggcgaccg

SEQ ID NO: 785178 - RNA, 13 nt, Mycobacterium avium subsp. paratuberculosis
uggccagcagcgu

SEQ ID NO: 785179 - RNA, 22 nt, Mycobacterium avium subsp. paratuberculosis
uggccagcagccgcgacacgug

SEQ ID NO: 785180 - RNA, 15 nt, Mycobacterium avium subsp. paratuberculosis
uggccagcaccaccg

SEQ ID NO: 785181 - RNA, 13 nt, Mycobacterium avium subsp. paratuberculosis
uggccacgcccca

SEQ ID NO: 785182 - RNA, 21 nt, Mycobacterium avium subsp. paratuberculosis
uggccacggcguugaccaacg

SEQ ID NO: 785183 - RNA, 16 nt, Mycobacterium avium subsp. paratuberculosis
uggccagcaccgcggc

SEQ ID NO: 785184 - RNA, 18 nt, Mycobacterium avium subsp. paratuberculosis
uggccagcaccgcggccg

SEQ ID NO: 785185 - RNA, 19 nt, Mycobacterium avium subsp. paratuberculosis
uggccagcaccgcggccgu

SEQ ID NO: 785186 - RNA, 24 nt, Mycobacterium avium subsp. paratuberculosis
uggccagcaccgcggcgaucgccg

SEQ ID NO: 785187 - RNA, 23 nt, Mycobacterium avium subsp. paratuberculosis
uggccccagaaccgcucggcggc

SEQ ID NO: 785188 - RNA, 16 nt, Mycobacterium avium subsp. paratuberculosis
uggccccagccaccgu

SEQ ID NO: 785189 - RNA, 22 nt, Mycobacterium avium subsp. paratuberculosis
uggcccaaccgcauucggccgc

SEQ ID NO: 785190 - RNA, 12 nt, Mycobacterium avium subsp. paratuberculosis
uggcccaccgaa

SEQ ID NO: 785191 - RNA, 21 nt, Mycobacterium avium subsp. paratuberculosis
uggcccaccgaaucacccacg

SEQ ID NO: 785192 - RNA, 12 nt, Mycobacterium avium subsp. paratuberculosis
uggccaucguca

SEQ ID NO: 785193 - RNA, 16 nt, Mycobacterium avium subsp. paratuberculosis
uggccaucuggccgcg

SEQ ID NO: 785194 - RNA, 13 nt, Mycobacterium avium subsp. paratuberculosis
uggccccggcgag

SEQ ID NO: 785195 - RNA, 19 nt, Mycobacterium avium subsp. paratuberculosis
uggcccgccaucgcccggu

SEQ ID NO: 785196 - RNA, 17 nt, Mycobacterium avium subsp. paratuberculosis
uggcccgcaccacccag

SEQ ID NO: 785197 - RNA, 19 nt, Mycobacterium avium subsp. paratuberculosis
uggcccgcacccgccgccc

SEQ ID NO: 785198 - RNA, 17 nt, Mycobacterium avium subsp. paratuberculosis
uggcccggugcgacgcc

SEQ ID NO: 785199 - RNA, 12 nt, Mycobacterium avium subsp. paratuberculosis
uggcccucggag

SEQ ID NO: 785200 - RNA, 18 nt, Mycobacterium avium subsp. paratuberculosis
uggcccgcucggucuuga

SEQ ID NO: 785201 - RNA, 18 nt, Mycobacterium avium subsp. paratuberculosis
uggcccggaccgccgcgg

SEQ ID NO: 785202 - RNA, 22 nt, Mycobacterium avium subsp. paratuberculosis
uggcccggaccgccgcggcggc

SEQ ID NO: 785203 - RNA, 20 nt, Mycobacterium avium subsp. paratuberculosis
uggcccggauggccgggcag

SEQ ID NO: 785204 - RNA, 22 nt, Mycobacterium avium subsp. paratuberculosis
uggcccggcgcggcggcgccgc

SEQ ID NO: 785205 - RNA, 13 nt, Mycobacterium avium subsp. paratuberculosis
uggcccggcguuc

SEQ ID NO: 785206 - RNA, 14 nt, Mycobacterium avium subsp. paratuberculosis
uggcccgcgcgcug

SEQ ID NO: 785207 - RNA, 15 nt, Mycobacterium avium subsp. paratuberculosis
uggcccgcgcgcuga

SEQ ID NO: 785208 - RNA, 14 nt, Mycobacterium avium subsp. paratuberculosis
uggcccgcggcgcc

SEQ ID NO: 785209 - RNA, 18 nt, Mycobacterium avium subsp. paratuberculosis
uggcccgcggcgcccgga

SEQ ID NO: 785210 - RNA, 20 nt, Mycobacterium avium subsp. paratuberculosis
ugggacagccggucgacgaa

SEQ ID NO: 785211 - RNA, 16 nt, Mycobacterium avium subsp. paratuberculosis
uggcugcacgucacgg

SEQ ID NO: 785212 - RNA, 19 nt, Mycobacterium avium subsp. paratuberculosis
uggcugaggccgccccggc

SEQ ID NO: 785213 - RNA, 15 nt, Mycobacterium avium subsp. paratuberculosis
uggcguugaugcggg

SEQ ID NO: 785214 - RNA, 17 nt, Mycobacterium avium subsp. paratuberculosis
uggcguugaugcgggcg

SEQ ID NO: 785215 - RNA, 16 nt, Mycobacterium avium subsp. paratuberculosis
uggcguucaucgucca

SEQ ID NO: 785216 - RNA, 18 nt, Mycobacterium avium subsp. paratuberculosis
uggcguucugcaccgacu

SEQ ID NO: 785217 - RNA, 14 nt, Mycobacterium avium subsp. paratuberculosis
uggcugagcaccgg

SEQ ID NO: 785218 - RNA, 17 nt, Mycobacterium avium subsp. paratuberculosis
uggcugagcagcacccg

SEQ ID NO: 785219 - RNA, 18 nt, Mycobacterium avium subsp. paratuberculosis
uggcugaacagcgcgccg

SEQ ID NO: 785220 - RNA, 19 nt, Mycobacterium avium subsp. paratuberculosis
uggcugaacagcgcgccga

SEQ ID NO: 785221 - RNA, 18 nt, Mycobacterium avium subsp. paratuberculosis
uggcguggcucggcccgc

SEQ ID NO: 785222 - RNA, 16 nt, Mycobacterium avium subsp. paratuberculosis
uggcgugucggugaug

SEQ ID NO: 785223 - RNA, 22 nt, Mycobacterium avium subsp. paratuberculosis
uggcgugucggugauggccggc

SEQ ID NO: 785224 - RNA, 17 nt, Mycobacterium avium subsp. paratuberculosis
uggcgugcggccucggc

SEQ ID NO: 785225 - RNA, 22 nt, Mycobacterium avium subsp. paratuberculosis
uggcgugcggccucggcaccgu

SEQ ID NO: 785226 - RNA, 17 nt, Mycobacterium avium subsp. paratuberculosis
uggcguggauggccggc

SEQ ID NO: 785227 - RNA, 16 nt, Mycobacterium avium subsp. paratuberculosis
uggcggugucgaagac

SEQ ID NO: 785228 - RNA, 23 nt, Mycobacterium avium subsp. paratuberculosis
uggcggugucgaagaccggugcg

SEQ ID NO: 785229 - RNA, 22 nt, Mycobacterium avium subsp. paratuberculosis
uggcgguguucgagggcgcggc

SEQ ID NO: 785230 - RNA, 14 nt, Mycobacterium avium subsp. paratuberculosis
uggcguagucgacu

SEQ ID NO: 785231 - RNA, 15 nt, Mycobacterium avium subsp. paratuberculosis
uggcguagucgucga

SEQ ID NO: 785232 - RNA, 23 nt, Mycobacterium avium subsp. paratuberculosis
uggcggccaccaucuccgcggcg

SEQ ID NO: 785233 - RNA, 17 nt, Mycobacterium avium subsp. paratuberculosis
uggcggccaccaugccg

SEQ ID NO: 785234 - RNA, 17 nt, Mycobacterium avium subsp. paratuberculosis
uggcggccacgaucgcg

SEQ ID NO: 785235 - RNA, 20 nt, Mycobacterium avium subsp. paratuberculosis
uggcggccacgaucgcgauc

SEQ ID NO: 785236 - RNA, 23 nt, Mycobacterium avium subsp. paratuberculosis
uggcggccacgaucgcgaucgcc

SEQ ID NO: 785237 - RNA, 23 nt, Mycobacterium avium subsp. paratuberculosis
uggcggcauccccagcugggccg

SEQ ID NO: 785238 - RNA, 16 nt, Mycobacterium avium subsp. paratuberculosis
uggcggccaggccggc

SEQ ID NO: 785239 - RNA, 15 nt, Mycobacterium avium subsp. paratuberculosis
uggcgucgccgccgg

SEQ ID NO: 785240 - RNA, 17 nt, Mycobacterium avium subsp. paratuberculosis
uggcgucgccgccggug

SEQ ID NO: 785241 - RNA, 14 nt, Mycobacterium avium subsp. paratuberculosis
uggcgucggugaug

SEQ ID NO: 785242 - RNA, 18 nt, Mycobacterium avium subsp. paratuberculosis
uggcgucggugaugccgg

SEQ ID NO: 785243 - RNA, 14 nt, Mycobacterium avium subsp. paratuberculosis
uggcgucgguggcg

SEQ ID NO: 785244 - RNA, 17 nt, Mycobacterium avium subsp. paratuberculosis
uggcgucggccagcggc

SEQ ID NO: 785245 - RNA, 14 nt, Mycobacterium avium subsp. paratuberculosis
uggcgucggccggg

SEQ ID NO: 785246 - RNA, 20 nt, Mycobacterium avium subsp. paratuberculosis
uggcgucggccgggggcgcg

SEQ ID NO: 785247 - RNA, 21 nt, Mycobacterium avium subsp. paratuberculosis
uggcgucggccgggggcgcgg

SEQ ID NO: 785248 - RNA, 22 nt, Mycobacterium avium subsp. paratuberculosis
uggcgugacacucggucaccgg

SEQ ID NO: 785249 - RNA, 18 nt, Mycobacterium avium subsp. paratuberculosis
uggcgugacgcucggcgc

SEQ ID NO: 785250 - RNA, 19 nt, Mycobacterium avium subsp. paratuberculosis
uggcgugacgcucggcggc

SEQ ID NO: 785251 - RNA, 20 nt, Mycobacterium avium subsp. paratuberculosis
uggcgugacguucggccaau

SEQ ID NO: 785252 - RNA, 12 nt, Mycobacterium avium subsp. paratuberculosis
uggcgucguuga

SEQ ID NO: 785253 - RNA, 17 nt, Mycobacterium avium subsp. paratuberculosis
uggcgucguugaacgcg

SEQ ID NO: 785254 - RNA, 19 nt, Mycobacterium avium subsp. paratuberculosis
uggcgucguuggcgccguc

SEQ ID NO: 785255 - RNA, 23 nt, Mycobacterium avium subsp. paratuberculosis
uggcgguuggacaggccggcgac

SEQ ID NO: 785256 - RNA, 23 nt, Mycobacterium avium subsp. paratuberculosis
uggcguaggacagcagccgcuca

SEQ ID NO: 785257 - RNA, 17 nt, Mycobacterium avium subsp. paratuberculosis
uggcguaguggugcagg

SEQ ID NO: 785258 - RNA, 22 nt, Mycobacterium avium subsp. paratuberculosis
uggcguaugccuccucggugag

SEQ ID NO: 785259 - RNA, 13 nt, Mycobacterium avium subsp. paratuberculosis
uggcgucgaacgu

SEQ ID NO: 785260 - RNA, 17 nt, Mycobacterium avium subsp. paratuberculosis
uggcgucacgcugcgcg

SEQ ID NO: 785261 - RNA, 20 nt, Mycobacterium avium subsp. paratuberculosis
uggcgucacgcugcgcgccg

SEQ ID NO: 785262 - RNA, 12 nt, Mycobacterium avium subsp. paratuberculosis
uggcgucgacgu

SEQ ID NO: 785263 - RNA, 13 nt, Mycobacterium avium subsp. paratuberculosis
uggcgucgacgug

SEQ ID NO: 785264 - RNA, 14 nt, Mycobacterium avium subsp. paratuberculosis
uggcgucgacgugc

SEQ ID NO: 785265 - RNA, 13 nt, Mycobacterium avium subsp. paratuberculosis
uggcgucgaucag

SEQ ID NO: 785266 - RNA, 15 nt, Mycobacterium avium subsp. paratuberculosis
ugggcgauggcggcg

SEQ ID NO: 785267 - RNA, 20 nt, Mycobacterium avium subsp. paratuberculosis
ugggcggcgacacgccgacg

SEQ ID NO: 785268 - RNA, 15 nt, Mycobacterium avium subsp. paratuberculosis
ugggcggcgcgcugc

SEQ ID NO: 785269 - RNA, 12 nt, Mycobacterium avium subsp. paratuberculosis
ugggcggcggcc

SEQ ID NO: 785270 - RNA, 16 nt, Mycobacterium avium subsp. paratuberculosis
ugggcgaaucugucga

SEQ ID NO: 785271 - RNA, 16 nt, Mycobacterium avium subsp. paratuberculosis
ugggcgaccacgucca

SEQ ID NO: 785272 - RNA, 21 nt, Mycobacterium avium subsp. paratuberculosis
ugggcgaccagauaggccagc

SEQ ID NO: 785273 - RNA, 17 nt, Mycobacterium avium subsp. paratuberculosis
ugggcgaccaugccgcg

SEQ ID NO: 785274 - RNA, 22 nt, Mycobacterium avium subsp. paratuberculosis
ugggcgaacagcagcacccggg

SEQ ID NO: 785275 - RNA, 18 nt, Mycobacterium avium subsp. paratuberculosis
ugggcgaacggcaacggc

SEQ ID NO: 785276 - RNA, 14 nt, Mycobacterium avium subsp. paratuberculosis
ugggccagcagcgu

SEQ ID NO: 785277 - RNA, 19 nt, Mycobacterium avium subsp. paratuberculosis
ugggccagcagcgucguca

SEQ ID NO: 785278 - RNA, 21 nt, Mycobacterium avium subsp. paratuberculosis
ugggccacgauccgcgcggcc

SEQ ID NO: 785279 - RNA, 11 nt, Mycobacterium avium subsp. paratuberculosis
ugggccacggc

SEQ ID NO: 785280 - RNA, 22 nt, Mycobacterium avium subsp. paratuberculosis
ugggcaugucgccgaacgccac

SEQ ID NO: 785281 - RNA, 20 nt, Mycobacterium avium subsp. paratuberculosis
ugggcauugcccaucgccac

SEQ ID NO: 785282 - RNA, 15 nt, Mycobacterium avium subsp. paratuberculosis
ugggcaucgucucgg

SEQ ID NO: 785283 - RNA, 18 nt, Mycobacterium avium subsp. paratuberculosis
ugggcaucaucggcacgc

SEQ ID NO: 785284 - RNA, 23 nt, Mycobacterium avium subsp. paratuberculosis
ugggcaucaucggcacgccgggg

SEQ ID NO: 785285 - RNA, 12 nt, Mycobacterium avium subsp. paratuberculosis
ugggcagcucgg

SEQ ID NO: 785286 - RNA, 12 nt, Mycobacterium avium subsp. paratuberculosis
ugggcagcucgu

SEQ ID NO: 785287 - RNA, 23 nt, Mycobacterium avium subsp. paratuberculosis
ugggcagcgcggccagcacgguc

SEQ ID NO: 785288 - RNA, 13 nt, Mycobacterium avium subsp. paratuberculosis
ugggacggcgggu

SEQ ID NO: 785289 - RNA, 18 nt, Mycobacterium avium subsp. paratuberculosis
ugggacgggucggcggcg

SEQ ID NO: 785290 - RNA, 17 nt, Mycobacterium avium subsp. paratuberculosis
ugggagcacgugaugag

SEQ ID NO: 785291 - RNA, 19 nt, Mycobacterium avium subsp. paratuberculosis
ugggcagccccagcgagca

SEQ ID NO: 785292 - RNA, 20 nt, Mycobacterium avium subsp. paratuberculosis
ugggcgugccggaugcgguc

SEQ ID NO: 785293 - RNA, 18 nt, Mycobacterium avium subsp. paratuberculosis
ugggcgugccggcccggc

SEQ ID NO: 785294 - RNA, 21 nt, Mycobacterium avium subsp. paratuberculosis
ugggggcgccgcggcgccgcc

SEQ ID NO: 785295 - RNA, 19 nt, Mycobacterium avium subsp. paratuberculosis
ugggcgucguggucgacgc

SEQ ID NO: 785296 - RNA, 19 nt, Mycobacterium avium subsp. paratuberculosis
ugggcgugcaggccgcggg

SEQ ID NO: 785297 - RNA, 23 nt, Mycobacterium avium subsp. paratuberculosis
ugggcgugcaggccgcggguggc

SEQ ID NO: 785298 - RNA, 19 nt, Mycobacterium avium subsp. paratuberculosis
ugggcguacugcucggcgc

SEQ ID NO: 785299 - RNA, 19 nt, Mycobacterium avium subsp. paratuberculosis
ugggcgguccgcuccacca

SEQ ID NO: 785300 - RNA, 15 nt, Mycobacterium avium subsp. paratuberculosis
ugggugggcagcucg

SEQ ID NO: 785301 - RNA, 20 nt, Mycobacterium avium subsp. paratuberculosis
uggguggucaccagcgcggu

SEQ ID NO: 785302 - RNA, 17 nt, Mycobacterium avium subsp. paratuberculosis
uggguggucagcgcggu

SEQ ID NO: 785303 - RNA, 14 nt, Mycobacterium avium subsp. paratuberculosis
ugggugguccaggc

SEQ ID NO: 785304 - RNA, 18 nt, Mycobacterium avium subsp. paratuberculosis
ugggugguccaggcgccg

SEQ ID NO: 785305 - RNA, 24 nt, Mycobacterium avium subsp. paratuberculosis
ugggugccccgccguuucagcagc

SEQ ID NO: 785306 - RNA, 20 nt, Mycobacterium avium subsp. paratuberculosis
ugggugccgcguuccccggc

SEQ ID NO: 785307 - RNA, 13 nt, Mycobacterium avium subsp. paratuberculosis
uggguguggcguc

SEQ ID NO: 785308 - RNA, 14 nt, Mycobacterium avium subsp. paratuberculosis
ugggugguggugcc

SEQ ID NO: 785309 - RNA, 14 nt, Mycobacterium avium subsp. paratuberculosis
uggguucggcggcg

SEQ ID NO: 785310 - RNA, 20 nt, Mycobacterium avium subsp. paratuberculosis
uggggugaggcacccgcugc

SEQ ID NO: 785311 - RNA, 17 nt, Mycobacterium avium subsp. paratuberculosis
uggggugucagcgcgac

SEQ ID NO: 785312 - RNA, 20 nt, Mycobacterium avium subsp. paratuberculosis
ugggugagcgacaccagguc

SEQ ID NO: 785313 - RNA, 17 nt, Mycobacterium avium subsp. paratuberculosis
ugggugagcggcgcguc

SEQ ID NO: 785314 - RNA, 19 nt, Mycobacterium avium subsp. paratuberculosis
ugggugagcuaucagcucg

SEQ ID NO: 785315 - RNA, 19 nt, Mycobacterium avium subsp. paratuberculosis
ugggggucggugaccagcc

SEQ ID NO: 785316 - RNA, 20 nt, Mycobacterium avium subsp. paratuberculosis
ugggguccucgauggcggcg

SEQ ID NO: 785317 - RNA, 15 nt, Mycobacterium avium subsp. paratuberculosis
uggggucggccagcg

SEQ ID NO: 785318 - RNA, 19 nt, Mycobacterium avium subsp. paratuberculosis
uggcgcgcaccagcucggc

SEQ ID NO: 785319 - RNA, 14 nt, Mycobacterium avium subsp. paratuberculosis
uggcgcgccccggc

SEQ ID NO: 785320 - RNA, 17 nt, Mycobacterium avium subsp. paratuberculosis
uggcgcgccccggcccg

SEQ ID NO: 785321 - RNA, 18 nt, Mycobacterium avium subsp. paratuberculosis
uggcgcgccccggcccgu

SEQ ID NO: 785322 - RNA, 19 nt, Mycobacterium avium subsp. paratuberculosis
uggcgcgccccggcccguc

SEQ ID NO: 785323 - RNA, 19 nt, Mycobacterium avium subsp. paratuberculosis
uggcgcgcaacgcuuucgg

SEQ ID NO: 785324 - RNA, 15 nt, Mycobacterium avium subsp. paratuberculosis
uggcgcgccguaccg

SEQ ID NO: 785325 - RNA, 20 nt, Mycobacterium avium subsp. paratuberculosis
uggcgcugccgagcaccucg

SEQ ID NO: 785326 - RNA, 16 nt, Mycobacterium avium subsp. paratuberculosis
uggcgcgcaucguggc

SEQ ID NO: 785327 - RNA, 23 nt, Mycobacterium avium subsp. paratuberculosis
uggcgcugcgcgacaccugcuca

SEQ ID NO: 785328 - RNA, 21 nt, Mycobacterium avium subsp. paratuberculosis
uggcgcgauagccggugaucg

SEQ ID NO: 785329 - RNA, 23 nt, Mycobacterium avium subsp. paratuberculosis
uggcgcgauagccggugaucgcg

SEQ ID NO: 785330 - RNA, 13 nt, Mycobacterium avium subsp. paratuberculosis
uggcgcgacgcgg

SEQ ID NO: 785331 - RNA, 13 nt, Mycobacterium avium subsp. paratuberculosis
uggcgccgaacag

SEQ ID NO: 785332 - RNA, 23 nt, Mycobacterium avium subsp. paratuberculosis
uggcgccgaacagaugccugccc

SEQ ID NO: 785333 - RNA, 12 nt, Mycobacterium avium subsp. paratuberculosis
uggcgcccggca

SEQ ID NO: 785334 - RNA, 14 nt, Mycobacterium avium subsp. paratuberculosis
uggcgcccggcagc

SEQ ID NO: 785335 - RNA, 21 nt, Mycobacterium avium subsp. paratuberculosis
uggcgcccggcagccgcuccg

SEQ ID NO: 785336 - RNA, 14 nt, Mycobacterium avium subsp. paratuberculosis
uggcggauggcgcc

SEQ ID NO: 785337 - RNA, 16 nt, Mycobacterium avium subsp. paratuberculosis
uggcggauggcgcccu

SEQ ID NO: 785338 - RNA, 13 nt, Mycobacterium avium subsp. paratuberculosis
uggcggaagcgcg

SEQ ID NO: 785339 - RNA, 20 nt, Mycobacterium avium subsp. paratuberculosis
uggcggaauuuucgccguca

SEQ ID NO: 785340 - RNA, 19 nt, Mycobacterium avium subsp. paratuberculosis
uggcgaacauggucgccca

SEQ ID NO: 785341 - RNA, 18 nt, Mycobacterium avium subsp. paratuberculosis
uggcgaacgcgaccugca

SEQ ID NO: 785342 - RNA, 12 nt, Mycobacterium avium subsp. paratuberculosis
uggcgaaccgcg

SEQ ID NO: 785343 - RNA, 18 nt, Mycobacterium avium subsp. paratuberculosis
uggcgaaccgcggcggca

SEQ ID NO: 785344 - RNA, 21 nt, Mycobacterium avium subsp. paratuberculosis
uggcgaacucgacggagugcg

SEQ ID NO: 785345 - RNA, 17 nt, Mycobacterium avium subsp. paratuberculosis
uggcgaagcccaugccg

SEQ ID NO: 785346 - RNA, 18 nt, Mycobacterium avium subsp. paratuberculosis
uggcgcagcaccgacucc

SEQ ID NO: 785347 - RNA, 14 nt, Mycobacterium avium subsp. paratuberculosis
uggcgcaccgcggc

SEQ ID NO: 785348 - RNA, 21 nt, Mycobacterium avium subsp. paratuberculosis
uggcgaagcguuucagcaacc

SEQ ID NO: 785349 - RNA, 22 nt, Mycobacterium avium subsp. paratuberculosis
uggcgaagcguuucagcaaccc

SEQ ID NO: 785350 - RNA, 18 nt, Mycobacterium avium subsp. paratuberculosis
uggcgcagcgucaacggc

SEQ ID NO: 785351 - RNA, 15 nt, Mycobacterium avium subsp. paratuberculosis
uggcgcagccgguca

SEQ ID NO: 785352 - RNA, 18 nt, Mycobacterium avium subsp. paratuberculosis
uggcgcaggcgcugggug

SEQ ID NO: 785353 - RNA, 21 nt, Mycobacterium avium subsp. paratuberculosis
uggcgccaguaguggaucagc

SEQ ID NO: 785354 - RNA, 14 nt, Mycobacterium avium subsp. paratuberculosis
uggcgcccagcgag

SEQ ID NO: 785355 - RNA, 18 nt, Mycobacterium avium subsp. paratuberculosis
uggcgcccagcgagcugc

SEQ ID NO: 785356 - RNA, 19 nt, Mycobacterium avium subsp. paratuberculosis
uggcgcccagcgagcugcc

SEQ ID NO: 785357 - RNA, 22 nt, Mycobacterium avium subsp. paratuberculosis
uggcgcccagcgucucggcggc

SEQ ID NO: 785358 - RNA, 16 nt, Mycobacterium avium subsp. paratuberculosis
uggcgccaccuccgac

SEQ ID NO: 785359 - RNA, 21 nt, Mycobacterium avium subsp. paratuberculosis
uggccuugacgacggccaccg

SEQ ID NO: 785360 - RNA, 13 nt, Mycobacterium avium subsp. paratuberculosis
uggccuggucgaa

SEQ ID NO: 785361 - RNA, 23 nt, Mycobacterium avium subsp. paratuberculosis
uggccuucaucaccgccccgacg

SEQ ID NO: 785362 - RNA, 23 nt, Mycobacterium avium subsp. paratuberculosis
uggccuugcugauccccagcggc

SEQ ID NO: 785363 - RNA, 17 nt, Mycobacterium avium subsp. paratuberculosis
uggccuggucggccggc

SEQ ID NO: 785364 - RNA, 15 nt, Mycobacterium avium subsp. paratuberculosis
uggccuggucggcga

SEQ ID NO: 785365 - RNA, 16 nt, Mycobacterium avium subsp. paratuberculosis
uggccuggucggcgac

SEQ ID NO: 785366 - RNA, 18 nt, Mycobacterium avium subsp. paratuberculosis
uggccugggccucgucca

SEQ ID NO: 785367 - RNA, 16 nt, Mycobacterium avium subsp. paratuberculosis
uggccugggcgaccag

SEQ ID NO: 785368 - RNA, 17 nt, Mycobacterium avium subsp. paratuberculosis
uggccugcuugggcagc

SEQ ID NO: 785369 - RNA, 19 nt, Mycobacterium avium subsp. paratuberculosis
uggccuggaagaugacccg

SEQ ID NO: 785370 - RNA, 16 nt, Mycobacterium avium subsp. paratuberculosis
uggccugcgcgaccuc

SEQ ID NO: 785371 - RNA, 23 nt, Mycobacterium avium subsp. paratuberculosis
uggccgggcucgaguuuggccag

SEQ ID NO: 785372 - RNA, 23 nt, Mycobacterium avium subsp. paratuberculosis
uggccggcguccaggcgcaccgc

SEQ ID NO: 785373 - RNA, 21 nt, Mycobacterium avium subsp. paratuberculosis
uggccggcuggaacaucccgg

SEQ ID NO: 785374 - RNA, 14 nt, Mycobacterium avium subsp. paratuberculosis
uggccggccaccag

SEQ ID NO: 785375 - RNA, 14 nt, Mycobacterium avium subsp. paratuberculosis
uggccgccggccgc

SEQ ID NO: 785376 - RNA, 16 nt, Mycobacterium avium subsp. paratuberculosis
uggccgcgaacggccc

SEQ ID NO: 785377 - RNA, 18 nt, Mycobacterium avium subsp. paratuberculosis
uggccgcgaacggcccgc

SEQ ID NO: 785378 - RNA, 13 nt, Mycobacterium avium subsp. paratuberculosis
uggccgcgacgcc

SEQ ID NO: 785379 - RNA, 14 nt, Mycobacterium avium subsp. paratuberculosis
uggccgcaggcggc

SEQ ID NO: 785380 - RNA, 19 nt, Mycobacterium avium subsp. paratuberculosis
uggccgcaggcggccagca

SEQ ID NO: 785381 - RNA, 15 nt, Mycobacterium avium subsp. paratuberculosis
uggccgauggucagc

SEQ ID NO: 785382 - RNA, 17 nt, Mycobacterium avium subsp. paratuberculosis
uggccgauggucagcug

SEQ ID NO: 785383 - RNA, 22 nt, Mycobacterium avium subsp. paratuberculosis
uggccgaguaggaagccaugcc

SEQ ID NO: 785384 - RNA, 22 nt, Mycobacterium avium subsp. paratuberculosis
uggccgccaccaggcugaacgu

SEQ ID NO: 785385 - RNA, 20 nt, Mycobacterium avium subsp. paratuberculosis
uggccgccaagugcggugug

SEQ ID NO: 785386 - RNA, 15 nt, Mycobacterium avium subsp. paratuberculosis
uggccgccacgaugc

SEQ ID NO: 785387 - RNA, 22 nt, Mycobacterium avium subsp. paratuberculosis
uggccgccaccaacaucgacgu

SEQ ID NO: 785388 - RNA, 13 nt, Mycobacterium avium subsp. paratuberculosis
uggccgccaccag

SEQ ID NO: 785389 - RNA, 16 nt, Mycobacterium avium subsp. paratuberculosis
uggccgcccucgcugc

SEQ ID NO: 785390 - RNA, 22 nt, Mycobacterium avium subsp. paratuberculosis
uggccgccagcaccucgcggca

SEQ ID NO: 785391 - RNA, 17 nt, Mycobacterium avium subsp. paratuberculosis
uggccgcccaccacgaa

SEQ ID NO: 785392 - RNA, 20 nt, Mycobacterium avium subsp. paratuberculosis
uggcccugcucuucgcgcgc

SEQ ID NO: 785393 - RNA, 14 nt, Mycobacterium avium subsp. paratuberculosis
uggccgaacggguc

SEQ ID NO: 785394 - RNA, 20 nt, Mycobacterium avium subsp. paratuberculosis
uggccgaacgggucggcgac

SEQ ID NO: 785395 - RNA, 22 nt, Mycobacterium avium subsp. paratuberculosis
uggccgacaacauccgcgacga

SEQ ID NO: 785396 - RNA, 15 nt, Mycobacterium avium subsp. paratuberculosis
uggccgagccgggcg

SEQ ID NO: 785397 - RNA, 17 nt, Mycobacterium avium subsp. paratuberculosis
uggccgagccgggcggc

SEQ ID NO: 785398 - RNA, 20 nt, Mycobacterium avium subsp. paratuberculosis
uggccgagccgggcggccag

SEQ ID NO: 785399 - RNA, 16 nt, Mycobacterium avium subsp. paratuberculosis
uggccgagcggcugcu

SEQ ID NO: 785400 - RNA, 22 nt, Mycobacterium avium subsp. paratuberculosis
uggccgagggguccggggcacg

SEQ ID NO: 785401 - RNA, 14 nt, Mycobacterium avium subsp. paratuberculosis
uggccgaucagcug

SEQ ID NO: 785402 - RNA, 19 nt, Mycobacterium avium subsp. paratuberculosis
uggccgaucccggccacgu

SEQ ID NO: 785403 - RNA, 22 nt, Mycobacterium avium subsp. paratuberculosis
uggccgaucccggccacgucga

SEQ ID NO: 785404 - RNA, 17 nt, Mycobacterium avium subsp. paratuberculosis
uggccgacgugccggug

SEQ ID NO: 785405 - RNA, 14 nt, Mycobacterium avium subsp. paratuberculosis
uggccgaccgccgc

SEQ ID NO: 785406 - RNA, 22 nt, Mycobacterium avium subsp. paratuberculosis
ugaaucccuccggcaggccgcg

SEQ ID NO: 785407 - RNA, 19 nt, Mycobacterium avium subsp. paratuberculosis
ugaauaccacugcgcgccc

SEQ ID NO: 785408 - RNA, 21 nt, Mycobacterium avium subsp. paratuberculosis
ugaauugggcgaguacaccuc

SEQ ID NO: 785409 - RNA, 15 nt, Mycobacterium avium subsp. paratuberculosis
ugaauuccuggccgg

SEQ ID NO: 785410 - RNA, 13 nt, Mycobacterium avium subsp. paratuberculosis
ugaagggcccgcc

SEQ ID NO: 785411 - RNA, 20 nt, Mycobacterium avium subsp. paratuberculosis
ugaaggcgaacaccagcccg

SEQ ID NO: 785412 - RNA, 23 nt, Mycobacterium avium subsp. paratuberculosis
ugaaggcgaacaccagcccggcc

SEQ ID NO: 785413 - RNA, 20 nt, Mycobacterium avium subsp. paratuberculosis
ugaaguuaacuucacgcucg

SEQ ID NO: 785414 - RNA, 13 nt, Mycobacterium avium subsp. paratuberculosis
ugaagucggugag

SEQ ID NO: 785415 - RNA, 23 nt, Mycobacterium avium subsp. paratuberculosis
ugaagucguucuccagcccucgu

SEQ ID NO: 785416 - RNA, 15 nt, Mycobacterium avium subsp. paratuberculosis
ugaaguucaccaccg

SEQ ID NO: 785417 - RNA, 16 nt, Mycobacterium avium subsp. paratuberculosis
ugaaguuggccaccgg

SEQ ID NO: 785418 - RNA, 15 nt, Mycobacterium avium subsp. paratuberculosis
ugaaggacuggccca

SEQ ID NO: 785419 - RNA, 16 nt, Mycobacterium avium subsp. paratuberculosis
ugaaggaggcggucga

SEQ ID NO: 785420 - RNA, 12 nt, Mycobacterium avium subsp. paratuberculosis
ugaagcuggcca

SEQ ID NO: 785421 - RNA, 16 nt, Mycobacterium avium subsp. paratuberculosis
ugaagcuggccaccgc

SEQ ID NO: 785422 - RNA, 13 nt, Mycobacterium avium subsp. paratuberculosis
ugaagcugccgac

SEQ ID NO: 785423 - RNA, 20 nt, Mycobacterium avium subsp. paratuberculosis
ugaagcuagcuucacgcucg

SEQ ID NO: 785424 - RNA, 21 nt, Mycobacterium avium subsp. paratuberculosis
ugaagcuagcuucacgcucgg

SEQ ID NO: 785425 - RNA, 20 nt, Mycobacterium avium subsp. paratuberculosis
ugaagcuaguuucacgcucg

SEQ ID NO: 785426 - RNA, 15 nt, Mycobacterium avium subsp. paratuberculosis
ugaaaugccgggccg

SEQ ID NO: 785427 - RNA, 12 nt, Mycobacterium avium subsp. paratuberculosis
ugaacuucagcu

SEQ ID NO: 785428 - RNA, 18 nt, Mycobacterium avium subsp. paratuberculosis
ugaacccgccggcgaacg

SEQ ID NO: 785429 - RNA, 13 nt, Mycobacterium avium subsp. paratuberculosis
ugaaccuggccac

SEQ ID NO: 785430 - RNA, 19 nt, Mycobacterium avium subsp. paratuberculosis
ugaaccuggccaccagcag

SEQ ID NO: 785431 - RNA, 20 nt, Mycobacterium avium subsp. paratuberculosis
ugaaccgguacaggccccac

SEQ ID NO: 785432 - RNA, 20 nt, Mycobacterium avium subsp. paratuberculosis
ugaaacuaacuucacgcucg

SEQ ID NO: 785433 - RNA, 20 nt, Mycobacterium avium subsp. paratuberculosis
ugaaacuagcuucacgcucg

SEQ ID NO: 785434 - RNA, 20 nt, Mycobacterium avium subsp. paratuberculosis
ugaaacuagcuucacggucg

SEQ ID NO: 785435 - RNA, 20 nt, Mycobacterium avium subsp. paratuberculosis
ugaaacuagcuucacguucg

SEQ ID NO: 785436 - RNA, 14 nt, Mycobacterium avium subsp. paratuberculosis
ucucccagacgucg

SEQ ID NO: 785437 - RNA, 13 nt, Mycobacterium avium subsp. paratuberculosis
ucucccgcggcag

SEQ ID NO: 785438 - RNA, 23 nt, Mycobacterium avium subsp. paratuberculosis
ucuccagcggccgcagcgcgacg

SEQ ID NO: 785439 - RNA, 24 nt, Mycobacterium avium subsp. paratuberculosis
ucuccaucccgcugaagccgaacg

SEQ ID NO: 785440 - RNA, 16 nt, Mycobacterium avium subsp. paratuberculosis
ucuccauccgggcggc

SEQ ID NO: 785441 - RNA, 21 nt, Mycobacterium avium subsp. paratuberculosis
ucuccauccgggcggccagcc

SEQ ID NO: 785442 - RNA, 15 nt, Mycobacterium avium subsp. paratuberculosis
ugaccaccgaccggc

SEQ ID NO: 785443 - RNA, 19 nt, Mycobacterium avium subsp. paratuberculosis
ugaccaccgagccgggcag

SEQ ID NO: 785444 - RNA, 17 nt, Mycobacterium avium subsp. paratuberculosis
ugaccaccgaggugacg

SEQ ID NO: 785445 - RNA, 13 nt, Mycobacterium avium subsp. paratuberculosis
ugaccaccaggua

SEQ ID NO: 785446 - RNA, 12 nt, Mycobacterium avium subsp. paratuberculosis
ugaccacgccgu

SEQ ID NO: 785447 - RNA, 20 nt, Mycobacterium avium subsp. paratuberculosis
ugaccaccuuggccggugcg

SEQ ID NO: 785448 - RNA, 18 nt, Mycobacterium avium subsp. paratuberculosis
ugacacagcaccggcguc

SEQ ID NO: 785449 - RNA, 14 nt, Mycobacterium avium subsp. paratuberculosis
ugacacgaccgccu

SEQ ID NO: 785450 - RNA, 15 nt, Mycobacterium avium subsp. paratuberculosis
ugacagguggggcac

SEQ ID NO: 785451 - RNA, 13 nt, Mycobacterium avium subsp. paratuberculosis
ugacccgcccggg

SEQ ID NO: 785452 - RNA, 19 nt, Mycobacterium avium subsp. paratuberculosis
ugacccggcccaucaccgg

SEQ ID NO: 785453 - RNA, 20 nt, Mycobacterium avium subsp. paratuberculosis
ugacccggcccaucaccgga

SEQ ID NO: 785454 - RNA, 17 nt, Mycobacterium avium subsp. paratuberculosis
ugacccggccgcacacc

SEQ ID NO: 785455 - RNA, 22 nt, Mycobacterium avium subsp. paratuberculosis
ugacccggccgcacaccaccac

SEQ ID NO: 785456 - RNA, 16 nt, Mycobacterium avium subsp. paratuberculosis
ugacccggucgcggcc

SEQ ID NO: 785457 - RNA, 18 nt, Mycobacterium avium subsp. paratuberculosis
ugacccggucgcggccgu

SEQ ID NO: 785458 - RNA, 22 nt, Mycobacterium avium subsp. paratuberculosis
ugacccaacucaugggcccggc

SEQ ID NO: 785459 - RNA, 15 nt, Mycobacterium avium subsp. paratuberculosis
ugacccaauccggcu

SEQ ID NO: 785460 - RNA, 23 nt, Mycobacterium avium subsp. paratuberculosis
ugacccacggguuggggccgcgg

SEQ ID NO: 785461 - RNA, 18 nt, Mycobacterium avium subsp. paratuberculosis
ugaccaugaguugcgggu

SEQ ID NO: 785462 - RNA, 15 nt, Mycobacterium avium subsp. paratuberculosis
ugaccccccgacgcc

SEQ ID NO: 785463 - RNA, 16 nt, Mycobacterium avium subsp. paratuberculosis
ugaccccccgacgccg

SEQ ID NO: 785464 - RNA, 18 nt, Mycobacterium avium subsp. paratuberculosis
ugaccccccgacgccgac

SEQ ID NO: 785465 - RNA, 20 nt, Mycobacterium avium subsp. paratuberculosis
ugaccccccgacgccgacgg

SEQ ID NO: 785466 - RNA, 19 nt, Mycobacterium avium subsp. paratuberculosis
ugaccccgacggcgccgcg

SEQ ID NO: 785467 - RNA, 16 nt, Mycobacterium avium subsp. paratuberculosis
ugaccccgcucggcgu

SEQ ID NO: 785468 - RNA, 18 nt, Mycobacterium avium subsp. paratuberculosis
ugaccccggccccggccg

SEQ ID NO: 785469 - RNA, 23 nt, Mycobacterium avium subsp. paratuberculosis
ugaccagaccgaagaucaccgcg

SEQ ID NO: 785470 - RNA, 15 nt, Mycobacterium avium subsp. paratuberculosis
ugaccacggcgcgga

SEQ ID NO: 785471 - RNA, 19 nt, Mycobacterium avium subsp. paratuberculosis
ugaccacggucggcgggua

SEQ ID NO: 785472 - RNA, 22 nt, Mycobacterium avium subsp. paratuberculosis
ugaccagcggcgcgccgggcag

SEQ ID NO: 785473 - RNA, 14 nt, Mycobacterium avium subsp. paratuberculosis
ugaccagcgugacg

SEQ ID NO: 785474 - RNA, 23 nt, Mycobacterium avium subsp. paratuberculosis
ugaccagcugcgaaucgucggcg

SEQ ID NO: 785475 - RNA, 23 nt, Mycobacterium avium subsp. paratuberculosis
ugaccaggaugucuccgcgcagc

SEQ ID NO: 785476 - RNA, 12 nt, Mycobacterium avium subsp. paratuberculosis
ugaccaggccga

SEQ ID NO: 785477 - RNA, 21 nt, Mycobacterium avium subsp. paratuberculosis
ugaccagggccucgucgucgu

SEQ ID NO: 785478 - RNA, 17 nt, Mycobacterium avium subsp. paratuberculosis
ugaccaggguggucagc

SEQ ID NO: 785479 - RNA, 20 nt, Mycobacterium avium subsp. paratuberculosis
ugaccaggguuccggucacg

SEQ ID NO: 785480 - RNA, 21 nt, Mycobacterium avium subsp. paratuberculosis
ugaccaggguuccggucacgu

SEQ ID NO: 785481 - RNA, 15 nt, Mycobacterium avium subsp. paratuberculosis
ugaccaggucgccgg

SEQ ID NO: 785482 - RNA, 22 nt, Mycobacterium avium subsp. paratuberculosis
ugaccaggucgccggcggccga

SEQ ID NO: 785483 - RNA, 13 nt, Mycobacterium avium subsp. paratuberculosis
ugaccgucguugc

SEQ ID NO: 785484 - RNA, 16 nt, Mycobacterium avium subsp. paratuberculosis
ugaccgugacggugcg

SEQ ID NO: 785485 - RNA, 15 nt, Mycobacterium avium subsp. paratuberculosis
ugaccgucgccgacc

SEQ ID NO: 785486 - RNA, 16 nt, Mycobacterium avium subsp. paratuberculosis
ugaccgucgccgacca

SEQ ID NO: 785487 - RNA, 20 nt, Mycobacterium avium subsp. paratuberculosis
ugaccucgagcagcgcgcgc

SEQ ID NO: 785488 - RNA, 16 nt, Mycobacterium avium subsp. paratuberculosis
ugaccucgcgcccggc

SEQ ID NO: 785489 - RNA, 17 nt, Mycobacterium avium subsp. paratuberculosis
ugaccucgcgcccggcg

SEQ ID NO: 785490 - RNA, 22 nt, Mycobacterium avium subsp. paratuberculosis
ugaccucgcgcccggcgccggc

SEQ ID NO: 785491 - RNA, 15 nt, Mycobacterium avium subsp. paratuberculosis
ugaccuugaccagcu

SEQ ID NO: 785492 - RNA, 14 nt, Mycobacterium avium subsp. paratuberculosis
ugaccugugcgccc

SEQ ID NO: 785493 - RNA, 11 nt, Mycobacterium avium subsp. paratuberculosis
ugaccugcgga

SEQ ID NO: 785494 - RNA, 15 nt, Mycobacterium avium subsp. paratuberculosis
ugaccugcagcgccu

SEQ ID NO: 785495 - RNA, 20 nt, Mycobacterium avium subsp. paratuberculosis
ugacgaacuccugcucgcgg

SEQ ID NO: 785496 - RNA, 20 nt, Mycobacterium avium subsp. paratuberculosis
ugacgaacaugcugccgccg

SEQ ID NO: 785497 - RNA, 22 nt, Mycobacterium avium subsp. paratuberculosis
ugacgaacaugcugccgccggc

SEQ ID NO: 785498 - RNA, 23 nt, Mycobacterium avium subsp. paratuberculosis
ugacgaacaugcugccgccggcg

SEQ ID NO: 785499 - RNA, 20 nt, Mycobacterium avium subsp. paratuberculosis
ugacgaacccgccgcggccg

SEQ ID NO: 785500 - RNA, 21 nt, Mycobacterium avium subsp. paratuberculosis
ugacgaacccgccgcggccga

SEQ ID NO: 785501 - RNA, 20 nt, Mycobacterium avium subsp. paratuberculosis
ugaccuugggcauccgcucg

SEQ ID NO: 785502 - RNA, 23 nt, Mycobacterium avium subsp. paratuberculosis
ugacgacguuggccagcaccgcg

SEQ ID NO: 785503 - RNA, 22 nt, Mycobacterium avium subsp. paratuberculosis
ugacgaggagggugucggcggg

SEQ ID NO: 785504 - RNA, 23 nt, Mycobacterium avium subsp. paratuberculosis
ugacgaggagggugucggcgggg

SEQ ID NO: 785505 - RNA, 19 nt, Mycobacterium avium subsp. paratuberculosis
ugacgacggucaccggcag

SEQ ID NO: 785506 - RNA, 20 nt, Mycobacterium avium subsp. paratuberculosis
ugacgaauuccgcaccgguc

SEQ ID NO: 785507 - RNA, 15 nt, Mycobacterium avium subsp. paratuberculosis
ugaccgagcggcgcu

SEQ ID NO: 785508 - RNA, 15 nt, Mycobacterium avium subsp. paratuberculosis
ugaccgaggccgccc

SEQ ID NO: 785509 - RNA, 13 nt, Mycobacterium avium subsp. paratuberculosis
ugaccgacgccuc

SEQ ID NO: 785510 - RNA, 14 nt, Mycobacterium avium subsp. paratuberculosis
ugaccgacggcgac

SEQ ID NO: 785511 - RNA, 14 nt, Mycobacterium avium subsp. paratuberculosis
ugaccgauggccgc

SEQ ID NO: 785512 - RNA, 22 nt, Mycobacterium avium subsp. paratuberculosis
ugaccgaccuccaaugcgcccu

SEQ ID NO: 785513 - RNA, 15 nt, Mycobacterium avium subsp. paratuberculosis
ugaccgacgacguga

SEQ ID NO: 785514 - RNA, 18 nt, Mycobacterium avium subsp. paratuberculosis
ugaccgacgacgugacga

SEQ ID NO: 785515 - RNA, 19 nt, Mycobacterium avium subsp. paratuberculosis
ugaccgacgacgugacgac

SEQ ID NO: 785516 - RNA, 22 nt, Mycobacterium avium subsp. paratuberculosis
ugaccgacagcaaaccgaccgc

SEQ ID NO: 785517 - RNA, 23 nt, Mycobacterium avium subsp. paratuberculosis
ugaccgacagcaaaccgaccgcc

SEQ ID NO: 785518 - RNA, 16 nt, Mycobacterium avium subsp. paratuberculosis
ugaccgccagcaccgc

SEQ ID NO: 785519 - RNA, 18 nt, Mycobacterium avium subsp. paratuberculosis
ugaccgcccgcucgacgg

SEQ ID NO: 785520 - RNA, 13 nt, Mycobacterium avium subsp. paratuberculosis
ugaccgccgacac

SEQ ID NO: 785521 - RNA, 15 nt, Mycobacterium avium subsp. paratuberculosis
ugaccgccucgucga

SEQ ID NO: 785522 - RNA, 21 nt, Mycobacterium avium subsp. paratuberculosis
ugaccgccgccauccgcgccg

SEQ ID NO: 785523 - RNA, 12 nt, Mycobacterium avium subsp. paratuberculosis
ugaccggcccgg

SEQ ID NO: 785524 - RNA, 20 nt, Mycobacterium avium subsp. paratuberculosis
ugaccggcccggcggccggc

SEQ ID NO: 785525 - RNA, 23 nt, Mycobacterium avium subsp. paratuberculosis
ugaccggcccggcggccggccgc

SEQ ID NO: 785526 - RNA, 23 nt, Mycobacterium avium subsp. paratuberculosis
ugaccggccugagacgacgccac

SEQ ID NO: 785527 - RNA, 23 nt, Mycobacterium avium subsp. paratuberculosis
ugaccgcggcgauggugggcagc

SEQ ID NO: 785528 - RNA, 14 nt, Mycobacterium avium subsp. paratuberculosis
ugaccgcggcgggc

SEQ ID NO: 785529 - RNA, 16 nt, Mycobacterium avium subsp. paratuberculosis
ugaccgcgccgcgggu

SEQ ID NO: 785530 - RNA, 19 nt, Mycobacterium avium subsp. paratuberculosis
ugaccgggucgccgaucac

SEQ ID NO: 785531 - RNA, 16 nt, Mycobacterium avium subsp. paratuberculosis
ugaccgggucgccgau

SEQ ID NO: 785532 - RNA, 14 nt, Mycobacterium avium subsp. paratuberculosis
ugaccggugcgccc

SEQ ID NO: 785533 - RNA, 20 nt, Mycobacterium avium subsp. paratuberculosis
ugaccguacucgugggccac

SEQ ID NO: 785534 - RNA, 16 nt, Mycobacterium avium subsp. paratuberculosis
ugaccggggucggcgc

SEQ ID NO: 785535 - RNA, 18 nt, Mycobacterium avium subsp. paratuberculosis
ugaccggcucgccggcgc

SEQ ID NO: 785536 - RNA, 20 nt, Mycobacterium avium subsp. paratuberculosis
ugaccggcucgccggcgcgc

SEQ ID NO: 785537 - RNA, 23 nt, Mycobacterium avium subsp. paratuberculosis
ugaccggcucgccggcgcgcacc

SEQ ID NO: 785538 - RNA, 14 nt, Mycobacterium avium subsp. paratuberculosis
ugaccggcgccggg

SEQ ID NO: 785539 - RNA, 15 nt, Mycobacterium avium subsp. paratuberculosis
ugaccggcgccgggu

SEQ ID NO: 785540 - RNA, 18 nt, Mycobacterium avium subsp. paratuberculosis
ugaccggcgcgcccgagu

SEQ ID NO: 785541 - RNA, 20 nt, Mycobacterium avium subsp. paratuberculosis
ugaccggcgcgcccgaguca

SEQ ID NO: 785542 - RNA, 16 nt, Mycobacterium avium subsp. paratuberculosis
ugaccggcggccagcg

SEQ ID NO: 785543 - RNA, 19 nt, Mycobacterium avium subsp. paratuberculosis
ugaucagguccuugcgcgc

SEQ ID NO: 785544 - RNA, 23 nt, Mycobacterium avium subsp. paratuberculosis
ugaucagguccuugcgcgccgcg

SEQ ID NO: 785545 - RNA, 14 nt, Mycobacterium avium subsp. paratuberculosis
ugaggucgcgaccg

SEQ ID NO: 785546 - RNA, 14 nt, Mycobacterium avium subsp. paratuberculosis
ugaggucgggcucg

SEQ ID NO: 785547 - RNA, 23 nt, Mycobacterium avium subsp. paratuberculosis
ugauccuggccuggucggccggc

SEQ ID NO: 785548 - RNA, 18 nt, Mycobacterium avium subsp. paratuberculosis
ugauccgcccggcccgca

SEQ ID NO: 785549 - RNA, 14 nt, Mycobacterium avium subsp. paratuberculosis
ugaucaugucgucc

SEQ ID NO: 785550 - RNA, 13 nt, Mycobacterium avium subsp. paratuberculosis
ugaucucgccgag

SEQ ID NO: 785551 - RNA, 15 nt, Mycobacterium avium subsp. paratuberculosis
ugaucucgccgagca

SEQ ID NO: 785552 - RNA, 13 nt, Mycobacterium avium subsp. paratuberculosis
ugaucucgccgcg

SEQ ID NO: 785553 - RNA, 22 nt, Mycobacterium avium subsp. paratuberculosis
ugaucgucucggccgcggugcg

SEQ ID NO: 785554 - RNA, 21 nt, Mycobacterium avium subsp. paratuberculosis
ugaucgguucgucguggccga

SEQ ID NO: 785555 - RNA, 20 nt, Mycobacterium avium subsp. paratuberculosis
ugaugaaaaccgggcccucg

SEQ ID NO: 785556 - RNA, 11 nt, Mycobacterium avium subsp. paratuberculosis
ugaugcgccgg

SEQ ID NO: 785557 - RNA, 12 nt, Mycobacterium avium subsp. paratuberculosis
ugaugcgccggc

SEQ ID NO: 785558 - RNA, 18 nt, Mycobacterium avium subsp. paratuberculosis
ugaugcgcgccgacgacc

SEQ ID NO: 785559 - RNA, 15 nt, Mycobacterium avium subsp. paratuberculosis
ugaugcgcggcgacg

SEQ ID NO: 785560 - RNA, 16 nt, Mycobacterium avium subsp. paratuberculosis
ugaucugggugccgcg

SEQ ID NO: 785561 - RNA, 23 nt, Mycobacterium avium subsp. paratuberculosis
ugaucuucgagacacgcgccggc

SEQ ID NO: 785562 - RNA, 14 nt, Mycobacterium avium subsp. paratuberculosis
ugaucuugaucgcc

SEQ ID NO: 785563 - RNA, 14 nt, Mycobacterium avium subsp. paratuberculosis
ugaucgccgacguc

SEQ ID NO: 785564 - RNA, 15 nt, Mycobacterium avium subsp. paratuberculosis
ugaucgccgacgucu

SEQ ID NO: 785565 - RNA, 23 nt, Mycobacterium avium subsp. paratuberculosis
ugaucgccaguccggcgccgacc

SEQ ID NO: 785566 - RNA, 23 nt, Mycobacterium avium subsp. paratuberculosis
ugaucgcccagcaccgcgacgau

SEQ ID NO: 785567 - RNA, 20 nt, Mycobacterium avium subsp. paratuberculosis
ugaucgccgauccgggcggc

SEQ ID NO: 785568 - RNA, 19 nt, Mycobacterium avium subsp. paratuberculosis
ugaucgccggaucgccgag

SEQ ID NO: 785569 - RNA, 17 nt, Mycobacterium avium subsp. paratuberculosis
ugaucgaguuccgcguc

SEQ ID NO: 785570 - RNA, 20 nt, Mycobacterium avium subsp. paratuberculosis
ugaucgccacggcggugucg

SEQ ID NO: 785571 - RNA, 22 nt, Mycobacterium avium subsp. paratuberculosis
ugaucggcguuggcggcgucga

SEQ ID NO: 785572 - RNA, 22 nt, Mycobacterium avium subsp. paratuberculosis
ugaucggucugccuggcgaacu

SEQ ID NO: 785573 - RNA, 15 nt, Mycobacterium avium subsp. paratuberculosis
ugaucgcgucgacgg

SEQ ID NO: 785574 - RNA, 21 nt, Mycobacterium avium subsp. paratuberculosis
ugaucgcggcccacccgcagg

SEQ ID NO: 785575 - RNA, 14 nt, Mycobacterium avium subsp. paratuberculosis
ugaucgcggccggc

SEQ ID NO: 785576 - RNA, 17 nt, Mycobacterium avium subsp. paratuberculosis
ugaucgcggccggcgag

SEQ ID NO: 785577 - RNA, 15 nt, Mycobacterium avium subsp. paratuberculosis
ugaucgccggcgccg

SEQ ID NO: 785578 - RNA, 14 nt, Mycobacterium avium subsp. paratuberculosis
ugaucgccggggcg

SEQ ID NO: 785579 - RNA, 14 nt, Mycobacterium avium subsp. paratuberculosis
ugaucgccgggucg

SEQ ID NO: 785580 - RNA, 16 nt, Mycobacterium avium subsp. paratuberculosis
ugaucgccucgaccag

SEQ ID NO: 785581 - RNA, 18 nt, Mycobacterium avium subsp. paratuberculosis
ugcacaccaccagcgagg

SEQ ID NO: 785582 - RNA, 22 nt, Mycobacterium avium subsp. paratuberculosis
ugcacaccgcuuugugaggcgc

SEQ ID NO: 785583 - RNA, 22 nt, Mycobacterium avium subsp. paratuberculosis
ugcacacggccuugccgaucag

SEQ ID NO: 785584 - RNA, 22 nt, Mycobacterium avium subsp. paratuberculosis
ugcacacgggcccguccgcgaa

SEQ ID NO: 785585 - RNA, 20 nt, Mycobacterium avium subsp. paratuberculosis
ugcaccgaguugaacgcguc

SEQ ID NO: 785586 - RNA, 19 nt, Mycobacterium avium subsp. paratuberculosis
ugcaccgcgauggcccgcg

SEQ ID NO: 785587 - RNA, 23 nt, Mycobacterium avium subsp. paratuberculosis
ugcaccgcggccaacccgggcgc

SEQ ID NO: 785588 - RNA, 14 nt, Mycobacterium avium subsp. paratuberculosis
ugcaccgcggcgcg

SEQ ID NO: 785589 - RNA, 19 nt, Mycobacterium avium subsp. paratuberculosis
ugcaccgccagcgcggcgg

SEQ ID NO: 785590 - RNA, 13 nt, Mycobacterium avium subsp. paratuberculosis
ugcaccgcccgcg

SEQ ID NO: 785591 - RNA, 12 nt, Mycobacterium avium subsp. paratuberculosis
ugcacacgccga

SEQ ID NO: 785592 - RNA, 15 nt, Mycobacterium avium subsp. paratuberculosis
ugcacccgcggcgcg

SEQ ID NO: 785593 - RNA, 16 nt, Mycobacterium avium subsp. paratuberculosis
ugcacaggccgccgca

SEQ ID NO: 785594 - RNA, 21 nt, Mycobacterium avium subsp. paratuberculosis
ugcacccaccggcgcagcgcg

SEQ ID NO: 785595 - RNA, 21 nt, Mycobacterium avium subsp. paratuberculosis
ugcaagaacccgaacgcgucg

SEQ ID NO: 785596 - RNA, 20 nt, Mycobacterium avium subsp. paratuberculosis
ugcaaucucgucggggcgcc

SEQ ID NO: 785597 - RNA, 20 nt, Mycobacterium avium subsp. paratuberculosis
ugaugcggaugcccgccggc

SEQ ID NO: 785598 - RNA, 15 nt, Mycobacterium avium subsp. paratuberculosis
ugcaaaagcauccgg

SEQ ID NO: 785599 - RNA, 19 nt, Mycobacterium avium subsp. paratuberculosis
ugcaaaagcauccggccgu

SEQ ID NO: 785600 - RNA, 14 nt, Mycobacterium avium subsp. paratuberculosis
ugacguccgcggga

SEQ ID NO: 785601 - RNA, 20 nt, Mycobacterium avium subsp. paratuberculosis
ugacugcgaucgccgacgcc

SEQ ID NO: 785602 - RNA, 21 nt, Mycobacterium avium subsp. paratuberculosis
ugacugcgaucgccgacgcca

SEQ ID NO: 785603 - RNA, 18 nt, Mycobacterium avium subsp. paratuberculosis
ugacguacuggcgccggu

SEQ ID NO: 785604 - RNA, 20 nt, Mycobacterium avium subsp. paratuberculosis
ugacguagacgacgggcagg

SEQ ID NO: 785605 - RNA, 13 nt, Mycobacterium avium subsp. paratuberculosis
ugacuccucugcc

SEQ ID NO: 785606 - RNA, 20 nt, Mycobacterium avium subsp. paratuberculosis
ugacguccuugacccggccg

SEQ ID NO: 785607 - RNA, 15 nt, Mycobacterium avium subsp. paratuberculosis
ugacgucgaugccgg

SEQ ID NO: 785608 - RNA, 17 nt, Mycobacterium avium subsp. paratuberculosis
ugagcagcccgaccacc

SEQ ID NO: 785609 - RNA, 17 nt, Mycobacterium avium subsp. paratuberculosis
ugagcaucgggcgcagg

SEQ ID NO: 785610 - RNA, 16 nt, Mycobacterium avium subsp. paratuberculosis
ugagcauuggcgaugg

SEQ ID NO: 785611 - RNA, 19 nt, Mycobacterium avium subsp. paratuberculosis
ugagcauguugaacgccgc

SEQ ID NO: 785612 - RNA, 20 nt, Mycobacterium avium subsp. paratuberculosis
ugagcauguugaacgccgcg

SEQ ID NO: 785613 - RNA, 20 nt, Mycobacterium avium subsp. paratuberculosis
ugagcgaggacgucgagcgg

SEQ ID NO: 785614 - RNA, 17 nt, Mycobacterium avium subsp. paratuberculosis
ugacuggcguugaugcg

SEQ ID NO: 785615 - RNA, 14 nt, Mycobacterium avium subsp. paratuberculosis
ugagcacggugggc

SEQ ID NO: 785616 - RNA, 20 nt, Mycobacterium avium subsp. paratuberculosis
ugagcacggugggcgccggg

SEQ ID NO: 785617 - RNA, 23 nt, Mycobacterium avium subsp. paratuberculosis
ugagcacgaccgccagcagcagc

SEQ ID NO: 785618 - RNA, 14 nt, Mycobacterium avium subsp. paratuberculosis
ugagcacgcccgcg

SEQ ID NO: 785619 - RNA, 17 nt, Mycobacterium avium subsp. paratuberculosis
ugagcacgcccgcgauc

SEQ ID NO: 785620 - RNA, 22 nt, Mycobacterium avium subsp. paratuberculosis
ugaggcguuggcccgcacccgc

SEQ ID NO: 785621 - RNA, 16 nt, Mycobacterium avium subsp. paratuberculosis
ugagguauucgucgag

SEQ ID NO: 785622 - RNA, 12 nt, Mycobacterium avium subsp. paratuberculosis
ugaggggcgcgc

SEQ ID NO: 785623 - RNA, 16 nt, Mycobacterium avium subsp. paratuberculosis
ugaggguccgcgcgua

SEQ ID NO: 785624 - RNA, 13 nt, Mycobacterium avium subsp. paratuberculosis
ugagggugaugac

SEQ ID NO: 785625 - RNA, 17 nt, Mycobacterium avium subsp. paratuberculosis
ugagcucgcggcgcagc

SEQ ID NO: 785626 - RNA, 22 nt, Mycobacterium avium subsp. paratuberculosis
ugagcucggccuuacgcugcgc

SEQ ID NO: 785627 - RNA, 15 nt, Mycobacterium avium subsp. paratuberculosis
ugagcugggcggcgc

SEQ ID NO: 785628 - RNA, 16 nt, Mycobacterium avium subsp. paratuberculosis
ugagcgccagcgcggu

SEQ ID NO: 785629 - RNA, 16 nt, Mycobacterium avium subsp. paratuberculosis
ugagcgcggcgagcgg

SEQ ID NO: 785630 - RNA, 14 nt, Mycobacterium avium subsp. paratuberculosis
ugagcgccggggcg

SEQ ID NO: 785631 - RNA, 15 nt, Mycobacterium avium subsp. paratuberculosis
ugagcgccggggcgg

SEQ ID NO: 785632 - RNA, 13 nt, Mycobacterium avium subsp. paratuberculosis
ugagcgcgccggc

SEQ ID NO: 785633 - RNA, 16 nt, Mycobacterium avium subsp. paratuberculosis
ugagcgcgccggcccg

SEQ ID NO: 785634 - RNA, 18 nt, Mycobacterium avium subsp. paratuberculosis
ugagcgcgccggcccgau

SEQ ID NO: 785635 - RNA, 13 nt, Mycobacterium avium subsp. paratuberculosis
ugagcggcgcguc

SEQ ID NO: 785636 - RNA, 16 nt, Mycobacterium avium subsp. paratuberculosis
ugagcgguggccacgc

SEQ ID NO: 785637 - RNA, 19 nt, Mycobacterium avium subsp. paratuberculosis
ugagcguggcagcggucgg

SEQ ID NO: 785638 - RNA, 19 nt, Mycobacterium avium subsp. paratuberculosis
ugacgguuuuggucugcgc

SEQ ID NO: 785639 - RNA, 22 nt, Mycobacterium avium subsp. paratuberculosis
ugacggugccgccgugcgcggc

SEQ ID NO: 785640 - RNA, 17 nt, Mycobacterium avium subsp. paratuberculosis
ugacggucacggugacg

SEQ ID NO: 785641 - RNA, 21 nt, Mycobacterium avium subsp. paratuberculosis
ugacggguuggucggcgcggc

SEQ ID NO: 785642 - RNA, 12 nt, Mycobacterium avium subsp. paratuberculosis
ugacggugaccg

SEQ ID NO: 785643 - RNA, 15 nt, Mycobacterium avium subsp. paratuberculosis
ugacggcgucguuga

SEQ ID NO: 785644 - RNA, 19 nt, Mycobacterium avium subsp. paratuberculosis
ugacgggaccgcacgccgg

SEQ ID NO: 785645 - RNA, 14 nt, Mycobacterium avium subsp. paratuberculosis
ugacgggccggcgg

SEQ ID NO: 785646 - RNA, 15 nt, Mycobacterium avium subsp. paratuberculosis
ugacgggccggcggg

SEQ ID NO: 785647 - RNA, 17 nt, Mycobacterium avium subsp. paratuberculosis
ugacggcucuucggcgc

SEQ ID NO: 785648 - RNA, 23 nt, Mycobacterium avium subsp. paratuberculosis
ugacggcggggcggaugcgcugg

SEQ ID NO: 785649 - RNA, 19 nt, Mycobacterium avium subsp. paratuberculosis
ugacgcugaccugugcgcc

SEQ ID NO: 785650 - RNA, 20 nt, Mycobacterium avium subsp. paratuberculosis
ugacgcucggucgccacggc

SEQ ID NO: 785651 - RNA, 21 nt, Mycobacterium avium subsp. paratuberculosis
ugacgcucggucgccacggcc

SEQ ID NO: 785652 - RNA, 17 nt, Mycobacterium avium subsp. paratuberculosis
ugacgcucgacggccgg

SEQ ID NO: 785653 - RNA, 17 nt, Mycobacterium avium subsp. paratuberculosis
ugacgcucgaggccccg

SEQ ID NO: 785654 - RNA, 20 nt, Mycobacterium avium subsp. paratuberculosis
ugacgcucgaggccccgcgu

SEQ ID NO: 785655 - RNA, 12 nt, Mycobacterium avium subsp. paratuberculosis
ugacgcucgcgg

SEQ ID NO: 785656 - RNA, 21 nt, Mycobacterium avium subsp. paratuberculosis
ugacgcucgcgguugggccgc

SEQ ID NO: 785657 - RNA, 14 nt, Mycobacterium avium subsp. paratuberculosis
ugacgcucggccgu

SEQ ID NO: 785658 - RNA, 17 nt, Mycobacterium avium subsp. paratuberculosis
ugacgcucggccguggc

SEQ ID NO: 785659 - RNA, 12 nt, Mycobacterium avium subsp. paratuberculosis
ugacgcucggcg

SEQ ID NO: 785660 - RNA, 19 nt, Mycobacterium avium subsp. paratuberculosis
ugacgcucggcgccgcggg

SEQ ID NO: 785661 - RNA, 17 nt, Mycobacterium avium subsp. paratuberculosis
ugacgcucggcgccggc

SEQ ID NO: 785662 - RNA, 18 nt, Mycobacterium avium subsp. paratuberculosis
ugacgcucggcgccggcc

SEQ ID NO: 785663 - RNA, 19 nt, Mycobacterium avium subsp. paratuberculosis
ugacgcucggcgccggccg

SEQ ID NO: 785664 - RNA, 17 nt, Mycobacterium avium subsp. paratuberculosis
ugacgcucggcgcgucg

SEQ ID NO: 785665 - RNA, 14 nt, Mycobacterium avium subsp. paratuberculosis
ugacgcugccgcgc

SEQ ID NO: 785666 - RNA, 17 nt, Mycobacterium avium subsp. paratuberculosis
ugacgcugccgcgccgc

SEQ ID NO: 785667 - RNA, 14 nt, Mycobacterium avium subsp. paratuberculosis
ugacgcugggcggc

SEQ ID NO: 785668 - RNA, 15 nt, Mycobacterium avium subsp. paratuberculosis
ugacgcugggcggcg

SEQ ID NO: 785669 - RNA, 18 nt, Mycobacterium avium subsp. paratuberculosis
ugacgcugggcggcgaca

SEQ ID NO: 785670 - RNA, 13 nt, Mycobacterium avium subsp. paratuberculosis
ugacggccgcggc

SEQ ID NO: 785671 - RNA, 14 nt, Mycobacterium avium subsp. paratuberculosis
ugacggccgggccc

SEQ ID NO: 785672 - RNA, 23 nt, Mycobacterium avium subsp. paratuberculosis
ugacggcccacgucgcgccgaug

SEQ ID NO: 785673 - RNA, 17 nt, Mycobacterium avium subsp. paratuberculosis
ugacggauguggucggc

SEQ ID NO: 785674 - RNA, 16 nt, Mycobacterium avium subsp. paratuberculosis
ugacgcggcgucgggc

SEQ ID NO: 785675 - RNA, 17 nt, Mycobacterium avium subsp. paratuberculosis
ugacgcggcgucgggcg

SEQ ID NO: 785676 - RNA, 22 nt, Mycobacterium avium subsp. paratuberculosis
ugacgcgcuuguacaggucgac

SEQ ID NO: 785677 - RNA, 12 nt, Mycobacterium avium subsp. paratuberculosis
ugacgcgccggc

SEQ ID NO: 785678 - RNA, 15 nt, Mycobacterium avium subsp. paratuberculosis
ugacgccguccgacg

SEQ ID NO: 785679 - RNA, 17 nt, Mycobacterium avium subsp. paratuberculosis
ugacgccguccgacgug

SEQ ID NO: 785680 - RNA, 22 nt, Mycobacterium avium subsp. paratuberculosis
ugacgcgaagucgccgcccggg

SEQ ID NO: 785681 - RNA, 19 nt, Mycobacterium avium subsp. paratuberculosis
ugacgcgaaugucgaccac

SEQ ID NO: 785682 - RNA, 20 nt, Mycobacterium avium subsp. paratuberculosis
ugacgcgaaugucgaccacc

SEQ ID NO: 785683 - RNA, 22 nt, Mycobacterium avium subsp. paratuberculosis
ugacgcgaaugucgaccaccgg

SEQ ID NO: 785684 - RNA, 13 nt, Mycobacterium avium subsp. paratuberculosis
ugacgcgaccgcg

SEQ ID NO: 785685 - RNA, 16 nt, Mycobacterium avium subsp. paratuberculosis
ugacgcgaccgcgcgg

SEQ ID NO: 785686 - RNA, 14 nt, Mycobacterium avium subsp. paratuberculosis
ugacgccgggccgc

SEQ ID NO: 785687 - RNA, 17 nt, Mycobacterium avium subsp. paratuberculosis
ugacgcccccggugacg

SEQ ID NO: 785688 - RNA, 17 nt, Mycobacterium avium subsp. paratuberculosis
ugacgcccggcgccggc

SEQ ID NO: 785689 - RNA, 19 nt, Mycobacterium avium subsp. paratuberculosis
ugacgcccgucccgccgac

SEQ ID NO: 785690 - RNA, 14 nt, Mycobacterium avium subsp. paratuberculosis
ugacgccgacguag

SEQ ID NO: 785691 - RNA, 21 nt, Mycobacterium avium subsp. paratuberculosis
ugacgccgcacgaauugccgg

SEQ ID NO: 785692 - RNA, 12 nt, Mycobacterium avium subsp. paratuberculosis
ugacgccgcggu

SEQ ID NO: 785693 - RNA, 14 nt, Mycobacterium avium subsp. paratuberculosis
ugacgccgcucggc

SEQ ID NO: 785694 - RNA, 18 nt, Mycobacterium avium subsp. paratuberculosis
ugacgccgcucggccagc

SEQ ID NO: 785695 - RNA, 17 nt, Mycobacterium avium subsp. paratuberculosis
ugacgcaucaccacgcu

SEQ ID NO: 785696 - RNA, 16 nt, Mycobacterium avium subsp. paratuberculosis
ugacgaugcggccggc

SEQ ID NO: 785697 - RNA, 13 nt, Mycobacterium avium subsp. paratuberculosis
ugacgauggugua

SEQ ID NO: 785698 - RNA, 21 nt, Mycobacterium avium subsp. paratuberculosis
ugacgaugucgaugacggcgg

SEQ ID NO: 785699 - RNA, 14 nt, Mycobacterium avium subsp. paratuberculosis
ugacgauggcgacc

SEQ ID NO: 785700 - RNA, 19 nt, Mycobacterium avium subsp. paratuberculosis
ugacgauucuugaccaccu

SEQ ID NO: 785701 - RNA, 17 nt, Mycobacterium avium subsp. paratuberculosis
ugacgauccacagcgcg

SEQ ID NO: 785702 - RNA, 22 nt, Mycobacterium avium subsp. paratuberculosis
ugacgaguuccaccucgggccg

SEQ ID NO: 785703 - RNA, 11 nt, Mycobacterium avium subsp. paratuberculosis
ugacgaugacg

SEQ ID NO: 785704 - RNA, 18 nt, Mycobacterium avium subsp. paratuberculosis
ugacgaucgucgacguca

SEQ ID NO: 785705 - RNA, 20 nt, Mycobacterium avium subsp. paratuberculosis
ugccucuucggcgcgccggc

SEQ ID NO: 785706 - RNA, 13 nt, Mycobacterium avium subsp. paratuberculosis
ugccgucggugcg

SEQ ID NO: 785707 - RNA, 10 nt, Mycobacterium avium subsp. paratuberculosis
ugccugcggg

SEQ ID NO: 785708 - RNA, 15 nt, Mycobacterium avium subsp. paratuberculosis
ugccguaaguggcgc

SEQ ID NO: 785709 - RNA, 17 nt, Mycobacterium avium subsp. paratuberculosis
ugccguaaguggcgccg

SEQ ID NO: 785710 - RNA, 20 nt, Mycobacterium avium subsp. paratuberculosis
ugccgguguucaagccggcg

SEQ ID NO: 785711 - RNA, 19 nt, Mycobacterium avium subsp. paratuberculosis
ugccgguguugccgacggc

SEQ ID NO: 785712 - RNA, 22 nt, Mycobacterium avium subsp. paratuberculosis
ugccguccagcuccgccgacac

SEQ ID NO: 785713 - RNA, 12 nt, Mycobacterium avium subsp. paratuberculosis
ugccgucgacgc

SEQ ID NO: 785714 - RNA, 13 nt, Mycobacterium avium subsp. paratuberculosis
ugccguccggccg

SEQ ID NO: 785715 - RNA, 15 nt, Mycobacterium avium subsp. paratuberculosis
ugccguccggccggu

SEQ ID NO: 785716 - RNA, 23 nt, Mycobacterium avium subsp. paratuberculosis
ugccguccggccgguuggcggcc

SEQ ID NO: 785717 - RNA, 15 nt, Mycobacterium avium subsp. paratuberculosis
ugccguccggguccg

SEQ ID NO: 785718 - RNA, 14 nt, Mycobacterium avium subsp. paratuberculosis
ugccguccgggucg

SEQ ID NO: 785719 - RNA, 20 nt, Mycobacterium avium subsp. paratuberculosis
ugccguccucggccgccacc

SEQ ID NO: 785720 - RNA, 22 nt, Mycobacterium avium subsp. paratuberculosis
ugccgucggcgucgacgacggc

SEQ ID NO: 785721 - RNA, 18 nt, Mycobacterium avium subsp. paratuberculosis
ugccgucgcgcucgacga

SEQ ID NO: 785722 - RNA, 17 nt, Mycobacterium avium subsp. paratuberculosis
ugccgucgaucgcccgc

SEQ ID NO: 785723 - RNA, 18 nt, Mycobacterium avium subsp. paratuberculosis
ugccgucgaucgcccgcu

SEQ ID NO: 785724 - RNA, 20 nt, Mycobacterium avium subsp. paratuberculosis
ugccgucgagcagggugacg

SEQ ID NO: 785725 - RNA, 21 nt, Mycobacterium avium subsp. paratuberculosis
ugccggucuuguagucgacca

SEQ ID NO: 785726 - RNA, 19 nt, Mycobacterium avium subsp. paratuberculosis
ugccggucgaugucggcga

SEQ ID NO: 785727 - RNA, 13 nt, Mycobacterium avium subsp. paratuberculosis
ugccggugucggu

SEQ ID NO: 785728 - RNA, 23 nt, Mycobacterium avium subsp. paratuberculosis
ugccggucgggauggcggcguug

SEQ ID NO: 785729 - RNA, 17 nt, Mycobacterium avium subsp. paratuberculosis
ugccggugccgacgauc

SEQ ID NO: 785730 - RNA, 23 nt, Mycobacterium avium subsp. paratuberculosis
ugccggucaggcauuccaccgcg

SEQ ID NO: 785731 - RNA, 17 nt, Mycobacterium avium subsp. paratuberculosis
ugccgguccagccgccg

SEQ ID NO: 785732 - RNA, 18 nt, Mycobacterium avium subsp. paratuberculosis
ugccgguacggccgacgc

SEQ ID NO: 785733 - RNA, 13 nt, Mycobacterium avium subsp. paratuberculosis
ugccggggcagca

SEQ ID NO: 785734 - RNA, 14 nt, Mycobacterium avium subsp. paratuberculosis
ugccgggccgcauc

SEQ ID NO: 785735 - RNA, 22 nt, Mycobacterium avium subsp. paratuberculosis
ugccgggggaggcguugcgucc

SEQ ID NO: 785736 - RNA, 19 nt, Mycobacterium avium subsp. paratuberculosis
ugccggggugcagcaccac

SEQ ID NO: 785737 - RNA, 21 nt, Mycobacterium avium subsp. paratuberculosis
ugccgggugcugaacgccugc

SEQ ID NO: 785738 - RNA, 19 nt, Mycobacterium avium subsp. paratuberculosis
ugccgggugggcagcccca

SEQ ID NO: 785739 - RNA, 21 nt, Mycobacterium avium subsp. paratuberculosis
ugccgggcggcgacgucgugg

SEQ ID NO: 785740 - RNA, 16 nt, Mycobacterium avium subsp. paratuberculosis
ugccgggcgucgacga

SEQ ID NO: 785741 - RNA, 18 nt, Mycobacterium avium subsp. paratuberculosis
ugccgggcuccgcguucg

SEQ ID NO: 785742 - RNA, 15 nt, Mycobacterium avium subsp. paratuberculosis
ugccgggccagccgg

SEQ ID NO: 785743 - RNA, 21 nt, Mycobacterium avium subsp. paratuberculosis
ugccgggccagcugcucguac

SEQ ID NO: 785744 - RNA, 21 nt, Mycobacterium avium subsp. paratuberculosis
ugccgggcaaccacagcggcg

SEQ ID NO: 785745 - RNA, 23 nt, Mycobacterium avium subsp. paratuberculosis
ugccgggcaaccacagcggcgca

SEQ ID NO: 785746 - RNA, 16 nt, Mycobacterium avium subsp. paratuberculosis
ugccgggcaccagcga

SEQ ID NO: 785747 - RNA, 20 nt, Mycobacterium avium subsp. paratuberculosis
ugccgggcaccagcgacagc

SEQ ID NO: 785748 - RNA, 15 nt, Mycobacterium avium subsp. paratuberculosis
ugccgggcagcggcc

SEQ ID NO: 785749 - RNA, 19 nt, Mycobacterium avium subsp. paratuberculosis
ugccgggcagcggccccac

SEQ ID NO: 785750 - RNA, 19 nt, Mycobacterium avium subsp. paratuberculosis
ugccgggcaggaugccgcg

SEQ ID NO: 785751 - RNA, 14 nt, Mycobacterium avium subsp. paratuberculosis
ugccggcucggcgg

SEQ ID NO: 785752 - RNA, 15 nt, Mycobacterium avium subsp. paratuberculosis
ugccggcucggcggc

SEQ ID NO: 785753 - RNA, 18 nt, Mycobacterium avium subsp. paratuberculosis
ugccggcugaaccugcug

SEQ ID NO: 785754 - RNA, 15 nt, Mycobacterium avium subsp. paratuberculosis
ugccggcuugggcga

SEQ ID NO: 785755 - RNA, 16 nt, Mycobacterium avium subsp. paratuberculosis
ugccgggaagcgaagc

SEQ ID NO: 785756 - RNA, 13 nt, Mycobacterium avium subsp. paratuberculosis
ugccggcggcgcg

SEQ ID NO: 785757 - RNA, 15 nt, Mycobacterium avium subsp. paratuberculosis
ugccggcggcgggcu

SEQ ID NO: 785758 - RNA, 20 nt, Mycobacterium avium subsp. paratuberculosis
ugccggcgguaccgccgauc

SEQ ID NO: 785759 - RNA, 24 nt, Mycobacterium avium subsp. paratuberculosis
ugccggcgguaccgccgaucguga

SEQ ID NO: 785760 - RNA, 12 nt, Mycobacterium avium subsp. paratuberculosis
ugccggcggugu

SEQ ID NO: 785761 - RNA, 21 nt, Mycobacterium avium subsp. paratuberculosis
ugccggcgguguccacgaugc

SEQ ID NO: 785762 - RNA, 14 nt, Mycobacterium avium subsp. paratuberculosis
ugcgagaucggcag

SEQ ID NO: 785763 - RNA, 18 nt, Mycobacterium avium subsp. paratuberculosis
ugcgacuucuacggcggg

SEQ ID NO: 785764 - RNA, 22 nt, Mycobacterium avium subsp. paratuberculosis
ugcgacuucuacggcgggccgg

SEQ ID NO: 785765 - RNA, 18 nt, Mycobacterium avium subsp. paratuberculosis
ugcgacuugcgcgccgug

SEQ ID NO: 785766 - RNA, 19 nt, Mycobacterium avium subsp. paratuberculosis
ugcgacuugcgcgccguga

SEQ ID NO: 785767 - RNA, 12 nt, Mycobacterium avium subsp. paratuberculosis
ugcgaccgccgc

SEQ ID NO: 785768 - RNA, 17 nt, Mycobacterium avium subsp. paratuberculosis
ugcgaccccgccgucga

SEQ ID NO: 785769 - RNA, 11 nt, Mycobacterium avium subsp. paratuberculosis
ugcgacgccgc

SEQ ID NO: 785770 - RNA, 12 nt, Mycobacterium avium subsp. paratuberculosis
ugcgacggcagc

SEQ ID NO: 785771 - RNA, 15 nt, Mycobacterium avium subsp. paratuberculosis
ugcgacggcagcacc

SEQ ID NO: 785772 - RNA, 20 nt, Mycobacterium avium subsp. paratuberculosis
ugccuggcuccccggcgauc

SEQ ID NO: 785773 - RNA, 15 nt, Mycobacterium avium subsp. paratuberculosis
ugccugguucgacgu

SEQ ID NO: 785774 - RNA, 17 nt, Mycobacterium avium subsp. paratuberculosis
ugccuggccacgugguc

SEQ ID NO: 785775 - RNA, 23 nt, Mycobacterium avium subsp. paratuberculosis
ugcgaauccgauugcggcgcagg

SEQ ID NO: 785776 - RNA, 14 nt, Mycobacterium avium subsp. paratuberculosis
ugcgacaccgcguc

SEQ ID NO: 785777 - RNA, 16 nt, Mycobacterium avium subsp. paratuberculosis
ugcgacaccgcguccu

SEQ ID NO: 785778 - RNA, 15 nt, Mycobacterium avium subsp. paratuberculosis
ugcgacagaaaucgc

SEQ ID NO: 785779 - RNA, 16 nt, Mycobacterium avium subsp. paratuberculosis
ugcgacaggucggcgg

SEQ ID NO: 785780 - RNA, 19 nt, Mycobacterium avium subsp. paratuberculosis
ugcgacaggucggcggucg

SEQ ID NO: 785781 - RNA, 20 nt, Mycobacterium avium subsp. paratuberculosis
ugcgauugguggcccggucg

SEQ ID NO: 785782 - RNA, 18 nt, Mycobacterium avium subsp. paratuberculosis
ugcgcaacaccucggcga

SEQ ID NO: 785783 - RNA, 19 nt, Mycobacterium avium subsp. paratuberculosis
ugcgcaacaccucggcgac

SEQ ID NO: 785784 - RNA, 20 nt, Mycobacterium avium subsp. paratuberculosis
ugcgcaacaccucggcgacg

SEQ ID NO: 785785 - RNA, 21 nt, Mycobacterium avium subsp. paratuberculosis
ugcgcaacagcauuucgcgcg

SEQ ID NO: 785786 - RNA, 13 nt, Mycobacterium avium subsp. paratuberculosis
ugcgaucgccgac

SEQ ID NO: 785787 - RNA, 18 nt, Mycobacterium avium subsp. paratuberculosis
ugcgaucgccgacgccag

SEQ ID NO: 785788 - RNA, 19 nt, Mycobacterium avium subsp. paratuberculosis
ugcgaucgccgacgccagc

SEQ ID NO: 785789 - RNA, 17 nt, Mycobacterium avium subsp. paratuberculosis
ugcgagcaggccgaggc

SEQ ID NO: 785790 - RNA, 19 nt, Mycobacterium avium subsp. paratuberculosis
ugcgaugagcucgcgcugc

SEQ ID NO: 785791 - RNA, 19 nt, Mycobacterium avium subsp. paratuberculosis
ugcgcaggcggcgcgcagc

SEQ ID NO: 785792 - RNA, 23 nt, Mycobacterium avium subsp. paratuberculosis
ugcgcaggcggcgcgcagccggc

SEQ ID NO: 785793 - RNA, 18 nt, Mycobacterium avium subsp. paratuberculosis
ugcgcaucagcgccacca

SEQ ID NO: 785794 - RNA, 16 nt, Mycobacterium avium subsp. paratuberculosis
ugcgccagcgaccgca

SEQ ID NO: 785795 - RNA, 17 nt, Mycobacterium avium subsp. paratuberculosis
ugcgccagcgaccgcag

SEQ ID NO: 785796 - RNA, 13 nt, Mycobacterium avium subsp. paratuberculosis
ugcgccagcgacg

SEQ ID NO: 785797 - RNA, 17 nt, Mycobacterium avium subsp. paratuberculosis
ugcgccagcgacggccg

SEQ ID NO: 785798 - RNA, 20 nt, Mycobacterium avium subsp. paratuberculosis
ugcggacggucgccgacgua

SEQ ID NO: 785799 - RNA, 13 nt, Mycobacterium avium subsp. paratuberculosis
ugcgcucggcgac

SEQ ID NO: 785800 - RNA, 14 nt, Mycobacterium avium subsp. paratuberculosis
ugcgcucgccgauc

SEQ ID NO: 785801 - RNA, 16 nt, Mycobacterium avium subsp. paratuberculosis
ugcgcucgaccucggc

SEQ ID NO: 785802 - RNA, 15 nt, Mycobacterium avium subsp. paratuberculosis
ugcgcguugcgcgga

SEQ ID NO: 785803 - RNA, 13 nt, Mycobacterium avium subsp. paratuberculosis
ugcgcgucgcggc

SEQ ID NO: 785804 - RNA, 18 nt, Mycobacterium avium subsp. paratuberculosis
ugcgcgucgcggcgcgga

SEQ ID NO: 785805 - RNA, 17 nt, Mycobacterium avium subsp. paratuberculosis
ugcgcguggggcgucgc

SEQ ID NO: 785806 - RNA, 20 nt, Mycobacterium avium subsp. paratuberculosis
ugcgcguggggcgucgccgc

SEQ ID NO: 785807 - RNA, 12 nt, Mycobacterium avium subsp. paratuberculosis
ugcggcaacccg

SEQ ID NO: 785808 - RNA, 21 nt, Mycobacterium avium subsp. paratuberculosis
ugcggcacaggcgaaucggcg

SEQ ID NO: 785809 - RNA, 15 nt, Mycobacterium avium subsp. paratuberculosis
ugcggcacggcgagg

SEQ ID NO: 785810 - RNA, 18 nt, Mycobacterium avium subsp. paratuberculosis
ugcggcacggugcgggug

SEQ ID NO: 785811 - RNA, 12 nt, Mycobacterium avium subsp. paratuberculosis
ugcggcacgccg

SEQ ID NO: 785812 - RNA, 14 nt, Mycobacterium avium subsp. paratuberculosis
ugcggcacgccgac

SEQ ID NO: 785813 - RNA, 12 nt, Mycobacterium avium subsp. paratuberculosis
ugcggcaccucg

SEQ ID NO: 785814 - RNA, 22 nt, Mycobacterium avium subsp. paratuberculosis
ugcggcaccucggccuugacca

SEQ ID NO: 785815 - RNA, 16 nt, Mycobacterium avium subsp. paratuberculosis
ugcggcaccagcccgc

SEQ ID NO: 785816 - RNA, 20 nt, Mycobacterium avium subsp. paratuberculosis
ugcggcaccagcccgccguc

SEQ ID NO: 785817 - RNA, 15 nt, Mycobacterium avium subsp. paratuberculosis
ugcggaugcugacca

SEQ ID NO: 785818 - RNA, 14 nt, Mycobacterium avium subsp. paratuberculosis
ugcggaucgaacgg

SEQ ID NO: 785819 - RNA, 20 nt, Mycobacterium avium subsp. paratuberculosis
ugcggaucgggcguggcguc

SEQ ID NO: 785820 - RNA, 21 nt, Mycobacterium avium subsp. paratuberculosis
ugcggaucgggcguggcgucg

SEQ ID NO: 785821 - RNA, 17 nt, Mycobacterium avium subsp. paratuberculosis
ugcggaucucgaccucg

SEQ ID NO: 785822 - RNA, 20 nt, Mycobacterium avium subsp. paratuberculosis
ugcggaucucggugccggug

SEQ ID NO: 785823 - RNA, 18 nt, Mycobacterium avium subsp. paratuberculosis
ugcggcagaccgguggcg

SEQ ID NO: 785824 - RNA, 19 nt, Mycobacterium avium subsp. paratuberculosis
ugcggcagaccgguggcga

SEQ ID NO: 785825 - RNA, 14 nt, Mycobacterium avium subsp. paratuberculosis
ugcggcagcacacc

SEQ ID NO: 785826 - RNA, 15 nt, Mycobacterium avium subsp. paratuberculosis
ugcggcagcucggcg

SEQ ID NO: 785827 - RNA, 16 nt, Mycobacterium avium subsp. paratuberculosis
ugcggcagcucggcgg

SEQ ID NO: 785828 - RNA, 19 nt, Mycobacterium avium subsp. paratuberculosis
ugcggcaggucggccagcg

SEQ ID NO: 785829 - RNA, 23 nt, Mycobacterium avium subsp. paratuberculosis
ugcggcaggucggccagcgccgc

SEQ ID NO: 785830 - RNA, 19 nt, Mycobacterium avium subsp. paratuberculosis
ugcggccagugccgggcca

SEQ ID NO: 785831 - RNA, 17 nt, Mycobacterium avium subsp. paratuberculosis
ugcggccagcgcaggua

SEQ ID NO: 785832 - RNA, 18 nt, Mycobacterium avium subsp. paratuberculosis
ugcggccagcgcagguac

SEQ ID NO: 785833 - RNA, 13 nt, Mycobacterium avium subsp. paratuberculosis
ugcggcccacccg

SEQ ID NO: 785834 - RNA, 13 nt, Mycobacterium avium subsp. paratuberculosis
ugcggcccagccc

SEQ ID NO: 785835 - RNA, 19 nt, Mycobacterium avium subsp. paratuberculosis
ugcggcccagcccggccag

SEQ ID NO: 785836 - RNA, 23 nt, Mycobacterium avium subsp. paratuberculosis
ugcggcccagcccggccagcacc

SEQ ID NO: 785837 - RNA, 13 nt, Mycobacterium avium subsp. paratuberculosis
ugcggcggcggcg

SEQ ID NO: 785838 - RNA, 19 nt, Mycobacterium avium subsp. paratuberculosis
ugcggcucgucggcgaaca

SEQ ID NO: 785839 - RNA, 14 nt, Mycobacterium avium subsp. paratuberculosis
ugcggccccgccag

SEQ ID NO: 785840 - RNA, 17 nt, Mycobacterium avium subsp. paratuberculosis
ugcggcgggcucggacg

SEQ ID NO: 785841 - RNA, 11 nt, Mycobacterium avium subsp. paratuberculosis
ugcggcggugu

SEQ ID NO: 785842 - RNA, 13 nt, Mycobacterium avium subsp. paratuberculosis
ugcggcgguguuc

SEQ ID NO: 785843 - RNA, 16 nt, Mycobacterium avium subsp. paratuberculosis
ugcggccccugcgggg

SEQ ID NO: 785844 - RNA, 15 nt, Mycobacterium avium subsp. paratuberculosis
ugcggcggcagucgc

SEQ ID NO: 785845 - RNA, 18 nt, Mycobacterium avium subsp. paratuberculosis
ugcggcggcagucgcagc

SEQ ID NO: 785846 - RNA, 21 nt, Mycobacterium avium subsp. paratuberculosis
ugcggccauguccccgccggu

SEQ ID NO: 785847 - RNA, 18 nt, Mycobacterium avium subsp. paratuberculosis
ugcgcgucgagcagcacc

SEQ ID NO: 785848 - RNA, 19 nt, Mycobacterium avium subsp. paratuberculosis
ugcgcgggguggcgccggc

SEQ ID NO: 785849 - RNA, 22 nt, Mycobacterium avium subsp. paratuberculosis
ugcgcgggguggcgccggccag

SEQ ID NO: 785850 - RNA, 15 nt, Mycobacterium avium subsp. paratuberculosis
ugcgcgggucgccgg

SEQ ID NO: 785851 - RNA, 18 nt, Mycobacterium avium subsp. paratuberculosis
ugcgcgguaacagagcgg

SEQ ID NO: 785852 - RNA, 17 nt, Mycobacterium avium subsp. paratuberculosis
ugcgcggucagcgcguc

SEQ ID NO: 785853 - RNA, 19 nt, Mycobacterium avium subsp. paratuberculosis
ugcgcggucagcgcgucca

SEQ ID NO: 785854 - RNA, 21 nt, Mycobacterium avium subsp. paratuberculosis
ugcgcgcuggugcugccgaac

SEQ ID NO: 785855 - RNA, 16 nt, Mycobacterium avium subsp. paratuberculosis
ugcgcggcacgggccg

SEQ ID NO: 785856 - RNA, 15 nt, Mycobacterium avium subsp. paratuberculosis
ugcgcgcggugcacg

SEQ ID NO: 785857 - RNA, 18 nt, Mycobacterium avium subsp. paratuberculosis
ugcgcgcggugcacgguc

SEQ ID NO: 785858 - RNA, 22 nt, Mycobacterium avium subsp. paratuberculosis
ugcgcgcguuguccagcagcgc

SEQ ID NO: 785859 - RNA, 19 nt, Mycobacterium avium subsp. paratuberculosis
ugcgcgcgcgaucgguguc

SEQ ID NO: 785860 - RNA, 18 nt, Mycobacterium avium subsp. paratuberculosis
ugcgcgcgcgcucggcgu

SEQ ID NO: 785861 - RNA, 14 nt, Mycobacterium avium subsp. paratuberculosis
ugcgcgaacagcga

SEQ ID NO: 785862 - RNA, 18 nt, Mycobacterium avium subsp. paratuberculosis
ugcgcgccuccgacgacg

SEQ ID NO: 785863 - RNA, 22 nt, Mycobacterium avium subsp. paratuberculosis
ugcgcgcgcaucaccgagguca

SEQ ID NO: 785864 - RNA, 18 nt, Mycobacterium avium subsp. paratuberculosis
ugcgccugcacggugccg

SEQ ID NO: 785865 - RNA, 22 nt, Mycobacterium avium subsp. paratuberculosis
ugcgccgugcagcacgccgcgg

SEQ ID NO: 785866 - RNA, 16 nt, Mycobacterium avium subsp. paratuberculosis
ugcgccgguagcgaca

SEQ ID NO: 785867 - RNA, 23 nt, Mycobacterium avium subsp. paratuberculosis
ugcgccguugauugcgcccgccg

SEQ ID NO: 785868 - RNA, 13 nt, Mycobacterium avium subsp. paratuberculosis
ugcgccucgauca

SEQ ID NO: 785869 - RNA, 21 nt, Mycobacterium avium subsp. paratuberculosis
ugcgccucgaucugguucacc

SEQ ID NO: 785870 - RNA, 17 nt, Mycobacterium avium subsp. paratuberculosis
ugcgccgcaacggcgca

SEQ ID NO: 785871 - RNA, 12 nt, Mycobacterium avium subsp. paratuberculosis
ugcgccgcacca

SEQ ID NO: 785872 - RNA, 18 nt, Mycobacterium avium subsp. paratuberculosis
ugcgccgaggucaccgcg

SEQ ID NO: 785873 - RNA, 19 nt, Mycobacterium avium subsp. paratuberculosis
ugcgccgcagcggugaucg

SEQ ID NO: 785874 - RNA, 13 nt, Mycobacterium avium subsp. paratuberculosis
ugcgccgccgcgu

SEQ ID NO: 785875 - RNA, 21 nt, Mycobacterium avium subsp. paratuberculosis
ugcgccgcauuggugccggcc

SEQ ID NO: 785876 - RNA, 14 nt, Mycobacterium avium subsp. paratuberculosis
ugcgccagcgccgg

SEQ ID NO: 785877 - RNA, 17 nt, Mycobacterium avium subsp. paratuberculosis
ugcgccagcuccagcag

SEQ ID NO: 785878 - RNA, 21 nt, Mycobacterium avium subsp. paratuberculosis
ugcgccagcuccagcagcccg

SEQ ID NO: 785879 - RNA, 18 nt, Mycobacterium avium subsp. paratuberculosis
ugcgccaguugcucgggu

SEQ ID NO: 785880 - RNA, 21 nt, Mycobacterium avium subsp. paratuberculosis
ugcgccaguuugccgucggga

SEQ ID NO: 785881 - RNA, 22 nt, Mycobacterium avium subsp. paratuberculosis
ugcgccaguuugccgucgggac

SEQ ID NO: 785882 - RNA, 22 nt, Mycobacterium avium subsp. paratuberculosis
ugcgccagugggggaauggcgg

SEQ ID NO: 785883 - RNA, 13 nt, Mycobacterium avium subsp. paratuberculosis
ugcgccgggucca

SEQ ID NO: 785884 - RNA, 20 nt, Mycobacterium avium subsp. paratuberculosis
ugcgccggguccagccgcgg

SEQ ID NO: 785885 - RNA, 13 nt, Mycobacterium avium subsp. paratuberculosis
ugcgccggggccg

SEQ ID NO: 785886 - RNA, 16 nt, Mycobacterium avium subsp. paratuberculosis
ugcgccgucaccggcu

SEQ ID NO: 785887 - RNA, 15 nt, Mycobacterium avium subsp. paratuberculosis
ugcgccgucacguca

SEQ ID NO: 785888 - RNA, 22 nt, Mycobacterium avium subsp. paratuberculosis
ugcgccgucccggacgcugcgg

SEQ ID NO: 785889 - RNA, 16 nt, Mycobacterium avium subsp. paratuberculosis
ugcgccguccggccac

SEQ ID NO: 785890 - RNA, 22 nt, Mycobacterium avium subsp. paratuberculosis
ugcgccguccggccacgaccuc

SEQ ID NO: 785891 - RNA, 17 nt, Mycobacterium avium subsp. paratuberculosis
ugcgccggcuccaccgc

SEQ ID NO: 785892 - RNA, 21 nt, Mycobacterium avium subsp. paratuberculosis
ugcgccggcuccaccgcgccg

SEQ ID NO: 785893 - RNA, 20 nt, Mycobacterium avium subsp. paratuberculosis
ugcgccggcgguaugcccgg

SEQ ID NO: 785894 - RNA, 14 nt, Mycobacterium avium subsp. paratuberculosis
ugcgccggcggugc

SEQ ID NO: 785895 - RNA, 16 nt, Mycobacterium avium subsp. paratuberculosis
ugcgccggcggugucg

SEQ ID NO: 785896 - RNA, 20 nt, Mycobacterium avium subsp. paratuberculosis
ugcgccggcggugucgagau

SEQ ID NO: 785897 - RNA, 19 nt, Mycobacterium avium subsp. paratuberculosis
ugcgccggcgcggccagcu

SEQ ID NO: 785898 - RNA, 12 nt, Mycobacterium avium subsp. paratuberculosis
ugcgccggcggc

SEQ ID NO: 785899 - RNA, 15 nt, Mycobacterium avium subsp. paratuberculosis
ugcgccgcucgucgg

SEQ ID NO: 785900 - RNA, 14 nt, Mycobacterium avium subsp. paratuberculosis
ugcgccggauucgg

SEQ ID NO: 785901 - RNA, 19 nt, Mycobacterium avium subsp. paratuberculosis
ugcgccggcaacuggccgc

SEQ ID NO: 785902 - RNA, 16 nt, Mycobacterium avium subsp. paratuberculosis
ugcgccgcgucgacgc

SEQ ID NO: 785903 - RNA, 12 nt, Mycobacterium avium subsp. paratuberculosis
ugcgccgccgua

SEQ ID NO: 785904 - RNA, 17 nt, Mycobacterium avium subsp. paratuberculosis
ugcgccgcggaugugga

SEQ ID NO: 785905 - RNA, 18 nt, Mycobacterium avium subsp. paratuberculosis
ugcauccgcagcaccagg

SEQ ID NO: 785906 - RNA, 13 nt, Mycobacterium avium subsp. paratuberculosis
ugcauccggaacc

SEQ ID NO: 785907 - RNA, 14 nt, Mycobacterium avium subsp. paratuberculosis
ugcaucgaugccgg

SEQ ID NO: 785908 - RNA, 18 nt, Mycobacterium avium subsp. paratuberculosis
ugcaucgcgaucgacagc

SEQ ID NO: 785909 - RNA, 22 nt, Mycobacterium avium subsp. paratuberculosis
ugcaucgcgaucgacagcucca

SEQ ID NO: 785910 - RNA, 16 nt, Mycobacterium avium subsp. paratuberculosis
ugcaugccgggcagga

SEQ ID NO: 785911 - RNA, 13 nt, Mycobacterium avium subsp. paratuberculosis
ugccaccgccgau

SEQ ID NO: 785912 - RNA, 19 nt, Mycobacterium avium subsp. paratuberculosis
ugccaccgccgauggcgac

SEQ ID NO: 785913 - RNA, 13 nt, Mycobacterium avium subsp. paratuberculosis
ugccacgcccacc

SEQ ID NO: 785914 - RNA, 22 nt, Mycobacterium avium subsp. paratuberculosis
ugccacgcccaccgguggccgg

SEQ ID NO: 785915 - RNA, 16 nt, Mycobacterium avium subsp. paratuberculosis
ugccacgccgauggcc

SEQ ID NO: 785916 - RNA, 21 nt, Mycobacterium avium subsp. paratuberculosis
ugccaccgcugggcggcgcgg

SEQ ID NO: 785917 - RNA, 22 nt, Mycobacterium avium subsp. paratuberculosis
ugccaccgcugggcggcgcggc

SEQ ID NO: 785918 - RNA, 14 nt, Mycobacterium avium subsp. paratuberculosis
ugcaggugcggcac

SEQ ID NO: 785919 - RNA, 20 nt, Mycobacterium avium subsp. paratuberculosis
ugcaguagacguugccgauc

SEQ ID NO: 785920 - RNA, 14 nt, Mycobacterium avium subsp. paratuberculosis
ugcacgccgagcag

SEQ ID NO: 785921 - RNA, 16 nt, Mycobacterium avium subsp. paratuberculosis
ugcacgccgagcagca

SEQ ID NO: 785922 - RNA, 16 nt, Mycobacterium avium subsp. paratuberculosis
ugcacgaugccgacca

SEQ ID NO: 785923 - RNA, 17 nt, Mycobacterium avium subsp. paratuberculosis
ugcacgaugccgaccaa

SEQ ID NO: 785924 - RNA, 15 nt, Mycobacterium avium subsp. paratuberculosis
ugcacgaucgcggug

SEQ ID NO: 785925 - RNA, 16 nt, Mycobacterium avium subsp. paratuberculosis
ugcacgaucgcgguga

SEQ ID NO: 785926 - RNA, 18 nt, Mycobacterium avium subsp. paratuberculosis
ugcacgaucgcggugacg

SEQ ID NO: 785927 - RNA, 20 nt, Mycobacterium avium subsp. paratuberculosis
ugcaccugugaggcaccgaa

SEQ ID NO: 785928 - RNA, 15 nt, Mycobacterium avium subsp. paratuberculosis
ugcaccugcagccgg

SEQ ID NO: 785929 - RNA, 20 nt, Mycobacterium avium subsp. paratuberculosis
ugcacgacgaacaccaccgg

SEQ ID NO: 785930 - RNA, 22 nt, Mycobacterium avium subsp. paratuberculosis
ugcacgacgaacaccaccggca

SEQ ID NO: 785931 - RNA, 22 nt, Mycobacterium avium subsp. paratuberculosis
ugcaccggguacaccggcucgc

SEQ ID NO: 785932 - RNA, 16 nt, Mycobacterium avium subsp. paratuberculosis
ugcaccggcaccgcgg

SEQ ID NO: 785933 - RNA, 18 nt, Mycobacterium avium subsp. paratuberculosis
ugcaccggcaccgcgguc

SEQ ID NO: 785934 - RNA, 23 nt, Mycobacterium avium subsp. paratuberculosis
ugcaccggcacgucgagcuccuc

SEQ ID NO: 785935 - RNA, 14 nt, Mycobacterium avium subsp. paratuberculosis
ugcaccgucgccgg

SEQ ID NO: 785936 - RNA, 17 nt, Mycobacterium avium subsp. paratuberculosis
ugcaccgucgccggcgg

SEQ ID NO: 785937 - RNA, 14 nt, Mycobacterium avium subsp. paratuberculosis
ugcaccguggugac

SEQ ID NO: 785938 - RNA, 21 nt, Mycobacterium avium subsp. paratuberculosis
ugcaccucgcccugcagccgg

SEQ ID NO: 785939 - RNA, 16 nt, Mycobacterium avium subsp. paratuberculosis
ugcccaggcccaccag

SEQ ID NO: 785940 - RNA, 18 nt, Mycobacterium avium subsp. paratuberculosis
ugcccaggccggcgagcu

SEQ ID NO: 785941 - RNA, 22 nt, Mycobacterium avium subsp. paratuberculosis
ugcccaggaaguagccggccag

SEQ ID NO: 785942 - RNA, 20 nt, Mycobacterium avium subsp. paratuberculosis
ugcccaggaucaccgggacg

SEQ ID NO: 785943 - RNA, 21 nt, Mycobacterium avium subsp. paratuberculosis
ugcccagcgcgaggucgacgg

SEQ ID NO: 785944 - RNA, 12 nt, Mycobacterium avium subsp. paratuberculosis
ugcccagcgcgc

SEQ ID NO: 785945 - RNA, 13 nt, Mycobacterium avium subsp. paratuberculosis
ugcccagcgcggu

SEQ ID NO: 785946 - RNA, 14 nt, Mycobacterium avium subsp. paratuberculosis
ugcccagcgcgguc

SEQ ID NO: 785947 - RNA, 20 nt, Mycobacterium avium subsp. paratuberculosis
ugccccacacgaugcgcggu

SEQ ID NO: 785948 - RNA, 14 nt, Mycobacterium avium subsp. paratuberculosis
ugccccacgccaug

SEQ ID NO: 785949 - RNA, 19 nt, Mycobacterium avium subsp. paratuberculosis
ugccccacacgcucggcgc

SEQ ID NO: 785950 - RNA, 13 nt, Mycobacterium avium subsp. paratuberculosis
ugccccaccccgg

SEQ ID NO: 785951 - RNA, 18 nt, Mycobacterium avium subsp. paratuberculosis
ugccccagcugucgggug

SEQ ID NO: 785952 - RNA, 21 nt, Mycobacterium avium subsp. paratuberculosis
ugccccccuugagccgguccg

SEQ ID NO: 785953 - RNA, 16 nt, Mycobacterium avium subsp. paratuberculosis
ugcccccgcccggccg

SEQ ID NO: 785954 - RNA, 23 nt, Mycobacterium avium subsp. paratuberculosis
ugccccaggucggggugggcgac

SEQ ID NO: 785955 - RNA, 18 nt, Mycobacterium avium subsp. paratuberculosis
ugccccaggugacgccgc

SEQ ID NO: 785956 - RNA, 17 nt, Mycobacterium avium subsp. paratuberculosis
ugcccgaauugcgcugc

SEQ ID NO: 785957 - RNA, 21 nt, Mycobacterium avium subsp. paratuberculosis
ugcccgacaccgccccgccgc

SEQ ID NO: 785958 - RNA, 19 nt, Mycobacterium avium subsp. paratuberculosis
ugcccgaagcugagguggc

SEQ ID NO: 785959 - RNA, 13 nt, Mycobacterium avium subsp. paratuberculosis
ugccccguccggc

SEQ ID NO: 785960 - RNA, 13 nt, Mycobacterium avium subsp. paratuberculosis
ugccccgcgaccg

SEQ ID NO: 785961 - RNA, 18 nt, Mycobacterium avium subsp. paratuberculosis
ugcccaacagcucgcggg

SEQ ID NO: 785962 - RNA, 13 nt, Mycobacterium avium subsp. paratuberculosis
ugcccaccagcau

SEQ ID NO: 785963 - RNA, 15 nt, Mycobacterium avium subsp. paratuberculosis
ugcccaauucgacug

SEQ ID NO: 785964 - RNA, 19 nt, Mycobacterium avium subsp. paratuberculosis
ugcccaaugaucugggccg

SEQ ID NO: 785965 - RNA, 22 nt, Mycobacterium avium subsp. paratuberculosis
ugcccaaugaucugggccgcca

SEQ ID NO: 785966 - RNA, 20 nt, Mycobacterium avium subsp. paratuberculosis
ugcccacccgcucggcgauc

SEQ ID NO: 785967 - RNA, 22 nt, Mycobacterium avium subsp. paratuberculosis
ugcccaccaucccgccgccgaa

SEQ ID NO: 785968 - RNA, 17 nt, Mycobacterium avium subsp. paratuberculosis
ugcccagcaccgccggc

SEQ ID NO: 785969 - RNA, 12 nt, Mycobacterium avium subsp. paratuberculosis
ugcccagcagcg

SEQ ID NO: 785970 - RNA, 21 nt, Mycobacterium avium subsp. paratuberculosis
ugcccagcagcggggcgagcu

SEQ ID NO: 785971 - RNA, 16 nt, Mycobacterium avium subsp. paratuberculosis
ugcccagauacgccgc

SEQ ID NO: 785972 - RNA, 13 nt, Mycobacterium avium subsp. paratuberculosis
ugcccacgccguc

SEQ ID NO: 785973 - RNA, 16 nt, Mycobacterium avium subsp. paratuberculosis
ugccagccgugcggcg

SEQ ID NO: 785974 - RNA, 18 nt, Mycobacterium avium subsp. paratuberculosis
ugccagccgugcggcggc

SEQ ID NO: 785975 - RNA, 20 nt, Mycobacterium avium subsp. paratuberculosis
ugccagcagguccgccggug

SEQ ID NO: 785976 - RNA, 13 nt, Mycobacterium avium subsp. paratuberculosis
ugccagcggcgca

SEQ ID NO: 785977 - RNA, 18 nt, Mycobacterium avium subsp. paratuberculosis
ugccagcgcaccgggccc

SEQ ID NO: 785978 - RNA, 12 nt, Mycobacterium avium subsp. paratuberculosis
ugccgccgaccg

SEQ ID NO: 785979 - RNA, 15 nt, Mycobacterium avium subsp. paratuberculosis
ugccgccgaccgccg

SEQ ID NO: 785980 - RNA, 15 nt, Mycobacterium avium subsp. paratuberculosis
ugccgccggcgcauc

SEQ ID NO: 785981 - RNA, 14 nt, Mycobacterium avium subsp. paratuberculosis
ugccgccggcgcgg

SEQ ID NO: 785982 - RNA, 14 nt, Mycobacterium avium subsp. paratuberculosis
ugccgaugucggcg

SEQ ID NO: 785983 - RNA, 20 nt, Mycobacterium avium subsp. paratuberculosis
ugccgcccuugcucgcggcg

SEQ ID NO: 785984 - RNA, 23 nt, Mycobacterium avium subsp. paratuberculosis
ugccgcccuugcucgcggcguag

SEQ ID NO: 785985 - RNA, 13 nt, Mycobacterium avium subsp. paratuberculosis
ugccgcccucggc

SEQ ID NO: 785986 - RNA, 14 nt, Mycobacterium avium subsp. paratuberculosis
ugccgcccgggccg

SEQ ID NO: 785987 - RNA, 18 nt, Mycobacterium avium subsp. paratuberculosis
ugccgcccaucaccccga

SEQ ID NO: 785988 - RNA, 13 nt, Mycobacterium avium subsp. paratuberculosis
ugccgcagcggcg

SEQ ID NO: 785989 - RNA, 15 nt, Mycobacterium avium subsp. paratuberculosis
ugccgcagcggcggc

SEQ ID NO: 785990 - RNA, 14 nt, Mycobacterium avium subsp. paratuberculosis
ugccgcagccgucc

SEQ ID NO: 785991 - RNA, 11 nt, Mycobacterium avium subsp. paratuberculosis
ugccgaucacc

SEQ ID NO: 785992 - RNA, 22 nt, Mycobacterium avium subsp. paratuberculosis
ugccgacggugucguagacgac

SEQ ID NO: 785993 - RNA, 21 nt, Mycobacterium avium subsp. paratuberculosis
ugccgagcccgccggcggcga

SEQ ID NO: 785994 - RNA, 19 nt, Mycobacterium avium subsp. paratuberculosis
ugccgagcccuuugcgcug

SEQ ID NO: 785995 - RNA, 17 nt, Mycobacterium avium subsp. paratuberculosis
ugccgagguagucggcc

SEQ ID NO: 785996 - RNA, 16 nt, Mycobacterium avium subsp. paratuberculosis
ugccgcacaccgcgca

SEQ ID NO: 785997 - RNA, 18 nt, Mycobacterium avium subsp. paratuberculosis
ugccgcacaccgcgcaga

SEQ ID NO: 785998 - RNA, 22 nt, Mycobacterium avium subsp. paratuberculosis
ugccgcacaccgucucccacga

SEQ ID NO: 785999 - RNA, 16 nt, Mycobacterium avium subsp. paratuberculosis
ugccgcaccagcaccc

SEQ ID NO: 786000 - RNA, 15 nt, Mycobacterium avium subsp. paratuberculosis
ugccgacggcgccgg

SEQ ID NO: 786001 - RNA, 21 nt, Mycobacterium avium subsp. paratuberculosis
ugccgacgugaugcacccgga

SEQ ID NO: 786002 - RNA, 20 nt, Mycobacterium avium subsp. paratuberculosis
ugccgacgaugucggcuucg

SEQ ID NO: 786003 - RNA, 21 nt, Mycobacterium avium subsp. paratuberculosis
ugccgacgaugagggccagca

SEQ ID NO: 786004 - RNA, 22 nt, Mycobacterium avium subsp. paratuberculosis
ugccgagccgcuugguggcgcc

SEQ ID NO: 786005 - RNA, 15 nt, Mycobacterium avium subsp. paratuberculosis
ugccgagccggccga

SEQ ID NO: 786006 - RNA, 17 nt, Mycobacterium avium subsp. paratuberculosis
ugccgagcagcaccgcg

SEQ ID NO: 786007 - RNA, 21 nt, Mycobacterium avium subsp. paratuberculosis
ugccgagcagcaccgcgaccc

SEQ ID NO: 786008 - RNA, 21 nt, Mycobacterium avium subsp. paratuberculosis
ugccgagcaucagcugccguc

SEQ ID NO: 786009 - RNA, 17 nt, Mycobacterium avium subsp. paratuberculosis
ugccgagcacgcggccg

SEQ ID NO: 786010 - RNA, 15 nt, Mycobacterium avium subsp. paratuberculosis
ugccgagcaccccgu

SEQ ID NO: 786011 - RNA, 22 nt, Mycobacterium avium subsp. paratuberculosis
ugccgagcaccucgucgccguc

SEQ ID NO: 786012 - RNA, 23 nt, Mycobacterium avium subsp. paratuberculosis
ugccgagcaccucgucgccgucg

SEQ ID NO: 786013 - RNA, 18 nt, Mycobacterium avium subsp. paratuberculosis
ugccgaggauuucgcgau

SEQ ID NO: 786014 - RNA, 19 nt, Mycobacterium avium subsp. paratuberculosis
ugccgaggauuucgcgauc

SEQ ID NO: 786015 - RNA, 22 nt, Mycobacterium avium subsp. paratuberculosis
ugccgaggcaguuccaugucga

SEQ ID NO: 786016 - RNA, 16 nt, Mycobacterium avium subsp. paratuberculosis
ugcccgggccgcagcu

SEQ ID NO: 786017 - RNA, 22 nt, Mycobacterium avium subsp. paratuberculosis
ugcccgggccgucaucgccgac

SEQ ID NO: 786018 - RNA, 15 nt, Mycobacterium avium subsp. paratuberculosis
ugcccgggccguccg

SEQ ID NO: 786019 - RNA, 17 nt, Mycobacterium avium subsp. paratuberculosis
ugcccgggccguccggg

SEQ ID NO: 786020 - RNA, 20 nt, Mycobacterium avium subsp. paratuberculosis
ugccgaccucgauggcgacg

SEQ ID NO: 786021 - RNA, 16 nt, Mycobacterium avium subsp. paratuberculosis
ugccgaccugggcggc

SEQ ID NO: 786022 - RNA, 14 nt, Mycobacterium avium subsp. paratuberculosis
ugccgacgaccucg

SEQ ID NO: 786023 - RNA, 14 nt, Mycobacterium avium subsp. paratuberculosis
ugccgacgacgucg

SEQ ID NO: 786024 - RNA, 16 nt, Mycobacterium avium subsp. paratuberculosis
ugcccggcucggugcg

SEQ ID NO: 786025 - RNA, 12 nt, Mycobacterium avium subsp. paratuberculosis
ugcccggcgcac

SEQ ID NO: 786026 - RNA, 15 nt, Mycobacterium avium subsp. paratuberculosis
ugcccggcgccgguc

SEQ ID NO: 786027 - RNA, 23 nt, Mycobacterium avium subsp. paratuberculosis
ugcccggcgcggacagcgcggug

SEQ ID NO: 786028 - RNA, 23 nt, Mycobacterium avium subsp. paratuberculosis
ugcccggcgagcgacgccacggg

SEQ ID NO: 786029 - RNA, 14 nt, Mycobacterium avium subsp. paratuberculosis
ugcccggcgacggc

SEQ ID NO: 786030 - RNA, 16 nt, Mycobacterium avium subsp. paratuberculosis
ugcccggcgacggcgc

SEQ ID NO: 786031 - RNA, 22 nt, Mycobacterium avium subsp. paratuberculosis
ugcccggcgacggcgccugauc

SEQ ID NO: 786032 - RNA, 13 nt, Mycobacterium avium subsp. paratuberculosis
ugcccggcccgcc

SEQ ID NO: 786033 - RNA, 15 nt, Mycobacterium avium subsp. paratuberculosis
ugcccggcccgccgc

SEQ ID NO: 786034 - RNA, 18 nt, Mycobacterium avium subsp. paratuberculosis
ugcccggaguccggcucg

SEQ ID NO: 786035 - RNA, 20 nt, Mycobacterium avium subsp. paratuberculosis
ugcccggagaaaccgucggc

SEQ ID NO: 786036 - RNA, 15 nt, Mycobacterium avium subsp. paratuberculosis
ugcccgaccgcgccg

SEQ ID NO: 786037 - RNA, 15 nt, Mycobacterium avium subsp. paratuberculosis
ugccggaucgggacc

SEQ ID NO: 786038 - RNA, 14 nt, Mycobacterium avium subsp. paratuberculosis
ugccggaugccgcg

SEQ ID NO: 786039 - RNA, 14 nt, Mycobacterium avium subsp. paratuberculosis
ugccggaugcgguc

SEQ ID NO: 786040 - RNA, 16 nt, Mycobacterium avium subsp. paratuberculosis
ugccggauugcgagcc

SEQ ID NO: 786041 - RNA, 15 nt, Mycobacterium avium subsp. paratuberculosis
ugccggccgccgcgc

SEQ ID NO: 786042 - RNA, 16 nt, Mycobacterium avium subsp. paratuberculosis
ugccggccgccguauc

SEQ ID NO: 786043 - RNA, 12 nt, Mycobacterium avium subsp. paratuberculosis
ugccggcccgca

SEQ ID NO: 786044 - RNA, 12 nt, Mycobacterium avium subsp. paratuberculosis
ugccggccagcc

SEQ ID NO: 786045 - RNA, 15 nt, Mycobacterium avium subsp. paratuberculosis
ugccggccagccgcg

SEQ ID NO: 786046 - RNA, 18 nt, Mycobacterium avium subsp. paratuberculosis
ugccggcauccucggcgc

SEQ ID NO: 786047 - RNA, 19 nt, Mycobacterium avium subsp. paratuberculosis
ugccggcauccucggcgcg

SEQ ID NO: 786048 - RNA, 22 nt, Mycobacterium avium subsp. paratuberculosis
ugccggcauccucggcgcgucg

SEQ ID NO: 786049 - RNA, 14 nt, Mycobacterium avium subsp. paratuberculosis
ugccggccaccggc

SEQ ID NO: 786050 - RNA, 15 nt, Mycobacterium avium subsp. paratuberculosis
ugccggccaccggcg

SEQ ID NO: 786051 - RNA, 21 nt, Mycobacterium avium subsp. paratuberculosis
ugccggccaccggcgcgacgg

SEQ ID NO: 786052 - RNA, 21 nt, Mycobacterium avium subsp. paratuberculosis
ugccggcauaggccagcacca

SEQ ID NO: 786053 - RNA, 21 nt, Mycobacterium avium subsp. paratuberculosis
ugccggccagaucgacgccgc

SEQ ID NO: 786054 - RNA, 22 nt, Mycobacterium avium subsp. paratuberculosis
ugccggccagaucgacgccgcg

SEQ ID NO: 786055 - RNA, 24 nt, Mycobacterium avium subsp. paratuberculosis
ugccggccagaucgacgccgcggu

SEQ ID NO: 786056 - RNA, 17 nt, Mycobacterium avium subsp. paratuberculosis
ugccggcgaccagcccc

SEQ ID NO: 786057 - RNA, 19 nt, Mycobacterium avium subsp. paratuberculosis
ugccggcgaacucgcggcg

SEQ ID NO: 786058 - RNA, 18 nt, Mycobacterium avium subsp. paratuberculosis
ugccggccucgucggcga

SEQ ID NO: 786059 - RNA, 14 nt, Mycobacterium avium subsp. paratuberculosis
ugccggccgggacg

SEQ ID NO: 786060 - RNA, 19 nt, Mycobacterium avium subsp. paratuberculosis
ugccggccgggacgcgguc

SEQ ID NO: 786061 - RNA, 17 nt, Mycobacterium avium subsp. paratuberculosis
ugccggccggggcggcg

SEQ ID NO: 786062 - RNA, 19 nt, Mycobacterium avium subsp. paratuberculosis
ugccggccggggcggcggu

SEQ ID NO: 786063 - RNA, 21 nt, Mycobacterium avium subsp. paratuberculosis
ugccggccggggcggcgguac

SEQ ID NO: 786064 - RNA, 22 nt, Mycobacterium avium subsp. paratuberculosis
ugccggccgggucgaccgcgau

SEQ ID NO: 786065 - RNA, 22 nt, Mycobacterium avium subsp. paratuberculosis
ugccggcccgcagcgccucggc

SEQ ID NO: 786066 - RNA, 12 nt, Mycobacterium avium subsp. paratuberculosis
ugccggccggca

SEQ ID NO: 786067 - RNA, 15 nt, Mycobacterium avium subsp. paratuberculosis
ugccggccggcacga

SEQ ID NO: 786068 - RNA, 13 nt, Mycobacterium avium subsp. paratuberculosis
ugccggccggcag

SEQ ID NO: 786069 - RNA, 14 nt, Mycobacterium avium subsp. paratuberculosis
ugccggccggcagc

SEQ ID NO: 786070 - RNA, 13 nt, Mycobacterium avium subsp. paratuberculosis
ugccggcggacag

SEQ ID NO: 786071 - RNA, 19 nt, Mycobacterium avium subsp. paratuberculosis
ugccggcggacagccccga

SEQ ID NO: 786072 - RNA, 19 nt, Mycobacterium avium subsp. paratuberculosis
ugccggcgcccagcggcga

SEQ ID NO: 786073 - RNA, 22 nt, Mycobacterium avium subsp. paratuberculosis
ugccggcgcucgucgucgccga

SEQ ID NO: 786074 - RNA, 13 nt, Mycobacterium avium subsp. paratuberculosis
ugccggcgccgau

SEQ ID NO: 786075 - RNA, 23 nt, Mycobacterium avium subsp. paratuberculosis
ugccggcgccgauuccgucggug

SEQ ID NO: 786076 - RNA, 13 nt, Mycobacterium avium subsp. paratuberculosis
ugccggcgccgga

SEQ ID NO: 786077 - RNA, 15 nt, Mycobacterium avium subsp. paratuberculosis
ugccggcgccggauc

SEQ ID NO: 786078 - RNA, 21 nt, Mycobacterium avium subsp. paratuberculosis
ugccggcgaugguggcgcugc

SEQ ID NO: 786079 - RNA, 15 nt, Mycobacterium avium subsp. paratuberculosis
ugccggcgcaccgcg

SEQ ID NO: 786080 - RNA, 18 nt, Mycobacterium avium subsp. paratuberculosis
ugccggcgauccgcgcgg

SEQ ID NO: 786081 - RNA, 20 nt, Mycobacterium avium subsp. paratuberculosis
ugccggcgauccgcgcggcg

SEQ ID NO: 786082 - RNA, 23 nt, Mycobacterium avium subsp. paratuberculosis
ugccggcgauccgcgcggcgacg

SEQ ID NO: 786083 - RNA, 21 nt, Mycobacterium avium subsp. paratuberculosis
ugccggcgagugcgaaucauc

SEQ ID NO: 786084 - RNA, 22 nt, Mycobacterium avium subsp. paratuberculosis
ugccggcgaucaccgggacacc

SEQ ID NO: 786085 - RNA, 17 nt, Mycobacterium avium subsp. paratuberculosis
ugccgcugcgccggcgc

SEQ ID NO: 786086 - RNA, 22 nt, Mycobacterium avium subsp. paratuberculosis
ugccgcugcgccggcgcggcca

SEQ ID NO: 786087 - RNA, 20 nt, Mycobacterium avium subsp. paratuberculosis
ugccgcuggauuccaccgug

SEQ ID NO: 786088 - RNA, 16 nt, Mycobacterium avium subsp. paratuberculosis
ugccgcuggcgucgau

SEQ ID NO: 786089 - RNA, 22 nt, Mycobacterium avium subsp. paratuberculosis
ugccgcugcauccgcagcacca

SEQ ID NO: 786090 - RNA, 19 nt, Mycobacterium avium subsp. paratuberculosis
ugccggaacaccucgaagu

SEQ ID NO: 786091 - RNA, 14 nt, Mycobacterium avium subsp. paratuberculosis
ugccggacaccccg

SEQ ID NO: 786092 - RNA, 15 nt, Mycobacterium avium subsp. paratuberculosis
ugccggacaccccgg

SEQ ID NO: 786093 - RNA, 16 nt, Mycobacterium avium subsp. paratuberculosis
ugccggacaccccggc

SEQ ID NO: 786094 - RNA, 16 nt, Mycobacterium avium subsp. paratuberculosis
ugccggaccucgacca

SEQ ID NO: 786095 - RNA, 19 nt, Mycobacterium avium subsp. paratuberculosis
ugccggaccucgaccagcc

SEQ ID NO: 786096 - RNA, 22 nt, Mycobacterium avium subsp. paratuberculosis
ugccggaaguucucgccgugca

SEQ ID NO: 786097 - RNA, 12 nt, Mycobacterium avium subsp. paratuberculosis
ugccggacgagg

SEQ ID NO: 786098 - RNA, 20 nt, Mycobacterium avium subsp. paratuberculosis
ugccggacgaggaucgcagg

SEQ ID NO: 786099 - RNA, 15 nt, Mycobacterium avium subsp. paratuberculosis
ugccggaggcgccgu

SEQ ID NO: 786100 - RNA, 15 nt, Mycobacterium avium subsp. paratuberculosis
ugccggaggcggcgu

SEQ ID NO: 786101 - RNA, 20 nt, Mycobacterium avium subsp. paratuberculosis
ugccggacuugaugcugccc

SEQ ID NO: 786102 - RNA, 19 nt, Mycobacterium avium subsp. paratuberculosis
ugccgcuccggucgcgucg

SEQ ID NO: 786103 - RNA, 15 nt, Mycobacterium avium subsp. paratuberculosis
ugccgcugacggucg

SEQ ID NO: 786104 - RNA, 20 nt, Mycobacterium avium subsp. paratuberculosis
ugccgcugacggucgccgac

SEQ ID NO: 786105 - RNA, 20 nt, Mycobacterium avium subsp. paratuberculosis
ugccgcguuccacgcagauc

SEQ ID NO: 786106 - RNA, 16 nt, Mycobacterium avium subsp. paratuberculosis
ugccgccgugcgcggc

SEQ ID NO: 786107 - RNA, 23 nt, Mycobacterium avium subsp. paratuberculosis
ugccgccgugcgcggcgaccacc

SEQ ID NO: 786108 - RNA, 23 nt, Mycobacterium avium subsp. paratuberculosis
ugccgccgggcaccucggcgucg

SEQ ID NO: 786109 - RNA, 22 nt, Mycobacterium avium subsp. paratuberculosis
ugccgccggggacccgcaccgg

SEQ ID NO: 786110 - RNA, 16 nt, Mycobacterium avium subsp. paratuberculosis
ugccgccggggugcac

SEQ ID NO: 786111 - RNA, 23 nt, Mycobacterium avium subsp. paratuberculosis
ugccgccggucacggcgucggcg

SEQ ID NO: 786112 - RNA, 16 nt, Mycobacterium avium subsp. paratuberculosis
ucgaguaguccgggau

SEQ ID NO: 786113 - RNA, 15 nt, Mycobacterium avium subsp. paratuberculosis
ucgauaauggcggcc

SEQ ID NO: 786114 - RNA, 17 nt, Mycobacterium avium subsp. paratuberculosis
ucgaguuccgcgucggc

SEQ ID NO: 786115 - RNA, 16 nt, Mycobacterium avium subsp. paratuberculosis
ucgaucaacgccgggu

SEQ ID NO: 786116 - RNA, 22 nt, Mycobacterium avium subsp. paratuberculosis
ucgauagugaacgccucgggcc

SEQ ID NO: 786117 - RNA, 22 nt, Mycobacterium avium subsp. paratuberculosis
ucgaucagagcgggccgaccgu

SEQ ID NO: 786118 - RNA, 16 nt, Mycobacterium avium subsp. paratuberculosis
ucgaucaccgggcggc

SEQ ID NO: 786119 - RNA, 17 nt, Mycobacterium avium subsp. paratuberculosis
ucgaucaccucgucgag

SEQ ID NO: 786120 - RNA, 15 nt, Mycobacterium avium subsp. paratuberculosis
ucgaucacgccgccg

SEQ ID NO: 786121 - RNA, 20 nt, Mycobacterium avium subsp. paratuberculosis
ucgaucacgccgccggggcg

SEQ ID NO: 786122 - RNA, 15 nt, Mycobacterium avium subsp. paratuberculosis
ucgaucagcaccgcc

SEQ ID NO: 786123 - RNA, 16 nt, Mycobacterium avium subsp. paratuberculosis
ucgaucagcaccgcca

SEQ ID NO: 786124 - RNA, 17 nt, Mycobacterium avium subsp. paratuberculosis
ucgaucagccgcgacag

SEQ ID NO: 786125 - RNA, 19 nt, Mycobacterium avium subsp. paratuberculosis
ucgaucagcgacggcccgc

SEQ ID NO: 786126 - RNA, 19 nt, Mycobacterium avium subsp. paratuberculosis
ucgaucuggcggacccgcu

SEQ ID NO: 786127 - RNA, 23 nt, Mycobacterium avium subsp. paratuberculosis
ucgaucugggccaggaucucguc

SEQ ID NO: 786128 - RNA, 24 nt, Mycobacterium avium subsp. paratuberculosis
ucgaucuugugcucgagcucggcg

SEQ ID NO: 786129 - RNA, 17 nt, Mycobacterium avium subsp. paratuberculosis
ucgaucugcagccggcg

SEQ ID NO: 786130 - RNA, 14 nt, Mycobacterium avium subsp. paratuberculosis
ucgaucugcggcac

SEQ ID NO: 786131 - RNA, 17 nt, Mycobacterium avium subsp. paratuberculosis
ucgaucucggccagcgg

SEQ ID NO: 786132 - RNA, 13 nt, Mycobacterium avium subsp. paratuberculosis
ucgaucucggcgc

SEQ ID NO: 786133 - RNA, 17 nt, Mycobacterium avium subsp. paratuberculosis
ucgaucuccucgcgcgg

SEQ ID NO: 786134 - RNA, 16 nt, Mycobacterium avium subsp. paratuberculosis
ucgaucucggccaccg

SEQ ID NO: 786135 - RNA, 15 nt, Mycobacterium avium subsp. paratuberculosis
ucgaugaacucgcgg

SEQ ID NO: 786136 - RNA, 16 nt, Mycobacterium avium subsp. paratuberculosis
ucgaugaacucgcggg

SEQ ID NO: 786137 - RNA, 17 nt, Mycobacterium avium subsp. paratuberculosis
ucgaugaacucgcgggc

SEQ ID NO: 786138 - RNA, 17 nt, Mycobacterium avium subsp. paratuberculosis
ucgaugaauccgcgcag

SEQ ID NO: 786139 - RNA, 18 nt, Mycobacterium avium subsp. paratuberculosis
ucgaugaccucgcgcagc

SEQ ID NO: 786140 - RNA, 21 nt, Mycobacterium avium subsp. paratuberculosis
ucgaugaccucgcgcccggcg

SEQ ID NO: 786141 - RNA, 14 nt, Mycobacterium avium subsp. paratuberculosis
ucgaugacggcggc

SEQ ID NO: 786142 - RNA, 15 nt, Mycobacterium avium subsp. paratuberculosis
ucgaugacggcggcg

SEQ ID NO: 786143 - RNA, 21 nt, Mycobacterium avium subsp. paratuberculosis
ucgaugacggcggcgcccugc

SEQ ID NO: 786144 - RNA, 20 nt, Mycobacterium avium subsp. paratuberculosis
ucgaugacggucuugcggcc

SEQ ID NO: 786145 - RNA, 13 nt, Mycobacterium avium subsp. paratuberculosis
ucgaugacgccgc

SEQ ID NO: 786146 - RNA, 15 nt, Mycobacterium avium subsp. paratuberculosis
ucgaucgccaccgag

SEQ ID NO: 786147 - RNA, 19 nt, Mycobacterium avium subsp. paratuberculosis
ucgaucgcccgcuccgcgg

SEQ ID NO: 786148 - RNA, 23 nt, Mycobacterium avium subsp. paratuberculosis
ucgaucgcccgcuccgcgggcag

SEQ ID NO: 786149 - RNA, 17 nt, Mycobacterium avium subsp. paratuberculosis
ucgaucgacgacgccag

SEQ ID NO: 786150 - RNA, 13 nt, Mycobacterium avium subsp. paratuberculosis
ucgaucgacgccg

SEQ ID NO: 786151 - RNA, 15 nt, Mycobacterium avium subsp. paratuberculosis
ucgaucgacgccgac

SEQ ID NO: 786152 - RNA, 17 nt, Mycobacterium avium subsp. paratuberculosis
ucgaucggcgcgccgaa

SEQ ID NO: 786153 - RNA, 19 nt, Mycobacterium avium subsp. paratuberculosis
ucgaucgcgaccaccggcc

SEQ ID NO: 786154 - RNA, 16 nt, Mycobacterium avium subsp. paratuberculosis
ucgaucgcggcgaugg

SEQ ID NO: 786155 - RNA, 14 nt, Mycobacterium avium subsp. paratuberculosis
ucgaucgcggucac

SEQ ID NO: 786156 - RNA, 11 nt, Mycobacterium avium subsp. paratuberculosis
ucgaucgcgua

SEQ ID NO: 786157 - RNA, 23 nt, Mycobacterium avium subsp. paratuberculosis
ucgauccccgcagcucccccggc

SEQ ID NO: 786158 - RNA, 17 nt, Mycobacterium avium subsp. paratuberculosis
ucgaucccgccggcgau

SEQ ID NO: 786159 - RNA, 19 nt, Mycobacterium avium subsp. paratuberculosis
ucgaucccgccggcgaucg

SEQ ID NO: 786160 - RNA, 18 nt, Mycobacterium avium subsp. paratuberculosis
ucgauccacccaccggca

SEQ ID NO: 786161 - RNA, 17 nt, Mycobacterium avium subsp. paratuberculosis
ucgaucaucgcgucggu

SEQ ID NO: 786162 - RNA, 19 nt, Mycobacterium avium subsp. paratuberculosis
ucgaucaucuccacccggc

SEQ ID NO: 786163 - RNA, 18 nt, Mycobacterium avium subsp. paratuberculosis
ucgaucagucgucccggc

SEQ ID NO: 786164 - RNA, 19 nt, Mycobacterium avium subsp. paratuberculosis
ucgaucagucgucccggcu

SEQ ID NO: 786165 - RNA, 22 nt, Mycobacterium avium subsp. paratuberculosis
ucgaucagcggcaucgaggacc

SEQ ID NO: 786166 - RNA, 23 nt, Mycobacterium avium subsp. paratuberculosis
ucgauuugaugaacacggucgcc

SEQ ID NO: 786167 - RNA, 20 nt, Mycobacterium avium subsp. paratuberculosis
ucgauuucaaggggccgggc

SEQ ID NO: 786168 - RNA, 14 nt, Mycobacterium avium subsp. paratuberculosis
ucgauugccggacg

SEQ ID NO: 786169 - RNA, 13 nt, Mycobacterium avium subsp. paratuberculosis
ucgcaaccgucuu

SEQ ID NO: 786170 - RNA, 19 nt, Mycobacterium avium subsp. paratuberculosis
ucgcaaccagugcacgcuc

SEQ ID NO: 786171 - RNA, 13 nt, Mycobacterium avium subsp. paratuberculosis
ucgcacaccagca

SEQ ID NO: 786172 - RNA, 21 nt, Mycobacterium avium subsp. paratuberculosis
ucgcacaccagcacggcggcg

SEQ ID NO: 786173 - RNA, 18 nt, Mycobacterium avium subsp. paratuberculosis
ucgcacaacccgcccggg

SEQ ID NO: 786174 - RNA, 19 nt, Mycobacterium avium subsp. paratuberculosis
ucgcacaaccgggccaacg

SEQ ID NO: 786175 - RNA, 14 nt, Mycobacterium avium subsp. paratuberculosis
ucgcacagcgccgc

SEQ ID NO: 786176 - RNA, 16 nt, Mycobacterium avium subsp. paratuberculosis
ucgcacagcgccgcgu

SEQ ID NO: 786177 - RNA, 13 nt, Mycobacterium avium subsp. paratuberculosis
ucgcacagccggc

SEQ ID NO: 786178 - RNA, 14 nt, Mycobacterium avium subsp. paratuberculosis
ucgcacagccggcg

SEQ ID NO: 786179 - RNA, 16 nt, Mycobacterium avium subsp. paratuberculosis
ucgcacagccggcgcg

SEQ ID NO: 786180 - RNA, 17 nt, Mycobacterium avium subsp. paratuberculosis
ucgcacagccggcgcgc

SEQ ID NO: 786181 - RNA, 18 nt, Mycobacterium avium subsp. paratuberculosis
ucgcaccccaccgacagc

SEQ ID NO: 786182 - RNA, 21 nt, Mycobacterium avium subsp. paratuberculosis
ucgcaccccaccgacagccgg

SEQ ID NO: 786183 - RNA, 23 nt, Mycobacterium avium subsp. paratuberculosis
ucgcaccccaccgacagccggac

SEQ ID NO: 786184 - RNA, 19 nt, Mycobacterium avium subsp. paratuberculosis
ucgcaccagcgcuuucgcg

SEQ ID NO: 786185 - RNA, 19 nt, Mycobacterium avium subsp. paratuberculosis
ucgcacagauacgcgacga

SEQ ID NO: 786186 - RNA, 16 nt, Mycobacterium avium subsp. paratuberculosis
ucgcacuagguccggc

SEQ ID NO: 786187 - RNA, 22 nt, Mycobacterium avium subsp. paratuberculosis
ucgcacuagguccggcgcgacc

SEQ ID NO: 786188 - RNA, 13 nt, Mycobacterium avium subsp. paratuberculosis
ucgcacgccggua

SEQ ID NO: 786189 - RNA, 13 nt, Mycobacterium avium subsp. paratuberculosis
ucgcaccgcgagc

SEQ ID NO: 786190 - RNA, 18 nt, Mycobacterium avium subsp. paratuberculosis
ucgcaccgcgagcagacg

SEQ ID NO: 786191 - RNA, 19 nt, Mycobacterium avium subsp. paratuberculosis
ucgcaccgcgagcagacgc

SEQ ID NO: 786192 - RNA, 13 nt, Mycobacterium avium subsp. paratuberculosis
ucgcaccgcggcg

SEQ ID NO: 786193 - RNA, 17 nt, Mycobacterium avium subsp. paratuberculosis
ucgcaccgcggcgugga

SEQ ID NO: 786194 - RNA, 13 nt, Mycobacterium avium subsp. paratuberculosis
ucgaugcgcaccg

SEQ ID NO: 786195 - RNA, 17 nt, Mycobacterium avium subsp. paratuberculosis
ucgaugccgggcauggc

SEQ ID NO: 786196 - RNA, 13 nt, Mycobacterium avium subsp. paratuberculosis
ucgaugcgcgcca

SEQ ID NO: 786197 - RNA, 19 nt, Mycobacterium avium subsp. paratuberculosis
ucgaugcgcgccaccaggc

SEQ ID NO: 786198 - RNA, 22 nt, Mycobacterium avium subsp. paratuberculosis
ucgaugcgcgccaccaggcggu

SEQ ID NO: 786199 - RNA, 18 nt, Mycobacterium avium subsp. paratuberculosis
ucgaugcgcgccagcagc

SEQ ID NO: 786200 - RNA, 15 nt, Mycobacterium avium subsp. paratuberculosis
ucgaugcgggcccgc

SEQ ID NO: 786201 - RNA, 20 nt, Mycobacterium avium subsp. paratuberculosis
ucgauggaauucgucggcgg

SEQ ID NO: 786202 - RNA, 16 nt, Mycobacterium avium subsp. paratuberculosis
ucgauggacagggcga

SEQ ID NO: 786203 - RNA, 17 nt, Mycobacterium avium subsp. paratuberculosis
ucgauggacagggcgac

SEQ ID NO: 786204 - RNA, 18 nt, Mycobacterium avium subsp. paratuberculosis
ucgauggacagggcgaca

SEQ ID NO: 786205 - RNA, 13 nt, Mycobacterium avium subsp. paratuberculosis
ucgaugccgugcc

SEQ ID NO: 786206 - RNA, 14 nt, Mycobacterium avium subsp. paratuberculosis
ucgaugccgugccg

SEQ ID NO: 786207 - RNA, 13 nt, Mycobacterium avium subsp. paratuberculosis
ucgaugccggcca

SEQ ID NO: 786208 - RNA, 19 nt, Mycobacterium avium subsp. paratuberculosis
ucgaugccggccagcggcc

SEQ ID NO: 786209 - RNA, 18 nt, Mycobacterium avium subsp. paratuberculosis
ucgaugccgaucggggcg

SEQ ID NO: 786210 - RNA, 15 nt, Mycobacterium avium subsp. paratuberculosis
ucgaugccgaugagg

SEQ ID NO: 786211 - RNA, 16 nt, Mycobacterium avium subsp. paratuberculosis
ucgaugcccagcgcgc

SEQ ID NO: 786212 - RNA, 16 nt, Mycobacterium avium subsp. paratuberculosis
ucgaugcacggucggc

SEQ ID NO: 786213 - RNA, 23 nt, Mycobacterium avium subsp. paratuberculosis
ucgaugcccgcguccugcagcgc

SEQ ID NO: 786214 - RNA, 20 nt, Mycobacterium avium subsp. paratuberculosis
ucgaugcccuagcgguggcg

SEQ ID NO: 786215 - RNA, 21 nt, Mycobacterium avium subsp. paratuberculosis
ucgaugcccuccagcaccguc

SEQ ID NO: 786216 - RNA, 18 nt, Mycobacterium avium subsp. paratuberculosis
ucgaugaugggcgaucga

SEQ ID NO: 786217 - RNA, 19 nt, Mycobacterium avium subsp. paratuberculosis
ucgaugaugggcgaucgac

SEQ ID NO: 786218 - RNA, 15 nt, Mycobacterium avium subsp. paratuberculosis
ucgaugaugccggcg

SEQ ID NO: 786219 - RNA, 16 nt, Mycobacterium avium subsp. paratuberculosis
ucgaugaugccggcgg

SEQ ID NO: 786220 - RNA, 12 nt, Mycobacterium avium subsp. paratuberculosis
ucgaugugggcc

SEQ ID NO: 786221 - RNA, 15 nt, Mycobacterium avium subsp. paratuberculosis
ucgaugugcucgggg

SEQ ID NO: 786222 - RNA, 15 nt, Mycobacterium avium subsp. paratuberculosis
ucgaugucgacgccg

SEQ ID NO: 786223 - RNA, 18 nt, Mycobacterium avium subsp. paratuberculosis
ucgaugucgcccggcgcg

SEQ ID NO: 786224 - RNA, 15 nt, Mycobacterium avium subsp. paratuberculosis
ucgaugucgccggcg

SEQ ID NO: 786225 - RNA, 14 nt, Mycobacterium avium subsp. paratuberculosis
ucgaugucggccag

SEQ ID NO: 786226 - RNA, 20 nt, Mycobacterium avium subsp. paratuberculosis
ucgaugucggccagcgcggc

SEQ ID NO: 786227 - RNA, 13 nt, Mycobacterium avium subsp. paratuberculosis
ucgaugucgucgu

SEQ ID NO: 786228 - RNA, 16 nt, Mycobacterium avium subsp. paratuberculosis
ucgauggggauggugc

SEQ ID NO: 786229 - RNA, 16 nt, Mycobacterium avium subsp. paratuberculosis
ucgauggguucuucga

SEQ ID NO: 786230 - RNA, 14 nt, Mycobacterium avium subsp. paratuberculosis
ucgauggcgccgau

SEQ ID NO: 786231 - RNA, 14 nt, Mycobacterium avium subsp. paratuberculosis
ucgauggcgcggcc

SEQ ID NO: 786232 - RNA, 15 nt, Mycobacterium avium subsp. paratuberculosis
ucgauggcggcggcu

SEQ ID NO: 786233 - RNA, 18 nt, Mycobacterium avium subsp. paratuberculosis
ucgauggcgggcgcgccg

SEQ ID NO: 786234 - RNA, 19 nt, Mycobacterium avium subsp. paratuberculosis
ucgauggcgggcgcgccgg

SEQ ID NO: 786235 - RNA, 20 nt, Mycobacterium avium subsp. paratuberculosis
ucgauggcgggcgcgccggc

SEQ ID NO: 786236 - RNA, 15 nt, Mycobacterium avium subsp. paratuberculosis
ucgauggacgcggug

SEQ ID NO: 786237 - RNA, 13 nt, Mycobacterium avium subsp. paratuberculosis
ucgauggccacgc

SEQ ID NO: 786238 - RNA, 13 nt, Mycobacterium avium subsp. paratuberculosis
ucgauggccaucg

SEQ ID NO: 786239 - RNA, 15 nt, Mycobacterium avium subsp. paratuberculosis
ucgagaaaagcggcg

SEQ ID NO: 786240 - RNA, 13 nt, Mycobacterium avium subsp. paratuberculosis
ucgagaaacgcgc

SEQ ID NO: 786241 - RNA, 16 nt, Mycobacterium avium subsp. paratuberculosis
ucgagauucugcagcc

SEQ ID NO: 786242 - RNA, 15 nt, Mycobacterium avium subsp. paratuberculosis
ucgagcaacggccgc

SEQ ID NO: 786243 - RNA, 15 nt, Mycobacterium avium subsp. paratuberculosis
ucgagcacacgaucu

SEQ ID NO: 786244 - RNA, 15 nt, Mycobacterium avium subsp. paratuberculosis
ucgagcaccacggcc

SEQ ID NO: 786245 - RNA, 19 nt, Mycobacterium avium subsp. paratuberculosis
ucgagcaccacggcccgcg

SEQ ID NO: 786246 - RNA, 21 nt, Mycobacterium avium subsp. paratuberculosis
ucgagcaccagcaacaccagg

SEQ ID NO: 786247 - RNA, 18 nt, Mycobacterium avium subsp. paratuberculosis
ucgagacugcacagugcg

SEQ ID NO: 786248 - RNA, 18 nt, Mycobacterium avium subsp. paratuberculosis
ucgagacacgcgccggcg

SEQ ID NO: 786249 - RNA, 16 nt, Mycobacterium avium subsp. paratuberculosis
ucgagagccgcaucgc

SEQ ID NO: 786250 - RNA, 17 nt, Mycobacterium avium subsp. paratuberculosis
ucgagaucagggcgcgc

SEQ ID NO: 786251 - RNA, 21 nt, Mycobacterium avium subsp. paratuberculosis
ucgagaucagggcgcgcaccg

SEQ ID NO: 786252 - RNA, 13 nt, Mycobacterium avium subsp. paratuberculosis
ucgagaugaccgu

SEQ ID NO: 786253 - RNA, 22 nt, Mycobacterium avium subsp. paratuberculosis
ucgagaugccgggaagcgaagc

SEQ ID NO: 786254 - RNA, 22 nt, Mycobacterium avium subsp. paratuberculosis
ucgagaugcguucggccgcagc

SEQ ID NO: 786255 - RNA, 15 nt, Mycobacterium avium subsp. paratuberculosis
ucgacgucauccggc

SEQ ID NO: 786256 - RNA, 15 nt, Mycobacterium avium subsp. paratuberculosis
ucgacgucgacgucg

SEQ ID NO: 786257 - RNA, 22 nt, Mycobacterium avium subsp. paratuberculosis
ucgacgucgacugaucgacgag

SEQ ID NO: 786258 - RNA, 23 nt, Mycobacterium avium subsp. paratuberculosis
ucgacgucgaagggucggucgag

SEQ ID NO: 786259 - RNA, 17 nt, Mycobacterium avium subsp. paratuberculosis
ucgacgucacgacgguc

SEQ ID NO: 786260 - RNA, 22 nt, Mycobacterium avium subsp. paratuberculosis
ucgacgucacgacggucacggc

SEQ ID NO: 786261 - RNA, 19 nt, Mycobacterium avium subsp. paratuberculosis
ucgacgugaucuggucggc

SEQ ID NO: 786262 - RNA, 20 nt, Mycobacterium avium subsp. paratuberculosis
ucgacgugaucuggucggcc

SEQ ID NO: 786263 - RNA, 14 nt, Mycobacterium avium subsp. paratuberculosis
ucgacgugccguug

SEQ ID NO: 786264 - RNA, 16 nt, Mycobacterium avium subsp. paratuberculosis
ucgacgugcgcggcgu

SEQ ID NO: 786265 - RNA, 21 nt, Mycobacterium avium subsp. paratuberculosis
ucgacgugcucggcggccgcc

SEQ ID NO: 786266 - RNA, 17 nt, Mycobacterium avium subsp. paratuberculosis
ucgacgugggcggccac

SEQ ID NO: 786267 - RNA, 18 nt, Mycobacterium avium subsp. paratuberculosis
ucgacguggugcaccgcc

SEQ ID NO: 786268 - RNA, 19 nt, Mycobacterium avium subsp. paratuberculosis
ucgacgucggacgcggccg

SEQ ID NO: 786269 - RNA, 22 nt, Mycobacterium avium subsp. paratuberculosis
ucgacgucggacgcggccgagc

SEQ ID NO: 786270 - RNA, 21 nt, Mycobacterium avium subsp. paratuberculosis
ucgacuccaccaccuggccgg

SEQ ID NO: 786271 - RNA, 14 nt, Mycobacterium avium subsp. paratuberculosis
ucgacuccggcgac

SEQ ID NO: 786272 - RNA, 15 nt, Mycobacterium avium subsp. paratuberculosis
ucgacguucgccgcc

SEQ ID NO: 786273 - RNA, 15 nt, Mycobacterium avium subsp. paratuberculosis
ucgacguucggcggg

SEQ ID NO: 786274 - RNA, 17 nt, Mycobacterium avium subsp. paratuberculosis
ucgacguucggcgggca

SEQ ID NO: 786275 - RNA, 18 nt, Mycobacterium avium subsp. paratuberculosis
ucgacguucggcgggcag

SEQ ID NO: 786276 - RNA, 15 nt, Mycobacterium avium subsp. paratuberculosis
ucgacugcaccgacu

SEQ ID NO: 786277 - RNA, 21 nt, Mycobacterium avium subsp. paratuberculosis
ucgacugggccaggucgcuga

SEQ ID NO: 786278 - RNA, 17 nt, Mycobacterium avium subsp. paratuberculosis
uccgggcgaccccggcc

SEQ ID NO: 786279 - RNA, 13 nt, Mycobacterium avium subsp. paratuberculosis
uccgggcgccauc

SEQ ID NO: 786280 - RNA, 23 nt, Mycobacterium avium subsp. paratuberculosis
uccgggcggcaucgcgcgcggcg

SEQ ID NO: 786281 - RNA, 18 nt, Mycobacterium avium subsp. paratuberculosis
uccgggcggccagccgcg

SEQ ID NO: 786282 - RNA, 19 nt, Mycobacterium avium subsp. paratuberculosis
uccgggccggcgucgcggu

SEQ ID NO: 786283 - RNA, 15 nt, Mycobacterium avium subsp. paratuberculosis
uccggguccgcggug

SEQ ID NO: 786284 - RNA, 12 nt, Mycobacterium avium subsp. paratuberculosis
uccgggucgcgg

SEQ ID NO: 786285 - RNA, 13 nt, Mycobacterium avium subsp. paratuberculosis
uccgggguggccu

SEQ ID NO: 786286 - RNA, 15 nt, Mycobacterium avium subsp. paratuberculosis
uccgggcugaccucg

SEQ ID NO: 786287 - RNA, 16 nt, Mycobacterium avium subsp. paratuberculosis
uccgggcugugggcgc

SEQ ID NO: 786288 - RNA, 12 nt, Mycobacterium avium subsp. paratuberculosis
uccggggcagca

SEQ ID NO: 786289 - RNA, 16 nt, Mycobacterium avium subsp. paratuberculosis
uccggggucagggcgc

SEQ ID NO: 786290 - RNA, 14 nt, Mycobacterium avium subsp. paratuberculosis
uccgggugcgggcu

SEQ ID NO: 786291 - RNA, 16 nt, Mycobacterium avium subsp. paratuberculosis
uccgggugucgacgcc

SEQ ID NO: 786292 - RNA, 18 nt, Mycobacterium avium subsp. paratuberculosis
uccgggugucgacgccgg

SEQ ID NO: 786293 - RNA, 20 nt, Mycobacterium avium subsp. paratuberculosis
uccggguucgacgccucggu

SEQ ID NO: 786294 - RNA, 15 nt, Mycobacterium avium subsp. paratuberculosis
ucgacggagucgucg

SEQ ID NO: 786295 - RNA, 16 nt, Mycobacterium avium subsp. paratuberculosis
ucgacggagucgucgg

SEQ ID NO: 786296 - RNA, 18 nt, Mycobacterium avium subsp. paratuberculosis
ucgacggagucgucggcg

SEQ ID NO: 786297 - RNA, 22 nt, Mycobacterium avium subsp. paratuberculosis
ucgacggagucgucggcgcggu

SEQ ID NO: 786298 - RNA, 22 nt, Mycobacterium avium subsp. paratuberculosis
ucgacgcguuguugcucggcgg

SEQ ID NO: 786299 - RNA, 21 nt, Mycobacterium avium subsp. paratuberculosis
ucgacgcugugcgccuugccg

SEQ ID NO: 786300 - RNA, 19 nt, Mycobacterium avium subsp. paratuberculosis
ucgacgcggggcggcggcg

SEQ ID NO: 786301 - RNA, 20 nt, Mycobacterium avium subsp. paratuberculosis
ucgacgcggggcggcggcgc

SEQ ID NO: 786302 - RNA, 22 nt, Mycobacterium avium subsp. paratuberculosis
ucgacgcugagcacccgcccgg

SEQ ID NO: 786303 - RNA, 18 nt, Mycobacterium avium subsp. paratuberculosis
ucgacgcugagccgcucg

SEQ ID NO: 786304 - RNA, 13 nt, Mycobacterium avium subsp. paratuberculosis
ucgacggcgccgg

SEQ ID NO: 786305 - RNA, 11 nt, Mycobacterium avium subsp. paratuberculosis
ucgacggcgaa

SEQ ID NO: 786306 - RNA, 15 nt, Mycobacterium avium subsp. paratuberculosis
ucgacggcgccgacg

SEQ ID NO: 786307 - RNA, 19 nt, Mycobacterium avium subsp. paratuberculosis
ucgacggccgccgcgacgc

SEQ ID NO: 786308 - RNA, 13 nt, Mycobacterium avium subsp. paratuberculosis
ucgacggccgcgc

SEQ ID NO: 786309 - RNA, 13 nt, Mycobacterium avium subsp. paratuberculosis
ucgacgguggccu

SEQ ID NO: 786310 - RNA, 18 nt, Mycobacterium avium subsp. paratuberculosis
ucgacgguggccucggcg

SEQ ID NO: 786311 - RNA, 20 nt, Mycobacterium avium subsp. paratuberculosis
ucgacgguggccucggcgcu

SEQ ID NO: 786312 - RNA, 24 nt, Mycobacterium avium subsp. paratuberculosis
ucgacgguugccucggccagcacc

SEQ ID NO: 786313 - RNA, 17 nt, Mycobacterium avium subsp. paratuberculosis
ucgacgguuugcccggc

SEQ ID NO: 786314 - RNA, 17 nt, Mycobacterium avium subsp. paratuberculosis
ucgacguacaucagcuc

SEQ ID NO: 786315 - RNA, 21 nt, Mycobacterium avium subsp. paratuberculosis
ucgacguacaucagcucguca

SEQ ID NO: 786316 - RNA, 15 nt, Mycobacterium avium subsp. paratuberculosis
ucgacggcggugacg

SEQ ID NO: 786317 - RNA, 21 nt, Mycobacterium avium subsp. paratuberculosis
ucgacggugaccggcucgagc

SEQ ID NO: 786318 - RNA, 19 nt, Mycobacterium avium subsp. paratuberculosis
ucgacggugaccucgucgg

SEQ ID NO: 786319 - RNA, 20 nt, Mycobacterium avium subsp. paratuberculosis
ucgagcagaacuccauggag

SEQ ID NO: 786320 - RNA, 16 nt, Mycobacterium avium subsp. paratuberculosis
ucgagcagcgcccggc

SEQ ID NO: 786321 - RNA, 15 nt, Mycobacterium avium subsp. paratuberculosis
ucgagcagcgcgcgc

SEQ ID NO: 786322 - RNA, 20 nt, Mycobacterium avium subsp. paratuberculosis
ucgagcauccggcgcacggc

SEQ ID NO: 786323 - RNA, 22 nt, Mycobacterium avium subsp. paratuberculosis
ucgagcauccggcgcacggcgc

SEQ ID NO: 786324 - RNA, 19 nt, Mycobacterium avium subsp. paratuberculosis
ucgagcaucuccagccggc

SEQ ID NO: 786325 - RNA, 22 nt, Mycobacterium avium subsp. paratuberculosis
ucgagcaucuccagccggcgaa

SEQ ID NO: 786326 - RNA, 13 nt, Mycobacterium avium subsp. paratuberculosis
ucgagcacucgcg

SEQ ID NO: 786327 - RNA, 13 nt, Mycobacterium avium subsp. paratuberculosis
ucgagcacgcccu

SEQ ID NO: 786328 - RNA, 15 nt, Mycobacterium avium subsp. paratuberculosis
ucgagcacgcccugc

SEQ ID NO: 786329 - RNA, 18 nt, Mycobacterium avium subsp. paratuberculosis
ucgagcaccgggcgucgg

SEQ ID NO: 786330 - RNA, 20 nt, Mycobacterium avium subsp. paratuberculosis
ucgagcaccgggcgucgggg

SEQ ID NO: 786331 - RNA, 14 nt, Mycobacterium avium subsp. paratuberculosis
ucgagcaccgcguc

SEQ ID NO: 786332 - RNA, 16 nt, Mycobacterium avium subsp. paratuberculosis
ucgagcaccggcggca

SEQ ID NO: 786333 - RNA, 18 nt, Mycobacterium avium subsp. paratuberculosis
ucgagcaccggcggcagc

SEQ ID NO: 786334 - RNA, 15 nt, Mycobacterium avium subsp. paratuberculosis
ucgagcacccggcgg

SEQ ID NO: 786335 - RNA, 16 nt, Mycobacterium avium subsp. paratuberculosis
ucgagcacccggcggg

SEQ ID NO: 786336 - RNA, 17 nt, Mycobacterium avium subsp. paratuberculosis
ucgagcacccggcgggg

SEQ ID NO: 786337 - RNA, 22 nt, Mycobacterium avium subsp. paratuberculosis
ucgagcaccgcgaccacgccgc

SEQ ID NO: 786338 - RNA, 14 nt, Mycobacterium avium subsp. paratuberculosis
ucgagcaccgcgau

SEQ ID NO: 786339 - RNA, 14 nt, Mycobacterium avium subsp. paratuberculosis
ucgagcgcccgggc

SEQ ID NO: 786340 - RNA, 14 nt, Mycobacterium avium subsp. paratuberculosis
ucgagcgccgcggc

SEQ ID NO: 786341 - RNA, 20 nt, Mycobacterium avium subsp. paratuberculosis
ucgagcgccgcggccaccgg

SEQ ID NO: 786342 - RNA, 14 nt, Mycobacterium avium subsp. paratuberculosis
ucgagcgccggacg

SEQ ID NO: 786343 - RNA, 15 nt, Mycobacterium avium subsp. paratuberculosis
ucgagccuggcgcgc

SEQ ID NO: 786344 - RNA, 14 nt, Mycobacterium avium subsp. paratuberculosis
ucgagcgcaccgcc

SEQ ID NO: 786345 - RNA, 18 nt, Mycobacterium avium subsp. paratuberculosis
ucgagccgggcgcgggcg

SEQ ID NO: 786346 - RNA, 22 nt, Mycobacterium avium subsp. paratuberculosis
ucgagccgggcgcgggcgccgu

SEQ ID NO: 786347 - RNA, 17 nt, Mycobacterium avium subsp. paratuberculosis
ucgagccggccggacac

SEQ ID NO: 786348 - RNA, 15 nt, Mycobacterium avium subsp. paratuberculosis
ucgagccggccguca

SEQ ID NO: 786349 - RNA, 19 nt, Mycobacterium avium subsp. paratuberculosis
ucgagccggcgcacucccg

SEQ ID NO: 786350 - RNA, 12 nt, Mycobacterium avium subsp. paratuberculosis
ucgagccgccgc

SEQ ID NO: 786351 - RNA, 16 nt, Mycobacterium avium subsp. paratuberculosis
ucgagccgccgccggc

SEQ ID NO: 786352 - RNA, 17 nt, Mycobacterium avium subsp. paratuberculosis
ucgagccgccgccggcg

SEQ ID NO: 786353 - RNA, 19 nt, Mycobacterium avium subsp. paratuberculosis
ucgagccgccgccggcguc

SEQ ID NO: 786354 - RNA, 21 nt, Mycobacterium avium subsp. paratuberculosis
ucgagccgccgccggcgucgc

SEQ ID NO: 786355 - RNA, 16 nt, Mycobacterium avium subsp. paratuberculosis
ucgagccgcggcccgc

SEQ ID NO: 786356 - RNA, 14 nt, Mycobacterium avium subsp. paratuberculosis
ucgagccgcucgcg

SEQ ID NO: 786357 - RNA, 22 nt, Mycobacterium avium subsp. paratuberculosis
ucgagccgcucgcgcaccggga

SEQ ID NO: 786358 - RNA, 19 nt, Mycobacterium avium subsp. paratuberculosis
ucgagccauaaaccggccg

SEQ ID NO: 786359 - RNA, 20 nt, Mycobacterium avium subsp. paratuberculosis
ucgagccauaaaccggccgg

SEQ ID NO: 786360 - RNA, 20 nt, Mycobacterium avium subsp. paratuberculosis
ucgagcccaccgcgcccagc

SEQ ID NO: 786361 - RNA, 12 nt, Mycobacterium avium subsp. paratuberculosis
ucgagcccgauc

SEQ ID NO: 786362 - RNA, 17 nt, Mycobacterium avium subsp. paratuberculosis
ucgagccgagcaccggc

SEQ ID NO: 786363 - RNA, 17 nt, Mycobacterium avium subsp. paratuberculosis
ucgagccaccacugcgc

SEQ ID NO: 786364 - RNA, 18 nt, Mycobacterium avium subsp. paratuberculosis
ucgagccaccacugcgcc

SEQ ID NO: 786365 - RNA, 19 nt, Mycobacterium avium subsp. paratuberculosis
ucgagccagcgggccgagc

SEQ ID NO: 786366 - RNA, 17 nt, Mycobacterium avium subsp. paratuberculosis
ucgaggaccggcgccgg

SEQ ID NO: 786367 - RNA, 16 nt, Mycobacterium avium subsp. paratuberculosis
ucgaggaucgccaacu

SEQ ID NO: 786368 - RNA, 13 nt, Mycobacterium avium subsp. paratuberculosis
ucgaggacaccgc

SEQ ID NO: 786369 - RNA, 15 nt, Mycobacterium avium subsp. paratuberculosis
ucgagcugggcccgc

SEQ ID NO: 786370 - RNA, 17 nt, Mycobacterium avium subsp. paratuberculosis
ucgagcuuccgccgagu

SEQ ID NO: 786371 - RNA, 22 nt, Mycobacterium avium subsp. paratuberculosis
ucgagcuuccgccgagucgcgc

SEQ ID NO: 786372 - RNA, 20 nt, Mycobacterium avium subsp. paratuberculosis
ucgagcgcgcugugcgccau

SEQ ID NO: 786373 - RNA, 15 nt, Mycobacterium avium subsp. paratuberculosis
ucgagcggcccgucg

SEQ ID NO: 786374 - RNA, 21 nt, Mycobacterium avium subsp. paratuberculosis
ucgagcggcccgucgccgauc

SEQ ID NO: 786375 - RNA, 12 nt, Mycobacterium avium subsp. paratuberculosis
ucgagcggcgcc

SEQ ID NO: 786376 - RNA, 16 nt, Mycobacterium avium subsp. paratuberculosis
ucgagcgucacgccgc

SEQ ID NO: 786377 - RNA, 18 nt, Mycobacterium avium subsp. paratuberculosis
ucgagcgucacgccgcgc

SEQ ID NO: 786378 - RNA, 23 nt, Mycobacterium avium subsp. paratuberculosis
ucgagcgucacgccgcgcccguc

SEQ ID NO: 786379 - RNA, 15 nt, Mycobacterium avium subsp. paratuberculosis
ucgagcgucacgcug

SEQ ID NO: 786380 - RNA, 21 nt, Mycobacterium avium subsp. paratuberculosis
ucgagcgucacgcuggcguga

SEQ ID NO: 786381 - RNA, 20 nt, Mycobacterium avium subsp. paratuberculosis
ucgagcgucauuccgccgcg

SEQ ID NO: 786382 - RNA, 21 nt, Mycobacterium avium subsp. paratuberculosis
ucgagcgucauuccgccgcgc

SEQ ID NO: 786383 - RNA, 22 nt, Mycobacterium avium subsp. paratuberculosis
ucgagcugcaacgcgucggcgc

SEQ ID NO: 786384 - RNA, 15 nt, Mycobacterium avium subsp. paratuberculosis
ucgaggccagcgcga

SEQ ID NO: 786385 - RNA, 22 nt, Mycobacterium avium subsp. paratuberculosis
ucgaggccagcgcgaucgccgg

SEQ ID NO: 786386 - RNA, 22 nt, Mycobacterium avium subsp. paratuberculosis
ucgaggccccgcgugacggccg

SEQ ID NO: 786387 - RNA, 14 nt, Mycobacterium avium subsp. paratuberculosis
ucgaggcccucgac

SEQ ID NO: 786388 - RNA, 14 nt, Mycobacterium avium subsp. paratuberculosis
ucgaggccgacgug

SEQ ID NO: 786389 - RNA, 15 nt, Mycobacterium avium subsp. paratuberculosis
ucgaggccgcgggcg

SEQ ID NO: 786390 - RNA, 19 nt, Mycobacterium avium subsp. paratuberculosis
ucgaggccggccagcgggu

SEQ ID NO: 786391 - RNA, 15 nt, Mycobacterium avium subsp. paratuberculosis
ucgagggcguucgcg

SEQ ID NO: 786392 - RNA, 23 nt, Mycobacterium avium subsp. paratuberculosis
ucgagggcuaaccaccggugacg

SEQ ID NO: 786393 - RNA, 17 nt, Mycobacterium avium subsp. paratuberculosis
ucgagggucgccaggcc

SEQ ID NO: 786394 - RNA, 23 nt, Mycobacterium avium subsp. paratuberculosis
ucgagggugaugucgcugccgcc

SEQ ID NO: 786395 - RNA, 16 nt, Mycobacterium avium subsp. paratuberculosis
ucgagggccaccggcu

SEQ ID NO: 786396 - RNA, 13 nt, Mycobacterium avium subsp. paratuberculosis
ucgagggccucca

SEQ ID NO: 786397 - RNA, 16 nt, Mycobacterium avium subsp. paratuberculosis
ucgagggccuccacca

SEQ ID NO: 786398 - RNA, 20 nt, Mycobacterium avium subsp. paratuberculosis
ucgaggucgaaccacgcggc

SEQ ID NO: 786399 - RNA, 19 nt, Mycobacterium avium subsp. paratuberculosis
ucgagguguugucgugccg

SEQ ID NO: 786400 - RNA, 23 nt, Mycobacterium avium subsp. paratuberculosis
ucgagguugaugccgacgucggu

SEQ ID NO: 786401 - RNA, 15 nt, Mycobacterium avium subsp. paratuberculosis
ucgaguaggcccagu

SEQ ID NO: 786402 - RNA, 21 nt, Mycobacterium avium subsp. paratuberculosis
ucgaguaggcccaguccugca

SEQ ID NO: 786403 - RNA, 13 nt, Mycobacterium avium subsp. paratuberculosis
ucgagggcgccgu

SEQ ID NO: 786404 - RNA, 16 nt, Mycobacterium avium subsp. paratuberculosis
ucgagggcggcgaccu

SEQ ID NO: 786405 - RNA, 22 nt, Mycobacterium avium subsp. paratuberculosis
ucgagguagcgugcgcccgacg

SEQ ID NO: 786406 - RNA, 16 nt, Mycobacterium avium subsp. paratuberculosis
ucgaggucggugaggc

SEQ ID NO: 786407 - RNA, 13 nt, Mycobacterium avium subsp. paratuberculosis
ucgaggucgucgg

SEQ ID NO: 786408 - RNA, 21 nt, Mycobacterium avium subsp. paratuberculosis
ucgaggucgucgggcgccggu

SEQ ID NO: 786409 - RNA, 21 nt, Mycobacterium avium subsp. paratuberculosis
ucgaggugauguuggccgcga

SEQ ID NO: 786410 - RNA, 17 nt, Mycobacterium avium subsp. paratuberculosis
ucgcagaucccgccggc

SEQ ID NO: 786411 - RNA, 17 nt, Mycobacterium avium subsp. paratuberculosis
ucgcaggcgagccgaca

SEQ ID NO: 786412 - RNA, 18 nt, Mycobacterium avium subsp. paratuberculosis
ucgcaggcgagccgacag

SEQ ID NO: 786413 - RNA, 15 nt, Mycobacterium avium subsp. paratuberculosis
ucgcaggcgagccgg

SEQ ID NO: 786414 - RNA, 17 nt, Mycobacterium avium subsp. paratuberculosis
ucgcaggcagcagcacc

SEQ ID NO: 786415 - RNA, 18 nt, Mycobacterium avium subsp. paratuberculosis
ucgcaggcagcagcaccc

SEQ ID NO: 786416 - RNA, 19 nt, Mycobacterium avium subsp. paratuberculosis
ucgcaggcagcagcacccc

SEQ ID NO: 786417 - RNA, 22 nt, Mycobacterium avium subsp. paratuberculosis
ucgcagcccgggugcgaacagc

SEQ ID NO: 786418 - RNA, 21 nt, Mycobacterium avium subsp. paratuberculosis
ucgcagcgacaaucggcucgc

SEQ ID NO: 786419 - RNA, 19 nt, Mycobacterium avium subsp. paratuberculosis
ucgcagcgcgcggcgcaga

SEQ ID NO: 786420 - RNA, 23 nt, Mycobacterium avium subsp. paratuberculosis
ucgcaggugccggugacggucag

SEQ ID NO: 786421 - RNA, 15 nt, Mycobacterium avium subsp. paratuberculosis
ucgcagucgaucagc

SEQ ID NO: 786422 - RNA, 14 nt, Mycobacterium avium subsp. paratuberculosis
ucgcaucagcucgg

SEQ ID NO: 786423 - RNA, 17 nt, Mycobacterium avium subsp. paratuberculosis
ucgcaucagcucggcag

SEQ ID NO: 786424 - RNA, 18 nt, Mycobacterium avium subsp. paratuberculosis
ucgcaucagcucggcagc

SEQ ID NO: 786425 - RNA, 13 nt, Mycobacterium avium subsp. paratuberculosis
ucgccaaggcgcu

SEQ ID NO: 786426 - RNA, 22 nt, Mycobacterium avium subsp. paratuberculosis
ucgccaauaaagcgggcccgcc

SEQ ID NO: 786427 - RNA, 17 nt, Mycobacterium avium subsp. paratuberculosis
ucgccaauccggcgggc

SEQ ID NO: 786428 - RNA, 19 nt, Mycobacterium avium subsp. paratuberculosis
ucgccaccaccacggggcg

SEQ ID NO: 786429 - RNA, 13 nt, Mycobacterium avium subsp. paratuberculosis
ucgccaccaccag

SEQ ID NO: 786430 - RNA, 22 nt, Mycobacterium avium subsp. paratuberculosis
ucgccaccaccuucaucgccgu

SEQ ID NO: 786431 - RNA, 13 nt, Mycobacterium avium subsp. paratuberculosis
ucgccaccacggc

SEQ ID NO: 786432 - RNA, 19 nt, Mycobacterium avium subsp. paratuberculosis
ucgccaccacggcgcccuc

SEQ ID NO: 786433 - RNA, 13 nt, Mycobacterium avium subsp. paratuberculosis
ucgccaccacggu

SEQ ID NO: 786434 - RNA, 16 nt, Mycobacterium avium subsp. paratuberculosis
ucgccaccagaccggc

SEQ ID NO: 786435 - RNA, 17 nt, Mycobacterium avium subsp. paratuberculosis
ucgccaccagaccggcg

SEQ ID NO: 786436 - RNA, 20 nt, Mycobacterium avium subsp. paratuberculosis
ucgccaccaccgcgccgucg

SEQ ID NO: 786437 - RNA, 15 nt, Mycobacterium avium subsp. paratuberculosis
ucgccaccccgcgcc

SEQ ID NO: 786438 - RNA, 19 nt, Mycobacterium avium subsp. paratuberculosis
ucgccaccccgcgccacgc

SEQ ID NO: 786439 - RNA, 18 nt, Mycobacterium avium subsp. paratuberculosis
ucgccagcaacgacccgg

SEQ ID NO: 786440 - RNA, 20 nt, Mycobacterium avium subsp. paratuberculosis
ucgccagaccgguugcggcg

SEQ ID NO: 786441 - RNA, 19 nt, Mycobacterium avium subsp. paratuberculosis
ucgccagacucacggcggc

SEQ ID NO: 786442 - RNA, 20 nt, Mycobacterium avium subsp. paratuberculosis
ucgccagacucacggcggca

SEQ ID NO: 786443 - RNA, 21 nt, Mycobacterium avium subsp. paratuberculosis
ucgccagacucacggcggcag

SEQ ID NO: 786444 - RNA, 18 nt, Mycobacterium avium subsp. paratuberculosis
ucgccacugggcgucggc

SEQ ID NO: 786445 - RNA, 19 nt, Mycobacterium avium subsp. paratuberculosis
ucgccacugggcgucggcg

SEQ ID NO: 786446 - RNA, 20 nt, Mycobacterium avium subsp. paratuberculosis
ucgccacugggcgucggcgc

SEQ ID NO: 786447 - RNA, 14 nt, Mycobacterium avium subsp. paratuberculosis
ucgccacucgggcg

SEQ ID NO: 786448 - RNA, 16 nt, Mycobacterium avium subsp. paratuberculosis
ucgccacucgggcggc

SEQ ID NO: 786449 - RNA, 19 nt, Mycobacterium avium subsp. paratuberculosis
ucgccacucgggcggccgc

SEQ ID NO: 786450 - RNA, 20 nt, Mycobacterium avium subsp. paratuberculosis
ucgccacucgggcggccgcg

SEQ ID NO: 786451 - RNA, 22 nt, Mycobacterium avium subsp. paratuberculosis
ucgccacggcggugucggcggc

SEQ ID NO: 786452 - RNA, 23 nt, Mycobacterium avium subsp. paratuberculosis
ucgccacggcggugucggcggca

SEQ ID NO: 786453 - RNA, 22 nt, Mycobacterium avium subsp. paratuberculosis
ucgccaccuggaagcgcaucgc

SEQ ID NO: 786454 - RNA, 15 nt, Mycobacterium avium subsp. paratuberculosis
ucgccacgccgacca

SEQ ID NO: 786455 - RNA, 13 nt, Mycobacterium avium subsp. paratuberculosis
ucgccaccgucgu

SEQ ID NO: 786456 - RNA, 15 nt, Mycobacterium avium subsp. paratuberculosis
ucgccaccgucgucg

SEQ ID NO: 786457 - RNA, 12 nt, Mycobacterium avium subsp. paratuberculosis
ucgccaccgaga

SEQ ID NO: 786458 - RNA, 22 nt, Mycobacterium avium subsp. paratuberculosis
ucgccaccgagucgcgcgacca

SEQ ID NO: 786459 - RNA, 23 nt, Mycobacterium avium subsp. paratuberculosis
ucgccaccgagucgcgcgaccag

SEQ ID NO: 786460 - RNA, 18 nt, Mycobacterium avium subsp. paratuberculosis
ucgccaccgaugcgggcc

SEQ ID NO: 786461 - RNA, 19 nt, Mycobacterium avium subsp. paratuberculosis
ucgccaccgaugcgggcca

SEQ ID NO: 786462 - RNA, 23 nt, Mycobacterium avium subsp. paratuberculosis
ucgcccucgaaguagagccgcug

SEQ ID NO: 786463 - RNA, 15 nt, Mycobacterium avium subsp. paratuberculosis
ucgcccuccccggcc

SEQ ID NO: 786464 - RNA, 17 nt, Mycobacterium avium subsp. paratuberculosis
ucgcccuccccggccag

SEQ ID NO: 786465 - RNA, 19 nt, Mycobacterium avium subsp. paratuberculosis
ucgcccuccccggccagca

SEQ ID NO: 786466 - RNA, 15 nt, Mycobacterium avium subsp. paratuberculosis
ucgcccucgaucgcg

SEQ ID NO: 786467 - RNA, 22 nt, Mycobacterium avium subsp. paratuberculosis
ucgcccucgaucgcgaccaccg

SEQ ID NO: 786468 - RNA, 20 nt, Mycobacterium avium subsp. paratuberculosis
ucgccgagcacaccgucgcc

SEQ ID NO: 786469 - RNA, 13 nt, Mycobacterium avium subsp. paratuberculosis
ucgccgagcagau

SEQ ID NO: 786470 - RNA, 17 nt, Mycobacterium avium subsp. paratuberculosis
ucgccgagccgcaccgc

SEQ ID NO: 786471 - RNA, 19 nt, Mycobacterium avium subsp. paratuberculosis
ucgccgagccgcaccgccu

SEQ ID NO: 786472 - RNA, 23 nt, Mycobacterium avium subsp. paratuberculosis
ucgccgagccgcgccacgcgcag

SEQ ID NO: 786473 - RNA, 16 nt, Mycobacterium avium subsp. paratuberculosis
ucgccgacgguggcga

SEQ ID NO: 786474 - RNA, 14 nt, Mycobacterium avium subsp. paratuberculosis
ucgccgacgguguc

SEQ ID NO: 786475 - RNA, 22 nt, Mycobacterium avium subsp. paratuberculosis
ucgccgacgguguccgcgggca

SEQ ID NO: 786476 - RNA, 23 nt, Mycobacterium avium subsp. paratuberculosis
ucgccgacgguguccgcgggcag

SEQ ID NO: 786477 - RNA, 21 nt, Mycobacterium avium subsp. paratuberculosis
ucgccgacguagacgagccgg

SEQ ID NO: 786478 - RNA, 15 nt, Mycobacterium avium subsp. paratuberculosis
ucgccgacgucuggu

SEQ ID NO: 786479 - RNA, 24 nt, Mycobacterium avium subsp. paratuberculosis
ucgccgacgucugguuggccggcg

SEQ ID NO: 786480 - RNA, 18 nt, Mycobacterium avium subsp. paratuberculosis
ucgcccgguaggccgccg

SEQ ID NO: 786481 - RNA, 22 nt, Mycobacterium avium subsp. paratuberculosis
ucgcccgguaggccgccgcgac

SEQ ID NO: 786482 - RNA, 17 nt, Mycobacterium avium subsp. paratuberculosis
ucgcccgguccaucccg

SEQ ID NO: 786483 - RNA, 17 nt, Mycobacterium avium subsp. paratuberculosis
ucgcccgucucggcgug

SEQ ID NO: 786484 - RNA, 14 nt, Mycobacterium avium subsp. paratuberculosis
ucgcccgggcggcg

SEQ ID NO: 786485 - RNA, 17 nt, Mycobacterium avium subsp. paratuberculosis
ucgcccgggcggcgggg

SEQ ID NO: 786486 - RNA, 22 nt, Mycobacterium avium subsp. paratuberculosis
ucgcccgaacucauggcgugcu

SEQ ID NO: 786487 - RNA, 23 nt, Mycobacterium avium subsp. paratuberculosis
ucgcccgggcuaucgcccggcgc

SEQ ID NO: 786488 - RNA, 13 nt, Mycobacterium avium subsp. paratuberculosis
ucgcccggcggca

SEQ ID NO: 786489 - RNA, 23 nt, Mycobacterium avium subsp. paratuberculosis
ucgcccggcucgaaguggcagcg

SEQ ID NO: 786490 - RNA, 13 nt, Mycobacterium avium subsp. paratuberculosis
ucgcccggcucgc

SEQ ID NO: 786491 - RNA, 17 nt, Mycobacterium avium subsp. paratuberculosis
ucgcccggcucgccggg

SEQ ID NO: 786492 - RNA, 20 nt, Mycobacterium avium subsp. paratuberculosis
ucgcccggcugcgccgcgcu

SEQ ID NO: 786493 - RNA, 12 nt, Mycobacterium avium subsp. paratuberculosis
ucgcccgggcca

SEQ ID NO: 786494 - RNA, 19 nt, Mycobacterium avium subsp. paratuberculosis
ucgcccgggccaggucggu

SEQ ID NO: 786495 - RNA, 21 nt, Mycobacterium avium subsp. paratuberculosis
ucgcccgggccaggucgguga

SEQ ID NO: 786496 - RNA, 19 nt, Mycobacterium avium subsp. paratuberculosis
ucgccgccaacgcgaacgg

SEQ ID NO: 786497 - RNA, 19 nt, Mycobacterium avium subsp. paratuberculosis
ucgccgccaucgccgccgc

SEQ ID NO: 786498 - RNA, 20 nt, Mycobacterium avium subsp. paratuberculosis
ucgccgagcgcaucgacugc

SEQ ID NO: 786499 - RNA, 12 nt, Mycobacterium avium subsp. paratuberculosis
ucgccgagcucg

SEQ ID NO: 786500 - RNA, 17 nt, Mycobacterium avium subsp. paratuberculosis
ucgccgagcucgugaug

SEQ ID NO: 786501 - RNA, 18 nt, Mycobacterium avium subsp. paratuberculosis
ucgccgaggaaccggcag

SEQ ID NO: 786502 - RNA, 19 nt, Mycobacterium avium subsp. paratuberculosis
ucgccgaggaaccggcagc

SEQ ID NO: 786503 - RNA, 16 nt, Mycobacterium avium subsp. paratuberculosis
ucgccgagggcgacga

SEQ ID NO: 786504 - RNA, 17 nt, Mycobacterium avium subsp. paratuberculosis
ucgccgagggcgacgau

SEQ ID NO: 786505 - RNA, 17 nt, Mycobacterium avium subsp. paratuberculosis
ucgccgagguagccgcg

SEQ ID NO: 786506 - RNA, 16 nt, Mycobacterium avium subsp. paratuberculosis
ucgccgagguccucga

SEQ ID NO: 786507 - RNA, 19 nt, Mycobacterium avium subsp. paratuberculosis
ucgccgagguccucgaccu

SEQ ID NO: 786508 - RNA, 23 nt, Mycobacterium avium subsp. paratuberculosis
ucgccgcacgcccacagcugacg

SEQ ID NO: 786509 - RNA, 21 nt, Mycobacterium avium subsp. paratuberculosis
ucgcccaucaccgcaccgacg

SEQ ID NO: 786510 - RNA, 14 nt, Mycobacterium avium subsp. paratuberculosis
ucgccaucagcagc

SEQ ID NO: 786511 - RNA, 23 nt, Mycobacterium avium subsp. paratuberculosis
ucgccaguugcacuuucggcagc

SEQ ID NO: 786512 - RNA, 21 nt, Mycobacterium avium subsp. paratuberculosis
ucgccaguccggcgccgaccc

SEQ ID NO: 786513 - RNA, 22 nt, Mycobacterium avium subsp. paratuberculosis
ucgccaguccggcgccgacccc

SEQ ID NO: 786514 - RNA, 21 nt, Mycobacterium avium subsp. paratuberculosis
ucgccagugccgcgcggacgc

SEQ ID NO: 786515 - RNA, 23 nt, Mycobacterium avium subsp. paratuberculosis
ucgccccgcuggaacgccgagga

SEQ ID NO: 786516 - RNA, 15 nt, Mycobacterium avium subsp. paratuberculosis
ucgccccggccgcgg

SEQ ID NO: 786517 - RNA, 13 nt, Mycobacterium avium subsp. paratuberculosis
ucgccccggcgac

SEQ ID NO: 786518 - RNA, 17 nt, Mycobacterium avium subsp. paratuberculosis
ucgccccggcgacgucg

SEQ ID NO: 786519 - RNA, 22 nt, Mycobacterium avium subsp. paratuberculosis
ucgccccggcgacgucgccggc

SEQ ID NO: 786520 - RNA, 13 nt, Mycobacterium avium subsp. paratuberculosis
ucgcccccucggc

SEQ ID NO: 786521 - RNA, 12 nt, Mycobacterium avium subsp. paratuberculosis
ucgccagccgcc

SEQ ID NO: 786522 - RNA, 13 nt, Mycobacterium avium subsp. paratuberculosis
ucgccagccgccg

SEQ ID NO: 786523 - RNA, 16 nt, Mycobacterium avium subsp. paratuberculosis
ucgccagccgccggcu

SEQ ID NO: 786524 - RNA, 17 nt, Mycobacterium avium subsp. paratuberculosis
ucgccagcaccgugcug

SEQ ID NO: 786525 - RNA, 13 nt, Mycobacterium avium subsp. paratuberculosis
ucgccagcccggc

SEQ ID NO: 786526 - RNA, 15 nt, Mycobacterium avium subsp. paratuberculosis
ucgccagcgccacgc

SEQ ID NO: 786527 - RNA, 16 nt, Mycobacterium avium subsp. paratuberculosis
ucgccagcgccacgcu

SEQ ID NO: 786528 - RNA, 13 nt, Mycobacterium avium subsp. paratuberculosis
ucgccagcgcggu

SEQ ID NO: 786529 - RNA, 20 nt, Mycobacterium avium subsp. paratuberculosis
ucgccagcgcggugucgacg

SEQ ID NO: 786530 - RNA, 21 nt, Mycobacterium avium subsp. paratuberculosis
ucgccagcgcggugucgacgu

SEQ ID NO: 786531 - RNA, 21 nt, Mycobacterium avium subsp. paratuberculosis
ucgccaggaaccacaccccgg

SEQ ID NO: 786532 - RNA, 16 nt, Mycobacterium avium subsp. paratuberculosis
ucgccagcgggccgac

SEQ ID NO: 786533 - RNA, 18 nt, Mycobacterium avium subsp. paratuberculosis
ucgccagcgggccgaccu

SEQ ID NO: 786534 - RNA, 19 nt, Mycobacterium avium subsp. paratuberculosis
ucgccagcgggccgaccug

SEQ ID NO: 786535 - RNA, 13 nt, Mycobacterium avium subsp. paratuberculosis
ucgccgugcggcg

SEQ ID NO: 786536 - RNA, 17 nt, Mycobacterium avium subsp. paratuberculosis
ucgccguggcggcccga

SEQ ID NO: 786537 - RNA, 18 nt, Mycobacterium avium subsp. paratuberculosis
ucgccgugcagcaccucg

SEQ ID NO: 786538 - RNA, 19 nt, Mycobacterium avium subsp. paratuberculosis
ucgccgugcagcaccucga

SEQ ID NO: 786539 - RNA, 21 nt, Mycobacterium avium subsp. paratuberculosis
ucgccgugccggaccgcgcgg

SEQ ID NO: 786540 - RNA, 21 nt, Mycobacterium avium subsp. paratuberculosis
ucgccgugagauccagcagcc

SEQ ID NO: 786541 - RNA, 22 nt, Mycobacterium avium subsp. paratuberculosis
ucgccgugagauccagcagcca

SEQ ID NO: 786542 - RNA, 20 nt, Mycobacterium avium subsp. paratuberculosis
ucgccgucgugguggccgcg

SEQ ID NO: 786543 - RNA, 16 nt, Mycobacterium avium subsp. paratuberculosis
ucgccggucagcacgu

SEQ ID NO: 786544 - RNA, 14 nt, Mycobacterium avium subsp. paratuberculosis
ucgccggucagcgc

SEQ ID NO: 786545 - RNA, 15 nt, Mycobacterium avium subsp. paratuberculosis
ucgccggucagcgca

SEQ ID NO: 786546 - RNA, 23 nt, Mycobacterium avium subsp. paratuberculosis
ucgccggucugguacccgauggu

SEQ ID NO: 786547 - RNA, 16 nt, Mycobacterium avium subsp. paratuberculosis
ucgccgucggccagca

SEQ ID NO: 786548 - RNA, 14 nt, Mycobacterium avium subsp. paratuberculosis
ucgccgucgccgca

SEQ ID NO: 786549 - RNA, 18 nt, Mycobacterium avium subsp. paratuberculosis
ucgccgucgccgcacgcc

SEQ ID NO: 786550 - RNA, 13 nt, Mycobacterium avium subsp. paratuberculosis
ucgccgucgcgau

SEQ ID NO: 786551 - RNA, 14 nt, Mycobacterium avium subsp. paratuberculosis
ucgccgucgcgauc

SEQ ID NO: 786552 - RNA, 19 nt, Mycobacterium avium subsp. paratuberculosis
ucgccgucgcgggugggga

SEQ ID NO: 786553 - RNA, 23 nt, Mycobacterium avium subsp. paratuberculosis
ucgccggggccuucuuggcggcg

SEQ ID NO: 786554 - RNA, 15 nt, Mycobacterium avium subsp. paratuberculosis
ucgccggugaccgcg

SEQ ID NO: 786555 - RNA, 12 nt, Mycobacterium avium subsp. paratuberculosis
ucgccgucgggg

SEQ ID NO: 786556 - RNA, 17 nt, Mycobacterium avium subsp. paratuberculosis
ucgccugauacgacguc

SEQ ID NO: 786557 - RNA, 18 nt, Mycobacterium avium subsp. paratuberculosis
ucgccugauacgacgucc

SEQ ID NO: 786558 - RNA, 18 nt, Mycobacterium avium subsp. paratuberculosis
ucgccugagcaaccgguu

SEQ ID NO: 786559 - RNA, 22 nt, Mycobacterium avium subsp. paratuberculosis
ucgccugcacgaaauaaccgcg

SEQ ID NO: 786560 - RNA, 15 nt, Mycobacterium avium subsp. paratuberculosis
ucgccugcagccgcc

SEQ ID NO: 786561 - RNA, 24 nt, Mycobacterium avium subsp. paratuberculosis
ucgccugcagccgccgcgccaccg

SEQ ID NO: 786562 - RNA, 12 nt, Mycobacterium avium subsp. paratuberculosis
ucgccucguccc

SEQ ID NO: 786563 - RNA, 12 nt, Mycobacterium avium subsp. paratuberculosis
ucgccucggcgu

SEQ ID NO: 786564 - RNA, 21 nt, Mycobacterium avium subsp. paratuberculosis
ucgccucggggaucgccaggc

SEQ ID NO: 786565 - RNA, 23 nt, Mycobacterium avium subsp. paratuberculosis
ucgccucggucgcgugaccggcg

SEQ ID NO: 786566 - RNA, 19 nt, Mycobacterium avium subsp. paratuberculosis
ucgccucggaggccaccgc

SEQ ID NO: 786567 - RNA, 19 nt, Mycobacterium avium subsp. paratuberculosis
ucgccucggcggccgcccg

SEQ ID NO: 786568 - RNA, 22 nt, Mycobacterium avium subsp. paratuberculosis
ucgccucaggcugacgccacgc

SEQ ID NO: 786569 - RNA, 19 nt, Mycobacterium avium subsp. paratuberculosis
ucgccguuuugccgccgag

SEQ ID NO: 786570 - RNA, 15 nt, Mycobacterium avium subsp. paratuberculosis
ucgccguugccggcc

SEQ ID NO: 786571 - RNA, 16 nt, Mycobacterium avium subsp. paratuberculosis
ucgccguugccggccc

SEQ ID NO: 786572 - RNA, 20 nt, Mycobacterium avium subsp. paratuberculosis
ucgccguugcgggucggcgu

SEQ ID NO: 786573 - RNA, 22 nt, Mycobacterium avium subsp. paratuberculosis
ucgccguuggucugcgcgagca

SEQ ID NO: 786574 - RNA, 23 nt, Mycobacterium avium subsp. paratuberculosis
ucgccguuggucugcgcgagcag

SEQ ID NO: 786575 - RNA, 19 nt, Mycobacterium avium subsp. paratuberculosis
ucgccuccugcuggcgcug

SEQ ID NO: 786576 - RNA, 13 nt, Mycobacterium avium subsp. paratuberculosis
ucgccucgaccag

SEQ ID NO: 786577 - RNA, 14 nt, Mycobacterium avium subsp. paratuberculosis
ucgccucgaccagc

SEQ ID NO: 786578 - RNA, 22 nt, Mycobacterium avium subsp. paratuberculosis
ucgccuccgggaaggcggccgc

SEQ ID NO: 786579 - RNA, 16 nt, Mycobacterium avium subsp. paratuberculosis
ucgccuccgucagcgc

SEQ ID NO: 786580 - RNA, 15 nt, Mycobacterium avium subsp. paratuberculosis
ucgccucggccacca

SEQ ID NO: 786581 - RNA, 23 nt, Mycobacterium avium subsp. paratuberculosis
ucgccucggccaccagaugccgg

SEQ ID NO: 786582 - RNA, 13 nt, Mycobacterium avium subsp. paratuberculosis
ucgccucggccgc

SEQ ID NO: 786583 - RNA, 21 nt, Mycobacterium avium subsp. paratuberculosis
ucgccucggccuuggccaccg

SEQ ID NO: 786584 - RNA, 17 nt, Mycobacterium avium subsp. paratuberculosis
ucgccggggacgacggc

SEQ ID NO: 786585 - RNA, 21 nt, Mycobacterium avium subsp. paratuberculosis
ucgccgggucuuccacgccgg

SEQ ID NO: 786586 - RNA, 15 nt, Mycobacterium avium subsp. paratuberculosis
ucgccggggucgcgc

SEQ ID NO: 786587 - RNA, 15 nt, Mycobacterium avium subsp. paratuberculosis
ucgccgguaccgccg

SEQ ID NO: 786588 - RNA, 16 nt, Mycobacterium avium subsp. paratuberculosis
ucgccgguaccgccgg

SEQ ID NO: 786589 - RNA, 18 nt, Mycobacterium avium subsp. paratuberculosis
ucgccgggcuggccgucg

SEQ ID NO: 786590 - RNA, 23 nt, Mycobacterium avium subsp. paratuberculosis
ucgccgggcuggccgucggcgau

SEQ ID NO: 786591 - RNA, 13 nt, Mycobacterium avium subsp. paratuberculosis
ucgccgggccggc

SEQ ID NO: 786592 - RNA, 15 nt, Mycobacterium avium subsp. paratuberculosis
ucgccgggccggccg

SEQ ID NO: 786593 - RNA, 16 nt, Mycobacterium avium subsp. paratuberculosis
ucgccggccgcgggcg

SEQ ID NO: 786594 - RNA, 14 nt, Mycobacterium avium subsp. paratuberculosis
ucgccggccgggcg

SEQ ID NO: 786595 - RNA, 14 nt, Mycobacterium avium subsp. paratuberculosis
ucgccggcccgacc

SEQ ID NO: 786596 - RNA, 18 nt, Mycobacterium avium subsp. paratuberculosis
ucgccggccugcccgccg

SEQ ID NO: 786597 - RNA, 18 nt, Mycobacterium avium subsp. paratuberculosis
ucgccggccgccagcgcc

SEQ ID NO: 786598 - RNA, 16 nt, Mycobacterium avium subsp. paratuberculosis
ucgccggccgccgugg

SEQ ID NO: 786599 - RNA, 22 nt, Mycobacterium avium subsp. paratuberculosis
ucgccggccgccguggcccacg

SEQ ID NO: 786600 - RNA, 16 nt, Mycobacterium avium subsp. paratuberculosis
ucgccggccagcacgc

SEQ ID NO: 786601 - RNA, 17 nt, Mycobacterium avium subsp. paratuberculosis
ucgccggccagcacgcc

SEQ ID NO: 786602 - RNA, 20 nt, Mycobacterium avium subsp. paratuberculosis
ucgccggccagcacgccguc

SEQ ID NO: 786603 - RNA, 16 nt, Mycobacterium avium subsp. paratuberculosis
ucgccgccgccgaucu

SEQ ID NO: 786604 - RNA, 19 nt, Mycobacterium avium subsp. paratuberculosis
ucgccgccgcgcaccgcgc

SEQ ID NO: 786605 - RNA, 16 nt, Mycobacterium avium subsp. paratuberculosis
ucgccgccgggcgcca

SEQ ID NO: 786606 - RNA, 17 nt, Mycobacterium avium subsp. paratuberculosis
ucgccgccgggcgccac

SEQ ID NO: 786607 - RNA, 22 nt, Mycobacterium avium subsp. paratuberculosis
ucgccgcccccgauagccccgc

SEQ ID NO: 786608 - RNA, 15 nt, Mycobacterium avium subsp. paratuberculosis
ucgccgccccgaguu

SEQ ID NO: 786609 - RNA, 16 nt, Mycobacterium avium subsp. paratuberculosis
ucgccgccagcacgug

SEQ ID NO: 786610 - RNA, 18 nt, Mycobacterium avium subsp. paratuberculosis
ucgccgcccaucggcagc

SEQ ID NO: 786611 - RNA, 21 nt, Mycobacterium avium subsp. paratuberculosis
ucgccgcccgggccgcgccca

SEQ ID NO: 786612 - RNA, 13 nt, Mycobacterium avium subsp. paratuberculosis
ucgccgccgacga

SEQ ID NO: 786613 - RNA, 13 nt, Mycobacterium avium subsp. paratuberculosis
ucgccgccgcacc

SEQ ID NO: 786614 - RNA, 16 nt, Mycobacterium avium subsp. paratuberculosis
ucgccgccgcaccggc

SEQ ID NO: 786615 - RNA, 12 nt, Mycobacterium avium subsp. paratuberculosis
ucgccgccgcca

SEQ ID NO: 786616 - RNA, 13 nt, Mycobacterium avium subsp. paratuberculosis
ucgccgccgccag

SEQ ID NO: 786617 - RNA, 21 nt, Mycobacterium avium subsp. paratuberculosis
ucgccgccgccagcaccaccg

SEQ ID NO: 786618 - RNA, 17 nt, Mycobacterium avium subsp. paratuberculosis
ucgccuuguuggcccac

SEQ ID NO: 786619 - RNA, 15 nt, Mycobacterium avium subsp. paratuberculosis
ucgcgaacgcgccgg

SEQ ID NO: 786620 - RNA, 16 nt, Mycobacterium avium subsp. paratuberculosis
ucgcgaacgcgccggu

SEQ ID NO: 786621 - RNA, 16 nt, Mycobacterium avium subsp. paratuberculosis
ucgccugcuggacguu

SEQ ID NO: 786622 - RNA, 21 nt, Mycobacterium avium subsp. paratuberculosis
ucgccugcuucuggaugcggu

SEQ ID NO: 786623 - RNA, 16 nt, Mycobacterium avium subsp. paratuberculosis
ucgccuguccgaccag

SEQ ID NO: 786624 - RNA, 17 nt, Mycobacterium avium subsp. paratuberculosis
ucgccuguccgaccagc

SEQ ID NO: 786625 - RNA, 17 nt, Mycobacterium avium subsp. paratuberculosis
ucgcgcaccuggucggu

SEQ ID NO: 786626 - RNA, 16 nt, Mycobacterium avium subsp. paratuberculosis
ucgcgcacgccaucgc

SEQ ID NO: 786627 - RNA, 17 nt, Mycobacterium avium subsp. paratuberculosis
ucgcgcacccagccgca

SEQ ID NO: 786628 - RNA, 12 nt, Mycobacterium avium subsp. paratuberculosis
ucgcgcacccgc

SEQ ID NO: 786629 - RNA, 16 nt, Mycobacterium avium subsp. paratuberculosis
ucgcgcaccgggacca

SEQ ID NO: 786630 - RNA, 18 nt, Mycobacterium avium subsp. paratuberculosis
ucgcgcacgcuggccggc

SEQ ID NO: 786631 - RNA, 22 nt, Mycobacterium avium subsp. paratuberculosis
ucgcgcacgcuggccggcagcg

SEQ ID NO: 786632 - RNA, 15 nt, Mycobacterium avium subsp. paratuberculosis
ucgcgcaccagggcc

SEQ ID NO: 786633 - RNA, 23 nt, Mycobacterium avium subsp. paratuberculosis
ucgcgcaccagggccugcagcac

SEQ ID NO: 786634 - RNA, 21 nt, Mycobacterium avium subsp. paratuberculosis
ucgcgcaaugccgccgcgacg

SEQ ID NO: 786635 - RNA, 22 nt, Mycobacterium avium subsp. paratuberculosis
ucgcgcaaugccgccgcgacga

SEQ ID NO: 786636 - RNA, 23 nt, Mycobacterium avium subsp. paratuberculosis
ucgcgcaaugccgccgcgacgau

SEQ ID NO: 786637 - RNA, 16 nt, Mycobacterium avium subsp. paratuberculosis
ucgcgaagaacgacgc

SEQ ID NO: 786638 - RNA, 20 nt, Mycobacterium avium subsp. paratuberculosis
ucgccuuggcucgggccaua

SEQ ID NO: 786639 - RNA, 22 nt, Mycobacterium avium subsp. paratuberculosis
ucgcgaagaccagcgugucgcc

SEQ ID NO: 786640 - RNA, 23 nt, Mycobacterium avium subsp. paratuberculosis
ucgcgaagaccagcgugucgccg

SEQ ID NO: 786641 - RNA, 19 nt, Mycobacterium avium subsp. paratuberculosis
ucgcgaagacgcuggccac

SEQ ID NO: 786642 - RNA, 18 nt, Mycobacterium avium subsp. paratuberculosis
ucgcgaagcgcgaugcgg

SEQ ID NO: 786643 - RNA, 23 nt, Mycobacterium avium subsp. paratuberculosis
ucgcgaagcguaugccgguggcg

SEQ ID NO: 786644 - RNA, 21 nt, Mycobacterium avium subsp. paratuberculosis
ucgcgauuggccucgagugcc

SEQ ID NO: 786645 - RNA, 12 nt, Mycobacterium avium subsp. paratuberculosis
ucgcgcagcguc

SEQ ID NO: 786646 - RNA, 18 nt, Mycobacterium avium subsp. paratuberculosis
ucgcgcagcgcgucgggc

SEQ ID NO: 786647 - RNA, 20 nt, Mycobacterium avium subsp. paratuberculosis
ucgcgcagcugcgccgcguc

SEQ ID NO: 786648 - RNA, 17 nt, Mycobacterium avium subsp. paratuberculosis
ucgcgcagcuggccgug

SEQ ID NO: 786649 - RNA, 23 nt, Mycobacterium avium subsp. paratuberculosis
ucgcgcaggaacagcgacccgaa

SEQ ID NO: 786650 - RNA, 21 nt, Mycobacterium avium subsp. paratuberculosis
ucgcgcaggaacuccagcagc

SEQ ID NO: 786651 - RNA, 19 nt, Mycobacterium avium subsp. paratuberculosis
ucgcgcaggaugcccagca

SEQ ID NO: 786652 - RNA, 21 nt, Mycobacterium avium subsp. paratuberculosis
ucgcgcaggaugcccagcacc

SEQ ID NO: 786653 - RNA, 23 nt, Mycobacterium avium subsp. paratuberculosis
ucgcgcagggccagcgccucggc

SEQ ID NO: 786654 - RNA, 14 nt, Mycobacterium avium subsp. paratuberculosis
ucgcgccgggcggc

SEQ ID NO: 786655 - RNA, 20 nt, Mycobacterium avium subsp. paratuberculosis
ucgcgccgguaggcggccag

SEQ ID NO: 786656 - RNA, 13 nt, Mycobacterium avium subsp. paratuberculosis
ucgcgccggccgc

SEQ ID NO: 786657 - RNA, 15 nt, Mycobacterium avium subsp. paratuberculosis
ucgcgccggccgccg

SEQ ID NO: 786658 - RNA, 12 nt, Mycobacterium avium subsp. paratuberculosis
ucgcgccgcucg

SEQ ID NO: 786659 - RNA, 14 nt, Mycobacterium avium subsp. paratuberculosis
ucgcgccgcucggc

SEQ ID NO: 786660 - RNA, 16 nt, Mycobacterium avium subsp. paratuberculosis
ucgcgccgcucggcca

SEQ ID NO: 786661 - RNA, 17 nt, Mycobacterium avium subsp. paratuberculosis
ucgcgccgcucggccag

SEQ ID NO: 786662 - RNA, 19 nt, Mycobacterium avium subsp. paratuberculosis
ucgcgccgcucggccagca

SEQ ID NO: 786663 - RNA, 20 nt, Mycobacterium avium subsp. paratuberculosis
ucgcgccgcgaucucggcgg

SEQ ID NO: 786664 - RNA, 19 nt, Mycobacterium avium subsp. paratuberculosis
ucgcgcaggucgggccggc

SEQ ID NO: 786665 - RNA, 19 nt, Mycobacterium avium subsp. paratuberculosis
ucgcgcaggugaugcggcc

SEQ ID NO: 786666 - RNA, 18 nt, Mycobacterium avium subsp. paratuberculosis
ucgcgcaucacccggcgc

SEQ ID NO: 786667 - RNA, 19 nt, Mycobacterium avium subsp. paratuberculosis
ucgcgcaucacccggcgcg

SEQ ID NO: 786668 - RNA, 20 nt, Mycobacterium avium subsp. paratuberculosis
ucgcgcaucacccggcgcgc

SEQ ID NO: 786669 - RNA, 14 nt, Mycobacterium avium subsp. paratuberculosis
ucgcgcaucgccuc

SEQ ID NO: 786670 - RNA, 17 nt, Mycobacterium avium subsp. paratuberculosis
ucgcgcaucgccucggc

SEQ ID NO: 786671 - RNA, 20 nt, Mycobacterium avium subsp. paratuberculosis
ucgcgcaucgccucggcggc

SEQ ID NO: 786672 - RNA, 23 nt, Mycobacterium avium subsp. paratuberculosis
ucgcgccgagguggccgccagca

SEQ ID NO: 786673 - RNA, 17 nt, Mycobacterium avium subsp. paratuberculosis
ucgcgccgccacgcggc

SEQ ID NO: 786674 - RNA, 14 nt, Mycobacterium avium subsp. paratuberculosis
ucgcgccgccagca

SEQ ID NO: 786675 - RNA, 19 nt, Mycobacterium avium subsp. paratuberculosis
ucgcgcucccggcgccgcc

SEQ ID NO: 786676 - RNA, 13 nt, Mycobacterium avium subsp. paratuberculosis
ucgcgcucgucca

SEQ ID NO: 786677 - RNA, 21 nt, Mycobacterium avium subsp. paratuberculosis
ucgcgcucuugggcggccggc

SEQ ID NO: 786678 - RNA, 13 nt, Mycobacterium avium subsp. paratuberculosis
ucgcgcugaccag

SEQ ID NO: 786679 - RNA, 16 nt, Mycobacterium avium subsp. paratuberculosis
ucgcgcugccagggcc

SEQ ID NO: 786680 - RNA, 20 nt, Mycobacterium avium subsp. paratuberculosis
ucgcgcugccgcgcgccgac

SEQ ID NO: 786681 - RNA, 22 nt, Mycobacterium avium subsp. paratuberculosis
ucgcgcugccgcgcgccgacag

SEQ ID NO: 786682 - RNA, 17 nt, Mycobacterium avium subsp. paratuberculosis
ucgcgcugccggcccga

SEQ ID NO: 786683 - RNA, 13 nt, Mycobacterium avium subsp. paratuberculosis
ucgcgcgcacuuc

SEQ ID NO: 786684 - RNA, 14 nt, Mycobacterium avium subsp. paratuberculosis
ucgcgcuaggacgc

SEQ ID NO: 786685 - RNA, 19 nt, Mycobacterium avium subsp. paratuberculosis
ucgcgcuaggacgcgggcc

SEQ ID NO: 786686 - RNA, 16 nt, Mycobacterium avium subsp. paratuberculosis
ucgcgccugcaccggc

SEQ ID NO: 786687 - RNA, 19 nt, Mycobacterium avium subsp. paratuberculosis
ucgcgccugcaccggcgac

SEQ ID NO: 786688 - RNA, 18 nt, Mycobacterium avium subsp. paratuberculosis
ucgcgcgaacagccgacc

SEQ ID NO: 786689 - RNA, 19 nt, Mycobacterium avium subsp. paratuberculosis
ucgcgcgaacagccgaccg

SEQ ID NO: 786690 - RNA, 15 nt, Mycobacterium avium subsp. paratuberculosis
ucgcgccggagccgg

SEQ ID NO: 786691 - RNA, 13 nt, Mycobacterium avium subsp. paratuberculosis
ucgcgccgcggcg

SEQ ID NO: 786692 - RNA, 18 nt, Mycobacterium avium subsp. paratuberculosis
ucuaacuccgcucgggcc

SEQ ID NO: 786693 - RNA, 18 nt, Mycobacterium avium subsp. paratuberculosis
ucucaggaauuugcggcc

SEQ ID NO: 786694 - RNA, 13 nt, Mycobacterium avium subsp. paratuberculosis
ucucagcggcgcu

SEQ ID NO: 786695 - RNA, 21 nt, Mycobacterium avium subsp. paratuberculosis
ucucagcguucacgucgauca

SEQ ID NO: 786696 - RNA, 23 nt, Mycobacterium avium subsp. paratuberculosis
ucucaggcguggguuccgccguc

SEQ ID NO: 786697 - RNA, 14 nt, Mycobacterium avium subsp. paratuberculosis
ucucagucggccac

SEQ ID NO: 786698 - RNA, 12 nt, Mycobacterium avium subsp. paratuberculosis
ucuccagccgcg

SEQ ID NO: 786699 - RNA, 13 nt, Mycobacterium avium subsp. paratuberculosis
ucuccaccgcgcg

SEQ ID NO: 786700 - RNA, 23 nt, Mycobacterium avium subsp. paratuberculosis
ucuccaacugcauuucggacggc

SEQ ID NO: 786701 - RNA, 12 nt, Mycobacterium avium subsp. paratuberculosis
ucguuggcggcg

SEQ ID NO: 786702 - RNA, 17 nt, Mycobacterium avium subsp. paratuberculosis
ucguugucgucgccggc

SEQ ID NO: 786703 - RNA, 22 nt, Mycobacterium avium subsp. paratuberculosis
ucguugugaauccagccgugcg

SEQ ID NO: 786704 - RNA, 24 nt, Mycobacterium avium subsp. paratuberculosis
ucguugugcauguggccgucgccg

SEQ ID NO: 786705 - RNA, 19 nt, Mycobacterium avium subsp. paratuberculosis
ucguggaaaucgagcgcgc

SEQ ID NO: 786706 - RNA, 14 nt, Mycobacterium avium subsp. paratuberculosis
ucguggaacgacgc

SEQ ID NO: 786707 - RNA, 16 nt, Mycobacterium avium subsp. paratuberculosis
ucgugcugggccgggc

SEQ ID NO: 786708 - RNA, 23 nt, Mycobacterium avium subsp. paratuberculosis
ucgugcuguggaacacgucggcg

SEQ ID NO: 786709 - RNA, 23 nt, Mycobacterium avium subsp. paratuberculosis
ucgugcucgagcaucucggugcc

SEQ ID NO: 786710 - RNA, 16 nt, Mycobacterium avium subsp. paratuberculosis
ucgugcucggcgagca

SEQ ID NO: 786711 - RNA, 15 nt, Mycobacterium avium subsp. paratuberculosis
ucgugcucgucggcg

SEQ ID NO: 786712 - RNA, 21 nt, Mycobacterium avium subsp. paratuberculosis
ucguggcgacaucgccgcggc

SEQ ID NO: 786713 - RNA, 18 nt, Mycobacterium avium subsp. paratuberculosis
ucguggauguugucgugg

SEQ ID NO: 786714 - RNA, 17 nt, Mycobacterium avium subsp. paratuberculosis
ucguggacgaacgcggc

SEQ ID NO: 786715 - RNA, 22 nt, Mycobacterium avium subsp. paratuberculosis
ucguggacgaacgcggcgaaca

SEQ ID NO: 786716 - RNA, 15 nt, Mycobacterium avium subsp. paratuberculosis
ucgugggcgccgucg

SEQ ID NO: 786717 - RNA, 24 nt, Mycobacterium avium subsp. paratuberculosis
ucgugguaccggcgccaggccggc

SEQ ID NO: 786718 - RNA, 15 nt, Mycobacterium avium subsp. paratuberculosis
ucguugcgggcggcg

SEQ ID NO: 786719 - RNA, 20 nt, Mycobacterium avium subsp. paratuberculosis
ucguugcgggcggcgcggcg

SEQ ID NO: 786720 - RNA, 15 nt, Mycobacterium avium subsp. paratuberculosis
ucguggcugaacagc

SEQ ID NO: 786721 - RNA, 16 nt, Mycobacterium avium subsp. paratuberculosis
ucguggcuuucggcgc

SEQ ID NO: 786722 - RNA, 19 nt, Mycobacterium avium subsp. paratuberculosis
ucguggggcucagccgaag

SEQ ID NO: 786723 - RNA, 17 nt, Mycobacterium avium subsp. paratuberculosis
ucgugggaaugcggcug

SEQ ID NO: 786724 - RNA, 17 nt, Mycobacterium avium subsp. paratuberculosis
ucgugggcaacacgucg

SEQ ID NO: 786725 - RNA, 20 nt, Mycobacterium avium subsp. paratuberculosis
ucgugaugguccagcaccgg

SEQ ID NO: 786726 - RNA, 23 nt, Mycobacterium avium subsp. paratuberculosis
ucgugaugguccagcaccggcgc

SEQ ID NO: 786727 - RNA, 16 nt, Mycobacterium avium subsp. paratuberculosis
ucgugaucgcccaccu

SEQ ID NO: 786728 - RNA, 16 nt, Mycobacterium avium subsp. paratuberculosis
ucgugcaacucccgcg

SEQ ID NO: 786729 - RNA, 15 nt, Mycobacterium avium subsp. paratuberculosis
ucgugcaaggccugc

SEQ ID NO: 786730 - RNA, 21 nt, Mycobacterium avium subsp. paratuberculosis
ucgugcacaugcccgucgggc

SEQ ID NO: 786731 - RNA, 20 nt, Mycobacterium avium subsp. paratuberculosis
ucgugcaccacgacgucgag

SEQ ID NO: 786732 - RNA, 14 nt, Mycobacterium avium subsp. paratuberculosis
ucgugcagccggcg

SEQ ID NO: 786733 - RNA, 14 nt, Mycobacterium avium subsp. paratuberculosis
ucgugcaucggcgc

SEQ ID NO: 786734 - RNA, 14 nt, Mycobacterium avium subsp. paratuberculosis
ucgugcacgccgug

SEQ ID NO: 786735 - RNA, 20 nt, Mycobacterium avium subsp. paratuberculosis
ucgugcacgccguggcggcg

SEQ ID NO: 786736 - RNA, 19 nt, Mycobacterium avium subsp. paratuberculosis
ucgugcagcaccgccagca

SEQ ID NO: 786737 - RNA, 23 nt, Mycobacterium avium subsp. paratuberculosis
ucgugccgcacccgauccacggc

SEQ ID NO: 786738 - RNA, 14 nt, Mycobacterium avium subsp. paratuberculosis
ucgugcggccggcg

SEQ ID NO: 786739 - RNA, 13 nt, Mycobacterium avium subsp. paratuberculosis
ucgugcggcgccg

SEQ ID NO: 786740 - RNA, 13 nt, Mycobacterium avium subsp. paratuberculosis
ucgugcggcugcc

SEQ ID NO: 786741 - RNA, 19 nt, Mycobacterium avium subsp. paratuberculosis
ucgugcgggaugccgagca

SEQ ID NO: 786742 - RNA, 21 nt, Mycobacterium avium subsp. paratuberculosis
ucgugcgcccauccggcgccg

SEQ ID NO: 786743 - RNA, 20 nt, Mycobacterium avium subsp. paratuberculosis
ucgugacgcggcgucgggcg

SEQ ID NO: 786744 - RNA, 15 nt, Mycobacterium avium subsp. paratuberculosis
ucgugaccgaccucc

SEQ ID NO: 786745 - RNA, 15 nt, Mycobacterium avium subsp. paratuberculosis
ucgugaagccggugg

SEQ ID NO: 786746 - RNA, 23 nt, Mycobacterium avium subsp. paratuberculosis
ucgugaccaaugcggugaacgcg

SEQ ID NO: 786747 - RNA, 15 nt, Mycobacterium avium subsp. paratuberculosis
ucgucuuccgcggcg

SEQ ID NO: 786748 - RNA, 18 nt, Mycobacterium avium subsp. paratuberculosis
ucgucuucuuggccgcgg

SEQ ID NO: 786749 - RNA, 15 nt, Mycobacterium avium subsp. paratuberculosis
ucgucuugaccgccc

SEQ ID NO: 786750 - RNA, 18 nt, Mycobacterium avium subsp. paratuberculosis
ucgucuugaccgcccggg

SEQ ID NO: 786751 - RNA, 18 nt, Mycobacterium avium subsp. paratuberculosis
ucgucguuguuggcggcg

SEQ ID NO: 786752 - RNA, 22 nt, Mycobacterium avium subsp. paratuberculosis
ucgucguuguuggcggcgguga

SEQ ID NO: 786753 - RNA, 15 nt, Mycobacterium avium subsp. paratuberculosis
ucgucuacuccacca

SEQ ID NO: 786754 - RNA, 15 nt, Mycobacterium avium subsp. paratuberculosis
ucgucuccggcggca

SEQ ID NO: 786755 - RNA, 16 nt, Mycobacterium avium subsp. paratuberculosis
ucgucuccggcggcag

SEQ ID NO: 786756 - RNA, 15 nt, Mycobacterium avium subsp. paratuberculosis
ucgucucggccgcgg

SEQ ID NO: 786757 - RNA, 15 nt, Mycobacterium avium subsp. paratuberculosis
ucgucgucggccggg

SEQ ID NO: 786758 - RNA, 18 nt, Mycobacterium avium subsp. paratuberculosis
ucgucgucggccgggccg

SEQ ID NO: 786759 - RNA, 13 nt, Mycobacterium avium subsp. paratuberculosis
ucgucgucggcgg

SEQ ID NO: 786760 - RNA, 14 nt, Mycobacterium avium subsp. paratuberculosis
ucgucgucggcggg

SEQ ID NO: 786761 - RNA, 16 nt, Mycobacterium avium subsp. paratuberculosis
ucgucgucggugaacg

SEQ ID NO: 786762 - RNA, 20 nt, Mycobacterium avium subsp. paratuberculosis
ucgucgucggugaacgccgg

SEQ ID NO: 786763 - RNA, 15 nt, Mycobacterium avium subsp. paratuberculosis
ucgucgucggugaug

SEQ ID NO: 786764 - RNA, 16 nt, Mycobacterium avium subsp. paratuberculosis
ucgucgucgucgagca

SEQ ID NO: 786765 - RNA, 21 nt, Mycobacterium avium subsp. paratuberculosis
ucgucgugcaccacgacgucg

SEQ ID NO: 786766 - RNA, 17 nt, Mycobacterium avium subsp. paratuberculosis
ucgucgugcgcgggcga

SEQ ID NO: 786767 - RNA, 17 nt, Mycobacterium avium subsp. paratuberculosis
ucguccagggacuccgg

SEQ ID NO: 786768 - RNA, 15 nt, Mycobacterium avium subsp. paratuberculosis
ucguccucggucagg

SEQ ID NO: 786769 - RNA, 13 nt, Mycobacterium avium subsp. paratuberculosis
ucguccagcgucg

SEQ ID NO: 786770 - RNA, 22 nt, Mycobacterium avium subsp. paratuberculosis
ucguccagcgucgacugcaccg

SEQ ID NO: 786771 - RNA, 18 nt, Mycobacterium avium subsp. paratuberculosis
ucguccagcgucgcggcc

SEQ ID NO: 786772 - RNA, 21 nt, Mycobacterium avium subsp. paratuberculosis
ucguccacgcuggcggugucg

SEQ ID NO: 786773 - RNA, 16 nt, Mycobacterium avium subsp. paratuberculosis
ucgucgaagccgauca

SEQ ID NO: 786774 - RNA, 20 nt, Mycobacterium avium subsp. paratuberculosis
ucgucgaaguagggccgcag

SEQ ID NO: 786775 - RNA, 21 nt, Mycobacterium avium subsp. paratuberculosis
ucgucgaaguagggccgcagc

SEQ ID NO: 786776 - RNA, 15 nt, Mycobacterium avium subsp. paratuberculosis
ucgucgaacgcggcg

SEQ ID NO: 786777 - RNA, 20 nt, Mycobacterium avium subsp. paratuberculosis
ucgucgaacgcggcgaagca

SEQ ID NO: 786778 - RNA, 22 nt, Mycobacterium avium subsp. paratuberculosis
ucgucgaacuccauccgccguc

SEQ ID NO: 786779 - RNA, 15 nt, Mycobacterium avium subsp. paratuberculosis
ucgucgaacucgugg

SEQ ID NO: 786780 - RNA, 14 nt, Mycobacterium avium subsp. paratuberculosis
ucgucggcgucgga

SEQ ID NO: 786781 - RNA, 15 nt, Mycobacterium avium subsp. paratuberculosis
ucgucggcgggcacc

SEQ ID NO: 786782 - RNA, 15 nt, Mycobacterium avium subsp. paratuberculosis
ucgucggcggugccg

SEQ ID NO: 786783 - RNA, 15 nt, Mycobacterium avium subsp. paratuberculosis
ucgucggcggugggc

SEQ ID NO: 786784 - RNA, 12 nt, Mycobacterium avium subsp. paratuberculosis
ucgucggcggcg

SEQ ID NO: 786785 - RNA, 14 nt, Mycobacterium avium subsp. paratuberculosis
ucgucggcgcgucg

SEQ ID NO: 786786 - RNA, 15 nt, Mycobacterium avium subsp. paratuberculosis
ucgucggccgcgacg

SEQ ID NO: 786787 - RNA, 15 nt, Mycobacterium avium subsp. paratuberculosis
ucgucggcgccggcg

SEQ ID NO: 786788 - RNA, 21 nt, Mycobacterium avium subsp. paratuberculosis
ucgucggcgccgucgcgggag

SEQ ID NO: 786789 - RNA, 19 nt, Mycobacterium avium subsp. paratuberculosis
ucgucggcgcgccacccga

SEQ ID NO: 786790 - RNA, 17 nt, Mycobacterium avium subsp. paratuberculosis
ucgucgggcaccacggc

SEQ ID NO: 786791 - RNA, 19 nt, Mycobacterium avium subsp. paratuberculosis
ucgucgggcaccacggcgg

SEQ ID NO: 786792 - RNA, 21 nt, Mycobacterium avium subsp. paratuberculosis
ucgucgggcaccacggcggca

SEQ ID NO: 786793 - RNA, 23 nt, Mycobacterium avium subsp. paratuberculosis
ucgucgggcaccacggcggcaug

SEQ ID NO: 786794 - RNA, 16 nt, Mycobacterium avium subsp. paratuberculosis
ucgucgggcaccagca

SEQ ID NO: 786795 - RNA, 17 nt, Mycobacterium avium subsp. paratuberculosis
ucgucgggcaccagcac

SEQ ID NO: 786796 - RNA, 20 nt, Mycobacterium avium subsp. paratuberculosis
ucgucgggcaccagcaccga

SEQ ID NO: 786797 - RNA, 20 nt, Mycobacterium avium subsp. paratuberculosis
ucgucggccgacucgaugcg

SEQ ID NO: 786798 - RNA, 20 nt, Mycobacterium avium subsp. paratuberculosis
ucgucgggccgcagcacggc

SEQ ID NO: 786799 - RNA, 19 nt, Mycobacterium avium subsp. paratuberculosis
ucgucgggcgccagcccgc

SEQ ID NO: 786800 - RNA, 15 nt, Mycobacterium avium subsp. paratuberculosis
ucgucgggcgccggu

SEQ ID NO: 786801 - RNA, 21 nt, Mycobacterium avium subsp. paratuberculosis
ucgucgucgcagugcccgccc

SEQ ID NO: 786802 - RNA, 21 nt, Mycobacterium avium subsp. paratuberculosis
ucgucgucgcgcaggucgggc

SEQ ID NO: 786803 - RNA, 19 nt, Mycobacterium avium subsp. paratuberculosis
ucgucgacccgcuccccga

SEQ ID NO: 786804 - RNA, 22 nt, Mycobacterium avium subsp. paratuberculosis
ucgucgacccggccgcgccgga

SEQ ID NO: 786805 - RNA, 12 nt, Mycobacterium avium subsp. paratuberculosis
ucgucgaccgcg

SEQ ID NO: 786806 - RNA, 24 nt, Mycobacterium avium subsp. paratuberculosis
ucgucgaccugcucgucggugacg

SEQ ID NO: 786807 - RNA, 21 nt, Mycobacterium avium subsp. paratuberculosis
ucgucgacgagcccgccggcg

SEQ ID NO: 786808 - RNA, 10 nt, Mycobacterium avium subsp. paratuberculosis
ucgucgacgg

SEQ ID NO: 786809 - RNA, 14 nt, Mycobacterium avium subsp. paratuberculosis
ucgucgacggccgc

SEQ ID NO: 786810 - RNA, 13 nt, Mycobacterium avium subsp. paratuberculosis
ucgucgacggcgg

SEQ ID NO: 786811 - RNA, 14 nt, Mycobacterium avium subsp. paratuberculosis
ucgucggccggcag

SEQ ID NO: 786812 - RNA, 22 nt, Mycobacterium avium subsp. paratuberculosis
ucgucggccggcaguugcggcc

SEQ ID NO: 786813 - RNA, 12 nt, Mycobacterium avium subsp. paratuberculosis
ucgucggccucg

SEQ ID NO: 786814 - RNA, 14 nt, Mycobacterium avium subsp. paratuberculosis
ucgucggccucggc

SEQ ID NO: 786815 - RNA, 18 nt, Mycobacterium avium subsp. paratuberculosis
ucgucggccugcacgucg

SEQ ID NO: 786816 - RNA, 15 nt, Mycobacterium avium subsp. paratuberculosis
ucguccacgcccagc

SEQ ID NO: 786817 - RNA, 21 nt, Mycobacterium avium subsp. paratuberculosis
ucgucggcgaacggccagucc

SEQ ID NO: 786818 - RNA, 16 nt, Mycobacterium avium subsp. paratuberculosis
ucgguacccccgccgg

SEQ ID NO: 786819 - RNA, 20 nt, Mycobacterium avium subsp. paratuberculosis
ucggguuguuguccgaccag

SEQ ID NO: 786820 - RNA, 22 nt, Mycobacterium avium subsp. paratuberculosis
ucggguguaggcccgaucaggg

SEQ ID NO: 786821 - RNA, 17 nt, Mycobacterium avium subsp. paratuberculosis
ucgggugucgccgagcc

SEQ ID NO: 786822 - RNA, 18 nt, Mycobacterium avium subsp. paratuberculosis
ucggguugccggcggcca

SEQ ID NO: 786823 - RNA, 20 nt, Mycobacterium avium subsp. paratuberculosis
ucggguucgcccuccccggc

SEQ ID NO: 786824 - RNA, 15 nt, Mycobacterium avium subsp. paratuberculosis
ucggguucgccggug

SEQ ID NO: 786825 - RNA, 18 nt, Mycobacterium avium subsp. paratuberculosis
ucggguggcgucgccgcc

SEQ ID NO: 786826 - RNA, 14 nt, Mycobacterium avium subsp. paratuberculosis
ucggggggcacguc

SEQ ID NO: 786827 - RNA, 14 nt, Mycobacterium avium subsp. paratuberculosis
ucgggggugaaggc

SEQ ID NO: 786828 - RNA, 13 nt, Mycobacterium avium subsp. paratuberculosis
ucgggggugucgu

SEQ ID NO: 786829 - RNA, 16 nt, Mycobacterium avium subsp. paratuberculosis
ucgggguacucggcgg

SEQ ID NO: 786830 - RNA, 15 nt, Mycobacterium avium subsp. paratuberculosis
ucgggguagccggcc

SEQ ID NO: 786831 - RNA, 16 nt, Mycobacterium avium subsp. paratuberculosis
ucgggguagccggccc

SEQ ID NO: 786832 - RNA, 18 nt, Mycobacterium avium subsp. paratuberculosis
ucgggguccaggccgcgc

SEQ ID NO: 786833 - RNA, 20 nt, Mycobacterium avium subsp. paratuberculosis
ucgggguccaggccgcgccg

SEQ ID NO: 786834 - RNA, 13 nt, Mycobacterium avium subsp. paratuberculosis
ucggggucgauca

SEQ ID NO: 786835 - RNA, 13 nt, Mycobacterium avium subsp. paratuberculosis
ucggggucgcgcc

SEQ ID NO: 786836 - RNA, 15 nt, Mycobacterium avium subsp. paratuberculosis
ucgggcguggcgucg

SEQ ID NO: 786837 - RNA, 18 nt, Mycobacterium avium subsp. paratuberculosis
ucgggcguugcgccgcga

SEQ ID NO: 786838 - RNA, 14 nt, Mycobacterium avium subsp. paratuberculosis
ucgggcucggccgc

SEQ ID NO: 786839 - RNA, 15 nt, Mycobacterium avium subsp. paratuberculosis
ucgggcucggccgcc

SEQ ID NO: 786840 - RNA, 18 nt, Mycobacterium avium subsp. paratuberculosis
ucgggcucggccgccgac

SEQ ID NO: 786841 - RNA, 18 nt, Mycobacterium avium subsp. paratuberculosis
ucggggauguaugcgguc

SEQ ID NO: 786842 - RNA, 22 nt, Mycobacterium avium subsp. paratuberculosis
ucggggcaucgcagcgcgcggc

SEQ ID NO: 786843 - RNA, 23 nt, Mycobacterium avium subsp. paratuberculosis
ucggggcaucgcagcgcgcggcg

SEQ ID NO: 786844 - RNA, 20 nt, Mycobacterium avium subsp. paratuberculosis
ucggggcgaccuggacgccg

SEQ ID NO: 786845 - RNA, 18 nt, Mycobacterium avium subsp. paratuberculosis
ucggggccaccaggccga

SEQ ID NO: 786846 - RNA, 16 nt, Mycobacterium avium subsp. paratuberculosis
ucggggcccaccccgg

SEQ ID NO: 786847 - RNA, 18 nt, Mycobacterium avium subsp. paratuberculosis
ucggggcccaccccggac

SEQ ID NO: 786848 - RNA, 20 nt, Mycobacterium avium subsp. paratuberculosis
ucggggcccaccccggacaa

SEQ ID NO: 786849 - RNA, 20 nt, Mycobacterium avium subsp. paratuberculosis
ucggggcccggcccggcgau

SEQ ID NO: 786850 - RNA, 12 nt, Mycobacterium avium subsp. paratuberculosis
ucggggcccguc

SEQ ID NO: 786851 - RNA, 22 nt, Mycobacterium avium subsp. paratuberculosis
ucggggcccguccccaccaccg

SEQ ID NO: 786852 - RNA, 18 nt, Mycobacterium avium subsp. paratuberculosis
ucggggcccuccgcggcg

SEQ ID NO: 786853 - RNA, 20 nt, Mycobacterium avium subsp. paratuberculosis
ucggggcccuccgcggcgcc

SEQ ID NO: 786854 - RNA, 16 nt, Mycobacterium avium subsp. paratuberculosis
ucggggcggcgggcga

SEQ ID NO: 786855 - RNA, 16 nt, Mycobacterium avium subsp. paratuberculosis
ucggggcguggcggaa

SEQ ID NO: 786856 - RNA, 13 nt, Mycobacterium avium subsp. paratuberculosis
ucggggcucacca

SEQ ID NO: 786857 - RNA, 16 nt, Mycobacterium avium subsp. paratuberculosis
ucggggcugcgcggcu

SEQ ID NO: 786858 - RNA, 18 nt, Mycobacterium avium subsp. paratuberculosis
ucgggggcgggcaccucg

SEQ ID NO: 786859 - RNA, 23 nt, Mycobacterium avium subsp. paratuberculosis
ucgggccauauuucgugaagccg

SEQ ID NO: 786860 - RNA, 12 nt, Mycobacterium avium subsp. paratuberculosis
ucgggcccagca

SEQ ID NO: 786861 - RNA, 14 nt, Mycobacterium avium subsp. paratuberculosis
ucgggcccagcagc

SEQ ID NO: 786862 - RNA, 13 nt, Mycobacterium avium subsp. paratuberculosis
ucgggccccaugg

SEQ ID NO: 786863 - RNA, 18 nt, Mycobacterium avium subsp. paratuberculosis
ucgggcccgcgcaccguc

SEQ ID NO: 786864 - RNA, 17 nt, Mycobacterium avium subsp. paratuberculosis
ucgggcccggccgccag

SEQ ID NO: 786865 - RNA, 19 nt, Mycobacterium avium subsp. paratuberculosis
ucgggcccggccgccagca

SEQ ID NO: 786866 - RNA, 13 nt, Mycobacterium avium subsp. paratuberculosis
ucgggccagccca

SEQ ID NO: 786867 - RNA, 19 nt, Mycobacterium avium subsp. paratuberculosis
ucgggccagcgccgagccg

SEQ ID NO: 786868 - RNA, 18 nt, Mycobacterium avium subsp. paratuberculosis
ucgggcauuggcagcucg

SEQ ID NO: 786869 - RNA, 21 nt, Mycobacterium avium subsp. paratuberculosis
ucgggcauuggcagcucgggc

SEQ ID NO: 786870 - RNA, 13 nt, Mycobacterium avium subsp. paratuberculosis
ucgggcaugccgg

SEQ ID NO: 786871 - RNA, 16 nt, Mycobacterium avium subsp. paratuberculosis
ucgggcaugccggccg

SEQ ID NO: 786872 - RNA, 18 nt, Mycobacterium avium subsp. paratuberculosis
ucgggcaugccggccggc

SEQ ID NO: 786873 - RNA, 20 nt, Mycobacterium avium subsp. paratuberculosis
ucgggcaugccggccggcac

SEQ ID NO: 786874 - RNA, 21 nt, Mycobacterium avium subsp. paratuberculosis
ucgggcagugcacgacgaccg

SEQ ID NO: 786875 - RNA, 13 nt, Mycobacterium avium subsp. paratuberculosis
ucgggcagcagca

SEQ ID NO: 786876 - RNA, 15 nt, Mycobacterium avium subsp. paratuberculosis
ucgggcagcagcacc

SEQ ID NO: 786877 - RNA, 16 nt, Mycobacterium avium subsp. paratuberculosis
ucgggcagcagcacca

SEQ ID NO: 786878 - RNA, 20 nt, Mycobacterium avium subsp. paratuberculosis
ucgggcagcccgccgaccac

SEQ ID NO: 786879 - RNA, 24 nt, Mycobacterium avium subsp. paratuberculosis
ucgggcaggauggucagcgagugg

SEQ ID NO: 786880 - RNA, 13 nt, Mycobacterium avium subsp. paratuberculosis
ucgggcacgucca

SEQ ID NO: 786881 - RNA, 16 nt, Mycobacterium avium subsp. paratuberculosis
ucgggcacguccagcc

SEQ ID NO: 786882 - RNA, 18 nt, Mycobacterium avium subsp. paratuberculosis
ucgggcaccagcaccgag

SEQ ID NO: 786883 - RNA, 22 nt, Mycobacterium avium subsp. paratuberculosis
ucgggcacagccagcgcccggc

SEQ ID NO: 786884 - RNA, 16 nt, Mycobacterium avium subsp. paratuberculosis
ucgggcaccacgccga

SEQ ID NO: 786885 - RNA, 20 nt, Mycobacterium avium subsp. paratuberculosis
ucgggcaccacgccgacgug

SEQ ID NO: 786886 - RNA, 14 nt, Mycobacterium avium subsp. paratuberculosis
ucgggcaccacggc

SEQ ID NO: 786887 - RNA, 17 nt, Mycobacterium avium subsp. paratuberculosis
ucgggcaccacggcggc

SEQ ID NO: 786888 - RNA, 18 nt, Mycobacterium avium subsp. paratuberculosis
ucgggcaccacggcggca

SEQ ID NO: 786889 - RNA, 22 nt, Mycobacterium avium subsp. paratuberculosis
ucgggcgguccaccgacgccac

SEQ ID NO: 786890 - RNA, 16 nt, Mycobacterium avium subsp. paratuberculosis
ucgggcgguggcgccg

SEQ ID NO: 786891 - RNA, 11 nt, Mycobacterium avium subsp. paratuberculosis
ucgggcgcucg

SEQ ID NO: 786892 - RNA, 20 nt, Mycobacterium avium subsp. paratuberculosis
ucgggcggccgcggauuccg

SEQ ID NO: 786893 - RNA, 17 nt, Mycobacterium avium subsp. paratuberculosis
ucgggcggccugccggc

SEQ ID NO: 786894 - RNA, 22 nt, Mycobacterium avium subsp. paratuberculosis
ucgggcggggugugcggcacgg

SEQ ID NO: 786895 - RNA, 23 nt, Mycobacterium avium subsp. paratuberculosis
ucgggcggggugugcggcacggc

SEQ ID NO: 786896 - RNA, 13 nt, Mycobacterium avium subsp. paratuberculosis
ucgggcgggugga

SEQ ID NO: 786897 - RNA, 15 nt, Mycobacterium avium subsp. paratuberculosis
ucgggcgcggcggca

SEQ ID NO: 786898 - RNA, 16 nt, Mycobacterium avium subsp. paratuberculosis
ucgggcgcaccacgac

SEQ ID NO: 786899 - RNA, 18 nt, Mycobacterium avium subsp. paratuberculosis
ucgggcgcagguccaccc

SEQ ID NO: 786900 - RNA, 20 nt, Mycobacterium avium subsp. paratuberculosis
ucgggcgcagguccacccgc

SEQ ID NO: 786901 - RNA, 14 nt, Mycobacterium avium subsp. paratuberculosis
ucgggcgccggcgc

SEQ ID NO: 786902 - RNA, 15 nt, Mycobacterium avium subsp. paratuberculosis
ucgggcgccggcgcg

SEQ ID NO: 786903 - RNA, 20 nt, Mycobacterium avium subsp. paratuberculosis
ucgggcgcgaacagcgccga

SEQ ID NO: 786904 - RNA, 18 nt, Mycobacterium avium subsp. paratuberculosis
ucgggcgacgacgcgguc

SEQ ID NO: 786905 - RNA, 14 nt, Mycobacterium avium subsp. paratuberculosis
ucgggccggaucag

SEQ ID NO: 786906 - RNA, 12 nt, Mycobacterium avium subsp. paratuberculosis
ucgggccggccc

SEQ ID NO: 786907 - RNA, 12 nt, Mycobacterium avium subsp. paratuberculosis
ucgggccgggcg

SEQ ID NO: 786908 - RNA, 16 nt, Mycobacterium avium subsp. paratuberculosis
ucgggccgggcgggca

SEQ ID NO: 786909 - RNA, 18 nt, Mycobacterium avium subsp. paratuberculosis
ucgggccgggcgggcacc

SEQ ID NO: 786910 - RNA, 20 nt, Mycobacterium avium subsp. paratuberculosis
ucgggccgggggcggcggcg

SEQ ID NO: 786911 - RNA, 18 nt, Mycobacterium avium subsp. paratuberculosis
ucguagggcucggcgucg

SEQ ID NO: 786912 - RNA, 16 nt, Mycobacterium avium subsp. paratuberculosis
ucguagguggccagca

SEQ ID NO: 786913 - RNA, 22 nt, Mycobacterium avium subsp. paratuberculosis
ucguagguggccagcacgaucg

SEQ ID NO: 786914 - RNA, 14 nt, Mycobacterium avium subsp. paratuberculosis
ucguaggcgcgguc

SEQ ID NO: 786915 - RNA, 17 nt, Mycobacterium avium subsp. paratuberculosis
ucgguugcuccggcguc

SEQ ID NO: 786916 - RNA, 22 nt, Mycobacterium avium subsp. paratuberculosis
ucguagcccaccucgagcacgc

SEQ ID NO: 786917 - RNA, 15 nt, Mycobacterium avium subsp. paratuberculosis
ucgguuugaccacgg

SEQ ID NO: 786918 - RNA, 18 nt, Mycobacterium avium subsp. paratuberculosis
ucguagacgcugccgcug

SEQ ID NO: 786919 - RNA, 22 nt, Mycobacterium avium subsp. paratuberculosis
ucguagagcugacgggaccgca

SEQ ID NO: 786920 - RNA, 23 nt, Mycobacterium avium subsp. paratuberculosis
ucguagagcugacgggaccgcac

SEQ ID NO: 786921 - RNA, 14 nt, Mycobacterium avium subsp. paratuberculosis
ucgucaacgccccg

SEQ ID NO: 786922 - RNA, 15 nt, Mycobacterium avium subsp. paratuberculosis
ucguauucgacggcg

SEQ ID NO: 786923 - RNA, 12 nt, Mycobacterium avium subsp. paratuberculosis
ucguagucgaug

SEQ ID NO: 786924 - RNA, 15 nt, Mycobacterium avium subsp. paratuberculosis
ucguagucgcucggc

SEQ ID NO: 786925 - RNA, 14 nt, Mycobacterium avium subsp. paratuberculosis
ucguagucggcccg

SEQ ID NO: 786926 - RNA, 18 nt, Mycobacterium avium subsp. paratuberculosis
ucguaguugcgcgccgau

SEQ ID NO: 786927 - RNA, 17 nt, Mycobacterium avium subsp. paratuberculosis
ucguaguugcggccggc

SEQ ID NO: 786928 - RNA, 19 nt, Mycobacterium avium subsp. paratuberculosis
ucguaguuggggccggccg

SEQ ID NO: 786929 - RNA, 22 nt, Mycobacterium avium subsp. paratuberculosis
ucgucaccgaccccucggcggc

SEQ ID NO: 786930 - RNA, 19 nt, Mycobacterium avium subsp. paratuberculosis
ucgucaccgugggcggcgc

SEQ ID NO: 786931 - RNA, 17 nt, Mycobacterium avium subsp. paratuberculosis
ucgucacuucgccgggc

SEQ ID NO: 786932 - RNA, 13 nt, Mycobacterium avium subsp. paratuberculosis
ucgucagcaccgu

SEQ ID NO: 786933 - RNA, 12 nt, Mycobacterium avium subsp. paratuberculosis
ucgucagcagcg

SEQ ID NO: 786934 - RNA, 15 nt, Mycobacterium avium subsp. paratuberculosis
ucgucagcgcgggcc

SEQ ID NO: 786935 - RNA, 17 nt, Mycobacterium avium subsp. paratuberculosis
ucgucaggccgugaucg

SEQ ID NO: 786936 - RNA, 22 nt, Mycobacterium avium subsp. paratuberculosis
ucggucgccacggccggcagca

SEQ ID NO: 786937 - RNA, 21 nt, Mycobacterium avium subsp. paratuberculosis
ucggucgccagcaccgugcug

SEQ ID NO: 786938 - RNA, 21 nt, Mycobacterium avium subsp. paratuberculosis
ucggucgccgaauccggcggg

SEQ ID NO: 786939 - RNA, 17 nt, Mycobacterium avium subsp. paratuberculosis
ucggucccgacagggag

SEQ ID NO: 786940 - RNA, 19 nt, Mycobacterium avium subsp. paratuberculosis
ucggucccgacgcggcgcg

SEQ ID NO: 786941 - RNA, 14 nt, Mycobacterium avium subsp. paratuberculosis
ucggucccggcggg

SEQ ID NO: 786942 - RNA, 13 nt, Mycobacterium avium subsp. paratuberculosis
ucggugcgcggcg

SEQ ID NO: 786943 - RNA, 14 nt, Mycobacterium avium subsp. paratuberculosis
ucggucucgacguu

SEQ ID NO: 786944 - RNA, 18 nt, Mycobacterium avium subsp. paratuberculosis
ucggucguaguaggugcg

SEQ ID NO: 786945 - RNA, 14 nt, Mycobacterium avium subsp. paratuberculosis
ucggugcgacccgg

SEQ ID NO: 786946 - RNA, 13 nt, Mycobacterium avium subsp. paratuberculosis
ucggugcgcaccc

SEQ ID NO: 786947 - RNA, 18 nt, Mycobacterium avium subsp. paratuberculosis
ucggugcgcaccccguug

SEQ ID NO: 786948 - RNA, 21 nt, Mycobacterium avium subsp. paratuberculosis
ucggugcgcaccccguugccg

SEQ ID NO: 786949 - RNA, 13 nt, Mycobacterium avium subsp. paratuberculosis
ucggucgcgaccc

SEQ ID NO: 786950 - RNA, 13 nt, Mycobacterium avium subsp. paratuberculosis
ucggucggcgucg

SEQ ID NO: 786951 - RNA, 15 nt, Mycobacterium avium subsp. paratuberculosis
ucggucgcggcaucc

SEQ ID NO: 786952 - RNA, 15 nt, Mycobacterium avium subsp. paratuberculosis
ucggucgcggcgucg

SEQ ID NO: 786953 - RNA, 22 nt, Mycobacterium avium subsp. paratuberculosis
ucggucgcggucggcgcccggc

SEQ ID NO: 786954 - RNA, 18 nt, Mycobacterium avium subsp. paratuberculosis
ucggucgcgugaccggcg

SEQ ID NO: 786955 - RNA, 15 nt, Mycobacterium avium subsp. paratuberculosis
ucggugucgccgauu

SEQ ID NO: 786956 - RNA, 19 nt, Mycobacterium avium subsp. paratuberculosis
ucgguggcaccccgcgccg

SEQ ID NO: 786957 - RNA, 21 nt, Mycobacterium avium subsp. paratuberculosis
ucggugugcagcagcucggcg

SEQ ID NO: 786958 - RNA, 23 nt, Mycobacterium avium subsp. paratuberculosis
ucggugugcagcagcucggcgau

SEQ ID NO: 786959 - RNA, 20 nt, Mycobacterium avium subsp. paratuberculosis
ucggugugggucagcgaggc

SEQ ID NO: 786960 - RNA, 21 nt, Mycobacterium avium subsp. paratuberculosis
ucggugugcgguucacgcggc

SEQ ID NO: 786961 - RNA, 13 nt, Mycobacterium avium subsp. paratuberculosis
ucgguggccaccg

SEQ ID NO: 786962 - RNA, 15 nt, Mycobacterium avium subsp. paratuberculosis
ucgguggccaccgcg

SEQ ID NO: 786963 - RNA, 22 nt, Mycobacterium avium subsp. paratuberculosis
ucgguggccaccgcgacgccca

SEQ ID NO: 786964 - RNA, 17 nt, Mycobacterium avium subsp. paratuberculosis
ucgguggacagcgcgac

SEQ ID NO: 786965 - RNA, 18 nt, Mycobacterium avium subsp. paratuberculosis
ucgguggacagcgcgacg

SEQ ID NO: 786966 - RNA, 13 nt, Mycobacterium avium subsp. paratuberculosis
ucgguggacgccg

SEQ ID NO: 786967 - RNA, 17 nt, Mycobacterium avium subsp. paratuberculosis
ucgguggagcgcggcau

SEQ ID NO: 786968 - RNA, 22 nt, Mycobacterium avium subsp. paratuberculosis
ucgguggauccggugaccgcga

SEQ ID NO: 786969 - RNA, 23 nt, Mycobacterium avium subsp. paratuberculosis
ucgguggauccggugaccgcgac

SEQ ID NO: 786970 - RNA, 19 nt, Mycobacterium avium subsp. paratuberculosis
ucgguggcccagccggccg

SEQ ID NO: 786971 - RNA, 17 nt, Mycobacterium avium subsp. paratuberculosis
ucgguggccccgggccg

SEQ ID NO: 786972 - RNA, 12 nt, Mycobacterium avium subsp. paratuberculosis
ucgguggccucg

SEQ ID NO: 786973 - RNA, 14 nt, Mycobacterium avium subsp. paratuberculosis
ucgguggccucgcg

SEQ ID NO: 786974 - RNA, 21 nt, Mycobacterium avium subsp. paratuberculosis
ucggugcggaaggcccccggc

SEQ ID NO: 786975 - RNA, 20 nt, Mycobacterium avium subsp. paratuberculosis
ucggugcgguaggugccggc

SEQ ID NO: 786976 - RNA, 22 nt, Mycobacterium avium subsp. paratuberculosis
ucggugcgguaggugccggccg

SEQ ID NO: 786977 - RNA, 17 nt, Mycobacterium avium subsp. paratuberculosis
ucggugcucaucagcga

SEQ ID NO: 786978 - RNA, 23 nt, Mycobacterium avium subsp. paratuberculosis
ucggcgaugcguugcgccagcac

SEQ ID NO: 786979 - RNA, 17 nt, Mycobacterium avium subsp. paratuberculosis
ucggcgauggaguagcu

SEQ ID NO: 786980 - RNA, 15 nt, Mycobacterium avium subsp. paratuberculosis
ucggcgaugcgccgu

SEQ ID NO: 786981 - RNA, 17 nt, Mycobacterium avium subsp. paratuberculosis
ucggcgaugucgaagcc

SEQ ID NO: 786982 - RNA, 18 nt, Mycobacterium avium subsp. paratuberculosis
ucggcgccaccccgggaa

SEQ ID NO: 786983 - RNA, 15 nt, Mycobacterium avium subsp. paratuberculosis
ucggcgccacgacca

SEQ ID NO: 786984 - RNA, 18 nt, Mycobacterium avium subsp. paratuberculosis
ucggcgccacgaccagcg

SEQ ID NO: 786985 - RNA, 18 nt, Mycobacterium avium subsp. paratuberculosis
ucggcgccggcauccagc

SEQ ID NO: 786986 - RNA, 13 nt, Mycobacterium avium subsp. paratuberculosis
ucggcgccggcca

SEQ ID NO: 786987 - RNA, 14 nt, Mycobacterium avium subsp. paratuberculosis
ucggcgccggccag

SEQ ID NO: 786988 - RNA, 13 nt, Mycobacterium avium subsp. paratuberculosis
ucggcgccggccg

SEQ ID NO: 786989 - RNA, 16 nt, Mycobacterium avium subsp. paratuberculosis
ucggcgccggccguca

SEQ ID NO: 786990 - RNA, 17 nt, Mycobacterium avium subsp. paratuberculosis
ucggcgccggccgucac

SEQ ID NO: 786991 - RNA, 17 nt, Mycobacterium avium subsp. paratuberculosis
ucggcgcccagaucggc

SEQ ID NO: 786992 - RNA, 20 nt, Mycobacterium avium subsp. paratuberculosis
ucggcgcccagaucggccag

SEQ ID NO: 786993 - RNA, 23 nt, Mycobacterium avium subsp. paratuberculosis
ucggcgccccccugcucgcugug

SEQ ID NO: 786994 - RNA, 16 nt, Mycobacterium avium subsp. paratuberculosis
ucggcgccccgcccgc

SEQ ID NO: 786995 - RNA, 22 nt, Mycobacterium avium subsp. paratuberculosis
ucggcgccccgcccgcgacugu

SEQ ID NO: 786996 - RNA, 15 nt, Mycobacterium avium subsp. paratuberculosis
ucggcgccccggcgc

SEQ ID NO: 786997 - RNA, 18 nt, Mycobacterium avium subsp. paratuberculosis
ucggcgccccggcgcuga

SEQ ID NO: 786998 - RNA, 18 nt, Mycobacterium avium subsp. paratuberculosis
ucggcgcccaccgcggcg

SEQ ID NO: 786999 - RNA, 21 nt, Mycobacterium avium subsp. paratuberculosis
ucggcgcccaccgcggcgcgc

SEQ ID NO: 787000 - RNA, 13 nt, Mycobacterium avium subsp. paratuberculosis
ucggcgccagccc

SEQ ID NO: 787001 - RNA, 14 nt, Mycobacterium avium subsp. paratuberculosis
ucggcgccagcccg

SEQ ID NO: 787002 - RNA, 15 nt, Mycobacterium avium subsp. paratuberculosis
ucggcgccagcccgc

SEQ ID NO: 787003 - RNA, 17 nt, Mycobacterium avium subsp. paratuberculosis
ucggcgccagcccgccg

SEQ ID NO: 787004 - RNA, 14 nt, Mycobacterium avium subsp. paratuberculosis
ucggcgccagccgc

SEQ ID NO: 787005 - RNA, 16 nt, Mycobacterium avium subsp. paratuberculosis
ucggcgccagccgcac

SEQ ID NO: 787006 - RNA, 22 nt, Mycobacterium avium subsp. paratuberculosis
ucggcgccagccgcaccgcgac

SEQ ID NO: 787007 - RNA, 21 nt, Mycobacterium avium subsp. paratuberculosis
ucggcgcggcuuuuggcgucg

SEQ ID NO: 787008 - RNA, 22 nt, Mycobacterium avium subsp. paratuberculosis
ucggcgcggcuuuuggcgucgu

SEQ ID NO: 787009 - RNA, 16 nt, Mycobacterium avium subsp. paratuberculosis
ucggcgcggcgacgug

SEQ ID NO: 787010 - RNA, 17 nt, Mycobacterium avium subsp. paratuberculosis
ucggcgcggcgacguga

SEQ ID NO: 787011 - RNA, 13 nt, Mycobacterium avium subsp. paratuberculosis
ucggcgcggggcc

SEQ ID NO: 787012 - RNA, 23 nt, Mycobacterium avium subsp. paratuberculosis
ucggcgcggggccaccaggcgcc

SEQ ID NO: 787013 - RNA, 15 nt, Mycobacterium avium subsp. paratuberculosis
ucggcgcgcggggcc

SEQ ID NO: 787014 - RNA, 21 nt, Mycobacterium avium subsp. paratuberculosis
ucggcgcgcggggccggcgcg

SEQ ID NO: 787015 - RNA, 14 nt, Mycobacterium avium subsp. paratuberculosis
ucggcgcggacgug

SEQ ID NO: 787016 - RNA, 21 nt, Mycobacterium avium subsp. paratuberculosis
ucggcgcgcgcgccccagccc

SEQ ID NO: 787017 - RNA, 15 nt, Mycobacterium avium subsp. paratuberculosis
ucggcgcgcgccgau

SEQ ID NO: 787018 - RNA, 17 nt, Mycobacterium avium subsp. paratuberculosis
ucggcgcgcgccgauca

SEQ ID NO: 787019 - RNA, 22 nt, Mycobacterium avium subsp. paratuberculosis
ucggcgcgccgaagauggccag

SEQ ID NO: 787020 - RNA, 12 nt, Mycobacterium avium subsp. paratuberculosis
ucggcgcgccgg

SEQ ID NO: 787021 - RNA, 18 nt, Mycobacterium avium subsp. paratuberculosis
ucggcgccuugguccgca

SEQ ID NO: 787022 - RNA, 18 nt, Mycobacterium avium subsp. paratuberculosis
ucggcgcgaagucgagca

SEQ ID NO: 787023 - RNA, 13 nt, Mycobacterium avium subsp. paratuberculosis
ucggcgccucggc

SEQ ID NO: 787024 - RNA, 13 nt, Mycobacterium avium subsp. paratuberculosis
ucggcgcgcaccg

SEQ ID NO: 787025 - RNA, 17 nt, Mycobacterium avium subsp. paratuberculosis
ucggcgccgcgcgccag

SEQ ID NO: 787026 - RNA, 13 nt, Mycobacterium avium subsp. paratuberculosis
ucggcgccggcgc

SEQ ID NO: 787027 - RNA, 15 nt, Mycobacterium avium subsp. paratuberculosis
ucggcgccggcgcgc

SEQ ID NO: 787028 - RNA, 16 nt, Mycobacterium avium subsp. paratuberculosis
ucggcgccgucgccgg

SEQ ID NO: 787029 - RNA, 23 nt, Mycobacterium avium subsp. paratuberculosis
ucggcgccgguggugucgacggu

SEQ ID NO: 787030 - RNA, 14 nt, Mycobacterium avium subsp. paratuberculosis
ucggcgccguccag

SEQ ID NO: 787031 - RNA, 20 nt, Mycobacterium avium subsp. paratuberculosis
ucggccuugaccacggugcg

SEQ ID NO: 787032 - RNA, 16 nt, Mycobacterium avium subsp. paratuberculosis
ucggccuugaccagga

SEQ ID NO: 787033 - RNA, 21 nt, Mycobacterium avium subsp. paratuberculosis
ucggccuugagccggucgugc

SEQ ID NO: 787034 - RNA, 22 nt, Mycobacterium avium subsp. paratuberculosis
ucggccuugagccggucgugcg

SEQ ID NO: 787035 - RNA, 16 nt, Mycobacterium avium subsp. paratuberculosis
ucggccuuggccaccg

SEQ ID NO: 787036 - RNA, 17 nt, Mycobacterium avium subsp. paratuberculosis
ucggccuuggccaccgc

SEQ ID NO: 787037 - RNA, 19 nt, Mycobacterium avium subsp. paratuberculosis
ucggccuuggccaccgccu

SEQ ID NO: 787038 - RNA, 22 nt, Mycobacterium avium subsp. paratuberculosis
ucggcgaacaucuccagauugc

SEQ ID NO: 787039 - RNA, 12 nt, Mycobacterium avium subsp. paratuberculosis
ucggcgaaccag

SEQ ID NO: 787040 - RNA, 22 nt, Mycobacterium avium subsp. paratuberculosis
ucggcgaaccagggcagccagc

SEQ ID NO: 787041 - RNA, 22 nt, Mycobacterium avium subsp. paratuberculosis
ucggcgaccgcgcgcggcgccg

SEQ ID NO: 787042 - RNA, 19 nt, Mycobacterium avium subsp. paratuberculosis
ucggcgacgauggccaggc

SEQ ID NO: 787043 - RNA, 20 nt, Mycobacterium avium subsp. paratuberculosis
ucggcgacgauggccaggcc

SEQ ID NO: 787044 - RNA, 22 nt, Mycobacterium avium subsp. paratuberculosis
ucggccuuacgcugcgcgaccu

SEQ ID NO: 787045 - RNA, 21 nt, Mycobacterium avium subsp. paratuberculosis
ucggccuucagcguccacgau

SEQ ID NO: 787046 - RNA, 13 nt, Mycobacterium avium subsp. paratuberculosis
ucggccgcccguc

SEQ ID NO: 787047 - RNA, 23 nt, Mycobacterium avium subsp. paratuberculosis
ucggccgcaucguugguccaggc

SEQ ID NO: 787048 - RNA, 13 nt, Mycobacterium avium subsp. paratuberculosis
ucggccgccaccg

SEQ ID NO: 787049 - RNA, 18 nt, Mycobacterium avium subsp. paratuberculosis
ucggccgccaccgccauc

SEQ ID NO: 787050 - RNA, 17 nt, Mycobacterium avium subsp. paratuberculosis
ucggcgaucgccgggga

SEQ ID NO: 787051 - RNA, 15 nt, Mycobacterium avium subsp. paratuberculosis
ucggcgaucggccgc

SEQ ID NO: 787052 - RNA, 21 nt, Mycobacterium avium subsp. paratuberculosis
ucggcgaucggccgcugcggg

SEQ ID NO: 787053 - RNA, 18 nt, Mycobacterium avium subsp. paratuberculosis
ucggcgaucggcgugccg

SEQ ID NO: 787054 - RNA, 16 nt, Mycobacterium avium subsp. paratuberculosis
ucggcgaucucgucgc

SEQ ID NO: 787055 - RNA, 17 nt, Mycobacterium avium subsp. paratuberculosis
ucggcgaucagcuccuc

SEQ ID NO: 787056 - RNA, 15 nt, Mycobacterium avium subsp. paratuberculosis
ucggcgauccacgcc

SEQ ID NO: 787057 - RNA, 16 nt, Mycobacterium avium subsp. paratuberculosis
ucggcgauccacgccu

SEQ ID NO: 787058 - RNA, 15 nt, Mycobacterium avium subsp. paratuberculosis
ucggcgaucgccagc

SEQ ID NO: 787059 - RNA, 16 nt, Mycobacterium avium subsp. paratuberculosis
ucggcgaucgccagca

SEQ ID NO: 787060 - RNA, 13 nt, Mycobacterium avium subsp. paratuberculosis
ucggcgacgcugg

SEQ ID NO: 787061 - RNA, 22 nt, Mycobacterium avium subsp. paratuberculosis
ucggcgacgcugguggccugca

SEQ ID NO: 787062 - RNA, 15 nt, Mycobacterium avium subsp. paratuberculosis
ucggcgacggcgacg

SEQ ID NO: 787063 - RNA, 17 nt, Mycobacterium avium subsp. paratuberculosis
ucggcgacggcgacggc

SEQ ID NO: 787064 - RNA, 22 nt, Mycobacterium avium subsp. paratuberculosis
ucggcgacggcgacggcguccg

SEQ ID NO: 787065 - RNA, 14 nt, Mycobacterium avium subsp. paratuberculosis
ucggcgacggcgcu

SEQ ID NO: 787066 - RNA, 12 nt, Mycobacterium avium subsp. paratuberculosis
ucggcgacgccg

SEQ ID NO: 787067 - RNA, 13 nt, Mycobacterium avium subsp. paratuberculosis
ucggcgacgccgu

SEQ ID NO: 787068 - RNA, 21 nt, Mycobacterium avium subsp. paratuberculosis
ucggcgagcaccgugccgucg

SEQ ID NO: 787069 - RNA, 19 nt, Mycobacterium avium subsp. paratuberculosis
ucggcgagcaaggcgagca

SEQ ID NO: 787070 - RNA, 14 nt, Mycobacterium avium subsp. paratuberculosis
ucggcgagcaccgu

SEQ ID NO: 787071 - RNA, 16 nt, Mycobacterium avium subsp. paratuberculosis
ucggcgagcagccgcg

SEQ ID NO: 787072 - RNA, 20 nt, Mycobacterium avium subsp. paratuberculosis
ucggcgagcagccgcgccgg

SEQ ID NO: 787073 - RNA, 20 nt, Mycobacterium avium subsp. paratuberculosis
ucggcgugaauccucagcac

SEQ ID NO: 787074 - RNA, 16 nt, Mycobacterium avium subsp. paratuberculosis
ucggcgugaucccgau

SEQ ID NO: 787075 - RNA, 21 nt, Mycobacterium avium subsp. paratuberculosis
ucggcgugaucccgauccucg

SEQ ID NO: 787076 - RNA, 14 nt, Mycobacterium avium subsp. paratuberculosis
ucggcgugcagcac

SEQ ID NO: 787077 - RNA, 17 nt, Mycobacterium avium subsp. paratuberculosis
ucggcgugcccgccgac

SEQ ID NO: 787078 - RNA, 19 nt, Mycobacterium avium subsp. paratuberculosis
ucggcgucguacagcagcc

SEQ ID NO: 787079 - RNA, 14 nt, Mycobacterium avium subsp. paratuberculosis
ucggcgucggccac

SEQ ID NO: 787080 - RNA, 15 nt, Mycobacterium avium subsp. paratuberculosis
ucggcgucggccacc

SEQ ID NO: 787081 - RNA, 17 nt, Mycobacterium avium subsp. paratuberculosis
ucggcgucggccaccgc

SEQ ID NO: 787082 - RNA, 13 nt, Mycobacterium avium subsp. paratuberculosis
ucggcgucggcgc

SEQ ID NO: 787083 - RNA, 12 nt, Mycobacterium avium subsp. paratuberculosis
ucggcgucgggc

SEQ ID NO: 787084 - RNA, 13 nt, Mycobacterium avium subsp. paratuberculosis
ucggcgucgggcc

SEQ ID NO: 787085 - RNA, 14 nt, Mycobacterium avium subsp. paratuberculosis
ucggcgucgggcgg

SEQ ID NO: 787086 - RNA, 15 nt, Mycobacterium avium subsp. paratuberculosis
ucggcgucucggccc

SEQ ID NO: 787087 - RNA, 18 nt, Mycobacterium avium subsp. paratuberculosis
ucggcgucucggcccgag

SEQ ID NO: 787088 - RNA, 15 nt, Mycobacterium avium subsp. paratuberculosis
ucggcgucucggcgu

SEQ ID NO: 787089 - RNA, 17 nt, Mycobacterium avium subsp. paratuberculosis
ucggcucgagcucgucg

SEQ ID NO: 787090 - RNA, 17 nt, Mycobacterium avium subsp. paratuberculosis
ucggcucgaucgucagg

SEQ ID NO: 787091 - RNA, 16 nt, Mycobacterium avium subsp. paratuberculosis
ucggcucgcccgcgac

SEQ ID NO: 787092 - RNA, 19 nt, Mycobacterium avium subsp. paratuberculosis
ucggcucgcccgcgacugu

SEQ ID NO: 787093 - RNA, 13 nt, Mycobacterium avium subsp. paratuberculosis
ucggcucgccgau

SEQ ID NO: 787094 - RNA, 16 nt, Mycobacterium avium subsp. paratuberculosis
ucggcucgccgauccg

SEQ ID NO: 787095 - RNA, 14 nt, Mycobacterium avium subsp. paratuberculosis
ucggcgugcucggc

SEQ ID NO: 787096 - RNA, 16 nt, Mycobacterium avium subsp. paratuberculosis
ucggcgugcucggcca

SEQ ID NO: 787097 - RNA, 22 nt, Mycobacterium avium subsp. paratuberculosis
ucggcgugcucggccacgacgc

SEQ ID NO: 787098 - RNA, 20 nt, Mycobacterium avium subsp. paratuberculosis
ucggcgugcucgucgcggag

SEQ ID NO: 787099 - RNA, 13 nt, Mycobacterium avium subsp. paratuberculosis
ucggcguggcagg

SEQ ID NO: 787100 - RNA, 14 nt, Mycobacterium avium subsp. paratuberculosis
ucggcguggcaggc

SEQ ID NO: 787101 - RNA, 14 nt, Mycobacterium avium subsp. paratuberculosis
ucggcucggccggc

SEQ ID NO: 787102 - RNA, 16 nt, Mycobacterium avium subsp. paratuberculosis
ucggcucggccggccg

SEQ ID NO: 787103 - RNA, 22 nt, Mycobacterium avium subsp. paratuberculosis
ucggcucggcgacaacagcgcc

SEQ ID NO: 787104 - RNA, 22 nt, Mycobacterium avium subsp. paratuberculosis
ucggcucguguccgaugacgag

SEQ ID NO: 787105 - RNA, 13 nt, Mycobacterium avium subsp. paratuberculosis
ucggcggccugcg

SEQ ID NO: 787106 - RNA, 16 nt, Mycobacterium avium subsp. paratuberculosis
ucggcggccugcggcg

SEQ ID NO: 787107 - RNA, 13 nt, Mycobacterium avium subsp. paratuberculosis
ucggcggccugcu

SEQ ID NO: 787108 - RNA, 16 nt, Mycobacterium avium subsp. paratuberculosis
ucggcggccugcucca

SEQ ID NO: 787109 - RNA, 20 nt, Mycobacterium avium subsp. paratuberculosis
ucggcggccuugaacgcguc

SEQ ID NO: 787110 - RNA, 22 nt, Mycobacterium avium subsp. paratuberculosis
ucggcggccuuuuccggcgaca

SEQ ID NO: 787111 - RNA, 22 nt, Mycobacterium avium subsp. paratuberculosis
ucggcgucgcggcgcacccggg

SEQ ID NO: 787112 - RNA, 16 nt, Mycobacterium avium subsp. paratuberculosis
ucggcgucggaggcgg

SEQ ID NO: 787113 - RNA, 18 nt, Mycobacterium avium subsp. paratuberculosis
ucggcgucggaggcggcg

SEQ ID NO: 787114 - RNA, 14 nt, Mycobacterium avium subsp. paratuberculosis
ucggcggccucggu

SEQ ID NO: 787115 - RNA, 13 nt, Mycobacterium avium subsp. paratuberculosis
ucggcggccgcga

SEQ ID NO: 787116 - RNA, 21 nt, Mycobacterium avium subsp. paratuberculosis
ucggcggccgcgaaggcggcg

SEQ ID NO: 787117 - RNA, 22 nt, Mycobacterium avium subsp. paratuberculosis
ucggcggccgcgaaggcggcgu

SEQ ID NO: 787118 - RNA, 23 nt, Mycobacterium avium subsp. paratuberculosis
ucggcggccgcgaaggcggcguc

SEQ ID NO: 787119 - RNA, 19 nt, Mycobacterium avium subsp. paratuberculosis
ucggcggccaugucggagc

SEQ ID NO: 787120 - RNA, 13 nt, Mycobacterium avium subsp. paratuberculosis
ucggcggccgacc

SEQ ID NO: 787121 - RNA, 14 nt, Mycobacterium avium subsp. paratuberculosis
ucggcggccgagcg

SEQ ID NO: 787122 - RNA, 21 nt, Mycobacterium avium subsp. paratuberculosis
ucggcggcccgcuugccgacg

SEQ ID NO: 787123 - RNA, 14 nt, Mycobacterium avium subsp. paratuberculosis
ucggcggccgagga

SEQ ID NO: 787124 - RNA, 19 nt, Mycobacterium avium subsp. paratuberculosis
ucggcggccgcccgggcgg

SEQ ID NO: 787125 - RNA, 15 nt, Mycobacterium avium subsp. paratuberculosis
ucggcgcgucggcgu

SEQ ID NO: 787126 - RNA, 19 nt, Mycobacterium avium subsp. paratuberculosis
ucggcgcgucguacaccuc

SEQ ID NO: 787127 - RNA, 19 nt, Mycobacterium avium subsp. paratuberculosis
ucggcgcgucguccgacac

SEQ ID NO: 787128 - RNA, 22 nt, Mycobacterium avium subsp. paratuberculosis
ucggcgcgucguccgacaccac

SEQ ID NO: 787129 - RNA, 16 nt, Mycobacterium avium subsp. paratuberculosis
ucggcgcucgccgcgc

SEQ ID NO: 787130 - RNA, 21 nt, Mycobacterium avium subsp. paratuberculosis
ucggcgcucgccgcgcggccc

SEQ ID NO: 787131 - RNA, 18 nt, Mycobacterium avium subsp. paratuberculosis
ucggcgcucgcgggugcg

SEQ ID NO: 787132 - RNA, 22 nt, Mycobacterium avium subsp. paratuberculosis
ucggcgcugaacugcucgacca

SEQ ID NO: 787133 - RNA, 17 nt, Mycobacterium avium subsp. paratuberculosis
ucgggcaacgcgccggc

SEQ ID NO: 787134 - RNA, 22 nt, Mycobacterium avium subsp. paratuberculosis
ucgggcaacgcgccggcggucg

SEQ ID NO: 787135 - RNA, 20 nt, Mycobacterium avium subsp. paratuberculosis
ucgggcaaucggacccagcc

SEQ ID NO: 787136 - RNA, 21 nt, Mycobacterium avium subsp. paratuberculosis
ucgggcaaucggacccagccc

SEQ ID NO: 787137 - RNA, 18 nt, Mycobacterium avium subsp. paratuberculosis
ucgggaugucgugggcgu

SEQ ID NO: 787138 - RNA, 19 nt, Mycobacterium avium subsp. paratuberculosis
ucgggauuggacagcggcg

SEQ ID NO: 787139 - RNA, 20 nt, Mycobacterium avium subsp. paratuberculosis
ucgggauuggacagcggcgc

SEQ ID NO: 787140 - RNA, 15 nt, Mycobacterium avium subsp. paratuberculosis
ucgggauuggcggcc

SEQ ID NO: 787141 - RNA, 18 nt, Mycobacterium avium subsp. paratuberculosis
ucgggaucgccgaagcgg

SEQ ID NO: 787142 - RNA, 16 nt, Mycobacterium avium subsp. paratuberculosis
ucgggaucggcgccca

SEQ ID NO: 787143 - RNA, 20 nt, Mycobacterium avium subsp. paratuberculosis
ucgggaucggugaagcggcg

SEQ ID NO: 787144 - RNA, 21 nt, Mycobacterium avium subsp. paratuberculosis
ucgggaucggugaagcggcgc

SEQ ID NO: 787145 - RNA, 18 nt, Mycobacterium avium subsp. paratuberculosis
ucgggaucagccguaccg

SEQ ID NO: 787146 - RNA, 14 nt, Mycobacterium avium subsp. paratuberculosis
ucgggauccaggaa

SEQ ID NO: 787147 - RNA, 15 nt, Mycobacterium avium subsp. paratuberculosis
ucgggauccaggaac

SEQ ID NO: 787148 - RNA, 20 nt, Mycobacterium avium subsp. paratuberculosis
ucgggauccaggaacggcac

SEQ ID NO: 787149 - RNA, 19 nt, Mycobacterium avium subsp. paratuberculosis
ucgggacgcggcaggcgcc

SEQ ID NO: 787150 - RNA, 16 nt, Mycobacterium avium subsp. paratuberculosis
ucgggacgucggcgcg

SEQ ID NO: 787151 - RNA, 20 nt, Mycobacterium avium subsp. paratuberculosis
ucgggacgucggcgcgcucg

SEQ ID NO: 787152 - RNA, 24 nt, Mycobacterium avium subsp. paratuberculosis
ucgggacgucggcgcgcucggugc

SEQ ID NO: 787153 - RNA, 16 nt, Mycobacterium avium subsp. paratuberculosis
ucgggauacucguccu

SEQ ID NO: 787154 - RNA, 19 nt, Mycobacterium avium subsp. paratuberculosis
ucgggauagccgagcggcg

SEQ ID NO: 787155 - RNA, 20 nt, Mycobacterium avium subsp. paratuberculosis
ucgggauagccgagcggcgc

SEQ ID NO: 787156 - RNA, 22 nt, Mycobacterium avium subsp. paratuberculosis
ucgggauagggcgcgucgaucg

SEQ ID NO: 787157 - RNA, 18 nt, Mycobacterium avium subsp. paratuberculosis
ucggcuggcgugcggcgc

SEQ ID NO: 787158 - RNA, 17 nt, Mycobacterium avium subsp. paratuberculosis
ucggcuggucggcggcc

SEQ ID NO: 787159 - RNA, 17 nt, Mycobacterium avium subsp. paratuberculosis
ucggcuuccuccucggc

SEQ ID NO: 787160 - RNA, 16 nt, Mycobacterium avium subsp. paratuberculosis
ucgggacccuugucca

SEQ ID NO: 787161 - RNA, 15 nt, Mycobacterium avium subsp. paratuberculosis
ucgggaccgaugccg

SEQ ID NO: 787162 - RNA, 21 nt, Mycobacterium avium subsp. paratuberculosis
ucgggaccgaugccgcugauc

SEQ ID NO: 787163 - RNA, 15 nt, Mycobacterium avium subsp. paratuberculosis
ucgggacgccacggc

SEQ ID NO: 787164 - RNA, 20 nt, Mycobacterium avium subsp. paratuberculosis
ucgggacgccacggcgaaca

SEQ ID NO: 787165 - RNA, 20 nt, Mycobacterium avium subsp. paratuberculosis
ucgggaccgucaccguggcg

SEQ ID NO: 787166 - RNA, 21 nt, Mycobacterium avium subsp. paratuberculosis
ucgggaccgucaccguggcgg

SEQ ID NO: 787167 - RNA, 17 nt, Mycobacterium avium subsp. paratuberculosis
ucgggaccgucgcgcag

SEQ ID NO: 787168 - RNA, 18 nt, Mycobacterium avium subsp. paratuberculosis
ucgggaccgucgcgcagc

SEQ ID NO: 787169 - RNA, 17 nt, Mycobacterium avium subsp. paratuberculosis
ucgggaaaucggaccca

SEQ ID NO: 787170 - RNA, 23 nt, Mycobacterium avium subsp. paratuberculosis
ucgggaaaucggacccagcccgg

SEQ ID NO: 787171 - RNA, 17 nt, Mycobacterium avium subsp. paratuberculosis
ucgggaaaugcgucggc

SEQ ID NO: 787172 - RNA, 15 nt, Mycobacterium avium subsp. paratuberculosis
ucgggaacagcccgc

SEQ ID NO: 787173 - RNA, 17 nt, Mycobacterium avium subsp. paratuberculosis
ucgggaacgccgaucac

SEQ ID NO: 787174 - RNA, 18 nt, Mycobacterium avium subsp. paratuberculosis
ucggcuuucucgccaaua

SEQ ID NO: 787175 - RNA, 12 nt, Mycobacterium avium subsp. paratuberculosis
ucgcuggcggcg

SEQ ID NO: 787176 - RNA, 21 nt, Mycobacterium avium subsp. paratuberculosis
ucggaaugaacugccgcggca

SEQ ID NO: 787177 - RNA, 22 nt, Mycobacterium avium subsp. paratuberculosis
ucggaaugaacugccgcggcac

SEQ ID NO: 787178 - RNA, 13 nt, Mycobacterium avium subsp. paratuberculosis
ucgcuggcgcgcu

SEQ ID NO: 787179 - RNA, 14 nt, Mycobacterium avium subsp. paratuberculosis
ucggacccagcccg

SEQ ID NO: 787180 - RNA, 16 nt, Mycobacterium avium subsp. paratuberculosis
ucggacccagcccgau

SEQ ID NO: 787181 - RNA, 16 nt, Mycobacterium avium subsp. paratuberculosis
ucggacccagcccggc

SEQ ID NO: 787182 - RNA, 21 nt, Mycobacterium avium subsp. paratuberculosis
ucggacccagcccggcgacga

SEQ ID NO: 787183 - RNA, 13 nt, Mycobacterium avium subsp. paratuberculosis
ucggacagguggc

SEQ ID NO: 787184 - RNA, 15 nt, Mycobacterium avium subsp. paratuberculosis
ucggacacggcgccg

SEQ ID NO: 787185 - RNA, 19 nt, Mycobacterium avium subsp. paratuberculosis
ucggacacggcgccgugcg

SEQ ID NO: 787186 - RNA, 20 nt, Mycobacterium avium subsp. paratuberculosis
ucggacagcagcaccggcac

SEQ ID NO: 787187 - RNA, 18 nt, Mycobacterium avium subsp. paratuberculosis
ucggacuccuccugcgac

SEQ ID NO: 787188 - RNA, 15 nt, Mycobacterium avium subsp. paratuberculosis
ucggacucgcgccgg

SEQ ID NO: 787189 - RNA, 21 nt, Mycobacterium avium subsp. paratuberculosis
ucggacgagccgucgcgggaa

SEQ ID NO: 787190 - RNA, 13 nt, Mycobacterium avium subsp. paratuberculosis
ucggacggcgacg

SEQ ID NO: 787191 - RNA, 15 nt, Mycobacterium avium subsp. paratuberculosis
ucggacggcgacggc

SEQ ID NO: 787192 - RNA, 18 nt, Mycobacterium avium subsp. paratuberculosis
ucggacggcgacggcagc

SEQ ID NO: 787193 - RNA, 20 nt, Mycobacterium avium subsp. paratuberculosis
ucggacggcgacggcagcgc

SEQ ID NO: 787194 - RNA, 23 nt, Mycobacterium avium subsp. paratuberculosis
ucgcugcgcucgccgucggccag

SEQ ID NO: 787195 - RNA, 24 nt, Mycobacterium avium subsp. paratuberculosis
ucgcugcgcucgccgucggccagc

SEQ ID NO: 787196 - RNA, 17 nt, Mycobacterium avium subsp. paratuberculosis
ucgcugcucugcgcgcg

SEQ ID NO: 787197 - RNA, 19 nt, Mycobacterium avium subsp. paratuberculosis
ucgcugcucaugagcccuc

SEQ ID NO: 787198 - RNA, 19 nt, Mycobacterium avium subsp. paratuberculosis
ucgcuggaaaccucuugcg

SEQ ID NO: 787199 - RNA, 22 nt, Mycobacterium avium subsp. paratuberculosis
ucgcuggaaaccucuugcggcg

SEQ ID NO: 787200 - RNA, 23 nt, Mycobacterium avium subsp. paratuberculosis
ucgcuggaaaccucuugcggcgc

SEQ ID NO: 787201 - RNA, 18 nt, Mycobacterium avium subsp. paratuberculosis
ucgcuggacagccacagc

SEQ ID NO: 787202 - RNA, 12 nt, Mycobacterium avium subsp. paratuberculosis
ucgcugcgcccg

SEQ ID NO: 787203 - RNA, 16 nt, Mycobacterium avium subsp. paratuberculosis
ucgcugcgccgaacgu

SEQ ID NO: 787204 - RNA, 12 nt, Mycobacterium avium subsp. paratuberculosis
ucgcugcgccgg

SEQ ID NO: 787205 - RNA, 13 nt, Mycobacterium avium subsp. paratuberculosis
ucgcugcgccggc

SEQ ID NO: 787206 - RNA, 17 nt, Mycobacterium avium subsp. paratuberculosis
ucgcugccguccacccg

SEQ ID NO: 787207 - RNA, 16 nt, Mycobacterium avium subsp. paratuberculosis
ucgcugcgagcccggc

SEQ ID NO: 787208 - RNA, 19 nt, Mycobacterium avium subsp. paratuberculosis
ucgcugcgagcccggccag

SEQ ID NO: 787209 - RNA, 18 nt, Mycobacterium avium subsp. paratuberculosis
ucgcugcccaacgucgac

SEQ ID NO: 787210 - RNA, 13 nt, Mycobacterium avium subsp. paratuberculosis
ucgcugccccggc

SEQ ID NO: 787211 - RNA, 17 nt, Mycobacterium avium subsp. paratuberculosis
ucgcugccccggcgagg

SEQ ID NO: 787212 - RNA, 12 nt, Mycobacterium avium subsp. paratuberculosis
ucgcugcccggc

SEQ ID NO: 787213 - RNA, 19 nt, Mycobacterium avium subsp. paratuberculosis
ucgcugccgcccccgcugg

SEQ ID NO: 787214 - RNA, 13 nt, Mycobacterium avium subsp. paratuberculosis
ucgcugccggccg

SEQ ID NO: 787215 - RNA, 18 nt, Mycobacterium avium subsp. paratuberculosis
ucgcugccggccggggcg

SEQ ID NO: 787216 - RNA, 20 nt, Mycobacterium avium subsp. paratuberculosis
ucgcugaucgcgauccgggc

SEQ ID NO: 787217 - RNA, 16 nt, Mycobacterium avium subsp. paratuberculosis
ucgcugaucucgacgg

SEQ ID NO: 787218 - RNA, 19 nt, Mycobacterium avium subsp. paratuberculosis
ucgcugaucucgacggugg

SEQ ID NO: 787219 - RNA, 19 nt, Mycobacterium avium subsp. paratuberculosis
ucgcugaucugcggcacca

SEQ ID NO: 787220 - RNA, 23 nt, Mycobacterium avium subsp. paratuberculosis
ucgcugcagcauuuccgagcgac

SEQ ID NO: 787221 - RNA, 14 nt, Mycobacterium avium subsp. paratuberculosis
ucgcugcagcggcg

SEQ ID NO: 787222 - RNA, 17 nt, Mycobacterium avium subsp. paratuberculosis
ucgcugcagcggcggcc

SEQ ID NO: 787223 - RNA, 20 nt, Mycobacterium avium subsp. paratuberculosis
ucgcugcaguagccggccag

SEQ ID NO: 787224 - RNA, 21 nt, Mycobacterium avium subsp. paratuberculosis
ucgcugccacguacaccggga

SEQ ID NO: 787225 - RNA, 20 nt, Mycobacterium avium subsp. paratuberculosis
ucgcugacgccgagcagcuc

SEQ ID NO: 787226 - RNA, 19 nt, Mycobacterium avium subsp. paratuberculosis
ucgcuccacaucugccggc

SEQ ID NO: 787227 - RNA, 16 nt, Mycobacterium avium subsp. paratuberculosis
ucgcuauaucgcaccg

SEQ ID NO: 787228 - RNA, 17 nt, Mycobacterium avium subsp. paratuberculosis
ucgcucagaggcgggca

SEQ ID NO: 787229 - RNA, 19 nt, Mycobacterium avium subsp. paratuberculosis
ucgcucagaggcgggcacu

SEQ ID NO: 787230 - RNA, 16 nt, Mycobacterium avium subsp. paratuberculosis
ucgcggaacagccggc

SEQ ID NO: 787231 - RNA, 15 nt, Mycobacterium avium subsp. paratuberculosis
ucgcggaaccggccg

SEQ ID NO: 787232 - RNA, 20 nt, Mycobacterium avium subsp. paratuberculosis
ucgcggaaccguugcagcac

SEQ ID NO: 787233 - RNA, 19 nt, Mycobacterium avium subsp. paratuberculosis
ucgcggacccuggccagca

SEQ ID NO: 787234 - RNA, 21 nt, Mycobacterium avium subsp. paratuberculosis
ucgcggacccuggccagcacc

SEQ ID NO: 787235 - RNA, 23 nt, Mycobacterium avium subsp. paratuberculosis
ucgcggacccuggccagcaccgc

SEQ ID NO: 787236 - RNA, 21 nt, Mycobacterium avium subsp. paratuberculosis
ucgcggacuggugggcgucgu

SEQ ID NO: 787237 - RNA, 14 nt, Mycobacterium avium subsp. paratuberculosis
ucggcaccgugccg

SEQ ID NO: 787238 - RNA, 21 nt, Mycobacterium avium subsp. paratuberculosis
ucggcaccgugccgcgcggcg

SEQ ID NO: 787239 - RNA, 22 nt, Mycobacterium avium subsp. paratuberculosis
ucggcaccgugccgcgcggcgg

SEQ ID NO: 787240 - RNA, 23 nt, Mycobacterium avium subsp. paratuberculosis
ucggcaccgugccgcgcggcggu

SEQ ID NO: 787241 - RNA, 20 nt, Mycobacterium avium subsp. paratuberculosis
ucggcacgccggggcccucg

SEQ ID NO: 787242 - RNA, 15 nt, Mycobacterium avium subsp. paratuberculosis
ucggcagacccagca

SEQ ID NO: 787243 - RNA, 22 nt, Mycobacterium avium subsp. paratuberculosis
ucggcagaccggugagcaccgg

SEQ ID NO: 787244 - RNA, 19 nt, Mycobacterium avium subsp. paratuberculosis
ucggaguugcgcagccggg

SEQ ID NO: 787245 - RNA, 23 nt, Mycobacterium avium subsp. paratuberculosis
ucggaguucgcccgcagcacgcc

SEQ ID NO: 787246 - RNA, 18 nt, Mycobacterium avium subsp. paratuberculosis
ucggaguaguccagcacc

SEQ ID NO: 787247 - RNA, 19 nt, Mycobacterium avium subsp. paratuberculosis
ucggaguaguuccggcggu

SEQ ID NO: 787248 - RNA, 15 nt, Mycobacterium avium subsp. paratuberculosis
ucggagcugcgcgcc

SEQ ID NO: 787249 - RNA, 20 nt, Mycobacterium avium subsp. paratuberculosis
ucggagcugcgcgccccggc

SEQ ID NO: 787250 - RNA, 19 nt, Mycobacterium avium subsp. paratuberculosis
ucggaggcuucgcucaucc

SEQ ID NO: 787251 - RNA, 14 nt, Mycobacterium avium subsp. paratuberculosis
ucggaggugccgcg

SEQ ID NO: 787252 - RNA, 21 nt, Mycobacterium avium subsp. paratuberculosis
ucggagagcuugccgcggauc

SEQ ID NO: 787253 - RNA, 14 nt, Mycobacterium avium subsp. paratuberculosis
ucggagaucaccgg

SEQ ID NO: 787254 - RNA, 23 nt, Mycobacterium avium subsp. paratuberculosis
ucggagaucaccggcacccccaa

SEQ ID NO: 787255 - RNA, 19 nt, Mycobacterium avium subsp. paratuberculosis
ucggagcaaauccggcagc

SEQ ID NO: 787256 - RNA, 20 nt, Mycobacterium avium subsp. paratuberculosis
ucggagcaaauccggcagcg

SEQ ID NO: 787257 - RNA, 13 nt, Mycobacterium avium subsp. paratuberculosis
ucggagcccagcg

SEQ ID NO: 787258 - RNA, 15 nt, Mycobacterium avium subsp. paratuberculosis
ucggagacguggcgg

SEQ ID NO: 787259 - RNA, 18 nt, Mycobacterium avium subsp. paratuberculosis
ucggaggccaccgcgccg

SEQ ID NO: 787260 - RNA, 20 nt, Mycobacterium avium subsp. paratuberculosis
ucggaggccaccgcgccguc

SEQ ID NO: 787261 - RNA, 14 nt, Mycobacterium avium subsp. paratuberculosis
ucggcagcaccggc

SEQ ID NO: 787262 - RNA, 16 nt, Mycobacterium avium subsp. paratuberculosis
ucggcagcaccggcag

SEQ ID NO: 787263 - RNA, 20 nt, Mycobacterium avium subsp. paratuberculosis
ucggcagcagggugccgccg

SEQ ID NO: 787264 - RNA, 20 nt, Mycobacterium avium subsp. paratuberculosis
ucggcauaacgcaaccgguc

SEQ ID NO: 787265 - RNA, 16 nt, Mycobacterium avium subsp. paratuberculosis
ucggcauagcgccgcu

SEQ ID NO: 787266 - RNA, 20 nt, Mycobacterium avium subsp. paratuberculosis
ucggcauagcgccgcucggc

SEQ ID NO: 787267 - RNA, 17 nt, Mycobacterium avium subsp. paratuberculosis
ucggcaugacgcccagc

SEQ ID NO: 787268 - RNA, 18 nt, Mycobacterium avium subsp. paratuberculosis
ucggcaucgcgcgcggcg

SEQ ID NO: 787269 - RNA, 16 nt, Mycobacterium avium subsp. paratuberculosis
ucggccaacagugcgc

SEQ ID NO: 787270 - RNA, 19 nt, Mycobacterium avium subsp. paratuberculosis
ucggccagcaccagcagcc

SEQ ID NO: 787271 - RNA, 24 nt, Mycobacterium avium subsp. paratuberculosis
ucggccagcaccagcagccggucg

SEQ ID NO: 787272 - RNA, 23 nt, Mycobacterium avium subsp. paratuberculosis
ucggccagcaccaggaaggcgac

SEQ ID NO: 787273 - RNA, 19 nt, Mycobacterium avium subsp. paratuberculosis
ucggccagccccaccaccg

SEQ ID NO: 787274 - RNA, 23 nt, Mycobacterium avium subsp. paratuberculosis
ucggccagccccaccaccgccac

SEQ ID NO: 787275 - RNA, 14 nt, Mycobacterium avium subsp. paratuberculosis
ucggccagccacgc

SEQ ID NO: 787276 - RNA, 22 nt, Mycobacterium avium subsp. paratuberculosis
ucggccagccaggccgucggcg

SEQ ID NO: 787277 - RNA, 14 nt, Mycobacterium avium subsp. paratuberculosis
ucggccagccccac

SEQ ID NO: 787278 - RNA, 19 nt, Mycobacterium avium subsp. paratuberculosis
ucggccagcaggucgucga

SEQ ID NO: 787279 - RNA, 17 nt, Mycobacterium avium subsp. paratuberculosis
ucggccagcagcgcguc

SEQ ID NO: 787280 - RNA, 17 nt, Mycobacterium avium subsp. paratuberculosis
ucggccaucagccgccg

SEQ ID NO: 787281 - RNA, 15 nt, Mycobacterium avium subsp. paratuberculosis
ucggccauccgggcg

SEQ ID NO: 787282 - RNA, 22 nt, Mycobacterium avium subsp. paratuberculosis
ucggccagcgcgcgggcgcgcg

SEQ ID NO: 787283 - RNA, 24 nt, Mycobacterium avium subsp. paratuberculosis
ucggccagcgcgcgggcgcgcgcc

SEQ ID NO: 787284 - RNA, 13 nt, Mycobacterium avium subsp. paratuberculosis
ucggccagcgcgc

SEQ ID NO: 787285 - RNA, 14 nt, Mycobacterium avium subsp. paratuberculosis
ucggccagcgcgcc

SEQ ID NO: 787286 - RNA, 13 nt, Mycobacterium avium subsp. paratuberculosis
ucggccagcgccg

SEQ ID NO: 787287 - RNA, 21 nt, Mycobacterium avium subsp. paratuberculosis
ucggccagcgccgccagccgc

SEQ ID NO: 787288 - RNA, 15 nt, Mycobacterium avium subsp. paratuberculosis
ucggccagcgccgcg

SEQ ID NO: 787289 - RNA, 23 nt, Mycobacterium avium subsp. paratuberculosis
ucggccagcgccgcgcgcgcggc

SEQ ID NO: 787290 - RNA, 15 nt, Mycobacterium avium subsp. paratuberculosis
ucggccagcgcggcc

SEQ ID NO: 787291 - RNA, 18 nt, Mycobacterium avium subsp. paratuberculosis
ucggccagcgcggccggg

SEQ ID NO: 787292 - RNA, 22 nt, Mycobacterium avium subsp. paratuberculosis
ucggccagcgcggccgggcgcc

SEQ ID NO: 787293 - RNA, 22 nt, Mycobacterium avium subsp. paratuberculosis
ucggccagcgcggcggccagcu

SEQ ID NO: 787294 - RNA, 15 nt, Mycobacterium avium subsp. paratuberculosis
ucggccagcgcgucg

SEQ ID NO: 787295 - RNA, 17 nt, Mycobacterium avium subsp. paratuberculosis
ucggccagcgcgucggc

SEQ ID NO: 787296 - RNA, 14 nt, Mycobacterium avium subsp. paratuberculosis
ucggccgacucgau

SEQ ID NO: 787297 - RNA, 17 nt, Mycobacterium avium subsp. paratuberculosis
ucggccgagucgacgug

SEQ ID NO: 787298 - RNA, 12 nt, Mycobacterium avium subsp. paratuberculosis
ucggccgaugag

SEQ ID NO: 787299 - RNA, 13 nt, Mycobacterium avium subsp. paratuberculosis
ucggcccgccggg

SEQ ID NO: 787300 - RNA, 22 nt, Mycobacterium avium subsp. paratuberculosis
ucggcccgccgggcgccacgcu

SEQ ID NO: 787301 - RNA, 22 nt, Mycobacterium avium subsp. paratuberculosis
ucggcccgacggguucgcgcag

SEQ ID NO: 787302 - RNA, 22 nt, Mycobacterium avium subsp. paratuberculosis
ucggcccgcuucaggcagcgca

SEQ ID NO: 787303 - RNA, 13 nt, Mycobacterium avium subsp. paratuberculosis
ucggcccuccagc

SEQ ID NO: 787304 - RNA, 16 nt, Mycobacterium avium subsp. paratuberculosis
ucggccccggccgagc

SEQ ID NO: 787305 - RNA, 19 nt, Mycobacterium avium subsp. paratuberculosis
ucggccccggccgagccgg

SEQ ID NO: 787306 - RNA, 24 nt, Mycobacterium avium subsp. paratuberculosis
ucggccccggccgagccggcguac

SEQ ID NO: 787307 - RNA, 23 nt, Mycobacterium avium subsp. paratuberculosis
ucggcccaguccagucgcgccga

SEQ ID NO: 787308 - RNA, 15 nt, Mycobacterium avium subsp. paratuberculosis
ucggcccacggugag

SEQ ID NO: 787309 - RNA, 21 nt, Mycobacterium avium subsp. paratuberculosis
ucggcccacggugaggacacc

SEQ ID NO: 787310 - RNA, 13 nt, Mycobacterium avium subsp. paratuberculosis
ucggccaugccgc

SEQ ID NO: 787311 - RNA, 15 nt, Mycobacterium avium subsp. paratuberculosis
ucggccaugccgcgc

SEQ ID NO: 787312 - RNA, 17 nt, Mycobacterium avium subsp. paratuberculosis
ucccaaccccgggcggc

SEQ ID NO: 787313 - RNA, 19 nt, Mycobacterium avium subsp. paratuberculosis
ucccaacgcagcgcauccg

SEQ ID NO: 787314 - RNA, 18 nt, Mycobacterium avium subsp. paratuberculosis
ucccacaccaccaccgag

SEQ ID NO: 787315 - RNA, 15 nt, Mycobacterium avium subsp. paratuberculosis
ucccacgaacggguc

SEQ ID NO: 787316 - RNA, 17 nt, Mycobacterium avium subsp. paratuberculosis
ucccagcacagccgucg

SEQ ID NO: 787317 - RNA, 18 nt, Mycobacterium avium subsp. paratuberculosis
ucccagaauucgccgggg

SEQ ID NO: 787318 - RNA, 14 nt, Mycobacterium avium subsp. paratuberculosis
ucccagccgccggc

SEQ ID NO: 787319 - RNA, 21 nt, Mycobacterium avium subsp. paratuberculosis
ucccagccgccggccaccagg

SEQ ID NO: 787320 - RNA, 17 nt, Mycobacterium avium subsp. paratuberculosis
ucccagcccggccaguu

SEQ ID NO: 787321 - RNA, 22 nt, Mycobacterium avium subsp. paratuberculosis
ucccagcgcccgggcgcgugca

SEQ ID NO: 787322 - RNA, 15 nt, Mycobacterium avium subsp. paratuberculosis
ucccagucguuggug

SEQ ID NO: 787323 - RNA, 23 nt, Mycobacterium avium subsp. paratuberculosis
ucccagugccaguaccagcggcc

SEQ ID NO: 787324 - RNA, 20 nt, Mycobacterium avium subsp. paratuberculosis
ucccagugccgcagguggug

SEQ ID NO: 787325 - RNA, 23 nt, Mycobacterium avium subsp. paratuberculosis
ucccagugccgcagguggugggc

SEQ ID NO: 787326 - RNA, 22 nt, Mycobacterium avium subsp. paratuberculosis
ucccaguuguuuccccagcccg

SEQ ID NO: 787327 - RNA, 12 nt, Mycobacterium avium subsp. paratuberculosis
ucccagcggccg

SEQ ID NO: 787328 - RNA, 23 nt, Mycobacterium avium subsp. paratuberculosis
ucccagcgggacagcaccaccag

SEQ ID NO: 787329 - RNA, 19 nt, Mycobacterium avium subsp. paratuberculosis
ucccaggaacgcgcccggc

SEQ ID NO: 787330 - RNA, 14 nt, Mycobacterium avium subsp. paratuberculosis
ucccaggacgcggu

SEQ ID NO: 787331 - RNA, 19 nt, Mycobacterium avium subsp. paratuberculosis
ucccaggauuccgucggcg

SEQ ID NO: 787332 - RNA, 20 nt, Mycobacterium avium subsp. paratuberculosis
ucccaggauuccgucggcgg

SEQ ID NO: 787333 - RNA, 21 nt, Mycobacterium avium subsp. paratuberculosis
ucccaggauuccgucggcggc

SEQ ID NO: 787334 - RNA, 19 nt, Mycobacterium avium subsp. paratuberculosis
ucccaggcccaucgcgguc

SEQ ID NO: 787335 - RNA, 12 nt, Mycobacterium avium subsp. paratuberculosis
ucccaggccgcg

SEQ ID NO: 787336 - RNA, 23 nt, Mycobacterium avium subsp. paratuberculosis
ucccaggcguggucggcgcgguc

SEQ ID NO: 787337 - RNA, 16 nt, Mycobacterium avium subsp. paratuberculosis
ucccaggguugccgca

SEQ ID NO: 787338 - RNA, 17 nt, Mycobacterium avium subsp. paratuberculosis
uccccaaccuggacggu

SEQ ID NO: 787339 - RNA, 12 nt, Mycobacterium avium subsp. paratuberculosis
uccccagcggca

SEQ ID NO: 787340 - RNA, 15 nt, Mycobacterium avium subsp. paratuberculosis
uccccagcggcacga

SEQ ID NO: 787341 - RNA, 13 nt, Mycobacterium avium subsp. paratuberculosis
uccccagcacggu

SEQ ID NO: 787342 - RNA, 17 nt, Mycobacterium avium subsp. paratuberculosis
uccccagcacggugaug

SEQ ID NO: 787343 - RNA, 18 nt, Mycobacterium avium subsp. paratuberculosis
uccccagcugggccgcca

SEQ ID NO: 787344 - RNA, 20 nt, Mycobacterium avium subsp. paratuberculosis
uccccguugaucuugaccgu

SEQ ID NO: 787345 - RNA, 17 nt, Mycobacterium avium subsp. paratuberculosis
ucccgaggaugccgccc

SEQ ID NO: 787346 - RNA, 18 nt, Mycobacterium avium subsp. paratuberculosis
ucccgaggaugccgccca

SEQ ID NO: 787347 - RNA, 13 nt, Mycobacterium avium subsp. paratuberculosis
ucccgaccagcug

SEQ ID NO: 787348 - RNA, 21 nt, Mycobacterium avium subsp. paratuberculosis
ucccgaccccgccagcaccga

SEQ ID NO: 787349 - RNA, 23 nt, Mycobacterium avium subsp. paratuberculosis
ucccgacgcugacgaugcggccg

SEQ ID NO: 787350 - RNA, 14 nt, Mycobacterium avium subsp. paratuberculosis
ucccgacuccucac

SEQ ID NO: 787351 - RNA, 19 nt, Mycobacterium avium subsp. paratuberculosis
ucccgagcaucgccgagcg

SEQ ID NO: 787352 - RNA, 14 nt, Mycobacterium avium subsp. paratuberculosis
ucccgaaaccgucg

SEQ ID NO: 787353 - RNA, 15 nt, Mycobacterium avium subsp. paratuberculosis
ucccgaacagggcga

SEQ ID NO: 787354 - RNA, 23 nt, Mycobacterium avium subsp. paratuberculosis
ucccgaacagggcgacggcggcg

SEQ ID NO: 787355 - RNA, 19 nt, Mycobacterium avium subsp. paratuberculosis
ucccgacagggagccgacg

SEQ ID NO: 787356 - RNA, 19 nt, Mycobacterium avium subsp. paratuberculosis
ucccggcaacaccggcggc

SEQ ID NO: 787357 - RNA, 20 nt, Mycobacterium avium subsp. paratuberculosis
ucccggcagaacgacgccag

SEQ ID NO: 787358 - RNA, 17 nt, Mycobacterium avium subsp. paratuberculosis
ucccggaagugccggcg

SEQ ID NO: 787359 - RNA, 14 nt, Mycobacterium avium subsp. paratuberculosis
ucccggaccaccag

SEQ ID NO: 787360 - RNA, 14 nt, Mycobacterium avium subsp. paratuberculosis
ucccggacgcugcg

SEQ ID NO: 787361 - RNA, 14 nt, Mycobacterium avium subsp. paratuberculosis
ucccggagccgucg

SEQ ID NO: 787362 - RNA, 15 nt, Mycobacterium avium subsp. paratuberculosis
ucccggagccgucgg

SEQ ID NO: 787363 - RNA, 17 nt, Mycobacterium avium subsp. paratuberculosis
ucccggauggagcgcga

SEQ ID NO: 787364 - RNA, 18 nt, Mycobacterium avium subsp. paratuberculosis
ucccgcguauugcacggc

SEQ ID NO: 787365 - RNA, 22 nt, Mycobacterium avium subsp. paratuberculosis
ucccgcguauugcacggcggcg

SEQ ID NO: 787366 - RNA, 18 nt, Mycobacterium avium subsp. paratuberculosis
ucccgcuccauggcggcg

SEQ ID NO: 787367 - RNA, 16 nt, Mycobacterium avium subsp. paratuberculosis
ucccgcuucuggcggg

SEQ ID NO: 787368 - RNA, 15 nt, Mycobacterium avium subsp. paratuberculosis
ucccgcuuggcgguc

SEQ ID NO: 787369 - RNA, 16 nt, Mycobacterium avium subsp. paratuberculosis
ucccgauccgcgccgc

SEQ ID NO: 787370 - RNA, 17 nt, Mycobacterium avium subsp. paratuberculosis
ucccgauccgcgccgcc

SEQ ID NO: 787371 - RNA, 15 nt, Mycobacterium avium subsp. paratuberculosis
ucccgaguggcgccg

SEQ ID NO: 787372 - RNA, 15 nt, Mycobacterium avium subsp. paratuberculosis
ucccgaugucggcga

SEQ ID NO: 787373 - RNA, 16 nt, Mycobacterium avium subsp. paratuberculosis
ucccgcgcggcgcagg

SEQ ID NO: 787374 - RNA, 15 nt, Mycobacterium avium subsp. paratuberculosis
ucccgcgcgggcaag

SEQ ID NO: 787375 - RNA, 19 nt, Mycobacterium avium subsp. paratuberculosis
ucccgcgcgggggccgccg

SEQ ID NO: 787376 - RNA, 18 nt, Mycobacterium avium subsp. paratuberculosis
ucccgcggcagccgggcg

SEQ ID NO: 787377 - RNA, 22 nt, Mycobacterium avium subsp. paratuberculosis
ucccgcggcagccgggcgauca

SEQ ID NO: 787378 - RNA, 15 nt, Mycobacterium avium subsp. paratuberculosis
ucccgcgggucgcgg

SEQ ID NO: 787379 - RNA, 17 nt, Mycobacterium avium subsp. paratuberculosis
uccccgauuucgcggcc

SEQ ID NO: 787380 - RNA, 13 nt, Mycobacterium avium subsp. paratuberculosis
ucccccucggcgg

SEQ ID NO: 787381 - RNA, 15 nt, Mycobacterium avium subsp. paratuberculosis
ucccccucggcggga

SEQ ID NO: 787382 - RNA, 21 nt, Mycobacterium avium subsp. paratuberculosis
uccccgaccaucauggccucc

SEQ ID NO: 787383 - RNA, 20 nt, Mycobacterium avium subsp. paratuberculosis
ucccccgucgggccguccgc

SEQ ID NO: 787384 - RNA, 15 nt, Mycobacterium avium subsp. paratuberculosis
ucccccgccgaccgg

SEQ ID NO: 787385 - RNA, 20 nt, Mycobacterium avium subsp. paratuberculosis
ucccccgccgaccgguccgc

SEQ ID NO: 787386 - RNA, 16 nt, Mycobacterium avium subsp. paratuberculosis
ucccccggaccugccg

SEQ ID NO: 787387 - RNA, 18 nt, Mycobacterium avium subsp. paratuberculosis
ucccccggaccugccggc

SEQ ID NO: 787388 - RNA, 13 nt, Mycobacterium avium subsp. paratuberculosis
ucccccgacgccg

SEQ ID NO: 787389 - RNA, 17 nt, Mycobacterium avium subsp. paratuberculosis
ucccccgacgccgacac

SEQ ID NO: 787390 - RNA, 18 nt, Mycobacterium avium subsp. paratuberculosis
ucccccgacgccgacacc

SEQ ID NO: 787391 - RNA, 12 nt, Mycobacterium avium subsp. paratuberculosis
ucccccgagucg

SEQ ID NO: 787392 - RNA, 23 nt, Mycobacterium avium subsp. paratuberculosis
uccccauccgcggccaccgggac

SEQ ID NO: 787393 - RNA, 20 nt, Mycobacterium avium subsp. paratuberculosis
uccccgcgcccgccgcguac

SEQ ID NO: 787394 - RNA, 15 nt, Mycobacterium avium subsp. paratuberculosis
uccccgcgccgggca

SEQ ID NO: 787395 - RNA, 16 nt, Mycobacterium avium subsp. paratuberculosis
uccccgcgccgggcaa

SEQ ID NO: 787396 - RNA, 16 nt, Mycobacterium avium subsp. paratuberculosis
uccccgcgcugggcug

SEQ ID NO: 787397 - RNA, 16 nt, Mycobacterium avium subsp. paratuberculosis
uccccgccggagauga

SEQ ID NO: 787398 - RNA, 16 nt, Mycobacterium avium subsp. paratuberculosis
uccccggagagccggu

SEQ ID NO: 787399 - RNA, 15 nt, Mycobacterium avium subsp. paratuberculosis
uccccggagucgucg

SEQ ID NO: 787400 - RNA, 18 nt, Mycobacterium avium subsp. paratuberculosis
uccccgcuagccucaacg

SEQ ID NO: 787401 - RNA, 20 nt, Mycobacterium avium subsp. paratuberculosis
uccccgcuagccucaacgac

SEQ ID NO: 787402 - RNA, 13 nt, Mycobacterium avium subsp. paratuberculosis
uccccggccagca

SEQ ID NO: 787403 - RNA, 21 nt, Mycobacterium avium subsp. paratuberculosis
uccccggccggcccgcccggc

SEQ ID NO: 787404 - RNA, 16 nt, Mycobacterium avium subsp. paratuberculosis
uccccgggcaccccgg

SEQ ID NO: 787405 - RNA, 12 nt, Mycobacterium avium subsp. paratuberculosis
uccccgggccca

SEQ ID NO: 787406 - RNA, 15 nt, Mycobacterium avium subsp. paratuberculosis
uccccgggcccagca

SEQ ID NO: 787407 - RNA, 19 nt, Mycobacterium avium subsp. paratuberculosis
uccccgggcccagcaccac

SEQ ID NO: 787408 - RNA, 18 nt, Mycobacterium avium subsp. paratuberculosis
uccccgggcgagcgucgc

SEQ ID NO: 787409 - RNA, 21 nt, Mycobacterium avium subsp. paratuberculosis
uccccgggcgugccggacacc

SEQ ID NO: 787410 - RNA, 13 nt, Mycobacterium avium subsp. paratuberculosis
uccccggcggccg

SEQ ID NO: 787411 - RNA, 21 nt, Mycobacterium avium subsp. paratuberculosis
uccccggcggccggccccggc

SEQ ID NO: 787412 - RNA, 12 nt, Mycobacterium avium subsp. paratuberculosis
uccccggcgggc

SEQ ID NO: 787413 - RNA, 14 nt, Mycobacterium avium subsp. paratuberculosis
uccccggcgugggu

SEQ ID NO: 787414 - RNA, 14 nt, Mycobacterium avium subsp. paratuberculosis
uccggcuccacagc

SEQ ID NO: 787415 - RNA, 16 nt, Mycobacterium avium subsp. paratuberculosis
uccggcuccacagcag

SEQ ID NO: 787416 - RNA, 19 nt, Mycobacterium avium subsp. paratuberculosis
uccggcguaucuccaccgu

SEQ ID NO: 787417 - RNA, 20 nt, Mycobacterium avium subsp. paratuberculosis
uccggcguaucuccaccguc

SEQ ID NO: 787418 - RNA, 17 nt, Mycobacterium avium subsp. paratuberculosis
uccggcgugcagcacgc

SEQ ID NO: 787419 - RNA, 15 nt, Mycobacterium avium subsp. paratuberculosis
uccggcgugccaccg

SEQ ID NO: 787420 - RNA, 19 nt, Mycobacterium avium subsp. paratuberculosis
uccggcggucagcaccguc

SEQ ID NO: 787421 - RNA, 22 nt, Mycobacterium avium subsp. paratuberculosis
uccggcggucgcugcagcggcg

SEQ ID NO: 787422 - RNA, 14 nt, Mycobacterium avium subsp. paratuberculosis
uccggcgggccucg

SEQ ID NO: 787423 - RNA, 15 nt, Mycobacterium avium subsp. paratuberculosis
uccggcgggccucgc

SEQ ID NO: 787424 - RNA, 22 nt, Mycobacterium avium subsp. paratuberculosis
uccggcgggcgccggucggcgg

SEQ ID NO: 787425 - RNA, 13 nt, Mycobacterium avium subsp. paratuberculosis
uccggcggccggc

SEQ ID NO: 787426 - RNA, 14 nt, Mycobacterium avium subsp. paratuberculosis
uccggcggcgcuca

SEQ ID NO: 787427 - RNA, 18 nt, Mycobacterium avium subsp. paratuberculosis
uccggcggcgcucagcgc

SEQ ID NO: 787428 - RNA, 20 nt, Mycobacterium avium subsp. paratuberculosis
uccggcggcgcucagcgcgg

SEQ ID NO: 787429 - RNA, 23 nt, Mycobacterium avium subsp. paratuberculosis
uccggcggcgcucagcgcggcgg

SEQ ID NO: 787430 - RNA, 12 nt, Mycobacterium avium subsp. paratuberculosis
uccggcgacacc

SEQ ID NO: 787431 - RNA, 13 nt, Mycobacterium avium subsp. paratuberculosis
uccggcgacaccg

SEQ ID NO: 787432 - RNA, 17 nt, Mycobacterium avium subsp. paratuberculosis
uccggccgcgccggccu

SEQ ID NO: 787433 - RNA, 17 nt, Mycobacterium avium subsp. paratuberculosis
uccggccgcggaugacc

SEQ ID NO: 787434 - RNA, 16 nt, Mycobacterium avium subsp. paratuberculosis
uccggccggagaccgc

SEQ ID NO: 787435 - RNA, 21 nt, Mycobacterium avium subsp. paratuberculosis
uccggccggagaccgccgugg

SEQ ID NO: 787436 - RNA, 12 nt, Mycobacterium avium subsp. paratuberculosis
uccggccggccg

SEQ ID NO: 787437 - RNA, 13 nt, Mycobacterium avium subsp. paratuberculosis
uccggccggccgc

SEQ ID NO: 787438 - RNA, 15 nt, Mycobacterium avium subsp. paratuberculosis
uccggccggccgccg

SEQ ID NO: 787439 - RNA, 19 nt, Mycobacterium avium subsp. paratuberculosis
uccggccggccgccggcgg

SEQ ID NO: 787440 - RNA, 20 nt, Mycobacterium avium subsp. paratuberculosis
uccggccggccgccggcggc

SEQ ID NO: 787441 - RNA, 15 nt, Mycobacterium avium subsp. paratuberculosis
uccggccggcgagga

SEQ ID NO: 787442 - RNA, 18 nt, Mycobacterium avium subsp. paratuberculosis
uccggaggugccggccgg

SEQ ID NO: 787443 - RNA, 15 nt, Mycobacterium avium subsp. paratuberculosis
uccggauagccgucg

SEQ ID NO: 787444 - RNA, 14 nt, Mycobacterium avium subsp. paratuberculosis
uccggaucgggcgg

SEQ ID NO: 787445 - RNA, 17 nt, Mycobacterium avium subsp. paratuberculosis
uccggaugcggcgccca

SEQ ID NO: 787446 - RNA, 15 nt, Mycobacterium avium subsp. paratuberculosis
uccggauugccgggc

SEQ ID NO: 787447 - RNA, 14 nt, Mycobacterium avium subsp. paratuberculosis
uccggaugccggcu

SEQ ID NO: 787448 - RNA, 18 nt, Mycobacterium avium subsp. paratuberculosis
uccggauggcggucgcgc

SEQ ID NO: 787449 - RNA, 17 nt, Mycobacterium avium subsp. paratuberculosis
uccggaugggagcgggg

SEQ ID NO: 787450 - RNA, 20 nt, Mycobacterium avium subsp. paratuberculosis
uccgcggcggccggcgauga

SEQ ID NO: 787451 - RNA, 13 nt, Mycobacterium avium subsp. paratuberculosis
uccgcgucggccc

SEQ ID NO: 787452 - RNA, 16 nt, Mycobacterium avium subsp. paratuberculosis
uccgcgucggcgccgg

SEQ ID NO: 787453 - RNA, 16 nt, Mycobacterium avium subsp. paratuberculosis
uccgcgucgucgaggc

SEQ ID NO: 787454 - RNA, 19 nt, Mycobacterium avium subsp. paratuberculosis
uccgcgugaaugcccagcg

SEQ ID NO: 787455 - RNA, 21 nt, Mycobacterium avium subsp. paratuberculosis
uccgcguucgaccuccacgag

SEQ ID NO: 787456 - RNA, 23 nt, Mycobacterium avium subsp. paratuberculosis
uccgcucaacuugaucagcucgc

SEQ ID NO: 787457 - RNA, 17 nt, Mycobacterium avium subsp. paratuberculosis
uccggacacggccagcg

SEQ ID NO: 787458 - RNA, 20 nt, Mycobacterium avium subsp. paratuberculosis
uccggacacggccagcgccg

SEQ ID NO: 787459 - RNA, 21 nt, Mycobacterium avium subsp. paratuberculosis
uccggacgaccugggcgccgu

SEQ ID NO: 787460 - RNA, 22 nt, Mycobacterium avium subsp. paratuberculosis
uccggacgaccugggcgccguc

SEQ ID NO: 787461 - RNA, 16 nt, Mycobacterium avium subsp. paratuberculosis
uccggagaaccgcucg

SEQ ID NO: 787462 - RNA, 18 nt, Mycobacterium avium subsp. paratuberculosis
uccggagaucgccccggg

SEQ ID NO: 787463 - RNA, 14 nt, Mycobacterium avium subsp. paratuberculosis
uccgcgggccggca

SEQ ID NO: 787464 - RNA, 14 nt, Mycobacterium avium subsp. paratuberculosis
uccgcgggcggggc

SEQ ID NO: 787465 - RNA, 19 nt, Mycobacterium avium subsp. paratuberculosis
uccgcggguacggucggcc

SEQ ID NO: 787466 - RNA, 19 nt, Mycobacterium avium subsp. paratuberculosis
uccgcgguuucaccgugcg

SEQ ID NO: 787467 - RNA, 23 nt, Mycobacterium avium subsp. paratuberculosis
uccgcgguuucaccgugcgcgcg

SEQ ID NO: 787468 - RNA, 20 nt, Mycobacterium avium subsp. paratuberculosis
uccgcgguuuggucagcgcc

SEQ ID NO: 787469 - RNA, 18 nt, Mycobacterium avium subsp. paratuberculosis
uccgcggccgcgcgcccg

SEQ ID NO: 787470 - RNA, 14 nt, Mycobacterium avium subsp. paratuberculosis
uccgcggccgcggc

SEQ ID NO: 787471 - RNA, 18 nt, Mycobacterium avium subsp. paratuberculosis
uccgcggccgcggcgcgc

SEQ ID NO: 787472 - RNA, 23 nt, Mycobacterium avium subsp. paratuberculosis
uccgcgcgagaguaucgccacgc

SEQ ID NO: 787473 - RNA, 13 nt, Mycobacterium avium subsp. paratuberculosis
uccgcggcgauga

SEQ ID NO: 787474 - RNA, 13 nt, Mycobacterium avium subsp. paratuberculosis
uccgcgcugacca

SEQ ID NO: 787475 - RNA, 14 nt, Mycobacterium avium subsp. paratuberculosis
uccgcgcugaccag

SEQ ID NO: 787476 - RNA, 22 nt, Mycobacterium avium subsp. paratuberculosis
uccgcggccaccgggaccgucg

SEQ ID NO: 787477 - RNA, 17 nt, Mycobacterium avium subsp. paratuberculosis
uccgcggccagcucggu

SEQ ID NO: 787478 - RNA, 15 nt, Mycobacterium avium subsp. paratuberculosis
uccgcgcggccacca

SEQ ID NO: 787479 - RNA, 16 nt, Mycobacterium avium subsp. paratuberculosis
uccgcgcggccaccag

SEQ ID NO: 787480 - RNA, 22 nt, Mycobacterium avium subsp. paratuberculosis
uccgcgcggccaccagcgcggc

SEQ ID NO: 787481 - RNA, 15 nt, Mycobacterium avium subsp. paratuberculosis
uccgcgcggcgacga

SEQ ID NO: 787482 - RNA, 16 nt, Mycobacterium avium subsp. paratuberculosis
uccgcgcggcgacgau

SEQ ID NO: 787483 - RNA, 21 nt, Mycobacterium avium subsp. paratuberculosis
uccgcgccggucccgcggcgg

SEQ ID NO: 787484 - RNA, 17 nt, Mycobacterium avium subsp. paratuberculosis
uccgcgcggcgggcccg

SEQ ID NO: 787485 - RNA, 22 nt, Mycobacterium avium subsp. paratuberculosis
uccgcgcgucucccccgaucag

SEQ ID NO: 787486 - RNA, 14 nt, Mycobacterium avium subsp. paratuberculosis
uccgcgccgccgcc

SEQ ID NO: 787487 - RNA, 21 nt, Mycobacterium avium subsp. paratuberculosis
uccgcgccgcgaugcaacacc

SEQ ID NO: 787488 - RNA, 13 nt, Mycobacterium avium subsp. paratuberculosis
uccgcaaccgccg

SEQ ID NO: 787489 - RNA, 15 nt, Mycobacterium avium subsp. paratuberculosis
uccgcaaccgccggc

SEQ ID NO: 787490 - RNA, 19 nt, Mycobacterium avium subsp. paratuberculosis
uccgcaacgccggcgugca

SEQ ID NO: 787491 - RNA, 18 nt, Mycobacterium avium subsp. paratuberculosis
uccgcaacgugcgccggc

SEQ ID NO: 787492 - RNA, 23 nt, Mycobacterium avium subsp. paratuberculosis
uccgccagaucgccuggcagcug

SEQ ID NO: 787493 - RNA, 15 nt, Mycobacterium avium subsp. paratuberculosis
uccgccacggcgggg

SEQ ID NO: 787494 - RNA, 14 nt, Mycobacterium avium subsp. paratuberculosis
uccgccuccgacca

SEQ ID NO: 787495 - RNA, 15 nt, Mycobacterium avium subsp. paratuberculosis
uccgccuccgaccag

SEQ ID NO: 787496 - RNA, 13 nt, Mycobacterium avium subsp. paratuberculosis
uccgcgcagcagc

SEQ ID NO: 787497 - RNA, 15 nt, Mycobacterium avium subsp. paratuberculosis
uccgcccagacgcgg

SEQ ID NO: 787498 - RNA, 18 nt, Mycobacterium avium subsp. paratuberculosis
uccgcccagacgcgggcg

SEQ ID NO: 787499 - RNA, 14 nt, Mycobacterium avium subsp. paratuberculosis
uccgccggcggugc

SEQ ID NO: 787500 - RNA, 15 nt, Mycobacterium avium subsp. paratuberculosis
uccgccggcuggcgg

SEQ ID NO: 787501 - RNA, 13 nt, Mycobacterium avium subsp. paratuberculosis
uccgccggccggu

SEQ ID NO: 787502 - RNA, 12 nt, Mycobacterium avium subsp. paratuberculosis
uccgccggcgaa

SEQ ID NO: 787503 - RNA, 18 nt, Mycobacterium avium subsp. paratuberculosis
uccgccggcgaagcucga

SEQ ID NO: 787504 - RNA, 20 nt, Mycobacterium avium subsp. paratuberculosis
uccgccggcgaagcucgacg

SEQ ID NO: 787505 - RNA, 22 nt, Mycobacterium avium subsp. paratuberculosis
uccgccacccugcgcaccgcgg

SEQ ID NO: 787506 - RNA, 18 nt, Mycobacterium avium subsp. paratuberculosis
uccgccgucaucggcgga

SEQ ID NO: 787507 - RNA, 13 nt, Mycobacterium avium subsp. paratuberculosis
uccgacaccaccu

SEQ ID NO: 787508 - RNA, 24 nt, Mycobacterium avium subsp. paratuberculosis
uccgacaccgccuucgacggccgg

SEQ ID NO: 787509 - RNA, 20 nt, Mycobacterium avium subsp. paratuberculosis
ucccguacucgaugccguug

SEQ ID NO: 787510 - RNA, 16 nt, Mycobacterium avium subsp. paratuberculosis
uccgaauccagcgcgc

SEQ ID NO: 787511 - RNA, 18 nt, Mycobacterium avium subsp. paratuberculosis
uccgaauccagcgcgccg

SEQ ID NO: 787512 - RNA, 20 nt, Mycobacterium avium subsp. paratuberculosis
uccgaauccagcgcgccgcu

SEQ ID NO: 787513 - RNA, 18 nt, Mycobacterium avium subsp. paratuberculosis
ucccgguccacggugucg

SEQ ID NO: 787514 - RNA, 17 nt, Mycobacterium avium subsp. paratuberculosis
ucccgguagagcggcac

SEQ ID NO: 787515 - RNA, 19 nt, Mycobacterium avium subsp. paratuberculosis
ucccgguagagcggcacca

SEQ ID NO: 787516 - RNA, 18 nt, Mycobacterium avium subsp. paratuberculosis
ucccgguaggcggcgaga

SEQ ID NO: 787517 - RNA, 15 nt, Mycobacterium avium subsp. paratuberculosis
ucccggugucgccgu

SEQ ID NO: 787518 - RNA, 16 nt, Mycobacterium avium subsp. paratuberculosis
ucccggugucgccguc

SEQ ID NO: 787519 - RNA, 15 nt, Mycobacterium avium subsp. paratuberculosis
ucccgguugaccccg

SEQ ID NO: 787520 - RNA, 17 nt, Mycobacterium avium subsp. paratuberculosis
ucccgggugcgcgucgc

SEQ ID NO: 787521 - RNA, 16 nt, Mycobacterium avium subsp. paratuberculosis
ucccgggugcgauggc

SEQ ID NO: 787522 - RNA, 21 nt, Mycobacterium avium subsp. paratuberculosis
ucccgggcccgcugcagcgcc

SEQ ID NO: 787523 - RNA, 23 nt, Mycobacterium avium subsp. paratuberculosis
ucccggguaccucugcgcgagca

SEQ ID NO: 787524 - RNA, 22 nt, Mycobacterium avium subsp. paratuberculosis
ucccgggcgaucagcccgccca

SEQ ID NO: 787525 - RNA, 13 nt, Mycobacterium avium subsp. paratuberculosis
ucccgggcggcgc

SEQ ID NO: 787526 - RNA, 19 nt, Mycobacterium avium subsp. paratuberculosis
ucccgggcggucgcgucgu

SEQ ID NO: 787527 - RNA, 14 nt, Mycobacterium avium subsp. paratuberculosis
uccgaucugcucga

SEQ ID NO: 787528 - RNA, 20 nt, Mycobacterium avium subsp. paratuberculosis
uccgaugaagaacaccccga

SEQ ID NO: 787529 - RNA, 14 nt, Mycobacterium avium subsp. paratuberculosis
uccgacgcgacggu

SEQ ID NO: 787530 - RNA, 16 nt, Mycobacterium avium subsp. paratuberculosis
uccgacgcgacggucg

SEQ ID NO: 787531 - RNA, 15 nt, Mycobacterium avium subsp. paratuberculosis
uccgacgcgguggcg

SEQ ID NO: 787532 - RNA, 23 nt, Mycobacterium avium subsp. paratuberculosis
uccgacgcgguggcgugcucgau

SEQ ID NO: 787533 - RNA, 22 nt, Mycobacterium avium subsp. paratuberculosis
uccgaguugauaggucacgccg

SEQ ID NO: 787534 - RNA, 15 nt, Mycobacterium avium subsp. paratuberculosis
uccgaucaacggcag

SEQ ID NO: 787535 - RNA, 14 nt, Mycobacterium avium subsp. paratuberculosis
uccgacgaaccgug

SEQ ID NO: 787536 - RNA, 18 nt, Mycobacterium avium subsp. paratuberculosis
uccgacgagucgacgcug

SEQ ID NO: 787537 - RNA, 16 nt, Mycobacterium avium subsp. paratuberculosis
uccgacgccgucgagc

SEQ ID NO: 787538 - RNA, 14 nt, Mycobacterium avium subsp. paratuberculosis
uccgaccagcaccc

SEQ ID NO: 787539 - RNA, 14 nt, Mycobacterium avium subsp. paratuberculosis
uccgaccagcggcc

SEQ ID NO: 787540 - RNA, 20 nt, Mycobacterium avium subsp. paratuberculosis
uccgaccgccaccacccggc

SEQ ID NO: 787541 - RNA, 23 nt, Mycobacterium avium subsp. paratuberculosis
uccgaccgccaccacccggcgau

SEQ ID NO: 787542 - RNA, 22 nt, Mycobacterium avium subsp. paratuberculosis
uccgaccggcucagcccggcgc

SEQ ID NO: 787543 - RNA, 18 nt, Mycobacterium avium subsp. paratuberculosis
uccgaccguugaccgacg

SEQ ID NO: 787544 - RNA, 23 nt, Mycobacterium avium subsp. paratuberculosis
uccgacaucagugcgggcaucgg

SEQ ID NO: 787545 - RNA, 16 nt, Mycobacterium avium subsp. paratuberculosis
uccgacagcccgccca

SEQ ID NO: 787546 - RNA, 13 nt, Mycobacterium avium subsp. paratuberculosis
uccgacagccgca

SEQ ID NO: 787547 - RNA, 15 nt, Mycobacterium avium subsp. paratuberculosis
uccgacagccgcacc

SEQ ID NO: 787548 - RNA, 22 nt, Mycobacterium avium subsp. paratuberculosis
uccgacagccgcaccggcgccg

SEQ ID NO: 787549 - RNA, 14 nt, Mycobacterium avium subsp. paratuberculosis
uccaguugcggcac

SEQ ID NO: 787550 - RNA, 18 nt, Mycobacterium avium subsp. paratuberculosis
uccaguugcgaccccgcc

SEQ ID NO: 787551 - RNA, 20 nt, Mycobacterium avium subsp. paratuberculosis
uccaguucggccagcgcggu

SEQ ID NO: 787552 - RNA, 15 nt, Mycobacterium avium subsp. paratuberculosis
uccagugcaugccgg

SEQ ID NO: 787553 - RNA, 18 nt, Mycobacterium avium subsp. paratuberculosis
uccagugccggcgagugc

SEQ ID NO: 787554 - RNA, 19 nt, Mycobacterium avium subsp. paratuberculosis
uccagugacgccugcggcc

SEQ ID NO: 787555 - RNA, 15 nt, Mycobacterium avium subsp. paratuberculosis
uccagucggcgccga

SEQ ID NO: 787556 - RNA, 17 nt, Mycobacterium avium subsp. paratuberculosis
uccagucggcgccgaug

SEQ ID NO: 787557 - RNA, 21 nt, Mycobacterium avium subsp. paratuberculosis
uccaggcaugggaucagcagc

SEQ ID NO: 787558 - RNA, 13 nt, Mycobacterium avium subsp. paratuberculosis
uccagucccaguu

SEQ ID NO: 787559 - RNA, 18 nt, Mycobacterium avium subsp. paratuberculosis
uccaguccggcgcccggc

SEQ ID NO: 787560 - RNA, 18 nt, Mycobacterium avium subsp. paratuberculosis
uccaguagccgccgggcg

SEQ ID NO: 787561 - RNA, 17 nt, Mycobacterium avium subsp. paratuberculosis
uccaggaucacgcggcg

SEQ ID NO: 787562 - RNA, 20 nt, Mycobacterium avium subsp. paratuberculosis
uccaggaagaacccggcgug

SEQ ID NO: 787563 - RNA, 21 nt, Mycobacterium avium subsp. paratuberculosis
uccaggaagaacccggcgugc

SEQ ID NO: 787564 - RNA, 17 nt, Mycobacterium avium subsp. paratuberculosis
uccaggacgaugcgcgc

SEQ ID NO: 787565 - RNA, 14 nt, Mycobacterium avium subsp. paratuberculosis
uccaggacucgggg

SEQ ID NO: 787566 - RNA, 14 nt, Mycobacterium avium subsp. paratuberculosis
uccaggaaacggcc

SEQ ID NO: 787567 - RNA, 16 nt, Mycobacterium avium subsp. paratuberculosis
uccagcgcgccgcuga

SEQ ID NO: 787568 - RNA, 14 nt, Mycobacterium avium subsp. paratuberculosis
uccagcgcggcgau

SEQ ID NO: 787569 - RNA, 15 nt, Mycobacterium avium subsp. paratuberculosis
uccagcgccgccauc

SEQ ID NO: 787570 - RNA, 22 nt, Mycobacterium avium subsp. paratuberculosis
uccagcgccagcgaguggguga

SEQ ID NO: 787571 - RNA, 15 nt, Mycobacterium avium subsp. paratuberculosis
uccagcgcccgccgc

SEQ ID NO: 787572 - RNA, 20 nt, Mycobacterium avium subsp. paratuberculosis
uccagcgccggcaccagcag

SEQ ID NO: 787573 - RNA, 18 nt, Mycobacterium avium subsp. paratuberculosis
uccagcgagcccuucgcg

SEQ ID NO: 787574 - RNA, 21 nt, Mycobacterium avium subsp. paratuberculosis
uccagcgagcccuucgcggug

SEQ ID NO: 787575 - RNA, 15 nt, Mycobacterium avium subsp. paratuberculosis
uccagcgcacacacc

SEQ ID NO: 787576 - RNA, 19 nt, Mycobacterium avium subsp. paratuberculosis
uccagcgacaacagcacga

SEQ ID NO: 787577 - RNA, 16 nt, Mycobacterium avium subsp. paratuberculosis
uccagcagcagcgcgc

SEQ ID NO: 787578 - RNA, 14 nt, Mycobacterium avium subsp. paratuberculosis
uccagcacgucggg

SEQ ID NO: 787579 - RNA, 15 nt, Mycobacterium avium subsp. paratuberculosis
uccagcacgucgggg

SEQ ID NO: 787580 - RNA, 18 nt, Mycobacterium avium subsp. paratuberculosis
uccagcacgugcccagcc

SEQ ID NO: 787581 - RNA, 22 nt, Mycobacterium avium subsp. paratuberculosis
uccagcacgugcccagcccgcg

SEQ ID NO: 787582 - RNA, 19 nt, Mycobacterium avium subsp. paratuberculosis
uccagcagcuguugcggcg

SEQ ID NO: 787583 - RNA, 21 nt, Mycobacterium avium subsp. paratuberculosis
uccagcagcgccuugccgacg

SEQ ID NO: 787584 - RNA, 22 nt, Mycobacterium avium subsp. paratuberculosis
uccagcagcgccuugccgacga

SEQ ID NO: 787585 - RNA, 15 nt, Mycobacterium avium subsp. paratuberculosis
uccagcagcggcucg

SEQ ID NO: 787586 - RNA, 15 nt, Mycobacterium avium subsp. paratuberculosis
uccagccguccagcc

SEQ ID NO: 787587 - RNA, 22 nt, Mycobacterium avium subsp. paratuberculosis
uccagccguucgcgcacggcgc

SEQ ID NO: 787588 - RNA, 14 nt, Mycobacterium avium subsp. paratuberculosis
uccagccggcccgc

SEQ ID NO: 787589 - RNA, 22 nt, Mycobacterium avium subsp. paratuberculosis
uccagccggcccgcaucgcggc

SEQ ID NO: 787590 - RNA, 20 nt, Mycobacterium avium subsp. paratuberculosis
uccagccggcggaucgcgug

SEQ ID NO: 787591 - RNA, 14 nt, Mycobacterium avium subsp. paratuberculosis
uccagccgccgcgu

SEQ ID NO: 787592 - RNA, 12 nt, Mycobacterium avium subsp. paratuberculosis
uccagccgccgg

SEQ ID NO: 787593 - RNA, 13 nt, Mycobacterium avium subsp. paratuberculosis
uccagccgccggc

SEQ ID NO: 787594 - RNA, 14 nt, Mycobacterium avium subsp. paratuberculosis
uccagccgccgguc

SEQ ID NO: 787595 - RNA, 17 nt, Mycobacterium avium subsp. paratuberculosis
uccagccgcgcggccgc

SEQ ID NO: 787596 - RNA, 15 nt, Mycobacterium avium subsp. paratuberculosis
uccagccgcuccgcg

SEQ ID NO: 787597 - RNA, 15 nt, Mycobacterium avium subsp. paratuberculosis
uccagccgaucgcgg

SEQ ID NO: 787598 - RNA, 16 nt, Mycobacterium avium subsp. paratuberculosis
uccagccgaucgcggu

SEQ ID NO: 787599 - RNA, 17 nt, Mycobacterium avium subsp. paratuberculosis
uccagcaggcgcgccga

SEQ ID NO: 787600 - RNA, 19 nt, Mycobacterium avium subsp. paratuberculosis
uccagcaggcgcgccgagc

SEQ ID NO: 787601 - RNA, 20 nt, Mycobacterium avium subsp. paratuberculosis
uccagcccugcuugaccgcg

SEQ ID NO: 787602 - RNA, 13 nt, Mycobacterium avium subsp. paratuberculosis
uccacaaccagcg

SEQ ID NO: 787603 - RNA, 18 nt, Mycobacterium avium subsp. paratuberculosis
uccaaugcgccgauggug

SEQ ID NO: 787604 - RNA, 20 nt, Mycobacterium avium subsp. paratuberculosis
uccaaugcgccgauggugcc

SEQ ID NO: 787605 - RNA, 17 nt, Mycobacterium avium subsp. paratuberculosis
uccaaggagaaggccgc

SEQ ID NO: 787606 - RNA, 14 nt, Mycobacterium avium subsp. paratuberculosis
uccaccaggguggc

SEQ ID NO: 787607 - RNA, 16 nt, Mycobacterium avium subsp. paratuberculosis
uccaccaggguggccg

SEQ ID NO: 787608 - RNA, 22 nt, Mycobacterium avium subsp. paratuberculosis
uccaccaguguccgggcgccca

SEQ ID NO: 787609 - RNA, 20 nt, Mycobacterium avium subsp. paratuberculosis
uccacccaccggcaugggcg

SEQ ID NO: 787610 - RNA, 13 nt, Mycobacterium avium subsp. paratuberculosis
uccaccagcggcc

SEQ ID NO: 787611 - RNA, 17 nt, Mycobacterium avium subsp. paratuberculosis
uccaccagcggccgucg

SEQ ID NO: 787612 - RNA, 13 nt, Mycobacterium avium subsp. paratuberculosis
uccaccagcucga

SEQ ID NO: 787613 - RNA, 15 nt, Mycobacterium avium subsp. paratuberculosis
uccagaccggcggcg

SEQ ID NO: 787614 - RNA, 17 nt, Mycobacterium avium subsp. paratuberculosis
uccagaccggcggcgau

SEQ ID NO: 787615 - RNA, 18 nt, Mycobacterium avium subsp. paratuberculosis
uccagaccggcggcgauc

SEQ ID NO: 787616 - RNA, 15 nt, Mycobacterium avium subsp. paratuberculosis
uccagaacucggcgg

SEQ ID NO: 787617 - RNA, 16 nt, Mycobacterium avium subsp. paratuberculosis
uccagcaccugcucga

SEQ ID NO: 787618 - RNA, 19 nt, Mycobacterium avium subsp. paratuberculosis
uccagcacgaaggccgccg

SEQ ID NO: 787619 - RNA, 14 nt, Mycobacterium avium subsp. paratuberculosis
uccagcacggccgc

SEQ ID NO: 787620 - RNA, 13 nt, Mycobacterium avium subsp. paratuberculosis
uccagcacgccca

SEQ ID NO: 787621 - RNA, 16 nt, Mycobacterium avium subsp. paratuberculosis
uccagcacgcccagau

SEQ ID NO: 787622 - RNA, 17 nt, Mycobacterium avium subsp. paratuberculosis
uccagagcaucagggcg

SEQ ID NO: 787623 - RNA, 15 nt, Mycobacterium avium subsp. paratuberculosis
uccagacgucggcgu

SEQ ID NO: 787624 - RNA, 13 nt, Mycobacterium avium subsp. paratuberculosis
uccagaccggccg

SEQ ID NO: 787625 - RNA, 20 nt, Mycobacterium avium subsp. paratuberculosis
uccaccgaaaagcccgccgc

SEQ ID NO: 787626 - RNA, 15 nt, Mycobacterium avium subsp. paratuberculosis
uccaccucgggccgg

SEQ ID NO: 787627 - RNA, 21 nt, Mycobacterium avium subsp. paratuberculosis
uccaccugcggcaccucggcc

SEQ ID NO: 787628 - RNA, 22 nt, Mycobacterium avium subsp. paratuberculosis
uccaccccgccaaucaccgcgg

SEQ ID NO: 787629 - RNA, 19 nt, Mycobacterium avium subsp. paratuberculosis
uccacccgccccgccgcgg

SEQ ID NO: 787630 - RNA, 20 nt, Mycobacterium avium subsp. paratuberculosis
uccacccguuccucgacgua

SEQ ID NO: 787631 - RNA, 19 nt, Mycobacterium avium subsp. paratuberculosis
uccacgcccagcgccccga

SEQ ID NO: 787632 - RNA, 18 nt, Mycobacterium avium subsp. paratuberculosis
uccacgaugccgggcacg

SEQ ID NO: 787633 - RNA, 20 nt, Mycobacterium avium subsp. paratuberculosis
uccacgaugcggugccgggu

SEQ ID NO: 787634 - RNA, 22 nt, Mycobacterium avium subsp. paratuberculosis
uccacgaugcguugguguagcc

SEQ ID NO: 787635 - RNA, 17 nt, Mycobacterium avium subsp. paratuberculosis
uccacgauuccucggac

SEQ ID NO: 787636 - RNA, 13 nt, Mycobacterium avium subsp. paratuberculosis
uccacgagccggu

SEQ ID NO: 787637 - RNA, 12 nt, Mycobacterium avium subsp. paratuberculosis
uccacgaugacg

SEQ ID NO: 787638 - RNA, 16 nt, Mycobacterium avium subsp. paratuberculosis
uccacgaccccggcgg

SEQ ID NO: 787639 - RNA, 17 nt, Mycobacterium avium subsp. paratuberculosis
ucaucucaccgacgacc

SEQ ID NO: 787640 - RNA, 20 nt, Mycobacterium avium subsp. paratuberculosis
ucaucucaccgacgaccucg

SEQ ID NO: 787641 - RNA, 18 nt, Mycobacterium avium subsp. paratuberculosis
ucaugcgcgucauggccg

SEQ ID NO: 787642 - RNA, 21 nt, Mycobacterium avium subsp. paratuberculosis
ucaugcgcgucauggccgucg

SEQ ID NO: 787643 - RNA, 14 nt, Mycobacterium avium subsp. paratuberculosis
ucauggcgaccgcg

SEQ ID NO: 787644 - RNA, 22 nt, Mycobacterium avium subsp. paratuberculosis
ucaucgaucggguggcccaauc

SEQ ID NO: 787645 - RNA, 13 nt, Mycobacterium avium subsp. paratuberculosis
ucaucgccccggc

SEQ ID NO: 787646 - RNA, 15 nt, Mycobacterium avium subsp. paratuberculosis
ucaucgccucggucg

SEQ ID NO: 787647 - RNA, 23 nt, Mycobacterium avium subsp. paratuberculosis
ucaucgagcaguagacgccgccg

SEQ ID NO: 787648 - RNA, 19 nt, Mycobacterium avium subsp. paratuberculosis
ucaucgagccgagcaccgg

SEQ ID NO: 787649 - RNA, 22 nt, Mycobacterium avium subsp. paratuberculosis
ucaucgaggucgaaccacgcgg

SEQ ID NO: 787650 - RNA, 12 nt, Mycobacterium avium subsp. paratuberculosis
ucaucgacgucg

SEQ ID NO: 787651 - RNA, 15 nt, Mycobacterium avium subsp. paratuberculosis
ucauaugacgccggc

SEQ ID NO: 787652 - RNA, 15 nt, Mycobacterium avium subsp. paratuberculosis
ucauccucgccgcgc

SEQ ID NO: 787653 - RNA, 17 nt, Mycobacterium avium subsp. paratuberculosis
ucauccaggugaacagc

SEQ ID NO: 787654 - RNA, 13 nt, Mycobacterium avium subsp. paratuberculosis
ucaucccggccac

SEQ ID NO: 787655 - RNA, 19 nt, Mycobacterium avium subsp. paratuberculosis
ucagguucuucugcgcgau

SEQ ID NO: 787656 - RNA, 19 nt, Mycobacterium avium subsp. paratuberculosis
ucagguugaccaggugggc

SEQ ID NO: 787657 - RNA, 16 nt, Mycobacterium avium subsp. paratuberculosis
ucagguuggggccgau

SEQ ID NO: 787658 - RNA, 16 nt, Mycobacterium avium subsp. paratuberculosis
ucaggugcgacgccca

SEQ ID NO: 787659 - RNA, 20 nt, Mycobacterium avium subsp. paratuberculosis
ucaggguguuguccgagccg

SEQ ID NO: 787660 - RNA, 23 nt, Mycobacterium avium subsp. paratuberculosis
ucaggguggugcccccgcccggc

SEQ ID NO: 787661 - RNA, 12 nt, Mycobacterium avium subsp. paratuberculosis
ucaguaccggcg

SEQ ID NO: 787662 - RNA, 13 nt, Mycobacterium avium subsp. paratuberculosis
ucauagccggccg

SEQ ID NO: 787663 - RNA, 14 nt, Mycobacterium avium subsp. paratuberculosis
ucauagccggccgc

SEQ ID NO: 787664 - RNA, 14 nt, Mycobacterium avium subsp. paratuberculosis
ucauacagcggcgc

SEQ ID NO: 787665 - RNA, 20 nt, Mycobacterium avium subsp. paratuberculosis
ucagggcgcucaucaggcgg

SEQ ID NO: 787666 - RNA, 18 nt, Mycobacterium avium subsp. paratuberculosis
ucagggcggugcggugcg

SEQ ID NO: 787667 - RNA, 23 nt, Mycobacterium avium subsp. paratuberculosis
ucagggcggugcggugcgccgca

SEQ ID NO: 787668 - RNA, 12 nt, Mycobacterium avium subsp. paratuberculosis
ucagggcucgca

SEQ ID NO: 787669 - RNA, 19 nt, Mycobacterium avium subsp. paratuberculosis
ucaggggugccggaggcgg

SEQ ID NO: 787670 - RNA, 14 nt, Mycobacterium avium subsp. paratuberculosis
ucaggggugggcga

SEQ ID NO: 787671 - RNA, 17 nt, Mycobacterium avium subsp. paratuberculosis
ucaggggugggcgacga

SEQ ID NO: 787672 - RNA, 14 nt, Mycobacterium avium subsp. paratuberculosis
ucagggugcguucc

SEQ ID NO: 787673 - RNA, 19 nt, Mycobacterium avium subsp. paratuberculosis
ucagggugcucagccgcac

SEQ ID NO: 787674 - RNA, 17 nt, Mycobacterium avium subsp. paratuberculosis
ucaggcugacgccacgc

SEQ ID NO: 787675 - RNA, 18 nt, Mycobacterium avium subsp. paratuberculosis
ucaggcguccagcaccug

SEQ ID NO: 787676 - RNA, 16 nt, Mycobacterium avium subsp. paratuberculosis
ucaggcggucgaacgc

SEQ ID NO: 787677 - RNA, 23 nt, Mycobacterium avium subsp. paratuberculosis
ucaggcggucgaacgcggcgccg

SEQ ID NO: 787678 - RNA, 17 nt, Mycobacterium avium subsp. paratuberculosis
ucagggccagcaacacc

SEQ ID NO: 787679 - RNA, 22 nt, Mycobacterium avium subsp. paratuberculosis
ucagggccgcggccgccgcgac

SEQ ID NO: 787680 - RNA, 18 nt, Mycobacterium avium subsp. paratuberculosis
ucagggagcugcccgcac

SEQ ID NO: 787681 - RNA, 23 nt, Mycobacterium avium subsp. paratuberculosis
ucaggcgcgcacguuggcggcca

SEQ ID NO: 787682 - RNA, 21 nt, Mycobacterium avium subsp. paratuberculosis
ucagcgagacgaccaggaugc

SEQ ID NO: 787683 - RNA, 12 nt, Mycobacterium avium subsp. paratuberculosis
ucagcgaggcgu

SEQ ID NO: 787684 - RNA, 16 nt, Mycobacterium avium subsp. paratuberculosis
ucaggcgcagccagcg

SEQ ID NO: 787685 - RNA, 16 nt, Mycobacterium avium subsp. paratuberculosis
ucagcgacgagagcgg

SEQ ID NO: 787686 - RNA, 21 nt, Mycobacterium avium subsp. paratuberculosis
ucagcgacgagagcggaucgg

SEQ ID NO: 787687 - RNA, 15 nt, Mycobacterium avium subsp. paratuberculosis
ucagcgacggcccgc

SEQ ID NO: 787688 - RNA, 19 nt, Mycobacterium avium subsp. paratuberculosis
ucagcgacggcccgccgga

SEQ ID NO: 787689 - RNA, 18 nt, Mycobacterium avium subsp. paratuberculosis
ucagcgacgucaggucga

SEQ ID NO: 787690 - RNA, 22 nt, Mycobacterium avium subsp. paratuberculosis
ucagcgacgucaggucgaccgg

SEQ ID NO: 787691 - RNA, 23 nt, Mycobacterium avium subsp. paratuberculosis
ucagcgacgucaggucgaccggc

SEQ ID NO: 787692 - RNA, 13 nt, Mycobacterium avium subsp. paratuberculosis
ucagcgagcgguu

SEQ ID NO: 787693 - RNA, 21 nt, Mycobacterium avium subsp. paratuberculosis
ucagcgagcgguuggcgacgc

SEQ ID NO: 787694 - RNA, 17 nt, Mycobacterium avium subsp. paratuberculosis
ucacaccgcggccagcg

SEQ ID NO: 787695 - RNA, 20 nt, Mycobacterium avium subsp. paratuberculosis
ucacaccgcggccagcgcgc

SEQ ID NO: 787696 - RNA, 21 nt, Mycobacterium avium subsp. paratuberculosis
ucacaccgucggcgaucgccg

SEQ ID NO: 787697 - RNA, 22 nt, Mycobacterium avium subsp. paratuberculosis
ucaauucgaagcccgugccgau

SEQ ID NO: 787698 - RNA, 14 nt, Mycobacterium avium subsp. paratuberculosis
ucaauucugcugcc

SEQ ID NO: 787699 - RNA, 16 nt, Mycobacterium avium subsp. paratuberculosis
ucaauugccacagccg

SEQ ID NO: 787700 - RNA, 23 nt, Mycobacterium avium subsp. paratuberculosis
ucaaugguguagcucagccacgc

SEQ ID NO: 787701 - RNA, 21 nt, Mycobacterium avium subsp. paratuberculosis
ucaccaaauagccgucggcgg

SEQ ID NO: 787702 - RNA, 22 nt, Mycobacterium avium subsp. paratuberculosis
ucaccaaauagccgucggcggc

SEQ ID NO: 787703 - RNA, 18 nt, Mycobacterium avium subsp. paratuberculosis
ucaccaaccgcucggcga

SEQ ID NO: 787704 - RNA, 20 nt, Mycobacterium avium subsp. paratuberculosis
ucaccaaccgcucggcgauc

SEQ ID NO: 787705 - RNA, 15 nt, Mycobacterium avium subsp. paratuberculosis
ucaccaagcgcgaca

SEQ ID NO: 787706 - RNA, 16 nt, Mycobacterium avium subsp. paratuberculosis
ucaccaaugcgccggc

SEQ ID NO: 787707 - RNA, 18 nt, Mycobacterium avium subsp. paratuberculosis
ucaccaaugcgccggcgg

SEQ ID NO: 787708 - RNA, 16 nt, Mycobacterium avium subsp. paratuberculosis
ucaccaccaccgccgu

SEQ ID NO: 787709 - RNA, 17 nt, Mycobacterium avium subsp. paratuberculosis
ucaccaccccggugccg

SEQ ID NO: 787710 - RNA, 22 nt, Mycobacterium avium subsp. paratuberculosis
ucaccaccccggugccgcagug

SEQ ID NO: 787711 - RNA, 17 nt, Mycobacterium avium subsp. paratuberculosis
ucaccaccgccggggug

SEQ ID NO: 787712 - RNA, 19 nt, Mycobacterium avium subsp. paratuberculosis
ucaccaccggagcggcggu

SEQ ID NO: 787713 - RNA, 20 nt, Mycobacterium avium subsp. paratuberculosis
ucaccaccgggucgucgcgg

SEQ ID NO: 787714 - RNA, 14 nt, Mycobacterium avium subsp. paratuberculosis
ucacagccgcgaua

SEQ ID NO: 787715 - RNA, 20 nt, Mycobacterium avium subsp. paratuberculosis
ucacagcgacaacgggccgc

SEQ ID NO: 787716 - RNA, 14 nt, Mycobacterium avium subsp. paratuberculosis
ucacagcgcggcgg

SEQ ID NO: 787717 - RNA, 19 nt, Mycobacterium avium subsp. paratuberculosis
ucacaggugacgacgcucu

SEQ ID NO: 787718 - RNA, 17 nt, Mycobacterium avium subsp. paratuberculosis
ucaccccagcgcgacca

SEQ ID NO: 787719 - RNA, 21 nt, Mycobacterium avium subsp. paratuberculosis
ucacccagaucgcccgggcgg

SEQ ID NO: 787720 - RNA, 22 nt, Mycobacterium avium subsp. paratuberculosis
ucacccagaucgcccgggcggc

SEQ ID NO: 787721 - RNA, 22 nt, Mycobacterium avium subsp. paratuberculosis
ucaccccgaagcucaucaccgg

SEQ ID NO: 787722 - RNA, 21 nt, Mycobacterium avium subsp. paratuberculosis
ucaccccggagauccggccgc

SEQ ID NO: 787723 - RNA, 11 nt, Mycobacterium avium subsp. paratuberculosis
ucaccccggcc

SEQ ID NO: 787724 - RNA, 15 nt, Mycobacterium avium subsp. paratuberculosis
ucaccccggcgcgga

SEQ ID NO: 787725 - RNA, 19 nt, Mycobacterium avium subsp. paratuberculosis
ucaccccggcgcggaacgc

SEQ ID NO: 787726 - RNA, 21 nt, Mycobacterium avium subsp. paratuberculosis
ucaccaucagcaccgccucgg

SEQ ID NO: 787727 - RNA, 15 nt, Mycobacterium avium subsp. paratuberculosis
ucaccaucagcggcu

SEQ ID NO: 787728 - RNA, 18 nt, Mycobacterium avium subsp. paratuberculosis
ucaccaucagcggcucgc

SEQ ID NO: 787729 - RNA, 20 nt, Mycobacterium avium subsp. paratuberculosis
ucaccaguuucacgucggcg

SEQ ID NO: 787730 - RNA, 19 nt, Mycobacterium avium subsp. paratuberculosis
ucaccaugaucagcgccgu

SEQ ID NO: 787731 - RNA, 15 nt, Mycobacterium avium subsp. paratuberculosis
ucacccacggccaca

SEQ ID NO: 787732 - RNA, 21 nt, Mycobacterium avium subsp. paratuberculosis
ucacccacuggcggccggccg

SEQ ID NO: 787733 - RNA, 19 nt, Mycobacterium avium subsp. paratuberculosis
ucaccaggcugcucggcgg

SEQ ID NO: 787734 - RNA, 21 nt, Mycobacterium avium subsp. paratuberculosis
ucaccaggcugcucggcgggc

SEQ ID NO: 787735 - RNA, 23 nt, Mycobacterium avium subsp. paratuberculosis
ucaccagggugccccgcgaccgc

SEQ ID NO: 787736 - RNA, 18 nt, Mycobacterium avium subsp. paratuberculosis
ucaccagcggcugcagca

SEQ ID NO: 787737 - RNA, 20 nt, Mycobacterium avium subsp. paratuberculosis
ucaccagcucccacgacgac

SEQ ID NO: 787738 - RNA, 12 nt, Mycobacterium avium subsp. paratuberculosis
ucaccagcgcgg

SEQ ID NO: 787739 - RNA, 15 nt, Mycobacterium avium subsp. paratuberculosis
ucaccagcggcccgc

SEQ ID NO: 787740 - RNA, 13 nt, Mycobacterium avium subsp. paratuberculosis
ucaccacggucac

SEQ ID NO: 787741 - RNA, 18 nt, Mycobacterium avium subsp. paratuberculosis
ucaccacggucaccccga

SEQ ID NO: 787742 - RNA, 16 nt, Mycobacterium avium subsp. paratuberculosis
ucaccacggucagggc

SEQ ID NO: 787743 - RNA, 21 nt, Mycobacterium avium subsp. paratuberculosis
ucaccacggucagggccagca

SEQ ID NO: 787744 - RNA, 16 nt, Mycobacterium avium subsp. paratuberculosis
ucaccacgguggccgc

SEQ ID NO: 787745 - RNA, 23 nt, Mycobacterium avium subsp. paratuberculosis
ucaccgguggccgcgucgaccag

SEQ ID NO: 787746 - RNA, 16 nt, Mycobacterium avium subsp. paratuberculosis
ucaccgguccggucac

SEQ ID NO: 787747 - RNA, 22 nt, Mycobacterium avium subsp. paratuberculosis
ucaccgguccggucacgcccgg

SEQ ID NO: 787748 - RNA, 13 nt, Mycobacterium avium subsp. paratuberculosis
ucaccggucgggc

SEQ ID NO: 787749 - RNA, 17 nt, Mycobacterium avium subsp. paratuberculosis
ucaccgcguagcgccgc

SEQ ID NO: 787750 - RNA, 15 nt, Mycobacterium avium subsp. paratuberculosis
ucaccgcgccgggca

SEQ ID NO: 787751 - RNA, 19 nt, Mycobacterium avium subsp. paratuberculosis
ucaccgcgggccaggccca

SEQ ID NO: 787752 - RNA, 15 nt, Mycobacterium avium subsp. paratuberculosis
ucaccgcgggcgcgc

SEQ ID NO: 787753 - RNA, 18 nt, Mycobacterium avium subsp. paratuberculosis
ucaccgcgggcgcgccgu

SEQ ID NO: 787754 - RNA, 19 nt, Mycobacterium avium subsp. paratuberculosis
ucaccgcggggugcccggc

SEQ ID NO: 787755 - RNA, 21 nt, Mycobacterium avium subsp. paratuberculosis
ucaccgcgguugcccucgguc

SEQ ID NO: 787756 - RNA, 13 nt, Mycobacterium avium subsp. paratuberculosis
ucaccgggcucgg

SEQ ID NO: 787757 - RNA, 14 nt, Mycobacterium avium subsp. paratuberculosis
ucaccgggcucggu

SEQ ID NO: 787758 - RNA, 17 nt, Mycobacterium avium subsp. paratuberculosis
ucaccggggugccgccc

SEQ ID NO: 787759 - RNA, 18 nt, Mycobacterium avium subsp. paratuberculosis
ucaccggggugccgccca

SEQ ID NO: 787760 - RNA, 23 nt, Mycobacterium avium subsp. paratuberculosis
ucaccgggugaugucgccgacca

SEQ ID NO: 787761 - RNA, 15 nt, Mycobacterium avium subsp. paratuberculosis
ucaccgccgagccgc

SEQ ID NO: 787762 - RNA, 17 nt, Mycobacterium avium subsp. paratuberculosis
ucaccgccgcaccgucg

SEQ ID NO: 787763 - RNA, 16 nt, Mycobacterium avium subsp. paratuberculosis
ucaccgccgcggcgac

SEQ ID NO: 787764 - RNA, 14 nt, Mycobacterium avium subsp. paratuberculosis
ucaccgccgucccg

SEQ ID NO: 787765 - RNA, 13 nt, Mycobacterium avium subsp. paratuberculosis
ucaccgcgacgac

SEQ ID NO: 787766 - RNA, 19 nt, Mycobacterium avium subsp. paratuberculosis
ucaccgcgcuugccgcgac

SEQ ID NO: 787767 - RNA, 13 nt, Mycobacterium avium subsp. paratuberculosis
ucaccgcggcgag

SEQ ID NO: 787768 - RNA, 18 nt, Mycobacterium avium subsp. paratuberculosis
ucacccaugauggugggc

SEQ ID NO: 787769 - RNA, 15 nt, Mycobacterium avium subsp. paratuberculosis
ucacccggcccaccg

SEQ ID NO: 787770 - RNA, 18 nt, Mycobacterium avium subsp. paratuberculosis
ucacccggcccaccggcc

SEQ ID NO: 787771 - RNA, 19 nt, Mycobacterium avium subsp. paratuberculosis
ucacccggcccaccggccc

SEQ ID NO: 787772 - RNA, 22 nt, Mycobacterium avium subsp. paratuberculosis
ucacccggcccaccggcccggc

SEQ ID NO: 787773 - RNA, 19 nt, Mycobacterium avium subsp. paratuberculosis
ucacccgccggguggccgc

SEQ ID NO: 787774 - RNA, 17 nt, Mycobacterium avium subsp. paratuberculosis
ucacccgcagcccgacc

SEQ ID NO: 787775 - RNA, 16 nt, Mycobacterium avium subsp. paratuberculosis
ucaccccgacggagac

SEQ ID NO: 787776 - RNA, 23 nt, Mycobacterium avium subsp. paratuberculosis
ucaccccgacggagacgacgacg

SEQ ID NO: 787777 - RNA, 13 nt, Mycobacterium avium subsp. paratuberculosis
ucacccggcgcgc

SEQ ID NO: 787778 - RNA, 15 nt, Mycobacterium avium subsp. paratuberculosis
ucacccggcgcgcgg

SEQ ID NO: 787779 - RNA, 20 nt, Mycobacterium avium subsp. paratuberculosis
ucacccguggcugaccacgc

SEQ ID NO: 787780 - RNA, 18 nt, Mycobacterium avium subsp. paratuberculosis
ucacccgugggccgaccg

SEQ ID NO: 787781 - RNA, 17 nt, Mycobacterium avium subsp. paratuberculosis
ucacccuggcgaaccgc

SEQ ID NO: 787782 - RNA, 20 nt, Mycobacterium avium subsp. paratuberculosis
ucacccuggcgaaccgcggc

SEQ ID NO: 787783 - RNA, 18 nt, Mycobacterium avium subsp. paratuberculosis
ucacccgguugagcaccg

SEQ ID NO: 787784 - RNA, 19 nt, Mycobacterium avium subsp. paratuberculosis
ucacccgguugagcaccgc

SEQ ID NO: 787785 - RNA, 16 nt, Mycobacterium avium subsp. paratuberculosis
ucaccgaauccaccgg

SEQ ID NO: 787786 - RNA, 22 nt, Mycobacterium avium subsp. paratuberculosis
ucaccgacaagggccgggcgcu

SEQ ID NO: 787787 - RNA, 16 nt, Mycobacterium avium subsp. paratuberculosis
ucaccgaacgcgaugu

SEQ ID NO: 787788 - RNA, 17 nt, Mycobacterium avium subsp. paratuberculosis
ucacucuggcgugacgc

SEQ ID NO: 787789 - RNA, 17 nt, Mycobacterium avium subsp. paratuberculosis
ucacuccagcggcggcc

SEQ ID NO: 787790 - RNA, 11 nt, Mycobacterium avium subsp. paratuberculosis
ucacggcgggu

SEQ ID NO: 787791 - RNA, 17 nt, Mycobacterium avium subsp. paratuberculosis
ucacggcgucggcgucg

SEQ ID NO: 787792 - RNA, 21 nt, Mycobacterium avium subsp. paratuberculosis
ucacggcguugaccgggccgc

SEQ ID NO: 787793 - RNA, 15 nt, Mycobacterium avium subsp. paratuberculosis
ucacggcugccgacc

SEQ ID NO: 787794 - RNA, 18 nt, Mycobacterium avium subsp. paratuberculosis
ucacggcugccgaccucg

SEQ ID NO: 787795 - RNA, 17 nt, Mycobacterium avium subsp. paratuberculosis
ucacgguccaucagcac

SEQ ID NO: 787796 - RNA, 13 nt, Mycobacterium avium subsp. paratuberculosis
ucacggucggcgu

SEQ ID NO: 787797 - RNA, 21 nt, Mycobacterium avium subsp. paratuberculosis
ucacggucggcguccagcgcg

SEQ ID NO: 787798 - RNA, 11 nt, Mycobacterium avium subsp. paratuberculosis
ucacggugacg

SEQ ID NO: 787799 - RNA, 14 nt, Mycobacterium avium subsp. paratuberculosis
ucacgguggccgcc

SEQ ID NO: 787800 - RNA, 22 nt, Mycobacterium avium subsp. paratuberculosis
ucacgguggccgccaccaacau

SEQ ID NO: 787801 - RNA, 18 nt, Mycobacterium avium subsp. paratuberculosis
ucacggugucggcgguga

SEQ ID NO: 787802 - RNA, 14 nt, Mycobacterium avium subsp. paratuberculosis
ucacggugaucgcc

SEQ ID NO: 787803 - RNA, 16 nt, Mycobacterium avium subsp. paratuberculosis
ucacggugaucgccgg

SEQ ID NO: 787804 - RNA, 14 nt, Mycobacterium avium subsp. paratuberculosis
ucacguucggcggg

SEQ ID NO: 787805 - RNA, 15 nt, Mycobacterium avium subsp. paratuberculosis
ucacguucggcgggc

SEQ ID NO: 787806 - RNA, 18 nt, Mycobacterium avium subsp. paratuberculosis
ucacguugaugaucgccg

SEQ ID NO: 787807 - RNA, 20 nt, Mycobacterium avium subsp. paratuberculosis
ucacguugaugaucgccgau

SEQ ID NO: 787808 - RNA, 15 nt, Mycobacterium avium subsp. paratuberculosis
ucacuacccgcgaug

SEQ ID NO: 787809 - RNA, 17 nt, Mycobacterium avium subsp. paratuberculosis
ucacgccucgucgagca

SEQ ID NO: 787810 - RNA, 13 nt, Mycobacterium avium subsp. paratuberculosis
ucacgcggcggga

SEQ ID NO: 787811 - RNA, 18 nt, Mycobacterium avium subsp. paratuberculosis
ucacgcggcuggcccggc

SEQ ID NO: 787812 - RNA, 18 nt, Mycobacterium avium subsp. paratuberculosis
ucacggcgaggauggcga

SEQ ID NO: 787813 - RNA, 15 nt, Mycobacterium avium subsp. paratuberculosis
ucacggcggcagcgc

SEQ ID NO: 787814 - RNA, 17 nt, Mycobacterium avium subsp. paratuberculosis
ucacggcggcagcgcgg

SEQ ID NO: 787815 - RNA, 18 nt, Mycobacterium avium subsp. paratuberculosis
ucacggcggcagcgcggc

SEQ ID NO: 787816 - RNA, 21 nt, Mycobacterium avium subsp. paratuberculosis
ucacgccgccggggcgcagau

SEQ ID NO: 787817 - RNA, 19 nt, Mycobacterium avium subsp. paratuberculosis
ucacgccguauucgccgac

SEQ ID NO: 787818 - RNA, 20 nt, Mycobacterium avium subsp. paratuberculosis
ucacgccggugagcacgacc

SEQ ID NO: 787819 - RNA, 20 nt, Mycobacterium avium subsp. paratuberculosis
ucaccguggugugcccgcgg

SEQ ID NO: 787820 - RNA, 23 nt, Mycobacterium avium subsp. paratuberculosis
ucaccguggugugcccgcgggcc

SEQ ID NO: 787821 - RNA, 16 nt, Mycobacterium avium subsp. paratuberculosis
ucaccucgauggccgg

SEQ ID NO: 787822 - RNA, 17 nt, Mycobacterium avium subsp. paratuberculosis
ucaccucaucgcccagc

SEQ ID NO: 787823 - RNA, 23 nt, Mycobacterium avium subsp. paratuberculosis
ucaccucgucgauccccacgucg

SEQ ID NO: 787824 - RNA, 16 nt, Mycobacterium avium subsp. paratuberculosis
ucaccucuucgggcag

SEQ ID NO: 787825 - RNA, 12 nt, Mycobacterium avium subsp. paratuberculosis
ucaccucgccgg

SEQ ID NO: 787826 - RNA, 16 nt, Mycobacterium avium subsp. paratuberculosis
ucaccucgccggccgg

SEQ ID NO: 787827 - RNA, 18 nt, Mycobacterium avium subsp. paratuberculosis
ucaccucgccggccgggc

SEQ ID NO: 787828 - RNA, 16 nt, Mycobacterium avium subsp. paratuberculosis
ucaccucgcugacguc

SEQ ID NO: 787829 - RNA, 17 nt, Mycobacterium avium subsp. paratuberculosis
ucaccucgcugacgucg

SEQ ID NO: 787830 - RNA, 23 nt, Mycobacterium avium subsp. paratuberculosis
ucaccucggugaugucgacgucg

SEQ ID NO: 787831 - RNA, 14 nt, Mycobacterium avium subsp. paratuberculosis
ucaccgucacgucg

SEQ ID NO: 787832 - RNA, 17 nt, Mycobacterium avium subsp. paratuberculosis
ucaccgucagggugacg

SEQ ID NO: 787833 - RNA, 17 nt, Mycobacterium avium subsp. paratuberculosis
ucaccgugcgcgcgcac

SEQ ID NO: 787834 - RNA, 23 nt, Mycobacterium avium subsp. paratuberculosis
ucaccgugcgggucgcgcugcgg

SEQ ID NO: 787835 - RNA, 15 nt, Mycobacterium avium subsp. paratuberculosis
ucaccgugggcggcg

SEQ ID NO: 787836 - RNA, 19 nt, Mycobacterium avium subsp. paratuberculosis
ucaccgugggcggcgcgau

SEQ ID NO: 787837 - RNA, 24 nt, Mycobacterium avium subsp. paratuberculosis
ucaccgugggcggcgcgaucgucg

SEQ ID NO: 787838 - RNA, 14 nt, Mycobacterium avium subsp. paratuberculosis
ucaccgugucggcg

SEQ ID NO: 787839 - RNA, 16 nt, Mycobacterium avium subsp. paratuberculosis
ucaccgugucggcggg

SEQ ID NO: 787840 - RNA, 19 nt, Mycobacterium avium subsp. paratuberculosis
ucaccgugucggcgggcgg

SEQ ID NO: 787841 - RNA, 18 nt, Mycobacterium avium subsp. paratuberculosis
ucaccguucggggggcac

SEQ ID NO: 787842 - RNA, 16 nt, Mycobacterium avium subsp. paratuberculosis
ucagcagguugauccg

SEQ ID NO: 787843 - RNA, 20 nt, Mycobacterium avium subsp. paratuberculosis
ucagcagugccccguccggc

SEQ ID NO: 787844 - RNA, 23 nt, Mycobacterium avium subsp. paratuberculosis
ucagcagugccccguccggcgcc

SEQ ID NO: 787845 - RNA, 16 nt, Mycobacterium avium subsp. paratuberculosis
ucagcaugucgcccgc

SEQ ID NO: 787846 - RNA, 17 nt, Mycobacterium avium subsp. paratuberculosis
ucagcaugucgcccgcg

SEQ ID NO: 787847 - RNA, 19 nt, Mycobacterium avium subsp. paratuberculosis
ucagcaugucgcccgcguc

SEQ ID NO: 787848 - RNA, 13 nt, Mycobacterium avium subsp. paratuberculosis
ucagcagcgggcc

SEQ ID NO: 787849 - RNA, 21 nt, Mycobacterium avium subsp. paratuberculosis
ucagcagcgucugcgccagcu

SEQ ID NO: 787850 - RNA, 20 nt, Mycobacterium avium subsp. paratuberculosis
ucagcacguugugggcgggc

SEQ ID NO: 787851 - RNA, 13 nt, Mycobacterium avium subsp. paratuberculosis
ucagcagcgacau

SEQ ID NO: 787852 - RNA, 14 nt, Mycobacterium avium subsp. paratuberculosis
ucagcagcgcgacg

SEQ ID NO: 787853 - RNA, 13 nt, Mycobacterium avium subsp. paratuberculosis
ucagcagcgcggc

SEQ ID NO: 787854 - RNA, 13 nt, Mycobacterium avium subsp. paratuberculosis
ucagcagcgcggu

SEQ ID NO: 787855 - RNA, 12 nt, Mycobacterium avium subsp. paratuberculosis
ucagcagcgcgu

SEQ ID NO: 787856 - RNA, 19 nt, Mycobacterium avium subsp. paratuberculosis
ucagcagcgcguaggugcg

SEQ ID NO: 787857 - RNA, 17 nt, Mycobacterium avium subsp. paratuberculosis
ucagcaggcuggcggcg

SEQ ID NO: 787858 - RNA, 19 nt, Mycobacterium avium subsp. paratuberculosis
ucagcagggcggcaccgau

SEQ ID NO: 787859 - RNA, 15 nt, Mycobacterium avium subsp. paratuberculosis
ucagcagggugacgu

SEQ ID NO: 787860 - RNA, 17 nt, Mycobacterium avium subsp. paratuberculosis
ucagcagggugacgucg

SEQ ID NO: 787861 - RNA, 18 nt, Mycobacterium avium subsp. paratuberculosis
ucagcagcuugaucgccg

SEQ ID NO: 787862 - RNA, 17 nt, Mycobacterium avium subsp. paratuberculosis
ucagcaggaccgggauc

SEQ ID NO: 787863 - RNA, 17 nt, Mycobacterium avium subsp. paratuberculosis
ucagcaggcccucggcc

SEQ ID NO: 787864 - RNA, 19 nt, Mycobacterium avium subsp. paratuberculosis
ucagcaggcccucggccag

SEQ ID NO: 787865 - RNA, 20 nt, Mycobacterium avium subsp. paratuberculosis
ucagcaggcccucggccagc

SEQ ID NO: 787866 - RNA, 17 nt, Mycobacterium avium subsp. paratuberculosis
ucagcccccaccgcgcc

SEQ ID NO: 787867 - RNA, 19 nt, Mycobacterium avium subsp. paratuberculosis
ucagcccccaccgcgccgu

SEQ ID NO: 787868 - RNA, 23 nt, Mycobacterium avium subsp. paratuberculosis
ucagccccgaguccacgacgucc

SEQ ID NO: 787869 - RNA, 20 nt, Mycobacterium avium subsp. paratuberculosis
ucagccagguguagaccacg

SEQ ID NO: 787870 - RNA, 21 nt, Mycobacterium avium subsp. paratuberculosis
ucagccaguugaucagcccga

SEQ ID NO: 787871 - RNA, 14 nt, Mycobacterium avium subsp. paratuberculosis
ucagcccggcccgc

SEQ ID NO: 787872 - RNA, 18 nt, Mycobacterium avium subsp. paratuberculosis
ucagcccgcgucgcgcag

SEQ ID NO: 787873 - RNA, 19 nt, Mycobacterium avium subsp. paratuberculosis
ucagcccgauucagccggc

SEQ ID NO: 787874 - RNA, 21 nt, Mycobacterium avium subsp. paratuberculosis
ucagcccgcccuuggccgcgg

SEQ ID NO: 787875 - RNA, 12 nt, Mycobacterium avium subsp. paratuberculosis
ucagaucgccga

SEQ ID NO: 787876 - RNA, 12 nt, Mycobacterium avium subsp. paratuberculosis
ucagcacccgca

SEQ ID NO: 787877 - RNA, 18 nt, Mycobacterium avium subsp. paratuberculosis
ucagcacccgcagccgcg

SEQ ID NO: 787878 - RNA, 22 nt, Mycobacterium avium subsp. paratuberculosis
ucagcacccgcagccgcgaguc

SEQ ID NO: 787879 - RNA, 20 nt, Mycobacterium avium subsp. paratuberculosis
ucagcaccuuccaucgacgc

SEQ ID NO: 787880 - RNA, 22 nt, Mycobacterium avium subsp. paratuberculosis
ucagcaccuuccaucgacgcug

SEQ ID NO: 787881 - RNA, 13 nt, Mycobacterium avium subsp. paratuberculosis
ucagcacggccgc

SEQ ID NO: 787882 - RNA, 14 nt, Mycobacterium avium subsp. paratuberculosis
ucagcacggccgcg

SEQ ID NO: 787883 - RNA, 17 nt, Mycobacterium avium subsp. paratuberculosis
ucagcacggccgcggcc

SEQ ID NO: 787884 - RNA, 17 nt, Mycobacterium avium subsp. paratuberculosis
ucagcaccuccggcagc

SEQ ID NO: 787885 - RNA, 17 nt, Mycobacterium avium subsp. paratuberculosis
ucagcaccgaaucgccg

SEQ ID NO: 787886 - RNA, 21 nt, Mycobacterium avium subsp. paratuberculosis
ucagcaccgaaucgccgagcu

SEQ ID NO: 787887 - RNA, 19 nt, Mycobacterium avium subsp. paratuberculosis
ucagcaccgacgcggcgac

SEQ ID NO: 787888 - RNA, 20 nt, Mycobacterium avium subsp. paratuberculosis
ucagcaccgacgcggcgacc

SEQ ID NO: 787889 - RNA, 17 nt, Mycobacterium avium subsp. paratuberculosis
ucagcaccgcgcggcgg

SEQ ID NO: 787890 - RNA, 20 nt, Mycobacterium avium subsp. paratuberculosis
ucagcaccgcgcggcggugc

SEQ ID NO: 787891 - RNA, 21 nt, Mycobacterium avium subsp. paratuberculosis
ucagcaccguccacagccggc

SEQ ID NO: 787892 - RNA, 22 nt, Mycobacterium avium subsp. paratuberculosis
ucagcaccguccacagccggcg

SEQ ID NO: 787893 - RNA, 18 nt, Mycobacterium avium subsp. paratuberculosis
ucagcacuucauggucgu

SEQ ID NO: 787894 - RNA, 22 nt, Mycobacterium avium subsp. paratuberculosis
ucagcagaugcgcgucgcggcg

SEQ ID NO: 787895 - RNA, 23 nt, Mycobacterium avium subsp. paratuberculosis
ucagcagaugcgcgucgcggcgc

SEQ ID NO: 787896 - RNA, 15 nt, Mycobacterium avium subsp. paratuberculosis
ucagcagcaccggcg

SEQ ID NO: 787897 - RNA, 13 nt, Mycobacterium avium subsp. paratuberculosis
ucagcagcaccug

SEQ ID NO: 787898 - RNA, 14 nt, Mycobacterium avium subsp. paratuberculosis
ucagcagcagcgcc

SEQ ID NO: 787899 - RNA, 13 nt, Mycobacterium avium subsp. paratuberculosis
ucagcagccggca

SEQ ID NO: 787900 - RNA, 14 nt, Mycobacterium avium subsp. paratuberculosis
ucagcagccgggcc

SEQ ID NO: 787901 - RNA, 15 nt, Mycobacterium avium subsp. paratuberculosis
ucagcagccgggccu

SEQ ID NO: 787902 - RNA, 15 nt, Mycobacterium avium subsp. paratuberculosis
ucagcagcacccggg

SEQ ID NO: 787903 - RNA, 21 nt, Mycobacterium avium subsp. paratuberculosis
ucagcagcacccggucgccgg

SEQ ID NO: 787904 - RNA, 17 nt, Mycobacterium avium subsp. paratuberculosis
ucaacggcuccagguag

SEQ ID NO: 787905 - RNA, 22 nt, Mycobacterium avium subsp. paratuberculosis
ucaacggcuccagguagggcac

SEQ ID NO: 787906 - RNA, 18 nt, Mycobacterium avium subsp. paratuberculosis
ucaacgugauacgccgac

SEQ ID NO: 787907 - RNA, 19 nt, Mycobacterium avium subsp. paratuberculosis
ucaacgugauacgccgacg

SEQ ID NO: 787908 - RNA, 14 nt, Mycobacterium avium subsp. paratuberculosis
ucaacgccccgguc

SEQ ID NO: 787909 - RNA, 21 nt, Mycobacterium avium subsp. paratuberculosis
ucaacgccgggucgacgccga

SEQ ID NO: 787910 - RNA, 13 nt, Mycobacterium avium subsp. paratuberculosis
ucaacgcgccgaa

SEQ ID NO: 787911 - RNA, 14 nt, Mycobacterium avium subsp. paratuberculosis
ucaacgcgccgaac

SEQ ID NO: 787912 - RNA, 20 nt, Mycobacterium avium subsp. paratuberculosis
ucaacggcaccgacagggcc

SEQ ID NO: 787913 - RNA, 16 nt, Mycobacterium avium subsp. paratuberculosis
ucaacggccaaccgcc

SEQ ID NO: 787914 - RNA, 19 nt, Mycobacterium avium subsp. paratuberculosis
ucaacggccggcgccgccg

SEQ ID NO: 787915 - RNA, 20 nt, Mycobacterium avium subsp. paratuberculosis
ucaacggccggcgccgccgg

SEQ ID NO: 787916 - RNA, 15 nt, Mycobacterium avium subsp. paratuberculosis
ucaacuugcgcgacg

SEQ ID NO: 787917 - RNA, 15 nt, Mycobacterium avium subsp. paratuberculosis
ucaagcgcuuucgcc

SEQ ID NO: 787918 - RNA, 15 nt, Mycobacterium avium subsp. paratuberculosis
ucaaggggccgggcu

SEQ ID NO: 787919 - RNA, 20 nt, Mycobacterium avium subsp. paratuberculosis
ucaauacguuccuggugggc

SEQ ID NO: 787920 - RNA, 16 nt, Mycobacterium avium subsp. paratuberculosis
ucaaccacaccagcau

SEQ ID NO: 787921 - RNA, 17 nt, Mycobacterium avium subsp. paratuberculosis
ucaaccaccggcaucgg

SEQ ID NO: 787922 - RNA, 22 nt, Mycobacterium avium subsp. paratuberculosis
ucaacaccgggauccggcgcgc

SEQ ID NO: 787923 - RNA, 21 nt, Mycobacterium avium subsp. paratuberculosis
ucaaccccgcgcgcgggccag

SEQ ID NO: 787924 - RNA, 23 nt, Mycobacterium avium subsp. paratuberculosis
ucaaccccgcgcgcgggccagcg

SEQ ID NO: 787925 - RNA, 18 nt, Mycobacterium avium subsp. paratuberculosis
ucaaccgauuucggccag

SEQ ID NO: 787926 - RNA, 20 nt, Mycobacterium avium subsp. paratuberculosis
ucaaccgauuucggccagcc

SEQ ID NO: 787927 - RNA, 22 nt, Mycobacterium avium subsp. paratuberculosis
ucaacccgcucaggucggccgc

SEQ ID NO: 787928 - RNA, 15 nt, Mycobacterium avium subsp. paratuberculosis
ucaacccgagcaccg

SEQ ID NO: 787929 - RNA, 23 nt, Mycobacterium avium subsp. paratuberculosis
ucaaccgguagaagaugcgccgg

SEQ ID NO: 787930 - RNA, 12 nt, Mycobacterium avium subsp. paratuberculosis
uaugcgcccggg

SEQ ID NO: 787931 - RNA, 16 nt, Mycobacterium avium subsp. paratuberculosis
uaucgccacgccgacc

SEQ ID NO: 787932 - RNA, 19 nt, Mycobacterium avium subsp. paratuberculosis
uaucgcccggcgcccggcc

SEQ ID NO: 787933 - RNA, 17 nt, Mycobacterium avium subsp. paratuberculosis
uagcgccacaucagcuc

SEQ ID NO: 787934 - RNA, 15 nt, Mycobacterium avium subsp. paratuberculosis
uagcggauggcgacg

SEQ ID NO: 787935 - RNA, 17 nt, Mycobacterium avium subsp. paratuberculosis
uagcggauggcgacggc

SEQ ID NO: 787936 - RNA, 20 nt, Mycobacterium avium subsp. paratuberculosis
uagcggauggcgacggcgac

SEQ ID NO: 787937 - RNA, 14 nt, Mycobacterium avium subsp. paratuberculosis
uagcggccgcacgc

SEQ ID NO: 787938 - RNA, 15 nt, Mycobacterium avium subsp. paratuberculosis
uagcggcgccaccgg

SEQ ID NO: 787939 - RNA, 13 nt, Mycobacterium avium subsp. paratuberculosis
uagcggccgcgga

SEQ ID NO: 787940 - RNA, 20 nt, Mycobacterium avium subsp. paratuberculosis
uagcggcggucggcgccgau

SEQ ID NO: 787941 - RNA, 18 nt, Mycobacterium avium subsp. paratuberculosis
uagcggcucgccaccucg

SEQ ID NO: 787942 - RNA, 18 nt, Mycobacterium avium subsp. paratuberculosis
uagcggcugaccgagcgg

SEQ ID NO: 787943 - RNA, 12 nt, Mycobacterium avium subsp. paratuberculosis
uagcggucgggg

SEQ ID NO: 787944 - RNA, 17 nt, Mycobacterium avium subsp. paratuberculosis
uagcgguccauccagcg

SEQ ID NO: 787945 - RNA, 21 nt, Mycobacterium avium subsp. paratuberculosis
uagcgguccauccagcgccgc

SEQ ID NO: 787946 - RNA, 18 nt, Mycobacterium avium subsp. paratuberculosis
uagcgggcuaggcucggc

SEQ ID NO: 787947 - RNA, 13 nt, Mycobacterium avium subsp. paratuberculosis
uaugcccgggccg

SEQ ID NO: 787948 - RNA, 14 nt, Mycobacterium avium subsp. paratuberculosis
uacugcucgacgua

SEQ ID NO: 787949 - RNA, 17 nt, Mycobacterium avium subsp. paratuberculosis
uacugcucggcgcggcu

SEQ ID NO: 787950 - RNA, 17 nt, Mycobacterium avium subsp. paratuberculosis
uacugggcguggucgcc

SEQ ID NO: 787951 - RNA, 16 nt, Mycobacterium avium subsp. paratuberculosis
uacucaaaccgggccu

SEQ ID NO: 787952 - RNA, 17 nt, Mycobacterium avium subsp. paratuberculosis
uagaggccgcggaucgc

SEQ ID NO: 787953 - RNA, 20 nt, Mycobacterium avium subsp. paratuberculosis
uagaggcggcgaccgcgacg

SEQ ID NO: 787954 - RNA, 17 nt, Mycobacterium avium subsp. paratuberculosis
uagacagcguggucgcg

SEQ ID NO: 787955 - RNA, 17 nt, Mycobacterium avium subsp. paratuberculosis
uagaccagcaucagcau

SEQ ID NO: 787956 - RNA, 24 nt, Mycobacterium avium subsp. paratuberculosis
uagacgcgcaccagggccgcgagc

SEQ ID NO: 787957 - RNA, 22 nt, Mycobacterium avium subsp. paratuberculosis
uagacgcgggccggcacccggg

SEQ ID NO: 787958 - RNA, 17 nt, Mycobacterium avium subsp. paratuberculosis
uagacgcugccgcuggc

SEQ ID NO: 787959 - RNA, 14 nt, Mycobacterium avium subsp. paratuberculosis
uagacgacgggcag

SEQ ID NO: 787960 - RNA, 18 nt, Mycobacterium avium subsp. paratuberculosis
uagacguagugcagccgc

SEQ ID NO: 787961 - RNA, 15 nt, Mycobacterium avium subsp. paratuberculosis
uacuugcuggcgcug

SEQ ID NO: 787962 - RNA, 15 nt, Mycobacterium avium subsp. paratuberculosis
uagcacccggccggc

SEQ ID NO: 787963 - RNA, 16 nt, Mycobacterium avium subsp. paratuberculosis
uagcacuuucgcggca

SEQ ID NO: 787964 - RNA, 23 nt, Mycobacterium avium subsp. paratuberculosis
uagcagcgcggcuuggccaccac

SEQ ID NO: 787965 - RNA, 18 nt, Mycobacterium avium subsp. paratuberculosis
uagcagcgucugcgcccc

SEQ ID NO: 787966 - RNA, 15 nt, Mycobacterium avium subsp. paratuberculosis
uagccagcaccgccc

SEQ ID NO: 787967 - RNA, 16 nt, Mycobacterium avium subsp. paratuberculosis
uagcgcagcaccaggc

SEQ ID NO: 787968 - RNA, 19 nt, Mycobacterium avium subsp. paratuberculosis
uagcgcagcaucacgucgg

SEQ ID NO: 787969 - RNA, 20 nt, Mycobacterium avium subsp. paratuberculosis
uagcgcaugaugcccaggcc

SEQ ID NO: 787970 - RNA, 14 nt, Mycobacterium avium subsp. paratuberculosis
uagcgcaucagcuc

SEQ ID NO: 787971 - RNA, 23 nt, Mycobacterium avium subsp. paratuberculosis
uagcgcaucagcucuucgacgau

SEQ ID NO: 787972 - RNA, 20 nt, Mycobacterium avium subsp. paratuberculosis
uagccgcccugcccgucggg

SEQ ID NO: 787973 - RNA, 21 nt, Mycobacterium avium subsp. paratuberculosis
uagccgccgguggcgucggug

SEQ ID NO: 787974 - RNA, 14 nt, Mycobacterium avium subsp. paratuberculosis
uagccgcgccgcgg

SEQ ID NO: 787975 - RNA, 15 nt, Mycobacterium avium subsp. paratuberculosis
uagccgcgccgcggu

SEQ ID NO: 787976 - RNA, 19 nt, Mycobacterium avium subsp. paratuberculosis
uagcgagugccggccagcu

SEQ ID NO: 787977 - RNA, 21 nt, Mycobacterium avium subsp. paratuberculosis
uagcgagugccggccagcucg

SEQ ID NO: 787978 - RNA, 17 nt, Mycobacterium avium subsp. paratuberculosis
uagcgcaacaccgaaag

SEQ ID NO: 787979 - RNA, 18 nt, Mycobacterium avium subsp. paratuberculosis
uagcccaucagcacgccc

SEQ ID NO: 787980 - RNA, 20 nt, Mycobacterium avium subsp. paratuberculosis
uagcccaucagcacgcccuc

SEQ ID NO: 787981 - RNA, 19 nt, Mycobacterium avium subsp. paratuberculosis
uagccaucagaacgcccgc

SEQ ID NO: 787982 - RNA, 14 nt, Mycobacterium avium subsp. paratuberculosis
uagcccagcguggu

SEQ ID NO: 787983 - RNA, 18 nt, Mycobacterium avium subsp. paratuberculosis
uagcccuaccggcucggc

SEQ ID NO: 787984 - RNA, 20 nt, Mycobacterium avium subsp. paratuberculosis
uagcccucccggaacagcuu

SEQ ID NO: 787985 - RNA, 13 nt, Mycobacterium avium subsp. paratuberculosis
uagccgaccaacg

SEQ ID NO: 787986 - RNA, 20 nt, Mycobacterium avium subsp. paratuberculosis
uagccgaccaacgggcggcg

SEQ ID NO: 787987 - RNA, 20 nt, Mycobacterium avium subsp. paratuberculosis
uagccgaccgacccggccag

SEQ ID NO: 787988 - RNA, 18 nt, Mycobacterium avium subsp. paratuberculosis
uagcccgaaacgucgcag

SEQ ID NO: 787989 - RNA, 21 nt, Mycobacterium avium subsp. paratuberculosis
uagcccgaaacgucgcagccc

SEQ ID NO: 787990 - RNA, 21 nt, Mycobacterium avium subsp. paratuberculosis
uagcccgacgggcgugccggc

SEQ ID NO: 787991 - RNA, 13 nt, Mycobacterium avium subsp. paratuberculosis
uagcccgccgcgg

SEQ ID NO: 787992 - RNA, 14 nt, Mycobacterium avium subsp. paratuberculosis
uagcccgccgcggc

SEQ ID NO: 787993 - RNA, 15 nt, Mycobacterium avium subsp. paratuberculosis
uaccgguuccgggcg

SEQ ID NO: 787994 - RNA, 23 nt, Mycobacterium avium subsp. paratuberculosis
uaccgguugcccgguuccgcgac

SEQ ID NO: 787995 - RNA, 17 nt, Mycobacterium avium subsp. paratuberculosis
uacgccaucagcaccac

SEQ ID NO: 787996 - RNA, 18 nt, Mycobacterium avium subsp. paratuberculosis
uacgccagaugcgccgcg

SEQ ID NO: 787997 - RNA, 13 nt, Mycobacterium avium subsp. paratuberculosis
uacgcaucgccga

SEQ ID NO: 787998 - RNA, 19 nt, Mycobacterium avium subsp. paratuberculosis
uacgcccgaucccgggccg

SEQ ID NO: 787999 - RNA, 21 nt, Mycobacterium avium subsp. paratuberculosis
uaccgcaacaccgaaagccga

SEQ ID NO: 788000 - RNA, 16 nt, Mycobacterium avium subsp. paratuberculosis
uaccgaggaugaccgc

SEQ ID NO: 788001 - RNA, 16 nt, Mycobacterium avium subsp. paratuberculosis
uaccgaccuguccgau

SEQ ID NO: 788002 - RNA, 13 nt, Mycobacterium avium subsp. paratuberculosis
uaccgccggccgc

SEQ ID NO: 788003 - RNA, 14 nt, Mycobacterium avium subsp. paratuberculosis
uaccgccggccgcg

SEQ ID NO: 788004 - RNA, 15 nt, Mycobacterium avium subsp. paratuberculosis
uaccgcccgcgcugg

SEQ ID NO: 788005 - RNA, 16 nt, Mycobacterium avium subsp. paratuberculosis
uaccgcccgcgcuggu

SEQ ID NO: 788006 - RNA, 16 nt, Mycobacterium avium subsp. paratuberculosis
uaccgcgcucaccguc

SEQ ID NO: 788007 - RNA, 16 nt, Mycobacterium avium subsp. paratuberculosis
uaccgcggcggcgucg

SEQ ID NO: 788008 - RNA, 14 nt, Mycobacterium avium subsp. paratuberculosis
uaccgccucgccag

SEQ ID NO: 788009 - RNA, 20 nt, Mycobacterium avium subsp. paratuberculosis
uaccggcagcaggugcacca

SEQ ID NO: 788010 - RNA, 13 nt, Mycobacterium avium subsp. paratuberculosis
uaccggcccagcg

SEQ ID NO: 788011 - RNA, 23 nt, Mycobacterium avium subsp. paratuberculosis
uaccggcgccaggccggcgacgc

SEQ ID NO: 788012 - RNA, 13 nt, Mycobacterium avium subsp. paratuberculosis
uacccccgcacgc

SEQ ID NO: 788013 - RNA, 14 nt, Mycobacterium avium subsp. paratuberculosis
uaccauugcgccgg

SEQ ID NO: 788014 - RNA, 14 nt, Mycobacterium avium subsp. paratuberculosis
uaccagugcccgag

SEQ ID NO: 788015 - RNA, 22 nt, Mycobacterium avium subsp. paratuberculosis
uaccagggcagcgccucggcgg

SEQ ID NO: 788016 - RNA, 13 nt, Mycobacterium avium subsp. paratuberculosis
uaccaggcgacgu

SEQ ID NO: 788017 - RNA, 14 nt, Mycobacterium avium subsp. paratuberculosis
uacccgcgcggcgc

SEQ ID NO: 788018 - RNA, 18 nt, Mycobacterium avium subsp. paratuberculosis
uacccgcgcggcgcaggu

SEQ ID NO: 788019 - RNA, 16 nt, Mycobacterium avium subsp. paratuberculosis
uacccguccagcgcga

SEQ ID NO: 788020 - RNA, 13 nt, Mycobacterium avium subsp. paratuberculosis
uacccuccgggcg

SEQ ID NO: 788021 - RNA, 16 nt, Mycobacterium avium subsp. paratuberculosis
uacccuccgggcggca

SEQ ID NO: 788022 - RNA, 14 nt, Mycobacterium avium subsp. paratuberculosis
uacagcgccagcgg

SEQ ID NO: 788023 - RNA, 11 nt, Mycobacterium avium subsp. paratuberculosis
uaccagcgcca

SEQ ID NO: 788024 - RNA, 15 nt, Mycobacterium avium subsp. paratuberculosis
uaccagcgcucgacg

SEQ ID NO: 788025 - RNA, 16 nt, Mycobacterium avium subsp. paratuberculosis
uaccagcgcucgacga

SEQ ID NO: 788026 - RNA, 21 nt, Mycobacterium avium subsp. paratuberculosis
uaccagcgcugguaccgguug

SEQ ID NO: 788027 - RNA, 17 nt, Mycobacterium avium subsp. paratuberculosis
uaccacgccgucgacga

SEQ ID NO: 788028 - RNA, 21 nt, Mycobacterium avium subsp. paratuberculosis
uaccacuugaaggaggcgguc

SEQ ID NO: 788029 - RNA, 16 nt, Mycobacterium avium subsp. paratuberculosis
uaccacugcgcgcccg

SEQ ID NO: 788030 - RNA, 20 nt, Mycobacterium avium subsp. paratuberculosis
uaacugcguguggcgcacgc

SEQ ID NO: 788031 - RNA, 19 nt, Mycobacterium avium subsp. paratuberculosis
uaagccauggcggcccgcg

SEQ ID NO: 788032 - RNA, 22 nt, Mycobacterium avium subsp. paratuberculosis
uaauccccccgcgccgcccgga

SEQ ID NO: 788033 - RNA, 18 nt, Mycobacterium avium subsp. paratuberculosis
uacaccgguugcgccgag

SEQ ID NO: 788034 - RNA, 19 nt, Mycobacterium avium subsp. paratuberculosis
uacaccgguugcgccgagg

SEQ ID NO: 788035 - RNA, 20 nt, Mycobacterium avium subsp. paratuberculosis
uacacagggcggcgacacgc

SEQ ID NO: 788036 - RNA, 20 nt, Mycobacterium avium subsp. paratuberculosis
uaacgccggccccggcgacg

SEQ ID NO: 788037 - RNA, 14 nt, Mycobacterium avium subsp. paratuberculosis
guuucacgcucggc

SEQ ID NO: 788038 - RNA, 16 nt, Mycobacterium avium subsp. paratuberculosis
guuucacgcucggcgg

SEQ ID NO: 788039 - RNA, 18 nt, Mycobacterium avium subsp. paratuberculosis
guuucaccgugcgcgcgc

SEQ ID NO: 788040 - RNA, 12 nt, Mycobacterium avium subsp. paratuberculosis
guuucagcaacc

SEQ ID NO: 788041 - RNA, 17 nt, Mycobacterium avium subsp. paratuberculosis
guuucagguggcgcccg

SEQ ID NO: 788042 - RNA, 14 nt, Mycobacterium avium subsp. paratuberculosis
uaaaccggccggcg

SEQ ID NO: 788043 - RNA, 17 nt, Mycobacterium avium subsp. paratuberculosis
uaaaccgccagcagcgc

SEQ ID NO: 788044 - RNA, 19 nt, Mycobacterium avium subsp. paratuberculosis
guguuguuugagaacucaa

SEQ ID NO: 788045 - RNA, 19 nt, Mycobacterium avium subsp. paratuberculosis
guguuguccgagccgccca

SEQ ID NO: 788046 - RNA, 23 nt, Mycobacterium avium subsp. paratuberculosis
guguuguccgguaggccggccgc

SEQ ID NO: 788047 - RNA, 15 nt, Mycobacterium avium subsp. paratuberculosis
guguuggcggcgucg

SEQ ID NO: 788048 - RNA, 18 nt, Mycobacterium avium subsp. paratuberculosis
guguugccgacggcgccg

SEQ ID NO: 788049 - RNA, 16 nt, Mycobacterium avium subsp. paratuberculosis
guguugaucauccggc

SEQ ID NO: 788050 - RNA, 16 nt, Mycobacterium avium subsp. paratuberculosis
guguugagcucgcggc

SEQ ID NO: 788051 - RNA, 13 nt, Mycobacterium avium subsp. paratuberculosis
guguucucacggc

SEQ ID NO: 788052 - RNA, 17 nt, Mycobacterium avium subsp. paratuberculosis
guguucucacggcgaau

SEQ ID NO: 788053 - RNA, 19 nt, Mycobacterium avium subsp. paratuberculosis
guguucuggaugcccaggg

SEQ ID NO: 788054 - RNA, 14 nt, Mycobacterium avium subsp. paratuberculosis
guuaagugcccgcc

SEQ ID NO: 788055 - RNA, 17 nt, Mycobacterium avium subsp. paratuberculosis
guuaagacuucggcgaa

SEQ ID NO: 788056 - RNA, 14 nt, Mycobacterium avium subsp. paratuberculosis
guguggcagguggc

SEQ ID NO: 788057 - RNA, 19 nt, Mycobacterium avium subsp. paratuberculosis
gugugggcggacugcccga

SEQ ID NO: 788058 - RNA, 17 nt, Mycobacterium avium subsp. paratuberculosis
gugugggcucgcccggg

SEQ ID NO: 788059 - RNA, 13 nt, Mycobacterium avium subsp. paratuberculosis
guguggcgcacgc

SEQ ID NO: 788060 - RNA, 15 nt, Mycobacterium avium subsp. paratuberculosis
guguggacggcgagu

SEQ ID NO: 788061 - RNA, 14 nt, Mycobacterium avium subsp. paratuberculosis
gugugcugacccag

SEQ ID NO: 788062 - RNA, 18 nt, Mycobacterium avium subsp. paratuberculosis
gugugcugacccagcgcg

SEQ ID NO: 788063 - RNA, 15 nt, Mycobacterium avium subsp. paratuberculosis
gugugcuggccagca

SEQ ID NO: 788064 - RNA, 23 nt, Mycobacterium avium subsp. paratuberculosis
guguggaucgcuucggccagcgc

SEQ ID NO: 788065 - RNA, 15 nt, Mycobacterium avium subsp. paratuberculosis
guguucaacgcgccg

SEQ ID NO: 788066 - RNA, 19 nt, Mycobacterium avium subsp. paratuberculosis
guguguacacagggcggcg

SEQ ID NO: 788067 - RNA, 14 nt, Mycobacterium avium subsp. paratuberculosis
guguuccuugcggc

SEQ ID NO: 788068 - RNA, 17 nt, Mycobacterium avium subsp. paratuberculosis
guguucggcgccagccg

SEQ ID NO: 788069 - RNA, 23 nt, Mycobacterium avium subsp. paratuberculosis
guguucgggcaguugccggccau

SEQ ID NO: 788070 - RNA, 17 nt, Mycobacterium avium subsp. paratuberculosis
gugucuuucucgaugac

SEQ ID NO: 788071 - RNA, 13 nt, Mycobacterium avium subsp. paratuberculosis
gugucgucgcgca

SEQ ID NO: 788072 - RNA, 13 nt, Mycobacterium avium subsp. paratuberculosis
gugucgucgucgc

SEQ ID NO: 788073 - RNA, 19 nt, Mycobacterium avium subsp. paratuberculosis
gugucgucgucgccgccgg

SEQ ID NO: 788074 - RNA, 22 nt, Mycobacterium avium subsp. paratuberculosis
gugucguggcgacaucgccgcg

SEQ ID NO: 788075 - RNA, 13 nt, Mycobacterium avium subsp. paratuberculosis
gugugcaccagcg

SEQ ID NO: 788076 - RNA, 14 nt, Mycobacterium avium subsp. paratuberculosis
gugugcagccaccc

SEQ ID NO: 788077 - RNA, 15 nt, Mycobacterium avium subsp. paratuberculosis
gugugcagccacccg

SEQ ID NO: 788078 - RNA, 13 nt, Mycobacterium avium subsp. paratuberculosis
gugugcaggccga

SEQ ID NO: 788079 - RNA, 24 nt, Mycobacterium avium subsp. paratuberculosis
gugugcccagcacgacgccgcugg

SEQ ID NO: 788080 - RNA, 12 nt, Mycobacterium avium subsp. paratuberculosis
gugugcccgccc

SEQ ID NO: 788081 - RNA, 18 nt, Mycobacterium avium subsp. paratuberculosis
gugugcgcaucggcgacg

SEQ ID NO: 788082 - RNA, 11 nt, Mycobacterium avium subsp. paratuberculosis
gugugcggcac

SEQ ID NO: 788083 - RNA, 21 nt, Mycobacterium avium subsp. paratuberculosis
gugugcgguucacgcggcugg

SEQ ID NO: 788084 - RNA, 15 nt, Mycobacterium avium subsp. paratuberculosis
gugucgaugaacgca

SEQ ID NO: 788085 - RNA, 20 nt, Mycobacterium avium subsp. paratuberculosis
gugucgagcacgucgacgcc

SEQ ID NO: 788086 - RNA, 16 nt, Mycobacterium avium subsp. paratuberculosis
gugucgagccggugcc

SEQ ID NO: 788087 - RNA, 18 nt, Mycobacterium avium subsp. paratuberculosis
gugucgaagaccggugcg

SEQ ID NO: 788088 - RNA, 20 nt, Mycobacterium avium subsp. paratuberculosis
gugucgaagaccggugcgcg

SEQ ID NO: 788089 - RNA, 22 nt, Mycobacterium avium subsp. paratuberculosis
gugucgaagaccggugcgcgca

SEQ ID NO: 788090 - RNA, 20 nt, Mycobacterium avium subsp. paratuberculosis
gugucgacccaggucgaguu

SEQ ID NO: 788091 - RNA, 20 nt, Mycobacterium avium subsp. paratuberculosis
gugucgacgguugccucggc

SEQ ID NO: 788092 - RNA, 21 nt, Mycobacterium avium subsp. paratuberculosis
gugucgccggggcggaucccc

SEQ ID NO: 788093 - RNA, 16 nt, Mycobacterium avium subsp. paratuberculosis
gugucgaggucgucgg

SEQ ID NO: 788094 - RNA, 15 nt, Mycobacterium avium subsp. paratuberculosis
gugucgccgucgccg

SEQ ID NO: 788095 - RNA, 13 nt, Mycobacterium avium subsp. paratuberculosis
gugucgcggcugc

SEQ ID NO: 788096 - RNA, 13 nt, Mycobacterium avium subsp. paratuberculosis
gugucgcucaucc

SEQ ID NO: 788097 - RNA, 16 nt, Mycobacterium avium subsp. paratuberculosis
gugucgcucaucccga

SEQ ID NO: 788098 - RNA, 21 nt, Mycobacterium avium subsp. paratuberculosis
gugucggagaucggcgagugc

SEQ ID NO: 788099 - RNA, 21 nt, Mycobacterium avium subsp. paratuberculosis
gugucggcgaaggugccccgc

SEQ ID NO: 788100 - RNA, 13 nt, Mycobacterium avium subsp. paratuberculosis
gugucggcgggcg

SEQ ID NO: 788101 - RNA, 13 nt, Mycobacterium avium subsp. paratuberculosis
gugucggcgucga

SEQ ID NO: 788102 - RNA, 22 nt, Mycobacterium avium subsp. paratuberculosis
gugucggcgucgaugucgucgu

SEQ ID NO: 788103 - RNA, 13 nt, Mycobacterium avium subsp. paratuberculosis
gugucggcgcccc

SEQ ID NO: 788104 - RNA, 19 nt, Mycobacterium avium subsp. paratuberculosis
gugucggggucggcgccgc

SEQ ID NO: 788105 - RNA, 16 nt, Mycobacterium avium subsp. paratuberculosis
gugucggggucgucga

SEQ ID NO: 788106 - RNA, 16 nt, Mycobacterium avium subsp. paratuberculosis
gugucguagacgacgu

SEQ ID NO: 788107 - RNA, 20 nt, Mycobacterium avium subsp. paratuberculosis
gugucguagacgacgucgac

SEQ ID NO: 788108 - RNA, 18 nt, Mycobacterium avium subsp. paratuberculosis
gugucguagcggcugucg

SEQ ID NO: 788109 - RNA, 19 nt, Mycobacterium avium subsp. paratuberculosis
gugucacguccacgccgcg

SEQ ID NO: 788110 - RNA, 21 nt, Mycobacterium avium subsp. paratuberculosis
gugucacguccacgccgcggg

SEQ ID NO: 788111 - RNA, 23 nt, Mycobacterium avium subsp. paratuberculosis
gugucagcgcgaccucgguggug

SEQ ID NO: 788112 - RNA, 16 nt, Mycobacterium avium subsp. paratuberculosis
gugucagggcagcggu

SEQ ID NO: 788113 - RNA, 15 nt, Mycobacterium avium subsp. paratuberculosis
gugucaggucggcga

SEQ ID NO: 788114 - RNA, 18 nt, Mycobacterium avium subsp. paratuberculosis
gugucaggucggcgaugg

SEQ ID NO: 788115 - RNA, 16 nt, Mycobacterium avium subsp. paratuberculosis
gugucaccgacgccag

SEQ ID NO: 788116 - RNA, 13 nt, Mycobacterium avium subsp. paratuberculosis
gugucacgcuggc

SEQ ID NO: 788117 - RNA, 19 nt, Mycobacterium avium subsp. paratuberculosis
gugucacgcuggcgugacg

SEQ ID NO: 788118 - RNA, 20 nt, Mycobacterium avium subsp. paratuberculosis
gugucacgcuggcgugacgu

SEQ ID NO: 788119 - RNA, 15 nt, Mycobacterium avium subsp. paratuberculosis
gugucaaccaggucg

SEQ ID NO: 788120 - RNA, 21 nt, Mycobacterium avium subsp. paratuberculosis
guguaguacugcucgacguag

SEQ ID NO: 788121 - RNA, 14 nt, Mycobacterium avium subsp. paratuberculosis
guguagucggcgau

SEQ ID NO: 788122 - RNA, 17 nt, Mycobacterium avium subsp. paratuberculosis
guguccgacgccgucga

SEQ ID NO: 788123 - RNA, 15 nt, Mycobacterium avium subsp. paratuberculosis
guguccgaugacgag

SEQ ID NO: 788124 - RNA, 23 nt, Mycobacterium avium subsp. paratuberculosis
guguccaggucguuggagucguc

SEQ ID NO: 788125 - RNA, 17 nt, Mycobacterium avium subsp. paratuberculosis
guguccacgucgcccag

SEQ ID NO: 788126 - RNA, 17 nt, Mycobacterium avium subsp. paratuberculosis
guguccgcggcgucggg

SEQ ID NO: 788127 - RNA, 11 nt, Mycobacterium avium subsp. paratuberculosis
guguccggccc

SEQ ID NO: 788128 - RNA, 14 nt, Mycobacterium avium subsp. paratuberculosis
guguccgggcccga

SEQ ID NO: 788129 - RNA, 15 nt, Mycobacterium avium subsp. paratuberculosis
guguccgggcgccca

SEQ ID NO: 788130 - RNA, 13 nt, Mycobacterium avium subsp. paratuberculosis
gugucccgcgugg

SEQ ID NO: 788131 - RNA, 18 nt, Mycobacterium avium subsp. paratuberculosis
guguccuugcgcaccacg

SEQ ID NO: 788132 - RNA, 15 nt, Mycobacterium avium subsp. paratuberculosis
guguacacagggcgg

SEQ ID NO: 788133 - RNA, 19 nt, Mycobacterium avium subsp. paratuberculosis
guguaaccguggcaggcga

SEQ ID NO: 788134 - RNA, 16 nt, Mycobacterium avium subsp. paratuberculosis
guguaacgcgucgacg

SEQ ID NO: 788135 - RNA, 17 nt, Mycobacterium avium subsp. paratuberculosis
guguaacgcgucgacgg

SEQ ID NO: 788136 - RNA, 21 nt, Mycobacterium avium subsp. paratuberculosis
gugguuggcgaucagggcggc

SEQ ID NO: 788137 - RNA, 13 nt, Mycobacterium avium subsp. paratuberculosis
gugguucguccgg

SEQ ID NO: 788138 - RNA, 13 nt, Mycobacterium avium subsp. paratuberculosis
guggugcgcccgu

SEQ ID NO: 788139 - RNA, 20 nt, Mycobacterium avium subsp. paratuberculosis
gugguuaccagcucaccggg

SEQ ID NO: 788140 - RNA, 22 nt, Mycobacterium avium subsp. paratuberculosis
gugguugagcagcagaccgccg

SEQ ID NO: 788141 - RNA, 20 nt, Mycobacterium avium subsp. paratuberculosis
gugguugcaaucucgucggg

SEQ ID NO: 788142 - RNA, 16 nt, Mycobacterium avium subsp. paratuberculosis
guguacucggcgucgc

SEQ ID NO: 788143 - RNA, 16 nt, Mycobacterium avium subsp. paratuberculosis
guguacacgucgcggg

SEQ ID NO: 788144 - RNA, 17 nt, Mycobacterium avium subsp. paratuberculosis
guguacacgucgcgggu

SEQ ID NO: 788145 - RNA, 14 nt, Mycobacterium avium subsp. paratuberculosis
guguaggcgucggc

SEQ ID NO: 788146 - RNA, 23 nt, Mycobacterium avium subsp. paratuberculosis
guguaggccgcgcuggccagcgu

SEQ ID NO: 788147 - RNA, 17 nt, Mycobacterium avium subsp. paratuberculosis
guguagagcaccucgau

SEQ ID NO: 788148 - RNA, 17 nt, Mycobacterium avium subsp. paratuberculosis
guggugggcgaacagca

SEQ ID NO: 788149 - RNA, 20 nt, Mycobacterium avium subsp. paratuberculosis
gugguggccgaacgggucgg

SEQ ID NO: 788150 - RNA, 13 nt, Mycobacterium avium subsp. paratuberculosis
gugguggcgaaca

SEQ ID NO: 788151 - RNA, 23 nt, Mycobacterium avium subsp. paratuberculosis
gugguggaaggugacgucgccga

SEQ ID NO: 788152 - RNA, 18 nt, Mycobacterium avium subsp. paratuberculosis
guggugcggugcaccgcg

SEQ ID NO: 788153 - RNA, 23 nt, Mycobacterium avium subsp. paratuberculosis
guggugggguccgcaggcgaagg

SEQ ID NO: 788154 - RNA, 23 nt, Mycobacterium avium subsp. paratuberculosis
gugguggucgucgacgagcccgc

SEQ ID NO: 788155 - RNA, 19 nt, Mycobacterium avium subsp. paratuberculosis
gugguggugcccaucgacc

SEQ ID NO: 788156 - RNA, 15 nt, Mycobacterium avium subsp. paratuberculosis
guggugugcccgcgg

SEQ ID NO: 788157 - RNA, 19 nt, Mycobacterium avium subsp. paratuberculosis
gugguguggcgucggccgg

SEQ ID NO: 788158 - RNA, 22 nt, Mycobacterium avium subsp. paratuberculosis
gugguguugaucauccggcggg

SEQ ID NO: 788159 - RNA, 16 nt, Mycobacterium avium subsp. paratuberculosis
guggugccgucgcgcu

SEQ ID NO: 788160 - RNA, 16 nt, Mycobacterium avium subsp. paratuberculosis
guggugccgccgucga

SEQ ID NO: 788161 - RNA, 16 nt, Mycobacterium avium subsp. paratuberculosis
gugcguuugaugacgc

SEQ ID NO: 788162 - RNA, 20 nt, Mycobacterium avium subsp. paratuberculosis
gugcguuccagguccgcggu

SEQ ID NO: 788163 - RNA, 12 nt, Mycobacterium avium subsp. paratuberculosis
gugcgugcgcuc

SEQ ID NO: 788164 - RNA, 22 nt, Mycobacterium avium subsp. paratuberculosis
guucaugaucucguugcggcgc

SEQ ID NO: 788165 - RNA, 16 nt, Mycobacterium avium subsp. paratuberculosis
guuccaacaacuucga

SEQ ID NO: 788166 - RNA, 20 nt, Mycobacterium avium subsp. paratuberculosis
guuccaacaacuucgagcag

SEQ ID NO: 788167 - RNA, 22 nt, Mycobacterium avium subsp. paratuberculosis
guucaugugaccggggucggcg

SEQ ID NO: 788168 - RNA, 16 nt, Mycobacterium avium subsp. paratuberculosis
guucauucagcaccuu

SEQ ID NO: 788169 - RNA, 23 nt, Mycobacterium avium subsp. paratuberculosis
guucauccccagcacggugaugc

SEQ ID NO: 788170 - RNA, 16 nt, Mycobacterium avium subsp. paratuberculosis
guucauccccgcggcc

SEQ ID NO: 788171 - RNA, 16 nt, Mycobacterium avium subsp. paratuberculosis
guucaucaccuggucg

SEQ ID NO: 788172 - RNA, 15 nt, Mycobacterium avium subsp. paratuberculosis
guuccaccagcggcc

SEQ ID NO: 788173 - RNA, 22 nt, Mycobacterium avium subsp. paratuberculosis
guuccaccagcggccgucgccg

SEQ ID NO: 788174 - RNA, 15 nt, Mycobacterium avium subsp. paratuberculosis
guuccaccgggccgc

SEQ ID NO: 788175 - RNA, 17 nt, Mycobacterium avium subsp. paratuberculosis
guuccaccggucggaaa

SEQ ID NO: 788176 - RNA, 14 nt, Mycobacterium avium subsp. paratuberculosis
guuccacaccgaca

SEQ ID NO: 788177 - RNA, 17 nt, Mycobacterium avium subsp. paratuberculosis
guuccagaccggcggcg

SEQ ID NO: 788178 - RNA, 15 nt, Mycobacterium avium subsp. paratuberculosis
guuccagcacccggc

SEQ ID NO: 788179 - RNA, 14 nt, Mycobacterium avium subsp. paratuberculosis
guuccagaaccggc

SEQ ID NO: 788180 - RNA, 14 nt, Mycobacterium avium subsp. paratuberculosis
guuccagcacgccc

SEQ ID NO: 788181 - RNA, 15 nt, Mycobacterium avium subsp. paratuberculosis
guuccaggugugccg

SEQ ID NO: 788182 - RNA, 23 nt, Mycobacterium avium subsp. paratuberculosis
guuccaggugugccgcugguagg

SEQ ID NO: 788183 - RNA, 16 nt, Mycobacterium avium subsp. paratuberculosis
guuccagccggcccgc

SEQ ID NO: 788184 - RNA, 21 nt, Mycobacterium avium subsp. paratuberculosis
guucagccggagccggccucg

SEQ ID NO: 788185 - RNA, 18 nt, Mycobacterium avium subsp. paratuberculosis
guucagcagccggcagac

SEQ ID NO: 788186 - RNA, 16 nt, Mycobacterium avium subsp. paratuberculosis
guucagccugaugccg

SEQ ID NO: 788187 - RNA, 21 nt, Mycobacterium avium subsp. paratuberculosis
guucagcgacuugccgccggc

SEQ ID NO: 788188 - RNA, 22 nt, Mycobacterium avium subsp. paratuberculosis
guucagcgacuugccgccggcg

SEQ ID NO: 788189 - RNA, 16 nt, Mycobacterium avium subsp. paratuberculosis
guucagcgcggccacc

SEQ ID NO: 788190 - RNA, 14 nt, Mycobacterium avium subsp. paratuberculosis
guucaggcccgcgc

SEQ ID NO: 788191 - RNA, 23 nt, Mycobacterium avium subsp. paratuberculosis
guucaggcccgcgccgacggccg

SEQ ID NO: 788192 - RNA, 20 nt, Mycobacterium avium subsp. paratuberculosis
guucagcugaacggugcccg

SEQ ID NO: 788193 - RNA, 21 nt, Mycobacterium avium subsp. paratuberculosis
guucagcggcaccgucaccga

SEQ ID NO: 788194 - RNA, 16 nt, Mycobacterium avium subsp. paratuberculosis
guucaggucgaugguc

SEQ ID NO: 788195 - RNA, 18 nt, Mycobacterium avium subsp. paratuberculosis
guucagaagucgcccgcg

SEQ ID NO: 788196 - RNA, 19 nt, Mycobacterium avium subsp. paratuberculosis
guucagaagucgcccgcgu

SEQ ID NO: 788197 - RNA, 16 nt, Mycobacterium avium subsp. paratuberculosis
guucacccgcgcccgc

SEQ ID NO: 788198 - RNA, 18 nt, Mycobacterium avium subsp. paratuberculosis
guucacccgcgcccgcau

SEQ ID NO: 788199 - RNA, 23 nt, Mycobacterium avium subsp. paratuberculosis
guucaccgcgccgggcaccacca

SEQ ID NO: 788200 - RNA, 20 nt, Mycobacterium avium subsp. paratuberculosis
guucaccccgaucaacaccg

SEQ ID NO: 788201 - RNA, 22 nt, Mycobacterium avium subsp. paratuberculosis
guucaccccgaucaacaccgcc

SEQ ID NO: 788202 - RNA, 21 nt, Mycobacterium avium subsp. paratuberculosis
guucaccccguugagcagcgg

SEQ ID NO: 788203 - RNA, 14 nt, Mycobacterium avium subsp. paratuberculosis
guucaccagcgggg

SEQ ID NO: 788204 - RNA, 22 nt, Mycobacterium avium subsp. paratuberculosis
guucaccugacgcaucaccacg

SEQ ID NO: 788205 - RNA, 19 nt, Mycobacterium avium subsp. paratuberculosis
guucacccuggcgaaccgc

SEQ ID NO: 788206 - RNA, 22 nt, Mycobacterium avium subsp. paratuberculosis
guucacccuggcgaaccgcggc

SEQ ID NO: 788207 - RNA, 20 nt, Mycobacterium avium subsp. paratuberculosis
guuacccgaacccagcgccu

SEQ ID NO: 788208 - RNA, 23 nt, Mycobacterium avium subsp. paratuberculosis
guuaguuaaccgaagcggcccga

SEQ ID NO: 788209 - RNA, 20 nt, Mycobacterium avium subsp. paratuberculosis
guuagggcgucaggcgcugg

SEQ ID NO: 788210 - RNA, 16 nt, Mycobacterium avium subsp. paratuberculosis
guuagggcgaccacca

SEQ ID NO: 788211 - RNA, 14 nt, Mycobacterium avium subsp. paratuberculosis
guucaagccgccga

SEQ ID NO: 788212 - RNA, 21 nt, Mycobacterium avium subsp. paratuberculosis
guucacaguaggcggcugucg

SEQ ID NO: 788213 - RNA, 14 nt, Mycobacterium avium subsp. paratuberculosis
guucaccaccgcgc

SEQ ID NO: 788214 - RNA, 15 nt, Mycobacterium avium subsp. paratuberculosis
guucaccaccgcgcu

SEQ ID NO: 788215 - RNA, 20 nt, Mycobacterium avium subsp. paratuberculosis
guucaccaccggagcggcgg

SEQ ID NO: 788216 - RNA, 17 nt, Mycobacterium avium subsp. paratuberculosis
guucaacgcgccgaugc

SEQ ID NO: 788217 - RNA, 17 nt, Mycobacterium avium subsp. paratuberculosis
guucgccggccagcacg

SEQ ID NO: 788218 - RNA, 23 nt, Mycobacterium avium subsp. paratuberculosis
guucgccggcguagaccagcgac

SEQ ID NO: 788219 - RNA, 16 nt, Mycobacterium avium subsp. paratuberculosis
guucgccgguaccgcc

SEQ ID NO: 788220 - RNA, 20 nt, Mycobacterium avium subsp. paratuberculosis
guucgccgguaccgccggcc

SEQ ID NO: 788221 - RNA, 21 nt, Mycobacterium avium subsp. paratuberculosis
guucgccgguaccgccggcca

SEQ ID NO: 788222 - RNA, 13 nt, Mycobacterium avium subsp. paratuberculosis
guucgccggugac

SEQ ID NO: 788223 - RNA, 17 nt, Mycobacterium avium subsp. paratuberculosis
guucgccggugaccgcg

SEQ ID NO: 788224 - RNA, 20 nt, Mycobacterium avium subsp. paratuberculosis
guucgccggugaccgcgccg

SEQ ID NO: 788225 - RNA, 12 nt, Mycobacterium avium subsp. paratuberculosis
guucgccgucgc

SEQ ID NO: 788226 - RNA, 15 nt, Mycobacterium avium subsp. paratuberculosis
guucgccgucgcggg

SEQ ID NO: 788227 - RNA, 18 nt, Mycobacterium avium subsp. paratuberculosis
guucgcgcacgcuggccg

SEQ ID NO: 788228 - RNA, 19 nt, Mycobacterium avium subsp. paratuberculosis
guucgcgcacgcuggccgg

SEQ ID NO: 788229 - RNA, 18 nt, Mycobacterium avium subsp. paratuberculosis
guucgcgcacggcgcgca

SEQ ID NO: 788230 - RNA, 15 nt, Mycobacterium avium subsp. paratuberculosis
guucgcggcgcacgu

SEQ ID NO: 788231 - RNA, 20 nt, Mycobacterium avium subsp. paratuberculosis
guucgcggugggcucgucga

SEQ ID NO: 788232 - RNA, 18 nt, Mycobacterium avium subsp. paratuberculosis
guucgcguacccgcgcgg

SEQ ID NO: 788233 - RNA, 13 nt, Mycobacterium avium subsp. paratuberculosis
guucgcgccgaga

SEQ ID NO: 788234 - RNA, 13 nt, Mycobacterium avium subsp. paratuberculosis
guucgcgccgaug

SEQ ID NO: 788235 - RNA, 17 nt, Mycobacterium avium subsp. paratuberculosis
guucgcgccgguaggcg

SEQ ID NO: 788236 - RNA, 12 nt, Mycobacterium avium subsp. paratuberculosis
guucgcuggcgg

SEQ ID NO: 788237 - RNA, 15 nt, Mycobacterium avium subsp. paratuberculosis
guucgcuggcggcca

SEQ ID NO: 788238 - RNA, 13 nt, Mycobacterium avium subsp. paratuberculosis
guucgcugaccgc

SEQ ID NO: 788239 - RNA, 22 nt, Mycobacterium avium subsp. paratuberculosis
guucggaugaccaagccccgca

SEQ ID NO: 788240 - RNA, 13 nt, Mycobacterium avium subsp. paratuberculosis
guucggacacggc

SEQ ID NO: 788241 - RNA, 15 nt, Mycobacterium avium subsp. paratuberculosis
guucggacacggcgc

SEQ ID NO: 788242 - RNA, 21 nt, Mycobacterium avium subsp. paratuberculosis
guucggacacggcgccgugcg

SEQ ID NO: 788243 - RNA, 21 nt, Mycobacterium avium subsp. paratuberculosis
guucgcuuucgccgggcguca

SEQ ID NO: 788244 - RNA, 16 nt, Mycobacterium avium subsp. paratuberculosis
guucgcuuucgcguuc

SEQ ID NO: 788245 - RNA, 19 nt, Mycobacterium avium subsp. paratuberculosis
guucggaguccaccggcgg

SEQ ID NO: 788246 - RNA, 14 nt, Mycobacterium avium subsp. paratuberculosis
guucggccgccgug

SEQ ID NO: 788247 - RNA, 12 nt, Mycobacterium avium subsp. paratuberculosis
guucggcgagug

SEQ ID NO: 788248 - RNA, 13 nt, Mycobacterium avium subsp. paratuberculosis
guucggcgaguga

SEQ ID NO: 788249 - RNA, 16 nt, Mycobacterium avium subsp. paratuberculosis
guucggccagcgccgc

SEQ ID NO: 788250 - RNA, 23 nt, Mycobacterium avium subsp. paratuberculosis
guucggccagcgccgccagccgc

SEQ ID NO: 788251 - RNA, 18 nt, Mycobacterium avium subsp. paratuberculosis
guucggccagcgcggugu

SEQ ID NO: 788252 - RNA, 17 nt, Mycobacterium avium subsp. paratuberculosis
guucggcaucucggccg

SEQ ID NO: 788253 - RNA, 17 nt, Mycobacterium avium subsp. paratuberculosis
guucuucgaugacggcc

SEQ ID NO: 788254 - RNA, 21 nt, Mycobacterium avium subsp. paratuberculosis
guugaccacccgcagcgaggc

SEQ ID NO: 788255 - RNA, 13 nt, Mycobacterium avium subsp. paratuberculosis
guucuugcccgaa

SEQ ID NO: 788256 - RNA, 17 nt, Mycobacterium avium subsp. paratuberculosis
guucuggccguggucgg

SEQ ID NO: 788257 - RNA, 13 nt, Mycobacterium avium subsp. paratuberculosis
guucggugcacgg

SEQ ID NO: 788258 - RNA, 16 nt, Mycobacterium avium subsp. paratuberculosis
guucggugcgggucac

SEQ ID NO: 788259 - RNA, 12 nt, Mycobacterium avium subsp. paratuberculosis
guucgguggcca

SEQ ID NO: 788260 - RNA, 14 nt, Mycobacterium avium subsp. paratuberculosis
guucgguggggccg

SEQ ID NO: 788261 - RNA, 13 nt, Mycobacterium avium subsp. paratuberculosis
guucggcgacgcu

SEQ ID NO: 788262 - RNA, 17 nt, Mycobacterium avium subsp. paratuberculosis
guucggcgccagccgca

SEQ ID NO: 788263 - RNA, 13 nt, Mycobacterium avium subsp. paratuberculosis
guucggcgggccu

SEQ ID NO: 788264 - RNA, 23 nt, Mycobacterium avium subsp. paratuberculosis
guucggcguucgauugccggacg

SEQ ID NO: 788265 - RNA, 14 nt, Mycobacterium avium subsp. paratuberculosis
guucggcgucgaaa

SEQ ID NO: 788266 - RNA, 15 nt, Mycobacterium avium subsp. paratuberculosis
guucggucagcacga

SEQ ID NO: 788267 - RNA, 18 nt, Mycobacterium avium subsp. paratuberculosis
guucggugaacugcagcc

SEQ ID NO: 788268 - RNA, 20 nt, Mycobacterium avium subsp. paratuberculosis
guucggguagacgaucaccg

SEQ ID NO: 788269 - RNA, 14 nt, Mycobacterium avium subsp. paratuberculosis
guucgggucggugg

SEQ ID NO: 788270 - RNA, 16 nt, Mycobacterium avium subsp. paratuberculosis
guucgggucgguggcg

SEQ ID NO: 788271 - RNA, 19 nt, Mycobacterium avium subsp. paratuberculosis
guucgggauccucgccgcg

SEQ ID NO: 788272 - RNA, 22 nt, Mycobacterium avium subsp. paratuberculosis
guucgggauccucgccgcgggc

SEQ ID NO: 788273 - RNA, 19 nt, Mycobacterium avium subsp. paratuberculosis
guucgggaucggcgcccac

SEQ ID NO: 788274 - RNA, 19 nt, Mycobacterium avium subsp. paratuberculosis
guucgggaucgucgccggg

SEQ ID NO: 788275 - RNA, 20 nt, Mycobacterium avium subsp. paratuberculosis
guucgggcagauggucgccg

SEQ ID NO: 788276 - RNA, 21 nt, Mycobacterium avium subsp. paratuberculosis
guucgggcagauggucgccga

SEQ ID NO: 788277 - RNA, 21 nt, Mycobacterium avium subsp. paratuberculosis
guucgggcagcgccucgagca

SEQ ID NO: 788278 - RNA, 14 nt, Mycobacterium avium subsp. paratuberculosis
guuccuugcgcagc

SEQ ID NO: 788279 - RNA, 23 nt, Mycobacterium avium subsp. paratuberculosis
guuccuugcgcagcaccuugccg

SEQ ID NO: 788280 - RNA, 17 nt, Mycobacterium avium subsp. paratuberculosis
guuccugcaugccgggc

SEQ ID NO: 788281 - RNA, 17 nt, Mycobacterium avium subsp. paratuberculosis
guuccuugauccggccg

SEQ ID NO: 788282 - RNA, 13 nt, Mycobacterium avium subsp. paratuberculosis
guucgaagcgcag

SEQ ID NO: 788283 - RNA, 15 nt, Mycobacterium avium subsp. paratuberculosis
guucgaagcgcagcg

SEQ ID NO: 788284 - RNA, 13 nt, Mycobacterium avium subsp. paratuberculosis
guucgaccggcac

SEQ ID NO: 788285 - RNA, 17 nt, Mycobacterium avium subsp. paratuberculosis
guucgaccggcaccagc

SEQ ID NO: 788286 - RNA, 16 nt, Mycobacterium avium subsp. paratuberculosis
guucgaccuccacccg

SEQ ID NO: 788287 - RNA, 21 nt, Mycobacterium avium subsp. paratuberculosis
guucgaccuccacgagccggu

SEQ ID NO: 788288 - RNA, 17 nt, Mycobacterium avium subsp. paratuberculosis
guucgauaccguccgcg

SEQ ID NO: 788289 - RNA, 17 nt, Mycobacterium avium subsp. paratuberculosis
guucgaggugcucgcgc

SEQ ID NO: 788290 - RNA, 17 nt, Mycobacterium avium subsp. paratuberculosis
guucgaguucgucgacc

SEQ ID NO: 788291 - RNA, 17 nt, Mycobacterium avium subsp. paratuberculosis
guucgagcgccgcggcc

SEQ ID NO: 788292 - RNA, 15 nt, Mycobacterium avium subsp. paratuberculosis
guucgagcgccggac

SEQ ID NO: 788293 - RNA, 19 nt, Mycobacterium avium subsp. paratuberculosis
guucgagggcgcggcguag

SEQ ID NO: 788294 - RNA, 24 nt, Mycobacterium avium subsp. paratuberculosis
guucgagggcgcggcguagccgcc

SEQ ID NO: 788295 - RNA, 15 nt, Mycobacterium avium subsp. paratuberculosis
guucgaccucgguga

SEQ ID NO: 788296 - RNA, 15 nt, Mycobacterium avium subsp. paratuberculosis
guucgaugcccugcc

SEQ ID NO: 788297 - RNA, 15 nt, Mycobacterium avium subsp. paratuberculosis
guucgaugccgauga

SEQ ID NO: 788298 - RNA, 13 nt, Mycobacterium avium subsp. paratuberculosis
guucgaugcgcuc

SEQ ID NO: 788299 - RNA, 18 nt, Mycobacterium avium subsp. paratuberculosis
guucgaugcgcucggcga

SEQ ID NO: 788300 - RNA, 17 nt, Mycobacterium avium subsp. paratuberculosis
guucgauaucgcccagg

SEQ ID NO: 788301 - RNA, 13 nt, Mycobacterium avium subsp. paratuberculosis
guucgaucaccga

SEQ ID NO: 788302 - RNA, 21 nt, Mycobacterium avium subsp. paratuberculosis
guucgaucagcagcucggugg

SEQ ID NO: 788303 - RNA, 16 nt, Mycobacterium avium subsp. paratuberculosis
guucgauccgccggug

SEQ ID NO: 788304 - RNA, 19 nt, Mycobacterium avium subsp. paratuberculosis
guucgaucuccucggcgua

SEQ ID NO: 788305 - RNA, 15 nt, Mycobacterium avium subsp. paratuberculosis
guucgaugacgucgc

SEQ ID NO: 788306 - RNA, 20 nt, Mycobacterium avium subsp. paratuberculosis
guucgaugucggccagcgcg

SEQ ID NO: 788307 - RNA, 17 nt, Mycobacterium avium subsp. paratuberculosis
guucgccgccagcacgu

SEQ ID NO: 788308 - RNA, 12 nt, Mycobacterium avium subsp. paratuberculosis
guucgccggcga

SEQ ID NO: 788309 - RNA, 13 nt, Mycobacterium avium subsp. paratuberculosis
guucgccggcgac

SEQ ID NO: 788310 - RNA, 17 nt, Mycobacterium avium subsp. paratuberculosis
guucgccggcgacggcc

SEQ ID NO: 788311 - RNA, 23 nt, Mycobacterium avium subsp. paratuberculosis
guucgccggcgacggccagcgcg

SEQ ID NO: 788312 - RNA, 20 nt, Mycobacterium avium subsp. paratuberculosis
guucgcccuccccggccagc

SEQ ID NO: 788313 - RNA, 23 nt, Mycobacterium avium subsp. paratuberculosis
guucgcccuccccggccagcacg

SEQ ID NO: 788314 - RNA, 15 nt, Mycobacterium avium subsp. paratuberculosis
guucgcccuggccgc

SEQ ID NO: 788315 - RNA, 17 nt, Mycobacterium avium subsp. paratuberculosis
guuccaucagcgcccgc

SEQ ID NO: 788316 - RNA, 14 nt, Mycobacterium avium subsp. paratuberculosis
guuccccggccgac

SEQ ID NO: 788317 - RNA, 18 nt, Mycobacterium avium subsp. paratuberculosis
guucccgacagcucgcgc

SEQ ID NO: 788318 - RNA, 21 nt, Mycobacterium avium subsp. paratuberculosis
guucccuucauuagccggacu

SEQ ID NO: 788319 - RNA, 12 nt, Mycobacterium avium subsp. paratuberculosis
guucccggccgg

SEQ ID NO: 788320 - RNA, 16 nt, Mycobacterium avium subsp. paratuberculosis
guucccggccgguggc

SEQ ID NO: 788321 - RNA, 18 nt, Mycobacterium avium subsp. paratuberculosis
guucccggccgguggccg

SEQ ID NO: 788322 - RNA, 14 nt, Mycobacterium avium subsp. paratuberculosis
guuccugcgaccgc

SEQ ID NO: 788323 - RNA, 14 nt, Mycobacterium avium subsp. paratuberculosis
guuccucgacggcg

SEQ ID NO: 788324 - RNA, 18 nt, Mycobacterium avium subsp. paratuberculosis
guuccggcggccggcggc

SEQ ID NO: 788325 - RNA, 16 nt, Mycobacterium avium subsp. paratuberculosis
guuccggcgguccugc

SEQ ID NO: 788326 - RNA, 13 nt, Mycobacterium avium subsp. paratuberculosis
guuccgguggcgc

SEQ ID NO: 788327 - RNA, 14 nt, Mycobacterium avium subsp. paratuberculosis
guuccggugucgag

SEQ ID NO: 788328 - RNA, 19 nt, Mycobacterium avium subsp. paratuberculosis
guuccggugucgagccggu

SEQ ID NO: 788329 - RNA, 18 nt, Mycobacterium avium subsp. paratuberculosis
guuccgucgaacagcggg

SEQ ID NO: 788330 - RNA, 21 nt, Mycobacterium avium subsp. paratuberculosis
guuccgcgacaucggugaccg

SEQ ID NO: 788331 - RNA, 13 nt, Mycobacterium avium subsp. paratuberculosis
guuguuuuuggcc

SEQ ID NO: 788332 - RNA, 18 nt, Mycobacterium avium subsp. paratuberculosis
guuguuuccccagcccgg

SEQ ID NO: 788333 - RNA, 16 nt, Mycobacterium avium subsp. paratuberculosis
guuguggcggccagcg

SEQ ID NO: 788334 - RNA, 21 nt, Mycobacterium avium subsp. paratuberculosis
guugucucggcgccgucgccg

SEQ ID NO: 788335 - RNA, 16 nt, Mycobacterium avium subsp. paratuberculosis
guugugcauguggccg

SEQ ID NO: 788336 - RNA, 23 nt, Mycobacterium avium subsp. paratuberculosis
guugugcauguggccgucgccga

SEQ ID NO: 788337 - RNA, 19 nt, Mycobacterium avium subsp. paratuberculosis
guugugccaccgccgaugg

SEQ ID NO: 788338 - RNA, 19 nt, Mycobacterium avium subsp. paratuberculosis
guuggucaccaggucgcgg

SEQ ID NO: 788339 - RNA, 21 nt, Mycobacterium avium subsp. paratuberculosis
guuggucaccaucagcggcuc

SEQ ID NO: 788340 - RNA, 16 nt, Mycobacterium avium subsp. paratuberculosis
guugguaagcgacgag

SEQ ID NO: 788341 - RNA, 21 nt, Mycobacterium avium subsp. paratuberculosis
guugggccggcgcccgucacg

SEQ ID NO: 788342 - RNA, 16 nt, Mycobacterium avium subsp. paratuberculosis
guugggcgccugcggu

SEQ ID NO: 788343 - RNA, 21 nt, Mycobacterium avium subsp. paratuberculosis
guugggcgggaucgcggcggu

SEQ ID NO: 788344 - RNA, 14 nt, Mycobacterium avium subsp. paratuberculosis
guuggggaugucga

SEQ ID NO: 788345 - RNA, 22 nt, Mycobacterium avium subsp. paratuberculosis
guuggggccgauguucaccccg

SEQ ID NO: 788346 - RNA, 21 nt, Mycobacterium avium subsp. paratuberculosis
guugggucgcguccgcgaucg

SEQ ID NO: 788347 - RNA, 23 nt, Mycobacterium avium subsp. paratuberculosis
guugucggucaggcacucgauca

SEQ ID NO: 788348 - RNA, 23 nt, Mycobacterium avium subsp. paratuberculosis
guugucggcguccuugcccgagg

SEQ ID NO: 788349 - RNA, 16 nt, Mycobacterium avium subsp. paratuberculosis
guuggucggcgcggcg

SEQ ID NO: 788350 - RNA, 21 nt, Mycobacterium avium subsp. paratuberculosis
guuggucggcgcggcgacgug

SEQ ID NO: 788351 - RNA, 19 nt, Mycobacterium avium subsp. paratuberculosis
guuggucggagccgucggu

SEQ ID NO: 788352 - RNA, 16 nt, Mycobacterium avium subsp. paratuberculosis
guuggucuguggucgg

SEQ ID NO: 788353 - RNA, 23 nt, Mycobacterium avium subsp. paratuberculosis
guugucguggguggugaccaggc

SEQ ID NO: 788354 - RNA, 16 nt, Mycobacterium avium subsp. paratuberculosis
guugucggcgacggcg

SEQ ID NO: 788355 - RNA, 20 nt, Mycobacterium avium subsp. paratuberculosis
guugucgucgccggccgcgg

SEQ ID NO: 788356 - RNA, 13 nt, Mycobacterium avium subsp. paratuberculosis
guugugcaccggc

SEQ ID NO: 788357 - RNA, 15 nt, Mycobacterium avium subsp. paratuberculosis
guugcucggcggccc

SEQ ID NO: 788358 - RNA, 16 nt, Mycobacterium avium subsp. paratuberculosis
guugcucggggcucgc

SEQ ID NO: 788359 - RNA, 14 nt, Mycobacterium avium subsp. paratuberculosis
guuggccgccgccu

SEQ ID NO: 788360 - RNA, 17 nt, Mycobacterium avium subsp. paratuberculosis
guuggccgcgacgccgc

SEQ ID NO: 788361 - RNA, 15 nt, Mycobacterium avium subsp. paratuberculosis
guuggccggcccgcc

SEQ ID NO: 788362 - RNA, 14 nt, Mycobacterium avium subsp. paratuberculosis
guuggccgucgcug

SEQ ID NO: 788363 - RNA, 17 nt, Mycobacterium avium subsp. paratuberculosis
guuggccuccucgguga

SEQ ID NO: 788364 - RNA, 16 nt, Mycobacterium avium subsp. paratuberculosis
guuggccugcgcgacc

SEQ ID NO: 788365 - RNA, 18 nt, Mycobacterium avium subsp. paratuberculosis
guuggcgaagucaucgag

SEQ ID NO: 788366 - RNA, 16 nt, Mycobacterium avium subsp. paratuberculosis
guuggcgacgacggcg

SEQ ID NO: 788367 - RNA, 18 nt, Mycobacterium avium subsp. paratuberculosis
guuggcgacgacggcgga

SEQ ID NO: 788368 - RNA, 23 nt, Mycobacterium avium subsp. paratuberculosis
guuggcgacggugcaugcgcugg

SEQ ID NO: 788369 - RNA, 18 nt, Mycobacterium avium subsp. paratuberculosis
guuggcgaucagggcggc

SEQ ID NO: 788370 - RNA, 17 nt, Mycobacterium avium subsp. paratuberculosis
guuggcgcucaacguga

SEQ ID NO: 788371 - RNA, 19 nt, Mycobacterium avium subsp. paratuberculosis
guuggcgcucaacgugaua

SEQ ID NO: 788372 - RNA, 22 nt, Mycobacterium avium subsp. paratuberculosis
guuggcggacucguuggggcca

SEQ ID NO: 788373 - RNA, 18 nt, Mycobacterium avium subsp. paratuberculosis
guuggcgccgggcccggu

SEQ ID NO: 788374 - RNA, 13 nt, Mycobacterium avium subsp. paratuberculosis
guuggcgccgguc

SEQ ID NO: 788375 - RNA, 16 nt, Mycobacterium avium subsp. paratuberculosis
guuggcgccggucgac

SEQ ID NO: 788376 - RNA, 13 nt, Mycobacterium avium subsp. paratuberculosis
guuggcgccggug

SEQ ID NO: 788377 - RNA, 14 nt, Mycobacterium avium subsp. paratuberculosis
guuggcgccgguga

SEQ ID NO: 788378 - RNA, 21 nt, Mycobacterium avium subsp. paratuberculosis
guuggcgccguccgcggcggc

SEQ ID NO: 788379 - RNA, 23 nt, Mycobacterium avium subsp. paratuberculosis
guuggcgccguccgcggcggcca

SEQ ID NO: 788380 - RNA, 14 nt, Mycobacterium avium subsp. paratuberculosis
guuggcggccgggu

SEQ ID NO: 788381 - RNA, 12 nt, Mycobacterium avium subsp. paratuberculosis
guuggcggcggc

SEQ ID NO: 788382 - RNA, 16 nt, Mycobacterium avium subsp. paratuberculosis
guuggcggcggcccgc

SEQ ID NO: 788383 - RNA, 16 nt, Mycobacterium avium subsp. paratuberculosis
guuggcggccagcgcg

SEQ ID NO: 788384 - RNA, 17 nt, Mycobacterium avium subsp. paratuberculosis
guuggcggccagcgcgc

SEQ ID NO: 788385 - RNA, 20 nt, Mycobacterium avium subsp. paratuberculosis
guuggcggccagcgcgccgc

SEQ ID NO: 788386 - RNA, 22 nt, Mycobacterium avium subsp. paratuberculosis
guuggcggccagcgcgccgccg

SEQ ID NO: 788387 - RNA, 20 nt, Mycobacterium avium subsp. paratuberculosis
guuggcguagugggucggcg

SEQ ID NO: 788388 - RNA, 17 nt, Mycobacterium avium subsp. paratuberculosis
guuggcggcgucgucgc

SEQ ID NO: 788389 - RNA, 12 nt, Mycobacterium avium subsp. paratuberculosis
guuggcgguggu

SEQ ID NO: 788390 - RNA, 20 nt, Mycobacterium avium subsp. paratuberculosis
guuggcgucgucggcggcga

SEQ ID NO: 788391 - RNA, 17 nt, Mycobacterium avium subsp. paratuberculosis
guuggcguggauggccg

SEQ ID NO: 788392 - RNA, 21 nt, Mycobacterium avium subsp. paratuberculosis
guuggcuuuucgggccggccc

SEQ ID NO: 788393 - RNA, 14 nt, Mycobacterium avium subsp. paratuberculosis
guugggcagcucgg

SEQ ID NO: 788394 - RNA, 15 nt, Mycobacterium avium subsp. paratuberculosis
guugaugucgcgcgg

SEQ ID NO: 788395 - RNA, 16 nt, Mycobacterium avium subsp. paratuberculosis
guugaugucgcgcggc

SEQ ID NO: 788396 - RNA, 23 nt, Mycobacterium avium subsp. paratuberculosis
guugaugccgucgaucaccugcg

SEQ ID NO: 788397 - RNA, 22 nt, Mycobacterium avium subsp. paratuberculosis
guugaugccgugcgcgcuggug

SEQ ID NO: 788398 - RNA, 16 nt, Mycobacterium avium subsp. paratuberculosis
guugaugcgcaccgcg

SEQ ID NO: 788399 - RNA, 16 nt, Mycobacterium avium subsp. paratuberculosis
guugaugccgcccagc

SEQ ID NO: 788400 - RNA, 12 nt, Mycobacterium avium subsp. paratuberculosis
guugcccgccgc

SEQ ID NO: 788401 - RNA, 13 nt, Mycobacterium avium subsp. paratuberculosis
guugcccgccgcg

SEQ ID NO: 788402 - RNA, 19 nt, Mycobacterium avium subsp. paratuberculosis
guugcccgguuccgcgaca

SEQ ID NO: 788403 - RNA, 22 nt, Mycobacterium avium subsp. paratuberculosis
guugcccgucgccuccgagaug

SEQ ID NO: 788404 - RNA, 14 nt, Mycobacterium avium subsp. paratuberculosis
guugcccugccugc

SEQ ID NO: 788405 - RNA, 14 nt, Mycobacterium avium subsp. paratuberculosis
guugccccaccccg

SEQ ID NO: 788406 - RNA, 20 nt, Mycobacterium avium subsp. paratuberculosis
guugccccaccccggacggc

SEQ ID NO: 788407 - RNA, 22 nt, Mycobacterium avium subsp. paratuberculosis
guugaccaggugggcggccacc

SEQ ID NO: 788408 - RNA, 14 nt, Mycobacterium avium subsp. paratuberculosis
guugaccgacgccu

SEQ ID NO: 788409 - RNA, 18 nt, Mycobacterium avium subsp. paratuberculosis
guugaccguugcgcccca

SEQ ID NO: 788410 - RNA, 20 nt, Mycobacterium avium subsp. paratuberculosis
guugaccguugcgccccaga

SEQ ID NO: 788411 - RNA, 14 nt, Mycobacterium avium subsp. paratuberculosis
guugaccggccggu

SEQ ID NO: 788412 - RNA, 20 nt, Mycobacterium avium subsp. paratuberculosis
guugaccgggccgcugguga

SEQ ID NO: 788413 - RNA, 16 nt, Mycobacterium avium subsp. paratuberculosis
guugaccgggucgccg

SEQ ID NO: 788414 - RNA, 22 nt, Mycobacterium avium subsp. paratuberculosis
guugaccgaggcgaucgcggcc

SEQ ID NO: 788415 - RNA, 23 nt, Mycobacterium avium subsp. paratuberculosis
guugaccgaggcgaucgcggcca

SEQ ID NO: 788416 - RNA, 22 nt, Mycobacterium avium subsp. paratuberculosis
guugaccgccgacaccaccgcg

SEQ ID NO: 788417 - RNA, 14 nt, Mycobacterium avium subsp. paratuberculosis
guugaccgcggcga

SEQ ID NO: 788418 - RNA, 17 nt, Mycobacterium avium subsp. paratuberculosis
guugaccccggccccgg

SEQ ID NO: 788419 - RNA, 18 nt, Mycobacterium avium subsp. paratuberculosis
guugaccccggccccggc

SEQ ID NO: 788420 - RNA, 17 nt, Mycobacterium avium subsp. paratuberculosis
guugacccggccggucg

SEQ ID NO: 788421 - RNA, 23 nt, Mycobacterium avium subsp. paratuberculosis
guugauccgaugcagggccgaaa

SEQ ID NO: 788422 - RNA, 17 nt, Mycobacterium avium subsp. paratuberculosis
guugaucagcccgaccc

SEQ ID NO: 788423 - RNA, 13 nt, Mycobacterium avium subsp. paratuberculosis
guugaucagcgcc

SEQ ID NO: 788424 - RNA, 19 nt, Mycobacterium avium subsp. paratuberculosis
guugaucaugucgaugccg

SEQ ID NO: 788425 - RNA, 17 nt, Mycobacterium avium subsp. paratuberculosis
guugaccuugaccagcu

SEQ ID NO: 788426 - RNA, 22 nt, Mycobacterium avium subsp. paratuberculosis
guugaccuugucgaaggugauc

SEQ ID NO: 788427 - RNA, 17 nt, Mycobacterium avium subsp. paratuberculosis
guugaucgagcaccggg

SEQ ID NO: 788428 - RNA, 20 nt, Mycobacterium avium subsp. paratuberculosis
guugaucuugaccgucgcgg

SEQ ID NO: 788429 - RNA, 22 nt, Mycobacterium avium subsp. paratuberculosis
guugaucuugaccgucgcggag

SEQ ID NO: 788430 - RNA, 14 nt, Mycobacterium avium subsp. paratuberculosis
guugcgucccgcgc

SEQ ID NO: 788431 - RNA, 16 nt, Mycobacterium avium subsp. paratuberculosis
guugcgugcagccgca

SEQ ID NO: 788432 - RNA, 17 nt, Mycobacterium avium subsp. paratuberculosis
guugcgguggccgauca

SEQ ID NO: 788433 - RNA, 14 nt, Mycobacterium avium subsp. paratuberculosis
guugcgggcggcgc

SEQ ID NO: 788434 - RNA, 19 nt, Mycobacterium avium subsp. paratuberculosis
guugcggguggcggccggg

SEQ ID NO: 788435 - RNA, 18 nt, Mycobacterium avium subsp. paratuberculosis
guugccuuuccgcgcggc

SEQ ID NO: 788436 - RNA, 21 nt, Mycobacterium avium subsp. paratuberculosis
guugcgagucaucgccacccg

SEQ ID NO: 788437 - RNA, 15 nt, Mycobacterium avium subsp. paratuberculosis
guugcgcacccgcgg

SEQ ID NO: 788438 - RNA, 16 nt, Mycobacterium avium subsp. paratuberculosis
guugcgcagccgggcg

SEQ ID NO: 788439 - RNA, 20 nt, Mycobacterium avium subsp. paratuberculosis
guugcgccagcaccgacagc

SEQ ID NO: 788440 - RNA, 23 nt, Mycobacterium avium subsp. paratuberculosis
guugcgcaucagcgccaccagca

SEQ ID NO: 788441 - RNA, 11 nt, Mycobacterium avium subsp. paratuberculosis
guugcgcccgg

SEQ ID NO: 788442 - RNA, 13 nt, Mycobacterium avium subsp. paratuberculosis
guugccgacggcg

SEQ ID NO: 788443 - RNA, 18 nt, Mycobacterium avium subsp. paratuberculosis
guugccgacggcgccggu

SEQ ID NO: 788444 - RNA, 17 nt, Mycobacterium avium subsp. paratuberculosis
guugccgaguaccgacg

SEQ ID NO: 788445 - RNA, 15 nt, Mycobacterium avium subsp. paratuberculosis
guugccgcacaccgc

SEQ ID NO: 788446 - RNA, 16 nt, Mycobacterium avium subsp. paratuberculosis
guugccgcacaccgcg

SEQ ID NO: 788447 - RNA, 17 nt, Mycobacterium avium subsp. paratuberculosis
guugccgcacaccgcgc

SEQ ID NO: 788448 - RNA, 18 nt, Mycobacterium avium subsp. paratuberculosis
guugccgcacaccgcgca

SEQ ID NO: 788449 - RNA, 19 nt, Mycobacterium avium subsp. paratuberculosis
guugccgcacaccgcgcag

SEQ ID NO: 788450 - RNA, 23 nt, Mycobacterium avium subsp. paratuberculosis
guugcgaaagcccaggcccggca

SEQ ID NO: 788451 - RNA, 12 nt, Mycobacterium avium subsp. paratuberculosis
guugcgaccccg

SEQ ID NO: 788452 - RNA, 19 nt, Mycobacterium avium subsp. paratuberculosis
guugcgaccccgccgucga

SEQ ID NO: 788453 - RNA, 16 nt, Mycobacterium avium subsp. paratuberculosis
guugccgcgcgcccgc

SEQ ID NO: 788454 - RNA, 19 nt, Mycobacterium avium subsp. paratuberculosis
guugccgcgcgcccgcggc

SEQ ID NO: 788455 - RNA, 21 nt, Mycobacterium avium subsp. paratuberculosis
guugccgcccucggccguacc

SEQ ID NO: 788456 - RNA, 14 nt, Mycobacterium avium subsp. paratuberculosis
guugccgccggcgc

SEQ ID NO: 788457 - RNA, 20 nt, Mycobacterium avium subsp. paratuberculosis
gucgcguugaaagccgcgaa

SEQ ID NO: 788458 - RNA, 13 nt, Mycobacterium avium subsp. paratuberculosis
gucgcggucggcg

SEQ ID NO: 788459 - RNA, 14 nt, Mycobacterium avium subsp. paratuberculosis
gucgcggucggcgc

SEQ ID NO: 788460 - RNA, 20 nt, Mycobacterium avium subsp. paratuberculosis
gucgcgguagcgcucgucgu

SEQ ID NO: 788461 - RNA, 14 nt, Mycobacterium avium subsp. paratuberculosis
gucgcgguccacgc

SEQ ID NO: 788462 - RNA, 16 nt, Mycobacterium avium subsp. paratuberculosis
gucgcgguccacgccg

SEQ ID NO: 788463 - RNA, 20 nt, Mycobacterium avium subsp. paratuberculosis
gucgcgguccacgccggcga

SEQ ID NO: 788464 - RNA, 21 nt, Mycobacterium avium subsp. paratuberculosis
gucgcgguccacgccggcgau

SEQ ID NO: 788465 - RNA, 23 nt, Mycobacterium avium subsp. paratuberculosis
gucgcggugaaguugccgccgcc

SEQ ID NO: 788466 - RNA, 15 nt, Mycobacterium avium subsp. paratuberculosis
gucgcggugcccagc

SEQ ID NO: 788467 - RNA, 16 nt, Mycobacterium avium subsp. paratuberculosis
gucgcggugcccagcc

SEQ ID NO: 788468 - RNA, 17 nt, Mycobacterium avium subsp. paratuberculosis
gucgcggugcccagccg

SEQ ID NO: 788469 - RNA, 20 nt, Mycobacterium avium subsp. paratuberculosis
gucgcgguggagcacagcac

SEQ ID NO: 788470 - RNA, 17 nt, Mycobacterium avium subsp. paratuberculosis
gucgcuaccucaccacg

SEQ ID NO: 788471 - RNA, 18 nt, Mycobacterium avium subsp. paratuberculosis
gucgcuaccucaccacgu

SEQ ID NO: 788472 - RNA, 18 nt, Mycobacterium avium subsp. paratuberculosis
gucgcucaaaggcgggca

SEQ ID NO: 788473 - RNA, 18 nt, Mycobacterium avium subsp. paratuberculosis
gucgcucagaggcgggca

SEQ ID NO: 788474 - RNA, 20 nt, Mycobacterium avium subsp. paratuberculosis
gucgcucagaggcgggcacu

SEQ ID NO: 788475 - RNA, 14 nt, Mycobacterium avium subsp. paratuberculosis
gucgcucggcggcg

SEQ ID NO: 788476 - RNA, 18 nt, Mycobacterium avium subsp. paratuberculosis
gucgcucaucccgauguc

SEQ ID NO: 788477 - RNA, 20 nt, Mycobacterium avium subsp. paratuberculosis
gucgcuccacaucugccggc

SEQ ID NO: 788478 - RNA, 23 nt, Mycobacterium avium subsp. paratuberculosis
gucgcuccacaucugccggcaga

SEQ ID NO: 788479 - RNA, 18 nt, Mycobacterium avium subsp. paratuberculosis
gucggacgcggccgagcc

SEQ ID NO: 788480 - RNA, 14 nt, Mycobacterium avium subsp. paratuberculosis
gucggacgcgggga

SEQ ID NO: 788481 - RNA, 21 nt, Mycobacterium avium subsp. paratuberculosis
gucggacuucugguugacgcc

SEQ ID NO: 788482 - RNA, 23 nt, Mycobacterium avium subsp. paratuberculosis
gucggacuucugguugacgccga

SEQ ID NO: 788483 - RNA, 15 nt, Mycobacterium avium subsp. paratuberculosis
gucggagacccgccc

SEQ ID NO: 788484 - RNA, 16 nt, Mycobacterium avium subsp. paratuberculosis
gucggagacccgcccg

SEQ ID NO: 788485 - RNA, 19 nt, Mycobacterium avium subsp. paratuberculosis
gucggagacccgcccggag

SEQ ID NO: 788486 - RNA, 13 nt, Mycobacterium avium subsp. paratuberculosis
gucgcuggcgcgc

SEQ ID NO: 788487 - RNA, 14 nt, Mycobacterium avium subsp. paratuberculosis
gucgcuggcgcgcu

SEQ ID NO: 788488 - RNA, 17 nt, Mycobacterium avium subsp. paratuberculosis
gucgcuggcgcgcuugg

SEQ ID NO: 788489 - RNA, 13 nt, Mycobacterium avium subsp. paratuberculosis
gucgcuggccgcg

SEQ ID NO: 788490 - RNA, 14 nt, Mycobacterium avium subsp. paratuberculosis
gucgcuggccgcga

SEQ ID NO: 788491 - RNA, 12 nt, Mycobacterium avium subsp. paratuberculosis
gucgcugggugu

SEQ ID NO: 788492 - RNA, 13 nt, Mycobacterium avium subsp. paratuberculosis
gucgcugggugua

SEQ ID NO: 788493 - RNA, 22 nt, Mycobacterium avium subsp. paratuberculosis
gucgcugcucaugagcccucca

SEQ ID NO: 788494 - RNA, 14 nt, Mycobacterium avium subsp. paratuberculosis
gucgcuggccaggu

SEQ ID NO: 788495 - RNA, 21 nt, Mycobacterium avium subsp. paratuberculosis
gucgcugcgcucgccgucggc

SEQ ID NO: 788496 - RNA, 22 nt, Mycobacterium avium subsp. paratuberculosis
gucgcugcgcucgccgucggcc

SEQ ID NO: 788497 - RNA, 23 nt, Mycobacterium avium subsp. paratuberculosis
gucgcugcgcucgccgucggcca

SEQ ID NO: 788498 - RNA, 18 nt, Mycobacterium avium subsp. paratuberculosis
gucgcugccguagcgcug

SEQ ID NO: 788499 - RNA, 12 nt, Mycobacterium avium subsp. paratuberculosis
gucgcugcgagg

SEQ ID NO: 788500 - RNA, 20 nt, Mycobacterium avium subsp. paratuberculosis
gucgcugcgaggcgggcaca

SEQ ID NO: 788501 - RNA, 16 nt, Mycobacterium avium subsp. paratuberculosis
gucgcugccgccgccg

SEQ ID NO: 788502 - RNA, 13 nt, Mycobacterium avium subsp. paratuberculosis
gucgcgcagcacc

SEQ ID NO: 788503 - RNA, 14 nt, Mycobacterium avium subsp. paratuberculosis
gucgcgcagcaccu

SEQ ID NO: 788504 - RNA, 21 nt, Mycobacterium avium subsp. paratuberculosis
gucgcgcaaacugacaggcgg

SEQ ID NO: 788505 - RNA, 15 nt, Mycobacterium avium subsp. paratuberculosis
gucgcgcagcagcgg

SEQ ID NO: 788506 - RNA, 15 nt, Mycobacterium avium subsp. paratuberculosis
gucgcgcaccgcggc

SEQ ID NO: 788507 - RNA, 13 nt, Mycobacterium avium subsp. paratuberculosis
gucgcgcaccgca

SEQ ID NO: 788508 - RNA, 17 nt, Mycobacterium avium subsp. paratuberculosis
gucgcgcaccaccucga

SEQ ID NO: 788509 - RNA, 17 nt, Mycobacterium avium subsp. paratuberculosis
gucgcgcaccagcucga

SEQ ID NO: 788510 - RNA, 19 nt, Mycobacterium avium subsp. paratuberculosis
gucgcgcaccagcucgagg

SEQ ID NO: 788511 - RNA, 21 nt, Mycobacterium avium subsp. paratuberculosis
gucgcgccgaccuggucgccg

SEQ ID NO: 788512 - RNA, 15 nt, Mycobacterium avium subsp. paratuberculosis
gucgcgccgaggugg

SEQ ID NO: 788513 - RNA, 18 nt, Mycobacterium avium subsp. paratuberculosis
gucgcgccgagguggccg

SEQ ID NO: 788514 - RNA, 20 nt, Mycobacterium avium subsp. paratuberculosis
gucgcgccgagguggccgcc

SEQ ID NO: 788515 - RNA, 12 nt, Mycobacterium avium subsp. paratuberculosis
gucgcgccgcca

SEQ ID NO: 788516 - RNA, 13 nt, Mycobacterium avium subsp. paratuberculosis
gucgcgccgccac

SEQ ID NO: 788517 - RNA, 14 nt, Mycobacterium avium subsp. paratuberculosis
gucgcgccgccacc

SEQ ID NO: 788518 - RNA, 15 nt, Mycobacterium avium subsp. paratuberculosis
gucgcgccgccaccc

SEQ ID NO: 788519 - RNA, 18 nt, Mycobacterium avium subsp. paratuberculosis
gucgcgccgccaccccag

SEQ ID NO: 788520 - RNA, 22 nt, Mycobacterium avium subsp. paratuberculosis
gucgcgccgccagcaaccccgc

SEQ ID NO: 788521 - RNA, 21 nt, Mycobacterium avium subsp. paratuberculosis
gucgcgccgccgcgucgugcc

SEQ ID NO: 788522 - RNA, 15 nt, Mycobacterium avium subsp. paratuberculosis
gucgcgccgcggcgc

SEQ ID NO: 788523 - RNA, 17 nt, Mycobacterium avium subsp. paratuberculosis
gucgcgccgcgucgcgc

SEQ ID NO: 788524 - RNA, 21 nt, Mycobacterium avium subsp. paratuberculosis
gucgcgccgcgucgcgccgcc

SEQ ID NO: 788525 - RNA, 15 nt, Mycobacterium avium subsp. paratuberculosis
gucgcgccgcucggc

SEQ ID NO: 788526 - RNA, 20 nt, Mycobacterium avium subsp. paratuberculosis
gucgcgccgcucggccagca

SEQ ID NO: 788527 - RNA, 18 nt, Mycobacterium avium subsp. paratuberculosis
gucgcgcggcugcucgaa

SEQ ID NO: 788528 - RNA, 15 nt, Mycobacterium avium subsp. paratuberculosis
gucgcggccuugcgg

SEQ ID NO: 788529 - RNA, 13 nt, Mycobacterium avium subsp. paratuberculosis
gucgcggcgaacc

SEQ ID NO: 788530 - RNA, 17 nt, Mycobacterium avium subsp. paratuberculosis
gucgcggcgaaccagca

SEQ ID NO: 788531 - RNA, 22 nt, Mycobacterium avium subsp. paratuberculosis
gucgcggcgaaccagcaugcgc

SEQ ID NO: 788532 - RNA, 14 nt, Mycobacterium avium subsp. paratuberculosis
gucgcggcgcaccc

SEQ ID NO: 788533 - RNA, 20 nt, Mycobacterium avium subsp. paratuberculosis
gucgcggcgcacggugcccg

SEQ ID NO: 788534 - RNA, 14 nt, Mycobacterium avium subsp. paratuberculosis
gucgcggcgccggu

SEQ ID NO: 788535 - RNA, 15 nt, Mycobacterium avium subsp. paratuberculosis
gucgcggcgccgguu

SEQ ID NO: 788536 - RNA, 13 nt, Mycobacterium avium subsp. paratuberculosis
gucgcgcgccggc

SEQ ID NO: 788537 - RNA, 14 nt, Mycobacterium avium subsp. paratuberculosis
gucgcgcgccggcg

SEQ ID NO: 788538 - RNA, 15 nt, Mycobacterium avium subsp. paratuberculosis
gucgcgcgccggcgc

SEQ ID NO: 788539 - RNA, 16 nt, Mycobacterium avium subsp. paratuberculosis
gucgcgcgccggcgca

SEQ ID NO: 788540 - RNA, 17 nt, Mycobacterium avium subsp. paratuberculosis
gucgcgcgacugggcgc

SEQ ID NO: 788541 - RNA, 20 nt, Mycobacterium avium subsp. paratuberculosis
gucgcgcgacugggcgccca

SEQ ID NO: 788542 - RNA, 22 nt, Mycobacterium avium subsp. paratuberculosis
gucgcgcgacugggcgcccacc

SEQ ID NO: 788543 - RNA, 17 nt, Mycobacterium avium subsp. paratuberculosis
gucgcgcgaacagccga

SEQ ID NO: 788544 - RNA, 19 nt, Mycobacterium avium subsp. paratuberculosis
gucgcgcgaacagccgacc

SEQ ID NO: 788545 - RNA, 14 nt, Mycobacterium avium subsp. paratuberculosis
gucgcgcgaccagu

SEQ ID NO: 788546 - RNA, 15 nt, Mycobacterium avium subsp. paratuberculosis
gucgcgcgaccagua

SEQ ID NO: 788547 - RNA, 13 nt, Mycobacterium avium subsp. paratuberculosis
gucgcgggcgccg

SEQ ID NO: 788548 - RNA, 14 nt, Mycobacterium avium subsp. paratuberculosis
gucgcgggcgccga

SEQ ID NO: 788549 - RNA, 16 nt, Mycobacterium avium subsp. paratuberculosis
gucgcgggcggggcgc

SEQ ID NO: 788550 - RNA, 19 nt, Mycobacterium avium subsp. paratuberculosis
gucgcgggcggggcgccga

SEQ ID NO: 788551 - RNA, 16 nt, Mycobacterium avium subsp. paratuberculosis
gucgcgggcgucgggc

SEQ ID NO: 788552 - RNA, 20 nt, Mycobacterium avium subsp. paratuberculosis
gucgcgggcgucgggcagca

SEQ ID NO: 788553 - RNA, 17 nt, Mycobacterium avium subsp. paratuberculosis
gucgcgggucuggcucg

SEQ ID NO: 788554 - RNA, 18 nt, Mycobacterium avium subsp. paratuberculosis
gucgcgggugaccggcgc

SEQ ID NO: 788555 - RNA, 20 nt, Mycobacterium avium subsp. paratuberculosis
gucgcgggugaccggcgccg

SEQ ID NO: 788556 - RNA, 21 nt, Mycobacterium avium subsp. paratuberculosis
gucgcgggugauccggugcca

SEQ ID NO: 788557 - RNA, 22 nt, Mycobacterium avium subsp. paratuberculosis
gucgcgggugauccggugccac

SEQ ID NO: 788558 - RNA, 17 nt, Mycobacterium avium subsp. paratuberculosis
gucgcgggcccgggcca

SEQ ID NO: 788559 - RNA, 13 nt, Mycobacterium avium subsp. paratuberculosis
gucgcgggcgaaa

SEQ ID NO: 788560 - RNA, 18 nt, Mycobacterium avium subsp. paratuberculosis
gucgcgggcgagccgaca

SEQ ID NO: 788561 - RNA, 16 nt, Mycobacterium avium subsp. paratuberculosis
gucgcggcuggugccg

SEQ ID NO: 788562 - RNA, 18 nt, Mycobacterium avium subsp. paratuberculosis
gucgcggcuggugccgcc

SEQ ID NO: 788563 - RNA, 20 nt, Mycobacterium avium subsp. paratuberculosis
gucgcggcuggugccgccgg

SEQ ID NO: 788564 - RNA, 24 nt, Mycobacterium avium subsp. paratuberculosis
gucgcggcuggugccgccggcgau

SEQ ID NO: 788565 - RNA, 14 nt, Mycobacterium avium subsp. paratuberculosis
gucgcggcugccgg

SEQ ID NO: 788566 - RNA, 17 nt, Mycobacterium avium subsp. paratuberculosis
gucgcgggaaucccacc

SEQ ID NO: 788567 - RNA, 19 nt, Mycobacterium avium subsp. paratuberculosis
gucgcgggaaucccacccg

SEQ ID NO: 788568 - RNA, 20 nt, Mycobacterium avium subsp. paratuberculosis
gucgcgggacaacacgaucg

SEQ ID NO: 788569 - RNA, 16 nt, Mycobacterium avium subsp. paratuberculosis
gucgcgggcagccggc

SEQ ID NO: 788570 - RNA, 15 nt, Mycobacterium avium subsp. paratuberculosis
gucgcggcgcggacc

SEQ ID NO: 788571 - RNA, 18 nt, Mycobacterium avium subsp. paratuberculosis
gucgcggcgcugcgccgu

SEQ ID NO: 788572 - RNA, 11 nt, Mycobacterium avium subsp. paratuberculosis
gucgcggcggc

SEQ ID NO: 788573 - RNA, 15 nt, Mycobacterium avium subsp. paratuberculosis
gucgcggcggcccgu

SEQ ID NO: 788574 - RNA, 20 nt, Mycobacterium avium subsp. paratuberculosis
gucgcggcggccggcgccga

SEQ ID NO: 788575 - RNA, 22 nt, Mycobacterium avium subsp. paratuberculosis
gucgcggcggccggcgccgacc

SEQ ID NO: 788576 - RNA, 17 nt, Mycobacterium avium subsp. paratuberculosis
gucgcggcggcgcuggu

SEQ ID NO: 788577 - RNA, 20 nt, Mycobacterium avium subsp. paratuberculosis
gucgcggcggcgcuggucgg

SEQ ID NO: 788578 - RNA, 20 nt, Mycobacterium avium subsp. paratuberculosis
gucgcggcgggggucggagc

SEQ ID NO: 788579 - RNA, 12 nt, Mycobacterium avium subsp. paratuberculosis
gucgccggcggc

SEQ ID NO: 788580 - RNA, 16 nt, Mycobacterium avium subsp. paratuberculosis
gucgccggcggccgac

SEQ ID NO: 788581 - RNA, 15 nt, Mycobacterium avium subsp. paratuberculosis
gucgccggcggcgau

SEQ ID NO: 788582 - RNA, 17 nt, Mycobacterium avium subsp. paratuberculosis
gucgccggcggcgaucg

SEQ ID NO: 788583 - RNA, 17 nt, Mycobacterium avium subsp. paratuberculosis
gucgccggcgcgcagcg

SEQ ID NO: 788584 - RNA, 18 nt, Mycobacterium avium subsp. paratuberculosis
gucgccggcgcgcagcgu

SEQ ID NO: 788585 - RNA, 21 nt, Mycobacterium avium subsp. paratuberculosis
gucgccggcgcgggccgcagc

SEQ ID NO: 788586 - RNA, 23 nt, Mycobacterium avium subsp. paratuberculosis
gucgccgggcagguggucggcga

SEQ ID NO: 788587 - RNA, 20 nt, Mycobacterium avium subsp. paratuberculosis
gucgccggcugacugccggc

SEQ ID NO: 788588 - RNA, 14 nt, Mycobacterium avium subsp. paratuberculosis
gucgccggcggggc

SEQ ID NO: 788589 - RNA, 14 nt, Mycobacterium avium subsp. paratuberculosis
gucgccgggccggc

SEQ ID NO: 788590 - RNA, 18 nt, Mycobacterium avium subsp. paratuberculosis
gucgccgggccggccggu

SEQ ID NO: 788591 - RNA, 14 nt, Mycobacterium avium subsp. paratuberculosis
gucgccugcacgaa

SEQ ID NO: 788592 - RNA, 19 nt, Mycobacterium avium subsp. paratuberculosis
gucgccggccaggccggcc

SEQ ID NO: 788593 - RNA, 21 nt, Mycobacterium avium subsp. paratuberculosis
gucgccggccaggccggccug

SEQ ID NO: 788594 - RNA, 14 nt, Mycobacterium avium subsp. paratuberculosis
gucgccggccaggc

SEQ ID NO: 788595 - RNA, 15 nt, Mycobacterium avium subsp. paratuberculosis
gucgccggccgccag

SEQ ID NO: 788596 - RNA, 20 nt, Mycobacterium avium subsp. paratuberculosis
gucgccggccgccagcgccc

SEQ ID NO: 788597 - RNA, 14 nt, Mycobacterium avium subsp. paratuberculosis
gucgccggccgcgg

SEQ ID NO: 788598 - RNA, 17 nt, Mycobacterium avium subsp. paratuberculosis
gucgccggccugcccgc

SEQ ID NO: 788599 - RNA, 20 nt, Mycobacterium avium subsp. paratuberculosis
gucgccggccugcccgccgc

SEQ ID NO: 788600 - RNA, 15 nt, Mycobacterium avium subsp. paratuberculosis
gucgccggcgaccgc

SEQ ID NO: 788601 - RNA, 21 nt, Mycobacterium avium subsp. paratuberculosis
gucgccgccgggcgccacccg

SEQ ID NO: 788602 - RNA, 21 nt, Mycobacterium avium subsp. paratuberculosis
gucgccgccggugccgacgau

SEQ ID NO: 788603 - RNA, 19 nt, Mycobacterium avium subsp. paratuberculosis
gucgccgcccgggccgcgc

SEQ ID NO: 788604 - RNA, 22 nt, Mycobacterium avium subsp. paratuberculosis
gucgccgcccgggccgcgccca

SEQ ID NO: 788605 - RNA, 14 nt, Mycobacterium avium subsp. paratuberculosis
gucgcgcaccaucc

SEQ ID NO: 788606 - RNA, 19 nt, Mycobacterium avium subsp. paratuberculosis
gucgcgcaccauccgcgac

SEQ ID NO: 788607 - RNA, 13 nt, Mycobacterium avium subsp. paratuberculosis
gucgcgcacccag

SEQ ID NO: 788608 - RNA, 14 nt, Mycobacterium avium subsp. paratuberculosis
gucgcgcacccaga

SEQ ID NO: 788609 - RNA, 17 nt, Mycobacterium avium subsp. paratuberculosis
gucgcgcacccagccgc

SEQ ID NO: 788610 - RNA, 18 nt, Mycobacterium avium subsp. paratuberculosis
gucgcgcacccagccgca

SEQ ID NO: 788611 - RNA, 14 nt, Mycobacterium avium subsp. paratuberculosis
gucgcgcacccgca

SEQ ID NO: 788612 - RNA, 16 nt, Mycobacterium avium subsp. paratuberculosis
gucgcgcacccgcacg

SEQ ID NO: 788613 - RNA, 14 nt, Mycobacterium avium subsp. paratuberculosis
gucgcgcaaugcca

SEQ ID NO: 788614 - RNA, 21 nt, Mycobacterium avium subsp. paratuberculosis
gucgcgaugcccaagccggcc

SEQ ID NO: 788615 - RNA, 22 nt, Mycobacterium avium subsp. paratuberculosis
gucgcgaugcccaagccggcca

SEQ ID NO: 788616 - RNA, 22 nt, Mycobacterium avium subsp. paratuberculosis
gucgcgacgagcgggccgauca

SEQ ID NO: 788617 - RNA, 17 nt, Mycobacterium avium subsp. paratuberculosis
gucgcgaucacaccacc

SEQ ID NO: 788618 - RNA, 21 nt, Mycobacterium avium subsp. paratuberculosis
gucgcgaucacaccaccacgc

SEQ ID NO: 788619 - RNA, 14 nt, Mycobacterium avium subsp. paratuberculosis
gucgcgaccgccgg

SEQ ID NO: 788620 - RNA, 12 nt, Mycobacterium avium subsp. paratuberculosis
gucgcgaagcgu

SEQ ID NO: 788621 - RNA, 22 nt, Mycobacterium avium subsp. paratuberculosis
gucgcgaagcguaugccggugg

SEQ ID NO: 788622 - RNA, 12 nt, Mycobacterium avium subsp. paratuberculosis
gucgcgacccgg

SEQ ID NO: 788623 - RNA, 16 nt, Mycobacterium avium subsp. paratuberculosis
gucgcgaaaaucggug

SEQ ID NO: 788624 - RNA, 19 nt, Mycobacterium avium subsp. paratuberculosis
gucgccgaaguuccagccg

SEQ ID NO: 788625 - RNA, 21 nt, Mycobacterium avium subsp. paratuberculosis
gucgccgaacgugcgcggcgc

SEQ ID NO: 788626 - RNA, 21 nt, Mycobacterium avium subsp. paratuberculosis
gucgccgaauccggcggggac

SEQ ID NO: 788627 - RNA, 15 nt, Mycobacterium avium subsp. paratuberculosis
gucgccgaacgccac

SEQ ID NO: 788628 - RNA, 18 nt, Mycobacterium avium subsp. paratuberculosis
gucgccgaacgccaccac

SEQ ID NO: 788629 - RNA, 13 nt, Mycobacterium avium subsp. paratuberculosis
gucgccgacgccg

SEQ ID NO: 788630 - RNA, 20 nt, Mycobacterium avium subsp. paratuberculosis
gucgccgaccagcaggacgc

SEQ ID NO: 788631 - RNA, 14 nt, Mycobacterium avium subsp. paratuberculosis
gucgccgaccagcc

SEQ ID NO: 788632 - RNA, 15 nt, Mycobacterium avium subsp. paratuberculosis
gucgccgaccagccg

SEQ ID NO: 788633 - RNA, 16 nt, Mycobacterium avium subsp. paratuberculosis
gucgccgacagcgucg

SEQ ID NO: 788634 - RNA, 18 nt, Mycobacterium avium subsp. paratuberculosis
gucgccgaccagguagcg

SEQ ID NO: 788635 - RNA, 14 nt, Mycobacterium avium subsp. paratuberculosis
gucgccgccgcgca

SEQ ID NO: 788636 - RNA, 17 nt, Mycobacterium avium subsp. paratuberculosis
gucgccgccgcgcaccg

SEQ ID NO: 788637 - RNA, 19 nt, Mycobacterium avium subsp. paratuberculosis
gucgccgccgcgcaccgcg

SEQ ID NO: 788638 - RNA, 22 nt, Mycobacterium avium subsp. paratuberculosis
gucgccgccgcgcaccgcgcgu

SEQ ID NO: 788639 - RNA, 15 nt, Mycobacterium avium subsp. paratuberculosis
gucgccgccccgagu

SEQ ID NO: 788640 - RNA, 14 nt, Mycobacterium avium subsp. paratuberculosis
gucgccgcccacgc

SEQ ID NO: 788641 - RNA, 16 nt, Mycobacterium avium subsp. paratuberculosis
gucgccgcccacgccg

SEQ ID NO: 788642 - RNA, 21 nt, Mycobacterium avium subsp. paratuberculosis
gucgccagcaccaccucgcgc

SEQ ID NO: 788643 - RNA, 16 nt, Mycobacterium avium subsp. paratuberculosis
gucgccagcaccgugc

SEQ ID NO: 788644 - RNA, 14 nt, Mycobacterium avium subsp. paratuberculosis
gucgccagccgccg

SEQ ID NO: 788645 - RNA, 17 nt, Mycobacterium avium subsp. paratuberculosis
gucgccacucgggcggc

SEQ ID NO: 788646 - RNA, 17 nt, Mycobacterium avium subsp. paratuberculosis
gucgccacgaucaccac

SEQ ID NO: 788647 - RNA, 23 nt, Mycobacterium avium subsp. paratuberculosis
gucgcccucgggguacucggcgg

SEQ ID NO: 788648 - RNA, 14 nt, Mycobacterium avium subsp. paratuberculosis
gucgccagcgccac

SEQ ID NO: 788649 - RNA, 15 nt, Mycobacterium avium subsp. paratuberculosis
gucgccaggccaccg

SEQ ID NO: 788650 - RNA, 23 nt, Mycobacterium avium subsp. paratuberculosis
gucgcccucgaaguagagccgcu

SEQ ID NO: 788651 - RNA, 18 nt, Mycobacterium avium subsp. paratuberculosis
gucgcccucgaucgcgac

SEQ ID NO: 788652 - RNA, 17 nt, Mycobacterium avium subsp. paratuberculosis
gucgccaauccggcggg

SEQ ID NO: 788653 - RNA, 19 nt, Mycobacterium avium subsp. paratuberculosis
gucgccaauccggcgggcc

SEQ ID NO: 788654 - RNA, 20 nt, Mycobacterium avium subsp. paratuberculosis
gucgccaauccggcgggccu

SEQ ID NO: 788655 - RNA, 23 nt, Mycobacterium avium subsp. paratuberculosis
gucgccaccaccacggggcgggu

SEQ ID NO: 788656 - RNA, 15 nt, Mycobacterium avium subsp. paratuberculosis
gucgccaccaccagc

SEQ ID NO: 788657 - RNA, 16 nt, Mycobacterium avium subsp. paratuberculosis
gucgccaccaccagcg

SEQ ID NO: 788658 - RNA, 21 nt, Mycobacterium avium subsp. paratuberculosis
gucgccaccaccagcgggcug

SEQ ID NO: 788659 - RNA, 15 nt, Mycobacterium avium subsp. paratuberculosis
gucgccaccaccgcg

SEQ ID NO: 788660 - RNA, 14 nt, Mycobacterium avium subsp. paratuberculosis
gucgccaccacggc

SEQ ID NO: 788661 - RNA, 16 nt, Mycobacterium avium subsp. paratuberculosis
gucgccaccacggcgc

SEQ ID NO: 788662 - RNA, 20 nt, Mycobacterium avium subsp. paratuberculosis
gucgccaccagaccggcgaa

SEQ ID NO: 788663 - RNA, 18 nt, Mycobacterium avium subsp. paratuberculosis
gucgccaccgagucgcgc

SEQ ID NO: 788664 - RNA, 21 nt, Mycobacterium avium subsp. paratuberculosis
gucgccaccgagucgcgcgac

SEQ ID NO: 788665 - RNA, 13 nt, Mycobacterium avium subsp. paratuberculosis
gucgcaggcagca

SEQ ID NO: 788666 - RNA, 16 nt, Mycobacterium avium subsp. paratuberculosis
gucgcaggcagcagca

SEQ ID NO: 788667 - RNA, 14 nt, Mycobacterium avium subsp. paratuberculosis
gucgcagugcccgc

SEQ ID NO: 788668 - RNA, 15 nt, Mycobacterium avium subsp. paratuberculosis
gucgcagugccggug

SEQ ID NO: 788669 - RNA, 18 nt, Mycobacterium avium subsp. paratuberculosis
gucgcaucagcucggcag

SEQ ID NO: 788670 - RNA, 16 nt, Mycobacterium avium subsp. paratuberculosis
gucgaugucggcggcc

SEQ ID NO: 788671 - RNA, 17 nt, Mycobacterium avium subsp. paratuberculosis
gucgaugucggugcggc

SEQ ID NO: 788672 - RNA, 17 nt, Mycobacterium avium subsp. paratuberculosis
gucgaugucgguggcgc

SEQ ID NO: 788673 - RNA, 14 nt, Mycobacterium avium subsp. paratuberculosis
gucgaugucgucgu

SEQ ID NO: 788674 - RNA, 15 nt, Mycobacterium avium subsp. paratuberculosis
gucgaugucgucguc

SEQ ID NO: 788675 - RNA, 22 nt, Mycobacterium avium subsp. paratuberculosis
gucgaugucgucgucgacgcug

SEQ ID NO: 788676 - RNA, 14 nt, Mycobacterium avium subsp. paratuberculosis
gucgaugugcucgg

SEQ ID NO: 788677 - RNA, 18 nt, Mycobacterium avium subsp. paratuberculosis
gucgaugugggccgcagc

SEQ ID NO: 788678 - RNA, 15 nt, Mycobacterium avium subsp. paratuberculosis
gucgcaggccccgga

SEQ ID NO: 788679 - RNA, 15 nt, Mycobacterium avium subsp. paratuberculosis
gucgcaggccgcccg

SEQ ID NO: 788680 - RNA, 17 nt, Mycobacterium avium subsp. paratuberculosis
gucgcaggccgcccggc

SEQ ID NO: 788681 - RNA, 18 nt, Mycobacterium avium subsp. paratuberculosis
gucgcaggccgcccggcc

SEQ ID NO: 788682 - RNA, 17 nt, Mycobacterium avium subsp. paratuberculosis
gucgaugucgacgccgu

SEQ ID NO: 788683 - RNA, 16 nt, Mycobacterium avium subsp. paratuberculosis
gucgaugucgcccggc

SEQ ID NO: 788684 - RNA, 15 nt, Mycobacterium avium subsp. paratuberculosis
gucgauggcgcggcc

SEQ ID NO: 788685 - RNA, 23 nt, Mycobacterium avium subsp. paratuberculosis
gucgauggucugcccgccgccga

SEQ ID NO: 788686 - RNA, 13 nt, Mycobacterium avium subsp. paratuberculosis
gucgaugcgcagc

SEQ ID NO: 788687 - RNA, 17 nt, Mycobacterium avium subsp. paratuberculosis
gucgauggacagggcga

SEQ ID NO: 788688 - RNA, 18 nt, Mycobacterium avium subsp. paratuberculosis
gucgauggccaccagguc

SEQ ID NO: 788689 - RNA, 14 nt, Mycobacterium avium subsp. paratuberculosis
gucgaugcgcagca

SEQ ID NO: 788690 - RNA, 19 nt, Mycobacterium avium subsp. paratuberculosis
gucgaugcgcagcagcggc

SEQ ID NO: 788691 - RNA, 22 nt, Mycobacterium avium subsp. paratuberculosis
gucgaugcggaucucggugccg

SEQ ID NO: 788692 - RNA, 14 nt, Mycobacterium avium subsp. paratuberculosis
gucgaugcgggccc

SEQ ID NO: 788693 - RNA, 18 nt, Mycobacterium avium subsp. paratuberculosis
gucgauccacccaccggc

SEQ ID NO: 788694 - RNA, 23 nt, Mycobacterium avium subsp. paratuberculosis
gucgaucccgccggcgaucgacg

SEQ ID NO: 788695 - RNA, 17 nt, Mycobacterium avium subsp. paratuberculosis
gucgaucagcgcgccgc

SEQ ID NO: 788696 - RNA, 19 nt, Mycobacterium avium subsp. paratuberculosis
gucgaucagcgguccaccc

SEQ ID NO: 788697 - RNA, 20 nt, Mycobacterium avium subsp. paratuberculosis
gucgaucagcgguccacccg

SEQ ID NO: 788698 - RNA, 14 nt, Mycobacterium avium subsp. paratuberculosis
gucgaucacgccgc

SEQ ID NO: 788699 - RNA, 17 nt, Mycobacterium avium subsp. paratuberculosis
gucgaucacgccgccgg

SEQ ID NO: 788700 - RNA, 18 nt, Mycobacterium avium subsp. paratuberculosis
gucgaucaacaccaacga

SEQ ID NO: 788701 - RNA, 12 nt, Mycobacterium avium subsp. paratuberculosis
gucgaucaagaa

SEQ ID NO: 788702 - RNA, 17 nt, Mycobacterium avium subsp. paratuberculosis
gucgaucaccucgucga

SEQ ID NO: 788703 - RNA, 13 nt, Mycobacterium avium subsp. paratuberculosis
gucgaucaccugc

SEQ ID NO: 788704 - RNA, 13 nt, Mycobacterium avium subsp. paratuberculosis
gucgagugcucga

SEQ ID NO: 788705 - RNA, 19 nt, Mycobacterium avium subsp. paratuberculosis
gucgaguucgccgucgacg

SEQ ID NO: 788706 - RNA, 19 nt, Mycobacterium avium subsp. paratuberculosis
gucgaguucgcggcgcagc

SEQ ID NO: 788707 - RNA, 23 nt, Mycobacterium avium subsp. paratuberculosis
gucgaguucgcggcgcagcacgg

SEQ ID NO: 788708 - RNA, 19 nt, Mycobacterium avium subsp. paratuberculosis
gucgagguguugucgugcc

SEQ ID NO: 788709 - RNA, 22 nt, Mycobacterium avium subsp. paratuberculosis
gucgagguucucgaacgggucg

SEQ ID NO: 788710 - RNA, 18 nt, Mycobacterium avium subsp. paratuberculosis
gucgagucggccaccgcg

SEQ ID NO: 788711 - RNA, 23 nt, Mycobacterium avium subsp. paratuberculosis
gucgagucggccaccgcggucga

SEQ ID NO: 788712 - RNA, 15 nt, Mycobacterium avium subsp. paratuberculosis
gucgagcaccacccg

SEQ ID NO: 788713 - RNA, 20 nt, Mycobacterium avium subsp. paratuberculosis
gucgagaugaccgucguugc

SEQ ID NO: 788714 - RNA, 15 nt, Mycobacterium avium subsp. paratuberculosis
gucgagaucagcacc

SEQ ID NO: 788715 - RNA, 16 nt, Mycobacterium avium subsp. paratuberculosis
gucgagaucagcaccg

SEQ ID NO: 788716 - RNA, 21 nt, Mycobacterium avium subsp. paratuberculosis
gucgagaucagcaccggguga

SEQ ID NO: 788717 - RNA, 16 nt, Mycobacterium avium subsp. paratuberculosis
gucgagcaccgcgucc

SEQ ID NO: 788718 - RNA, 23 nt, Mycobacterium avium subsp. paratuberculosis
gucgagcaccgcguccgcgucgu

SEQ ID NO: 788719 - RNA, 13 nt, Mycobacterium avium subsp. paratuberculosis
gucgagcaccggc

SEQ ID NO: 788720 - RNA, 23 nt, Mycobacterium avium subsp. paratuberculosis
gucgagcaccacccggguguugg

SEQ ID NO: 788721 - RNA, 14 nt, Mycobacterium avium subsp. paratuberculosis
gucgagcaccgcga

SEQ ID NO: 788722 - RNA, 15 nt, Mycobacterium avium subsp. paratuberculosis
gucgagcaccgcgau

SEQ ID NO: 788723 - RNA, 18 nt, Mycobacterium avium subsp. paratuberculosis
gucgagcaccgcgaucac

SEQ ID NO: 788724 - RNA, 13 nt, Mycobacterium avium subsp. paratuberculosis
gucgagggccacc

SEQ ID NO: 788725 - RNA, 21 nt, Mycobacterium avium subsp. paratuberculosis
gucgagggcguucgcgguggg

SEQ ID NO: 788726 - RNA, 22 nt, Mycobacterium avium subsp. paratuberculosis
gucgaggggcuugagcgcgucg

SEQ ID NO: 788727 - RNA, 14 nt, Mycobacterium avium subsp. paratuberculosis
gucgagggucgcca

SEQ ID NO: 788728 - RNA, 16 nt, Mycobacterium avium subsp. paratuberculosis
gucgagggugacccgg

SEQ ID NO: 788729 - RNA, 16 nt, Mycobacterium avium subsp. paratuberculosis
gucgagguacugcagc

SEQ ID NO: 788730 - RNA, 20 nt, Mycobacterium avium subsp. paratuberculosis
gucgagguacugcagcaguc

SEQ ID NO: 788731 - RNA, 17 nt, Mycobacterium avium subsp. paratuberculosis
gucgagguagugcgcga

SEQ ID NO: 788732 - RNA, 19 nt, Mycobacterium avium subsp. paratuberculosis
gucgagguagugcgcgaug

SEQ ID NO: 788733 - RNA, 17 nt, Mycobacterium avium subsp. paratuberculosis
gucgagguccucggcga

SEQ ID NO: 788734 - RNA, 19 nt, Mycobacterium avium subsp. paratuberculosis
gucgagguccucggcgaug

SEQ ID NO: 788735 - RNA, 14 nt, Mycobacterium avium subsp. paratuberculosis
gucgaggucgccga

SEQ ID NO: 788736 - RNA, 13 nt, Mycobacterium avium subsp. paratuberculosis
gucgaggucgcgc

SEQ ID NO: 788737 - RNA, 14 nt, Mycobacterium avium subsp. paratuberculosis
gucgaggucgcgca

SEQ ID NO: 788738 - RNA, 18 nt, Mycobacterium avium subsp. paratuberculosis
gucgaggucgcgcagcac

SEQ ID NO: 788739 - RNA, 19 nt, Mycobacterium avium subsp. paratuberculosis
gucgaggucgcgcagcacc

SEQ ID NO: 788740 - RNA, 15 nt, Mycobacterium avium subsp. paratuberculosis
gucgaggucggccag

SEQ ID NO: 788741 - RNA, 12 nt, Mycobacterium avium subsp. paratuberculosis
gucgaggucggu

SEQ ID NO: 788742 - RNA, 16 nt, Mycobacterium avium subsp. paratuberculosis
gucgaggucgucggcc

SEQ ID NO: 788743 - RNA, 17 nt, Mycobacterium avium subsp. paratuberculosis
gucgaggucgucggcca

SEQ ID NO: 788744 - RNA, 16 nt, Mycobacterium avium subsp. paratuberculosis
gucgaggucgucgggc

SEQ ID NO: 788745 - RNA, 22 nt, Mycobacterium avium subsp. paratuberculosis
gucgaggucgucgggcgccggu

SEQ ID NO: 788746 - RNA, 14 nt, Mycobacterium avium subsp. paratuberculosis
gucgagaaacgcgc

SEQ ID NO: 788747 - RNA, 17 nt, Mycobacterium avium subsp. paratuberculosis
gucgagaaaggccagca

SEQ ID NO: 788748 - RNA, 16 nt, Mycobacterium avium subsp. paratuberculosis
gucgacugggccaggu

SEQ ID NO: 788749 - RNA, 12 nt, Mycobacterium avium subsp. paratuberculosis
gucgacuggucg

SEQ ID NO: 788750 - RNA, 21 nt, Mycobacterium avium subsp. paratuberculosis
gucgacuucccaguccggcca

SEQ ID NO: 788751 - RNA, 19 nt, Mycobacterium avium subsp. paratuberculosis
gucgagacaccgucgcgca

SEQ ID NO: 788752 - RNA, 21 nt, Mycobacterium avium subsp. paratuberculosis
gucgagacaccgucgcgcacc

SEQ ID NO: 788753 - RNA, 15 nt, Mycobacterium avium subsp. paratuberculosis
gucgagagccgcauc

SEQ ID NO: 788754 - RNA, 19 nt, Mycobacterium avium subsp. paratuberculosis
gucgacguucgagucggcc

SEQ ID NO: 788755 - RNA, 17 nt, Mycobacterium avium subsp. paratuberculosis
gucgacguucgccgcca

SEQ ID NO: 788756 - RNA, 20 nt, Mycobacterium avium subsp. paratuberculosis
gucgacguucgccgccagca

SEQ ID NO: 788757 - RNA, 13 nt, Mycobacterium avium subsp. paratuberculosis
gucgacgcgccgc

SEQ ID NO: 788758 - RNA, 16 nt, Mycobacterium avium subsp. paratuberculosis
gucgacgugcucggcg

SEQ ID NO: 788759 - RNA, 20 nt, Mycobacterium avium subsp. paratuberculosis
gucgacgugcucggcggccg

SEQ ID NO: 788760 - RNA, 23 nt, Mycobacterium avium subsp. paratuberculosis
gucgacgugcucggcggccgcca

SEQ ID NO: 788761 - RNA, 17 nt, Mycobacterium avium subsp. paratuberculosis
gucgacgugggcggcca

SEQ ID NO: 788762 - RNA, 19 nt, Mycobacterium avium subsp. paratuberculosis
gucgacgugggcggccacc

SEQ ID NO: 788763 - RNA, 18 nt, Mycobacterium avium subsp. paratuberculosis
gucgacguggugcaccgc

SEQ ID NO: 788764 - RNA, 20 nt, Mycobacterium avium subsp. paratuberculosis
gucgacguggugcaccgcca

SEQ ID NO: 788765 - RNA, 22 nt, Mycobacterium avium subsp. paratuberculosis
gucgacguggugcaccgccagc

SEQ ID NO: 788766 - RNA, 15 nt, Mycobacterium avium subsp. paratuberculosis
gucgacucggcggug

SEQ ID NO: 788767 - RNA, 17 nt, Mycobacterium avium subsp. paratuberculosis
gucgacucggcggugcc

SEQ ID NO: 788768 - RNA, 15 nt, Mycobacterium avium subsp. paratuberculosis
gucgacgccgugcug

SEQ ID NO: 788769 - RNA, 14 nt, Mycobacterium avium subsp. paratuberculosis
gucgacgccguggu

SEQ ID NO: 788770 - RNA, 22 nt, Mycobacterium avium subsp. paratuberculosis
gucgacgccgugguccagccgg

SEQ ID NO: 788771 - RNA, 23 nt, Mycobacterium avium subsp. paratuberculosis
gucgacgcaccacgagcagccga

SEQ ID NO: 788772 - RNA, 14 nt, Mycobacterium avium subsp. paratuberculosis
gucgacugcaccga

SEQ ID NO: 788773 - RNA, 12 nt, Mycobacterium avium subsp. paratuberculosis
gucgacgccggg

SEQ ID NO: 788774 - RNA, 14 nt, Mycobacterium avium subsp. paratuberculosis
gucgacgccgaugg

SEQ ID NO: 788775 - RNA, 13 nt, Mycobacterium avium subsp. paratuberculosis
gucgacgccgcug

SEQ ID NO: 788776 - RNA, 20 nt, Mycobacterium avium subsp. paratuberculosis
gucgacgcccuuggcgccca

SEQ ID NO: 788777 - RNA, 22 nt, Mycobacterium avium subsp. paratuberculosis
gucgacgcccuuggcgcccagc

SEQ ID NO: 788778 - RNA, 15 nt, Mycobacterium avium subsp. paratuberculosis
gucgacgcccaccug

SEQ ID NO: 788779 - RNA, 16 nt, Mycobacterium avium subsp. paratuberculosis
gucgacgccccgcgcc

SEQ ID NO: 788780 - RNA, 20 nt, Mycobacterium avium subsp. paratuberculosis
gucgacgcccugccacagcg

SEQ ID NO: 788781 - RNA, 17 nt, Mycobacterium avium subsp. paratuberculosis
gucgacgaugcgcugcu

SEQ ID NO: 788782 - RNA, 18 nt, Mycobacterium avium subsp. paratuberculosis
gucgacgaugcguucggg

SEQ ID NO: 788783 - RNA, 17 nt, Mycobacterium avium subsp. paratuberculosis
gucgacgauggcccgga

SEQ ID NO: 788784 - RNA, 20 nt, Mycobacterium avium subsp. paratuberculosis
gucgacgauggcccggaccg

SEQ ID NO: 788785 - RNA, 20 nt, Mycobacterium avium subsp. paratuberculosis
gucgacgaagaaggacgccu

SEQ ID NO: 788786 - RNA, 14 nt, Mycobacterium avium subsp. paratuberculosis
gucgacgacguugc

SEQ ID NO: 788787 - RNA, 18 nt, Mycobacterium avium subsp. paratuberculosis
gucgacgacguugcgggc

SEQ ID NO: 788788 - RNA, 20 nt, Mycobacterium avium subsp. paratuberculosis
gucgacgacguugcgggcca

SEQ ID NO: 788789 - RNA, 17 nt, Mycobacterium avium subsp. paratuberculosis
gucgacgagcccgccgg

SEQ ID NO: 788790 - RNA, 19 nt, Mycobacterium avium subsp. paratuberculosis
gucgacgagcccgccggcg

SEQ ID NO: 788791 - RNA, 20 nt, Mycobacterium avium subsp. paratuberculosis
gucgacgagcccgccggcgg

SEQ ID NO: 788792 - RNA, 21 nt, Mycobacterium avium subsp. paratuberculosis
gucgacgagcccgccggcggg

SEQ ID NO: 788793 - RNA, 17 nt, Mycobacterium avium subsp. paratuberculosis
gucgacgagcccgcgcc

SEQ ID NO: 788794 - RNA, 22 nt, Mycobacterium avium subsp. paratuberculosis
gucgaccuugcagcccgcgucc

SEQ ID NO: 788795 - RNA, 21 nt, Mycobacterium avium subsp. paratuberculosis
gucgaccuuggggucaccguc

SEQ ID NO: 788796 - RNA, 14 nt, Mycobacterium avium subsp. paratuberculosis
gucgaccugcucgu

SEQ ID NO: 788797 - RNA, 17 nt, Mycobacterium avium subsp. paratuberculosis
gucgaccugcucgucgg

SEQ ID NO: 788798 - RNA, 19 nt, Mycobacterium avium subsp. paratuberculosis
gucgaccugcucgucggug

SEQ ID NO: 788799 - RNA, 18 nt, Mycobacterium avium subsp. paratuberculosis
gucgaccgucacgcuggc

SEQ ID NO: 788800 - RNA, 17 nt, Mycobacterium avium subsp. paratuberculosis
gucgaccuccucgaccc

SEQ ID NO: 788801 - RNA, 18 nt, Mycobacterium avium subsp. paratuberculosis
gucgaccuccucgacccc

SEQ ID NO: 788802 - RNA, 17 nt, Mycobacterium avium subsp. paratuberculosis
gucgaccaaugcgauca

SEQ ID NO: 788803 - RNA, 14 nt, Mycobacterium avium subsp. paratuberculosis
gucgaccaccgggu

SEQ ID NO: 788804 - RNA, 20 nt, Mycobacterium avium subsp. paratuberculosis
gucgaccacgaagggcgcca

SEQ ID NO: 788805 - RNA, 14 nt, Mycobacterium avium subsp. paratuberculosis
gucgaccacccgca

SEQ ID NO: 788806 - RNA, 16 nt, Mycobacterium avium subsp. paratuberculosis
gucgaccacccgcagc

SEQ ID NO: 788807 - RNA, 17 nt, Mycobacterium avium subsp. paratuberculosis
gucgaccacccgcagcu

SEQ ID NO: 788808 - RNA, 14 nt, Mycobacterium avium subsp. paratuberculosis
gucgaccaccgccg

SEQ ID NO: 788809 - RNA, 17 nt, Mycobacterium avium subsp. paratuberculosis
gucgaccaccgccggcc

SEQ ID NO: 788810 - RNA, 21 nt, Mycobacterium avium subsp. paratuberculosis
gucgaccaccgccggcccggc

SEQ ID NO: 788811 - RNA, 18 nt, Mycobacterium avium subsp. paratuberculosis
gucgacaccccgcucggc

SEQ ID NO: 788812 - RNA, 19 nt, Mycobacterium avium subsp. paratuberculosis
gucgacaccccgcucggcc

SEQ ID NO: 788813 - RNA, 15 nt, Mycobacterium avium subsp. paratuberculosis
gucgacacgccggcc

SEQ ID NO: 788814 - RNA, 16 nt, Mycobacterium avium subsp. paratuberculosis
gucgacagccggucgc

SEQ ID NO: 788815 - RNA, 22 nt, Mycobacterium avium subsp. paratuberculosis
gucgacagccugaccgcgggug

SEQ ID NO: 788816 - RNA, 21 nt, Mycobacterium avium subsp. paratuberculosis
gucgacacgaucggcaugacg

SEQ ID NO: 788817 - RNA, 20 nt, Mycobacterium avium subsp. paratuberculosis
gucgaccggggcgccccgcu

SEQ ID NO: 788818 - RNA, 14 nt, Mycobacterium avium subsp. paratuberculosis
gucgaccgcggccu

SEQ ID NO: 788819 - RNA, 20 nt, Mycobacterium avium subsp. paratuberculosis
gucgaccgcggcuccggccg

SEQ ID NO: 788820 - RNA, 21 nt, Mycobacterium avium subsp. paratuberculosis
gucgaccgcggcuccggccgc

SEQ ID NO: 788821 - RNA, 12 nt, Mycobacterium avium subsp. paratuberculosis
gucgaccgccgc

SEQ ID NO: 788822 - RNA, 12 nt, Mycobacterium avium subsp. paratuberculosis
gucgaccgccuc

SEQ ID NO: 788823 - RNA, 12 nt, Mycobacterium avium subsp. paratuberculosis
gucgaccgcgac

SEQ ID NO: 788824 - RNA, 19 nt, Mycobacterium avium subsp. paratuberculosis
gucgaccgcgaugguggcg

SEQ ID NO: 788825 - RNA, 15 nt, Mycobacterium avium subsp. paratuberculosis
gucgaccgcgcaccg

SEQ ID NO: 788826 - RNA, 17 nt, Mycobacterium avium subsp. paratuberculosis
gucgaccgcgcaccggc

SEQ ID NO: 788827 - RNA, 12 nt, Mycobacterium avium subsp. paratuberculosis
gucgaccgcgcc

SEQ ID NO: 788828 - RNA, 15 nt, Mycobacterium avium subsp. paratuberculosis
gucgaccgcgccggg

SEQ ID NO: 788829 - RNA, 13 nt, Mycobacterium avium subsp. paratuberculosis
gucgaccgcggcc

SEQ ID NO: 788830 - RNA, 14 nt, Mycobacterium avium subsp. paratuberculosis
gucgacccggccgc

SEQ ID NO: 788831 - RNA, 20 nt, Mycobacterium avium subsp. paratuberculosis
gucgacccggccgcgccgga

SEQ ID NO: 788832 - RNA, 18 nt, Mycobacterium avium subsp. paratuberculosis
gucgacccguuccccggc

SEQ ID NO: 788833 - RNA, 19 nt, Mycobacterium avium subsp. paratuberculosis
gucgacccguuccccggcc

SEQ ID NO: 788834 - RNA, 15 nt, Mycobacterium avium subsp. paratuberculosis
gucgaccaucugccg

SEQ ID NO: 788835 - RNA, 19 nt, Mycobacterium avium subsp. paratuberculosis
gucgaccaucugccggcgc

SEQ ID NO: 788836 - RNA, 21 nt, Mycobacterium avium subsp. paratuberculosis
gucgaccagggcgaucaccgc

SEQ ID NO: 788837 - RNA, 22 nt, Mycobacterium avium subsp. paratuberculosis
gucgaccagggcgaucaccgcg

SEQ ID NO: 788838 - RNA, 12 nt, Mycobacterium avium subsp. paratuberculosis
gucgaccaggua

SEQ ID NO: 788839 - RNA, 22 nt, Mycobacterium avium subsp. paratuberculosis
gucgaccagcgggcugucggcg

SEQ ID NO: 788840 - RNA, 20 nt, Mycobacterium avium subsp. paratuberculosis
gucgaccagcuugucgaucu

SEQ ID NO: 788841 - RNA, 14 nt, Mycobacterium avium subsp. paratuberculosis
gucgaccccgccgg

SEQ ID NO: 788842 - RNA, 16 nt, Mycobacterium avium subsp. paratuberculosis
gucgaccccgccggcc

SEQ ID NO: 788843 - RNA, 20 nt, Mycobacterium avium subsp. paratuberculosis
gucgaccccgccggcccggu

SEQ ID NO: 788844 - RNA, 14 nt, Mycobacterium avium subsp. paratuberculosis
gucgacccgccgca

SEQ ID NO: 788845 - RNA, 15 nt, Mycobacterium avium subsp. paratuberculosis
gucgacccgccgcag

SEQ ID NO: 788846 - RNA, 12 nt, Mycobacterium avium subsp. paratuberculosis
gucgacccggcc

SEQ ID NO: 788847 - RNA, 14 nt, Mycobacterium avium subsp. paratuberculosis
gucgacccaggucg

SEQ ID NO: 788848 - RNA, 19 nt, Mycobacterium avium subsp. paratuberculosis
gucgaccaggacgucggcc

SEQ ID NO: 788849 - RNA, 24 nt, Mycobacterium avium subsp. paratuberculosis
gucagacccugugggucgacagaa

SEQ ID NO: 788850 - RNA, 14 nt, Mycobacterium avium subsp. paratuberculosis
gucagaccgcggcg

SEQ ID NO: 788851 - RNA, 16 nt, Mycobacterium avium subsp. paratuberculosis
gucagaccgcggcggu

SEQ ID NO: 788852 - RNA, 18 nt, Mycobacterium avium subsp. paratuberculosis
gucagaccgcggcggucg

SEQ ID NO: 788853 - RNA, 18 nt, Mycobacterium avium subsp. paratuberculosis
gucacguagcgcggccgc

SEQ ID NO: 788854 - RNA, 17 nt, Mycobacterium avium subsp. paratuberculosis
gucacguagcucagcgg

SEQ ID NO: 788855 - RNA, 19 nt, Mycobacterium avium subsp. paratuberculosis
gucacgucauuucggucgg

SEQ ID NO: 788856 - RNA, 15 nt, Mycobacterium avium subsp. paratuberculosis
gucacguccacgccg

SEQ ID NO: 788857 - RNA, 17 nt, Mycobacterium avium subsp. paratuberculosis
gucacguccacgccgcg

SEQ ID NO: 788858 - RNA, 19 nt, Mycobacterium avium subsp. paratuberculosis
gucacgucgacggccgccg

SEQ ID NO: 788859 - RNA, 15 nt, Mycobacterium avium subsp. paratuberculosis
gucacggacagccgg

SEQ ID NO: 788860 - RNA, 16 nt, Mycobacterium avium subsp. paratuberculosis
gucacggacagccggc

SEQ ID NO: 788861 - RNA, 14 nt, Mycobacterium avium subsp. paratuberculosis
gucacggacaggug

SEQ ID NO: 788862 - RNA, 24 nt, Mycobacterium avium subsp. paratuberculosis
gucacggacaggugugggcguacg

SEQ ID NO: 788863 - RNA, 16 nt, Mycobacterium avium subsp. paratuberculosis
gucacggaucgcccac

SEQ ID NO: 788864 - RNA, 14 nt, Mycobacterium avium subsp. paratuberculosis
gucacgggccaggc

SEQ ID NO: 788865 - RNA, 20 nt, Mycobacterium avium subsp. paratuberculosis
gucacgggccaggcgcgcgc

SEQ ID NO: 788866 - RNA, 19 nt, Mycobacterium avium subsp. paratuberculosis
gucacgggcugaccgccag

SEQ ID NO: 788867 - RNA, 19 nt, Mycobacterium avium subsp. paratuberculosis
gucacggccgccagcagca

SEQ ID NO: 788868 - RNA, 22 nt, Mycobacterium avium subsp. paratuberculosis
gucacggccgccagcagcacgg

SEQ ID NO: 788869 - RNA, 16 nt, Mycobacterium avium subsp. paratuberculosis
gucacggcgucggcgu

SEQ ID NO: 788870 - RNA, 18 nt, Mycobacterium avium subsp. paratuberculosis
guccagcucucgagcaca

SEQ ID NO: 788871 - RNA, 15 nt, Mycobacterium avium subsp. paratuberculosis
guccagcucgcgaag

SEQ ID NO: 788872 - RNA, 20 nt, Mycobacterium avium subsp. paratuberculosis
guccagcucgcgaagcgcga

SEQ ID NO: 788873 - RNA, 15 nt, Mycobacterium avium subsp. paratuberculosis
guccagcucagcgcg

SEQ ID NO: 788874 - RNA, 16 nt, Mycobacterium avium subsp. paratuberculosis
guccagcucagcgcgc

SEQ ID NO: 788875 - RNA, 15 nt, Mycobacterium avium subsp. paratuberculosis
guccaggccgccgug

SEQ ID NO: 788876 - RNA, 14 nt, Mycobacterium avium subsp. paratuberculosis
guccaggccgcgcc

SEQ ID NO: 788877 - RNA, 17 nt, Mycobacterium avium subsp. paratuberculosis
guccaggccgcgccggg

SEQ ID NO: 788878 - RNA, 11 nt, Mycobacterium avium subsp. paratuberculosis
guccaggccgg

SEQ ID NO: 788879 - RNA, 19 nt, Mycobacterium avium subsp. paratuberculosis
guccagcuucucggcgucc

SEQ ID NO: 788880 - RNA, 21 nt, Mycobacterium avium subsp. paratuberculosis
guccagcuugucguagcggcg

SEQ ID NO: 788881 - RNA, 17 nt, Mycobacterium avium subsp. paratuberculosis
guccaggaucacgcggc

SEQ ID NO: 788882 - RNA, 18 nt, Mycobacterium avium subsp. paratuberculosis
guccaggaucacgcggcg

SEQ ID NO: 788883 - RNA, 19 nt, Mycobacterium avium subsp. paratuberculosis
guccaggaucacgcggcgg

SEQ ID NO: 788884 - RNA, 21 nt, Mycobacterium avium subsp. paratuberculosis
guccaggauccccguccagcc

SEQ ID NO: 788885 - RNA, 21 nt, Mycobacterium avium subsp. paratuberculosis
guccaggaucugcagcacgcc

SEQ ID NO: 788886 - RNA, 22 nt, Mycobacterium avium subsp. paratuberculosis
gucagcaccaccaacagcagcg

SEQ ID NO: 788887 - RNA, 16 nt, Mycobacterium avium subsp. paratuberculosis
gucagcaccgcgcggc

SEQ ID NO: 788888 - RNA, 17 nt, Mycobacterium avium subsp. paratuberculosis
gucagcaccgcgcggcg

SEQ ID NO: 788889 - RNA, 13 nt, Mycobacterium avium subsp. paratuberculosis
gucagcaccgcgg

SEQ ID NO: 788890 - RNA, 14 nt, Mycobacterium avium subsp. paratuberculosis
gucagcaccgcgga

SEQ ID NO: 788891 - RNA, 15 nt, Mycobacterium avium subsp. paratuberculosis
gucagcaccggcgug

SEQ ID NO: 788892 - RNA, 13 nt, Mycobacterium avium subsp. paratuberculosis
gucagcaccguca

SEQ ID NO: 788893 - RNA, 17 nt, Mycobacterium avium subsp. paratuberculosis
gucagcaccgucaccgc

SEQ ID NO: 788894 - RNA, 19 nt, Mycobacterium avium subsp. paratuberculosis
gucagcaccgucaccgccu

SEQ ID NO: 788895 - RNA, 22 nt, Mycobacterium avium subsp. paratuberculosis
gucagcaccgugggcccgugcg

SEQ ID NO: 788896 - RNA, 19 nt, Mycobacterium avium subsp. paratuberculosis
guccagcgucuggcagccg

SEQ ID NO: 788897 - RNA, 20 nt, Mycobacterium avium subsp. paratuberculosis
guccagcgucuggcagccgg

SEQ ID NO: 788898 - RNA, 12 nt, Mycobacterium avium subsp. paratuberculosis
guccagcgugcc

SEQ ID NO: 788899 - RNA, 14 nt, Mycobacterium avium subsp. paratuberculosis
guccagcgugccgc

SEQ ID NO: 788900 - RNA, 18 nt, Mycobacterium avium subsp. paratuberculosis
guccagcgugccgcgcac

SEQ ID NO: 788901 - RNA, 19 nt, Mycobacterium avium subsp. paratuberculosis
guccagcgugccgcgcacc

SEQ ID NO: 788902 - RNA, 20 nt, Mycobacterium avium subsp. paratuberculosis
guccagcgugcgcggcuggc

SEQ ID NO: 788903 - RNA, 21 nt, Mycobacterium avium subsp. paratuberculosis
guccagcgugcgcggcuggcc

SEQ ID NO: 788904 - RNA, 22 nt, Mycobacterium avium subsp. paratuberculosis
guccagcgugcgcggcuggccg

SEQ ID NO: 788905 - RNA, 23 nt, Mycobacterium avium subsp. paratuberculosis
guccagcgugcgcggcuggccgu

SEQ ID NO: 788906 - RNA, 21 nt, Mycobacterium avium subsp. paratuberculosis
gucccgcccggcgccggccga

SEQ ID NO: 788907 - RNA, 11 nt, Mycobacterium avium subsp. paratuberculosis
gucccgccguc

SEQ ID NO: 788908 - RNA, 18 nt, Mycobacterium avium subsp. paratuberculosis
gucccgccgucucgacca

SEQ ID NO: 788909 - RNA, 16 nt, Mycobacterium avium subsp. paratuberculosis
gucccgcgccuggcgc

SEQ ID NO: 788910 - RNA, 17 nt, Mycobacterium avium subsp. paratuberculosis
gucccgcgccuggcgca

SEQ ID NO: 788911 - RNA, 18 nt, Mycobacterium avium subsp. paratuberculosis
gucccgcgccuggcgcag

SEQ ID NO: 788912 - RNA, 15 nt, Mycobacterium avium subsp. paratuberculosis
gucccgcgcggcgca

SEQ ID NO: 788913 - RNA, 21 nt, Mycobacterium avium subsp. paratuberculosis
gucccgcgcggcgcagggcgg

SEQ ID NO: 788914 - RNA, 15 nt, Mycobacterium avium subsp. paratuberculosis
gucccgcgcgggggc

SEQ ID NO: 788915 - RNA, 21 nt, Mycobacterium avium subsp. paratuberculosis
gucccgcgcgggggccgccgc

SEQ ID NO: 788916 - RNA, 22 nt, Mycobacterium avium subsp. paratuberculosis
gucccgcgcgggggccgccgcg

SEQ ID NO: 788917 - RNA, 17 nt, Mycobacterium avium subsp. paratuberculosis
gucccgcguggccgcca

SEQ ID NO: 788918 - RNA, 19 nt, Mycobacterium avium subsp. paratuberculosis
gucccgcguugugcaccaa

SEQ ID NO: 788919 - RNA, 13 nt, Mycobacterium avium subsp. paratuberculosis
gucccgcucgauc

SEQ ID NO: 788920 - RNA, 22 nt, Mycobacterium avium subsp. paratuberculosis
gucccgcucgaucuggcggacc

SEQ ID NO: 788921 - RNA, 15 nt, Mycobacterium avium subsp. paratuberculosis
guccccgccgccgug

SEQ ID NO: 788922 - RNA, 15 nt, Mycobacterium avium subsp. paratuberculosis
gucccgacagggagc

SEQ ID NO: 788923 - RNA, 22 nt, Mycobacterium avium subsp. paratuberculosis
gucccgacgcggcgcgacaccg

SEQ ID NO: 788924 - RNA, 23 nt, Mycobacterium avium subsp. paratuberculosis
gucccgacgcggcgcgacaccgc

SEQ ID NO: 788925 - RNA, 17 nt, Mycobacterium avium subsp. paratuberculosis
guccccggagucgucga

SEQ ID NO: 788926 - RNA, 14 nt, Mycobacterium avium subsp. paratuberculosis
guccccggccggcc

SEQ ID NO: 788927 - RNA, 12 nt, Mycobacterium avium subsp. paratuberculosis
guccccggcgac

SEQ ID NO: 788928 - RNA, 12 nt, Mycobacterium avium subsp. paratuberculosis
guccccggcggu

SEQ ID NO: 788929 - RNA, 23 nt, Mycobacterium avium subsp. paratuberculosis
guccccgggcaccccggucaccg

SEQ ID NO: 788930 - RNA, 20 nt, Mycobacterium avium subsp. paratuberculosis
guccccgggcccagcaccac

SEQ ID NO: 788931 - RNA, 15 nt, Mycobacterium avium subsp. paratuberculosis
guccccgggcgugcc

SEQ ID NO: 788932 - RNA, 16 nt, Mycobacterium avium subsp. paratuberculosis
guccaguacaccgcga

SEQ ID NO: 788933 - RNA, 17 nt, Mycobacterium avium subsp. paratuberculosis
guccaguccggccguga

SEQ ID NO: 788934 - RNA, 16 nt, Mycobacterium avium subsp. paratuberculosis
guccaguccggcgugc

SEQ ID NO: 788935 - RNA, 21 nt, Mycobacterium avium subsp. paratuberculosis
guccaguccggcgugccaccg

SEQ ID NO: 788936 - RNA, 16 nt, Mycobacterium avium subsp. paratuberculosis
guccaggccggcgccg

SEQ ID NO: 788937 - RNA, 15 nt, Mycobacterium avium subsp. paratuberculosis
guccaggccgucgag

SEQ ID NO: 788938 - RNA, 22 nt, Mycobacterium avium subsp. paratuberculosis
guccagucgaugucgguggcgc

SEQ ID NO: 788939 - RNA, 16 nt, Mycobacterium avium subsp. paratuberculosis
guccagucgcgccgag

SEQ ID NO: 788940 - RNA, 15 nt, Mycobacterium avium subsp. paratuberculosis
guccagucggccgug

SEQ ID NO: 788941 - RNA, 16 nt, Mycobacterium avium subsp. paratuberculosis
guccagucggccguga

SEQ ID NO: 788942 - RNA, 14 nt, Mycobacterium avium subsp. paratuberculosis
guccagugacgccu

SEQ ID NO: 788943 - RNA, 16 nt, Mycobacterium avium subsp. paratuberculosis
guccagugacgccugc

SEQ ID NO: 788944 - RNA, 17 nt, Mycobacterium avium subsp. paratuberculosis
guccagugcaugccggc

SEQ ID NO: 788945 - RNA, 18 nt, Mycobacterium avium subsp. paratuberculosis
guccagugccggcgagug

SEQ ID NO: 788946 - RNA, 19 nt, Mycobacterium avium subsp. paratuberculosis
guccagugccggcgagugc

SEQ ID NO: 788947 - RNA, 14 nt, Mycobacterium avium subsp. paratuberculosis
guccaguucggcca

SEQ ID NO: 788948 - RNA, 15 nt, Mycobacterium avium subsp. paratuberculosis
guccaguucggccag

SEQ ID NO: 788949 - RNA, 18 nt, Mycobacterium avium subsp. paratuberculosis
guccaguucggccagcgc

SEQ ID NO: 788950 - RNA, 20 nt, Mycobacterium avium subsp. paratuberculosis
guccaguucggccagcgcgg

SEQ ID NO: 788951 - RNA, 16 nt, Mycobacterium avium subsp. paratuberculosis
guccaguugcggcacg

SEQ ID NO: 788952 - RNA, 19 nt, Mycobacterium avium subsp. paratuberculosis
guccccgccgguggcggcg

SEQ ID NO: 788953 - RNA, 19 nt, Mycobacterium avium subsp. paratuberculosis
guccccgccuucgaugccc

SEQ ID NO: 788954 - RNA, 14 nt, Mycobacterium avium subsp. paratuberculosis
guccccgcgcccgc

SEQ ID NO: 788955 - RNA, 16 nt, Mycobacterium avium subsp. paratuberculosis
guccccgcgcccgccg

SEQ ID NO: 788956 - RNA, 17 nt, Mycobacterium avium subsp. paratuberculosis
guccccgcgcccgccgc

SEQ ID NO: 788957 - RNA, 14 nt, Mycobacterium avium subsp. paratuberculosis
guccccgcgccggg

SEQ ID NO: 788958 - RNA, 13 nt, Mycobacterium avium subsp. paratuberculosis
guccaucgccgcg

SEQ ID NO: 788959 - RNA, 18 nt, Mycobacterium avium subsp. paratuberculosis
guccaucgccgcgcaccc

SEQ ID NO: 788960 - RNA, 13 nt, Mycobacterium avium subsp. paratuberculosis
guccaucagcacc

SEQ ID NO: 788961 - RNA, 14 nt, Mycobacterium avium subsp. paratuberculosis
guccaucagcaccg

SEQ ID NO: 788962 - RNA, 15 nt, Mycobacterium avium subsp. paratuberculosis
guccauccagcgccg

SEQ ID NO: 788963 - RNA, 15 nt, Mycobacterium avium subsp. paratuberculosis
guccgcccagcgagu

SEQ ID NO: 788964 - RNA, 16 nt, Mycobacterium avium subsp. paratuberculosis
guccgccgacagcggg

SEQ ID NO: 788965 - RNA, 19 nt, Mycobacterium avium subsp. paratuberculosis
guccgccccgaugcgcauc

SEQ ID NO: 788966 - RNA, 19 nt, Mycobacterium avium subsp. paratuberculosis
guccgccccgcugccggac

SEQ ID NO: 788967 - RNA, 20 nt, Mycobacterium avium subsp. paratuberculosis
guccgccccgcugccggacc

SEQ ID NO: 788968 - RNA, 21 nt, Mycobacterium avium subsp. paratuberculosis
guccgcccacuucgacgguga

SEQ ID NO: 788969 - RNA, 15 nt, Mycobacterium avium subsp. paratuberculosis
guccgcccagacgcg

SEQ ID NO: 788970 - RNA, 16 nt, Mycobacterium avium subsp. paratuberculosis
guccgcccagacgcgg

SEQ ID NO: 788971 - RNA, 12 nt, Mycobacterium avium subsp. paratuberculosis
guccgacaccac

SEQ ID NO: 788972 - RNA, 15 nt, Mycobacterium avium subsp. paratuberculosis
guccgacaccaccug

SEQ ID NO: 788973 - RNA, 17 nt, Mycobacterium avium subsp. paratuberculosis
guccgacaccaccugca

SEQ ID NO: 788974 - RNA, 21 nt, Mycobacterium avium subsp. paratuberculosis
gucccugcggcugcaucaugc

SEQ ID NO: 788975 - RNA, 16 nt, Mycobacterium avium subsp. paratuberculosis
gucccuguucgcgccg

SEQ ID NO: 788976 - RNA, 18 nt, Mycobacterium avium subsp. paratuberculosis
gucccuguucgcgccggu

SEQ ID NO: 788977 - RNA, 22 nt, Mycobacterium avium subsp. paratuberculosis
gucccuuugcuguucgucgagu

SEQ ID NO: 788978 - RNA, 21 nt, Mycobacterium avium subsp. paratuberculosis
guccgaaacaucaaacggcag

SEQ ID NO: 788979 - RNA, 20 nt, Mycobacterium avium subsp. paratuberculosis
gucccucggcgagcgaggcc

SEQ ID NO: 788980 - RNA, 23 nt, Mycobacterium avium subsp. paratuberculosis
gucccucgucuuggugcgagcca

SEQ ID NO: 788981 - RNA, 15 nt, Mycobacterium avium subsp. paratuberculosis
gucccgcggcggcgc

SEQ ID NO: 788982 - RNA, 20 nt, Mycobacterium avium subsp. paratuberculosis
gucccggaagugccggcgaa

SEQ ID NO: 788983 - RNA, 19 nt, Mycobacterium avium subsp. paratuberculosis
gucccguugcgggacuggg

SEQ ID NO: 788984 - RNA, 22 nt, Mycobacterium avium subsp. paratuberculosis
gucccguugcgggacugggcga

SEQ ID NO: 788985 - RNA, 13 nt, Mycobacterium avium subsp. paratuberculosis
gucccguuggcgc

SEQ ID NO: 788986 - RNA, 17 nt, Mycobacterium avium subsp. paratuberculosis
gucccguuggcgccggu

SEQ ID NO: 788987 - RNA, 17 nt, Mycobacterium avium subsp. paratuberculosis
guccgccgucaucggcg

SEQ ID NO: 788988 - RNA, 18 nt, Mycobacterium avium subsp. paratuberculosis
guccgccuccgaccagcc

SEQ ID NO: 788989 - RNA, 19 nt, Mycobacterium avium subsp. paratuberculosis
guccgccuccgaccagccg

SEQ ID NO: 788990 - RNA, 19 nt, Mycobacterium avium subsp. paratuberculosis
guccgccggagaccagcag

SEQ ID NO: 788991 - RNA, 15 nt, Mycobacterium avium subsp. paratuberculosis
guccgccgggcgcga

SEQ ID NO: 788992 - RNA, 23 nt, Mycobacterium avium subsp. paratuberculosis
guccgccggcuggcgggcgaucg

SEQ ID NO: 788993 - RNA, 15 nt, Mycobacterium avium subsp. paratuberculosis
guccgccggccgguc

SEQ ID NO: 788994 - RNA, 16 nt, Mycobacterium avium subsp. paratuberculosis
guccgccgcagcggcg

SEQ ID NO: 788995 - RNA, 21 nt, Mycobacterium avium subsp. paratuberculosis
guccgccgcagcggcgccgca

SEQ ID NO: 788996 - RNA, 11 nt, Mycobacterium avium subsp. paratuberculosis
guccgccgccg

SEQ ID NO: 788997 - RNA, 13 nt, Mycobacterium avium subsp. paratuberculosis
guccgccgccggc

SEQ ID NO: 788998 - RNA, 15 nt, Mycobacterium avium subsp. paratuberculosis
guccgccgccggcgg

SEQ ID NO: 788999 - RNA, 14 nt, Mycobacterium avium subsp. paratuberculosis
guccgccgccgucc

SEQ ID NO: 789000 - RNA, 22 nt, Mycobacterium avium subsp. paratuberculosis
guccgccgccgucccaccggcg

SEQ ID NO: 789001 - RNA, 18 nt, Mycobacterium avium subsp. paratuberculosis
guccgcgcccacccgaug

SEQ ID NO: 789002 - RNA, 19 nt, Mycobacterium avium subsp. paratuberculosis
guccgcgaacgggugcggc

SEQ ID NO: 789003 - RNA, 17 nt, Mycobacterium avium subsp. paratuberculosis
guccgcgaacucgucga

SEQ ID NO: 789004 - RNA, 18 nt, Mycobacterium avium subsp. paratuberculosis
guccgcgaacucgucgac

SEQ ID NO: 789005 - RNA, 22 nt, Mycobacterium avium subsp. paratuberculosis
guccgcgaacucgucgacgccc

SEQ ID NO: 789006 - RNA, 23 nt, Mycobacterium avium subsp. paratuberculosis
guccgcgaacucgucgacgccca

SEQ ID NO: 789007 - RNA, 20 nt, Mycobacterium avium subsp. paratuberculosis
guccgccgucggggugcggu

SEQ ID NO: 789008 - RNA, 14 nt, Mycobacterium avium subsp. paratuberculosis
guccgcgacgcuga

SEQ ID NO: 789009 - RNA, 15 nt, Mycobacterium avium subsp. paratuberculosis
guccgcgaggaaucg

SEQ ID NO: 789010 - RNA, 14 nt, Mycobacterium avium subsp. paratuberculosis
guccgcgccggcgc

SEQ ID NO: 789011 - RNA, 13 nt, Mycobacterium avium subsp. paratuberculosis
guccgcgccgguc

SEQ ID NO: 789012 - RNA, 14 nt, Mycobacterium avium subsp. paratuberculosis
guccgcgccggucc

SEQ ID NO: 789013 - RNA, 16 nt, Mycobacterium avium subsp. paratuberculosis
guccgcgcgaccauca

SEQ ID NO: 789014 - RNA, 20 nt, Mycobacterium avium subsp. paratuberculosis
guccgcgcgagaguaucgcc

SEQ ID NO: 789015 - RNA, 22 nt, Mycobacterium avium subsp. paratuberculosis
guccgcgcgagaguaucgccac

SEQ ID NO: 789016 - RNA, 15 nt, Mycobacterium avium subsp. paratuberculosis
guccggcgaauccga

SEQ ID NO: 789017 - RNA, 20 nt, Mycobacterium avium subsp. paratuberculosis
guccggcgaauccgaccggc

SEQ ID NO: 789018 - RNA, 19 nt, Mycobacterium avium subsp. paratuberculosis
guccggcgaguacccgccg

SEQ ID NO: 789019 - RNA, 21 nt, Mycobacterium avium subsp. paratuberculosis
guccggcgaguacccgccgca

SEQ ID NO: 789020 - RNA, 14 nt, Mycobacterium avium subsp. paratuberculosis
guccggcgccacga

SEQ ID NO: 789021 - RNA, 16 nt, Mycobacterium avium subsp. paratuberculosis
guccggcgccacgacu

SEQ ID NO: 789022 - RNA, 14 nt, Mycobacterium avium subsp. paratuberculosis
guccggcgcccgau

SEQ ID NO: 789023 - RNA, 17 nt, Mycobacterium avium subsp. paratuberculosis
guccggcgcccgaucgg

SEQ ID NO: 789024 - RNA, 18 nt, Mycobacterium avium subsp. paratuberculosis
guccggcgcccgaucggc

SEQ ID NO: 789025 - RNA, 21 nt, Mycobacterium avium subsp. paratuberculosis
guccggcgcuacgccggcucg

SEQ ID NO: 789026 - RNA, 12 nt, Mycobacterium avium subsp. paratuberculosis
guccggcggcaa

SEQ ID NO: 789027 - RNA, 18 nt, Mycobacterium avium subsp. paratuberculosis
guccggcggcaccacccg

SEQ ID NO: 789028 - RNA, 19 nt, Mycobacterium avium subsp. paratuberculosis
guccggcggcaccacccgc

SEQ ID NO: 789029 - RNA, 18 nt, Mycobacterium avium subsp. paratuberculosis
guccggcgcgaccagguu

SEQ ID NO: 789030 - RNA, 15 nt, Mycobacterium avium subsp. paratuberculosis
guccggcgcgcccgg

SEQ ID NO: 789031 - RNA, 13 nt, Mycobacterium avium subsp. paratuberculosis
guccggcgccgac

SEQ ID NO: 789032 - RNA, 23 nt, Mycobacterium avium subsp. paratuberculosis
guccggcgccgacccccgccgcg

SEQ ID NO: 789033 - RNA, 13 nt, Mycobacterium avium subsp. paratuberculosis
guccggccggccg

SEQ ID NO: 789034 - RNA, 14 nt, Mycobacterium avium subsp. paratuberculosis
guccggccggccga

SEQ ID NO: 789035 - RNA, 17 nt, Mycobacterium avium subsp. paratuberculosis
guccggccggccgaaca

SEQ ID NO: 789036 - RNA, 22 nt, Mycobacterium avium subsp. paratuberculosis
guccggccgugaugcgccggcg

SEQ ID NO: 789037 - RNA, 13 nt, Mycobacterium avium subsp. paratuberculosis
guccggccgugcc

SEQ ID NO: 789038 - RNA, 15 nt, Mycobacterium avium subsp. paratuberculosis
guccggcccggcguc

SEQ ID NO: 789039 - RNA, 16 nt, Mycobacterium avium subsp. paratuberculosis
guccggcccggcgucc

SEQ ID NO: 789040 - RNA, 16 nt, Mycobacterium avium subsp. paratuberculosis
guccggcccuggucgg

SEQ ID NO: 789041 - RNA, 19 nt, Mycobacterium avium subsp. paratuberculosis
guccggcccuggucggcca

SEQ ID NO: 789042 - RNA, 13 nt, Mycobacterium avium subsp. paratuberculosis
guccggccagcgu

SEQ ID NO: 789043 - RNA, 17 nt, Mycobacterium avium subsp. paratuberculosis
guccggccagguccaca

SEQ ID NO: 789044 - RNA, 18 nt, Mycobacterium avium subsp. paratuberculosis
guccggccaggucgccgc

SEQ ID NO: 789045 - RNA, 19 nt, Mycobacterium avium subsp. paratuberculosis
guccggccaggucgccgcg

SEQ ID NO: 789046 - RNA, 21 nt, Mycobacterium avium subsp. paratuberculosis
guccggccaggucgccgcgca

SEQ ID NO: 789047 - RNA, 14 nt, Mycobacterium avium subsp. paratuberculosis
guccggcagcgcgc

SEQ ID NO: 789048 - RNA, 21 nt, Mycobacterium avium subsp. paratuberculosis
guccggcaggcucagcagcac

SEQ ID NO: 789049 - RNA, 15 nt, Mycobacterium avium subsp. paratuberculosis
guccggccacgaccu

SEQ ID NO: 789050 - RNA, 16 nt, Mycobacterium avium subsp. paratuberculosis
guccggcagcagcgag

SEQ ID NO: 789051 - RNA, 19 nt, Mycobacterium avium subsp. paratuberculosis
guccggcagcagcgagucg

SEQ ID NO: 789052 - RNA, 15 nt, Mycobacterium avium subsp. paratuberculosis
guccggaugcggcgc

SEQ ID NO: 789053 - RNA, 19 nt, Mycobacterium avium subsp. paratuberculosis
guccggaugcggcgcccac

SEQ ID NO: 789054 - RNA, 15 nt, Mycobacterium avium subsp. paratuberculosis
guccggagcgaaggu

SEQ ID NO: 789055 - RNA, 19 nt, Mycobacterium avium subsp. paratuberculosis
guccggagcgaaggugccg

SEQ ID NO: 789056 - RNA, 23 nt, Mycobacterium avium subsp. paratuberculosis
guccggagaaccgcucgauggcg

SEQ ID NO: 789057 - RNA, 15 nt, Mycobacterium avium subsp. paratuberculosis
guccggaaccgcgcc

SEQ ID NO: 789058 - RNA, 21 nt, Mycobacterium avium subsp. paratuberculosis
guccggaagcccuugcagcac

SEQ ID NO: 789059 - RNA, 22 nt, Mycobacterium avium subsp. paratuberculosis
guccggaagcccuugcagcaca

SEQ ID NO: 789060 - RNA, 17 nt, Mycobacterium avium subsp. paratuberculosis
guccgcuccaccagcgc

SEQ ID NO: 789061 - RNA, 18 nt, Mycobacterium avium subsp. paratuberculosis
guccgcuccaccagcgcg

SEQ ID NO: 789062 - RNA, 17 nt, Mycobacterium avium subsp. paratuberculosis
guccgcugugcggcccg

SEQ ID NO: 789063 - RNA, 13 nt, Mycobacterium avium subsp. paratuberculosis
guccgcggccgcg

SEQ ID NO: 789064 - RNA, 20 nt, Mycobacterium avium subsp. paratuberculosis
guccgcggccgcggcgcgca

SEQ ID NO: 789065 - RNA, 13 nt, Mycobacterium avium subsp. paratuberculosis
guccgcggcggcg

SEQ ID NO: 789066 - RNA, 13 nt, Mycobacterium avium subsp. paratuberculosis
guccgcggcgucg

SEQ ID NO: 789067 - RNA, 20 nt, Mycobacterium avium subsp. paratuberculosis
guccgcgggaauuggcaccg

SEQ ID NO: 789068 - RNA, 16 nt, Mycobacterium avium subsp. paratuberculosis
guccgcgggcggggcc

SEQ ID NO: 789069 - RNA, 14 nt, Mycobacterium avium subsp. paratuberculosis
guccgcgcguagug

SEQ ID NO: 789070 - RNA, 21 nt, Mycobacterium avium subsp. paratuberculosis
guccgcgcguagugcucgcgc

SEQ ID NO: 789071 - RNA, 23 nt, Mycobacterium avium subsp. paratuberculosis
guccgcgcguagugcucgcgcag

SEQ ID NO: 789072 - RNA, 17 nt, Mycobacterium avium subsp. paratuberculosis
guccgcggaggcgagca

SEQ ID NO: 789073 - RNA, 20 nt, Mycobacterium avium subsp. paratuberculosis
guccgcggaggcgagcagcc

SEQ ID NO: 789074 - RNA, 22 nt, Mycobacterium avium subsp. paratuberculosis
guccgcggaggcgagcagccgg

SEQ ID NO: 789075 - RNA, 19 nt, Mycobacterium avium subsp. paratuberculosis
guccgcggugagcaccgga

SEQ ID NO: 789076 - RNA, 20 nt, Mycobacterium avium subsp. paratuberculosis
guccgcgguuuggucagcgc

SEQ ID NO: 789077 - RNA, 18 nt, Mycobacterium avium subsp. paratuberculosis
guccgugccacggccgcg

SEQ ID NO: 789078 - RNA, 17 nt, Mycobacterium avium subsp. paratuberculosis
guccgugccguccggcc

SEQ ID NO: 789079 - RNA, 16 nt, Mycobacterium avium subsp. paratuberculosis
guccgugcugccggcc

SEQ ID NO: 789080 - RNA, 17 nt, Mycobacterium avium subsp. paratuberculosis
guccgugcugccggccg

SEQ ID NO: 789081 - RNA, 19 nt, Mycobacterium avium subsp. paratuberculosis
guccgugcugccggccggc

SEQ ID NO: 789082 - RNA, 20 nt, Mycobacterium avium subsp. paratuberculosis
guccgguucgaccggcguca

SEQ ID NO: 789083 - RNA, 15 nt, Mycobacterium avium subsp. paratuberculosis
guccgguucggcggc

SEQ ID NO: 789084 - RNA, 17 nt, Mycobacterium avium subsp. paratuberculosis
guccgguucggcggcau

SEQ ID NO: 789085 - RNA, 20 nt, Mycobacterium avium subsp. paratuberculosis
guccguagugcucggcgucc

SEQ ID NO: 789086 - RNA, 21 nt, Mycobacterium avium subsp. paratuberculosis
guccguagugcucggcguccc

SEQ ID NO: 789087 - RNA, 14 nt, Mycobacterium avium subsp. paratuberculosis
guccggucagcacc

SEQ ID NO: 789088 - RNA, 16 nt, Mycobacterium avium subsp. paratuberculosis
guccggucagcaccgc

SEQ ID NO: 789089 - RNA, 21 nt, Mycobacterium avium subsp. paratuberculosis
guccggucagcaccgcgcggc

SEQ ID NO: 789090 - RNA, 16 nt, Mycobacterium avium subsp. paratuberculosis
guccgguaggccggcc

SEQ ID NO: 789091 - RNA, 16 nt, Mycobacterium avium subsp. paratuberculosis
guccgguaggcguugu

SEQ ID NO: 789092 - RNA, 20 nt, Mycobacterium avium subsp. paratuberculosis
guccgguaggugaucgccuc

SEQ ID NO: 789093 - RNA, 18 nt, Mycobacterium avium subsp. paratuberculosis
guccggguugggcgccug

SEQ ID NO: 789094 - RNA, 18 nt, Mycobacterium avium subsp. paratuberculosis
guccgggugcgggcugac

SEQ ID NO: 789095 - RNA, 17 nt, Mycobacterium avium subsp. paratuberculosis
guccgggcgcugcgcgg

SEQ ID NO: 789096 - RNA, 16 nt, Mycobacterium avium subsp. paratuberculosis
guccgggcacucgagc

SEQ ID NO: 789097 - RNA, 17 nt, Mycobacterium avium subsp. paratuberculosis
guccggggccggugcgu

SEQ ID NO: 789098 - RNA, 21 nt, Mycobacterium avium subsp. paratuberculosis
guccggggccggugcguccgc

SEQ ID NO: 789099 - RNA, 14 nt, Mycobacterium avium subsp. paratuberculosis
guccggggugcccu

SEQ ID NO: 789100 - RNA, 16 nt, Mycobacterium avium subsp. paratuberculosis
guccggggugggcacg

SEQ ID NO: 789101 - RNA, 20 nt, Mycobacterium avium subsp. paratuberculosis
guccggggugggcacgucgg

SEQ ID NO: 789102 - RNA, 22 nt, Mycobacterium avium subsp. paratuberculosis
guccggggugggcacgucggcc

SEQ ID NO: 789103 - RNA, 19 nt, Mycobacterium avium subsp. paratuberculosis
guccgggguguaggcgucg

SEQ ID NO: 789104 - RNA, 23 nt, Mycobacterium avium subsp. paratuberculosis
guccgggguguaggcgucggcgg

SEQ ID NO: 789105 - RNA, 15 nt, Mycobacterium avium subsp. paratuberculosis
guccgggccgccggc

SEQ ID NO: 789106 - RNA, 19 nt, Mycobacterium avium subsp. paratuberculosis
guccgggccgccggccgcg

SEQ ID NO: 789107 - RNA, 14 nt, Mycobacterium avium subsp. paratuberculosis
guccgggcguagug

SEQ ID NO: 789108 - RNA, 15 nt, Mycobacterium avium subsp. paratuberculosis
guccggcgugccacc

SEQ ID NO: 789109 - RNA, 19 nt, Mycobacterium avium subsp. paratuberculosis
guccggcgugccaccgcug

SEQ ID NO: 789110 - RNA, 14 nt, Mycobacterium avium subsp. paratuberculosis
guccggcggucagc

SEQ ID NO: 789111 - RNA, 21 nt, Mycobacterium avium subsp. paratuberculosis
guccggcggucagcaccguca

SEQ ID NO: 789112 - RNA, 14 nt, Mycobacterium avium subsp. paratuberculosis
guccggcggucgcu

SEQ ID NO: 789113 - RNA, 18 nt, Mycobacterium avium subsp. paratuberculosis
guccggcggucgcugcag

SEQ ID NO: 789114 - RNA, 20 nt, Mycobacterium avium subsp. paratuberculosis
guccggcggucgcugcagcg

SEQ ID NO: 789115 - RNA, 22 nt, Mycobacterium avium subsp. paratuberculosis
guccggcugaacgccagcagcc

SEQ ID NO: 789116 - RNA, 14 nt, Mycobacterium avium subsp. paratuberculosis
guccggcuggucgg

SEQ ID NO: 789117 - RNA, 17 nt, Mycobacterium avium subsp. paratuberculosis
guccggcuucaccguca

SEQ ID NO: 789118 - RNA, 20 nt, Mycobacterium avium subsp. paratuberculosis
guccgggauaguucgccgcc

SEQ ID NO: 789119 - RNA, 21 nt, Mycobacterium avium subsp. paratuberculosis
guccgggauaguucgccgccg

SEQ ID NO: 789120 - RNA, 18 nt, Mycobacterium avium subsp. paratuberculosis
guccgggaugacaccgcg

SEQ ID NO: 789121 - RNA, 20 nt, Mycobacterium avium subsp. paratuberculosis
guccgggcacccgacgucga

SEQ ID NO: 789122 - RNA, 17 nt, Mycobacterium avium subsp. paratuberculosis
guccucugcgaccaccc

SEQ ID NO: 789123 - RNA, 20 nt, Mycobacterium avium subsp. paratuberculosis
guccugcaccgacugcggcg

SEQ ID NO: 789124 - RNA, 19 nt, Mycobacterium avium subsp. paratuberculosis
guccugcaggcaggccggc

SEQ ID NO: 789125 - RNA, 16 nt, Mycobacterium avium subsp. paratuberculosis
guccugcagcucgccg

SEQ ID NO: 789126 - RNA, 14 nt, Mycobacterium avium subsp. paratuberculosis
guccugcagcagcc

SEQ ID NO: 789127 - RNA, 17 nt, Mycobacterium avium subsp. paratuberculosis
guccugcagcagccgga

SEQ ID NO: 789128 - RNA, 15 nt, Mycobacterium avium subsp. paratuberculosis
guccugcagcgccgu

SEQ ID NO: 789129 - RNA, 23 nt, Mycobacterium avium subsp. paratuberculosis
guccugcagcgccguccgcaccg

SEQ ID NO: 789130 - RNA, 20 nt, Mycobacterium avium subsp. paratuberculosis
guccucgccguacgcgccgg

SEQ ID NO: 789131 - RNA, 21 nt, Mycobacterium avium subsp. paratuberculosis
guccucgccguacgcgccggc

SEQ ID NO: 789132 - RNA, 12 nt, Mycobacterium avium subsp. paratuberculosis
guccucgcgguu

SEQ ID NO: 789133 - RNA, 16 nt, Mycobacterium avium subsp. paratuberculosis
guccucgcgucgcgcg

SEQ ID NO: 789134 - RNA, 17 nt, Mycobacterium avium subsp. paratuberculosis
guccucgcgucgcgcgg

SEQ ID NO: 789135 - RNA, 18 nt, Mycobacterium avium subsp. paratuberculosis
guccucgcgucgcgcggu

SEQ ID NO: 789136 - RNA, 17 nt, Mycobacterium avium subsp. paratuberculosis
guccucggacucgucgc

SEQ ID NO: 789137 - RNA, 16 nt, Mycobacterium avium subsp. paratuberculosis
guccucggccgccacc

SEQ ID NO: 789138 - RNA, 17 nt, Mycobacterium avium subsp. paratuberculosis
guccucggccgccaccg

SEQ ID NO: 789139 - RNA, 19 nt, Mycobacterium avium subsp. paratuberculosis
guccucggccgccaccgcc

SEQ ID NO: 789140 - RNA, 14 nt, Mycobacterium avium subsp. paratuberculosis
guccucggcgaugu

SEQ ID NO: 789141 - RNA, 13 nt, Mycobacterium avium subsp. paratuberculosis
guccucucggcgc

SEQ ID NO: 789142 - RNA, 14 nt, Mycobacterium avium subsp. paratuberculosis
guccucucggcgcc

SEQ ID NO: 789143 - RNA, 15 nt, Mycobacterium avium subsp. paratuberculosis
guccucucggcgccg

SEQ ID NO: 789144 - RNA, 22 nt, Mycobacterium avium subsp. paratuberculosis
guccguuggaggugaucgccag

SEQ ID NO: 789145 - RNA, 19 nt, Mycobacterium avium subsp. paratuberculosis
guccguugggggcgccgcg

SEQ ID NO: 789146 - RNA, 23 nt, Mycobacterium avium subsp. paratuberculosis
guccguugggggcgccgcggcgc

SEQ ID NO: 789147 - RNA, 17 nt, Mycobacterium avium subsp. paratuberculosis
guccguggugaucgccg

SEQ ID NO: 789148 - RNA, 21 nt, Mycobacterium avium subsp. paratuberculosis
guccguggugaucgccgcgga

SEQ ID NO: 789149 - RNA, 14 nt, Mycobacterium avium subsp. paratuberculosis
guccguucggcggu

SEQ ID NO: 789150 - RNA, 15 nt, Mycobacterium avium subsp. paratuberculosis
guccucccagcgccc

SEQ ID NO: 789151 - RNA, 16 nt, Mycobacterium avium subsp. paratuberculosis
guccucccagcgcccg

SEQ ID NO: 789152 - RNA, 23 nt, Mycobacterium avium subsp. paratuberculosis
guccucccagcgcccgggcgcgu

SEQ ID NO: 789153 - RNA, 20 nt, Mycobacterium avium subsp. paratuberculosis
guccucgaugacgccggaca

SEQ ID NO: 789154 - RNA, 22 nt, Mycobacterium avium subsp. paratuberculosis
guccucgaugacgccggacagc

SEQ ID NO: 789155 - RNA, 16 nt, Mycobacterium avium subsp. paratuberculosis
guccucgauggcggcg

SEQ ID NO: 789156 - RNA, 18 nt, Mycobacterium avium subsp. paratuberculosis
guccucgauggcggcggc

SEQ ID NO: 789157 - RNA, 22 nt, Mycobacterium avium subsp. paratuberculosis
guccucgaucaccgacagcgcg

SEQ ID NO: 789158 - RNA, 22 nt, Mycobacterium avium subsp. paratuberculosis
guccucgauccgguccagcccg

SEQ ID NO: 789159 - RNA, 21 nt, Mycobacterium avium subsp. paratuberculosis
guccuccccgcuggcgccggc

SEQ ID NO: 789160 - RNA, 15 nt, Mycobacterium avium subsp. paratuberculosis
guccucgaccacccg

SEQ ID NO: 789161 - RNA, 23 nt, Mycobacterium avium subsp. paratuberculosis
guccucgaccacccgcuggucaa

SEQ ID NO: 789162 - RNA, 14 nt, Mycobacterium avium subsp. paratuberculosis
guccuccgucgccu

SEQ ID NO: 789163 - RNA, 20 nt, Mycobacterium avium subsp. paratuberculosis
guccuccgucgccuucuggc

SEQ ID NO: 789164 - RNA, 17 nt, Mycobacterium avium subsp. paratuberculosis
guccuccuccucgucgc

SEQ ID NO: 789165 - RNA, 13 nt, Mycobacterium avium subsp. paratuberculosis
guccuccucgucc

SEQ ID NO: 789166 - RNA, 21 nt, Mycobacterium avium subsp. paratuberculosis
guccuccucguccgcggcggc

SEQ ID NO: 789167 - RNA, 16 nt, Mycobacterium avium subsp. paratuberculosis
guccuccugcgccggc

SEQ ID NO: 789168 - RNA, 15 nt, Mycobacterium avium subsp. paratuberculosis
guccuucuccgccgg

SEQ ID NO: 789169 - RNA, 18 nt, Mycobacterium avium subsp. paratuberculosis
guccuucuccgccgggcu

SEQ ID NO: 789170 - RNA, 16 nt, Mycobacterium avium subsp. paratuberculosis
guccuugaccagcugc

SEQ ID NO: 789171 - RNA, 19 nt, Mycobacterium avium subsp. paratuberculosis
guccuugagcccccaccug

SEQ ID NO: 789172 - RNA, 20 nt, Mycobacterium avium subsp. paratuberculosis
guccuugaggaugcgcacca

SEQ ID NO: 789173 - RNA, 20 nt, Mycobacterium avium subsp. paratuberculosis
guccuugagguagucgcgca

SEQ ID NO: 789174 - RNA, 18 nt, Mycobacterium avium subsp. paratuberculosis
guccuugauccgggcgcc

SEQ ID NO: 789175 - RNA, 22 nt, Mycobacterium avium subsp. paratuberculosis
guccuucaacuugcgcgacgcc

SEQ ID NO: 789176 - RNA, 15 nt, Mycobacterium avium subsp. paratuberculosis
guccuugccggcggc

SEQ ID NO: 789177 - RNA, 20 nt, Mycobacterium avium subsp. paratuberculosis
guccuggucgcuuucgguga

SEQ ID NO: 789178 - RNA, 21 nt, Mycobacterium avium subsp. paratuberculosis
gucgaaacccaggaacacggg

SEQ ID NO: 789179 - RNA, 18 nt, Mycobacterium avium subsp. paratuberculosis
gucgaaaccgucuccggc

SEQ ID NO: 789180 - RNA, 21 nt, Mycobacterium avium subsp. paratuberculosis
gucgaaacggcugcugcgcgg

SEQ ID NO: 789181 - RNA, 23 nt, Mycobacterium avium subsp. paratuberculosis
gucgaaaucggguccagcgccga

SEQ ID NO: 789182 - RNA, 18 nt, Mycobacterium avium subsp. paratuberculosis
guccuuggccgccagcac

SEQ ID NO: 789183 - RNA, 14 nt, Mycobacterium avium subsp. paratuberculosis
guccuugcgcacca

SEQ ID NO: 789184 - RNA, 15 nt, Mycobacterium avium subsp. paratuberculosis
guccuugcgcaccac

SEQ ID NO: 789185 - RNA, 16 nt, Mycobacterium avium subsp. paratuberculosis
guccuugcgcaccacg

SEQ ID NO: 789186 - RNA, 18 nt, Mycobacterium avium subsp. paratuberculosis
guccuugcgccccggcgg

SEQ ID NO: 789187 - RNA, 16 nt, Mycobacterium avium subsp. paratuberculosis
guccuugcgcgccgcg

SEQ ID NO: 789188 - RNA, 20 nt, Mycobacterium avium subsp. paratuberculosis
guccuuggugaugucgguga

SEQ ID NO: 789189 - RNA, 21 nt, Mycobacterium avium subsp. paratuberculosis
guccuuggugauuucgcgcac

SEQ ID NO: 789190 - RNA, 17 nt, Mycobacterium avium subsp. paratuberculosis
guccuugucgcgcaccg

SEQ ID NO: 789191 - RNA, 17 nt, Mycobacterium avium subsp. paratuberculosis
guccuggacgucgucgc

SEQ ID NO: 789192 - RNA, 23 nt, Mycobacterium avium subsp. paratuberculosis
guccuggcccccgccccagcccg

SEQ ID NO: 789193 - RNA, 18 nt, Mycobacterium avium subsp. paratuberculosis
guccuggcccuugaccgc

SEQ ID NO: 789194 - RNA, 16 nt, Mycobacterium avium subsp. paratuberculosis
guccuggaucagccag

SEQ ID NO: 789195 - RNA, 15 nt, Mycobacterium avium subsp. paratuberculosis
guccuggaucgcgca

SEQ ID NO: 789196 - RNA, 16 nt, Mycobacterium avium subsp. paratuberculosis
guccuggcgguggccc

SEQ ID NO: 789197 - RNA, 17 nt, Mycobacterium avium subsp. paratuberculosis
guccuggaugaacagca

SEQ ID NO: 789198 - RNA, 23 nt, Mycobacterium avium subsp. paratuberculosis
guccuggaugaacagcacgugcc

SEQ ID NO: 789199 - RNA, 18 nt, Mycobacterium avium subsp. paratuberculosis
guccugcgguucgggccc

SEQ ID NO: 789200 - RNA, 14 nt, Mycobacterium avium subsp. paratuberculosis
guccugcucggcga

SEQ ID NO: 789201 - RNA, 16 nt, Mycobacterium avium subsp. paratuberculosis
guccugcucggcgacg

SEQ ID NO: 789202 - RNA, 18 nt, Mycobacterium avium subsp. paratuberculosis
gucgaagucgaucccggg

SEQ ID NO: 789203 - RNA, 14 nt, Mycobacterium avium subsp. paratuberculosis
gucgaaguucggca

SEQ ID NO: 789204 - RNA, 15 nt, Mycobacterium avium subsp. paratuberculosis
gucgaaguacgccgu

SEQ ID NO: 789205 - RNA, 23 nt, Mycobacterium avium subsp. paratuberculosis
gucgaaggugaucuuguuguugg

SEQ ID NO: 789206 - RNA, 18 nt, Mycobacterium avium subsp. paratuberculosis
gucgaaggcggccgcgag

SEQ ID NO: 789207 - RNA, 19 nt, Mycobacterium avium subsp. paratuberculosis
gucgaaggcggccgcgagc

SEQ ID NO: 789208 - RNA, 17 nt, Mycobacterium avium subsp. paratuberculosis
gucgaagcgcagcaccu

SEQ ID NO: 789209 - RNA, 16 nt, Mycobacterium avium subsp. paratuberculosis
gucgaaggaggccagc

SEQ ID NO: 789210 - RNA, 17 nt, Mycobacterium avium subsp. paratuberculosis
gucgaagccguccaggc

SEQ ID NO: 789211 - RNA, 14 nt, Mycobacterium avium subsp. paratuberculosis
gucgaagccguggc

SEQ ID NO: 789212 - RNA, 17 nt, Mycobacterium avium subsp. paratuberculosis
gucgaagcccgccguca

SEQ ID NO: 789213 - RNA, 19 nt, Mycobacterium avium subsp. paratuberculosis
gucgaagaugucgcggcgc

SEQ ID NO: 789214 - RNA, 22 nt, Mycobacterium avium subsp. paratuberculosis
gucgaagaugucgcggcgcacg

SEQ ID NO: 789215 - RNA, 17 nt, Mycobacterium avium subsp. paratuberculosis
gucgaagagcuggucgc

SEQ ID NO: 789216 - RNA, 19 nt, Mycobacterium avium subsp. paratuberculosis
gucgaagaggugcucgacg

SEQ ID NO: 789217 - RNA, 19 nt, Mycobacterium avium subsp. paratuberculosis
gucgaagaccggugcgcgc

SEQ ID NO: 789218 - RNA, 17 nt, Mycobacterium avium subsp. paratuberculosis
gucgaagacgguccgcu

SEQ ID NO: 789219 - RNA, 17 nt, Mycobacterium avium subsp. paratuberculosis
gucgaacuggcgcaccg

SEQ ID NO: 789220 - RNA, 19 nt, Mycobacterium avium subsp. paratuberculosis
gucgaacuggcgcaccggg

SEQ ID NO: 789221 - RNA, 17 nt, Mycobacterium avium subsp. paratuberculosis
gucgaacucgggcccga

SEQ ID NO: 789222 - RNA, 17 nt, Mycobacterium avium subsp. paratuberculosis
gucgaacugcagccggc

SEQ ID NO: 789223 - RNA, 19 nt, Mycobacterium avium subsp. paratuberculosis
gucgaacgggccgggcacc

SEQ ID NO: 789224 - RNA, 13 nt, Mycobacterium avium subsp. paratuberculosis
gucgaacgcggcg

SEQ ID NO: 789225 - RNA, 16 nt, Mycobacterium avium subsp. paratuberculosis
gucgaacgcggcgaag

SEQ ID NO: 789226 - RNA, 17 nt, Mycobacterium avium subsp. paratuberculosis
gucgaacgcggcgccga

SEQ ID NO: 789227 - RNA, 21 nt, Mycobacterium avium subsp. paratuberculosis
gucgaacgcggcgccgacguc

SEQ ID NO: 789228 - RNA, 23 nt, Mycobacterium avium subsp. paratuberculosis
gucgaacgcggcgccgacguccu

SEQ ID NO: 789229 - RNA, 20 nt, Mycobacterium avium subsp. paratuberculosis
gucgaacgcguacacggccc

SEQ ID NO: 789230 - RNA, 17 nt, Mycobacterium avium subsp. paratuberculosis
gucgaacccgaccccgg

SEQ ID NO: 789231 - RNA, 18 nt, Mycobacterium avium subsp. paratuberculosis
gucgaacccgaccccggc

SEQ ID NO: 789232 - RNA, 21 nt, Mycobacterium avium subsp. paratuberculosis
gucgaacccgaccccggcgag

SEQ ID NO: 789233 - RNA, 22 nt, Mycobacterium avium subsp. paratuberculosis
gucgaaccgcgagcgcgcggug

SEQ ID NO: 789234 - RNA, 16 nt, Mycobacterium avium subsp. paratuberculosis
gucgaacgccagcgcc

SEQ ID NO: 789235 - RNA, 17 nt, Mycobacterium avium subsp. paratuberculosis
gucgaacgccagcgccg

SEQ ID NO: 789236 - RNA, 19 nt, Mycobacterium avium subsp. paratuberculosis
gucgaacgccagcgccgca

SEQ ID NO: 789237 - RNA, 21 nt, Mycobacterium avium subsp. paratuberculosis
gucgaacgccagcgccgcaac

SEQ ID NO: 789238 - RNA, 12 nt, Mycobacterium avium subsp. paratuberculosis
gucgaaccacgc

SEQ ID NO: 789239 - RNA, 15 nt, Mycobacterium avium subsp. paratuberculosis
gucgaaccacgcggc

SEQ ID NO: 789240 - RNA, 19 nt, Mycobacterium avium subsp. paratuberculosis
gucgaaccacgcggcggcg

SEQ ID NO: 789241 - RNA, 22 nt, Mycobacterium avium subsp. paratuberculosis
gucgaaccacgcggcggcggug

SEQ ID NO: 789242 - RNA, 17 nt, Mycobacterium avium subsp. paratuberculosis
gucgaacaggaugcagc

SEQ ID NO: 789243 - RNA, 21 nt, Mycobacterium avium subsp. paratuberculosis
gucgaacaggaugcagccggc

SEQ ID NO: 789244 - RNA, 21 nt, Mycobacterium avium subsp. paratuberculosis
gucgaacaacgcggugaccgc

SEQ ID NO: 789245 - RNA, 20 nt, Mycobacterium avium subsp. paratuberculosis
gucgaaauagcggcgcaccu

SEQ ID NO: 789246 - RNA, 18 nt, Mycobacterium avium subsp. paratuberculosis
gucgaacagcacgccggc

SEQ ID NO: 789247 - RNA, 17 nt, Mycobacterium avium subsp. paratuberculosis
gucgaacagcaggccca

SEQ ID NO: 789248 - RNA, 16 nt, Mycobacterium avium subsp. paratuberculosis
gucgaacagccgggcc

SEQ ID NO: 789249 - RNA, 20 nt, Mycobacterium avium subsp. paratuberculosis
gucgaacagccgggccgccc

SEQ ID NO: 789250 - RNA, 14 nt, Mycobacterium avium subsp. paratuberculosis
gucgaacagccggu

SEQ ID NO: 789251 - RNA, 15 nt, Mycobacterium avium subsp. paratuberculosis
gucgaacagcgcgcc

SEQ ID NO: 789252 - RNA, 17 nt, Mycobacterium avium subsp. paratuberculosis
gucgaacagcgcgcccg

SEQ ID NO: 789253 - RNA, 18 nt, Mycobacterium avium subsp. paratuberculosis
gucgaacagcgcgcccga

SEQ ID NO: 789254 - RNA, 19 nt, Mycobacterium avium subsp. paratuberculosis
gucgaacagcgcgcccgac

SEQ ID NO: 789255 - RNA, 14 nt, Mycobacterium avium subsp. paratuberculosis
gucgaacagcucga

SEQ ID NO: 789256 - RNA, 22 nt, Mycobacterium avium subsp. paratuberculosis
gucuggaugaucgucucggccg

SEQ ID NO: 789257 - RNA, 15 nt, Mycobacterium avium subsp. paratuberculosis
gucuggcagccggcc

SEQ ID NO: 789258 - RNA, 19 nt, Mycobacterium avium subsp. paratuberculosis
gucuggcagccggccggca

SEQ ID NO: 789259 - RNA, 23 nt, Mycobacterium avium subsp. paratuberculosis
gucugcuuugccuuagcccggcc

SEQ ID NO: 789260 - RNA, 14 nt, Mycobacterium avium subsp. paratuberculosis
gucugggaggcggc

SEQ ID NO: 789261 - RNA, 16 nt, Mycobacterium avium subsp. paratuberculosis
gucuggccccgucguc

SEQ ID NO: 789262 - RNA, 14 nt, Mycobacterium avium subsp. paratuberculosis
gucuggcccggugc

SEQ ID NO: 789263 - RNA, 13 nt, Mycobacterium avium subsp. paratuberculosis
gucugcuggcccg

SEQ ID NO: 789264 - RNA, 14 nt, Mycobacterium avium subsp. paratuberculosis
gucugcucggcggc

SEQ ID NO: 789265 - RNA, 22 nt, Mycobacterium avium subsp. paratuberculosis
gucugcucgccagacucacggc

SEQ ID NO: 789266 - RNA, 14 nt, Mycobacterium avium subsp. paratuberculosis
gucugcucgccggc

SEQ ID NO: 789267 - RNA, 15 nt, Mycobacterium avium subsp. paratuberculosis
gucugcucgccggcu

SEQ ID NO: 789268 - RNA, 14 nt, Mycobacterium avium subsp. paratuberculosis
gucugcucgccguc

SEQ ID NO: 789269 - RNA, 15 nt, Mycobacterium avium subsp. paratuberculosis
gucugcucgccguca

SEQ ID NO: 789270 - RNA, 13 nt, Mycobacterium avium subsp. paratuberculosis
gucugcucggcgg

SEQ ID NO: 789271 - RNA, 14 nt, Mycobacterium avium subsp. paratuberculosis
gucucggccgcggu

SEQ ID NO: 789272 - RNA, 19 nt, Mycobacterium avium subsp. paratuberculosis
gucucggaccgguaggcgc

SEQ ID NO: 789273 - RNA, 22 nt, Mycobacterium avium subsp. paratuberculosis
gucucggaccgguaggcgcacc

SEQ ID NO: 789274 - RNA, 24 nt, Mycobacterium avium subsp. paratuberculosis
gucucggaccgguaggcgcaccgc

SEQ ID NO: 789275 - RNA, 16 nt, Mycobacterium avium subsp. paratuberculosis
gucucggagcgguguc

SEQ ID NO: 789276 - RNA, 13 nt, Mycobacterium avium subsp. paratuberculosis
gucucgcgcaccu

SEQ ID NO: 789277 - RNA, 16 nt, Mycobacterium avium subsp. paratuberculosis
gucucgcgcagcacga

SEQ ID NO: 789278 - RNA, 17 nt, Mycobacterium avium subsp. paratuberculosis
gucucggcgccgucgcc

SEQ ID NO: 789279 - RNA, 13 nt, Mycobacterium avium subsp. paratuberculosis
gucucggcggccg

SEQ ID NO: 789280 - RNA, 17 nt, Mycobacterium avium subsp. paratuberculosis
gucucggcggcgcccag

SEQ ID NO: 789281 - RNA, 15 nt, Mycobacterium avium subsp. paratuberculosis
gucucggcgucucgg

SEQ ID NO: 789282 - RNA, 18 nt, Mycobacterium avium subsp. paratuberculosis
gucucgggcaccacgccg

SEQ ID NO: 789283 - RNA, 21 nt, Mycobacterium avium subsp. paratuberculosis
gucucgggcaccacgccgacg

SEQ ID NO: 789284 - RNA, 18 nt, Mycobacterium avium subsp. paratuberculosis
gucucgggcagcagcacc

SEQ ID NO: 789285 - RNA, 13 nt, Mycobacterium avium subsp. paratuberculosis
gucugcucgccag

SEQ ID NO: 789286 - RNA, 15 nt, Mycobacterium avium subsp. paratuberculosis
gucucgucggccgcg

SEQ ID NO: 789287 - RNA, 21 nt, Mycobacterium avium subsp. paratuberculosis
gucucgucggccgcgacgacc

SEQ ID NO: 789288 - RNA, 13 nt, Mycobacterium avium subsp. paratuberculosis
gucugcggccgcg

SEQ ID NO: 789289 - RNA, 14 nt, Mycobacterium avium subsp. paratuberculosis
gucugcggccgcga

SEQ ID NO: 789290 - RNA, 15 nt, Mycobacterium avium subsp. paratuberculosis
gucugcggccgcgac

SEQ ID NO: 789291 - RNA, 15 nt, Mycobacterium avium subsp. paratuberculosis
gucugcggccggggc

SEQ ID NO: 789292 - RNA, 17 nt, Mycobacterium avium subsp. paratuberculosis
gucugcggccggggcag

SEQ ID NO: 789293 - RNA, 15 nt, Mycobacterium avium subsp. paratuberculosis
gucugcggcucggcg

SEQ ID NO: 789294 - RNA, 18 nt, Mycobacterium avium subsp. paratuberculosis
gucugcgggaagcccacc

SEQ ID NO: 789295 - RNA, 21 nt, Mycobacterium avium subsp. paratuberculosis
gucugcgggaagcccaccgcg

SEQ ID NO: 789296 - RNA, 16 nt, Mycobacterium avium subsp. paratuberculosis
gucucguugugcaccg

SEQ ID NO: 789297 - RNA, 18 nt, Mycobacterium avium subsp. paratuberculosis
gucucguugugcaccggc

SEQ ID NO: 789298 - RNA, 22 nt, Mycobacterium avium subsp. paratuberculosis
gucucggugucggacuugucgc

SEQ ID NO: 789299 - RNA, 17 nt, Mycobacterium avium subsp. paratuberculosis
gucucggguuugccgac

SEQ ID NO: 789300 - RNA, 16 nt, Mycobacterium avium subsp. paratuberculosis
gucucggucgcggcgu

SEQ ID NO: 789301 - RNA, 17 nt, Mycobacterium avium subsp. paratuberculosis
gucguucagcugcagcc

SEQ ID NO: 789302 - RNA, 17 nt, Mycobacterium avium subsp. paratuberculosis
gucguucaugaucggca

SEQ ID NO: 789303 - RNA, 15 nt, Mycobacterium avium subsp. paratuberculosis
gucguguccgggccc

SEQ ID NO: 789304 - RNA, 15 nt, Mycobacterium avium subsp. paratuberculosis
gucguguucgccgag

SEQ ID NO: 789305 - RNA, 16 nt, Mycobacterium avium subsp. paratuberculosis
gucguguucgccgagg

SEQ ID NO: 789306 - RNA, 15 nt, Mycobacterium avium subsp. paratuberculosis
gucguucggccagca

SEQ ID NO: 789307 - RNA, 14 nt, Mycobacterium avium subsp. paratuberculosis
gucguucuccaucc

SEQ ID NO: 789308 - RNA, 21 nt, Mycobacterium avium subsp. paratuberculosis
gucuccucgaccagcgcgccg

SEQ ID NO: 789309 - RNA, 15 nt, Mycobacterium avium subsp. paratuberculosis
gucuccucgaccgcc

SEQ ID NO: 789310 - RNA, 16 nt, Mycobacterium avium subsp. paratuberculosis
gucuccuggccgccgu

SEQ ID NO: 789311 - RNA, 12 nt, Mycobacterium avium subsp. paratuberculosis
gucucgcccacc

SEQ ID NO: 789312 - RNA, 22 nt, Mycobacterium avium subsp. paratuberculosis
gucucgcccaccuuggcgucga

SEQ ID NO: 789313 - RNA, 16 nt, Mycobacterium avium subsp. paratuberculosis
gucucgaucuccaucc

SEQ ID NO: 789314 - RNA, 19 nt, Mycobacterium avium subsp. paratuberculosis
gucucgaucugcaccagcg

SEQ ID NO: 789315 - RNA, 21 nt, Mycobacterium avium subsp. paratuberculosis
gucucgaucugcaccagcgcg

SEQ ID NO: 789316 - RNA, 16 nt, Mycobacterium avium subsp. paratuberculosis
gucucgaugaccucgc

SEQ ID NO: 789317 - RNA, 15 nt, Mycobacterium avium subsp. paratuberculosis
gucucgaacacgccg

SEQ ID NO: 789318 - RNA, 22 nt, Mycobacterium avium subsp. paratuberculosis
gucucgaacacgccgucguggg

SEQ ID NO: 789319 - RNA, 16 nt, Mycobacterium avium subsp. paratuberculosis
gucucgagccggcgca

SEQ ID NO: 789320 - RNA, 18 nt, Mycobacterium avium subsp. paratuberculosis
gucucgagcuuccgccga

SEQ ID NO: 789321 - RNA, 14 nt, Mycobacterium avium subsp. paratuberculosis
gucucgacccgggc

SEQ ID NO: 789322 - RNA, 19 nt, Mycobacterium avium subsp. paratuberculosis
gucucgacccgggccagca

SEQ ID NO: 789323 - RNA, 18 nt, Mycobacterium avium subsp. paratuberculosis
gucucgaccgcggcgccg

SEQ ID NO: 789324 - RNA, 12 nt, Mycobacterium avium subsp. paratuberculosis
gucucgacggcg

SEQ ID NO: 789325 - RNA, 15 nt, Mycobacterium avium subsp. paratuberculosis
gucucgacggcgccg

SEQ ID NO: 789326 - RNA, 16 nt, Mycobacterium avium subsp. paratuberculosis
gucucgacggcgccga

SEQ ID NO: 789327 - RNA, 15 nt, Mycobacterium avium subsp. paratuberculosis
gucguggucgacgcc

SEQ ID NO: 789328 - RNA, 16 nt, Mycobacterium avium subsp. paratuberculosis
gucgugguggccgcga

SEQ ID NO: 789329 - RNA, 18 nt, Mycobacterium avium subsp. paratuberculosis
gucguggguauccgccgc

SEQ ID NO: 789330 - RNA, 19 nt, Mycobacterium avium subsp. paratuberculosis
gucguggguauccgccgcc

SEQ ID NO: 789331 - RNA, 21 nt, Mycobacterium avium subsp. paratuberculosis
gucguggguauccgccgccag

SEQ ID NO: 789332 - RNA, 16 nt, Mycobacterium avium subsp. paratuberculosis
gucgugggugacccgg

SEQ ID NO: 789333 - RNA, 22 nt, Mycobacterium avium subsp. paratuberculosis
gucgugauggcgaaccagcgcc

SEQ ID NO: 789334 - RNA, 15 nt, Mycobacterium avium subsp. paratuberculosis
gucguggcgccgagg

SEQ ID NO: 789335 - RNA, 16 nt, Mycobacterium avium subsp. paratuberculosis
gucgugcaacucccgc

SEQ ID NO: 789336 - RNA, 17 nt, Mycobacterium avium subsp. paratuberculosis
gucgugcaacucccgcg

SEQ ID NO: 789337 - RNA, 20 nt, Mycobacterium avium subsp. paratuberculosis
gucgugcaacucccgcgccg

SEQ ID NO: 789338 - RNA, 21 nt, Mycobacterium avium subsp. paratuberculosis
gucgugcaacucccgcgccgc

SEQ ID NO: 789339 - RNA, 24 nt, Mycobacterium avium subsp. paratuberculosis
gucgugcaacucccgcgccgcggc

SEQ ID NO: 789340 - RNA, 12 nt, Mycobacterium avium subsp. paratuberculosis
gucgugcaccac

SEQ ID NO: 789341 - RNA, 14 nt, Mycobacterium avium subsp. paratuberculosis
gucgugcaccacga

SEQ ID NO: 789342 - RNA, 21 nt, Mycobacterium avium subsp. paratuberculosis
gucgucuucuuggccgcggcc

SEQ ID NO: 789343 - RNA, 20 nt, Mycobacterium avium subsp. paratuberculosis
gucgugaaacauggcgcccg

SEQ ID NO: 789344 - RNA, 21 nt, Mycobacterium avium subsp. paratuberculosis
gucgucgucccaggguugccg

SEQ ID NO: 789345 - RNA, 14 nt, Mycobacterium avium subsp. paratuberculosis
gucuucucggccag

SEQ ID NO: 789346 - RNA, 18 nt, Mycobacterium avium subsp. paratuberculosis
gucuucuucagccgcagc

SEQ ID NO: 789347 - RNA, 15 nt, Mycobacterium avium subsp. paratuberculosis
gucuucuuggccgcg

SEQ ID NO: 789348 - RNA, 17 nt, Mycobacterium avium subsp. paratuberculosis
gucuucuuggccgcgcc

SEQ ID NO: 789349 - RNA, 21 nt, Mycobacterium avium subsp. paratuberculosis
gucuucuuggccgcgccgccg

SEQ ID NO: 789350 - RNA, 18 nt, Mycobacterium avium subsp. paratuberculosis
gucuucuuggcgggcgac

SEQ ID NO: 789351 - RNA, 19 nt, Mycobacterium avium subsp. paratuberculosis
gucuucggccaucgacucc

SEQ ID NO: 789352 - RNA, 21 nt, Mycobacterium avium subsp. paratuberculosis
gucuucggggauguagccgcc

SEQ ID NO: 789353 - RNA, 23 nt, Mycobacterium avium subsp. paratuberculosis
gucuucggggauguagccgccgg

SEQ ID NO: 789354 - RNA, 14 nt, Mycobacterium avium subsp. paratuberculosis
gucuucggggccgc

SEQ ID NO: 789355 - RNA, 17 nt, Mycobacterium avium subsp. paratuberculosis
gucuucggggccgccgu

SEQ ID NO: 789356 - RNA, 18 nt, Mycobacterium avium subsp. paratuberculosis
gucuucggggccgccguc

SEQ ID NO: 789357 - RNA, 18 nt, Mycobacterium avium subsp. paratuberculosis
gucuucggucccggcggg

SEQ ID NO: 789358 - RNA, 14 nt, Mycobacterium avium subsp. paratuberculosis
gucuucggucgcga

SEQ ID NO: 789359 - RNA, 20 nt, Mycobacterium avium subsp. paratuberculosis
gucugggcgaccaugccgcg

SEQ ID NO: 789360 - RNA, 12 nt, Mycobacterium avium subsp. paratuberculosis
gucuucgcgguc

SEQ ID NO: 789361 - RNA, 20 nt, Mycobacterium avium subsp. paratuberculosis
gucugguuggccggcggguu

SEQ ID NO: 789362 - RNA, 18 nt, Mycobacterium avium subsp. paratuberculosis
gugaagugccgguccagc

SEQ ID NO: 789363 - RNA, 21 nt, Mycobacterium avium subsp. paratuberculosis
gugaaguccaugaacggcagc

SEQ ID NO: 789364 - RNA, 22 nt, Mycobacterium avium subsp. paratuberculosis
gugaagucggugcccagcgcga

SEQ ID NO: 789365 - RNA, 20 nt, Mycobacterium avium subsp. paratuberculosis
gugaagucguccagcgucga

SEQ ID NO: 789366 - RNA, 18 nt, Mycobacterium avium subsp. paratuberculosis
gugaaguucuccagcacg

SEQ ID NO: 789367 - RNA, 19 nt, Mycobacterium avium subsp. paratuberculosis
gugaaguucuccagcacga

SEQ ID NO: 789368 - RNA, 16 nt, Mycobacterium avium subsp. paratuberculosis
gugaaguugccgguca

SEQ ID NO: 789369 - RNA, 13 nt, Mycobacterium avium subsp. paratuberculosis
gugaagcggcgcg

SEQ ID NO: 789370 - RNA, 23 nt, Mycobacterium avium subsp. paratuberculosis
gugaagcggcgcgggucgcgguu

SEQ ID NO: 789371 - RNA, 20 nt, Mycobacterium avium subsp. paratuberculosis
gugaagcuaguuucacguuc

SEQ ID NO: 789372 - RNA, 21 nt, Mycobacterium avium subsp. paratuberculosis
gugaagcuaguuucacguucg

SEQ ID NO: 789373 - RNA, 20 nt, Mycobacterium avium subsp. paratuberculosis
gugaagcugccgaccaggaa

SEQ ID NO: 789374 - RNA, 15 nt, Mycobacterium avium subsp. paratuberculosis
gugaagggcccgccg

SEQ ID NO: 789375 - RNA, 18 nt, Mycobacterium avium subsp. paratuberculosis
gugaagggcccgccggug

SEQ ID NO: 789376 - RNA, 15 nt, Mycobacterium avium subsp. paratuberculosis
gugaaggugcccucc

SEQ ID NO: 789377 - RNA, 19 nt, Mycobacterium avium subsp. paratuberculosis
gucuugaucaggucgccga

SEQ ID NO: 789378 - RNA, 16 nt, Mycobacterium avium subsp. paratuberculosis
gugaagcccagcgcgu

SEQ ID NO: 789379 - RNA, 16 nt, Mycobacterium avium subsp. paratuberculosis
gugaagccguugucga

SEQ ID NO: 789380 - RNA, 13 nt, Mycobacterium avium subsp. paratuberculosis
gugacaucgccac

SEQ ID NO: 789381 - RNA, 14 nt, Mycobacterium avium subsp. paratuberculosis
gugacaucgccacc

SEQ ID NO: 789382 - RNA, 15 nt, Mycobacterium avium subsp. paratuberculosis
gugaccaaugcggug

SEQ ID NO: 789383 - RNA, 21 nt, Mycobacterium avium subsp. paratuberculosis
gugaccaccugcaccugcggc

SEQ ID NO: 789384 - RNA, 19 nt, Mycobacterium avium subsp. paratuberculosis
gugaccacgcugagcaacc

SEQ ID NO: 789385 - RNA, 20 nt, Mycobacterium avium subsp. paratuberculosis
gugaccagccacauguucuc

SEQ ID NO: 789386 - RNA, 13 nt, Mycobacterium avium subsp. paratuberculosis
gugaccagcgccc

SEQ ID NO: 789387 - RNA, 15 nt, Mycobacterium avium subsp. paratuberculosis
gugaccagcgccccc

SEQ ID NO: 789388 - RNA, 15 nt, Mycobacterium avium subsp. paratuberculosis
gugaccagcgugacg

SEQ ID NO: 789389 - RNA, 14 nt, Mycobacterium avium subsp. paratuberculosis
gugaccacggucgg

SEQ ID NO: 789390 - RNA, 15 nt, Mycobacterium avium subsp. paratuberculosis
gugaccaucgggucg

SEQ ID NO: 789391 - RNA, 19 nt, Mycobacterium avium subsp. paratuberculosis
gugaccaucgggucgucgg

SEQ ID NO: 789392 - RNA, 19 nt, Mycobacterium avium subsp. paratuberculosis
gugaccccguugcacaggc

SEQ ID NO: 789393 - RNA, 20 nt, Mycobacterium avium subsp. paratuberculosis
gugaccccguugcacaggca

SEQ ID NO: 789394 - RNA, 16 nt, Mycobacterium avium subsp. paratuberculosis
gugaccaggcuugccc

SEQ ID NO: 789395 - RNA, 22 nt, Mycobacterium avium subsp. paratuberculosis
gugaccaggcuugccccguacg

SEQ ID NO: 789396 - RNA, 20 nt, Mycobacterium avium subsp. paratuberculosis
gugacccgccgugaccggcg

SEQ ID NO: 789397 - RNA, 23 nt, Mycobacterium avium subsp. paratuberculosis
gugacccggaccgggugaccggc

SEQ ID NO: 789398 - RNA, 17 nt, Mycobacterium avium subsp. paratuberculosis
gugacccgggcgauggu

SEQ ID NO: 789399 - RNA, 16 nt, Mycobacterium avium subsp. paratuberculosis
gugacaggggcagcag

SEQ ID NO: 789400 - RNA, 18 nt, Mycobacterium avium subsp. paratuberculosis
gugacaggggcagcagca

SEQ ID NO: 789401 - RNA, 14 nt, Mycobacterium avium subsp. paratuberculosis
gugacagucgaccu

SEQ ID NO: 789402 - RNA, 21 nt, Mycobacterium avium subsp. paratuberculosis
gugacagucgaccucgcgcgu

SEQ ID NO: 789403 - RNA, 19 nt, Mycobacterium avium subsp. paratuberculosis
gugacacucggucaccggu

SEQ ID NO: 789404 - RNA, 20 nt, Mycobacterium avium subsp. paratuberculosis
gugacacucggucaccggug

SEQ ID NO: 789405 - RNA, 13 nt, Mycobacterium avium subsp. paratuberculosis
gugaauucggccg

SEQ ID NO: 789406 - RNA, 15 nt, Mycobacterium avium subsp. paratuberculosis
gugacaacgguggug

SEQ ID NO: 789407 - RNA, 17 nt, Mycobacterium avium subsp. paratuberculosis
gugacaacggugguggc

SEQ ID NO: 789408 - RNA, 17 nt, Mycobacterium avium subsp. paratuberculosis
gugacaagccggcgucg

SEQ ID NO: 789409 - RNA, 18 nt, Mycobacterium avium subsp. paratuberculosis
gugaauccagccgugcgg

SEQ ID NO: 789410 - RNA, 16 nt, Mycobacterium avium subsp. paratuberculosis
gugaaugcucagcggg

SEQ ID NO: 789411 - RNA, 20 nt, Mycobacterium avium subsp. paratuberculosis
gugaaugggcugcgcgucga

SEQ ID NO: 789412 - RNA, 23 nt, Mycobacterium avium subsp. paratuberculosis
gucggaucgaaggcgugcucgau

SEQ ID NO: 789413 - RNA, 23 nt, Mycobacterium avium subsp. paratuberculosis
gucggaucgagcucgcagucgau

SEQ ID NO: 789414 - RNA, 16 nt, Mycobacterium avium subsp. paratuberculosis
gucggaucgcuugacc

SEQ ID NO: 789415 - RNA, 13 nt, Mycobacterium avium subsp. paratuberculosis
gucggcagcaccg

SEQ ID NO: 789416 - RNA, 16 nt, Mycobacterium avium subsp. paratuberculosis
gucggagaucaccggc

SEQ ID NO: 789417 - RNA, 17 nt, Mycobacterium avium subsp. paratuberculosis
gucggagaucaccggca

SEQ ID NO: 789418 - RNA, 20 nt, Mycobacterium avium subsp. paratuberculosis
gucggagaucagggugcuca

SEQ ID NO: 789419 - RNA, 14 nt, Mycobacterium avium subsp. paratuberculosis
gucggagaucggcg

SEQ ID NO: 789420 - RNA, 18 nt, Mycobacterium avium subsp. paratuberculosis
gucggagaucggcgagug

SEQ ID NO: 789421 - RNA, 20 nt, Mycobacterium avium subsp. paratuberculosis
gucggagaugcgggccaccg

SEQ ID NO: 789422 - RNA, 23 nt, Mycobacterium avium subsp. paratuberculosis
gucggagaugcgggccaccgucc

SEQ ID NO: 789423 - RNA, 14 nt, Mycobacterium avium subsp. paratuberculosis
gucggagcccagcg

SEQ ID NO: 789424 - RNA, 17 nt, Mycobacterium avium subsp. paratuberculosis
gucggagcccagcguga

SEQ ID NO: 789425 - RNA, 14 nt, Mycobacterium avium subsp. paratuberculosis
gucggagccgucgg

SEQ ID NO: 789426 - RNA, 17 nt, Mycobacterium avium subsp. paratuberculosis
gucggagcgcuccacca

SEQ ID NO: 789427 - RNA, 18 nt, Mycobacterium avium subsp. paratuberculosis
gucggaguccagcacgcc

SEQ ID NO: 789428 - RNA, 17 nt, Mycobacterium avium subsp. paratuberculosis
gucggccaacagugcgc

SEQ ID NO: 789429 - RNA, 16 nt, Mycobacterium avium subsp. paratuberculosis
gucggcagcgacgcgg

SEQ ID NO: 789430 - RNA, 22 nt, Mycobacterium avium subsp. paratuberculosis
gucggcaggauccggacgaccu

SEQ ID NO: 789431 - RNA, 20 nt, Mycobacterium avium subsp. paratuberculosis
gucggcaguagcacuuucgc

SEQ ID NO: 789432 - RNA, 17 nt, Mycobacterium avium subsp. paratuberculosis
gucggcauagcgccgcu

SEQ ID NO: 789433 - RNA, 18 nt, Mycobacterium avium subsp. paratuberculosis
gucggcauagcgccgcuc

SEQ ID NO: 789434 - RNA, 23 nt, Mycobacterium avium subsp. paratuberculosis
gucggcauagcgccgcucggccg

SEQ ID NO: 789435 - RNA, 18 nt, Mycobacterium avium subsp. paratuberculosis
gucggcucggcucggccg

SEQ ID NO: 789436 - RNA, 21 nt, Mycobacterium avium subsp. paratuberculosis
gucggcucggcucggccggcc

SEQ ID NO: 789437 - RNA, 23 nt, Mycobacterium avium subsp. paratuberculosis
gucggcucguguccgaugacgag

SEQ ID NO: 789438 - RNA, 19 nt, Mycobacterium avium subsp. paratuberculosis
gucggcuggcgugcggcgc

SEQ ID NO: 789439 - RNA, 13 nt, Mycobacterium avium subsp. paratuberculosis
gucggcggugaug

SEQ ID NO: 789440 - RNA, 18 nt, Mycobacterium avium subsp. paratuberculosis
gucggcggugaugcgcgc

SEQ ID NO: 789441 - RNA, 21 nt, Mycobacterium avium subsp. paratuberculosis
gucggcggugaugcgcgccga

SEQ ID NO: 789442 - RNA, 22 nt, Mycobacterium avium subsp. paratuberculosis
gucggcggugaugcgcgccgac

SEQ ID NO: 789443 - RNA, 13 nt, Mycobacterium avium subsp. paratuberculosis
gucggcggugccg

SEQ ID NO: 789444 - RNA, 23 nt, Mycobacterium avium subsp. paratuberculosis
gucggcguagggcagcccgagca

SEQ ID NO: 789445 - RNA, 19 nt, Mycobacterium avium subsp. paratuberculosis
gucggcgucaccccaccga

SEQ ID NO: 789446 - RNA, 14 nt, Mycobacterium avium subsp. paratuberculosis
gucggcgucaucga

SEQ ID NO: 789447 - RNA, 16 nt, Mycobacterium avium subsp. paratuberculosis
gucggcguccagcgcg

SEQ ID NO: 789448 - RNA, 14 nt, Mycobacterium avium subsp. paratuberculosis
gucggcggucgcca

SEQ ID NO: 789449 - RNA, 20 nt, Mycobacterium avium subsp. paratuberculosis
gucggcggucgcggugccca

SEQ ID NO: 789450 - RNA, 17 nt, Mycobacterium avium subsp. paratuberculosis
gucggcggucuuggcgg

SEQ ID NO: 789451 - RNA, 19 nt, Mycobacterium avium subsp. paratuberculosis
gucggcggucuuggcggcc

SEQ ID NO: 789452 - RNA, 22 nt, Mycobacterium avium subsp. paratuberculosis
gucggcggucuuggcggccagc

SEQ ID NO: 789453 - RNA, 23 nt, Mycobacterium avium subsp. paratuberculosis
gucggcggugccgagcccgccgg

SEQ ID NO: 789454 - RNA, 14 nt, Mycobacterium avium subsp. paratuberculosis
gucggcggugggcg

SEQ ID NO: 789455 - RNA, 15 nt, Mycobacterium avium subsp. paratuberculosis
gucggcggugggcgc

SEQ ID NO: 789456 - RNA, 23 nt, Mycobacterium avium subsp. paratuberculosis
gucggcgguucgauaccguccgc

SEQ ID NO: 789457 - RNA, 19 nt, Mycobacterium avium subsp. paratuberculosis
gucggcgguuucggugccg

SEQ ID NO: 789458 - RNA, 14 nt, Mycobacterium avium subsp. paratuberculosis
gucggcggucaaca

SEQ ID NO: 789459 - RNA, 15 nt, Mycobacterium avium subsp. paratuberculosis
gucggcggggaaggu

SEQ ID NO: 789460 - RNA, 13 nt, Mycobacterium avium subsp. paratuberculosis
gucggcggggccg

SEQ ID NO: 789461 - RNA, 17 nt, Mycobacterium avium subsp. paratuberculosis
gucggcggggccgguga

SEQ ID NO: 789462 - RNA, 15 nt, Mycobacterium avium subsp. paratuberculosis
gucggccaccgcgau

SEQ ID NO: 789463 - RNA, 23 nt, Mycobacterium avium subsp. paratuberculosis
gucggccaccgcgaucucgaugg

SEQ ID NO: 789464 - RNA, 18 nt, Mycobacterium avium subsp. paratuberculosis
gucggcgggauggguggu

SEQ ID NO: 789465 - RNA, 16 nt, Mycobacterium avium subsp. paratuberculosis
gucggcgggcaccucg

SEQ ID NO: 789466 - RNA, 16 nt, Mycobacterium avium subsp. paratuberculosis
gucggcuucguacggc

SEQ ID NO: 789467 - RNA, 18 nt, Mycobacterium avium subsp. paratuberculosis
gucggcuucguacggccc

SEQ ID NO: 789468 - RNA, 19 nt, Mycobacterium avium subsp. paratuberculosis
gucggcuucguacggcccg

SEQ ID NO: 789469 - RNA, 21 nt, Mycobacterium avium subsp. paratuberculosis
gucggcuucguacggcccggg

SEQ ID NO: 789470 - RNA, 20 nt, Mycobacterium avium subsp. paratuberculosis
gucggcuuccuccucggcgc

SEQ ID NO: 789471 - RNA, 16 nt, Mycobacterium avium subsp. paratuberculosis
gucgggacguccgcgc

SEQ ID NO: 789472 - RNA, 18 nt, Mycobacterium avium subsp. paratuberculosis
gucgggacguccgcgcga

SEQ ID NO: 789473 - RNA, 13 nt, Mycobacterium avium subsp. paratuberculosis
gucgggacgucgg

SEQ ID NO: 789474 - RNA, 18 nt, Mycobacterium avium subsp. paratuberculosis
gucggggcagccgucgau

SEQ ID NO: 789475 - RNA, 15 nt, Mycobacterium avium subsp. paratuberculosis
gucgggaacgccgau

SEQ ID NO: 789476 - RNA, 21 nt, Mycobacterium avium subsp. paratuberculosis
gucgggaacgccgaucaccgc

SEQ ID NO: 789477 - RNA, 22 nt, Mycobacterium avium subsp. paratuberculosis
gucgggaacgccgaucaccgcg

SEQ ID NO: 789478 - RNA, 17 nt, Mycobacterium avium subsp. paratuberculosis
gucgggacccuugucca

SEQ ID NO: 789479 - RNA, 16 nt, Mycobacterium avium subsp. paratuberculosis
gucgggaccgucgcgc

SEQ ID NO: 789480 - RNA, 19 nt, Mycobacterium avium subsp. paratuberculosis
gucgggaccgucgcgcagc

SEQ ID NO: 789481 - RNA, 22 nt, Mycobacterium avium subsp. paratuberculosis
gucgggaccgucgcgcagcccg

SEQ ID NO: 789482 - RNA, 18 nt, Mycobacterium avium subsp. paratuberculosis
gucgggacgcggcaggcg

SEQ ID NO: 789483 - RNA, 16 nt, Mycobacterium avium subsp. paratuberculosis
gucgggacggccagca

SEQ ID NO: 789484 - RNA, 15 nt, Mycobacterium avium subsp. paratuberculosis
gucggggcccggccc

SEQ ID NO: 789485 - RNA, 19 nt, Mycobacterium avium subsp. paratuberculosis
gucggggcccguccccacc

SEQ ID NO: 789486 - RNA, 13 nt, Mycobacterium avium subsp. paratuberculosis
gucggggccgcac

SEQ ID NO: 789487 - RNA, 18 nt, Mycobacterium avium subsp. paratuberculosis
gucggggccgcacucuug

SEQ ID NO: 789488 - RNA, 14 nt, Mycobacterium avium subsp. paratuberculosis
gucggggcuggcgg

SEQ ID NO: 789489 - RNA, 15 nt, Mycobacterium avium subsp. paratuberculosis
gucggggcuggcggc

SEQ ID NO: 789490 - RNA, 22 nt, Mycobacterium avium subsp. paratuberculosis
gucggggcgccuaccggguggc

SEQ ID NO: 789491 - RNA, 21 nt, Mycobacterium avium subsp. paratuberculosis
gucggggucgaacaucacccg

SEQ ID NO: 789492 - RNA, 22 nt, Mycobacterium avium subsp. paratuberculosis
gucggggugcggucggcgacgu

SEQ ID NO: 789493 - RNA, 17 nt, Mycobacterium avium subsp. paratuberculosis
gucggggugcucgaucg

SEQ ID NO: 789494 - RNA, 18 nt, Mycobacterium avium subsp. paratuberculosis
gucgggguggaucgccca

SEQ ID NO: 789495 - RNA, 13 nt, Mycobacterium avium subsp. paratuberculosis
gucgggguggccg

SEQ ID NO: 789496 - RNA, 15 nt, Mycobacterium avium subsp. paratuberculosis
gucgggguggccggc

SEQ ID NO: 789497 - RNA, 16 nt, Mycobacterium avium subsp. paratuberculosis
gucgggguggccggcc

SEQ ID NO: 789498 - RNA, 19 nt, Mycobacterium avium subsp. paratuberculosis
gucgggguggccggccagc

SEQ ID NO: 789499 - RNA, 17 nt, Mycobacterium avium subsp. paratuberculosis
gucggggugggcgacgu

SEQ ID NO: 789500 - RNA, 17 nt, Mycobacterium avium subsp. paratuberculosis
gucggucaacacuuucc

SEQ ID NO: 789501 - RNA, 23 nt, Mycobacterium avium subsp. paratuberculosis
gucgguaguugcacucucgcggc

SEQ ID NO: 789502 - RNA, 15 nt, Mycobacterium avium subsp. paratuberculosis
gucgguaucgagguc

SEQ ID NO: 789503 - RNA, 14 nt, Mycobacterium avium subsp. paratuberculosis
gucggucagcaggc

SEQ ID NO: 789504 - RNA, 16 nt, Mycobacterium avium subsp. paratuberculosis
gucggucagcaggcgc

SEQ ID NO: 789505 - RNA, 20 nt, Mycobacterium avium subsp. paratuberculosis
gucggucagcaggcgccgca

SEQ ID NO: 789506 - RNA, 13 nt, Mycobacterium avium subsp. paratuberculosis
gucggucagcauc

SEQ ID NO: 789507 - RNA, 14 nt, Mycobacterium avium subsp. paratuberculosis
gucggucagcgcca

SEQ ID NO: 789508 - RNA, 13 nt, Mycobacterium avium subsp. paratuberculosis
gucggucagcggc

SEQ ID NO: 789509 - RNA, 17 nt, Mycobacterium avium subsp. paratuberculosis
gucggucagcggcguca

SEQ ID NO: 789510 - RNA, 16 nt, Mycobacterium avium subsp. paratuberculosis
gucggucagcgucgcc

SEQ ID NO: 789511 - RNA, 16 nt, Mycobacterium avium subsp. paratuberculosis
gucggugagcaccguu

SEQ ID NO: 789512 - RNA, 23 nt, Mycobacterium avium subsp. paratuberculosis
gucggucacccgguugagcaccg

SEQ ID NO: 789513 - RNA, 18 nt, Mycobacterium avium subsp. paratuberculosis
gucggucacggacagccg

SEQ ID NO: 789514 - RNA, 16 nt, Mycobacterium avium subsp. paratuberculosis
gucggugagcuggccg

SEQ ID NO: 789515 - RNA, 20 nt, Mycobacterium avium subsp. paratuberculosis
gucggugagcuggccgcgca

SEQ ID NO: 789516 - RNA, 14 nt, Mycobacterium avium subsp. paratuberculosis
gucggugcccagca

SEQ ID NO: 789517 - RNA, 23 nt, Mycobacterium avium subsp. paratuberculosis
gucggugcccagcaccgccggcg

SEQ ID NO: 789518 - RNA, 17 nt, Mycobacterium avium subsp. paratuberculosis
gucggugcccagcgcga

SEQ ID NO: 789519 - RNA, 20 nt, Mycobacterium avium subsp. paratuberculosis
gucggugcccaggucgccca

SEQ ID NO: 789520 - RNA, 22 nt, Mycobacterium avium subsp. paratuberculosis
gucggugccgagcacgcggccg

SEQ ID NO: 789521 - RNA, 14 nt, Mycobacterium avium subsp. paratuberculosis
gucggguguggcgc

SEQ ID NO: 789522 - RNA, 21 nt, Mycobacterium avium subsp. paratuberculosis
gucggguucgcccuccccggc

SEQ ID NO: 789523 - RNA, 15 nt, Mycobacterium avium subsp. paratuberculosis
gucgguaaucggcgg

SEQ ID NO: 789524 - RNA, 17 nt, Mycobacterium avium subsp. paratuberculosis
gucgggugcgcucaccg

SEQ ID NO: 789525 - RNA, 18 nt, Mycobacterium avium subsp. paratuberculosis
gucgggugcgcucaccgc

SEQ ID NO: 789526 - RNA, 22 nt, Mycobacterium avium subsp. paratuberculosis
gucgggugcgcucaccgcaucg

SEQ ID NO: 789527 - RNA, 16 nt, Mycobacterium avium subsp. paratuberculosis
gucgggugcggcggug

SEQ ID NO: 789528 - RNA, 20 nt, Mycobacterium avium subsp. paratuberculosis
gucgggugguuuugcgucug

SEQ ID NO: 789529 - RNA, 19 nt, Mycobacterium avium subsp. paratuberculosis
gucgggugucaggucggcg

SEQ ID NO: 789530 - RNA, 20 nt, Mycobacterium avium subsp. paratuberculosis
gucgggugucaggucggcga

SEQ ID NO: 789531 - RNA, 21 nt, Mycobacterium avium subsp. paratuberculosis
gucgggugucaggucggcgau

SEQ ID NO: 789532 - RNA, 23 nt, Mycobacterium avium subsp. paratuberculosis
gucgggugucaggucggcgaugg

SEQ ID NO: 789533 - RNA, 17 nt, Mycobacterium avium subsp. paratuberculosis
gucgggguccaggccgc

SEQ ID NO: 789534 - RNA, 19 nt, Mycobacterium avium subsp. paratuberculosis
gucgggguccaggccgcgc

SEQ ID NO: 789535 - RNA, 22 nt, Mycobacterium avium subsp. paratuberculosis
gucggguagggcgccgucggcg

SEQ ID NO: 789536 - RNA, 17 nt, Mycobacterium avium subsp. paratuberculosis
gucgguggacagcgcga

SEQ ID NO: 789537 - RNA, 17 nt, Mycobacterium avium subsp. paratuberculosis
gucggugcgcuccucga

SEQ ID NO: 789538 - RNA, 22 nt, Mycobacterium avium subsp. paratuberculosis
gucggugcgcuccucgacguag

SEQ ID NO: 789539 - RNA, 15 nt, Mycobacterium avium subsp. paratuberculosis
gucggugcgcgccgc

SEQ ID NO: 789540 - RNA, 16 nt, Mycobacterium avium subsp. paratuberculosis
gucggugcgcgccgca

SEQ ID NO: 789541 - RNA, 18 nt, Mycobacterium avium subsp. paratuberculosis
gucggugccgcggcgcac

SEQ ID NO: 789542 - RNA, 19 nt, Mycobacterium avium subsp. paratuberculosis
gucggugccgcggcgcacc

SEQ ID NO: 789543 - RNA, 20 nt, Mycobacterium avium subsp. paratuberculosis
gucggugccgcggcgcaccc

SEQ ID NO: 789544 - RNA, 13 nt, Mycobacterium avium subsp. paratuberculosis
gucggugccgcgu

SEQ ID NO: 789545 - RNA, 15 nt, Mycobacterium avium subsp. paratuberculosis
gucggugcgacccgg

SEQ ID NO: 789546 - RNA, 17 nt, Mycobacterium avium subsp. paratuberculosis
gucggugcgcagcacgu

SEQ ID NO: 789547 - RNA, 12 nt, Mycobacterium avium subsp. paratuberculosis
gucggugcgcgc

SEQ ID NO: 789548 - RNA, 24 nt, Mycobacterium avium subsp. paratuberculosis
gucgguucauccacucggccacca

SEQ ID NO: 789549 - RNA, 18 nt, Mycobacterium avium subsp. paratuberculosis
gucgguuucgaccugcgg

SEQ ID NO: 789550 - RNA, 15 nt, Mycobacterium avium subsp. paratuberculosis
gucguaccaccacca

SEQ ID NO: 789551 - RNA, 13 nt, Mycobacterium avium subsp. paratuberculosis
gucguacagcagc

SEQ ID NO: 789552 - RNA, 16 nt, Mycobacterium avium subsp. paratuberculosis
gucgguuucggucgcg

SEQ ID NO: 789553 - RNA, 17 nt, Mycobacterium avium subsp. paratuberculosis
gucguaguaggugcgcg

SEQ ID NO: 789554 - RNA, 16 nt, Mycobacterium avium subsp. paratuberculosis
gucguagucgaggccg

SEQ ID NO: 789555 - RNA, 20 nt, Mycobacterium avium subsp. paratuberculosis
gucguagucgcucggcggcg

SEQ ID NO: 789556 - RNA, 21 nt, Mycobacterium avium subsp. paratuberculosis
gucguagucgcucggcggcga

SEQ ID NO: 789557 - RNA, 21 nt, Mycobacterium avium subsp. paratuberculosis
gucguagucggcccgccgggc

SEQ ID NO: 789558 - RNA, 18 nt, Mycobacterium avium subsp. paratuberculosis
gucguaguugcggccggc

SEQ ID NO: 789559 - RNA, 22 nt, Mycobacterium avium subsp. paratuberculosis
gucguaguugcggccggcggug

SEQ ID NO: 789560 - RNA, 18 nt, Mycobacterium avium subsp. paratuberculosis
gucguagcggcgccaccg

SEQ ID NO: 789561 - RNA, 14 nt, Mycobacterium avium subsp. paratuberculosis
gucguagccgcggg

SEQ ID NO: 789562 - RNA, 15 nt, Mycobacterium avium subsp. paratuberculosis
gucguagccgcgggu

SEQ ID NO: 789563 - RNA, 22 nt, Mycobacterium avium subsp. paratuberculosis
gucguaggacaccacgguggcg

SEQ ID NO: 789564 - RNA, 20 nt, Mycobacterium avium subsp. paratuberculosis
gucguaguagcggaucaggu

SEQ ID NO: 789565 - RNA, 19 nt, Mycobacterium avium subsp. paratuberculosis
gucguagacgacgucgacc

SEQ ID NO: 789566 - RNA, 14 nt, Mycobacterium avium subsp. paratuberculosis
gucguagacgcugc

SEQ ID NO: 789567 - RNA, 17 nt, Mycobacterium avium subsp. paratuberculosis
gucguagagcgcgaagc

SEQ ID NO: 789568 - RNA, 23 nt, Mycobacterium avium subsp. paratuberculosis
gucguagagcugacgggaccgca

SEQ ID NO: 789569 - RNA, 22 nt, Mycobacterium avium subsp. paratuberculosis
gucguagaggggccggacggug

SEQ ID NO: 789570 - RNA, 17 nt, Mycobacterium avium subsp. paratuberculosis
gucguagaugguccgca

SEQ ID NO: 789571 - RNA, 17 nt, Mycobacterium avium subsp. paratuberculosis
gucguagaacucgccgu

SEQ ID NO: 789572 - RNA, 17 nt, Mycobacterium avium subsp. paratuberculosis
gucguacucgaccgcga

SEQ ID NO: 789573 - RNA, 14 nt, Mycobacterium avium subsp. paratuberculosis
gucguacgggcgca

SEQ ID NO: 789574 - RNA, 15 nt, Mycobacterium avium subsp. paratuberculosis
gucgucagccgggcc

SEQ ID NO: 789575 - RNA, 19 nt, Mycobacterium avium subsp. paratuberculosis
gucgucagccgggccagcc

SEQ ID NO: 789576 - RNA, 16 nt, Mycobacterium avium subsp. paratuberculosis
gucgucaacgacccgg

SEQ ID NO: 789577 - RNA, 20 nt, Mycobacterium avium subsp. paratuberculosis
gucgucaacgacccggaucu

SEQ ID NO: 789578 - RNA, 18 nt, Mycobacterium avium subsp. paratuberculosis
gucgucaccucgaccaga

SEQ ID NO: 789579 - RNA, 14 nt, Mycobacterium avium subsp. paratuberculosis
gucgucaucgucuc

SEQ ID NO: 789580 - RNA, 20 nt, Mycobacterium avium subsp. paratuberculosis
gucguccagcgucgacugca

SEQ ID NO: 789581 - RNA, 21 nt, Mycobacterium avium subsp. paratuberculosis
gucguccagcuucucggcguc

SEQ ID NO: 789582 - RNA, 23 nt, Mycobacterium avium subsp. paratuberculosis
gucguccagcuucucggcguccc

SEQ ID NO: 789583 - RNA, 15 nt, Mycobacterium avium subsp. paratuberculosis
gucgucgaccaacgc

SEQ ID NO: 789584 - RNA, 21 nt, Mycobacterium avium subsp. paratuberculosis
gucgucgacccgcuccccgau

SEQ ID NO: 789585 - RNA, 16 nt, Mycobacterium avium subsp. paratuberculosis
gucgucgaccgccacc

SEQ ID NO: 789586 - RNA, 16 nt, Mycobacterium avium subsp. paratuberculosis
gucgucgaccucgauc

SEQ ID NO: 789587 - RNA, 17 nt, Mycobacterium avium subsp. paratuberculosis
gucgucgaccucgauca

SEQ ID NO: 789588 - RNA, 17 nt, Mycobacterium avium subsp. paratuberculosis
gucgucgacgagcccgc

SEQ ID NO: 789589 - RNA, 14 nt, Mycobacterium avium subsp. paratuberculosis
gucgucgacgcuga

SEQ ID NO: 789590 - RNA, 17 nt, Mycobacterium avium subsp. paratuberculosis
gucgucgacgcugccca

SEQ ID NO: 789591 - RNA, 18 nt, Mycobacterium avium subsp. paratuberculosis
gucgucgacggccgcgcc

SEQ ID NO: 789592 - RNA, 15 nt, Mycobacterium avium subsp. paratuberculosis
gucgucgacgucgga

SEQ ID NO: 789593 - RNA, 18 nt, Mycobacterium avium subsp. paratuberculosis
gucgucgacgucggacgc

SEQ ID NO: 789594 - RNA, 22 nt, Mycobacterium avium subsp. paratuberculosis
gucgucgagcaccggcuggugc

SEQ ID NO: 789595 - RNA, 23 nt, Mycobacterium avium subsp. paratuberculosis
gucgucgagcacgaaacugccgu

SEQ ID NO: 789596 - RNA, 16 nt, Mycobacterium avium subsp. paratuberculosis
gucgucgagcgcucgc

SEQ ID NO: 789597 - RNA, 20 nt, Mycobacterium avium subsp. paratuberculosis
gucgucgagcugacacccga

SEQ ID NO: 789598 - RNA, 19 nt, Mycobacterium avium subsp. paratuberculosis
gucgucgaggccgaaccgc

SEQ ID NO: 789599 - RNA, 15 nt, Mycobacterium avium subsp. paratuberculosis
gucgucgagggccac

SEQ ID NO: 789600 - RNA, 19 nt, Mycobacterium avium subsp. paratuberculosis
gucgucggugauggugacc

SEQ ID NO: 789601 - RNA, 15 nt, Mycobacterium avium subsp. paratuberculosis
gucgucggugggccg

SEQ ID NO: 789602 - RNA, 18 nt, Mycobacterium avium subsp. paratuberculosis
gucgucggugggccgccg

SEQ ID NO: 789603 - RNA, 13 nt, Mycobacterium avium subsp. paratuberculosis
gucgucggucagc

SEQ ID NO: 789604 - RNA, 19 nt, Mycobacterium avium subsp. paratuberculosis
gucgucggugaacgccggu

SEQ ID NO: 789605 - RNA, 22 nt, Mycobacterium avium subsp. paratuberculosis
gucgucggugaacgccggugag

SEQ ID NO: 789606 - RNA, 17 nt, Mycobacterium avium subsp. paratuberculosis
gucgucgggcaccacgg

SEQ ID NO: 789607 - RNA, 16 nt, Mycobacterium avium subsp. paratuberculosis
gucgucgggccgcagc

SEQ ID NO: 789608 - RNA, 13 nt, Mycobacterium avium subsp. paratuberculosis
gucgucgggcgcg

SEQ ID NO: 789609 - RNA, 21 nt, Mycobacterium avium subsp. paratuberculosis
gucgucggggcaucgcagcgc

SEQ ID NO: 789610 - RNA, 21 nt, Mycobacterium avium subsp. paratuberculosis
gucgucguccgcaaccgccgg

SEQ ID NO: 789611 - RNA, 14 nt, Mycobacterium avium subsp. paratuberculosis
gucgucgucgaagg

SEQ ID NO: 789612 - RNA, 13 nt, Mycobacterium avium subsp. paratuberculosis
gucgucgucgacc

SEQ ID NO: 789613 - RNA, 17 nt, Mycobacterium avium subsp. paratuberculosis
gucgucgucgagcacga

SEQ ID NO: 789614 - RNA, 14 nt, Mycobacterium avium subsp. paratuberculosis
gucgucgucgagcc

SEQ ID NO: 789615 - RNA, 15 nt, Mycobacterium avium subsp. paratuberculosis
gucgucgucgccgcc

SEQ ID NO: 789616 - RNA, 16 nt, Mycobacterium avium subsp. paratuberculosis
gucgucgucgccgccg

SEQ ID NO: 789617 - RNA, 15 nt, Mycobacterium avium subsp. paratuberculosis
gucgucgucgcucca

SEQ ID NO: 789618 - RNA, 14 nt, Mycobacterium avium subsp. paratuberculosis
gucgucgucggccg

SEQ ID NO: 789619 - RNA, 14 nt, Mycobacterium avium subsp. paratuberculosis
gucgucgucggcga

SEQ ID NO: 789620 - RNA, 16 nt, Mycobacterium avium subsp. paratuberculosis
gucgucgucggcgacg

SEQ ID NO: 789621 - RNA, 17 nt, Mycobacterium avium subsp. paratuberculosis
gucgucgucggcgacga

SEQ ID NO: 789622 - RNA, 20 nt, Mycobacterium avium subsp. paratuberculosis
gucgucgugcgcgggcgaaa

SEQ ID NO: 789623 - RNA, 20 nt, Mycobacterium avium subsp. paratuberculosis
gucgucgugguagcggucgg

SEQ ID NO: 789624 - RNA, 22 nt, Mycobacterium avium subsp. paratuberculosis
gucgucguuggcccgccgcggc

SEQ ID NO: 789625 - RNA, 11 nt, Mycobacterium avium subsp. paratuberculosis
gucgucguugu

SEQ ID NO: 789626 - RNA, 20 nt, Mycobacterium avium subsp. paratuberculosis
gucgucguugugggccagcg

SEQ ID NO: 789627 - RNA, 22 nt, Mycobacterium avium subsp. paratuberculosis
gucgucguugugggccagcgcg

SEQ ID NO: 789628 - RNA, 23 nt, Mycobacterium avium subsp. paratuberculosis
gucgucguugugggccagcgcgg

SEQ ID NO: 789629 - RNA, 15 nt, Mycobacterium avium subsp. paratuberculosis
gucgucgcagugccc

SEQ ID NO: 789630 - RNA, 17 nt, Mycobacterium avium subsp. paratuberculosis
gucgucgcagugcccgc

SEQ ID NO: 789631 - RNA, 15 nt, Mycobacterium avium subsp. paratuberculosis
gucgucgaugcgcag

SEQ ID NO: 789632 - RNA, 16 nt, Mycobacterium avium subsp. paratuberculosis
gucgucgaugcgcagc

SEQ ID NO: 789633 - RNA, 17 nt, Mycobacterium avium subsp. paratuberculosis
gucgucgaugcgcagca

SEQ ID NO: 789634 - RNA, 18 nt, Mycobacterium avium subsp. paratuberculosis
gucgucgauggccaccag

SEQ ID NO: 789635 - RNA, 17 nt, Mycobacterium avium subsp. paratuberculosis
gucgucgaucucgguga

SEQ ID NO: 789636 - RNA, 18 nt, Mycobacterium avium subsp. paratuberculosis
gucgucgaugaacaucgc

SEQ ID NO: 789637 - RNA, 17 nt, Mycobacterium avium subsp. paratuberculosis
gucgucgaugaagucgg

SEQ ID NO: 789638 - RNA, 20 nt, Mycobacterium avium subsp. paratuberculosis
gucgucgaugaagucgguga

SEQ ID NO: 789639 - RNA, 17 nt, Mycobacterium avium subsp. paratuberculosis
gucgucggcgacgaccu

SEQ ID NO: 789640 - RNA, 13 nt, Mycobacterium avium subsp. paratuberculosis
gucgucggcgccg

SEQ ID NO: 789641 - RNA, 14 nt, Mycobacterium avium subsp. paratuberculosis
gucgucggcgccgc

SEQ ID NO: 789642 - RNA, 15 nt, Mycobacterium avium subsp. paratuberculosis
gucgucggcgccgcg

SEQ ID NO: 789643 - RNA, 20 nt, Mycobacterium avium subsp. paratuberculosis
gucgucggcgccgcgccggc

SEQ ID NO: 789644 - RNA, 14 nt, Mycobacterium avium subsp. paratuberculosis
gucgucggcgcggu

SEQ ID NO: 789645 - RNA, 20 nt, Mycobacterium avium subsp. paratuberculosis
gucgucggcggcgacgugcc

SEQ ID NO: 789646 - RNA, 12 nt, Mycobacterium avium subsp. paratuberculosis
gucgucggcggg

SEQ ID NO: 789647 - RNA, 19 nt, Mycobacterium avium subsp. paratuberculosis
gucgucggcgggcugcagc

SEQ ID NO: 789648 - RNA, 17 nt, Mycobacterium avium subsp. paratuberculosis
gucgucggccugcacgu

SEQ ID NO: 789649 - RNA, 14 nt, Mycobacterium avium subsp. paratuberculosis
gucgucggcgucgg

SEQ ID NO: 789650 - RNA, 15 nt, Mycobacterium avium subsp. paratuberculosis
gugacggcaucggcg

SEQ ID NO: 789651 - RNA, 16 nt, Mycobacterium avium subsp. paratuberculosis
gugacggcaucggcgc

SEQ ID NO: 789652 - RNA, 19 nt, Mycobacterium avium subsp. paratuberculosis
gugacggcaucggcgcccu

SEQ ID NO: 789653 - RNA, 14 nt, Mycobacterium avium subsp. paratuberculosis
gugacggccgcggc

SEQ ID NO: 789654 - RNA, 18 nt, Mycobacterium avium subsp. paratuberculosis
gugacggccgcggcgcgg

SEQ ID NO: 789655 - RNA, 23 nt, Mycobacterium avium subsp. paratuberculosis
gugacggccgcggcgcggcccgg

SEQ ID NO: 789656 - RNA, 17 nt, Mycobacterium avium subsp. paratuberculosis
gugacggauguggucgg

SEQ ID NO: 789657 - RNA, 20 nt, Mycobacterium avium subsp. paratuberculosis
gugacggauguggucggcca

SEQ ID NO: 789658 - RNA, 21 nt, Mycobacterium avium subsp. paratuberculosis
gugacggauguggucggccac

SEQ ID NO: 789659 - RNA, 23 nt, Mycobacterium avium subsp. paratuberculosis
gugacgcuugggguuuggcgacg

SEQ ID NO: 789660 - RNA, 20 nt, Mycobacterium avium subsp. paratuberculosis
gugacggaguuggaucgccg

SEQ ID NO: 789661 - RNA, 22 nt, Mycobacterium avium subsp. paratuberculosis
gugacggaguuggaucgccgca

SEQ ID NO: 789662 - RNA, 23 nt, Mycobacterium avium subsp. paratuberculosis
gugacggaguuggaucgccgcaa

SEQ ID NO: 789663 - RNA, 15 nt, Mycobacterium avium subsp. paratuberculosis
gugacggauccgggc

SEQ ID NO: 789664 - RNA, 21 nt, Mycobacterium avium subsp. paratuberculosis
gugacggauccgggcgccggu

SEQ ID NO: 789665 - RNA, 16 nt, Mycobacterium avium subsp. paratuberculosis
gugacggguuggucgg

SEQ ID NO: 789666 - RNA, 19 nt, Mycobacterium avium subsp. paratuberculosis
gugacggguuggucggcgc

SEQ ID NO: 789667 - RNA, 21 nt, Mycobacterium avium subsp. paratuberculosis
gugacggguuggucggcgcgg

SEQ ID NO: 789668 - RNA, 16 nt, Mycobacterium avium subsp. paratuberculosis
gugacggcggggcgga

SEQ ID NO: 789669 - RNA, 13 nt, Mycobacterium avium subsp. paratuberculosis
gugacggcgucgg

SEQ ID NO: 789670 - RNA, 14 nt, Mycobacterium avium subsp. paratuberculosis
gugacggcgucggc

SEQ ID NO: 789671 - RNA, 14 nt, Mycobacterium avium subsp. paratuberculosis
gugacggccgugau

SEQ ID NO: 789672 - RNA, 18 nt, Mycobacterium avium subsp. paratuberculosis
gugacggccgugaugccg

SEQ ID NO: 789673 - RNA, 13 nt, Mycobacterium avium subsp. paratuberculosis
gugacgucguuga

SEQ ID NO: 789674 - RNA, 18 nt, Mycobacterium avium subsp. paratuberculosis
gugacguggcggccgucg

SEQ ID NO: 789675 - RNA, 19 nt, Mycobacterium avium subsp. paratuberculosis
gugacgucgcgccgcucgg

SEQ ID NO: 789676 - RNA, 14 nt, Mycobacterium avium subsp. paratuberculosis
gugacgucgcgcgg

SEQ ID NO: 789677 - RNA, 14 nt, Mycobacterium avium subsp. paratuberculosis
gugacgggcgucgg

SEQ ID NO: 789678 - RNA, 17 nt, Mycobacterium avium subsp. paratuberculosis
gugacgggcgucggcgg

SEQ ID NO: 789679 - RNA, 22 nt, Mycobacterium avium subsp. paratuberculosis
gugacggucaugccgagccgcu

SEQ ID NO: 789680 - RNA, 18 nt, Mycobacterium avium subsp. paratuberculosis
gugacggucgaccucgag

SEQ ID NO: 789681 - RNA, 16 nt, Mycobacterium avium subsp. paratuberculosis
gugacggugccgccgu

SEQ ID NO: 789682 - RNA, 17 nt, Mycobacterium avium subsp. paratuberculosis
gugacggugccgccgug

SEQ ID NO: 789683 - RNA, 19 nt, Mycobacterium avium subsp. paratuberculosis
gugaggcacccgcugcacc

SEQ ID NO: 789684 - RNA, 14 nt, Mycobacterium avium subsp. paratuberculosis
gugaggcgcgccgg

SEQ ID NO: 789685 - RNA, 19 nt, Mycobacterium avium subsp. paratuberculosis
gugaggcguuggcccgcac

SEQ ID NO: 789686 - RNA, 15 nt, Mycobacterium avium subsp. paratuberculosis
gugagggaacgccga

SEQ ID NO: 789687 - RNA, 18 nt, Mycobacterium avium subsp. paratuberculosis
gugagcuggccgcgcagc

SEQ ID NO: 789688 - RNA, 21 nt, Mycobacterium avium subsp. paratuberculosis
gugaggacaccacgaucagcg

SEQ ID NO: 789689 - RNA, 16 nt, Mycobacterium avium subsp. paratuberculosis
gugaggacgcccggcg

SEQ ID NO: 789690 - RNA, 19 nt, Mycobacterium avium subsp. paratuberculosis
gugaggacgcccggcgagu

SEQ ID NO: 789691 - RNA, 20 nt, Mycobacterium avium subsp. paratuberculosis
gugaggacgcccggcgagug

SEQ ID NO: 789692 - RNA, 20 nt, Mycobacterium avium subsp. paratuberculosis
gugagacggccagcagcacc

SEQ ID NO: 789693 - RNA, 15 nt, Mycobacterium avium subsp. paratuberculosis
gugagauccagcagc

SEQ ID NO: 789694 - RNA, 21 nt, Mycobacterium avium subsp. paratuberculosis
gugagcaacaccggcacgauc

SEQ ID NO: 789695 - RNA, 23 nt, Mycobacterium avium subsp. paratuberculosis
gugagcaacagcgcuucgcgcug

SEQ ID NO: 789696 - RNA, 15 nt, Mycobacterium avium subsp. paratuberculosis
gugagcaacgccagc

SEQ ID NO: 789697 - RNA, 18 nt, Mycobacterium avium subsp. paratuberculosis
gugagcaacgccagcgcg

SEQ ID NO: 789698 - RNA, 19 nt, Mycobacterium avium subsp. paratuberculosis
gugagaaaagcgaccagcg

SEQ ID NO: 789699 - RNA, 21 nt, Mycobacterium avium subsp. paratuberculosis
gugagaaaagcgaccagcgcg

SEQ ID NO: 789700 - RNA, 22 nt, Mycobacterium avium subsp. paratuberculosis
gugagaaaagcgaccagcgcgc

SEQ ID NO: 789701 - RNA, 17 nt, Mycobacterium avium subsp. paratuberculosis
gugacuugucgggccgc

SEQ ID NO: 789702 - RNA, 17 nt, Mycobacterium avium subsp. paratuberculosis
gugacguugagcacccg

SEQ ID NO: 789703 - RNA, 14 nt, Mycobacterium avium subsp. paratuberculosis
gugaccggcggugu

SEQ ID NO: 789704 - RNA, 20 nt, Mycobacterium avium subsp. paratuberculosis
gugaccggcggugucggugc

SEQ ID NO: 789705 - RNA, 21 nt, Mycobacterium avium subsp. paratuberculosis
gugaccgucacccccggcgcg

SEQ ID NO: 789706 - RNA, 14 nt, Mycobacterium avium subsp. paratuberculosis
gugaccuugcgggc

SEQ ID NO: 789707 - RNA, 16 nt, Mycobacterium avium subsp. paratuberculosis
gugaccuugcgggcgg

SEQ ID NO: 789708 - RNA, 19 nt, Mycobacterium avium subsp. paratuberculosis
gugaccuugcgggcgguca

SEQ ID NO: 789709 - RNA, 20 nt, Mycobacterium avium subsp. paratuberculosis
gugacgaacccgccgcggcc

SEQ ID NO: 789710 - RNA, 22 nt, Mycobacterium avium subsp. paratuberculosis
gugacgaacccgccgcggccga

SEQ ID NO: 789711 - RNA, 23 nt, Mycobacterium avium subsp. paratuberculosis
gugacgaacccgccgcggccgaa

SEQ ID NO: 789712 - RNA, 15 nt, Mycobacterium avium subsp. paratuberculosis
gugaccgucgccgac

SEQ ID NO: 789713 - RNA, 17 nt, Mycobacterium avium subsp. paratuberculosis
gugaccgucgccgacca

SEQ ID NO: 789714 - RNA, 15 nt, Mycobacterium avium subsp. paratuberculosis
gugaccucgaagaug

SEQ ID NO: 789715 - RNA, 20 nt, Mycobacterium avium subsp. paratuberculosis
gugaccucgagcaccggcgg

SEQ ID NO: 789716 - RNA, 14 nt, Mycobacterium avium subsp. paratuberculosis
gugaccucgagcag

SEQ ID NO: 789717 - RNA, 16 nt, Mycobacterium avium subsp. paratuberculosis
gugaccucgagcagcg

SEQ ID NO: 789718 - RNA, 19 nt, Mycobacterium avium subsp. paratuberculosis
gugaccucgagcagcgcgc

SEQ ID NO: 789719 - RNA, 22 nt, Mycobacterium avium subsp. paratuberculosis
gugaccucgagcagcgcgcgcu

SEQ ID NO: 789720 - RNA, 13 nt, Mycobacterium avium subsp. paratuberculosis
gugaccggcucga

SEQ ID NO: 789721 - RNA, 16 nt, Mycobacterium avium subsp. paratuberculosis
gugaccggcugcucgc

SEQ ID NO: 789722 - RNA, 18 nt, Mycobacterium avium subsp. paratuberculosis
gugaccggcugcucgcgc

SEQ ID NO: 789723 - RNA, 18 nt, Mycobacterium avium subsp. paratuberculosis
gugaccggggucggcgcc

SEQ ID NO: 789724 - RNA, 19 nt, Mycobacterium avium subsp. paratuberculosis
gugaccggggucggcgccc

SEQ ID NO: 789725 - RNA, 22 nt, Mycobacterium avium subsp. paratuberculosis
gugaccggggucggcgcccucg

SEQ ID NO: 789726 - RNA, 13 nt, Mycobacterium avium subsp. paratuberculosis
gugaccggcgccg

SEQ ID NO: 789727 - RNA, 23 nt, Mycobacterium avium subsp. paratuberculosis
gugaccggcgccgggucgcggua

SEQ ID NO: 789728 - RNA, 15 nt, Mycobacterium avium subsp. paratuberculosis
gugaccggcgcgccc

SEQ ID NO: 789729 - RNA, 13 nt, Mycobacterium avium subsp. paratuberculosis
gugaccggcggcc

SEQ ID NO: 789730 - RNA, 20 nt, Mycobacterium avium subsp. paratuberculosis
gugaccggcggccagcgagg

SEQ ID NO: 789731 - RNA, 16 nt, Mycobacterium avium subsp. paratuberculosis
gugaccgcgacgcugc

SEQ ID NO: 789732 - RNA, 13 nt, Mycobacterium avium subsp. paratuberculosis
gugaccgcgccgc

SEQ ID NO: 789733 - RNA, 14 nt, Mycobacterium avium subsp. paratuberculosis
gugaccgcgccgcg

SEQ ID NO: 789734 - RNA, 23 nt, Mycobacterium avium subsp. paratuberculosis
gugaccgcgccgguguucggcgc

SEQ ID NO: 789735 - RNA, 15 nt, Mycobacterium avium subsp. paratuberculosis
gugaccgcggccucg

SEQ ID NO: 789736 - RNA, 22 nt, Mycobacterium avium subsp. paratuberculosis
gugacccugccgucaccggcca

SEQ ID NO: 789737 - RNA, 23 nt, Mycobacterium avium subsp. paratuberculosis
gugacccugccgucaccggccau

SEQ ID NO: 789738 - RNA, 19 nt, Mycobacterium avium subsp. paratuberculosis
gugaccgacgacgugacga

SEQ ID NO: 789739 - RNA, 23 nt, Mycobacterium avium subsp. paratuberculosis
gugaccgaggccgcccgcuccug

SEQ ID NO: 789740 - RNA, 16 nt, Mycobacterium avium subsp. paratuberculosis
gugaccgagucgucgc

SEQ ID NO: 789741 - RNA, 18 nt, Mycobacterium avium subsp. paratuberculosis
gugaccgagucgucgcgc

SEQ ID NO: 789742 - RNA, 20 nt, Mycobacterium avium subsp. paratuberculosis
gugaccgagucgucgcgcac

SEQ ID NO: 789743 - RNA, 21 nt, Mycobacterium avium subsp. paratuberculosis
gugaccgagucgucgcgcacc

SEQ ID NO: 789744 - RNA, 13 nt, Mycobacterium avium subsp. paratuberculosis
gugaccgcccgcu

SEQ ID NO: 789745 - RNA, 22 nt, Mycobacterium avium subsp. paratuberculosis
gugaccgcccgcucgacggccg

SEQ ID NO: 789746 - RNA, 22 nt, Mycobacterium avium subsp. paratuberculosis
gugaccgccgccauccgcgccg

SEQ ID NO: 789747 - RNA, 16 nt, Mycobacterium avium subsp. paratuberculosis
gugaccgccucgucga

SEQ ID NO: 789748 - RNA, 14 nt, Mycobacterium avium subsp. paratuberculosis
gugacgccgacgua

SEQ ID NO: 789749 - RNA, 14 nt, Mycobacterium avium subsp. paratuberculosis
gugacgcggcgucg

SEQ ID NO: 789750 - RNA, 16 nt, Mycobacterium avium subsp. paratuberculosis
gugacgcggcgucggg

SEQ ID NO: 789751 - RNA, 18 nt, Mycobacterium avium subsp. paratuberculosis
gugacgcucacccggccc

SEQ ID NO: 789752 - RNA, 19 nt, Mycobacterium avium subsp. paratuberculosis
gugacgcucgacggccggc

SEQ ID NO: 789753 - RNA, 16 nt, Mycobacterium avium subsp. paratuberculosis
gugacgcucgccggcg

SEQ ID NO: 789754 - RNA, 17 nt, Mycobacterium avium subsp. paratuberculosis
gugacgcucgccggcgg

SEQ ID NO: 789755 - RNA, 18 nt, Mycobacterium avium subsp. paratuberculosis
gugacgcucgccggcggc

SEQ ID NO: 789756 - RNA, 13 nt, Mycobacterium avium subsp. paratuberculosis
gugacgcucgcgg

SEQ ID NO: 789757 - RNA, 15 nt, Mycobacterium avium subsp. paratuberculosis
gugacgcucgcgguu

SEQ ID NO: 789758 - RNA, 23 nt, Mycobacterium avium subsp. paratuberculosis
gugacgcucgcguggccugggcg

SEQ ID NO: 789759 - RNA, 18 nt, Mycobacterium avium subsp. paratuberculosis
gugacgcucggcgccgcg

SEQ ID NO: 789760 - RNA, 19 nt, Mycobacterium avium subsp. paratuberculosis
gugacgcucggcgccgcgg

SEQ ID NO: 789761 - RNA, 15 nt, Mycobacterium avium subsp. paratuberculosis
gugacgcucggcgcg

SEQ ID NO: 789762 - RNA, 18 nt, Mycobacterium avium subsp. paratuberculosis
gugacgcucggcggccga

SEQ ID NO: 789763 - RNA, 23 nt, Mycobacterium avium subsp. paratuberculosis
gugacgcucgggcuucggcguca

SEQ ID NO: 789764 - RNA, 17 nt, Mycobacterium avium subsp. paratuberculosis
gugacgcugaagaucga

SEQ ID NO: 789765 - RNA, 13 nt, Mycobacterium avium subsp. paratuberculosis
gugacgcccggcg

SEQ ID NO: 789766 - RNA, 14 nt, Mycobacterium avium subsp. paratuberculosis
gugacgcccggcgc

SEQ ID NO: 789767 - RNA, 20 nt, Mycobacterium avium subsp. paratuberculosis
gugacgcccggcgccggcgg

SEQ ID NO: 789768 - RNA, 19 nt, Mycobacterium avium subsp. paratuberculosis
gugacgcccgucccgccga

SEQ ID NO: 789769 - RNA, 14 nt, Mycobacterium avium subsp. paratuberculosis
gugacgccgcucgg

SEQ ID NO: 789770 - RNA, 18 nt, Mycobacterium avium subsp. paratuberculosis
gugacgccgcucggccag

SEQ ID NO: 789771 - RNA, 23 nt, Mycobacterium avium subsp. paratuberculosis
gugacgccgcucggccagcgcag

SEQ ID NO: 789772 - RNA, 18 nt, Mycobacterium avium subsp. paratuberculosis
gugacgccgggccgccgc

SEQ ID NO: 789773 - RNA, 20 nt, Mycobacterium avium subsp. paratuberculosis
gugacgccgggccgccgcgg

SEQ ID NO: 789774 - RNA, 13 nt, Mycobacterium avium subsp. paratuberculosis
gugacgccugcgg

SEQ ID NO: 789775 - RNA, 14 nt, Mycobacterium avium subsp. paratuberculosis
gugacgccugcggc

SEQ ID NO: 789776 - RNA, 16 nt, Mycobacterium avium subsp. paratuberculosis
gugacgccugcggccc

SEQ ID NO: 789777 - RNA, 22 nt, Mycobacterium avium subsp. paratuberculosis
gugacgcgaagucgccgcccgg

SEQ ID NO: 789778 - RNA, 16 nt, Mycobacterium avium subsp. paratuberculosis
gugacgcgccggccca

SEQ ID NO: 789779 - RNA, 21 nt, Mycobacterium avium subsp. paratuberculosis
gugacgaugcugagcagauca

SEQ ID NO: 789780 - RNA, 23 nt, Mycobacterium avium subsp. paratuberculosis
gugacgaugucgaugacggcggc

SEQ ID NO: 789781 - RNA, 18 nt, Mycobacterium avium subsp. paratuberculosis
gugaccucgucgggcgcc

SEQ ID NO: 789782 - RNA, 18 nt, Mycobacterium avium subsp. paratuberculosis
gugacgaucaccgcugcc

SEQ ID NO: 789783 - RNA, 18 nt, Mycobacterium avium subsp. paratuberculosis
gugacgauccacagcgcg

SEQ ID NO: 789784 - RNA, 14 nt, Mycobacterium avium subsp. paratuberculosis
gugacgaccggcag

SEQ ID NO: 789785 - RNA, 20 nt, Mycobacterium avium subsp. paratuberculosis
gugacgaccuggucgccgcc

SEQ ID NO: 789786 - RNA, 22 nt, Mycobacterium avium subsp. paratuberculosis
gugacgaggagggugucggcgg

SEQ ID NO: 789787 - RNA, 16 nt, Mycobacterium avium subsp. paratuberculosis
gugacgaggcccacga

SEQ ID NO: 789788 - RNA, 21 nt, Mycobacterium avium subsp. paratuberculosis
gugacgaggcccacgaaccgg

SEQ ID NO: 789789 - RNA, 14 nt, Mycobacterium avium subsp. paratuberculosis
gugauggucgucgu

SEQ ID NO: 789790 - RNA, 13 nt, Mycobacterium avium subsp. paratuberculosis
gugaugucgcugc

SEQ ID NO: 789791 - RNA, 13 nt, Mycobacterium avium subsp. paratuberculosis
gugaugucgguga

SEQ ID NO: 789792 - RNA, 22 nt, Mycobacterium avium subsp. paratuberculosis
gugaugucgacgucgucgaccc

SEQ ID NO: 789793 - RNA, 16 nt, Mycobacterium avium subsp. paratuberculosis
gugaugucgccggcgg

SEQ ID NO: 789794 - RNA, 19 nt, Mycobacterium avium subsp. paratuberculosis
gugaugucgccggcggcga

SEQ ID NO: 789795 - RNA, 16 nt, Mycobacterium avium subsp. paratuberculosis
gugaugugcggcgcgg

SEQ ID NO: 789796 - RNA, 16 nt, Mycobacterium avium subsp. paratuberculosis
gugaugggcagcgccc

SEQ ID NO: 789797 - RNA, 17 nt, Mycobacterium avium subsp. paratuberculosis
gugaucuggucggccag

SEQ ID NO: 789798 - RNA, 21 nt, Mycobacterium avium subsp. paratuberculosis
gugaucuggugggcgggcacc

SEQ ID NO: 789799 - RNA, 22 nt, Mycobacterium avium subsp. paratuberculosis
gugaugaacgcgccgucgucgg

SEQ ID NO: 789800 - RNA, 23 nt, Mycobacterium avium subsp. paratuberculosis
gugauggccgccgcaggcgaagg

SEQ ID NO: 789801 - RNA, 17 nt, Mycobacterium avium subsp. paratuberculosis
gugauguuggccgcgac

SEQ ID NO: 789802 - RNA, 20 nt, Mycobacterium avium subsp. paratuberculosis
gugauguuggccgcgacgcc

SEQ ID NO: 789803 - RNA, 13 nt, Mycobacterium avium subsp. paratuberculosis
gugauguugucga

SEQ ID NO: 789804 - RNA, 21 nt, Mycobacterium avium subsp. paratuberculosis
gugauuccggcacccgccagc

SEQ ID NO: 789805 - RNA, 17 nt, Mycobacterium avium subsp. paratuberculosis
gugauuaggcaguucga

SEQ ID NO: 789806 - RNA, 18 nt, Mycobacterium avium subsp. paratuberculosis
gugauucgaagaacacgc

SEQ ID NO: 789807 - RNA, 24 nt, Mycobacterium avium subsp. paratuberculosis
gugauucgggucagaccgcggcgg

SEQ ID NO: 789808 - RNA, 22 nt, Mycobacterium avium subsp. paratuberculosis
gugauucgugcagugcgaucgc

SEQ ID NO: 789809 - RNA, 22 nt, Mycobacterium avium subsp. paratuberculosis
gugaggggauccagcggcggcc

SEQ ID NO: 789810 - RNA, 16 nt, Mycobacterium avium subsp. paratuberculosis
gugaguucgucggcga

SEQ ID NO: 789811 - RNA, 14 nt, Mycobacterium avium subsp. paratuberculosis
gugaucgcggccca

SEQ ID NO: 789812 - RNA, 15 nt, Mycobacterium avium subsp. paratuberculosis
gugaucgcggcccgc

SEQ ID NO: 789813 - RNA, 16 nt, Mycobacterium avium subsp. paratuberculosis
gugaucgcggcccgcg

SEQ ID NO: 789814 - RNA, 16 nt, Mycobacterium avium subsp. paratuberculosis
gugaucgcggcgcugc

SEQ ID NO: 789815 - RNA, 13 nt, Mycobacterium avium subsp. paratuberculosis
gugaucgcggcgg

SEQ ID NO: 789816 - RNA, 17 nt, Mycobacterium avium subsp. paratuberculosis
gugaucgcggcggcgua

SEQ ID NO: 789817 - RNA, 16 nt, Mycobacterium avium subsp. paratuberculosis
gugaucgcgguggccg

SEQ ID NO: 789818 - RNA, 13 nt, Mycobacterium avium subsp. paratuberculosis
gugaucgcgucaa

SEQ ID NO: 789819 - RNA, 18 nt, Mycobacterium avium subsp. paratuberculosis
gugaucgcugacgccguu

SEQ ID NO: 789820 - RNA, 15 nt, Mycobacterium avium subsp. paratuberculosis
gugaucgccgcccac

SEQ ID NO: 789821 - RNA, 19 nt, Mycobacterium avium subsp. paratuberculosis
gugaucgccucgaccaggc

SEQ ID NO: 789822 - RNA, 14 nt, Mycobacterium avium subsp. paratuberculosis
gugaucggccaggc

SEQ ID NO: 789823 - RNA, 14 nt, Mycobacterium avium subsp. paratuberculosis
gugaucggccuuca

SEQ ID NO: 789824 - RNA, 13 nt, Mycobacterium avium subsp. paratuberculosis
gugaucggcggaa

SEQ ID NO: 789825 - RNA, 14 nt, Mycobacterium avium subsp. paratuberculosis
gugaucggcggcca

SEQ ID NO: 789826 - RNA, 15 nt, Mycobacterium avium subsp. paratuberculosis
gugaucggcggccac

SEQ ID NO: 789827 - RNA, 18 nt, Mycobacterium avium subsp. paratuberculosis
gugaucggcggccugcgg

SEQ ID NO: 789828 - RNA, 21 nt, Mycobacterium avium subsp. paratuberculosis
gugaucggcggccugcggcgg

SEQ ID NO: 789829 - RNA, 15 nt, Mycobacterium avium subsp. paratuberculosis
gugaucucaccggcg

SEQ ID NO: 789830 - RNA, 15 nt, Mycobacterium avium subsp. paratuberculosis
gugaucggugcccgc

SEQ ID NO: 789831 - RNA, 17 nt, Mycobacterium avium subsp. paratuberculosis
gugaucggugcccgcgg

SEQ ID NO: 789832 - RNA, 16 nt, Mycobacterium avium subsp. paratuberculosis
gugaucucgucggcgg

SEQ ID NO: 789833 - RNA, 21 nt, Mycobacterium avium subsp. paratuberculosis
gugaucucgucggcggcggcc

SEQ ID NO: 789834 - RNA, 23 nt, Mycobacterium avium subsp. paratuberculosis
gugaucucgugccgcacccgauc

SEQ ID NO: 789835 - RNA, 16 nt, Mycobacterium avium subsp. paratuberculosis
gugaucugcaccagcg

SEQ ID NO: 789836 - RNA, 22 nt, Mycobacterium avium subsp. paratuberculosis
gugaucugcaccagcguggugc

SEQ ID NO: 789837 - RNA, 23 nt, Mycobacterium avium subsp. paratuberculosis
gugcagauagguggucucccaga

SEQ ID NO: 789838 - RNA, 16 nt, Mycobacterium avium subsp. paratuberculosis
gugcagaccccggcgu

SEQ ID NO: 789839 - RNA, 18 nt, Mycobacterium avium subsp. paratuberculosis
gugcagacgugacgugcc

SEQ ID NO: 789840 - RNA, 20 nt, Mycobacterium avium subsp. paratuberculosis
gugcagacaaccggugugcc

SEQ ID NO: 789841 - RNA, 16 nt, Mycobacterium avium subsp. paratuberculosis
gugcagcaccucgaag

SEQ ID NO: 789842 - RNA, 14 nt, Mycobacterium avium subsp. paratuberculosis
gugcagcacgccgc

SEQ ID NO: 789843 - RNA, 17 nt, Mycobacterium avium subsp. paratuberculosis
gugcagcacgccgcgga

SEQ ID NO: 789844 - RNA, 17 nt, Mycobacterium avium subsp. paratuberculosis
gugcaggcccgggcggc

SEQ ID NO: 789845 - RNA, 20 nt, Mycobacterium avium subsp. paratuberculosis
gugcaggccgaacaccguca

SEQ ID NO: 789846 - RNA, 14 nt, Mycobacterium avium subsp. paratuberculosis
gugcaggccgcgac

SEQ ID NO: 789847 - RNA, 15 nt, Mycobacterium avium subsp. paratuberculosis
gugcaggccgcgacg

SEQ ID NO: 789848 - RNA, 16 nt, Mycobacterium avium subsp. paratuberculosis
gugcagcagcagccac

SEQ ID NO: 789849 - RNA, 22 nt, Mycobacterium avium subsp. paratuberculosis
gugcagcagcagccacgccagc

SEQ ID NO: 789850 - RNA, 12 nt, Mycobacterium avium subsp. paratuberculosis
gugcagcagcgc

SEQ ID NO: 789851 - RNA, 14 nt, Mycobacterium avium subsp. paratuberculosis
gugcagcagcgccg

SEQ ID NO: 789852 - RNA, 15 nt, Mycobacterium avium subsp. paratuberculosis
gugcagcagcgccgc

SEQ ID NO: 789853 - RNA, 19 nt, Mycobacterium avium subsp. paratuberculosis
gugcacgccgagcagcacc

SEQ ID NO: 789854 - RNA, 21 nt, Mycobacterium avium subsp. paratuberculosis
gugcacgccgaggcgugccgc

SEQ ID NO: 789855 - RNA, 22 nt, Mycobacterium avium subsp. paratuberculosis
gugcacgccgaggcgugccgcu

SEQ ID NO: 789856 - RNA, 13 nt, Mycobacterium avium subsp. paratuberculosis
gugcacgccgucg

SEQ ID NO: 789857 - RNA, 23 nt, Mycobacterium avium subsp. paratuberculosis
gugcacgccgucgugcucggcga

SEQ ID NO: 789858 - RNA, 15 nt, Mycobacterium avium subsp. paratuberculosis
gugcacgcguucgga

SEQ ID NO: 789859 - RNA, 16 nt, Mycobacterium avium subsp. paratuberculosis
gugcacgcucggcgcg

SEQ ID NO: 789860 - RNA, 15 nt, Mycobacterium avium subsp. paratuberculosis
gugcacgcucggcgg

SEQ ID NO: 789861 - RNA, 13 nt, Mycobacterium avium subsp. paratuberculosis
gugcacggcgccg

SEQ ID NO: 789862 - RNA, 14 nt, Mycobacterium avium subsp. paratuberculosis
gugcacggcgccgu

SEQ ID NO: 789863 - RNA, 19 nt, Mycobacterium avium subsp. paratuberculosis
gugcacggcgccgugccgc

SEQ ID NO: 789864 - RNA, 19 nt, Mycobacterium avium subsp. paratuberculosis
gugcacggucagcucgcgc

SEQ ID NO: 789865 - RNA, 20 nt, Mycobacterium avium subsp. paratuberculosis
gugcacggucagcucgcgcc

SEQ ID NO: 789866 - RNA, 18 nt, Mycobacterium avium subsp. paratuberculosis
gugcacgaucgcggugac

SEQ ID NO: 789867 - RNA, 20 nt, Mycobacterium avium subsp. paratuberculosis
gugcacgaucgcggugacgc

SEQ ID NO: 789868 - RNA, 15 nt, Mycobacterium avium subsp. paratuberculosis
gugcacucagggcga

SEQ ID NO: 789869 - RNA, 13 nt, Mycobacterium avium subsp. paratuberculosis
gugcacucggcga

SEQ ID NO: 789870 - RNA, 15 nt, Mycobacterium avium subsp. paratuberculosis
gugcagaacagcacg

SEQ ID NO: 789871 - RNA, 16 nt, Mycobacterium avium subsp. paratuberculosis
gugcacgaacagggug

SEQ ID NO: 789872 - RNA, 19 nt, Mycobacterium avium subsp. paratuberculosis
gugcaccugugaggcaccg

SEQ ID NO: 789873 - RNA, 15 nt, Mycobacterium avium subsp. paratuberculosis
gugcacgaacgcggc

SEQ ID NO: 789874 - RNA, 16 nt, Mycobacterium avium subsp. paratuberculosis
gugcacgaacgcggcc

SEQ ID NO: 789875 - RNA, 15 nt, Mycobacterium avium subsp. paratuberculosis
gugcacgaacggcac

SEQ ID NO: 789876 - RNA, 17 nt, Mycobacterium avium subsp. paratuberculosis
gugcacgauggacaggu

SEQ ID NO: 789877 - RNA, 21 nt, Mycobacterium avium subsp. paratuberculosis
gugcacgauggacagguagcg

SEQ ID NO: 789878 - RNA, 14 nt, Mycobacterium avium subsp. paratuberculosis
gugcacgagcgucg

SEQ ID NO: 789879 - RNA, 19 nt, Mycobacterium avium subsp. paratuberculosis
gugcacgagcgucgugcgg

SEQ ID NO: 789880 - RNA, 13 nt, Mycobacterium avium subsp. paratuberculosis
gugcacgaucgcg

SEQ ID NO: 789881 - RNA, 13 nt, Mycobacterium avium subsp. paratuberculosis
gugcaccgcgcgc

SEQ ID NO: 789882 - RNA, 14 nt, Mycobacterium avium subsp. paratuberculosis
gugcaccgcgcgca

SEQ ID NO: 789883 - RNA, 19 nt, Mycobacterium avium subsp. paratuberculosis
gugcaccgcgcgcaccacg

SEQ ID NO: 789884 - RNA, 17 nt, Mycobacterium avium subsp. paratuberculosis
gugcaccgcggccaacc

SEQ ID NO: 789885 - RNA, 19 nt, Mycobacterium avium subsp. paratuberculosis
gugcaccgcggccaacccg

SEQ ID NO: 789886 - RNA, 13 nt, Mycobacterium avium subsp. paratuberculosis
gugcaccgcggcg

SEQ ID NO: 789887 - RNA, 14 nt, Mycobacterium avium subsp. paratuberculosis
gugcaccgcggcgc

SEQ ID NO: 789888 - RNA, 15 nt, Mycobacterium avium subsp. paratuberculosis
gugcaccgcggcgcg

SEQ ID NO: 789889 - RNA, 22 nt, Mycobacterium avium subsp. paratuberculosis
gugcaccgcggcgcgcaucgcc

SEQ ID NO: 789890 - RNA, 13 nt, Mycobacterium avium subsp. paratuberculosis
gugcaccggcgag

SEQ ID NO: 789891 - RNA, 19 nt, Mycobacterium avium subsp. paratuberculosis
gugcaccgucgccggcggg

SEQ ID NO: 789892 - RNA, 15 nt, Mycobacterium avium subsp. paratuberculosis
gugcaccguggugac

SEQ ID NO: 789893 - RNA, 16 nt, Mycobacterium avium subsp. paratuberculosis
gugcaacacucgagcg

SEQ ID NO: 789894 - RNA, 20 nt, Mycobacterium avium subsp. paratuberculosis
gugcaacacucgagcgcgcu

SEQ ID NO: 789895 - RNA, 17 nt, Mycobacterium avium subsp. paratuberculosis
gugcaagcucgccagga

SEQ ID NO: 789896 - RNA, 15 nt, Mycobacterium avium subsp. paratuberculosis
gugcaacgccgccga

SEQ ID NO: 789897 - RNA, 19 nt, Mycobacterium avium subsp. paratuberculosis
gugcaacucccgcgccgcg

SEQ ID NO: 789898 - RNA, 22 nt, Mycobacterium avium subsp. paratuberculosis
gugccgggcgguacgcgccgcg

SEQ ID NO: 789899 - RNA, 20 nt, Mycobacterium avium subsp. paratuberculosis
gugccgggucgcagcggcac

SEQ ID NO: 789900 - RNA, 21 nt, Mycobacterium avium subsp. paratuberculosis
gugccgggucgcagcggcacg

SEQ ID NO: 789901 - RNA, 22 nt, Mycobacterium avium subsp. paratuberculosis
gugccgggugcugaacgccugc

SEQ ID NO: 789902 - RNA, 15 nt, Mycobacterium avium subsp. paratuberculosis
gugccgguccagccg

SEQ ID NO: 789903 - RNA, 23 nt, Mycobacterium avium subsp. paratuberculosis
gugccgguccagccgccgcgugg

SEQ ID NO: 789904 - RNA, 21 nt, Mycobacterium avium subsp. paratuberculosis
gugccggugaugaacgcgccg

SEQ ID NO: 789905 - RNA, 21 nt, Mycobacterium avium subsp. paratuberculosis
gugccgguguugccgacggcg

SEQ ID NO: 789906 - RNA, 22 nt, Mycobacterium avium subsp. paratuberculosis
gugccgguguugccgacggcgc

SEQ ID NO: 789907 - RNA, 14 nt, Mycobacterium avium subsp. paratuberculosis
gugccgucacgccc

SEQ ID NO: 789908 - RNA, 15 nt, Mycobacterium avium subsp. paratuberculosis
gugccguccgggucg

SEQ ID NO: 789909 - RNA, 16 nt, Mycobacterium avium subsp. paratuberculosis
gugccguccucggccg

SEQ ID NO: 789910 - RNA, 22 nt, Mycobacterium avium subsp. paratuberculosis
gugccguccucggccgccaccg

SEQ ID NO: 789911 - RNA, 19 nt, Mycobacterium avium subsp. paratuberculosis
gugccgucgaucgcccgcu

SEQ ID NO: 789912 - RNA, 20 nt, Mycobacterium avium subsp. paratuberculosis
gugccguccagcuccgccga

SEQ ID NO: 789913 - RNA, 22 nt, Mycobacterium avium subsp. paratuberculosis
gugccguccagcuccgccgaca

SEQ ID NO: 789914 - RNA, 20 nt, Mycobacterium avium subsp. paratuberculosis
gugccgucgcgcucgacgau

SEQ ID NO: 789915 - RNA, 13 nt, Mycobacterium avium subsp. paratuberculosis
gugccgucggcgu

SEQ ID NO: 789916 - RNA, 16 nt, Mycobacterium avium subsp. paratuberculosis
gugccgucggcgucga

SEQ ID NO: 789917 - RNA, 20 nt, Mycobacterium avium subsp. paratuberculosis
gugccgucggcgucgacgac

SEQ ID NO: 789918 - RNA, 16 nt, Mycobacterium avium subsp. paratuberculosis
gugccguggucggugc

SEQ ID NO: 789919 - RNA, 17 nt, Mycobacterium avium subsp. paratuberculosis
gugccguggucggugcc

SEQ ID NO: 789920 - RNA, 13 nt, Mycobacterium avium subsp. paratuberculosis
gugcgcgccgacc

SEQ ID NO: 789921 - RNA, 20 nt, Mycobacterium avium subsp. paratuberculosis
gugcgcgccgaccgcgagca

SEQ ID NO: 789922 - RNA, 15 nt, Mycobacterium avium subsp. paratuberculosis
gugcgcgccggcguc

SEQ ID NO: 789923 - RNA, 16 nt, Mycobacterium avium subsp. paratuberculosis
gugcgcgccggcgucg

SEQ ID NO: 789924 - RNA, 21 nt, Mycobacterium avium subsp. paratuberculosis
gugcgcgccggcgucgguguc

SEQ ID NO: 789925 - RNA, 20 nt, Mycobacterium avium subsp. paratuberculosis
gugcgccuugucgauggucg

SEQ ID NO: 789926 - RNA, 13 nt, Mycobacterium avium subsp. paratuberculosis
gugcgcagcccgc

SEQ ID NO: 789927 - RNA, 16 nt, Mycobacterium avium subsp. paratuberculosis
gugcgcagcccgccgg

SEQ ID NO: 789928 - RNA, 19 nt, Mycobacterium avium subsp. paratuberculosis
gugcgcagccgcugcagcg

SEQ ID NO: 789929 - RNA, 18 nt, Mycobacterium avium subsp. paratuberculosis
gugcgccgugcagcacgc

SEQ ID NO: 789930 - RNA, 13 nt, Mycobacterium avium subsp. paratuberculosis
gugcgcagccguc

SEQ ID NO: 789931 - RNA, 12 nt, Mycobacterium avium subsp. paratuberculosis
gugcgcagcgcg

SEQ ID NO: 789932 - RNA, 12 nt, Mycobacterium avium subsp. paratuberculosis
gugcgcagcacg

SEQ ID NO: 789933 - RNA, 17 nt, Mycobacterium avium subsp. paratuberculosis
gugcgcacgaacggcgc

SEQ ID NO: 789934 - RNA, 12 nt, Mycobacterium avium subsp. paratuberculosis
gugcgcacgauc

SEQ ID NO: 789935 - RNA, 22 nt, Mycobacterium avium subsp. paratuberculosis
gugcgcacgaucugcaggccga

SEQ ID NO: 789936 - RNA, 13 nt, Mycobacterium avium subsp. paratuberculosis
gugcgaucgccgu

SEQ ID NO: 789937 - RNA, 17 nt, Mycobacterium avium subsp. paratuberculosis
gugcgcaauggcgaaca

SEQ ID NO: 789938 - RNA, 13 nt, Mycobacterium avium subsp. paratuberculosis
gugcgcaccagca

SEQ ID NO: 789939 - RNA, 12 nt, Mycobacterium avium subsp. paratuberculosis
gugcggcgcccu

SEQ ID NO: 789940 - RNA, 13 nt, Mycobacterium avium subsp. paratuberculosis
gugcggcgccgcc

SEQ ID NO: 789941 - RNA, 21 nt, Mycobacterium avium subsp. paratuberculosis
gugcggcgcggugcgccgaca

SEQ ID NO: 789942 - RNA, 19 nt, Mycobacterium avium subsp. paratuberculosis
gugcggcgcugccggcgca

SEQ ID NO: 789943 - RNA, 13 nt, Mycobacterium avium subsp. paratuberculosis
gugcggcggcucg

SEQ ID NO: 789944 - RNA, 17 nt, Mycobacterium avium subsp. paratuberculosis
gugcggcggcucguuga

SEQ ID NO: 789945 - RNA, 17 nt, Mycobacterium avium subsp. paratuberculosis
gugcguacuucgcguuc

SEQ ID NO: 789946 - RNA, 14 nt, Mycobacterium avium subsp. paratuberculosis
gugcgugaccugcu

SEQ ID NO: 789947 - RNA, 15 nt, Mycobacterium avium subsp. paratuberculosis
gugcgugaccugcug

SEQ ID NO: 789948 - RNA, 22 nt, Mycobacterium avium subsp. paratuberculosis
gugcgugacgggcugauccgcg

SEQ ID NO: 789949 - RNA, 20 nt, Mycobacterium avium subsp. paratuberculosis
gugcgugacguaagugucgu

SEQ ID NO: 789950 - RNA, 18 nt, Mycobacterium avium subsp. paratuberculosis
gugcgugccagcagcucg

SEQ ID NO: 789951 - RNA, 15 nt, Mycobacterium avium subsp. paratuberculosis
gugcgucaucgcgcu

SEQ ID NO: 789952 - RNA, 20 nt, Mycobacterium avium subsp. paratuberculosis
gugcgucaucgcgcuggggu

SEQ ID NO: 789953 - RNA, 22 nt, Mycobacterium avium subsp. paratuberculosis
gugcguccagaccggccggggc

SEQ ID NO: 789954 - RNA, 13 nt, Mycobacterium avium subsp. paratuberculosis
gugcgucgggcgc

SEQ ID NO: 789955 - RNA, 17 nt, Mycobacterium avium subsp. paratuberculosis
gugcgucgggcgccggc

SEQ ID NO: 789956 - RNA, 22 nt, Mycobacterium avium subsp. paratuberculosis
gugcggcccgcggcaucgucgg

SEQ ID NO: 789957 - RNA, 16 nt, Mycobacterium avium subsp. paratuberculosis
gugcggcccggcacug

SEQ ID NO: 789958 - RNA, 15 nt, Mycobacterium avium subsp. paratuberculosis
gugcggccgcgaucg

SEQ ID NO: 789959 - RNA, 18 nt, Mycobacterium avium subsp. paratuberculosis
gugcggccgcgaucgcca

SEQ ID NO: 789960 - RNA, 19 nt, Mycobacterium avium subsp. paratuberculosis
gugcggccgcgcagcucga

SEQ ID NO: 789961 - RNA, 14 nt, Mycobacterium avium subsp. paratuberculosis
gugcggcaacccga

SEQ ID NO: 789962 - RNA, 16 nt, Mycobacterium avium subsp. paratuberculosis
gugcggcacgccgcag

SEQ ID NO: 789963 - RNA, 13 nt, Mycobacterium avium subsp. paratuberculosis
gugcggcagcucg

SEQ ID NO: 789964 - RNA, 17 nt, Mycobacterium avium subsp. paratuberculosis
gugcggcagcucggcgg

SEQ ID NO: 789965 - RNA, 15 nt, Mycobacterium avium subsp. paratuberculosis
gugcggccagcgcag

SEQ ID NO: 789966 - RNA, 13 nt, Mycobacterium avium subsp. paratuberculosis
gugcgcggcgaag

SEQ ID NO: 789967 - RNA, 20 nt, Mycobacterium avium subsp. paratuberculosis
gugcgcggcgaaggcauccc

SEQ ID NO: 789968 - RNA, 23 nt, Mycobacterium avium subsp. paratuberculosis
gugcgcggcgaccaccucggcga

SEQ ID NO: 789969 - RNA, 13 nt, Mycobacterium avium subsp. paratuberculosis
gugcgcgcgcacc

SEQ ID NO: 789970 - RNA, 21 nt, Mycobacterium avium subsp. paratuberculosis
gugcgccucgaucaacgccgg

SEQ ID NO: 789971 - RNA, 19 nt, Mycobacterium avium subsp. paratuberculosis
gugcgcgcgcgcucggcgu

SEQ ID NO: 789972 - RNA, 21 nt, Mycobacterium avium subsp. paratuberculosis
gugcgcgcgcgcucggcguug

SEQ ID NO: 789973 - RNA, 18 nt, Mycobacterium avium subsp. paratuberculosis
gugcgcgaguaggcgaag

SEQ ID NO: 789974 - RNA, 16 nt, Mycobacterium avium subsp. paratuberculosis
gugcgcgauggcgugc

SEQ ID NO: 789975 - RNA, 18 nt, Mycobacterium avium subsp. paratuberculosis
gugcgcgauggcgugccg

SEQ ID NO: 789976 - RNA, 22 nt, Mycobacterium avium subsp. paratuberculosis
gugcgcgauggcgugccggcgc

SEQ ID NO: 789977 - RNA, 13 nt, Mycobacterium avium subsp. paratuberculosis
gugcgcggcgucc

SEQ ID NO: 789978 - RNA, 17 nt, Mycobacterium avium subsp. paratuberculosis
gugcgcggcguccucga

SEQ ID NO: 789979 - RNA, 20 nt, Mycobacterium avium subsp. paratuberculosis
gugcgcggcguccucgauga

SEQ ID NO: 789980 - RNA, 15 nt, Mycobacterium avium subsp. paratuberculosis
gugcgcggcuggccg

SEQ ID NO: 789981 - RNA, 22 nt, Mycobacterium avium subsp. paratuberculosis
gugcgcggcuggccgucgucga

SEQ ID NO: 789982 - RNA, 15 nt, Mycobacterium avium subsp. paratuberculosis
gugcgcgggaacgau

SEQ ID NO: 789983 - RNA, 20 nt, Mycobacterium avium subsp. paratuberculosis
gugcgcgggaacgaucggcu

SEQ ID NO: 789984 - RNA, 14 nt, Mycobacterium avium subsp. paratuberculosis
gugcgcgggcgaaa

SEQ ID NO: 789985 - RNA, 16 nt, Mycobacterium avium subsp. paratuberculosis
gugcgcgggcgcccgu

SEQ ID NO: 789986 - RNA, 14 nt, Mycobacterium avium subsp. paratuberculosis
gugcggaacaccgc

SEQ ID NO: 789987 - RNA, 21 nt, Mycobacterium avium subsp. paratuberculosis
gugcggaaggcccccggcucg

SEQ ID NO: 789988 - RNA, 18 nt, Mycobacterium avium subsp. paratuberculosis
gugcggacggucgccgac

SEQ ID NO: 789989 - RNA, 20 nt, Mycobacterium avium subsp. paratuberculosis
gugcggaugaagugcgccag

SEQ ID NO: 789990 - RNA, 23 nt, Mycobacterium avium subsp. paratuberculosis
gugcggaugaagugcgccagcga

SEQ ID NO: 789991 - RNA, 19 nt, Mycobacterium avium subsp. paratuberculosis
gugcggaugaugguggcca

SEQ ID NO: 789992 - RNA, 22 nt, Mycobacterium avium subsp. paratuberculosis
gugcggaugaugguggccaguu

SEQ ID NO: 789993 - RNA, 23 nt, Mycobacterium avium subsp. paratuberculosis
gugcggaugcugaccaaggccga

SEQ ID NO: 789994 - RNA, 21 nt, Mycobacterium avium subsp. paratuberculosis
gugcggauggccccggcgagu

SEQ ID NO: 789995 - RNA, 17 nt, Mycobacterium avium subsp. paratuberculosis
gugcgcguggggcgucg

SEQ ID NO: 789996 - RNA, 14 nt, Mycobacterium avium subsp. paratuberculosis
gugcgcgcuggccg

SEQ ID NO: 789997 - RNA, 18 nt, Mycobacterium avium subsp. paratuberculosis
gugcgcucgacggccugc

SEQ ID NO: 789998 - RNA, 19 nt, Mycobacterium avium subsp. paratuberculosis
gugcgcugcagcgagaccu

SEQ ID NO: 789999 - RNA, 18 nt, Mycobacterium avium subsp. paratuberculosis
gugcgcuugucggcgugg

SEQ ID NO: 790000 - RNA, 21 nt, Mycobacterium avium subsp. paratuberculosis
gugcgcuugucggcguggccg

SEQ ID NO: 790001 - RNA, 15 nt, Mycobacterium avium subsp. paratuberculosis
gugcggaaaagucgg

SEQ ID NO: 790002 - RNA, 19 nt, Mycobacterium avium subsp. paratuberculosis
gugccgggccagcugcucg

SEQ ID NO: 790003 - RNA, 17 nt, Mycobacterium avium subsp. paratuberculosis
gugccggcgcucgucgu

SEQ ID NO: 790004 - RNA, 19 nt, Mycobacterium avium subsp. paratuberculosis
gugccggcgcucgucgucg

SEQ ID NO: 790005 - RNA, 20 nt, Mycobacterium avium subsp. paratuberculosis
gugccggcgcucgucgucgc

SEQ ID NO: 790006 - RNA, 15 nt, Mycobacterium avium subsp. paratuberculosis
gugccggcggcgcgg

SEQ ID NO: 790007 - RNA, 20 nt, Mycobacterium avium subsp. paratuberculosis
gugccggcgggucagcagcg

SEQ ID NO: 790008 - RNA, 13 nt, Mycobacterium avium subsp. paratuberculosis
gugccgcccgucg

SEQ ID NO: 790009 - RNA, 14 nt, Mycobacterium avium subsp. paratuberculosis
gugccgcccgucgc

SEQ ID NO: 790010 - RNA, 15 nt, Mycobacterium avium subsp. paratuberculosis
gugccgcccgucgcc

SEQ ID NO: 790011 - RNA, 19 nt, Mycobacterium avium subsp. paratuberculosis
gugccgcccaacgacgucg

SEQ ID NO: 790012 - RNA, 20 nt, Mycobacterium avium subsp. paratuberculosis
gugccgcccaacgacgucgg

SEQ ID NO: 790013 - RNA, 19 nt, Mycobacterium avium subsp. paratuberculosis
gugccgccgaugacggcgc

SEQ ID NO: 790014 - RNA, 20 nt, Mycobacterium avium subsp. paratuberculosis
gugccgccgaugacggcgcg

SEQ ID NO: 790015 - RNA, 14 nt, Mycobacterium avium subsp. paratuberculosis
gugccgccggcgau

SEQ ID NO: 790016 - RNA, 15 nt, Mycobacterium avium subsp. paratuberculosis
gugccgccggcgauc

SEQ ID NO: 790017 - RNA, 13 nt, Mycobacterium avium subsp. paratuberculosis
gugccggcgagug

SEQ ID NO: 790018 - RNA, 20 nt, Mycobacterium avium subsp. paratuberculosis
gugccggcgagugcgaauca

SEQ ID NO: 790019 - RNA, 15 nt, Mycobacterium avium subsp. paratuberculosis
gugccggcgcaccgc

SEQ ID NO: 790020 - RNA, 19 nt, Mycobacterium avium subsp. paratuberculosis
gugccggcgcaccgcgucg

SEQ ID NO: 790021 - RNA, 18 nt, Mycobacterium avium subsp. paratuberculosis
gugccgcagugccggcgc

SEQ ID NO: 790022 - RNA, 14 nt, Mycobacterium avium subsp. paratuberculosis
gugccgcagcucga

SEQ ID NO: 790023 - RNA, 14 nt, Mycobacterium avium subsp. paratuberculosis
gugccgcagcggcg

SEQ ID NO: 790024 - RNA, 23 nt, Mycobacterium avium subsp. paratuberculosis
gugccgcaccagcaccccgccgc

SEQ ID NO: 790025 - RNA, 15 nt, Mycobacterium avium subsp. paratuberculosis
gugccgaugccggcc

SEQ ID NO: 790026 - RNA, 17 nt, Mycobacterium avium subsp. paratuberculosis
gugccgaugccggccug

SEQ ID NO: 790027 - RNA, 13 nt, Mycobacterium avium subsp. paratuberculosis
gugccgauggcca

SEQ ID NO: 790028 - RNA, 12 nt, Mycobacterium avium subsp. paratuberculosis
gugccgagcacg

SEQ ID NO: 790029 - RNA, 15 nt, Mycobacterium avium subsp. paratuberculosis
gugccgagcacgcgg

SEQ ID NO: 790030 - RNA, 19 nt, Mycobacterium avium subsp. paratuberculosis
gugccgagcacgcggccgc

SEQ ID NO: 790031 - RNA, 20 nt, Mycobacterium avium subsp. paratuberculosis
gugccgagcacgcggccgcg

SEQ ID NO: 790032 - RNA, 17 nt, Mycobacterium avium subsp. paratuberculosis
gugccgagcccgccggc

SEQ ID NO: 790033 - RNA, 21 nt, Mycobacterium avium subsp. paratuberculosis
gugccgagcccgccggcggcg

SEQ ID NO: 790034 - RNA, 23 nt, Mycobacterium avium subsp. paratuberculosis
gugccgaguucgaccucggugau

SEQ ID NO: 790035 - RNA, 14 nt, Mycobacterium avium subsp. paratuberculosis
gugccgaucaccuc

SEQ ID NO: 790036 - RNA, 15 nt, Mycobacterium avium subsp. paratuberculosis
gugccgaucgagacc

SEQ ID NO: 790037 - RNA, 18 nt, Mycobacterium avium subsp. paratuberculosis
gugcccuuccccggcggc

SEQ ID NO: 790038 - RNA, 22 nt, Mycobacterium avium subsp. paratuberculosis
gugccgaacacguacagcggcg

SEQ ID NO: 790039 - RNA, 14 nt, Mycobacterium avium subsp. paratuberculosis
gugccgaacagcga

SEQ ID NO: 790040 - RNA, 16 nt, Mycobacterium avium subsp. paratuberculosis
gugccgaacagcgacg

SEQ ID NO: 790041 - RNA, 20 nt, Mycobacterium avium subsp. paratuberculosis
gugccgaacagcgacgucug

SEQ ID NO: 790042 - RNA, 21 nt, Mycobacterium avium subsp. paratuberculosis
gugccgaaccggaucuggccc

SEQ ID NO: 790043 - RNA, 19 nt, Mycobacterium avium subsp. paratuberculosis
gugccgaagcgccacgggg

SEQ ID NO: 790044 - RNA, 22 nt, Mycobacterium avium subsp. paratuberculosis
gugccgaagcgccacggggcgc

SEQ ID NO: 790045 - RNA, 15 nt, Mycobacterium avium subsp. paratuberculosis
gugccgaagcgccgc

SEQ ID NO: 790046 - RNA, 15 nt, Mycobacterium avium subsp. paratuberculosis
gugccgaagggcaac

SEQ ID NO: 790047 - RNA, 12 nt, Mycobacterium avium subsp. paratuberculosis
gugccgaacgug

SEQ ID NO: 790048 - RNA, 14 nt, Mycobacterium avium subsp. paratuberculosis
gugccgaccagccg

SEQ ID NO: 790049 - RNA, 17 nt, Mycobacterium avium subsp. paratuberculosis
gugccacgaugaugccc

SEQ ID NO: 790050 - RNA, 16 nt, Mycobacterium avium subsp. paratuberculosis
gugccacggccgcggc

SEQ ID NO: 790051 - RNA, 17 nt, Mycobacterium avium subsp. paratuberculosis
gugccacggccgcggcc

SEQ ID NO: 790052 - RNA, 21 nt, Mycobacterium avium subsp. paratuberculosis
gugccacggccgcggcccggc

SEQ ID NO: 790053 - RNA, 20 nt, Mycobacterium avium subsp. paratuberculosis
gugcccgggccgcagcucgc

SEQ ID NO: 790054 - RNA, 22 nt, Mycobacterium avium subsp. paratuberculosis
gugcccgggguccaccggccga

SEQ ID NO: 790055 - RNA, 16 nt, Mycobacterium avium subsp. paratuberculosis
gugcccgucggcaacg

SEQ ID NO: 790056 - RNA, 19 nt, Mycobacterium avium subsp. paratuberculosis
gugcccgucggcaacgccg

SEQ ID NO: 790057 - RNA, 13 nt, Mycobacterium avium subsp. paratuberculosis
gugcccgucggcc

SEQ ID NO: 790058 - RNA, 18 nt, Mycobacterium avium subsp. paratuberculosis
gugcccguugcccgauca

SEQ ID NO: 790059 - RNA, 22 nt, Mycobacterium avium subsp. paratuberculosis
gugcccguugcccgaucagccg

SEQ ID NO: 790060 - RNA, 15 nt, Mycobacterium avium subsp. paratuberculosis
gugcccuccucgccg

SEQ ID NO: 790061 - RNA, 17 nt, Mycobacterium avium subsp. paratuberculosis
gugcccuccucgccgga

SEQ ID NO: 790062 - RNA, 16 nt, Mycobacterium avium subsp. paratuberculosis
gugccaccgccgaugg

SEQ ID NO: 790063 - RNA, 14 nt, Mycobacterium avium subsp. paratuberculosis
gugccacaggccga

SEQ ID NO: 790064 - RNA, 14 nt, Mycobacterium avium subsp. paratuberculosis
gugccaccaccacg

SEQ ID NO: 790065 - RNA, 20 nt, Mycobacterium avium subsp. paratuberculosis
gugccaccaccacggccagg

SEQ ID NO: 790066 - RNA, 19 nt, Mycobacterium avium subsp. paratuberculosis
gugccaaugaaauucaggc

SEQ ID NO: 790067 - RNA, 22 nt, Mycobacterium avium subsp. paratuberculosis
gugccaaugaaauucaggccac

SEQ ID NO: 790068 - RNA, 17 nt, Mycobacterium avium subsp. paratuberculosis
gugcaguacgcaucggc

SEQ ID NO: 790069 - RNA, 20 nt, Mycobacterium avium subsp. paratuberculosis
gugcaguacgcaucggcgcc

SEQ ID NO: 790070 - RNA, 21 nt, Mycobacterium avium subsp. paratuberculosis
gugcaguacgcaucggcgccg

SEQ ID NO: 790071 - RNA, 19 nt, Mycobacterium avium subsp. paratuberculosis
gugcagucggucggucagc

SEQ ID NO: 790072 - RNA, 18 nt, Mycobacterium avium subsp. paratuberculosis
gugcaggugcccgucggc

SEQ ID NO: 790073 - RNA, 21 nt, Mycobacterium avium subsp. paratuberculosis
gugccaagcgguuccagaccg

SEQ ID NO: 790074 - RNA, 23 nt, Mycobacterium avium subsp. paratuberculosis
gugccaagcguauccggccagcc

SEQ ID NO: 790075 - RNA, 18 nt, Mycobacterium avium subsp. paratuberculosis
gugccaaggucgccggug

SEQ ID NO: 790076 - RNA, 23 nt, Mycobacterium avium subsp. paratuberculosis
gugcaggaugaccgcgucggcgc

SEQ ID NO: 790077 - RNA, 17 nt, Mycobacterium avium subsp. paratuberculosis
gugcagggggcgcagcc

SEQ ID NO: 790078 - RNA, 17 nt, Mycobacterium avium subsp. paratuberculosis
gugcagggucagcagca

SEQ ID NO: 790079 - RNA, 19 nt, Mycobacterium avium subsp. paratuberculosis
gugcaggcugacgcgaccg

SEQ ID NO: 790080 - RNA, 21 nt, Mycobacterium avium subsp. paratuberculosis
gugcaggcugacgcgaccgcg

SEQ ID NO: 790081 - RNA, 19 nt, Mycobacterium avium subsp. paratuberculosis
gugcaggccgcggguggcg

SEQ ID NO: 790082 - RNA, 14 nt, Mycobacterium avium subsp. paratuberculosis
guacaccggcucgc

SEQ ID NO: 790083 - RNA, 18 nt, Mycobacterium avium subsp. paratuberculosis
guacaccggcugaccggc

SEQ ID NO: 790084 - RNA, 19 nt, Mycobacterium avium subsp. paratuberculosis
guacaccggcugaccggcg

SEQ ID NO: 790085 - RNA, 19 nt, Mycobacterium avium subsp. paratuberculosis
guacaccgggaucggggug

SEQ ID NO: 790086 - RNA, 15 nt, Mycobacterium avium subsp. paratuberculosis
guacaccgggcuggu

SEQ ID NO: 790087 - RNA, 17 nt, Mycobacterium avium subsp. paratuberculosis
guacaaggugauggccc

SEQ ID NO: 790088 - RNA, 16 nt, Mycobacterium avium subsp. paratuberculosis
guacaccaccgcggcg

SEQ ID NO: 790089 - RNA, 17 nt, Mycobacterium avium subsp. paratuberculosis
guacaccaccgcggcga

SEQ ID NO: 790090 - RNA, 18 nt, Mycobacterium avium subsp. paratuberculosis
guacacagggcggcgaca

SEQ ID NO: 790091 - RNA, 14 nt, Mycobacterium avium subsp. paratuberculosis
guaccaccaccagu

SEQ ID NO: 790092 - RNA, 14 nt, Mycobacterium avium subsp. paratuberculosis
guaccacgccgucg

SEQ ID NO: 790093 - RNA, 15 nt, Mycobacterium avium subsp. paratuberculosis
guaccacgccgucga

SEQ ID NO: 790094 - RNA, 22 nt, Mycobacterium avium subsp. paratuberculosis
guacaucguucccugcgcggcg

SEQ ID NO: 790095 - RNA, 16 nt, Mycobacterium avium subsp. paratuberculosis
guacaggugcagcagc

SEQ ID NO: 790096 - RNA, 13 nt, Mycobacterium avium subsp. paratuberculosis
guacagggcgucg

SEQ ID NO: 790097 - RNA, 13 nt, Mycobacterium avium subsp. paratuberculosis
guacaggucgacc

SEQ ID NO: 790098 - RNA, 22 nt, Mycobacterium avium subsp. paratuberculosis
guacaggucgcugcccggcgug

SEQ ID NO: 790099 - RNA, 13 nt, Mycobacterium avium subsp. paratuberculosis
guacagcccgcgg

SEQ ID NO: 790100 - RNA, 11 nt, Mycobacterium avium subsp. paratuberculosis
guacagccgca

SEQ ID NO: 790101 - RNA, 21 nt, Mycobacterium avium subsp. paratuberculosis
guacagcagccccugcaccac

SEQ ID NO: 790102 - RNA, 15 nt, Mycobacterium avium subsp. paratuberculosis
guacagcaccgccgc

SEQ ID NO: 790103 - RNA, 16 nt, Mycobacterium avium subsp. paratuberculosis
guacagcaccgccgcg

SEQ ID NO: 790104 - RNA, 18 nt, Mycobacterium avium subsp. paratuberculosis
guacacggcccgcggcac

SEQ ID NO: 790105 - RNA, 12 nt, Mycobacterium avium subsp. paratuberculosis
guacaccucgag

SEQ ID NO: 790106 - RNA, 20 nt, Mycobacterium avium subsp. paratuberculosis
guacaggaucaacucgucgg

SEQ ID NO: 790107 - RNA, 15 nt, Mycobacterium avium subsp. paratuberculosis
guacaggccgucggg

SEQ ID NO: 790108 - RNA, 22 nt, Mycobacterium avium subsp. paratuberculosis
guacagcuaggccagcagcgcg

SEQ ID NO: 790109 - RNA, 15 nt, Mycobacterium avium subsp. paratuberculosis
guacagcgcgccgcg

SEQ ID NO: 790110 - RNA, 19 nt, Mycobacterium avium subsp. paratuberculosis
guacagcgacagcagcgug

SEQ ID NO: 790111 - RNA, 20 nt, Mycobacterium avium subsp. paratuberculosis
guacagcgacagcagcgugg

SEQ ID NO: 790112 - RNA, 17 nt, Mycobacterium avium subsp. paratuberculosis
guacagcgacuccagcg

SEQ ID NO: 790113 - RNA, 23 nt, Mycobacterium avium subsp. paratuberculosis
guacagcgacuccagcgcgauca

SEQ ID NO: 790114 - RNA, 13 nt, Mycobacterium avium subsp. paratuberculosis
guacagcgccagc

SEQ ID NO: 790115 - RNA, 15 nt, Mycobacterium avium subsp. paratuberculosis
guacagcgccagcgg

SEQ ID NO: 790116 - RNA, 19 nt, Mycobacterium avium subsp. paratuberculosis
guacagcgccagcggcuug

SEQ ID NO: 790117 - RNA, 13 nt, Mycobacterium avium subsp. paratuberculosis
guacagcgccgcg

SEQ ID NO: 790118 - RNA, 16 nt, Mycobacterium avium subsp. paratuberculosis
guacagcgccgcggcc

SEQ ID NO: 790119 - RNA, 20 nt, Mycobacterium avium subsp. paratuberculosis
guacagcgccgcggccagcc

SEQ ID NO: 790120 - RNA, 18 nt, Mycobacterium avium subsp. paratuberculosis
guaaauugaacgccgcca

SEQ ID NO: 790121 - RNA, 13 nt, Mycobacterium avium subsp. paratuberculosis
guaacgcgucgac

SEQ ID NO: 790122 - RNA, 20 nt, Mycobacterium avium subsp. paratuberculosis
gguuuggccagcaccgcggc

SEQ ID NO: 790123 - RNA, 16 nt, Mycobacterium avium subsp. paratuberculosis
gguuguucugcucgaa

SEQ ID NO: 790124 - RNA, 19 nt, Mycobacterium avium subsp. paratuberculosis
gguuuugcgucugcucggc

SEQ ID NO: 790125 - RNA, 22 nt, Mycobacterium avium subsp. paratuberculosis
gguuuugcgucugcucggcggc

SEQ ID NO: 790126 - RNA, 20 nt, Mycobacterium avium subsp. paratuberculosis
gguuuuugauugcgcggcgc

SEQ ID NO: 790127 - RNA, 17 nt, Mycobacterium avium subsp. paratuberculosis
gguuguagcaggcggug

SEQ ID NO: 790128 - RNA, 16 nt, Mycobacterium avium subsp. paratuberculosis
gguuguagucggcgcc

SEQ ID NO: 790129 - RNA, 22 nt, Mycobacterium avium subsp. paratuberculosis
gguugucgacguggugcaccgc

SEQ ID NO: 790130 - RNA, 16 nt, Mycobacterium avium subsp. paratuberculosis
gguugucgccgcgcca

SEQ ID NO: 790131 - RNA, 22 nt, Mycobacterium avium subsp. paratuberculosis
gguugucgcucagaggcgggca

SEQ ID NO: 790132 - RNA, 18 nt, Mycobacterium avium subsp. paratuberculosis
gguuguccagccggugca

SEQ ID NO: 790133 - RNA, 14 nt, Mycobacterium avium subsp. paratuberculosis
gguugucggucagg

SEQ ID NO: 790134 - RNA, 15 nt, Mycobacterium avium subsp. paratuberculosis
gguugucggucaggc

SEQ ID NO: 790135 - RNA, 12 nt, Mycobacterium avium subsp. paratuberculosis
gguugucgucgg

SEQ ID NO: 790136 - RNA, 15 nt, Mycobacterium avium subsp. paratuberculosis
gguugucgucgggca

SEQ ID NO: 790137 - RNA, 23 nt, Mycobacterium avium subsp. paratuberculosis
gguugucgucgggcaccacggcg

SEQ ID NO: 790138 - RNA, 17 nt, Mycobacterium avium subsp. paratuberculosis
gguuggucaauccgggc

SEQ ID NO: 790139 - RNA, 15 nt, Mycobacterium avium subsp. paratuberculosis
gguuggucggagccg

SEQ ID NO: 790140 - RNA, 13 nt, Mycobacterium avium subsp. paratuberculosis
gguuggucggcgc

SEQ ID NO: 790141 - RNA, 14 nt, Mycobacterium avium subsp. paratuberculosis
gguuggucggcgcg

SEQ ID NO: 790142 - RNA, 20 nt, Mycobacterium avium subsp. paratuberculosis
gguuggucggcgcggcgacg

SEQ ID NO: 790143 - RNA, 15 nt, Mycobacterium avium subsp. paratuberculosis
gguuggcgccgguga

SEQ ID NO: 790144 - RNA, 16 nt, Mycobacterium avium subsp. paratuberculosis
gguugggcggcggcca

SEQ ID NO: 790145 - RNA, 13 nt, Mycobacterium avium subsp. paratuberculosis
gguuggcggcggc

SEQ ID NO: 790146 - RNA, 15 nt, Mycobacterium avium subsp. paratuberculosis
gguuggcggcggccc

SEQ ID NO: 790147 - RNA, 13 nt, Mycobacterium avium subsp. paratuberculosis
gguugcuccucgg

SEQ ID NO: 790148 - RNA, 15 nt, Mycobacterium avium subsp. paratuberculosis
gguuggcccgcacca

SEQ ID NO: 790149 - RNA, 19 nt, Mycobacterium avium subsp. paratuberculosis
gguuggcccuucgaccucg

SEQ ID NO: 790150 - RNA, 15 nt, Mycobacterium avium subsp. paratuberculosis
gguucgacgucacga

SEQ ID NO: 790151 - RNA, 15 nt, Mycobacterium avium subsp. paratuberculosis
gguugcgguggccga

SEQ ID NO: 790152 - RNA, 14 nt, Mycobacterium avium subsp. paratuberculosis
gguugcgguguugc

SEQ ID NO: 790153 - RNA, 19 nt, Mycobacterium avium subsp. paratuberculosis
gguucgacgccucggugcg

SEQ ID NO: 790154 - RNA, 18 nt, Mycobacterium avium subsp. paratuberculosis
gguuccaguacccgcgca

SEQ ID NO: 790155 - RNA, 17 nt, Mycobacterium avium subsp. paratuberculosis
gguucccgugcuggcca

SEQ ID NO: 790156 - RNA, 14 nt, Mycobacterium avium subsp. paratuberculosis
gguuccgggcgacc

SEQ ID NO: 790157 - RNA, 13 nt, Mycobacterium avium subsp. paratuberculosis
gguuccggucacg

SEQ ID NO: 790158 - RNA, 18 nt, Mycobacterium avium subsp. paratuberculosis
gguucccggccgguggcc

SEQ ID NO: 790159 - RNA, 23 nt, Mycobacterium avium subsp. paratuberculosis
gguucauguggaagccgcgaucg

SEQ ID NO: 790160 - RNA, 19 nt, Mycobacterium avium subsp. paratuberculosis
gguuccagaccggcggcga

SEQ ID NO: 790161 - RNA, 19 nt, Mycobacterium avium subsp. paratuberculosis
gguuccagccauucgucgg

SEQ ID NO: 790162 - RNA, 22 nt, Mycobacterium avium subsp. paratuberculosis
gguuccaaccaccguggcccca

SEQ ID NO: 790163 - RNA, 13 nt, Mycobacterium avium subsp. paratuberculosis
gguuccaccgggc

SEQ ID NO: 790164 - RNA, 18 nt, Mycobacterium avium subsp. paratuberculosis
gguuccaccgggccgcca

SEQ ID NO: 790165 - RNA, 15 nt, Mycobacterium avium subsp. paratuberculosis
gguuccaccggucgg

SEQ ID NO: 790166 - RNA, 18 nt, Mycobacterium avium subsp. paratuberculosis
gguuaccagcucaccggg

SEQ ID NO: 790167 - RNA, 13 nt, Mycobacterium avium subsp. paratuberculosis
gguuaccggugca

SEQ ID NO: 790168 - RNA, 14 nt, Mycobacterium avium subsp. paratuberculosis
gguguuuggccgcg

SEQ ID NO: 790169 - RNA, 17 nt, Mycobacterium avium subsp. paratuberculosis
gguguuucggucggcgu

SEQ ID NO: 790170 - RNA, 23 nt, Mycobacterium avium subsp. paratuberculosis
ggugugcggcagcucggcggccc

SEQ ID NO: 790171 - RNA, 15 nt, Mycobacterium avium subsp. paratuberculosis
ggugugcgggucggu

SEQ ID NO: 790172 - RNA, 20 nt, Mycobacterium avium subsp. paratuberculosis
gguguggaucuccagcagcu

SEQ ID NO: 790173 - RNA, 14 nt, Mycobacterium avium subsp. paratuberculosis
gguguggcaggugg

SEQ ID NO: 790174 - RNA, 14 nt, Mycobacterium avium subsp. paratuberculosis
gguguggccgcggu

SEQ ID NO: 790175 - RNA, 16 nt, Mycobacterium avium subsp. paratuberculosis
gguguggccgcggugg

SEQ ID NO: 790176 - RNA, 13 nt, Mycobacterium avium subsp. paratuberculosis
ggugucgccgucg

SEQ ID NO: 790177 - RNA, 15 nt, Mycobacterium avium subsp. paratuberculosis
ggugucgccgucgcc

SEQ ID NO: 790178 - RNA, 13 nt, Mycobacterium avium subsp. paratuberculosis
ggugucggggucg

SEQ ID NO: 790179 - RNA, 17 nt, Mycobacterium avium subsp. paratuberculosis
ggugucggggucgucga

SEQ ID NO: 790180 - RNA, 23 nt, Mycobacterium avium subsp. paratuberculosis
ggugucggugccgagcacgcggc

SEQ ID NO: 790181 - RNA, 19 nt, Mycobacterium avium subsp. paratuberculosis
ggugucguagacgacgucg

SEQ ID NO: 790182 - RNA, 18 nt, Mycobacterium avium subsp. paratuberculosis
ggugucguaguugcgcgc

SEQ ID NO: 790183 - RNA, 13 nt, Mycobacterium avium subsp. paratuberculosis
ggugucgucgacc

SEQ ID NO: 790184 - RNA, 18 nt, Mycobacterium avium subsp. paratuberculosis
ggugucgucgaccucgau

SEQ ID NO: 790185 - RNA, 14 nt, Mycobacterium avium subsp. paratuberculosis
ggugucgcccucgc

SEQ ID NO: 790186 - RNA, 15 nt, Mycobacterium avium subsp. paratuberculosis
ggugucgcccucgcg

SEQ ID NO: 790187 - RNA, 18 nt, Mycobacterium avium subsp. paratuberculosis
ggugucgccgagccgcac

SEQ ID NO: 790188 - RNA, 11 nt, Mycobacterium avium subsp. paratuberculosis
ggugucgucgu

SEQ ID NO: 790189 - RNA, 13 nt, Mycobacterium avium subsp. paratuberculosis
ggugucggcgaag

SEQ ID NO: 790190 - RNA, 16 nt, Mycobacterium avium subsp. paratuberculosis
ggugucggcgccccgg

SEQ ID NO: 790191 - RNA, 12 nt, Mycobacterium avium subsp. paratuberculosis
ggugucggcggg

SEQ ID NO: 790192 - RNA, 16 nt, Mycobacterium avium subsp. paratuberculosis
ggugucggcggggccg

SEQ ID NO: 790193 - RNA, 14 nt, Mycobacterium avium subsp. paratuberculosis
ggugucggcgucga

SEQ ID NO: 790194 - RNA, 19 nt, Mycobacterium avium subsp. paratuberculosis
ggugucggcgucgaucgcc

SEQ ID NO: 790195 - RNA, 13 nt, Mycobacterium avium subsp. paratuberculosis
ggugucgaggucg

SEQ ID NO: 790196 - RNA, 20 nt, Mycobacterium avium subsp. paratuberculosis
ggugucgaggucgucggcca

SEQ ID NO: 790197 - RNA, 23 nt, Mycobacterium avium subsp. paratuberculosis
ggugucgauagugaacgccucgg

SEQ ID NO: 790198 - RNA, 17 nt, Mycobacterium avium subsp. paratuberculosis
ggugugacgcucgcggu

SEQ ID NO: 790199 - RNA, 15 nt, Mycobacterium avium subsp. paratuberculosis
ggugugacggauccg

SEQ ID NO: 790200 - RNA, 17 nt, Mycobacterium avium subsp. paratuberculosis
ggugucugaccucgcgc

SEQ ID NO: 790201 - RNA, 18 nt, Mycobacterium avium subsp. paratuberculosis
ggugucugaccucgcgcc

SEQ ID NO: 790202 - RNA, 16 nt, Mycobacterium avium subsp. paratuberculosis
ggugugcaaggcgaug

SEQ ID NO: 790203 - RNA, 14 nt, Mycobacterium avium subsp. paratuberculosis
ggugugcaccagcg

SEQ ID NO: 790204 - RNA, 21 nt, Mycobacterium avium subsp. paratuberculosis
ggugugcccgaacgcgcgucg

SEQ ID NO: 790205 - RNA, 14 nt, Mycobacterium avium subsp. paratuberculosis
ggugugccgcuggu

SEQ ID NO: 790206 - RNA, 20 nt, Mycobacterium avium subsp. paratuberculosis
ggugugccgcugguaggcgg

SEQ ID NO: 790207 - RNA, 21 nt, Mycobacterium avium subsp. paratuberculosis
ggugugccuggcuccccggcg

SEQ ID NO: 790208 - RNA, 14 nt, Mycobacterium avium subsp. paratuberculosis
ggugugcggcacga

SEQ ID NO: 790209 - RNA, 14 nt, Mycobacterium avium subsp. paratuberculosis
ggugugcggcacgg

SEQ ID NO: 790210 - RNA, 16 nt, Mycobacterium avium subsp. paratuberculosis
ggugugcggcacggcg

SEQ ID NO: 790211 - RNA, 15 nt, Mycobacterium avium subsp. paratuberculosis
ggugugcucggcggc

SEQ ID NO: 790212 - RNA, 16 nt, Mycobacterium avium subsp. paratuberculosis
ggugugcucggcggcg

SEQ ID NO: 790213 - RNA, 13 nt, Mycobacterium avium subsp. paratuberculosis
gguguagcgagug

SEQ ID NO: 790214 - RNA, 19 nt, Mycobacterium avium subsp. paratuberculosis
gguguagcggauggcgacg

SEQ ID NO: 790215 - RNA, 19 nt, Mycobacterium avium subsp. paratuberculosis
gguggugcccaucgacccg

SEQ ID NO: 790216 - RNA, 19 nt, Mycobacterium avium subsp. paratuberculosis
gguggugcccccgcccggc

SEQ ID NO: 790217 - RNA, 17 nt, Mycobacterium avium subsp. paratuberculosis
gguggugccgccgucga

SEQ ID NO: 790218 - RNA, 14 nt, Mycobacterium avium subsp. paratuberculosis
gguggugcggcccu

SEQ ID NO: 790219 - RNA, 16 nt, Mycobacterium avium subsp. paratuberculosis
gguggugcucgccccg

SEQ ID NO: 790220 - RNA, 22 nt, Mycobacterium avium subsp. paratuberculosis
ggugucacguccacgccgcggg

SEQ ID NO: 790221 - RNA, 14 nt, Mycobacterium avium subsp. paratuberculosis
ggugucagcgcgac

SEQ ID NO: 790222 - RNA, 18 nt, Mycobacterium avium subsp. paratuberculosis
ggugucagcgcgaccucg

SEQ ID NO: 790223 - RNA, 17 nt, Mycobacterium avium subsp. paratuberculosis
ggugucaggucggcgau

SEQ ID NO: 790224 - RNA, 15 nt, Mycobacterium avium subsp. paratuberculosis
gguguaguccugcuu

SEQ ID NO: 790225 - RNA, 16 nt, Mycobacterium avium subsp. paratuberculosis
ggugucaccgacgcca

SEQ ID NO: 790226 - RNA, 20 nt, Mycobacterium avium subsp. paratuberculosis
ggugucacgcuggcgugacg

SEQ ID NO: 790227 - RNA, 22 nt, Mycobacterium avium subsp. paratuberculosis
ggugucgacgcugagcacccgc

SEQ ID NO: 790228 - RNA, 23 nt, Mycobacterium avium subsp. paratuberculosis
ggugucgacgguugccucggcca

SEQ ID NO: 790229 - RNA, 16 nt, Mycobacterium avium subsp. paratuberculosis
ggugucgagccggugc

SEQ ID NO: 790230 - RNA, 18 nt, Mycobacterium avium subsp. paratuberculosis
ggugucgagccggugccg

SEQ ID NO: 790231 - RNA, 17 nt, Mycobacterium avium subsp. paratuberculosis
gguguccuugcgcacca

SEQ ID NO: 790232 - RNA, 19 nt, Mycobacterium avium subsp. paratuberculosis
ggugucgaaaccgcccagu

SEQ ID NO: 790233 - RNA, 14 nt, Mycobacterium avium subsp. paratuberculosis
gguguccggcccga

SEQ ID NO: 790234 - RNA, 17 nt, Mycobacterium avium subsp. paratuberculosis
gguguccgagcgggccg

SEQ ID NO: 790235 - RNA, 14 nt, Mycobacterium avium subsp. paratuberculosis
ggugucccagcgcc

SEQ ID NO: 790236 - RNA, 15 nt, Mycobacterium avium subsp. paratuberculosis
ggugucccagcgcca

SEQ ID NO: 790237 - RNA, 23 nt, Mycobacterium avium subsp. paratuberculosis
ggugucccaguucccggcgggca

SEQ ID NO: 790238 - RNA, 13 nt, Mycobacterium avium subsp. paratuberculosis
ggugucccgcgcc

SEQ ID NO: 790239 - RNA, 17 nt, Mycobacterium avium subsp. paratuberculosis
ggugucccgcgcccgcg

SEQ ID NO: 790240 - RNA, 20 nt, Mycobacterium avium subsp. paratuberculosis
ggugucccgcguggccgcca

SEQ ID NO: 790241 - RNA, 16 nt, Mycobacterium avium subsp. paratuberculosis
gguguccacccgcgcc

SEQ ID NO: 790242 - RNA, 14 nt, Mycobacterium avium subsp. paratuberculosis
gguguccacgaugc

SEQ ID NO: 790243 - RNA, 19 nt, Mycobacterium avium subsp. paratuberculosis
gguguccacgaugcggugc

SEQ ID NO: 790244 - RNA, 15 nt, Mycobacterium avium subsp. paratuberculosis
gguguccacgucgcc

SEQ ID NO: 790245 - RNA, 17 nt, Mycobacterium avium subsp. paratuberculosis
gguguccacgucgccca

SEQ ID NO: 790246 - RNA, 22 nt, Mycobacterium avium subsp. paratuberculosis
gguguccagcccuacccgucca

SEQ ID NO: 790247 - RNA, 17 nt, Mycobacterium avium subsp. paratuberculosis
gguguccagccgcacga

SEQ ID NO: 790248 - RNA, 13 nt, Mycobacterium avium subsp. paratuberculosis
gguguccagcggc

SEQ ID NO: 790249 - RNA, 13 nt, Mycobacterium avium subsp. paratuberculosis
gguggugcaggcg

SEQ ID NO: 790250 - RNA, 13 nt, Mycobacterium avium subsp. paratuberculosis
gguggugaacgcg

SEQ ID NO: 790251 - RNA, 16 nt, Mycobacterium avium subsp. paratuberculosis
gguggugaucacccag

SEQ ID NO: 790252 - RNA, 20 nt, Mycobacterium avium subsp. paratuberculosis
gguggugaucacccagccgu

SEQ ID NO: 790253 - RNA, 23 nt, Mycobacterium avium subsp. paratuberculosis
gguggugaucacccagccguugg

SEQ ID NO: 790254 - RNA, 13 nt, Mycobacterium avium subsp. paratuberculosis
gguggucgacgag

SEQ ID NO: 790255 - RNA, 17 nt, Mycobacterium avium subsp. paratuberculosis
gguggucgacgcgccgc

SEQ ID NO: 790256 - RNA, 14 nt, Mycobacterium avium subsp. paratuberculosis
gguggucgccgucg

SEQ ID NO: 790257 - RNA, 12 nt, Mycobacterium avium subsp. paratuberculosis
gguggucgucga

SEQ ID NO: 790258 - RNA, 22 nt, Mycobacterium avium subsp. paratuberculosis
gguggucugccagaacggcggc

SEQ ID NO: 790259 - RNA, 15 nt, Mycobacterium avium subsp. paratuberculosis
ggugggcgcgggccg

SEQ ID NO: 790260 - RNA, 13 nt, Mycobacterium avium subsp. paratuberculosis
ggugggcgcggug

SEQ ID NO: 790261 - RNA, 13 nt, Mycobacterium avium subsp. paratuberculosis
ggugggcggccac

SEQ ID NO: 790262 - RNA, 16 nt, Mycobacterium avium subsp. paratuberculosis
ggugggcggcgggagc

SEQ ID NO: 790263 - RNA, 21 nt, Mycobacterium avium subsp. paratuberculosis
ggugggcgaacgaggccgacg

SEQ ID NO: 790264 - RNA, 13 nt, Mycobacterium avium subsp. paratuberculosis
ggugggcgacgag

SEQ ID NO: 790265 - RNA, 18 nt, Mycobacterium avium subsp. paratuberculosis
ggugggcgacgucgucgc

SEQ ID NO: 790266 - RNA, 21 nt, Mycobacterium avium subsp. paratuberculosis
ggugggcgacgucgucgccca

SEQ ID NO: 790267 - RNA, 18 nt, Mycobacterium avium subsp. paratuberculosis
ggugggcgucguggucga

SEQ ID NO: 790268 - RNA, 20 nt, Mycobacterium avium subsp. paratuberculosis
ggugggcgucguggucgacg

SEQ ID NO: 790269 - RNA, 20 nt, Mycobacterium avium subsp. paratuberculosis
ggugggcgugcaggccgcgg

SEQ ID NO: 790270 - RNA, 21 nt, Mycobacterium avium subsp. paratuberculosis
ggugggcgugcaggccgcggg

SEQ ID NO: 790271 - RNA, 13 nt, Mycobacterium avium subsp. paratuberculosis
ggugggcguggcg

SEQ ID NO: 790272 - RNA, 18 nt, Mycobacterium avium subsp. paratuberculosis
ggugggcguggcgggcca

SEQ ID NO: 790273 - RNA, 16 nt, Mycobacterium avium subsp. paratuberculosis
ggugggcgccggcguc

SEQ ID NO: 790274 - RNA, 14 nt, Mycobacterium avium subsp. paratuberculosis
ggugggcgccgggu

SEQ ID NO: 790275 - RNA, 14 nt, Mycobacterium avium subsp. paratuberculosis
ggugggcgcgcagc

SEQ ID NO: 790276 - RNA, 15 nt, Mycobacterium avium subsp. paratuberculosis
gguggucagcgcggu

SEQ ID NO: 790277 - RNA, 17 nt, Mycobacterium avium subsp. paratuberculosis
gguggucagcggcgcca

SEQ ID NO: 790278 - RNA, 14 nt, Mycobacterium avium subsp. paratuberculosis
ggugguccacccag

SEQ ID NO: 790279 - RNA, 19 nt, Mycobacterium avium subsp. paratuberculosis
ggugguccaggcgccgggu

SEQ ID NO: 790280 - RNA, 18 nt, Mycobacterium avium subsp. paratuberculosis
ggugcagggucagcagca

SEQ ID NO: 790281 - RNA, 22 nt, Mycobacterium avium subsp. paratuberculosis
ggugcagggucagcagcacccg

SEQ ID NO: 790282 - RNA, 19 nt, Mycobacterium avium subsp. paratuberculosis
ggugcaggcccagcugcug

SEQ ID NO: 790283 - RNA, 17 nt, Mycobacterium avium subsp. paratuberculosis
ggugcaggcccgggcgg

SEQ ID NO: 790284 - RNA, 20 nt, Mycobacterium avium subsp. paratuberculosis
ggugcaggcccgggcggcga

SEQ ID NO: 790285 - RNA, 22 nt, Mycobacterium avium subsp. paratuberculosis
ggugcaggcccgggcggcgagu

SEQ ID NO: 790286 - RNA, 18 nt, Mycobacterium avium subsp. paratuberculosis
ggugcguccgccggcggu

SEQ ID NO: 790287 - RNA, 19 nt, Mycobacterium avium subsp. paratuberculosis
ggugcgguugagcaccagc

SEQ ID NO: 790288 - RNA, 14 nt, Mycobacterium avium subsp. paratuberculosis
ggugcggucccggu

SEQ ID NO: 790289 - RNA, 15 nt, Mycobacterium avium subsp. paratuberculosis
ggugcggugcaccgc

SEQ ID NO: 790290 - RNA, 13 nt, Mycobacterium avium subsp. paratuberculosis
ggugcgucgggcg

SEQ ID NO: 790291 - RNA, 15 nt, Mycobacterium avium subsp. paratuberculosis
ggugcgucgggcgcc

SEQ ID NO: 790292 - RNA, 19 nt, Mycobacterium avium subsp. paratuberculosis
ggugcgucgggcgccggcg

SEQ ID NO: 790293 - RNA, 15 nt, Mycobacterium avium subsp. paratuberculosis
ggugcucaccccggc

SEQ ID NO: 790294 - RNA, 17 nt, Mycobacterium avium subsp. paratuberculosis
ggugcucaccccggcca

SEQ ID NO: 790295 - RNA, 19 nt, Mycobacterium avium subsp. paratuberculosis
ggugcucaccccggccagg

SEQ ID NO: 790296 - RNA, 16 nt, Mycobacterium avium subsp. paratuberculosis
ggugcucgacggcacc

SEQ ID NO: 790297 - RNA, 18 nt, Mycobacterium avium subsp. paratuberculosis
ggugcucgaucagcgacu

SEQ ID NO: 790298 - RNA, 18 nt, Mycobacterium avium subsp. paratuberculosis
ggugcucgaucggcgcgc

SEQ ID NO: 790299 - RNA, 13 nt, Mycobacterium avium subsp. paratuberculosis
ggugcucgaugcg

SEQ ID NO: 790300 - RNA, 14 nt, Mycobacterium avium subsp. paratuberculosis
ggugcucgccccgc

SEQ ID NO: 790301 - RNA, 15 nt, Mycobacterium avium subsp. paratuberculosis
ggugcucgccggcgc

SEQ ID NO: 790302 - RNA, 13 nt, Mycobacterium avium subsp. paratuberculosis
gguggacgcccgc

SEQ ID NO: 790303 - RNA, 14 nt, Mycobacterium avium subsp. paratuberculosis
gguggacgcccgcg

SEQ ID NO: 790304 - RNA, 19 nt, Mycobacterium avium subsp. paratuberculosis
gguggacgcccgcgaggug

SEQ ID NO: 790305 - RNA, 23 nt, Mycobacterium avium subsp. paratuberculosis
gguggacgcgaccaggcccagcg

SEQ ID NO: 790306 - RNA, 20 nt, Mycobacterium avium subsp. paratuberculosis
gguggacgaggugaccggcg

SEQ ID NO: 790307 - RNA, 23 nt, Mycobacterium avium subsp. paratuberculosis
gguggacggucagcgcgccgucg

SEQ ID NO: 790308 - RNA, 19 nt, Mycobacterium avium subsp. paratuberculosis
gguggacuccagcaccagc

SEQ ID NO: 790309 - RNA, 20 nt, Mycobacterium avium subsp. paratuberculosis
gguggagcacagcacggcau

SEQ ID NO: 790310 - RNA, 19 nt, Mycobacterium avium subsp. paratuberculosis
gguggauccggugaccgcg

SEQ ID NO: 790311 - RNA, 16 nt, Mycobacterium avium subsp. paratuberculosis
gguggaugaugccggc

SEQ ID NO: 790312 - RNA, 18 nt, Mycobacterium avium subsp. paratuberculosis
gguggaugaugccggcgg

SEQ ID NO: 790313 - RNA, 19 nt, Mycobacterium avium subsp. paratuberculosis
gguggaugaugccggcggu

SEQ ID NO: 790314 - RNA, 13 nt, Mycobacterium avium subsp. paratuberculosis
gguggaugggcuc

SEQ ID NO: 790315 - RNA, 20 nt, Mycobacterium avium subsp. paratuberculosis
gguggaugggcucgaccacg

SEQ ID NO: 790316 - RNA, 21 nt, Mycobacterium avium subsp. paratuberculosis
gguggaugggcucgaccacgc

SEQ ID NO: 790317 - RNA, 14 nt, Mycobacterium avium subsp. paratuberculosis
ggugcugccguugg

SEQ ID NO: 790318 - RNA, 15 nt, Mycobacterium avium subsp. paratuberculosis
ggugcugcagcgcga

SEQ ID NO: 790319 - RNA, 13 nt, Mycobacterium avium subsp. paratuberculosis
ggugcugcccggc

SEQ ID NO: 790320 - RNA, 14 nt, Mycobacterium avium subsp. paratuberculosis
ggugcugcccggcg

SEQ ID NO: 790321 - RNA, 15 nt, Mycobacterium avium subsp. paratuberculosis
ggugcugcccggcgc

SEQ ID NO: 790322 - RNA, 18 nt, Mycobacterium avium subsp. paratuberculosis
ggugcugcccggcgcgga

SEQ ID NO: 790323 - RNA, 16 nt, Mycobacterium avium subsp. paratuberculosis
ggugcucggcgcgcgg

SEQ ID NO: 790324 - RNA, 17 nt, Mycobacterium avium subsp. paratuberculosis
ggugcucgcgccgggcg

SEQ ID NO: 790325 - RNA, 22 nt, Mycobacterium avium subsp. paratuberculosis
ggugcucgucgagcauccggcg

SEQ ID NO: 790326 - RNA, 21 nt, Mycobacterium avium subsp. paratuberculosis
ggugcucuugacggccgcggc

SEQ ID NO: 790327 - RNA, 22 nt, Mycobacterium avium subsp. paratuberculosis
ggugcugaacgccugccggcgc

SEQ ID NO: 790328 - RNA, 23 nt, Mycobacterium avium subsp. paratuberculosis
ggugcugaacgccugccggcgcc

SEQ ID NO: 790329 - RNA, 20 nt, Mycobacterium avium subsp. paratuberculosis
gguggcaccccgcgccgggc

SEQ ID NO: 790330 - RNA, 21 nt, Mycobacterium avium subsp. paratuberculosis
gguggcaccccgcgccgggcg

SEQ ID NO: 790331 - RNA, 14 nt, Mycobacterium avium subsp. paratuberculosis
gguggcacgccacu

SEQ ID NO: 790332 - RNA, 22 nt, Mycobacterium avium subsp. paratuberculosis
gguggcagcggacccggucggc

SEQ ID NO: 790333 - RNA, 16 nt, Mycobacterium avium subsp. paratuberculosis
gguggcgccggccagc

SEQ ID NO: 790334 - RNA, 20 nt, Mycobacterium avium subsp. paratuberculosis
gguggcgccggccagcacca

SEQ ID NO: 790335 - RNA, 15 nt, Mycobacterium avium subsp. paratuberculosis
gguggcagcccggcu

SEQ ID NO: 790336 - RNA, 12 nt, Mycobacterium avium subsp. paratuberculosis
gguggcgggccg

SEQ ID NO: 790337 - RNA, 19 nt, Mycobacterium avium subsp. paratuberculosis
gguggcgggccgccgggug

SEQ ID NO: 790338 - RNA, 15 nt, Mycobacterium avium subsp. paratuberculosis
gguggcggugcgguc

SEQ ID NO: 790339 - RNA, 14 nt, Mycobacterium avium subsp. paratuberculosis
gguggcgguggcca

SEQ ID NO: 790340 - RNA, 16 nt, Mycobacterium avium subsp. paratuberculosis
gguggcgguggggccg

SEQ ID NO: 790341 - RNA, 12 nt, Mycobacterium avium subsp. paratuberculosis
gguggcgguccc

SEQ ID NO: 790342 - RNA, 16 nt, Mycobacterium avium subsp. paratuberculosis
gguggcggucccggcg

SEQ ID NO: 790343 - RNA, 17 nt, Mycobacterium avium subsp. paratuberculosis
gguggcggucccggcgg

SEQ ID NO: 790344 - RNA, 18 nt, Mycobacterium avium subsp. paratuberculosis
gguggcggucccggcgga

SEQ ID NO: 790345 - RNA, 16 nt, Mycobacterium avium subsp. paratuberculosis
gguggcggugccgcgg

SEQ ID NO: 790346 - RNA, 17 nt, Mycobacterium avium subsp. paratuberculosis
gguggcggugccgcggc

SEQ ID NO: 790347 - RNA, 20 nt, Mycobacterium avium subsp. paratuberculosis
gguggcggugccgcggcggc

SEQ ID NO: 790348 - RNA, 14 nt, Mycobacterium avium subsp. paratuberculosis
gguggcggccacca

SEQ ID NO: 790349 - RNA, 15 nt, Mycobacterium avium subsp. paratuberculosis
gguggcggccggggu

SEQ ID NO: 790350 - RNA, 13 nt, Mycobacterium avium subsp. paratuberculosis
gguggcggcgccg

SEQ ID NO: 790351 - RNA, 15 nt, Mycobacterium avium subsp. paratuberculosis
gguggcggcgccgga

SEQ ID NO: 790352 - RNA, 16 nt, Mycobacterium avium subsp. paratuberculosis
gguggcgccgcgcagc

SEQ ID NO: 790353 - RNA, 15 nt, Mycobacterium avium subsp. paratuberculosis
gguggcgccgcgggc

SEQ ID NO: 790354 - RNA, 17 nt, Mycobacterium avium subsp. paratuberculosis
gguggcgccggcaucga

SEQ ID NO: 790355 - RNA, 19 nt, Mycobacterium avium subsp. paratuberculosis
gguggcgccuccgcccggg

SEQ ID NO: 790356 - RNA, 17 nt, Mycobacterium avium subsp. paratuberculosis
gguggcgcugccgagca

SEQ ID NO: 790357 - RNA, 14 nt, Mycobacterium avium subsp. paratuberculosis
gguggcgucggcgg

SEQ ID NO: 790358 - RNA, 14 nt, Mycobacterium avium subsp. paratuberculosis
gguggcgucggcgu

SEQ ID NO: 790359 - RNA, 23 nt, Mycobacterium avium subsp. paratuberculosis
gguggcuaccgccgggcgggccg

SEQ ID NO: 790360 - RNA, 13 nt, Mycobacterium avium subsp. paratuberculosis
gguggcgguguuc

SEQ ID NO: 790361 - RNA, 21 nt, Mycobacterium avium subsp. paratuberculosis
gguggcguccagcggguugcc

SEQ ID NO: 790362 - RNA, 17 nt, Mycobacterium avium subsp. paratuberculosis
gguggcguccucgacgg

SEQ ID NO: 790363 - RNA, 17 nt, Mycobacterium avium subsp. paratuberculosis
gguggcguccuugccga

SEQ ID NO: 790364 - RNA, 18 nt, Mycobacterium avium subsp. paratuberculosis
gguggcgucgccgccggu

SEQ ID NO: 790365 - RNA, 20 nt, Mycobacterium avium subsp. paratuberculosis
gguggcgucgccgccggugc

SEQ ID NO: 790366 - RNA, 15 nt, Mycobacterium avium subsp. paratuberculosis
ggugggccaucgcca

SEQ ID NO: 790367 - RNA, 13 nt, Mycobacterium avium subsp. paratuberculosis
ggugggcccgccg

SEQ ID NO: 790368 - RNA, 22 nt, Mycobacterium avium subsp. paratuberculosis
ggugggcccgccgucgaccacg

SEQ ID NO: 790369 - RNA, 21 nt, Mycobacterium avium subsp. paratuberculosis
ggugggccgaccugcacgcug

SEQ ID NO: 790370 - RNA, 23 nt, Mycobacterium avium subsp. paratuberculosis
ggugggcaccuggccgucggugg

SEQ ID NO: 790371 - RNA, 19 nt, Mycobacterium avium subsp. paratuberculosis
ggugggcagaugcccgcug

SEQ ID NO: 790372 - RNA, 16 nt, Mycobacterium avium subsp. paratuberculosis
ggugggcagccccagc

SEQ ID NO: 790373 - RNA, 15 nt, Mycobacterium avium subsp. paratuberculosis
ggugggcagccggca

SEQ ID NO: 790374 - RNA, 23 nt, Mycobacterium avium subsp. paratuberculosis
ggugggcagcgcggccagcacgg

SEQ ID NO: 790375 - RNA, 17 nt, Mycobacterium avium subsp. paratuberculosis
ggugggcagcucggugg

SEQ ID NO: 790376 - RNA, 22 nt, Mycobacterium avium subsp. paratuberculosis
ggugggcagcucgucggcgcgc

SEQ ID NO: 790377 - RNA, 24 nt, Mycobacterium avium subsp. paratuberculosis
ggugggcagcucgucggcgcgcca

SEQ ID NO: 790378 - RNA, 15 nt, Mycobacterium avium subsp. paratuberculosis
ggugggacggcgggu

SEQ ID NO: 790379 - RNA, 21 nt, Mycobacterium avium subsp. paratuberculosis
ggugggauccauucggucucg

SEQ ID NO: 790380 - RNA, 20 nt, Mycobacterium avium subsp. paratuberculosis
ggugggcaccagcagcgcga

SEQ ID NO: 790381 - RNA, 20 nt, Mycobacterium avium subsp. paratuberculosis
guagcagacggacacccgcg

SEQ ID NO: 790382 - RNA, 16 nt, Mycobacterium avium subsp. paratuberculosis
guagcaggcgcgcagc

SEQ ID NO: 790383 - RNA, 12 nt, Mycobacterium avium subsp. paratuberculosis
guagcaggcggu

SEQ ID NO: 790384 - RNA, 15 nt, Mycobacterium avium subsp. paratuberculosis
guagcaggcgguggu

SEQ ID NO: 790385 - RNA, 23 nt, Mycobacterium avium subsp. paratuberculosis
guagcagcgcggcuuggccacca

SEQ ID NO: 790386 - RNA, 23 nt, Mycobacterium avium subsp. paratuberculosis
guagcagcgucugcgccccggcg

SEQ ID NO: 790387 - RNA, 13 nt, Mycobacterium avium subsp. paratuberculosis
guagccggucggc

SEQ ID NO: 790388 - RNA, 14 nt, Mycobacterium avium subsp. paratuberculosis
guagccggcgaucg

SEQ ID NO: 790389 - RNA, 15 nt, Mycobacterium avium subsp. paratuberculosis
guagccggcgaucgu

SEQ ID NO: 790390 - RNA, 16 nt, Mycobacterium avium subsp. paratuberculosis
guagccggcgaucguc

SEQ ID NO: 790391 - RNA, 22 nt, Mycobacterium avium subsp. paratuberculosis
guagcccaugucgccggugcug

SEQ ID NO: 790392 - RNA, 23 nt, Mycobacterium avium subsp. paratuberculosis
guagccggccagcucgagcauca

SEQ ID NO: 790393 - RNA, 16 nt, Mycobacterium avium subsp. paratuberculosis
guagcagucggccugc

SEQ ID NO: 790394 - RNA, 20 nt, Mycobacterium avium subsp. paratuberculosis
guagccaugggucucggcga

SEQ ID NO: 790395 - RNA, 22 nt, Mycobacterium avium subsp. paratuberculosis
guagcccaggauucccgacccc

SEQ ID NO: 790396 - RNA, 14 nt, Mycobacterium avium subsp. paratuberculosis
guacgugcgccggc

SEQ ID NO: 790397 - RNA, 13 nt, Mycobacterium avium subsp. paratuberculosis
guacuccugcgcg

SEQ ID NO: 790398 - RNA, 15 nt, Mycobacterium avium subsp. paratuberculosis
guacucgaccgcgac

SEQ ID NO: 790399 - RNA, 18 nt, Mycobacterium avium subsp. paratuberculosis
guacucgagcgugcccgc

SEQ ID NO: 790400 - RNA, 16 nt, Mycobacterium avium subsp. paratuberculosis
guacucgcacagccgg

SEQ ID NO: 790401 - RNA, 17 nt, Mycobacterium avium subsp. paratuberculosis
guacucgcacagccggc

SEQ ID NO: 790402 - RNA, 22 nt, Mycobacterium avium subsp. paratuberculosis
guacucgcacagccggcgcgcg

SEQ ID NO: 790403 - RNA, 22 nt, Mycobacterium avium subsp. paratuberculosis
guagaaccaacgcggcgccggu

SEQ ID NO: 790404 - RNA, 16 nt, Mycobacterium avium subsp. paratuberculosis
guagaaccagcccggc

SEQ ID NO: 790405 - RNA, 20 nt, Mycobacterium avium subsp. paratuberculosis
guagaaccagugcgccuugu

SEQ ID NO: 790406 - RNA, 16 nt, Mycobacterium avium subsp. paratuberculosis
guagaaccggcccagc

SEQ ID NO: 790407 - RNA, 14 nt, Mycobacterium avium subsp. paratuberculosis
guagacagcguggu

SEQ ID NO: 790408 - RNA, 22 nt, Mycobacterium avium subsp. paratuberculosis
guagacagcguggucgcgcagc

SEQ ID NO: 790409 - RNA, 17 nt, Mycobacterium avium subsp. paratuberculosis
guagaaguggccgaccg

SEQ ID NO: 790410 - RNA, 14 nt, Mycobacterium avium subsp. paratuberculosis
guagaagaccaccu

SEQ ID NO: 790411 - RNA, 18 nt, Mycobacterium avium subsp. paratuberculosis
guagaagaucagcgccag

SEQ ID NO: 790412 - RNA, 16 nt, Mycobacterium avium subsp. paratuberculosis
guagaagaugcgccgg

SEQ ID NO: 790413 - RNA, 15 nt, Mycobacterium avium subsp. paratuberculosis
guagccugcggccug

SEQ ID NO: 790414 - RNA, 16 nt, Mycobacterium avium subsp. paratuberculosis
guagccugcggccugc

SEQ ID NO: 790415 - RNA, 18 nt, Mycobacterium avium subsp. paratuberculosis
guagccgguucgucccgc

SEQ ID NO: 790416 - RNA, 17 nt, Mycobacterium avium subsp. paratuberculosis
guagccguaacgaugcc

SEQ ID NO: 790417 - RNA, 21 nt, Mycobacterium avium subsp. paratuberculosis
guagccgggcucgagcaccga

SEQ ID NO: 790418 - RNA, 17 nt, Mycobacterium avium subsp. paratuberculosis
guagccggucggcccgc

SEQ ID NO: 790419 - RNA, 21 nt, Mycobacterium avium subsp. paratuberculosis
guagccggucggcccgcuccc

SEQ ID NO: 790420 - RNA, 23 nt, Mycobacterium avium subsp. paratuberculosis
guagcgcagcaucacgucggcga

SEQ ID NO: 790421 - RNA, 16 nt, Mycobacterium avium subsp. paratuberculosis
guagcgagugccggcc

SEQ ID NO: 790422 - RNA, 17 nt, Mycobacterium avium subsp. paratuberculosis
guagcgcauaggccgcg

SEQ ID NO: 790423 - RNA, 11 nt, Mycobacterium avium subsp. paratuberculosis
guagcgcagca

SEQ ID NO: 790424 - RNA, 23 nt, Mycobacterium avium subsp. paratuberculosis
guagcgccacaucagcucggcgg

SEQ ID NO: 790425 - RNA, 21 nt, Mycobacterium avium subsp. paratuberculosis
guagcgccagucgcggcgaac

SEQ ID NO: 790426 - RNA, 22 nt, Mycobacterium avium subsp. paratuberculosis
guagcgcugcauagucggcccg

SEQ ID NO: 790427 - RNA, 23 nt, Mycobacterium avium subsp. paratuberculosis
guagcgcuccaccagguucgcgc

SEQ ID NO: 790428 - RNA, 17 nt, Mycobacterium avium subsp. paratuberculosis
guagcgguauccgauca

SEQ ID NO: 790429 - RNA, 21 nt, Mycobacterium avium subsp. paratuberculosis
guagcggcgccaccggcuggc

SEQ ID NO: 790430 - RNA, 11 nt, Mycobacterium avium subsp. paratuberculosis
guagcggcgga

SEQ ID NO: 790431 - RNA, 12 nt, Mycobacterium avium subsp. paratuberculosis
guagcggcgguc

SEQ ID NO: 790432 - RNA, 15 nt, Mycobacterium avium subsp. paratuberculosis
guagcggcggucggc

SEQ ID NO: 790433 - RNA, 17 nt, Mycobacterium avium subsp. paratuberculosis
guagcggcggucggcgc

SEQ ID NO: 790434 - RNA, 22 nt, Mycobacterium avium subsp. paratuberculosis
guagcggcggucggcgccgauc

SEQ ID NO: 790435 - RNA, 13 nt, Mycobacterium avium subsp. paratuberculosis
guagcggccgcac

SEQ ID NO: 790436 - RNA, 16 nt, Mycobacterium avium subsp. paratuberculosis
guagcggacgacggcc

SEQ ID NO: 790437 - RNA, 20 nt, Mycobacterium avium subsp. paratuberculosis
guagcggacgacggccagcu

SEQ ID NO: 790438 - RNA, 19 nt, Mycobacterium avium subsp. paratuberculosis
guagcggacgggccgcauc

SEQ ID NO: 790439 - RNA, 19 nt, Mycobacterium avium subsp. paratuberculosis
guacgacaucucgacggug

SEQ ID NO: 790440 - RNA, 23 nt, Mycobacterium avium subsp. paratuberculosis
guacgacaucucgacggugaccg

SEQ ID NO: 790441 - RNA, 17 nt, Mycobacterium avium subsp. paratuberculosis
guacgaccgcgacgugg

SEQ ID NO: 790442 - RNA, 20 nt, Mycobacterium avium subsp. paratuberculosis
guacgaccguagccggucgg

SEQ ID NO: 790443 - RNA, 16 nt, Mycobacterium avium subsp. paratuberculosis
guaccugccccacacg

SEQ ID NO: 790444 - RNA, 17 nt, Mycobacterium avium subsp. paratuberculosis
guaccuagggcccacgc

SEQ ID NO: 790445 - RNA, 15 nt, Mycobacterium avium subsp. paratuberculosis
guacgcgagaagcgc

SEQ ID NO: 790446 - RNA, 23 nt, Mycobacterium avium subsp. paratuberculosis
guacgccgccuugacgccgggca

SEQ ID NO: 790447 - RNA, 13 nt, Mycobacterium avium subsp. paratuberculosis
guacgcgauggcg

SEQ ID NO: 790448 - RNA, 20 nt, Mycobacterium avium subsp. paratuberculosis
guacgcgauggcggcgcgcu

SEQ ID NO: 790449 - RNA, 18 nt, Mycobacterium avium subsp. paratuberculosis
guacgcgcaauccugccc

SEQ ID NO: 790450 - RNA, 13 nt, Mycobacterium avium subsp. paratuberculosis
guacgcgccgcgc

SEQ ID NO: 790451 - RNA, 13 nt, Mycobacterium avium subsp. paratuberculosis
guacgcgccggcc

SEQ ID NO: 790452 - RNA, 16 nt, Mycobacterium avium subsp. paratuberculosis
guacgcgccggccagc

SEQ ID NO: 790453 - RNA, 19 nt, Mycobacterium avium subsp. paratuberculosis
guacgcgccggccagccgg

SEQ ID NO: 790454 - RNA, 22 nt, Mycobacterium avium subsp. paratuberculosis
guacucccaggauuccgucggc

SEQ ID NO: 790455 - RNA, 16 nt, Mycobacterium avium subsp. paratuberculosis
guacucccaggccgcg

SEQ ID NO: 790456 - RNA, 18 nt, Mycobacterium avium subsp. paratuberculosis
guacgucuugcgcaccug

SEQ ID NO: 790457 - RNA, 17 nt, Mycobacterium avium subsp. paratuberculosis
guaccauugcgccgguc

SEQ ID NO: 790458 - RNA, 23 nt, Mycobacterium avium subsp. paratuberculosis
guaccagcggccgucgcgcagcc

SEQ ID NO: 790459 - RNA, 18 nt, Mycobacterium avium subsp. paratuberculosis
guaccagggcagcgccuc

SEQ ID NO: 790460 - RNA, 22 nt, Mycobacterium avium subsp. paratuberculosis
guaccagggcagcgccucggcg

SEQ ID NO: 790461 - RNA, 23 nt, Mycobacterium avium subsp. paratuberculosis
guaccagggcagcgccucggcgg

SEQ ID NO: 790462 - RNA, 19 nt, Mycobacterium avium subsp. paratuberculosis
guacccccgcacgccagca

SEQ ID NO: 790463 - RNA, 13 nt, Mycobacterium avium subsp. paratuberculosis
guacccccgccgg

SEQ ID NO: 790464 - RNA, 14 nt, Mycobacterium avium subsp. paratuberculosis
guacccgcgcggcg

SEQ ID NO: 790465 - RNA, 20 nt, Mycobacterium avium subsp. paratuberculosis
guacccgcgcggcgucggcc

SEQ ID NO: 790466 - RNA, 14 nt, Mycobacterium avium subsp. paratuberculosis
guacccgcaggcca

SEQ ID NO: 790467 - RNA, 17 nt, Mycobacterium avium subsp. paratuberculosis
guacccgcaggccauga

SEQ ID NO: 790468 - RNA, 21 nt, Mycobacterium avium subsp. paratuberculosis
guacccggucugaucgcccag

SEQ ID NO: 790469 - RNA, 22 nt, Mycobacterium avium subsp. paratuberculosis
guaccgaacgacgagccgucga

SEQ ID NO: 790470 - RNA, 15 nt, Mycobacterium avium subsp. paratuberculosis
guaccgguuccgggc

SEQ ID NO: 790471 - RNA, 21 nt, Mycobacterium avium subsp. paratuberculosis
guaccgguuccgggcgacccc

SEQ ID NO: 790472 - RNA, 17 nt, Mycobacterium avium subsp. paratuberculosis
guaccggguggccguga

SEQ ID NO: 790473 - RNA, 22 nt, Mycobacterium avium subsp. paratuberculosis
guaccggcgggcgaaaucgcgg

SEQ ID NO: 790474 - RNA, 14 nt, Mycobacterium avium subsp. paratuberculosis
guaccgauccgcgg

SEQ ID NO: 790475 - RNA, 22 nt, Mycobacterium avium subsp. paratuberculosis
guaccgcaauccuguuccccgg

SEQ ID NO: 790476 - RNA, 16 nt, Mycobacterium avium subsp. paratuberculosis
guaccgccggccaggc

SEQ ID NO: 790477 - RNA, 19 nt, Mycobacterium avium subsp. paratuberculosis
guaccgcgagaucagcgcc

SEQ ID NO: 790478 - RNA, 17 nt, Mycobacterium avium subsp. paratuberculosis
guaccgcggcggcgucg

SEQ ID NO: 790479 - RNA, 18 nt, Mycobacterium avium subsp. paratuberculosis
guaccgcggcggcgucga

SEQ ID NO: 790480 - RNA, 21 nt, Mycobacterium avium subsp. paratuberculosis
guaccggaacggcuugcgcuc

SEQ ID NO: 790481 - RNA, 19 nt, Mycobacterium avium subsp. paratuberculosis
guagucccgcgccuggcgc

SEQ ID NO: 790482 - RNA, 16 nt, Mycobacterium avium subsp. paratuberculosis
guaguccggccagucc

SEQ ID NO: 790483 - RNA, 20 nt, Mycobacterium avium subsp. paratuberculosis
guaguccgggaugacaccgc

SEQ ID NO: 790484 - RNA, 20 nt, Mycobacterium avium subsp. paratuberculosis
guagucgcgcaccauccgcg

SEQ ID NO: 790485 - RNA, 12 nt, Mycobacterium avium subsp. paratuberculosis
guagucgcgcag

SEQ ID NO: 790486 - RNA, 13 nt, Mycobacterium avium subsp. paratuberculosis
guagucgcgcagc

SEQ ID NO: 790487 - RNA, 14 nt, Mycobacterium avium subsp. paratuberculosis
guagucgcgcagcu

SEQ ID NO: 790488 - RNA, 17 nt, Mycobacterium avium subsp. paratuberculosis
guagucgcgcagcugcg

SEQ ID NO: 790489 - RNA, 21 nt, Mycobacterium avium subsp. paratuberculosis
guagucgcucggcggcgacgg

SEQ ID NO: 790490 - RNA, 14 nt, Mycobacterium avium subsp. paratuberculosis
guagucggcccgcc

SEQ ID NO: 790491 - RNA, 19 nt, Mycobacterium avium subsp. paratuberculosis
guagucggcccgccgggcc

SEQ ID NO: 790492 - RNA, 14 nt, Mycobacterium avium subsp. paratuberculosis
guagucggcgcagc

SEQ ID NO: 790493 - RNA, 15 nt, Mycobacterium avium subsp. paratuberculosis
guagucggcgcagcg

SEQ ID NO: 790494 - RNA, 16 nt, Mycobacterium avium subsp. paratuberculosis
guagucggcgccgacg

SEQ ID NO: 790495 - RNA, 14 nt, Mycobacterium avium subsp. paratuberculosis
guagucggugcagu

SEQ ID NO: 790496 - RNA, 20 nt, Mycobacterium avium subsp. paratuberculosis
guagucguccucguucuggc

SEQ ID NO: 790497 - RNA, 13 nt, Mycobacterium avium subsp. paratuberculosis
guagucgucgagg

SEQ ID NO: 790498 - RNA, 14 nt, Mycobacterium avium subsp. paratuberculosis
guagugggucggcg

SEQ ID NO: 790499 - RNA, 14 nt, Mycobacterium avium subsp. paratuberculosis
guagugcaucggca

SEQ ID NO: 790500 - RNA, 17 nt, Mycobacterium avium subsp. paratuberculosis
guaguccagcacggcga

SEQ ID NO: 790501 - RNA, 12 nt, Mycobacterium avium subsp. paratuberculosis
guagucacccgg

SEQ ID NO: 790502 - RNA, 16 nt, Mycobacterium avium subsp. paratuberculosis
guaguacgaccgcgac

SEQ ID NO: 790503 - RNA, 20 nt, Mycobacterium avium subsp. paratuberculosis
guaguagaccuugaccaccg

SEQ ID NO: 790504 - RNA, 13 nt, Mycobacterium avium subsp. paratuberculosis
guaggacgccgca

SEQ ID NO: 790505 - RNA, 13 nt, Mycobacterium avium subsp. paratuberculosis
guaggacgccgug

SEQ ID NO: 790506 - RNA, 12 nt, Mycobacterium avium subsp. paratuberculosis
guaggacaggaa

SEQ ID NO: 790507 - RNA, 22 nt, Mycobacterium avium subsp. paratuberculosis
guaggacccuucgaacgcgacg

SEQ ID NO: 790508 - RNA, 23 nt, Mycobacterium avium subsp. paratuberculosis
guagcugauggcacccucggugc

SEQ ID NO: 790509 - RNA, 22 nt, Mycobacterium avium subsp. paratuberculosis
guagcgggcgaacgaccgggug

SEQ ID NO: 790510 - RNA, 13 nt, Mycobacterium avium subsp. paratuberculosis
guagcugcggguc

SEQ ID NO: 790511 - RNA, 17 nt, Mycobacterium avium subsp. paratuberculosis
guagcuggugcgcagcc

SEQ ID NO: 790512 - RNA, 22 nt, Mycobacterium avium subsp. paratuberculosis
guagcuggugcgcagcccgccg

SEQ ID NO: 790513 - RNA, 19 nt, Mycobacterium avium subsp. paratuberculosis
guaggacaccacgguggcg

SEQ ID NO: 790514 - RNA, 19 nt, Mycobacterium avium subsp. paratuberculosis
guaguuguucgacugcagg

SEQ ID NO: 790515 - RNA, 16 nt, Mycobacterium avium subsp. paratuberculosis
guauccggccagccgg

SEQ ID NO: 790516 - RNA, 17 nt, Mycobacterium avium subsp. paratuberculosis
guauccggccagccggg

SEQ ID NO: 790517 - RNA, 21 nt, Mycobacterium avium subsp. paratuberculosis
guaucccguugggguccucga

SEQ ID NO: 790518 - RNA, 16 nt, Mycobacterium avium subsp. paratuberculosis
guauccgaucgcggcc

SEQ ID NO: 790519 - RNA, 13 nt, Mycobacterium avium subsp. paratuberculosis
guauccgccgcca

SEQ ID NO: 790520 - RNA, 16 nt, Mycobacterium avium subsp. paratuberculosis
guauccgccgccagcg

SEQ ID NO: 790521 - RNA, 13 nt, Mycobacterium avium subsp. paratuberculosis
guauccgcgcagc

SEQ ID NO: 790522 - RNA, 23 nt, Mycobacterium avium subsp. paratuberculosis
guaucccaccacgaagucguugg

SEQ ID NO: 790523 - RNA, 20 nt, Mycobacterium avium subsp. paratuberculosis
gucaaacccauugucgccgu

SEQ ID NO: 790524 - RNA, 21 nt, Mycobacterium avium subsp. paratuberculosis
gucaaacccauugucgccgug

SEQ ID NO: 790525 - RNA, 22 nt, Mycobacterium avium subsp. paratuberculosis
gucaaacccauugucgccgugc

SEQ ID NO: 790526 - RNA, 17 nt, Mycobacterium avium subsp. paratuberculosis
guaugucggcgacccgc

SEQ ID NO: 790527 - RNA, 20 nt, Mycobacterium avium subsp. paratuberculosis
guaugccuuggcccgcgcgg

SEQ ID NO: 790528 - RNA, 23 nt, Mycobacterium avium subsp. paratuberculosis
gucaacgagacacccucgcgcag

SEQ ID NO: 790529 - RNA, 20 nt, Mycobacterium avium subsp. paratuberculosis
gucacacccucggcccgcca

SEQ ID NO: 790530 - RNA, 22 nt, Mycobacterium avium subsp. paratuberculosis
gucacaccgcggccagcgcgcg

SEQ ID NO: 790531 - RNA, 14 nt, Mycobacterium avium subsp. paratuberculosis
gucacagccgcgau

SEQ ID NO: 790532 - RNA, 15 nt, Mycobacterium avium subsp. paratuberculosis
gucaccaaggcgauu

SEQ ID NO: 790533 - RNA, 17 nt, Mycobacterium avium subsp. paratuberculosis
gucaccaaugcgccggc

SEQ ID NO: 790534 - RNA, 18 nt, Mycobacterium avium subsp. paratuberculosis
gucaccaaugcgccggcg

SEQ ID NO: 790535 - RNA, 21 nt, Mycobacterium avium subsp. paratuberculosis
gucaccaaugcgccggcggcc

SEQ ID NO: 790536 - RNA, 17 nt, Mycobacterium avium subsp. paratuberculosis
gucaccaccaacgccac

SEQ ID NO: 790537 - RNA, 15 nt, Mycobacterium avium subsp. paratuberculosis
gucaccaccaccagu

SEQ ID NO: 790538 - RNA, 17 nt, Mycobacterium avium subsp. paratuberculosis
gucaccaccgagccggu

SEQ ID NO: 790539 - RNA, 20 nt, Mycobacterium avium subsp. paratuberculosis
gucacauccgucacgcccgu

SEQ ID NO: 790540 - RNA, 19 nt, Mycobacterium avium subsp. paratuberculosis
gucaccaccgggucgucgc

SEQ ID NO: 790541 - RNA, 21 nt, Mycobacterium avium subsp. paratuberculosis
gucacgcccgucccugcgcgg

SEQ ID NO: 790542 - RNA, 19 nt, Mycobacterium avium subsp. paratuberculosis
gucacgcaucagggccagc

SEQ ID NO: 790543 - RNA, 13 nt, Mycobacterium avium subsp. paratuberculosis
gucacgccagcgu

SEQ ID NO: 790544 - RNA, 19 nt, Mycobacterium avium subsp. paratuberculosis
gucacgccagcgugacgcc

SEQ ID NO: 790545 - RNA, 23 nt, Mycobacterium avium subsp. paratuberculosis
gucacgccgggguagaggccgcg

SEQ ID NO: 790546 - RNA, 14 nt, Mycobacterium avium subsp. paratuberculosis
gucacgcugcgcgc

SEQ ID NO: 790547 - RNA, 20 nt, Mycobacterium avium subsp. paratuberculosis
gucacgcuggcgugacacuc

SEQ ID NO: 790548 - RNA, 20 nt, Mycobacterium avium subsp. paratuberculosis
gucacgcuggcgugacgcuc

SEQ ID NO: 790549 - RNA, 22 nt, Mycobacterium avium subsp. paratuberculosis
gucacgcuggcgugacgcucgg

SEQ ID NO: 790550 - RNA, 15 nt, Mycobacterium avium subsp. paratuberculosis
gucacgcuggcgugg

SEQ ID NO: 790551 - RNA, 22 nt, Mycobacterium avium subsp. paratuberculosis
gucacgcuggcguggcgccggc

SEQ ID NO: 790552 - RNA, 20 nt, Mycobacterium avium subsp. paratuberculosis
gucacgcuggcguggcucgg

SEQ ID NO: 790553 - RNA, 14 nt, Mycobacterium avium subsp. paratuberculosis
gucacgcuggugac

SEQ ID NO: 790554 - RNA, 21 nt, Mycobacterium avium subsp. paratuberculosis
gucaccgggugaugucgccga

SEQ ID NO: 790555 - RNA, 19 nt, Mycobacterium avium subsp. paratuberculosis
gucaccgcgggugaucugc

SEQ ID NO: 790556 - RNA, 17 nt, Mycobacterium avium subsp. paratuberculosis
gucaccggcucgcgggg

SEQ ID NO: 790557 - RNA, 18 nt, Mycobacterium avium subsp. paratuberculosis
gucaccggcugcccgacc

SEQ ID NO: 790558 - RNA, 18 nt, Mycobacterium avium subsp. paratuberculosis
gucaccggggugccgccc

SEQ ID NO: 790559 - RNA, 19 nt, Mycobacterium avium subsp. paratuberculosis
gucaccggggugccgccca

SEQ ID NO: 790560 - RNA, 15 nt, Mycobacterium avium subsp. paratuberculosis
gucaccggucgcguu

SEQ ID NO: 790561 - RNA, 21 nt, Mycobacterium avium subsp. paratuberculosis
gucaccggucggugcccagca

SEQ ID NO: 790562 - RNA, 22 nt, Mycobacterium avium subsp. paratuberculosis
gucaccggucggugcccagcac

SEQ ID NO: 790563 - RNA, 17 nt, Mycobacterium avium subsp. paratuberculosis
gucaccggugucacgcu

SEQ ID NO: 790564 - RNA, 21 nt, Mycobacterium avium subsp. paratuberculosis
gucaccggaugcaccggcagc

SEQ ID NO: 790565 - RNA, 23 nt, Mycobacterium avium subsp. paratuberculosis
gucaccggaugcaccggcagcca

SEQ ID NO: 790566 - RNA, 14 nt, Mycobacterium avium subsp. paratuberculosis
gucaccggccgagc

SEQ ID NO: 790567 - RNA, 19 nt, Mycobacterium avium subsp. paratuberculosis
gucaccgcgcuugccgcga

SEQ ID NO: 790568 - RNA, 15 nt, Mycobacterium avium subsp. paratuberculosis
gucaccgcugaugcc

SEQ ID NO: 790569 - RNA, 17 nt, Mycobacterium avium subsp. paratuberculosis
gucaccgcugaugccgc

SEQ ID NO: 790570 - RNA, 20 nt, Mycobacterium avium subsp. paratuberculosis
gucaccgcugaugccgccga

SEQ ID NO: 790571 - RNA, 13 nt, Mycobacterium avium subsp. paratuberculosis
gucaccgccgcac

SEQ ID NO: 790572 - RNA, 16 nt, Mycobacterium avium subsp. paratuberculosis
gucaccgccgcaccgu

SEQ ID NO: 790573 - RNA, 21 nt, Mycobacterium avium subsp. paratuberculosis
gucaccgccaggaccacccac

SEQ ID NO: 790574 - RNA, 12 nt, Mycobacterium avium subsp. paratuberculosis
gucaccgcccac

SEQ ID NO: 790575 - RNA, 14 nt, Mycobacterium avium subsp. paratuberculosis
gucaccgagcggcc

SEQ ID NO: 790576 - RNA, 18 nt, Mycobacterium avium subsp. paratuberculosis
gucaccgagcggccgucc

SEQ ID NO: 790577 - RNA, 15 nt, Mycobacterium avium subsp. paratuberculosis
gucaccgagcggggu

SEQ ID NO: 790578 - RNA, 17 nt, Mycobacterium avium subsp. paratuberculosis
gucacccucgaggccga

SEQ ID NO: 790579 - RNA, 22 nt, Mycobacterium avium subsp. paratuberculosis
gucaccgaccccucggcggccg

SEQ ID NO: 790580 - RNA, 14 nt, Mycobacterium avium subsp. paratuberculosis
gucacccggcuggc

SEQ ID NO: 790581 - RNA, 19 nt, Mycobacterium avium subsp. paratuberculosis
gucacccggcuggccgcac

SEQ ID NO: 790582 - RNA, 20 nt, Mycobacterium avium subsp. paratuberculosis
gucacccggcuggccgcaca

SEQ ID NO: 790583 - RNA, 15 nt, Mycobacterium avium subsp. paratuberculosis
gucacccgugggccg

SEQ ID NO: 790584 - RNA, 18 nt, Mycobacterium avium subsp. paratuberculosis
gucacccgugggccgacc

SEQ ID NO: 790585 - RNA, 21 nt, Mycobacterium avium subsp. paratuberculosis
gucacccgugggccgaccggc

SEQ ID NO: 790586 - RNA, 13 nt, Mycobacterium avium subsp. paratuberculosis
gucacccgcagcc

SEQ ID NO: 790587 - RNA, 15 nt, Mycobacterium avium subsp. paratuberculosis
gucacccgcagcccg

SEQ ID NO: 790588 - RNA, 14 nt, Mycobacterium avium subsp. paratuberculosis
gguaagugucgugg

SEQ ID NO: 790589 - RNA, 18 nt, Mycobacterium avium subsp. paratuberculosis
gguaacugcguguggcgc

SEQ ID NO: 790590 - RNA, 13 nt, Mycobacterium avium subsp. paratuberculosis
gguaaccgcccga

SEQ ID NO: 790591 - RNA, 19 nt, Mycobacterium avium subsp. paratuberculosis
gguaaagucuucggcgaug

SEQ ID NO: 790592 - RNA, 14 nt, Mycobacterium avium subsp. paratuberculosis
gguaaucggcggug

SEQ ID NO: 790593 - RNA, 15 nt, Mycobacterium avium subsp. paratuberculosis
gguaaugggcgaucg

SEQ ID NO: 790594 - RNA, 19 nt, Mycobacterium avium subsp. paratuberculosis
gguacccgauggugaacca

SEQ ID NO: 790595 - RNA, 14 nt, Mycobacterium avium subsp. paratuberculosis
gguacaucgacgcg

SEQ ID NO: 790596 - RNA, 13 nt, Mycobacterium avium subsp. paratuberculosis
gguaccacgccgu

SEQ ID NO: 790597 - RNA, 16 nt, Mycobacterium avium subsp. paratuberculosis
gguacagggucaucgc

SEQ ID NO: 790598 - RNA, 20 nt, Mycobacterium avium subsp. paratuberculosis
gguacacguagcgguccagc

SEQ ID NO: 790599 - RNA, 14 nt, Mycobacterium avium subsp. paratuberculosis
gguacacguggccg

SEQ ID NO: 790600 - RNA, 15 nt, Mycobacterium avium subsp. paratuberculosis
gguacacguggccga

SEQ ID NO: 790601 - RNA, 19 nt, Mycobacterium avium subsp. paratuberculosis
gguacagcaccgccgcggg

SEQ ID NO: 790602 - RNA, 18 nt, Mycobacterium avium subsp. paratuberculosis
gguacagcgacuccagcg

SEQ ID NO: 790603 - RNA, 18 nt, Mycobacterium avium subsp. paratuberculosis
ggguuuccacgugcacgg

SEQ ID NO: 790604 - RNA, 14 nt, Mycobacterium avium subsp. paratuberculosis
ggguugcucgccgu

SEQ ID NO: 790605 - RNA, 14 nt, Mycobacterium avium subsp. paratuberculosis
ggguugccggcggc

SEQ ID NO: 790606 - RNA, 12 nt, Mycobacterium avium subsp. paratuberculosis
ggguugggcggc

SEQ ID NO: 790607 - RNA, 13 nt, Mycobacterium avium subsp. paratuberculosis
ggguuggggccgc

SEQ ID NO: 790608 - RNA, 14 nt, Mycobacterium avium subsp. paratuberculosis
ggguuucggcccgg

SEQ ID NO: 790609 - RNA, 15 nt, Mycobacterium avium subsp. paratuberculosis
ggguuucgugugcuc

SEQ ID NO: 790610 - RNA, 17 nt, Mycobacterium avium subsp. paratuberculosis
ggguuuguccggccagg

SEQ ID NO: 790611 - RNA, 15 nt, Mycobacterium avium subsp. paratuberculosis
ggguuuucggcgcgc

SEQ ID NO: 790612 - RNA, 14 nt, Mycobacterium avium subsp. paratuberculosis
gguaaaccgccagc

SEQ ID NO: 790613 - RNA, 18 nt, Mycobacterium avium subsp. paratuberculosis
gguaaaccgccagcagcg

SEQ ID NO: 790614 - RNA, 19 nt, Mycobacterium avium subsp. paratuberculosis
ggguugaagcuggccaccg

SEQ ID NO: 790615 - RNA, 16 nt, Mycobacterium avium subsp. paratuberculosis
ggguugacccggccgg

SEQ ID NO: 790616 - RNA, 14 nt, Mycobacterium avium subsp. paratuberculosis
ggguucuucgacca

SEQ ID NO: 790617 - RNA, 21 nt, Mycobacterium avium subsp. paratuberculosis
ggguucuucgaccacgcgcca

SEQ ID NO: 790618 - RNA, 18 nt, Mycobacterium avium subsp. paratuberculosis
ggguucguugcgccgcca

SEQ ID NO: 790619 - RNA, 19 nt, Mycobacterium avium subsp. paratuberculosis
ggguucucgcggcggccga

SEQ ID NO: 790620 - RNA, 22 nt, Mycobacterium avium subsp. paratuberculosis
ggguucgcccuccccggccagc

SEQ ID NO: 790621 - RNA, 13 nt, Mycobacterium avium subsp. paratuberculosis
ggguguggcgucg

SEQ ID NO: 790622 - RNA, 17 nt, Mycobacterium avium subsp. paratuberculosis
gggugucgucgcgcacc

SEQ ID NO: 790623 - RNA, 13 nt, Mycobacterium avium subsp. paratuberculosis
ggguguuccccgg

SEQ ID NO: 790624 - RNA, 16 nt, Mycobacterium avium subsp. paratuberculosis
ggguguuggacgaggu

SEQ ID NO: 790625 - RNA, 14 nt, Mycobacterium avium subsp. paratuberculosis
ggguguuucggucg

SEQ ID NO: 790626 - RNA, 17 nt, Mycobacterium avium subsp. paratuberculosis
ggguuacguggacgcgc

SEQ ID NO: 790627 - RNA, 15 nt, Mycobacterium avium subsp. paratuberculosis
gggcgguggcggcga

SEQ ID NO: 790628 - RNA, 23 nt, Mycobacterium avium subsp. paratuberculosis
gggcgguugccugguucgacgug

SEQ ID NO: 790629 - RNA, 13 nt, Mycobacterium avium subsp. paratuberculosis
gggcggugcagcc

SEQ ID NO: 790630 - RNA, 15 nt, Mycobacterium avium subsp. paratuberculosis
gggcggugcgcaguc

SEQ ID NO: 790631 - RNA, 16 nt, Mycobacterium avium subsp. paratuberculosis
gggcguacgcgcugcc

SEQ ID NO: 790632 - RNA, 17 nt, Mycobacterium avium subsp. paratuberculosis
gggcguacugcucggcg

SEQ ID NO: 790633 - RNA, 12 nt, Mycobacterium avium subsp. paratuberculosis
gggcgucacgag

SEQ ID NO: 790634 - RNA, 23 nt, Mycobacterium avium subsp. paratuberculosis
gggcgucacgcaucagggccagc

SEQ ID NO: 790635 - RNA, 15 nt, Mycobacterium avium subsp. paratuberculosis
gggcgucacgccagc

SEQ ID NO: 790636 - RNA, 16 nt, Mycobacterium avium subsp. paratuberculosis
gggcgucacgccagcg

SEQ ID NO: 790637 - RNA, 19 nt, Mycobacterium avium subsp. paratuberculosis
gggcgucacucuggcguga

SEQ ID NO: 790638 - RNA, 13 nt, Mycobacterium avium subsp. paratuberculosis
gggcgucaggcgc

SEQ ID NO: 790639 - RNA, 21 nt, Mycobacterium avium subsp. paratuberculosis
gggcguagugcagcugcagcg

SEQ ID NO: 790640 - RNA, 23 nt, Mycobacterium avium subsp. paratuberculosis
gggcguccgagaagggccgccgc

SEQ ID NO: 790641 - RNA, 17 nt, Mycobacterium avium subsp. paratuberculosis
gggcguccuugaccagc

SEQ ID NO: 790642 - RNA, 14 nt, Mycobacterium avium subsp. paratuberculosis
gggugagcggcgcg

SEQ ID NO: 790643 - RNA, 14 nt, Mycobacterium avium subsp. paratuberculosis
gggcguccagcgag

SEQ ID NO: 790644 - RNA, 15 nt, Mycobacterium avium subsp. paratuberculosis
gggcgucgacgaugg

SEQ ID NO: 790645 - RNA, 18 nt, Mycobacterium avium subsp. paratuberculosis
gggcgucgcccgccgacg

SEQ ID NO: 790646 - RNA, 15 nt, Mycobacterium avium subsp. paratuberculosis
gggugaggggcgcgc

SEQ ID NO: 790647 - RNA, 11 nt, Mycobacterium avium subsp. paratuberculosis
gggugaucgcg

SEQ ID NO: 790648 - RNA, 15 nt, Mycobacterium avium subsp. paratuberculosis
gggugaucgcggccc

SEQ ID NO: 790649 - RNA, 17 nt, Mycobacterium avium subsp. paratuberculosis
gggugaucgcggcccgc

SEQ ID NO: 790650 - RNA, 21 nt, Mycobacterium avium subsp. paratuberculosis
gggugauggucucccgggcgg

SEQ ID NO: 790651 - RNA, 20 nt, Mycobacterium avium subsp. paratuberculosis
gggugaugucgcugccgccg

SEQ ID NO: 790652 - RNA, 19 nt, Mycobacterium avium subsp. paratuberculosis
gggugauuaggcaguucga

SEQ ID NO: 790653 - RNA, 16 nt, Mycobacterium avium subsp. paratuberculosis
gggugcgauggcaacg

SEQ ID NO: 790654 - RNA, 24 nt, Mycobacterium avium subsp. paratuberculosis
gggugcgcagcgcgucgucgguca

SEQ ID NO: 790655 - RNA, 13 nt, Mycobacterium avium subsp. paratuberculosis
gggugcgccacug

SEQ ID NO: 790656 - RNA, 12 nt, Mycobacterium avium subsp. paratuberculosis
gggugcgccagg

SEQ ID NO: 790657 - RNA, 16 nt, Mycobacterium avium subsp. paratuberculosis
gggugccgcagcggcg

SEQ ID NO: 790658 - RNA, 17 nt, Mycobacterium avium subsp. paratuberculosis
gggugccgccgggcacc

SEQ ID NO: 790659 - RNA, 13 nt, Mycobacterium avium subsp. paratuberculosis
gggugccgcgguu

SEQ ID NO: 790660 - RNA, 14 nt, Mycobacterium avium subsp. paratuberculosis
gggugccggccacc

SEQ ID NO: 790661 - RNA, 18 nt, Mycobacterium avium subsp. paratuberculosis
gggugccggccaccggcg

SEQ ID NO: 790662 - RNA, 13 nt, Mycobacterium avium subsp. paratuberculosis
gggugccccgcga

SEQ ID NO: 790663 - RNA, 18 nt, Mycobacterium avium subsp. paratuberculosis
gggugccccgcgaccgca

SEQ ID NO: 790664 - RNA, 19 nt, Mycobacterium avium subsp. paratuberculosis
gggugccccgcgaccgcag

SEQ ID NO: 790665 - RNA, 23 nt, Mycobacterium avium subsp. paratuberculosis
gggugccagccgugcggcggcgg

SEQ ID NO: 790666 - RNA, 13 nt, Mycobacterium avium subsp. paratuberculosis
gggugcccaccag

SEQ ID NO: 790667 - RNA, 17 nt, Mycobacterium avium subsp. paratuberculosis
gggugcccggcugggcg

SEQ ID NO: 790668 - RNA, 23 nt, Mycobacterium avium subsp. paratuberculosis
gggugcccggcugggcgcgcaac

SEQ ID NO: 790669 - RNA, 15 nt, Mycobacterium avium subsp. paratuberculosis
gggugccgaccgcgu

SEQ ID NO: 790670 - RNA, 18 nt, Mycobacterium avium subsp. paratuberculosis
gggugccgacgagcucgc

SEQ ID NO: 790671 - RNA, 21 nt, Mycobacterium avium subsp. paratuberculosis
gggugccgacgagcucgccgc

SEQ ID NO: 790672 - RNA, 18 nt, Mycobacterium avium subsp. paratuberculosis
gggugaugaggucgcgac

SEQ ID NO: 790673 - RNA, 19 nt, Mycobacterium avium subsp. paratuberculosis
gggugcagcaccacgaacg

SEQ ID NO: 790674 - RNA, 20 nt, Mycobacterium avium subsp. paratuberculosis
gggugcaggcccagcugcug

SEQ ID NO: 790675 - RNA, 17 nt, Mycobacterium avium subsp. paratuberculosis
gggugcaggcccgggcg

SEQ ID NO: 790676 - RNA, 18 nt, Mycobacterium avium subsp. paratuberculosis
gggugcaggcccgggcgg

SEQ ID NO: 790677 - RNA, 12 nt, Mycobacterium avium subsp. paratuberculosis
gggcgucgccgc

SEQ ID NO: 790678 - RNA, 18 nt, Mycobacterium avium subsp. paratuberculosis
gggugugcccgaacgcgc

SEQ ID NO: 790679 - RNA, 13 nt, Mycobacterium avium subsp. paratuberculosis
gggugucgaugac

SEQ ID NO: 790680 - RNA, 13 nt, Mycobacterium avium subsp. paratuberculosis
gggugucgcccuc

SEQ ID NO: 790681 - RNA, 17 nt, Mycobacterium avium subsp. paratuberculosis
ggguguccuugcgcacc

SEQ ID NO: 790682 - RNA, 22 nt, Mycobacterium avium subsp. paratuberculosis
ggguguccuugcgcaccacguc

SEQ ID NO: 790683 - RNA, 13 nt, Mycobacterium avium subsp. paratuberculosis
ggguggucugcug

SEQ ID NO: 790684 - RNA, 15 nt, Mycobacterium avium subsp. paratuberculosis
gggugucgacgaugc

SEQ ID NO: 790685 - RNA, 16 nt, Mycobacterium avium subsp. paratuberculosis
gggugucaggucggcg

SEQ ID NO: 790686 - RNA, 18 nt, Mycobacterium avium subsp. paratuberculosis
gggugucaggucggcgau

SEQ ID NO: 790687 - RNA, 19 nt, Mycobacterium avium subsp. paratuberculosis
ggguguccgagcgggccgu

SEQ ID NO: 790688 - RNA, 14 nt, Mycobacterium avium subsp. paratuberculosis
gggugguucguccg

SEQ ID NO: 790689 - RNA, 15 nt, Mycobacterium avium subsp. paratuberculosis
ggguguagcggaugg

SEQ ID NO: 790690 - RNA, 15 nt, Mycobacterium avium subsp. paratuberculosis
ggguguaggccgcgu

SEQ ID NO: 790691 - RNA, 13 nt, Mycobacterium avium subsp. paratuberculosis
ggguguaggcguc

SEQ ID NO: 790692 - RNA, 18 nt, Mycobacterium avium subsp. paratuberculosis
ggguggucacaccgcuga

SEQ ID NO: 790693 - RNA, 18 nt, Mycobacterium avium subsp. paratuberculosis
ggguggucaccagcgcgg

SEQ ID NO: 790694 - RNA, 15 nt, Mycobacterium avium subsp. paratuberculosis
ggguggucaccggca

SEQ ID NO: 790695 - RNA, 16 nt, Mycobacterium avium subsp. paratuberculosis
ggguggucagcgucuc

SEQ ID NO: 790696 - RNA, 22 nt, Mycobacterium avium subsp. paratuberculosis
ggguggucagcgucucggcgau

SEQ ID NO: 790697 - RNA, 15 nt, Mycobacterium avium subsp. paratuberculosis
gggugguccacccag

SEQ ID NO: 790698 - RNA, 19 nt, Mycobacterium avium subsp. paratuberculosis
gggugggcggcacaccgcg

SEQ ID NO: 790699 - RNA, 15 nt, Mycobacterium avium subsp. paratuberculosis
ggguggcgucgccgc

SEQ ID NO: 790700 - RNA, 12 nt, Mycobacterium avium subsp. paratuberculosis
gggugggcacgu

SEQ ID NO: 790701 - RNA, 13 nt, Mycobacterium avium subsp. paratuberculosis
gggugggcagcgc

SEQ ID NO: 790702 - RNA, 15 nt, Mycobacterium avium subsp. paratuberculosis
gggugggcagcucgg

SEQ ID NO: 790703 - RNA, 16 nt, Mycobacterium avium subsp. paratuberculosis
gggugggcgacgaggu

SEQ ID NO: 790704 - RNA, 22 nt, Mycobacterium avium subsp. paratuberculosis
gggugggcucccagucccagca

SEQ ID NO: 790705 - RNA, 16 nt, Mycobacterium avium subsp. paratuberculosis
ggguggggacgacgcc

SEQ ID NO: 790706 - RNA, 18 nt, Mycobacterium avium subsp. paratuberculosis
ggguggggaucacgucgg

SEQ ID NO: 790707 - RNA, 16 nt, Mycobacterium avium subsp. paratuberculosis
ggguggcgccggccag

SEQ ID NO: 790708 - RNA, 18 nt, Mycobacterium avium subsp. paratuberculosis
ggguggcgccggccagca

SEQ ID NO: 790709 - RNA, 14 nt, Mycobacterium avium subsp. paratuberculosis
ggguggccagccag

SEQ ID NO: 790710 - RNA, 14 nt, Mycobacterium avium subsp. paratuberculosis
ggguggccucgucg

SEQ ID NO: 790711 - RNA, 19 nt, Mycobacterium avium subsp. paratuberculosis
ggguggccucgucggcgcc

SEQ ID NO: 790712 - RNA, 12 nt, Mycobacterium avium subsp. paratuberculosis
ggguggcccgcc

SEQ ID NO: 790713 - RNA, 13 nt, Mycobacterium avium subsp. paratuberculosis
ggguggcccgccc

SEQ ID NO: 790714 - RNA, 15 nt, Mycobacterium avium subsp. paratuberculosis
ggguggcccgcccgg

SEQ ID NO: 790715 - RNA, 19 nt, Mycobacterium avium subsp. paratuberculosis
ggguggcccgcccgggcac

SEQ ID NO: 790716 - RNA, 22 nt, Mycobacterium avium subsp. paratuberculosis
ggguggccgccacguccggaug

SEQ ID NO: 790717 - RNA, 12 nt, Mycobacterium avium subsp. paratuberculosis
ggguggccggcc

SEQ ID NO: 790718 - RNA, 16 nt, Mycobacterium avium subsp. paratuberculosis
ggguggccggccagca

SEQ ID NO: 790719 - RNA, 14 nt, Mycobacterium avium subsp. paratuberculosis
ggguggccggggcc

SEQ ID NO: 790720 - RNA, 14 nt, Mycobacterium avium subsp. paratuberculosis
ggguggccgggucg

SEQ ID NO: 790721 - RNA, 12 nt, Mycobacterium avium subsp. paratuberculosis
ggguggccguga

SEQ ID NO: 790722 - RNA, 13 nt, Mycobacterium avium subsp. paratuberculosis
ggguggccagcac

SEQ ID NO: 790723 - RNA, 16 nt, Mycobacterium avium subsp. paratuberculosis
ggguggccagcaccag

SEQ ID NO: 790724 - RNA, 20 nt, Mycobacterium avium subsp. paratuberculosis
ggguggccagcacgcugcgg

SEQ ID NO: 790725 - RNA, 16 nt, Mycobacterium avium subsp. paratuberculosis
ggguggacgcccgcga

SEQ ID NO: 790726 - RNA, 19 nt, Mycobacterium avium subsp. paratuberculosis
ggguggagacguaccagcu

SEQ ID NO: 790727 - RNA, 19 nt, Mycobacterium avium subsp. paratuberculosis
gggugcucgaucggcgcgc

SEQ ID NO: 790728 - RNA, 20 nt, Mycobacterium avium subsp. paratuberculosis
gggugcucgaucggcgcgcc

SEQ ID NO: 790729 - RNA, 17 nt, Mycobacterium avium subsp. paratuberculosis
gggugcugaacgccugc

SEQ ID NO: 790730 - RNA, 20 nt, Mycobacterium avium subsp. paratuberculosis
gggugcucaccccggccagg

SEQ ID NO: 790731 - RNA, 14 nt, Mycobacterium avium subsp. paratuberculosis
gggugcucagccgc

SEQ ID NO: 790732 - RNA, 15 nt, Mycobacterium avium subsp. paratuberculosis
gggugcuggucagca

SEQ ID NO: 790733 - RNA, 20 nt, Mycobacterium avium subsp. paratuberculosis
gggugcuuucgcgucugcuc

SEQ ID NO: 790734 - RNA, 21 nt, Mycobacterium avium subsp. paratuberculosis
ggguggacaccuuggcggcca

SEQ ID NO: 790735 - RNA, 15 nt, Mycobacterium avium subsp. paratuberculosis
gggugcgcucaccgc

SEQ ID NO: 790736 - RNA, 21 nt, Mycobacterium avium subsp. paratuberculosis
gggugcgcucaccgcaucgaa

SEQ ID NO: 790737 - RNA, 16 nt, Mycobacterium avium subsp. paratuberculosis
gggugcgcucgacggc

SEQ ID NO: 790738 - RNA, 21 nt, Mycobacterium avium subsp. paratuberculosis
gggugcgcugcagcgagaccu

SEQ ID NO: 790739 - RNA, 18 nt, Mycobacterium avium subsp. paratuberculosis
gggugcggcacggcaugg

SEQ ID NO: 790740 - RNA, 13 nt, Mycobacterium avium subsp. paratuberculosis
gggugcggccagc

SEQ ID NO: 790741 - RNA, 17 nt, Mycobacterium avium subsp. paratuberculosis
gggugcggccagcgcag

SEQ ID NO: 790742 - RNA, 15 nt, Mycobacterium avium subsp. paratuberculosis
gggugcggcgcugcc

SEQ ID NO: 790743 - RNA, 15 nt, Mycobacterium avium subsp. paratuberculosis
gggugcgggcugacg

SEQ ID NO: 790744 - RNA, 18 nt, Mycobacterium avium subsp. paratuberculosis
gggugcgggugcggccgg

SEQ ID NO: 790745 - RNA, 14 nt, Mycobacterium avium subsp. paratuberculosis
gggugcggucggcg

SEQ ID NO: 790746 - RNA, 13 nt, Mycobacterium avium subsp. paratuberculosis
gggugcggugcgg

SEQ ID NO: 790747 - RNA, 21 nt, Mycobacterium avium subsp. paratuberculosis
ggucacggcgucggcgucggg

SEQ ID NO: 790748 - RNA, 19 nt, Mycobacterium avium subsp. paratuberculosis
ggucacgugcacccacgcc

SEQ ID NO: 790749 - RNA, 22 nt, Mycobacterium avium subsp. paratuberculosis
ggucacgugcacccacgccagc

SEQ ID NO: 790750 - RNA, 23 nt, Mycobacterium avium subsp. paratuberculosis
ggucagaucguugaugucggugg

SEQ ID NO: 790751 - RNA, 12 nt, Mycobacterium avium subsp. paratuberculosis
ggucagcaacag

SEQ ID NO: 790752 - RNA, 18 nt, Mycobacterium avium subsp. paratuberculosis
ggucagaccgcggcgguc

SEQ ID NO: 790753 - RNA, 20 nt, Mycobacterium avium subsp. paratuberculosis
ggucagagcccgaacacggg

SEQ ID NO: 790754 - RNA, 22 nt, Mycobacterium avium subsp. paratuberculosis
ggucagagcccgaacacgggcg

SEQ ID NO: 790755 - RNA, 14 nt, Mycobacterium avium subsp. paratuberculosis
ggucagcaccacca

SEQ ID NO: 790756 - RNA, 18 nt, Mycobacterium avium subsp. paratuberculosis
ggucagcacccgcagccg

SEQ ID NO: 790757 - RNA, 13 nt, Mycobacterium avium subsp. paratuberculosis
ggucagcaccgcg

SEQ ID NO: 790758 - RNA, 17 nt, Mycobacterium avium subsp. paratuberculosis
ggucagcaccgcgcggc

SEQ ID NO: 790759 - RNA, 15 nt, Mycobacterium avium subsp. paratuberculosis
ggucacgcuggcgug

SEQ ID NO: 790760 - RNA, 18 nt, Mycobacterium avium subsp. paratuberculosis
ggucacgcuggcgugacg

SEQ ID NO: 790761 - RNA, 16 nt, Mycobacterium avium subsp. paratuberculosis
ggucacggacagccgg

SEQ ID NO: 790762 - RNA, 14 nt, Mycobacterium avium subsp. paratuberculosis
ggucacggacaggu

SEQ ID NO: 790763 - RNA, 16 nt, Mycobacterium avium subsp. paratuberculosis
ggucacgcccggggug

SEQ ID NO: 790764 - RNA, 20 nt, Mycobacterium avium subsp. paratuberculosis
ggucaccgugcgggucgcgc

SEQ ID NO: 790765 - RNA, 17 nt, Mycobacterium avium subsp. paratuberculosis
ggucacccacuggcggc

SEQ ID NO: 790766 - RNA, 19 nt, Mycobacterium avium subsp. paratuberculosis
ggucacccacuggcggccg

SEQ ID NO: 790767 - RNA, 20 nt, Mycobacterium avium subsp. paratuberculosis
ggucacccacuggcggccgg

SEQ ID NO: 790768 - RNA, 22 nt, Mycobacterium avium subsp. paratuberculosis
ggucacccacuggcggccggcc

SEQ ID NO: 790769 - RNA, 15 nt, Mycobacterium avium subsp. paratuberculosis
ggucaccaggucgcg

SEQ ID NO: 790770 - RNA, 17 nt, Mycobacterium avium subsp. paratuberculosis
ggucaccaucagcggcu

SEQ ID NO: 790771 - RNA, 22 nt, Mycobacterium avium subsp. paratuberculosis
ggucaccaucagcggcucgcgg

SEQ ID NO: 790772 - RNA, 20 nt, Mycobacterium avium subsp. paratuberculosis
ggucaccaccaacgccacgu

SEQ ID NO: 790773 - RNA, 13 nt, Mycobacterium avium subsp. paratuberculosis
ggucaccacgguc

SEQ ID NO: 790774 - RNA, 15 nt, Mycobacterium avium subsp. paratuberculosis
ggucaccagcgcggu

SEQ ID NO: 790775 - RNA, 12 nt, Mycobacterium avium subsp. paratuberculosis
ggucaccagcuc

SEQ ID NO: 790776 - RNA, 17 nt, Mycobacterium avium subsp. paratuberculosis
ggucaccagcucgccga

SEQ ID NO: 790777 - RNA, 21 nt, Mycobacterium avium subsp. paratuberculosis
ggucacccuccucgcggcggu

SEQ ID NO: 790778 - RNA, 14 nt, Mycobacterium avium subsp. paratuberculosis
ggucaccgcgggaa

SEQ ID NO: 790779 - RNA, 22 nt, Mycobacterium avium subsp. paratuberculosis
ggucaccgcgggaauggccgcg

SEQ ID NO: 790780 - RNA, 20 nt, Mycobacterium avium subsp. paratuberculosis
ggucaccggagagcaacacc

SEQ ID NO: 790781 - RNA, 19 nt, Mycobacterium avium subsp. paratuberculosis
ggucaccggaugcaccggc

SEQ ID NO: 790782 - RNA, 20 nt, Mycobacterium avium subsp. paratuberculosis
ggucaccggaugcaccggca

SEQ ID NO: 790783 - RNA, 17 nt, Mycobacterium avium subsp. paratuberculosis
ggucaccggggugccgc

SEQ ID NO: 790784 - RNA, 20 nt, Mycobacterium avium subsp. paratuberculosis
ggucaccggggugccgccca

SEQ ID NO: 790785 - RNA, 22 nt, Mycobacterium avium subsp. paratuberculosis
ggucaccgggugaugucgccga

SEQ ID NO: 790786 - RNA, 11 nt, Mycobacterium avium subsp. paratuberculosis
ggucaccgguc

SEQ ID NO: 790787 - RNA, 19 nt, Mycobacterium avium subsp. paratuberculosis
ggucacccgcagcccgacc

SEQ ID NO: 790788 - RNA, 19 nt, Mycobacterium avium subsp. paratuberculosis
ggucaccguguuggugacg

SEQ ID NO: 790789 - RNA, 20 nt, Mycobacterium avium subsp. paratuberculosis
gguauucaucgcggccgccg

SEQ ID NO: 790790 - RNA, 18 nt, Mycobacterium avium subsp. paratuberculosis
ggucaagccggccagcag

SEQ ID NO: 790791 - RNA, 20 nt, Mycobacterium avium subsp. paratuberculosis
ggucaagcgcuuucgccgaa

SEQ ID NO: 790792 - RNA, 19 nt, Mycobacterium avium subsp. paratuberculosis
ggucaacgugucgagcacg

SEQ ID NO: 790793 - RNA, 18 nt, Mycobacterium avium subsp. paratuberculosis
ggucaacucgacccgcac

SEQ ID NO: 790794 - RNA, 20 nt, Mycobacterium avium subsp. paratuberculosis
ggucaacucgacccgcaccu

SEQ ID NO: 790795 - RNA, 23 nt, Mycobacterium avium subsp. paratuberculosis
ggucaacucgacccgcaccucga

SEQ ID NO: 790796 - RNA, 22 nt, Mycobacterium avium subsp. paratuberculosis
ggucaagaacgaaucgucgccg

SEQ ID NO: 790797 - RNA, 23 nt, Mycobacterium avium subsp. paratuberculosis
ggucaagaacgcaaucgcccagu

SEQ ID NO: 790798 - RNA, 18 nt, Mycobacterium avium subsp. paratuberculosis
ggucaagauaccggccgg

SEQ ID NO: 790799 - RNA, 18 nt, Mycobacterium avium subsp. paratuberculosis
ggucaauugacguaaccg

SEQ ID NO: 790800 - RNA, 15 nt, Mycobacterium avium subsp. paratuberculosis
ggucacacccucggc

SEQ ID NO: 790801 - RNA, 18 nt, Mycobacterium avium subsp. paratuberculosis
ggucacacccucggcccg

SEQ ID NO: 790802 - RNA, 22 nt, Mycobacterium avium subsp. paratuberculosis
ggucacacccuugucggugacc

SEQ ID NO: 790803 - RNA, 13 nt, Mycobacterium avium subsp. paratuberculosis
ggucacaccgcug

SEQ ID NO: 790804 - RNA, 16 nt, Mycobacterium avium subsp. paratuberculosis
ggucacagccgcgaua

SEQ ID NO: 790805 - RNA, 13 nt, Mycobacterium avium subsp. paratuberculosis
ggucaacaccggg

SEQ ID NO: 790806 - RNA, 23 nt, Mycobacterium avium subsp. paratuberculosis
ggucaacaccgggauccggcgcg

SEQ ID NO: 790807 - RNA, 23 nt, Mycobacterium avium subsp. paratuberculosis
ggucaacacgaagccggugucgg

SEQ ID NO: 790808 - RNA, 22 nt, Mycobacterium avium subsp. paratuberculosis
ggucaacacuuuccgcacgcug

SEQ ID NO: 790809 - RNA, 15 nt, Mycobacterium avium subsp. paratuberculosis
gguaugcggcgacga

SEQ ID NO: 790810 - RNA, 22 nt, Mycobacterium avium subsp. paratuberculosis
ggucaaccaggccuuccgcaac

SEQ ID NO: 790811 - RNA, 16 nt, Mycobacterium avium subsp. paratuberculosis
ggucaacggcucgguc

SEQ ID NO: 790812 - RNA, 15 nt, Mycobacterium avium subsp. paratuberculosis
gguaguggugggcgu

SEQ ID NO: 790813 - RNA, 15 nt, Mycobacterium avium subsp. paratuberculosis
gguagucgucguggu

SEQ ID NO: 790814 - RNA, 14 nt, Mycobacterium avium subsp. paratuberculosis
gguaguucagcgcg

SEQ ID NO: 790815 - RNA, 15 nt, Mycobacterium avium subsp. paratuberculosis
gguaguucagcgcgc

SEQ ID NO: 790816 - RNA, 16 nt, Mycobacterium avium subsp. paratuberculosis
gguaguucugcucgau

SEQ ID NO: 790817 - RNA, 12 nt, Mycobacterium avium subsp. paratuberculosis
gguaggccaccg

SEQ ID NO: 790818 - RNA, 14 nt, Mycobacterium avium subsp. paratuberculosis
gguaggcggcgccg

SEQ ID NO: 790819 - RNA, 17 nt, Mycobacterium avium subsp. paratuberculosis
gguaggcggcgccgucg

SEQ ID NO: 790820 - RNA, 22 nt, Mycobacterium avium subsp. paratuberculosis
gguaggcggcgccgucgaccag

SEQ ID NO: 790821 - RNA, 15 nt, Mycobacterium avium subsp. paratuberculosis
gguaggcgguggcgc

SEQ ID NO: 790822 - RNA, 15 nt, Mycobacterium avium subsp. paratuberculosis
gguagggccggucac

SEQ ID NO: 790823 - RNA, 21 nt, Mycobacterium avium subsp. paratuberculosis
gguagggccggucaccggucg

SEQ ID NO: 790824 - RNA, 17 nt, Mycobacterium avium subsp. paratuberculosis
gguagggcgccgucggc

SEQ ID NO: 790825 - RNA, 13 nt, Mycobacterium avium subsp. paratuberculosis
gguagggucgggu

SEQ ID NO: 790826 - RNA, 12 nt, Mycobacterium avium subsp. paratuberculosis
gguagucgcgca

SEQ ID NO: 790827 - RNA, 15 nt, Mycobacterium avium subsp. paratuberculosis
gguagucgcgcagcu

SEQ ID NO: 790828 - RNA, 16 nt, Mycobacterium avium subsp. paratuberculosis
gguaguagcgcgccgg

SEQ ID NO: 790829 - RNA, 21 nt, Mycobacterium avium subsp. paratuberculosis
gguagucccgcgccuggcgca

SEQ ID NO: 790830 - RNA, 14 nt, Mycobacterium avium subsp. paratuberculosis
gguagcggaccugc

SEQ ID NO: 790831 - RNA, 17 nt, Mycobacterium avium subsp. paratuberculosis
gguagcggugcucgaug

SEQ ID NO: 790832 - RNA, 13 nt, Mycobacterium avium subsp. paratuberculosis
gguagcgugcgcc

SEQ ID NO: 790833 - RNA, 17 nt, Mycobacterium avium subsp. paratuberculosis
gguagcgugcgcccgac

SEQ ID NO: 790834 - RNA, 21 nt, Mycobacterium avium subsp. paratuberculosis
gguagcgugcgcccgacgccg

SEQ ID NO: 790835 - RNA, 15 nt, Mycobacterium avium subsp. paratuberculosis
gguagcgcagcacca

SEQ ID NO: 790836 - RNA, 16 nt, Mycobacterium avium subsp. paratuberculosis
gguagcgcagcccggu

SEQ ID NO: 790837 - RNA, 18 nt, Mycobacterium avium subsp. paratuberculosis
gguagcgccgccggggcg

SEQ ID NO: 790838 - RNA, 23 nt, Mycobacterium avium subsp. paratuberculosis
gguagcgccgccggggcgggcag

SEQ ID NO: 790839 - RNA, 16 nt, Mycobacterium avium subsp. paratuberculosis
gguagccggcccgcag

SEQ ID NO: 790840 - RNA, 17 nt, Mycobacterium avium subsp. paratuberculosis
gguagccggcccgcagc

SEQ ID NO: 790841 - RNA, 21 nt, Mycobacterium avium subsp. paratuberculosis
gguagccggcccgcagccagc

SEQ ID NO: 790842 - RNA, 22 nt, Mycobacterium avium subsp. paratuberculosis
gguaggcggccagcgcccgcgg

SEQ ID NO: 790843 - RNA, 14 nt, Mycobacterium avium subsp. paratuberculosis
gguagcugagcagc

SEQ ID NO: 790844 - RNA, 14 nt, Mycobacterium avium subsp. paratuberculosis
gguagcaggcgcgc

SEQ ID NO: 790845 - RNA, 20 nt, Mycobacterium avium subsp. paratuberculosis
gguagccagcaccgccccgg

SEQ ID NO: 790846 - RNA, 12 nt, Mycobacterium avium subsp. paratuberculosis
gguagcccgcgu

SEQ ID NO: 790847 - RNA, 20 nt, Mycobacterium avium subsp. paratuberculosis
gguagccgccguagccggcg

SEQ ID NO: 790848 - RNA, 21 nt, Mycobacterium avium subsp. paratuberculosis
gguagccgccguagccggcgg

SEQ ID NO: 790849 - RNA, 20 nt, Mycobacterium avium subsp. paratuberculosis
gguagccgccguucucgcgc

SEQ ID NO: 790850 - RNA, 15 nt, Mycobacterium avium subsp. paratuberculosis
gguagcccgucgacg

SEQ ID NO: 790851 - RNA, 16 nt, Mycobacterium avium subsp. paratuberculosis
gguagccgcucgccca

SEQ ID NO: 790852 - RNA, 18 nt, Mycobacterium avium subsp. paratuberculosis
gguagccgcucgcccagc

SEQ ID NO: 790853 - RNA, 15 nt, Mycobacterium avium subsp. paratuberculosis
gguagaccgccgagu

SEQ ID NO: 790854 - RNA, 15 nt, Mycobacterium avium subsp. paratuberculosis
gguagaggccgcgga

SEQ ID NO: 790855 - RNA, 14 nt, Mycobacterium avium subsp. paratuberculosis
gguagaggcggcga

SEQ ID NO: 790856 - RNA, 18 nt, Mycobacterium avium subsp. paratuberculosis
gguagaggcggcgaccgc

SEQ ID NO: 790857 - RNA, 22 nt, Mycobacterium avium subsp. paratuberculosis
gguagaggcggcgaccgcgacg

SEQ ID NO: 790858 - RNA, 18 nt, Mycobacterium avium subsp. paratuberculosis
gguagacgaucaccggcu

SEQ ID NO: 790859 - RNA, 15 nt, Mycobacterium avium subsp. paratuberculosis
gguagacgccggacg

SEQ ID NO: 790860 - RNA, 22 nt, Mycobacterium avium subsp. paratuberculosis
gguagacguucuccccgccgga

SEQ ID NO: 790861 - RNA, 21 nt, Mycobacterium avium subsp. paratuberculosis
gguacugcuugccgccgggcc

SEQ ID NO: 790862 - RNA, 17 nt, Mycobacterium avium subsp. paratuberculosis
gguagaaccagcccggc

SEQ ID NO: 790863 - RNA, 13 nt, Mycobacterium avium subsp. paratuberculosis
gguagacaccgcc

SEQ ID NO: 790864 - RNA, 16 nt, Mycobacterium avium subsp. paratuberculosis
gguacgugcgccggcg

SEQ ID NO: 790865 - RNA, 17 nt, Mycobacterium avium subsp. paratuberculosis
gguacgugcgccggcgg

SEQ ID NO: 790866 - RNA, 18 nt, Mycobacterium avium subsp. paratuberculosis
gguacgugcgccggcggu

SEQ ID NO: 790867 - RNA, 13 nt, Mycobacterium avium subsp. paratuberculosis
gguacgcggcugg

SEQ ID NO: 790868 - RNA, 16 nt, Mycobacterium avium subsp. paratuberculosis
gguacggucggccgua

SEQ ID NO: 790869 - RNA, 21 nt, Mycobacterium avium subsp. paratuberculosis
gguacggccgacgcccagcac

SEQ ID NO: 790870 - RNA, 13 nt, Mycobacterium avium subsp. paratuberculosis
gguacggcggccg

SEQ ID NO: 790871 - RNA, 14 nt, Mycobacterium avium subsp. paratuberculosis
gguacggcggccgc

SEQ ID NO: 790872 - RNA, 16 nt, Mycobacterium avium subsp. paratuberculosis
gguacggcggccgcgg

SEQ ID NO: 790873 - RNA, 17 nt, Mycobacterium avium subsp. paratuberculosis
gguacggcggccgcgga

SEQ ID NO: 790874 - RNA, 21 nt, Mycobacterium avium subsp. paratuberculosis
gguacggcucguggguggucu

SEQ ID NO: 790875 - RNA, 16 nt, Mycobacterium avium subsp. paratuberculosis
gguaccgguugcccgg

SEQ ID NO: 790876 - RNA, 15 nt, Mycobacterium avium subsp. paratuberculosis
gguaccggcgggcga

SEQ ID NO: 790877 - RNA, 20 nt, Mycobacterium avium subsp. paratuberculosis
ggugcacggcgccaccagcc

SEQ ID NO: 790878 - RNA, 22 nt, Mycobacterium avium subsp. paratuberculosis
ggugcagaccccggcguccagu

SEQ ID NO: 790879 - RNA, 15 nt, Mycobacterium avium subsp. paratuberculosis
ggugcagacgugacg

SEQ ID NO: 790880 - RNA, 20 nt, Mycobacterium avium subsp. paratuberculosis
ggugcagacgugacgugccc

SEQ ID NO: 790881 - RNA, 16 nt, Mycobacterium avium subsp. paratuberculosis
ggugcagauagguggu

SEQ ID NO: 790882 - RNA, 22 nt, Mycobacterium avium subsp. paratuberculosis
ggugcagauagguggucuccca

SEQ ID NO: 790883 - RNA, 18 nt, Mycobacterium avium subsp. paratuberculosis
ggugcagcagcagccacg

SEQ ID NO: 790884 - RNA, 22 nt, Mycobacterium avium subsp. paratuberculosis
ggugcagcagcagccacgccag

SEQ ID NO: 790885 - RNA, 13 nt, Mycobacterium avium subsp. paratuberculosis
ggugcagccgggg

SEQ ID NO: 790886 - RNA, 14 nt, Mycobacterium avium subsp. paratuberculosis
ggugcagccgggug

SEQ ID NO: 790887 - RNA, 21 nt, Mycobacterium avium subsp. paratuberculosis
ggugauguuggccgcgacgcc

SEQ ID NO: 790888 - RNA, 22 nt, Mycobacterium avium subsp. paratuberculosis
ggugaugucacccucgaggccg

SEQ ID NO: 790889 - RNA, 17 nt, Mycobacterium avium subsp. paratuberculosis
ggugaugucgccggcgg

SEQ ID NO: 790890 - RNA, 18 nt, Mycobacterium avium subsp. paratuberculosis
ggugaugucgccggcggc

SEQ ID NO: 790891 - RNA, 14 nt, Mycobacterium avium subsp. paratuberculosis
ggugaugucgcugc

SEQ ID NO: 790892 - RNA, 21 nt, Mycobacterium avium subsp. paratuberculosis
ggugaugucgcugccgccgcc

SEQ ID NO: 790893 - RNA, 21 nt, Mycobacterium avium subsp. paratuberculosis
ggugaugugcggcgcggcggu

SEQ ID NO: 790894 - RNA, 22 nt, Mycobacterium avium subsp. paratuberculosis
ggugaugugcggcgcggcggug

SEQ ID NO: 790895 - RNA, 20 nt, Mycobacterium avium subsp. paratuberculosis
ggugaugccgagcgccgcgu

SEQ ID NO: 790896 - RNA, 13 nt, Mycobacterium avium subsp. paratuberculosis
ggugauggcgaug

SEQ ID NO: 790897 - RNA, 15 nt, Mycobacterium avium subsp. paratuberculosis
ggugaugggcagcgc

SEQ ID NO: 790898 - RNA, 20 nt, Mycobacterium avium subsp. paratuberculosis
ggugaugggcagcgccccgg

SEQ ID NO: 790899 - RNA, 20 nt, Mycobacterium avium subsp. paratuberculosis
ggugauggccgccgcaggcg

SEQ ID NO: 790900 - RNA, 14 nt, Mycobacterium avium subsp. paratuberculosis
ggugauggucaccg

SEQ ID NO: 790901 - RNA, 21 nt, Mycobacterium avium subsp. paratuberculosis
ggugaucaggcccucgucggc

SEQ ID NO: 790902 - RNA, 22 nt, Mycobacterium avium subsp. paratuberculosis
ggugauccacuccagcaccgga

SEQ ID NO: 790903 - RNA, 15 nt, Mycobacterium avium subsp. paratuberculosis
ggugaucacccgccg

SEQ ID NO: 790904 - RNA, 18 nt, Mycobacterium avium subsp. paratuberculosis
ggugaucacccgccgggu

SEQ ID NO: 790905 - RNA, 16 nt, Mycobacterium avium subsp. paratuberculosis
ggugaguucgucggcg

SEQ ID NO: 790906 - RNA, 19 nt, Mycobacterium avium subsp. paratuberculosis
ggugaucaaagccgguggc

SEQ ID NO: 790907 - RNA, 16 nt, Mycobacterium avium subsp. paratuberculosis
ggugagacggccagca

SEQ ID NO: 790908 - RNA, 13 nt, Mycobacterium avium subsp. paratuberculosis
ggugaggucgcgc

SEQ ID NO: 790909 - RNA, 15 nt, Mycobacterium avium subsp. paratuberculosis
ggugaugcgcggcga

SEQ ID NO: 790910 - RNA, 17 nt, Mycobacterium avium subsp. paratuberculosis
ggugaugcgcggcgacg

SEQ ID NO: 790911 - RNA, 18 nt, Mycobacterium avium subsp. paratuberculosis
ggugaugcgcggcgacgg

SEQ ID NO: 790912 - RNA, 20 nt, Mycobacterium avium subsp. paratuberculosis
ggugaugcgcggcgacggcg

SEQ ID NO: 790913 - RNA, 18 nt, Mycobacterium avium subsp. paratuberculosis
ggugaugcggaugcccgc

SEQ ID NO: 790914 - RNA, 22 nt, Mycobacterium avium subsp. paratuberculosis
ggugaugcggaugcccgccggc

SEQ ID NO: 790915 - RNA, 15 nt, Mycobacterium avium subsp. paratuberculosis
ggugauccgcccggc

SEQ ID NO: 790916 - RNA, 13 nt, Mycobacterium avium subsp. paratuberculosis
ggugauccggggc

SEQ ID NO: 790917 - RNA, 15 nt, Mycobacterium avium subsp. paratuberculosis
ggugauccggugcca

SEQ ID NO: 790918 - RNA, 20 nt, Mycobacterium avium subsp. paratuberculosis
ggugauccggugccacgcgg

SEQ ID NO: 790919 - RNA, 20 nt, Mycobacterium avium subsp. paratuberculosis
ggugauccucgucuccggcg

SEQ ID NO: 790920 - RNA, 22 nt, Mycobacterium avium subsp. paratuberculosis
ggugauccucgucuccggcggc

SEQ ID NO: 790921 - RNA, 13 nt, Mycobacterium avium subsp. paratuberculosis
ggugaucgaccgg

SEQ ID NO: 790922 - RNA, 14 nt, Mycobacterium avium subsp. paratuberculosis
ggugaucgaccgga

SEQ ID NO: 790923 - RNA, 16 nt, Mycobacterium avium subsp. paratuberculosis
ggugacuucgagccgg

SEQ ID NO: 790924 - RNA, 21 nt, Mycobacterium avium subsp. paratuberculosis
ggugacuucgagccgggcgcg

SEQ ID NO: 790925 - RNA, 19 nt, Mycobacterium avium subsp. paratuberculosis
ggugagaaaagcgaccagc

SEQ ID NO: 790926 - RNA, 17 nt, Mycobacterium avium subsp. paratuberculosis
ggugagaaagucgaucu

SEQ ID NO: 790927 - RNA, 18 nt, Mycobacterium avium subsp. paratuberculosis
ggugagaaagucgaucug

SEQ ID NO: 790928 - RNA, 23 nt, Mycobacterium avium subsp. paratuberculosis
ggugacuccuccucggccagccc

SEQ ID NO: 790929 - RNA, 20 nt, Mycobacterium avium subsp. paratuberculosis
ggugacgguggcguccucga

SEQ ID NO: 790930 - RNA, 23 nt, Mycobacterium avium subsp. paratuberculosis
ggugacgguuucggaguggaaca

SEQ ID NO: 790931 - RNA, 23 nt, Mycobacterium avium subsp. paratuberculosis
ggugacgguuuuggucugcgccg

SEQ ID NO: 790932 - RNA, 15 nt, Mycobacterium avium subsp. paratuberculosis
ggugacgucgccgau

SEQ ID NO: 790933 - RNA, 13 nt, Mycobacterium avium subsp. paratuberculosis
ggugacgucgcgc

SEQ ID NO: 790934 - RNA, 19 nt, Mycobacterium avium subsp. paratuberculosis
ggugacgugcaccugcagc

SEQ ID NO: 790935 - RNA, 24 nt, Mycobacterium avium subsp. paratuberculosis
ggugacgugcaccugcagccgguc

SEQ ID NO: 790936 - RNA, 18 nt, Mycobacterium avium subsp. paratuberculosis
ggugacguggcggccguc

SEQ ID NO: 790937 - RNA, 19 nt, Mycobacterium avium subsp. paratuberculosis
ggugacguggcggccgucg

SEQ ID NO: 790938 - RNA, 22 nt, Mycobacterium avium subsp. paratuberculosis
ggugacggugaacuucaccguc

SEQ ID NO: 790939 - RNA, 19 nt, Mycobacterium avium subsp. paratuberculosis
ggugacggucaugccgagc

SEQ ID NO: 790940 - RNA, 14 nt, Mycobacterium avium subsp. paratuberculosis
ggugacgcucaccc

SEQ ID NO: 790941 - RNA, 14 nt, Mycobacterium avium subsp. paratuberculosis
ggugacgggcgucg

SEQ ID NO: 790942 - RNA, 17 nt, Mycobacterium avium subsp. paratuberculosis
ggugacggccgugaugc

SEQ ID NO: 790943 - RNA, 23 nt, Mycobacterium avium subsp. paratuberculosis
ggugacggccucccacucgucga

SEQ ID NO: 790944 - RNA, 22 nt, Mycobacterium avium subsp. paratuberculosis
ggugacgaacucaagggcguca

SEQ ID NO: 790945 - RNA, 22 nt, Mycobacterium avium subsp. paratuberculosis
ggugacgaccggcagccgcgcc

SEQ ID NO: 790946 - RNA, 20 nt, Mycobacterium avium subsp. paratuberculosis
ggugacgaggagggugucgg

SEQ ID NO: 790947 - RNA, 22 nt, Mycobacterium avium subsp. paratuberculosis
ggugacgauccacagcgcgaau

SEQ ID NO: 790948 - RNA, 19 nt, Mycobacterium avium subsp. paratuberculosis
ggugacgauccggucgaug

SEQ ID NO: 790949 - RNA, 12 nt, Mycobacterium avium subsp. paratuberculosis
ggugacgaucug

SEQ ID NO: 790950 - RNA, 22 nt, Mycobacterium avium subsp. paratuberculosis
ggugacgaugaugucggccggc

SEQ ID NO: 790951 - RNA, 23 nt, Mycobacterium avium subsp. paratuberculosis
ggugacgaugucgaugacggcgg

SEQ ID NO: 790952 - RNA, 12 nt, Mycobacterium avium subsp. paratuberculosis
ggugacgcccgu

SEQ ID NO: 790953 - RNA, 19 nt, Mycobacterium avium subsp. paratuberculosis
ggugacgcccgucccgccg

SEQ ID NO: 790954 - RNA, 18 nt, Mycobacterium avium subsp. paratuberculosis
ggugaauucaucgucccc

SEQ ID NO: 790955 - RNA, 15 nt, Mycobacterium avium subsp. paratuberculosis
ggugaauugggcgag

SEQ ID NO: 790956 - RNA, 14 nt, Mycobacterium avium subsp. paratuberculosis
ggugaccggcgcgc

SEQ ID NO: 790957 - RNA, 15 nt, Mycobacterium avium subsp. paratuberculosis
ggugaccggcgcgca

SEQ ID NO: 790958 - RNA, 18 nt, Mycobacterium avium subsp. paratuberculosis
ggugaccggcgcgcccga

SEQ ID NO: 790959 - RNA, 15 nt, Mycobacterium avium subsp. paratuberculosis
ggugaccggcggcca

SEQ ID NO: 790960 - RNA, 18 nt, Mycobacterium avium subsp. paratuberculosis
ggugaagucggugcccag

SEQ ID NO: 790961 - RNA, 15 nt, Mycobacterium avium subsp. paratuberculosis
ggugaaucaccaagc

SEQ ID NO: 790962 - RNA, 21 nt, Mycobacterium avium subsp. paratuberculosis
ggugaccguacucgugggcca

SEQ ID NO: 790963 - RNA, 23 nt, Mycobacterium avium subsp. paratuberculosis
ggugaccgucacccccggcgcga

SEQ ID NO: 790964 - RNA, 15 nt, Mycobacterium avium subsp. paratuberculosis
ggugaccgucgccga

SEQ ID NO: 790965 - RNA, 20 nt, Mycobacterium avium subsp. paratuberculosis
ggugaccgucgccgaccagc

SEQ ID NO: 790966 - RNA, 12 nt, Mycobacterium avium subsp. paratuberculosis
ggugaccucgaa

SEQ ID NO: 790967 - RNA, 20 nt, Mycobacterium avium subsp. paratuberculosis
ggugaccucgagcaccggcg

SEQ ID NO: 790968 - RNA, 20 nt, Mycobacterium avium subsp. paratuberculosis
ggugaccucgucgggcgcca

SEQ ID NO: 790969 - RNA, 23 nt, Mycobacterium avium subsp. paratuberculosis
ggugaccucgucgggcgccagcc

SEQ ID NO: 790970 - RNA, 14 nt, Mycobacterium avium subsp. paratuberculosis
ggugaccugcacgc

SEQ ID NO: 790971 - RNA, 13 nt, Mycobacterium avium subsp. paratuberculosis
ggugaccugcgga

SEQ ID NO: 790972 - RNA, 18 nt, Mycobacterium avium subsp. paratuberculosis
ggugaagaucgcccgccg

SEQ ID NO: 790973 - RNA, 17 nt, Mycobacterium avium subsp. paratuberculosis
ggugaagcugccgacca

SEQ ID NO: 790974 - RNA, 21 nt, Mycobacterium avium subsp. paratuberculosis
ggugaagcugccgaccaggaa

SEQ ID NO: 790975 - RNA, 16 nt, Mycobacterium avium subsp. paratuberculosis
ggugaaguugccgguc

SEQ ID NO: 790976 - RNA, 20 nt, Mycobacterium avium subsp. paratuberculosis
ggugaaguugccggucaggc

SEQ ID NO: 790977 - RNA, 16 nt, Mycobacterium avium subsp. paratuberculosis
ggugaaguuggcggcg

SEQ ID NO: 790978 - RNA, 21 nt, Mycobacterium avium subsp. paratuberculosis
ggucggaggccuuggugaugg

SEQ ID NO: 790979 - RNA, 15 nt, Mycobacterium avium subsp. paratuberculosis
ggucggaguccagca

SEQ ID NO: 790980 - RNA, 13 nt, Mycobacterium avium subsp. paratuberculosis
ggucggacgccuc

SEQ ID NO: 790981 - RNA, 22 nt, Mycobacterium avium subsp. paratuberculosis
ggucggacgccucccccacccg

SEQ ID NO: 790982 - RNA, 16 nt, Mycobacterium avium subsp. paratuberculosis
ggucggagcgcuccac

SEQ ID NO: 790983 - RNA, 18 nt, Mycobacterium avium subsp. paratuberculosis
ggucggaaaaguggguca

SEQ ID NO: 790984 - RNA, 12 nt, Mycobacterium avium subsp. paratuberculosis
ggucggcgaugg

SEQ ID NO: 790985 - RNA, 16 nt, Mycobacterium avium subsp. paratuberculosis
ggucggcgccgaucac

SEQ ID NO: 790986 - RNA, 15 nt, Mycobacterium avium subsp. paratuberculosis
ggucggcgccggcca

SEQ ID NO: 790987 - RNA, 15 nt, Mycobacterium avium subsp. paratuberculosis
ggucggcgaccaugc

SEQ ID NO: 790988 - RNA, 14 nt, Mycobacterium avium subsp. paratuberculosis
ggucggcgacgccg

SEQ ID NO: 790989 - RNA, 15 nt, Mycobacterium avium subsp. paratuberculosis
ggucggcgacgccgu

SEQ ID NO: 790990 - RNA, 15 nt, Mycobacterium avium subsp. paratuberculosis
ggucggcgacggcgc

SEQ ID NO: 790991 - RNA, 15 nt, Mycobacterium avium subsp. paratuberculosis
ggucggcgacguaca

SEQ ID NO: 790992 - RNA, 16 nt, Mycobacterium avium subsp. paratuberculosis
ggucggcgagcagccg

SEQ ID NO: 790993 - RNA, 21 nt, Mycobacterium avium subsp. paratuberculosis
ggucggcgagcagccgcgccg

SEQ ID NO: 790994 - RNA, 15 nt, Mycobacterium avium subsp. paratuberculosis
ggucggccuggccca

SEQ ID NO: 790995 - RNA, 12 nt, Mycobacterium avium subsp. paratuberculosis
ggucgucgacga

SEQ ID NO: 790996 - RNA, 18 nt, Mycobacterium avium subsp. paratuberculosis
ggucgucgacgagcccgc

SEQ ID NO: 790997 - RNA, 14 nt, Mycobacterium avium subsp. paratuberculosis
ggucgucgacgucg

SEQ ID NO: 790998 - RNA, 21 nt, Mycobacterium avium subsp. paratuberculosis
ggucgucgacgucggacgcgg

SEQ ID NO: 790999 - RNA, 20 nt, Mycobacterium avium subsp. paratuberculosis
ggucgucgagcaccggcugg

SEQ ID NO: 791000 - RNA, 17 nt, Mycobacterium avium subsp. paratuberculosis
ggucggugaagugccgg

SEQ ID NO: 791001 - RNA, 20 nt, Mycobacterium avium subsp. paratuberculosis
ggucggugacaaagaucaca

SEQ ID NO: 791002 - RNA, 13 nt, Mycobacterium avium subsp. paratuberculosis
ggucgguacgcgc

SEQ ID NO: 791003 - RNA, 17 nt, Mycobacterium avium subsp. paratuberculosis
ggucggucaccgagcuc

SEQ ID NO: 791004 - RNA, 22 nt, Mycobacterium avium subsp. paratuberculosis
ggucggucagucgcgccgccag

SEQ ID NO: 791005 - RNA, 17 nt, Mycobacterium avium subsp. paratuberculosis
ggucggugagcuggccg

SEQ ID NO: 791006 - RNA, 21 nt, Mycobacterium avium subsp. paratuberculosis
ggucggugagcuggccgcgca

SEQ ID NO: 791007 - RNA, 22 nt, Mycobacterium avium subsp. paratuberculosis
ggucggugagcuggccgcgcag

SEQ ID NO: 791008 - RNA, 14 nt, Mycobacterium avium subsp. paratuberculosis
ggucgggugcgcuc

SEQ ID NO: 791009 - RNA, 20 nt, Mycobacterium avium subsp. paratuberculosis
ggucgggugcgcucaccgca

SEQ ID NO: 791010 - RNA, 13 nt, Mycobacterium avium subsp. paratuberculosis
ggucgggugcggc

SEQ ID NO: 791011 - RNA, 16 nt, Mycobacterium avium subsp. paratuberculosis
ggucgggugcggcggu

SEQ ID NO: 791012 - RNA, 20 nt, Mycobacterium avium subsp. paratuberculosis
ggucggguucgcccuccccg

SEQ ID NO: 791013 - RNA, 18 nt, Mycobacterium avium subsp. paratuberculosis
ggucgggucccggcaaca

SEQ ID NO: 791014 - RNA, 18 nt, Mycobacterium avium subsp. paratuberculosis
ggucggggcggcgggcga

SEQ ID NO: 791015 - RNA, 15 nt, Mycobacterium avium subsp. paratuberculosis
ggucgggguccaggc

SEQ ID NO: 791016 - RNA, 22 nt, Mycobacterium avium subsp. paratuberculosis
ggucgggguccaggccgcgccg

SEQ ID NO: 791017 - RNA, 16 nt, Mycobacterium avium subsp. paratuberculosis
ggucggcgcggggcca

SEQ ID NO: 791018 - RNA, 20 nt, Mycobacterium avium subsp. paratuberculosis
ggucggcgcggggccaccag

SEQ ID NO: 791019 - RNA, 15 nt, Mycobacterium avium subsp. paratuberculosis
ggucggcgcggucca

SEQ ID NO: 791020 - RNA, 18 nt, Mycobacterium avium subsp. paratuberculosis
ggucggcgcucgcgggug

SEQ ID NO: 791021 - RNA, 16 nt, Mycobacterium avium subsp. paratuberculosis
ggucguuucggccggc

SEQ ID NO: 791022 - RNA, 18 nt, Mycobacterium avium subsp. paratuberculosis
ggucguuuggugguggcg

SEQ ID NO: 791023 - RNA, 14 nt, Mycobacterium avium subsp. paratuberculosis
ggucugggcgaacg

SEQ ID NO: 791024 - RNA, 17 nt, Mycobacterium avium subsp. paratuberculosis
ggucugggcgaccaugc

SEQ ID NO: 791025 - RNA, 16 nt, Mycobacterium avium subsp. paratuberculosis
ggucuggcuggugacc

SEQ ID NO: 791026 - RNA, 13 nt, Mycobacterium avium subsp. paratuberculosis
ggucuguggucgg

SEQ ID NO: 791027 - RNA, 15 nt, Mycobacterium avium subsp. paratuberculosis
ggucuucccgccgcc

SEQ ID NO: 791028 - RNA, 19 nt, Mycobacterium avium subsp. paratuberculosis
ggucuucggucccggcggg

SEQ ID NO: 791029 - RNA, 18 nt, Mycobacterium avium subsp. paratuberculosis
ggucuucuuggcgggcga

SEQ ID NO: 791030 - RNA, 16 nt, Mycobacterium avium subsp. paratuberculosis
ggugaacgcgucgguc

SEQ ID NO: 791031 - RNA, 23 nt, Mycobacterium avium subsp. paratuberculosis
ggugaacgcgucggucagcggcg

SEQ ID NO: 791032 - RNA, 15 nt, Mycobacterium avium subsp. paratuberculosis
ggugaacgggccgca

SEQ ID NO: 791033 - RNA, 19 nt, Mycobacterium avium subsp. paratuberculosis
ggugaacgggccgcacugc

SEQ ID NO: 791034 - RNA, 20 nt, Mycobacterium avium subsp. paratuberculosis
ggucguuguuguugccgguc

SEQ ID NO: 791035 - RNA, 14 nt, Mycobacterium avium subsp. paratuberculosis
ggucguugccggug

SEQ ID NO: 791036 - RNA, 16 nt, Mycobacterium avium subsp. paratuberculosis
ggucguggcgccgagg

SEQ ID NO: 791037 - RNA, 14 nt, Mycobacterium avium subsp. paratuberculosis
ggucgugcggcggc

SEQ ID NO: 791038 - RNA, 21 nt, Mycobacterium avium subsp. paratuberculosis
ggucgugcgggaugccgagca

SEQ ID NO: 791039 - RNA, 21 nt, Mycobacterium avium subsp. paratuberculosis
ggucgugcucgucggcgggca

SEQ ID NO: 791040 - RNA, 18 nt, Mycobacterium avium subsp. paratuberculosis
ggucgucgcgguccacgc

SEQ ID NO: 791041 - RNA, 19 nt, Mycobacterium avium subsp. paratuberculosis
ggucgucgcgguccacgcc

SEQ ID NO: 791042 - RNA, 17 nt, Mycobacterium avium subsp. paratuberculosis
ggucgucgggccgggga

SEQ ID NO: 791043 - RNA, 14 nt, Mycobacterium avium subsp. paratuberculosis
ggucgucgggcggc

SEQ ID NO: 791044 - RNA, 15 nt, Mycobacterium avium subsp. paratuberculosis
ggucgucgggcggca

SEQ ID NO: 791045 - RNA, 14 nt, Mycobacterium avium subsp. paratuberculosis
ggucgucggccagu

SEQ ID NO: 791046 - RNA, 18 nt, Mycobacterium avium subsp. paratuberculosis
ggucgucgagggccaccg

SEQ ID NO: 791047 - RNA, 15 nt, Mycobacterium avium subsp. paratuberculosis
ggucgucgcccaccg

SEQ ID NO: 791048 - RNA, 13 nt, Mycobacterium avium subsp. paratuberculosis
ggucgucgcccgu

SEQ ID NO: 791049 - RNA, 14 nt, Mycobacterium avium subsp. paratuberculosis
ggucgucgcggcca

SEQ ID NO: 791050 - RNA, 19 nt, Mycobacterium avium subsp. paratuberculosis
ggucgucgcggccaacgcc

SEQ ID NO: 791051 - RNA, 13 nt, Mycobacterium avium subsp. paratuberculosis
ggucgucgucgaa

SEQ ID NO: 791052 - RNA, 16 nt, Mycobacterium avium subsp. paratuberculosis
ggucgucgucgccgcg

SEQ ID NO: 791053 - RNA, 16 nt, Mycobacterium avium subsp. paratuberculosis
ggucgucgucgucggu

SEQ ID NO: 791054 - RNA, 18 nt, Mycobacterium avium subsp. paratuberculosis
ggucgucgucgucgguga

SEQ ID NO: 791055 - RNA, 13 nt, Mycobacterium avium subsp. paratuberculosis
ggucgucguggug

SEQ ID NO: 791056 - RNA, 20 nt, Mycobacterium avium subsp. paratuberculosis
ggucgucuucuuggccgcgg

SEQ ID NO: 791057 - RNA, 23 nt, Mycobacterium avium subsp. paratuberculosis
ggucgucuucuuggccgcggccu

SEQ ID NO: 791058 - RNA, 23 nt, Mycobacterium avium subsp. paratuberculosis
ggucgugaaacauggcgcccgcg

SEQ ID NO: 791059 - RNA, 12 nt, Mycobacterium avium subsp. paratuberculosis
ggucgugcagca

SEQ ID NO: 791060 - RNA, 14 nt, Mycobacterium avium subsp. paratuberculosis
ggucgagucguaga

SEQ ID NO: 791061 - RNA, 13 nt, Mycobacterium avium subsp. paratuberculosis
ggucgagccgcag

SEQ ID NO: 791062 - RNA, 14 nt, Mycobacterium avium subsp. paratuberculosis
ggucgaggccggcc

SEQ ID NO: 791063 - RNA, 18 nt, Mycobacterium avium subsp. paratuberculosis
ggucgaggccggccagcg

SEQ ID NO: 791064 - RNA, 19 nt, Mycobacterium avium subsp. paratuberculosis
ggucgaggccggccagcgg

SEQ ID NO: 791065 - RNA, 18 nt, Mycobacterium avium subsp. paratuberculosis
ggucgagggcguucgcgg

SEQ ID NO: 791066 - RNA, 19 nt, Mycobacterium avium subsp. paratuberculosis
ggucgagggcguucgcggu

SEQ ID NO: 791067 - RNA, 20 nt, Mycobacterium avium subsp. paratuberculosis
ggucgagggcguucgcggug

SEQ ID NO: 791068 - RNA, 17 nt, Mycobacterium avium subsp. paratuberculosis
ggucgagggucgccagg

SEQ ID NO: 791069 - RNA, 21 nt, Mycobacterium avium subsp. paratuberculosis
ggucgagggugacccgggcga

SEQ ID NO: 791070 - RNA, 15 nt, Mycobacterium avium subsp. paratuberculosis
ggucgagguccucgg

SEQ ID NO: 791071 - RNA, 18 nt, Mycobacterium avium subsp. paratuberculosis
ggucgagguccucggcga

SEQ ID NO: 791072 - RNA, 17 nt, Mycobacterium avium subsp. paratuberculosis
ggucgccaaacugcgca

SEQ ID NO: 791073 - RNA, 20 nt, Mycobacterium avium subsp. paratuberculosis
ggucgccaaacugcgcaacc

SEQ ID NO: 791074 - RNA, 15 nt, Mycobacterium avium subsp. paratuberculosis
ggucgccaccaccag

SEQ ID NO: 791075 - RNA, 17 nt, Mycobacterium avium subsp. paratuberculosis
ggucgccaccaccagcg

SEQ ID NO: 791076 - RNA, 14 nt, Mycobacterium avium subsp. paratuberculosis
ggucgcacgccggu

SEQ ID NO: 791077 - RNA, 22 nt, Mycobacterium avium subsp. paratuberculosis
ggucgcacgccgguagccgcuc

SEQ ID NO: 791078 - RNA, 15 nt, Mycobacterium avium subsp. paratuberculosis
ggucgcagcggcacg

SEQ ID NO: 791079 - RNA, 13 nt, Mycobacterium avium subsp. paratuberculosis
ggucgagcaugcg

SEQ ID NO: 791080 - RNA, 19 nt, Mycobacterium avium subsp. paratuberculosis
ggucgacacgaucggcaug

SEQ ID NO: 791081 - RNA, 16 nt, Mycobacterium avium subsp. paratuberculosis
ggucgacagccugacc

SEQ ID NO: 791082 - RNA, 20 nt, Mycobacterium avium subsp. paratuberculosis
ggucgaagcccgccgucacg

SEQ ID NO: 791083 - RNA, 21 nt, Mycobacterium avium subsp. paratuberculosis
ggucgaaccgcgagcgcgcgg

SEQ ID NO: 791084 - RNA, 18 nt, Mycobacterium avium subsp. paratuberculosis
ggucgaaggaggccagcu

SEQ ID NO: 791085 - RNA, 17 nt, Mycobacterium avium subsp. paratuberculosis
ggucgaaggccccgguc

SEQ ID NO: 791086 - RNA, 15 nt, Mycobacterium avium subsp. paratuberculosis
ggucgaaggcggccg

SEQ ID NO: 791087 - RNA, 17 nt, Mycobacterium avium subsp. paratuberculosis
ggucgaaggcggccgcg

SEQ ID NO: 791088 - RNA, 20 nt, Mycobacterium avium subsp. paratuberculosis
ggucgaaguccugcgccgcg

SEQ ID NO: 791089 - RNA, 21 nt, Mycobacterium avium subsp. paratuberculosis
ggucgaaguccugcgccgcgg

SEQ ID NO: 791090 - RNA, 19 nt, Mycobacterium avium subsp. paratuberculosis
ggucgaacaucacccggcg

SEQ ID NO: 791091 - RNA, 19 nt, Mycobacterium avium subsp. paratuberculosis
ggucgaacagcgcgcccga

SEQ ID NO: 791092 - RNA, 15 nt, Mycobacterium avium subsp. paratuberculosis
ggucgaacgccaccu

SEQ ID NO: 791093 - RNA, 15 nt, Mycobacterium avium subsp. paratuberculosis
ggucgaacgccagcg

SEQ ID NO: 791094 - RNA, 18 nt, Mycobacterium avium subsp. paratuberculosis
ggucgaacgccagcgccg

SEQ ID NO: 791095 - RNA, 14 nt, Mycobacterium avium subsp. paratuberculosis
ggucgaacuggcgc

SEQ ID NO: 791096 - RNA, 15 nt, Mycobacterium avium subsp. paratuberculosis
ggucgaacuggcgca

SEQ ID NO: 791097 - RNA, 23 nt, Mycobacterium avium subsp. paratuberculosis
ggucgcguacgggaugaucagca

SEQ ID NO: 791098 - RNA, 15 nt, Mycobacterium avium subsp. paratuberculosis
ggucgcgucgugcgg

SEQ ID NO: 791099 - RNA, 23 nt, Mycobacterium avium subsp. paratuberculosis
ggucgcgucgugcggccggcgcc

SEQ ID NO: 791100 - RNA, 13 nt, Mycobacterium avium subsp. paratuberculosis
ggucgcgugaccg

SEQ ID NO: 791101 - RNA, 18 nt, Mycobacterium avium subsp. paratuberculosis
ggucgcgugaccggcggu

SEQ ID NO: 791102 - RNA, 15 nt, Mycobacterium avium subsp. paratuberculosis
ggucgcggugggcgc

SEQ ID NO: 791103 - RNA, 19 nt, Mycobacterium avium subsp. paratuberculosis
ggucgcggugggcucggcg

SEQ ID NO: 791104 - RNA, 18 nt, Mycobacterium avium subsp. paratuberculosis
ggucgcggugucggcguc

SEQ ID NO: 791105 - RNA, 15 nt, Mycobacterium avium subsp. paratuberculosis
ggucgcgguagaugu

SEQ ID NO: 791106 - RNA, 13 nt, Mycobacterium avium subsp. paratuberculosis
ggucgcggugauc

SEQ ID NO: 791107 - RNA, 14 nt, Mycobacterium avium subsp. paratuberculosis
ggucgcggugauca

SEQ ID NO: 791108 - RNA, 14 nt, Mycobacterium avium subsp. paratuberculosis
ggucgcggugccca

SEQ ID NO: 791109 - RNA, 17 nt, Mycobacterium avium subsp. paratuberculosis
ggucgcggugcccagcc

SEQ ID NO: 791110 - RNA, 20 nt, Mycobacterium avium subsp. paratuberculosis
ggucgcggugcccagccgca

SEQ ID NO: 791111 - RNA, 21 nt, Mycobacterium avium subsp. paratuberculosis
ggucgcggugcccagccgcag

SEQ ID NO: 791112 - RNA, 18 nt, Mycobacterium avium subsp. paratuberculosis
ggucgcugugcagcgggu

SEQ ID NO: 791113 - RNA, 16 nt, Mycobacterium avium subsp. paratuberculosis
ggucgcugcagcggcg

SEQ ID NO: 791114 - RNA, 20 nt, Mycobacterium avium subsp. paratuberculosis
ggucgcugcagcggcggcca

SEQ ID NO: 791115 - RNA, 16 nt, Mycobacterium avium subsp. paratuberculosis
ggucgcugacccgccg

SEQ ID NO: 791116 - RNA, 14 nt, Mycobacterium avium subsp. paratuberculosis
ggucgcugacgaug

SEQ ID NO: 791117 - RNA, 15 nt, Mycobacterium avium subsp. paratuberculosis
ggucgcugcccggcg

SEQ ID NO: 791118 - RNA, 23 nt, Mycobacterium avium subsp. paratuberculosis
ggucgcugcgaugauggucaccg

SEQ ID NO: 791119 - RNA, 18 nt, Mycobacterium avium subsp. paratuberculosis
ggucgcggcuggugccgc

SEQ ID NO: 791120 - RNA, 20 nt, Mycobacterium avium subsp. paratuberculosis
ggucgcggcuggugccgccg

SEQ ID NO: 791121 - RNA, 18 nt, Mycobacterium avium subsp. paratuberculosis
ggucgcgggacaacacga

SEQ ID NO: 791122 - RNA, 16 nt, Mycobacterium avium subsp. paratuberculosis
ggucgcgcagccgccg

SEQ ID NO: 791123 - RNA, 14 nt, Mycobacterium avium subsp. paratuberculosis
ggucgccugcacga

SEQ ID NO: 791124 - RNA, 13 nt, Mycobacterium avium subsp. paratuberculosis
ggucgccugcugg

SEQ ID NO: 791125 - RNA, 10 nt, Mycobacterium avium subsp. paratuberculosis
ggucgcgacc

SEQ ID NO: 791126 - RNA, 13 nt, Mycobacterium avium subsp. paratuberculosis
ggucgcgacccgg

SEQ ID NO: 791127 - RNA, 14 nt, Mycobacterium avium subsp. paratuberculosis
ggucgcgacccggu

SEQ ID NO: 791128 - RNA, 14 nt, Mycobacterium avium subsp. paratuberculosis
ggucgccuccaggu

SEQ ID NO: 791129 - RNA, 16 nt, Mycobacterium avium subsp. paratuberculosis
ggucgcgaagacgcug

SEQ ID NO: 791130 - RNA, 16 nt, Mycobacterium avium subsp. paratuberculosis
ggucgcgaagcguaug

SEQ ID NO: 791131 - RNA, 21 nt, Mycobacterium avium subsp. paratuberculosis
ggucgcgaagcguaugccggu

SEQ ID NO: 791132 - RNA, 17 nt, Mycobacterium avium subsp. paratuberculosis
ggucgccgucgugcucg

SEQ ID NO: 791133 - RNA, 14 nt, Mycobacterium avium subsp. paratuberculosis
ggucgccgguguca

SEQ ID NO: 791134 - RNA, 20 nt, Mycobacterium avium subsp. paratuberculosis
ggucgccggugugaucgagc

SEQ ID NO: 791135 - RNA, 17 nt, Mycobacterium avium subsp. paratuberculosis
ggucgccgggccggccg

SEQ ID NO: 791136 - RNA, 13 nt, Mycobacterium avium subsp. paratuberculosis
ggucgccgggcag

SEQ ID NO: 791137 - RNA, 13 nt, Mycobacterium avium subsp. paratuberculosis
ggucgccggcggc

SEQ ID NO: 791138 - RNA, 15 nt, Mycobacterium avium subsp. paratuberculosis
ggucgccggcggccg

SEQ ID NO: 791139 - RNA, 16 nt, Mycobacterium avium subsp. paratuberculosis
ggucgccggcggccga

SEQ ID NO: 791140 - RNA, 15 nt, Mycobacterium avium subsp. paratuberculosis
ggucgccagcgccac

SEQ ID NO: 791141 - RNA, 14 nt, Mycobacterium avium subsp. paratuberculosis
ggucgccgcgccgc

SEQ ID NO: 791142 - RNA, 15 nt, Mycobacterium avium subsp. paratuberculosis
ggucgccgcgccgcc

SEQ ID NO: 791143 - RNA, 13 nt, Mycobacterium avium subsp. paratuberculosis
ggucgccacggcc

SEQ ID NO: 791144 - RNA, 16 nt, Mycobacterium avium subsp. paratuberculosis
ggucgccacggccggc

SEQ ID NO: 791145 - RNA, 17 nt, Mycobacterium avium subsp. paratuberculosis
ggucgccacggccggca

SEQ ID NO: 791146 - RNA, 18 nt, Mycobacterium avium subsp. paratuberculosis
ggucgccacggccggcag

SEQ ID NO: 791147 - RNA, 22 nt, Mycobacterium avium subsp. paratuberculosis
ggucgccacucgggcggccgcg

SEQ ID NO: 791148 - RNA, 23 nt, Mycobacterium avium subsp. paratuberculosis
ggucgccacucgggcggccgcgg

SEQ ID NO: 791149 - RNA, 19 nt, Mycobacterium avium subsp. paratuberculosis
ggucgccagcaccgugcug

SEQ ID NO: 791150 - RNA, 16 nt, Mycobacterium avium subsp. paratuberculosis
gguccgaggugaucgc

SEQ ID NO: 791151 - RNA, 21 nt, Mycobacterium avium subsp. paratuberculosis
gguccgaggugaucgcgaacg

SEQ ID NO: 791152 - RNA, 15 nt, Mycobacterium avium subsp. paratuberculosis
gguccgauugcccga

SEQ ID NO: 791153 - RNA, 17 nt, Mycobacterium avium subsp. paratuberculosis
gguccgauugcccgacu

SEQ ID NO: 791154 - RNA, 19 nt, Mycobacterium avium subsp. paratuberculosis
gguccgauugcccgacucc

SEQ ID NO: 791155 - RNA, 17 nt, Mycobacterium avium subsp. paratuberculosis
gguccgauuucccgacu

SEQ ID NO: 791156 - RNA, 19 nt, Mycobacterium avium subsp. paratuberculosis
gguccgauuucccgacucc

SEQ ID NO: 791157 - RNA, 17 nt, Mycobacterium avium subsp. paratuberculosis
gguccgcaacgccggcg

SEQ ID NO: 791158 - RNA, 23 nt, Mycobacterium avium subsp. paratuberculosis
gguccgcaacgcggcggugacga

SEQ ID NO: 791159 - RNA, 13 nt, Mycobacterium avium subsp. paratuberculosis
gguccgaccagcg

SEQ ID NO: 791160 - RNA, 15 nt, Mycobacterium avium subsp. paratuberculosis
gguccgcccggacca

SEQ ID NO: 791161 - RNA, 15 nt, Mycobacterium avium subsp. paratuberculosis
gguccgccgccggcg

SEQ ID NO: 791162 - RNA, 15 nt, Mycobacterium avium subsp. paratuberculosis
gguccgccgggcgcg

SEQ ID NO: 791163 - RNA, 23 nt, Mycobacterium avium subsp. paratuberculosis
gguccgccggugccagcaacaca

SEQ ID NO: 791164 - RNA, 15 nt, Mycobacterium avium subsp. paratuberculosis
gguccacgguggcgc

SEQ ID NO: 791165 - RNA, 13 nt, Mycobacterium avium subsp. paratuberculosis
ggucccgugcgcc

SEQ ID NO: 791166 - RNA, 20 nt, Mycobacterium avium subsp. paratuberculosis
gguccacgccgagggcggcg

SEQ ID NO: 791167 - RNA, 22 nt, Mycobacterium avium subsp. paratuberculosis
gguccacgccgagggcggcggc

SEQ ID NO: 791168 - RNA, 20 nt, Mycobacterium avium subsp. paratuberculosis
gguccaccguugucucggcg

SEQ ID NO: 791169 - RNA, 23 nt, Mycobacterium avium subsp. paratuberculosis
gguccacgcaguguccgaucgcc

SEQ ID NO: 791170 - RNA, 16 nt, Mycobacterium avium subsp. paratuberculosis
gguccaccgccgcgcc

SEQ ID NO: 791171 - RNA, 17 nt, Mycobacterium avium subsp. paratuberculosis
gguccaccgccgcgccg

SEQ ID NO: 791172 - RNA, 18 nt, Mycobacterium avium subsp. paratuberculosis
gguccaccgcggcggcca

SEQ ID NO: 791173 - RNA, 22 nt, Mycobacterium avium subsp. paratuberculosis
ggucgaaaucgcagacguagca

SEQ ID NO: 791174 - RNA, 16 nt, Mycobacterium avium subsp. paratuberculosis
ggucgaacacggcgcu

SEQ ID NO: 791175 - RNA, 17 nt, Mycobacterium avium subsp. paratuberculosis
ggucgaacacggcgcug

SEQ ID NO: 791176 - RNA, 23 nt, Mycobacterium avium subsp. paratuberculosis
ggucgaacagcacgccggccggc

SEQ ID NO: 791177 - RNA, 14 nt, Mycobacterium avium subsp. paratuberculosis
gguccuggcggugg

SEQ ID NO: 791178 - RNA, 16 nt, Mycobacterium avium subsp. paratuberculosis
gguccuggcgguggcc

SEQ ID NO: 791179 - RNA, 22 nt, Mycobacterium avium subsp. paratuberculosis
gguccugggccuccggcggcag

SEQ ID NO: 791180 - RNA, 21 nt, Mycobacterium avium subsp. paratuberculosis
gguccuuaaucgggacguuga

SEQ ID NO: 791181 - RNA, 23 nt, Mycobacterium avium subsp. paratuberculosis
gguccuugaggaugcgcaccacg

SEQ ID NO: 791182 - RNA, 14 nt, Mycobacterium avium subsp. paratuberculosis
gguccuugcccagc

SEQ ID NO: 791183 - RNA, 16 nt, Mycobacterium avium subsp. paratuberculosis
gguccuugcccagcag

SEQ ID NO: 791184 - RNA, 21 nt, Mycobacterium avium subsp. paratuberculosis
gguccgcucaacuugaucagc

SEQ ID NO: 791185 - RNA, 14 nt, Mycobacterium avium subsp. paratuberculosis
gguccugcaccgag

SEQ ID NO: 791186 - RNA, 23 nt, Mycobacterium avium subsp. paratuberculosis
gguccucgauccgguccagcccg

SEQ ID NO: 791187 - RNA, 14 nt, Mycobacterium avium subsp. paratuberculosis
gguccucgauggcg

SEQ ID NO: 791188 - RNA, 15 nt, Mycobacterium avium subsp. paratuberculosis
gguccucgcuggcga

SEQ ID NO: 791189 - RNA, 20 nt, Mycobacterium avium subsp. paratuberculosis
gguccucggacucgucgcug

SEQ ID NO: 791190 - RNA, 14 nt, Mycobacterium avium subsp. paratuberculosis
gguccucggcgaug

SEQ ID NO: 791191 - RNA, 12 nt, Mycobacterium avium subsp. paratuberculosis
gguccgaccgcc

SEQ ID NO: 791192 - RNA, 14 nt, Mycobacterium avium subsp. paratuberculosis
gguccgcggugaug

SEQ ID NO: 791193 - RNA, 19 nt, Mycobacterium avium subsp. paratuberculosis
gguccgcggugaugccgag

SEQ ID NO: 791194 - RNA, 18 nt, Mycobacterium avium subsp. paratuberculosis
gguccgcgaacucgucga

SEQ ID NO: 791195 - RNA, 18 nt, Mycobacterium avium subsp. paratuberculosis
gguccuccaacggcacca

SEQ ID NO: 791196 - RNA, 14 nt, Mycobacterium avium subsp. paratuberculosis
gguccucccgggug

SEQ ID NO: 791197 - RNA, 21 nt, Mycobacterium avium subsp. paratuberculosis
ggucaguccggguugggcgcc

SEQ ID NO: 791198 - RNA, 17 nt, Mycobacterium avium subsp. paratuberculosis
ggucagucgcgccgcca

SEQ ID NO: 791199 - RNA, 19 nt, Mycobacterium avium subsp. paratuberculosis
ggucagucgcgccgccagc

SEQ ID NO: 791200 - RNA, 16 nt, Mycobacterium avium subsp. paratuberculosis
ggucaguacagcuagg

SEQ ID NO: 791201 - RNA, 14 nt, Mycobacterium avium subsp. paratuberculosis
ggucagcgccagca

SEQ ID NO: 791202 - RNA, 19 nt, Mycobacterium avium subsp. paratuberculosis
gguccaccaauggcggcca

SEQ ID NO: 791203 - RNA, 20 nt, Mycobacterium avium subsp. paratuberculosis
gguccaccaauggcggccac

SEQ ID NO: 791204 - RNA, 12 nt, Mycobacterium avium subsp. paratuberculosis
gguccaccacca

SEQ ID NO: 791205 - RNA, 14 nt, Mycobacterium avium subsp. paratuberculosis
gguccaccaccaca

SEQ ID NO: 791206 - RNA, 21 nt, Mycobacterium avium subsp. paratuberculosis
gguccaacgggcucagcacca

SEQ ID NO: 791207 - RNA, 15 nt, Mycobacterium avium subsp. paratuberculosis
ggucaucagugaccg

SEQ ID NO: 791208 - RNA, 12 nt, Mycobacterium avium subsp. paratuberculosis
ggucaucagcga

SEQ ID NO: 791209 - RNA, 22 nt, Mycobacterium avium subsp. paratuberculosis
ggucauccucgccgcgccagca

SEQ ID NO: 791210 - RNA, 16 nt, Mycobacterium avium subsp. paratuberculosis
gguccaaagacguuga

SEQ ID NO: 791211 - RNA, 22 nt, Mycobacterium avium subsp. paratuberculosis
gguccaaagacguugaccgcga

SEQ ID NO: 791212 - RNA, 13 nt, Mycobacterium avium subsp. paratuberculosis
ggucagcgccagc

SEQ ID NO: 791213 - RNA, 13 nt, Mycobacterium avium subsp. paratuberculosis
ggucagcgaggcg

SEQ ID NO: 791214 - RNA, 13 nt, Mycobacterium avium subsp. paratuberculosis
ggucagcgcgaca

SEQ ID NO: 791215 - RNA, 13 nt, Mycobacterium avium subsp. paratuberculosis
ggucagccgggcg

SEQ ID NO: 791216 - RNA, 21 nt, Mycobacterium avium subsp. paratuberculosis
ggucagcccgcccuuggccgc

SEQ ID NO: 791217 - RNA, 14 nt, Mycobacterium avium subsp. paratuberculosis
ggucagccgcacca

SEQ ID NO: 791218 - RNA, 15 nt, Mycobacterium avium subsp. paratuberculosis
ggucagccgcggcgg

SEQ ID NO: 791219 - RNA, 20 nt, Mycobacterium avium subsp. paratuberculosis
ggucagccgcggcggcagca

SEQ ID NO: 791220 - RNA, 17 nt, Mycobacterium avium subsp. paratuberculosis
ggucagcagcagcgccu

SEQ ID NO: 791221 - RNA, 21 nt, Mycobacterium avium subsp. paratuberculosis
ggucagccagguuggccaggu

SEQ ID NO: 791222 - RNA, 19 nt, Mycobacterium avium subsp. paratuberculosis
ggucagcacgucggucagc

SEQ ID NO: 791223 - RNA, 22 nt, Mycobacterium avium subsp. paratuberculosis
ggucagcagcgucugcgccagc

SEQ ID NO: 791224 - RNA, 23 nt, Mycobacterium avium subsp. paratuberculosis
ggucagcagcgucugcgccagcu

SEQ ID NO: 791225 - RNA, 14 nt, Mycobacterium avium subsp. paratuberculosis
ggucagcaggcgcc

SEQ ID NO: 791226 - RNA, 16 nt, Mycobacterium avium subsp. paratuberculosis
ggucagcaccggcgug

SEQ ID NO: 791227 - RNA, 19 nt, Mycobacterium avium subsp. paratuberculosis
ggucagcaccgucaccgcc

SEQ ID NO: 791228 - RNA, 21 nt, Mycobacterium avium subsp. paratuberculosis
ggauuccagaucugucuucgc

SEQ ID NO: 791229 - RNA, 15 nt, Mycobacterium avium subsp. paratuberculosis
ggauucccgaccccg

SEQ ID NO: 791230 - RNA, 23 nt, Mycobacterium avium subsp. paratuberculosis
ggauguuguccggaacacccagg

SEQ ID NO: 791231 - RNA, 13 nt, Mycobacterium avium subsp. paratuberculosis
ggagacugcgacc

SEQ ID NO: 791232 - RNA, 13 nt, Mycobacterium avium subsp. paratuberculosis
ggagacgucggcc

SEQ ID NO: 791233 - RNA, 15 nt, Mycobacterium avium subsp. paratuberculosis
ggagacguggcggcg

SEQ ID NO: 791234 - RNA, 16 nt, Mycobacterium avium subsp. paratuberculosis
ggagacguugccgcac

SEQ ID NO: 791235 - RNA, 21 nt, Mycobacterium avium subsp. paratuberculosis
ggauucucgcucugccgggcc

SEQ ID NO: 791236 - RNA, 22 nt, Mycobacterium avium subsp. paratuberculosis
ggauucguucauguagcagcgc

SEQ ID NO: 791237 - RNA, 13 nt, Mycobacterium avium subsp. paratuberculosis
ggauuggcggcca

SEQ ID NO: 791238 - RNA, 19 nt, Mycobacterium avium subsp. paratuberculosis
ggauugccgggcaccagcg

SEQ ID NO: 791239 - RNA, 14 nt, Mycobacterium avium subsp. paratuberculosis
ggauugccgggcag

SEQ ID NO: 791240 - RNA, 16 nt, Mycobacterium avium subsp. paratuberculosis
ggauugcgagccgguc

SEQ ID NO: 791241 - RNA, 19 nt, Mycobacterium avium subsp. paratuberculosis
ggauuucacgucugcucgg

SEQ ID NO: 791242 - RNA, 18 nt, Mycobacterium avium subsp. paratuberculosis
ggcaacgacccgucgggg

SEQ ID NO: 791243 - RNA, 21 nt, Mycobacterium avium subsp. paratuberculosis
ggcaacgacccgucggggugc

SEQ ID NO: 791244 - RNA, 13 nt, Mycobacterium avium subsp. paratuberculosis
ggcaacgaggcca

SEQ ID NO: 791245 - RNA, 14 nt, Mycobacterium avium subsp. paratuberculosis
ggcaacgaggccag

SEQ ID NO: 791246 - RNA, 13 nt, Mycobacterium avium subsp. paratuberculosis
ggcaacgccagcc

SEQ ID NO: 791247 - RNA, 14 nt, Mycobacterium avium subsp. paratuberculosis
ggcaacgcgccggc

SEQ ID NO: 791248 - RNA, 16 nt, Mycobacterium avium subsp. paratuberculosis
ggcaacgcgccggcgg

SEQ ID NO: 791249 - RNA, 19 nt, Mycobacterium avium subsp. paratuberculosis
ggcaacgccggguccacga

SEQ ID NO: 791250 - RNA, 12 nt, Mycobacterium avium subsp. paratuberculosis
ggcaacgccggu

SEQ ID NO: 791251 - RNA, 17 nt, Mycobacterium avium subsp. paratuberculosis
ggcaacgaacgcggcgc

SEQ ID NO: 791252 - RNA, 18 nt, Mycobacterium avium subsp. paratuberculosis
ggcaacgaacgcggcgcc

SEQ ID NO: 791253 - RNA, 12 nt, Mycobacterium avium subsp. paratuberculosis
ggcaacccgacc

SEQ ID NO: 791254 - RNA, 21 nt, Mycobacterium avium subsp. paratuberculosis
ggcaacccgaccucgucgacg

SEQ ID NO: 791255 - RNA, 22 nt, Mycobacterium avium subsp. paratuberculosis
ggcaacccgaccucgucgacgg

SEQ ID NO: 791256 - RNA, 15 nt, Mycobacterium avium subsp. paratuberculosis
ggcaacccgaucgcc

SEQ ID NO: 791257 - RNA, 17 nt, Mycobacterium avium subsp. paratuberculosis
ggcaacccgaucgccga

SEQ ID NO: 791258 - RNA, 19 nt, Mycobacterium avium subsp. paratuberculosis
ggcaacccgaucgccgagu

SEQ ID NO: 791259 - RNA, 14 nt, Mycobacterium avium subsp. paratuberculosis
ggcaaccacagcgg

SEQ ID NO: 791260 - RNA, 22 nt, Mycobacterium avium subsp. paratuberculosis
ggcaacagcgcgccggccggca

SEQ ID NO: 791261 - RNA, 14 nt, Mycobacterium avium subsp. paratuberculosis
ggcaacacgccggc

SEQ ID NO: 791262 - RNA, 17 nt, Mycobacterium avium subsp. paratuberculosis
ggcaacacgccggcggc

SEQ ID NO: 791263 - RNA, 19 nt, Mycobacterium avium subsp. paratuberculosis
ggcaacacgccggcggcca

SEQ ID NO: 791264 - RNA, 22 nt, Mycobacterium avium subsp. paratuberculosis
ggcaacacagccaaucgccgau

SEQ ID NO: 791265 - RNA, 19 nt, Mycobacterium avium subsp. paratuberculosis
ggcaacacguagucgccga

SEQ ID NO: 791266 - RNA, 22 nt, Mycobacterium avium subsp. paratuberculosis
ggcaacacgucguccggcgcgc

SEQ ID NO: 791267 - RNA, 23 nt, Mycobacterium avium subsp. paratuberculosis
ggcaacacgucguccggcgcgca

SEQ ID NO: 791268 - RNA, 20 nt, Mycobacterium avium subsp. paratuberculosis
ggcaaagcguugccgcgcgc

SEQ ID NO: 791269 - RNA, 15 nt, Mycobacterium avium subsp. paratuberculosis
ggcaauaccggcagc

SEQ ID NO: 791270 - RNA, 17 nt, Mycobacterium avium subsp. paratuberculosis
ggcaaggagguggucga

SEQ ID NO: 791271 - RNA, 13 nt, Mycobacterium avium subsp. paratuberculosis
ggcaaggccagca

SEQ ID NO: 791272 - RNA, 20 nt, Mycobacterium avium subsp. paratuberculosis
ggcaacucaguccucgccga

SEQ ID NO: 791273 - RNA, 17 nt, Mycobacterium avium subsp. paratuberculosis
ggcaacucccgaucgcc

SEQ ID NO: 791274 - RNA, 16 nt, Mycobacterium avium subsp. paratuberculosis
ggcaacgucuggccac

SEQ ID NO: 791275 - RNA, 20 nt, Mycobacterium avium subsp. paratuberculosis
ggcaagcaguaugcccgccg

SEQ ID NO: 791276 - RNA, 23 nt, Mycobacterium avium subsp. paratuberculosis
ggcaagcaguaugcccgccgcug

SEQ ID NO: 791277 - RNA, 13 nt, Mycobacterium avium subsp. paratuberculosis
ggcaagcagcggc

SEQ ID NO: 791278 - RNA, 14 nt, Mycobacterium avium subsp. paratuberculosis
ggcaagcagcggca

SEQ ID NO: 791279 - RNA, 16 nt, Mycobacterium avium subsp. paratuberculosis
ggcaagcagcggcagc

SEQ ID NO: 791280 - RNA, 17 nt, Mycobacterium avium subsp. paratuberculosis
ggcaagcagcggcagcc

SEQ ID NO: 791281 - RNA, 18 nt, Mycobacterium avium subsp. paratuberculosis
ggcaagcagcggcagcca

SEQ ID NO: 791282 - RNA, 12 nt, Mycobacterium avium subsp. paratuberculosis
ggcacaccagcg

SEQ ID NO: 791283 - RNA, 21 nt, Mycobacterium avium subsp. paratuberculosis
ggcacaccagguaggcggugg

SEQ ID NO: 791284 - RNA, 20 nt, Mycobacterium avium subsp. paratuberculosis
ggcaauugaauucgaccacg

SEQ ID NO: 791285 - RNA, 19 nt, Mycobacterium avium subsp. paratuberculosis
ggcaaugguugcggcgggc

SEQ ID NO: 791286 - RNA, 15 nt, Mycobacterium avium subsp. paratuberculosis
ggcaauccggccccg

SEQ ID NO: 791287 - RNA, 15 nt, Mycobacterium avium subsp. paratuberculosis
ggcaaucaggcgguc

SEQ ID NO: 791288 - RNA, 13 nt, Mycobacterium avium subsp. paratuberculosis
ggcaaugaccggc

SEQ ID NO: 791289 - RNA, 17 nt, Mycobacterium avium subsp. paratuberculosis
ggcaaugaccggcacca

SEQ ID NO: 791290 - RNA, 19 nt, Mycobacterium avium subsp. paratuberculosis
ggcaaucgguuaagugccc

SEQ ID NO: 791291 - RNA, 17 nt, Mycobacterium avium subsp. paratuberculosis
ggcaaucggacccagcc

SEQ ID NO: 791292 - RNA, 17 nt, Mycobacterium avium subsp. paratuberculosis
ggcaaucgggacgccac

SEQ ID NO: 791293 - RNA, 16 nt, Mycobacterium avium subsp. paratuberculosis
ggcaccuccagcccgg

SEQ ID NO: 791294 - RNA, 16 nt, Mycobacterium avium subsp. paratuberculosis
ggcaccucggccaggu

SEQ ID NO: 791295 - RNA, 13 nt, Mycobacterium avium subsp. paratuberculosis
ggcaccucggccu

SEQ ID NO: 791296 - RNA, 16 nt, Mycobacterium avium subsp. paratuberculosis
ggcaccucggccuuga

SEQ ID NO: 791297 - RNA, 22 nt, Mycobacterium avium subsp. paratuberculosis
ggcaccucggccuugaccacgg

SEQ ID NO: 791298 - RNA, 21 nt, Mycobacterium avium subsp. paratuberculosis
ggcaccucgaagggcgccagc

SEQ ID NO: 791299 - RNA, 14 nt, Mycobacterium avium subsp. paratuberculosis
ggcaccucgaucac

SEQ ID NO: 791300 - RNA, 16 nt, Mycobacterium avium subsp. paratuberculosis
ggcaccucgaucaccg

SEQ ID NO: 791301 - RNA, 17 nt, Mycobacterium avium subsp. paratuberculosis
ggcaccucgaucaccgg

SEQ ID NO: 791302 - RNA, 15 nt, Mycobacterium avium subsp. paratuberculosis
ggcaccucgaugccg

SEQ ID NO: 791303 - RNA, 21 nt, Mycobacterium avium subsp. paratuberculosis
ggcaccucgaugccgugccgg

SEQ ID NO: 791304 - RNA, 23 nt, Mycobacterium avium subsp. paratuberculosis
ggcaccucgaugccgugccggug

SEQ ID NO: 791305 - RNA, 17 nt, Mycobacterium avium subsp. paratuberculosis
ggcaccgugccgcgcgg

SEQ ID NO: 791306 - RNA, 23 nt, Mycobacterium avium subsp. paratuberculosis
ggcaccgugccgcgcggcgguga

SEQ ID NO: 791307 - RNA, 23 nt, Mycobacterium avium subsp. paratuberculosis
ggcaccgucgaccucgaugcgca

SEQ ID NO: 791308 - RNA, 18 nt, Mycobacterium avium subsp. paratuberculosis
ggcaccgggugggccgac

SEQ ID NO: 791309 - RNA, 15 nt, Mycobacterium avium subsp. paratuberculosis
ggcaccggugcggcg

SEQ ID NO: 791310 - RNA, 17 nt, Mycobacterium avium subsp. paratuberculosis
ggcaccggugcggcggu

SEQ ID NO: 791311 - RNA, 20 nt, Mycobacterium avium subsp. paratuberculosis
ggcaccuuggugagcaccgc

SEQ ID NO: 791312 - RNA, 21 nt, Mycobacterium avium subsp. paratuberculosis
ggcacgaacgcgacgaucagc

SEQ ID NO: 791313 - RNA, 16 nt, Mycobacterium avium subsp. paratuberculosis
ggcacgaauucggugg

SEQ ID NO: 791314 - RNA, 19 nt, Mycobacterium avium subsp. paratuberculosis
ggcacgaauucgguggcga

SEQ ID NO: 791315 - RNA, 21 nt, Mycobacterium avium subsp. paratuberculosis
ggcacgaauucgguggcgaug

SEQ ID NO: 791316 - RNA, 22 nt, Mycobacterium avium subsp. paratuberculosis
ggcacgaauucgguggcgaugg

SEQ ID NO: 791317 - RNA, 15 nt, Mycobacterium avium subsp. paratuberculosis
ggcaccucggcgucg

SEQ ID NO: 791318 - RNA, 14 nt, Mycobacterium avium subsp. paratuberculosis
ggcaccuggccguc

SEQ ID NO: 791319 - RNA, 16 nt, Mycobacterium avium subsp. paratuberculosis
ggcaccuggccgucgg

SEQ ID NO: 791320 - RNA, 17 nt, Mycobacterium avium subsp. paratuberculosis
ggcaccuggccgucggu

SEQ ID NO: 791321 - RNA, 19 nt, Mycobacterium avium subsp. paratuberculosis
ggcaccuggccgucggugg

SEQ ID NO: 791322 - RNA, 21 nt, Mycobacterium avium subsp. paratuberculosis
ggcaccuggccgucgguggcc

SEQ ID NO: 791323 - RNA, 21 nt, Mycobacterium avium subsp. paratuberculosis
ggcacgcccguucgagcgccg

SEQ ID NO: 791324 - RNA, 15 nt, Mycobacterium avium subsp. paratuberculosis
ggcacgccgaccacc

SEQ ID NO: 791325 - RNA, 22 nt, Mycobacterium avium subsp. paratuberculosis
ggcacgccgaccacccccagcc

SEQ ID NO: 791326 - RNA, 21 nt, Mycobacterium avium subsp. paratuberculosis
ggcacgccacucgucgacguu

SEQ ID NO: 791327 - RNA, 23 nt, Mycobacterium avium subsp. paratuberculosis
ggcacgccacucgucgacguucg

SEQ ID NO: 791328 - RNA, 12 nt, Mycobacterium avium subsp. paratuberculosis
ggcacgcgcgcc

SEQ ID NO: 791329 - RNA, 17 nt, Mycobacterium avium subsp. paratuberculosis
ggcacgcgcgcccggca

SEQ ID NO: 791330 - RNA, 18 nt, Mycobacterium avium subsp. paratuberculosis
ggcacgcgcgcccggcac

SEQ ID NO: 791331 - RNA, 21 nt, Mycobacterium avium subsp. paratuberculosis
ggcacgccgcagcgcagcguc

SEQ ID NO: 791332 - RNA, 20 nt, Mycobacterium avium subsp. paratuberculosis
ggcacgccgcucgucgggca

SEQ ID NO: 791333 - RNA, 20 nt, Mycobacterium avium subsp. paratuberculosis
ggcacgcagcggcgucacgc

SEQ ID NO: 791334 - RNA, 14 nt, Mycobacterium avium subsp. paratuberculosis
ggcacgauggcgcg

SEQ ID NO: 791335 - RNA, 17 nt, Mycobacterium avium subsp. paratuberculosis
ggcacgauggcgcggcg

SEQ ID NO: 791336 - RNA, 19 nt, Mycobacterium avium subsp. paratuberculosis
ggcacgaucgucgccgcca

SEQ ID NO: 791337 - RNA, 16 nt, Mycobacterium avium subsp. paratuberculosis
ggcacgaucucgacca

SEQ ID NO: 791338 - RNA, 15 nt, Mycobacterium avium subsp. paratuberculosis
ggcacgacggucagc

SEQ ID NO: 791339 - RNA, 16 nt, Mycobacterium avium subsp. paratuberculosis
ggcaccuucaccgacc

SEQ ID NO: 791340 - RNA, 16 nt, Mycobacterium avium subsp. paratuberculosis
ggcacgacgccgccga

SEQ ID NO: 791341 - RNA, 13 nt, Mycobacterium avium subsp. paratuberculosis
ggcacucgagcgu

SEQ ID NO: 791342 - RNA, 19 nt, Mycobacterium avium subsp. paratuberculosis
ggcacucgaucagcaccgc

SEQ ID NO: 791343 - RNA, 21 nt, Mycobacterium avium subsp. paratuberculosis
ggcacucgaucagcaccgcca

SEQ ID NO: 791344 - RNA, 16 nt, Mycobacterium avium subsp. paratuberculosis
ggcacucgucguggcg

SEQ ID NO: 791345 - RNA, 20 nt, Mycobacterium avium subsp. paratuberculosis
ggcacucgucguggcggugc

SEQ ID NO: 791346 - RNA, 20 nt, Mycobacterium avium subsp. paratuberculosis
ggcacuaccgccucgccagc

SEQ ID NO: 791347 - RNA, 20 nt, Mycobacterium avium subsp. paratuberculosis
ggcacucccuuguugccgag

SEQ ID NO: 791348 - RNA, 16 nt, Mycobacterium avium subsp. paratuberculosis
ggcacgugcggguugg

SEQ ID NO: 791349 - RNA, 23 nt, Mycobacterium avium subsp. paratuberculosis
ggcacgugcggguuggcgccggu

SEQ ID NO: 791350 - RNA, 13 nt, Mycobacterium avium subsp. paratuberculosis
ggcacgucgacgc

SEQ ID NO: 791351 - RNA, 15 nt, Mycobacterium avium subsp. paratuberculosis
ggcacgucgacgccc

SEQ ID NO: 791352 - RNA, 19 nt, Mycobacterium avium subsp. paratuberculosis
ggcacgucgagggugaugu

SEQ ID NO: 791353 - RNA, 21 nt, Mycobacterium avium subsp. paratuberculosis
ggcacgucgagggugaugucg

SEQ ID NO: 791354 - RNA, 20 nt, Mycobacterium avium subsp. paratuberculosis
ggcacgguuggccggcccgc

SEQ ID NO: 791355 - RNA, 16 nt, Mycobacterium avium subsp. paratuberculosis
ggcacgucggccacgc

SEQ ID NO: 791356 - RNA, 15 nt, Mycobacterium avium subsp. paratuberculosis
ggcacgucggccagg

SEQ ID NO: 791357 - RNA, 19 nt, Mycobacterium avium subsp. paratuberculosis
ggcacguccagcccgcgcc

SEQ ID NO: 791358 - RNA, 21 nt, Mycobacterium avium subsp. paratuberculosis
ggcacguccccgugcagccgg

SEQ ID NO: 791359 - RNA, 12 nt, Mycobacterium avium subsp. paratuberculosis
ggcacguacgcg

SEQ ID NO: 791360 - RNA, 16 nt, Mycobacterium avium subsp. paratuberculosis
ggcacguacgcgcuga

SEQ ID NO: 791361 - RNA, 18 nt, Mycobacterium avium subsp. paratuberculosis
ggcacggugggacggcgg

SEQ ID NO: 791362 - RNA, 22 nt, Mycobacterium avium subsp. paratuberculosis
ggcacggugggacggcgggugg

SEQ ID NO: 791363 - RNA, 21 nt, Mycobacterium avium subsp. paratuberculosis
ggcacgguguagcugcggguc

SEQ ID NO: 791364 - RNA, 16 nt, Mycobacterium avium subsp. paratuberculosis
ggcacggugucgauag

SEQ ID NO: 791365 - RNA, 21 nt, Mycobacterium avium subsp. paratuberculosis
ggcacggugcacacgccgagg

SEQ ID NO: 791366 - RNA, 13 nt, Mycobacterium avium subsp. paratuberculosis
ggcacggcgaugu

SEQ ID NO: 791367 - RNA, 21 nt, Mycobacterium avium subsp. paratuberculosis
ggcacggcuaccuaggcgucg

SEQ ID NO: 791368 - RNA, 15 nt, Mycobacterium avium subsp. paratuberculosis
ggcacgggcccgcgg

SEQ ID NO: 791369 - RNA, 12 nt, Mycobacterium avium subsp. paratuberculosis
ggcacgggccgu

SEQ ID NO: 791370 - RNA, 19 nt, Mycobacterium avium subsp. paratuberculosis
ggcacggccggccggccga

SEQ ID NO: 791371 - RNA, 15 nt, Mycobacterium avium subsp. paratuberculosis
ggcacggcccgcucg

SEQ ID NO: 791372 - RNA, 16 nt, Mycobacterium avium subsp. paratuberculosis
ggcacggcccgcucgg

SEQ ID NO: 791373 - RNA, 14 nt, Mycobacterium avium subsp. paratuberculosis
ggcacgcgagacga

SEQ ID NO: 791374 - RNA, 13 nt, Mycobacterium avium subsp. paratuberculosis
ggcacggcaccgc

SEQ ID NO: 791375 - RNA, 15 nt, Mycobacterium avium subsp. paratuberculosis
ggcaccgcccccgcg

SEQ ID NO: 791376 - RNA, 18 nt, Mycobacterium avium subsp. paratuberculosis
ggcaccgcccccgcggcg

SEQ ID NO: 791377 - RNA, 19 nt, Mycobacterium avium subsp. paratuberculosis
ggcaccgcccccgcggcgg

SEQ ID NO: 791378 - RNA, 17 nt, Mycobacterium avium subsp. paratuberculosis
ggcaccgccagccacca

SEQ ID NO: 791379 - RNA, 12 nt, Mycobacterium avium subsp. paratuberculosis
ggcaccgccagc

SEQ ID NO: 791380 - RNA, 16 nt, Mycobacterium avium subsp. paratuberculosis
ggcaccgcgagcaccg

SEQ ID NO: 791381 - RNA, 12 nt, Mycobacterium avium subsp. paratuberculosis
ggcaccgcgaac

SEQ ID NO: 791382 - RNA, 19 nt, Mycobacterium avium subsp. paratuberculosis
ggcaccgccggcggccucc

SEQ ID NO: 791383 - RNA, 13 nt, Mycobacterium avium subsp. paratuberculosis
ggcaccgccgcgc

SEQ ID NO: 791384 - RNA, 22 nt, Mycobacterium avium subsp. paratuberculosis
ggcaccgccgcgcggccgggcu

SEQ ID NO: 791385 - RNA, 16 nt, Mycobacterium avium subsp. paratuberculosis
ggcaccgcggcgauga

SEQ ID NO: 791386 - RNA, 23 nt, Mycobacterium avium subsp. paratuberculosis
ggcaccgcggcgaugauccgcgg

SEQ ID NO: 791387 - RNA, 22 nt, Mycobacterium avium subsp. paratuberculosis
ggcaccgcggcggugucggcgc

SEQ ID NO: 791388 - RNA, 12 nt, Mycobacterium avium subsp. paratuberculosis
ggcaccgcggcu

SEQ ID NO: 791389 - RNA, 14 nt, Mycobacterium avium subsp. paratuberculosis
ggcaccgcggcucg

SEQ ID NO: 791390 - RNA, 21 nt, Mycobacterium avium subsp. paratuberculosis
ggcaccgcggcucggucgcga

SEQ ID NO: 791391 - RNA, 19 nt, Mycobacterium avium subsp. paratuberculosis
ggcaccgcggucugcgcca

SEQ ID NO: 791392 - RNA, 23 nt, Mycobacterium avium subsp. paratuberculosis
ggcaccgcggucugcgccagcuc

SEQ ID NO: 791393 - RNA, 16 nt, Mycobacterium avium subsp. paratuberculosis
ggcaccgcugccggcc

SEQ ID NO: 791394 - RNA, 14 nt, Mycobacterium avium subsp. paratuberculosis
ggcaccgacggagc

SEQ ID NO: 791395 - RNA, 23 nt, Mycobacterium avium subsp. paratuberculosis
ggcaccgacggagccgagcacca

SEQ ID NO: 791396 - RNA, 15 nt, Mycobacterium avium subsp. paratuberculosis
ggcaccgacggccgc

SEQ ID NO: 791397 - RNA, 19 nt, Mycobacterium avium subsp. paratuberculosis
ggcaccgacggccgcaccc

SEQ ID NO: 791398 - RNA, 22 nt, Mycobacterium avium subsp. paratuberculosis
ggcaccgacggccgcaccccac

SEQ ID NO: 791399 - RNA, 18 nt, Mycobacterium avium subsp. paratuberculosis
ggcaccgacagggccagc

SEQ ID NO: 791400 - RNA, 20 nt, Mycobacterium avium subsp. paratuberculosis
ggcaccgacagggccagcgc

SEQ ID NO: 791401 - RNA, 22 nt, Mycobacterium avium subsp. paratuberculosis
ggcaccgacagggccagcgcca

SEQ ID NO: 791402 - RNA, 22 nt, Mycobacterium avium subsp. paratuberculosis
ggcaccgacaucagaucgccga

SEQ ID NO: 791403 - RNA, 15 nt, Mycobacterium avium subsp. paratuberculosis
ggcaccgaucggcac

SEQ ID NO: 791404 - RNA, 16 nt, Mycobacterium avium subsp. paratuberculosis
ggcaccgaucggcacg

SEQ ID NO: 791405 - RNA, 19 nt, Mycobacterium avium subsp. paratuberculosis
ggcaccgaucggcacgucg

SEQ ID NO: 791406 - RNA, 16 nt, Mycobacterium avium subsp. paratuberculosis
ggcaccgaacgccagc

SEQ ID NO: 791407 - RNA, 17 nt, Mycobacterium avium subsp. paratuberculosis
ggcaccgaacgccagca

SEQ ID NO: 791408 - RNA, 19 nt, Mycobacterium avium subsp. paratuberculosis
ggcaccgaacgccagcagc

SEQ ID NO: 791409 - RNA, 17 nt, Mycobacterium avium subsp. paratuberculosis
ggcacccucggugcucu

SEQ ID NO: 791410 - RNA, 12 nt, Mycobacterium avium subsp. paratuberculosis
ggcacccggcgc

SEQ ID NO: 791411 - RNA, 16 nt, Mycobacterium avium subsp. paratuberculosis
ggcacccgggccuuga

SEQ ID NO: 791412 - RNA, 21 nt, Mycobacterium avium subsp. paratuberculosis
ggcacccgggccuugacggcc

SEQ ID NO: 791413 - RNA, 16 nt, Mycobacterium avium subsp. paratuberculosis
ggcacccgggcgacau

SEQ ID NO: 791414 - RNA, 19 nt, Mycobacterium avium subsp. paratuberculosis
ggcacccgggcgcgacggu

SEQ ID NO: 791415 - RNA, 16 nt, Mycobacterium avium subsp. paratuberculosis
ggcacccggguggaca

SEQ ID NO: 791416 - RNA, 22 nt, Mycobacterium avium subsp. paratuberculosis
ggcacccggguggacaccgcga

SEQ ID NO: 791417 - RNA, 19 nt, Mycobacterium avium subsp. paratuberculosis
ggcacccgguccggcccgg

SEQ ID NO: 791418 - RNA, 22 nt, Mycobacterium avium subsp. paratuberculosis
ggcacccgguccggcccgggga

SEQ ID NO: 791419 - RNA, 19 nt, Mycobacterium avium subsp. paratuberculosis
ggcacccgcaacaccacgu

SEQ ID NO: 791420 - RNA, 15 nt, Mycobacterium avium subsp. paratuberculosis
ggcacccgcgcgucg

SEQ ID NO: 791421 - RNA, 18 nt, Mycobacterium avium subsp. paratuberculosis
ggcacccgcgcgucgcgc

SEQ ID NO: 791422 - RNA, 19 nt, Mycobacterium avium subsp. paratuberculosis
ggcacccgcgcgucgcgca

SEQ ID NO: 791423 - RNA, 15 nt, Mycobacterium avium subsp. paratuberculosis
ggcaccccggucacc

SEQ ID NO: 791424 - RNA, 17 nt, Mycobacterium avium subsp. paratuberculosis
ggcaccccggucaccgg

SEQ ID NO: 791425 - RNA, 18 nt, Mycobacterium avium subsp. paratuberculosis
ggcaccccggucaccggu

SEQ ID NO: 791426 - RNA, 16 nt, Mycobacterium avium subsp. paratuberculosis
ggcaccccugccgcca

SEQ ID NO: 791427 - RNA, 21 nt, Mycobacterium avium subsp. paratuberculosis
ggcacccgaccgacgcccggc

SEQ ID NO: 791428 - RNA, 20 nt, Mycobacterium avium subsp. paratuberculosis
ggcacccgacgucgacgcgg

SEQ ID NO: 791429 - RNA, 21 nt, Mycobacterium avium subsp. paratuberculosis
ggcaccaacccgaucggcccg

SEQ ID NO: 791430 - RNA, 19 nt, Mycobacterium avium subsp. paratuberculosis
ggcaccaccacgguggcgc

SEQ ID NO: 791431 - RNA, 20 nt, Mycobacterium avium subsp. paratuberculosis
ggcaccaccacgguggcgcc

SEQ ID NO: 791432 - RNA, 18 nt, Mycobacterium avium subsp. paratuberculosis
ggcaccaccagcgugugg

SEQ ID NO: 791433 - RNA, 17 nt, Mycobacterium avium subsp. paratuberculosis
ggcaccacccgcggccg

SEQ ID NO: 791434 - RNA, 19 nt, Mycobacterium avium subsp. paratuberculosis
ggcaccacccgcggccggc

SEQ ID NO: 791435 - RNA, 22 nt, Mycobacterium avium subsp. paratuberculosis
ggcaccaccaccgacaccccga

SEQ ID NO: 791436 - RNA, 13 nt, Mycobacterium avium subsp. paratuberculosis
ggcaccacgccga

SEQ ID NO: 791437 - RNA, 14 nt, Mycobacterium avium subsp. paratuberculosis
ggcaccacgccgac

SEQ ID NO: 791438 - RNA, 15 nt, Mycobacterium avium subsp. paratuberculosis
ggcaccacggcggca

SEQ ID NO: 791439 - RNA, 16 nt, Mycobacterium avium subsp. paratuberculosis
ggcacaccggugcucu

SEQ ID NO: 791440 - RNA, 16 nt, Mycobacterium avium subsp. paratuberculosis
ggcacaccgucgucca

SEQ ID NO: 791441 - RNA, 17 nt, Mycobacterium avium subsp. paratuberculosis
ggcacacgaacaccggc

SEQ ID NO: 791442 - RNA, 22 nt, Mycobacterium avium subsp. paratuberculosis
ggcacagcagcacguugucgcc

SEQ ID NO: 791443 - RNA, 17 nt, Mycobacterium avium subsp. paratuberculosis
ggcacagcagggcaccg

SEQ ID NO: 791444 - RNA, 19 nt, Mycobacterium avium subsp. paratuberculosis
ggcacagcagggcaccgac

SEQ ID NO: 791445 - RNA, 20 nt, Mycobacterium avium subsp. paratuberculosis
ggcacagcagggcaccgacg

SEQ ID NO: 791446 - RNA, 19 nt, Mycobacterium avium subsp. paratuberculosis
ggcacagccagcgcccggc

SEQ ID NO: 791447 - RNA, 20 nt, Mycobacterium avium subsp. paratuberculosis
ggcacagccagcgcccggcg

SEQ ID NO: 791448 - RNA, 21 nt, Mycobacterium avium subsp. paratuberculosis
ggcacagccagcgcccggcga

SEQ ID NO: 791449 - RNA, 19 nt, Mycobacterium avium subsp. paratuberculosis
ggcaccagcgcgacggugu

SEQ ID NO: 791450 - RNA, 18 nt, Mycobacterium avium subsp. paratuberculosis
ggcaccagguucacgucg

SEQ ID NO: 791451 - RNA, 21 nt, Mycobacterium avium subsp. paratuberculosis
ggcaccaguaggucacccggu

SEQ ID NO: 791452 - RNA, 14 nt, Mycobacterium avium subsp. paratuberculosis
ggcaccagucgcgc

SEQ ID NO: 791453 - RNA, 14 nt, Mycobacterium avium subsp. paratuberculosis
ggcaccagcagcca

SEQ ID NO: 791454 - RNA, 16 nt, Mycobacterium avium subsp. paratuberculosis
ggcaccagcagccagc

SEQ ID NO: 791455 - RNA, 17 nt, Mycobacterium avium subsp. paratuberculosis
ggcaccagcagccagcc

SEQ ID NO: 791456 - RNA, 21 nt, Mycobacterium avium subsp. paratuberculosis
ggcaccagcagccgcagcgcg

SEQ ID NO: 791457 - RNA, 24 nt, Mycobacterium avium subsp. paratuberculosis
ggcaccagcagccgcagcgcgcga

SEQ ID NO: 791458 - RNA, 15 nt, Mycobacterium avium subsp. paratuberculosis
ggcaccagcagcgcg

SEQ ID NO: 791459 - RNA, 22 nt, Mycobacterium avium subsp. paratuberculosis
ggcaccagcccgccgucggcau

SEQ ID NO: 791460 - RNA, 14 nt, Mycobacterium avium subsp. paratuberculosis
ggcaccagcaccga

SEQ ID NO: 791461 - RNA, 13 nt, Mycobacterium avium subsp. paratuberculosis
ggcaccagcgaca

SEQ ID NO: 791462 - RNA, 14 nt, Mycobacterium avium subsp. paratuberculosis
ggcaccagcugcgg

SEQ ID NO: 791463 - RNA, 13 nt, Mycobacterium avium subsp. paratuberculosis
ggcaccccaucgg

SEQ ID NO: 791464 - RNA, 20 nt, Mycobacterium avium subsp. paratuberculosis
ggcacccccaauugccgggc

SEQ ID NO: 791465 - RNA, 21 nt, Mycobacterium avium subsp. paratuberculosis
ggcacccccaauugccgggcc

SEQ ID NO: 791466 - RNA, 22 nt, Mycobacterium avium subsp. paratuberculosis
ggcacccccaauugccgggcca

SEQ ID NO: 791467 - RNA, 21 nt, Mycobacterium avium subsp. paratuberculosis
ggcacccccgggguggugugc

SEQ ID NO: 791468 - RNA, 22 nt, Mycobacterium avium subsp. paratuberculosis
ggcacccccgggguggugugca

SEQ ID NO: 791469 - RNA, 14 nt, Mycobacterium avium subsp. paratuberculosis
ggcaccccgaucag

SEQ ID NO: 791470 - RNA, 20 nt, Mycobacterium avium subsp. paratuberculosis
ggcaccccgcgccgggcguu

SEQ ID NO: 791471 - RNA, 21 nt, Mycobacterium avium subsp. paratuberculosis
ggcaccccgcgccgggcguug

SEQ ID NO: 791472 - RNA, 17 nt, Mycobacterium avium subsp. paratuberculosis
ggcaccccgcggucggc

SEQ ID NO: 791473 - RNA, 21 nt, Mycobacterium avium subsp. paratuberculosis
ggcaccccgcggucggcggcg

SEQ ID NO: 791474 - RNA, 20 nt, Mycobacterium avium subsp. paratuberculosis
ggcagaagcuccacgccgcc

SEQ ID NO: 791475 - RNA, 21 nt, Mycobacterium avium subsp. paratuberculosis
ggcagaagcuccacgccgccg

SEQ ID NO: 791476 - RNA, 15 nt, Mycobacterium avium subsp. paratuberculosis
ggcacugcugcccgc

SEQ ID NO: 791477 - RNA, 16 nt, Mycobacterium avium subsp. paratuberculosis
ggcacugcugcccgcg

SEQ ID NO: 791478 - RNA, 12 nt, Mycobacterium avium subsp. paratuberculosis
ggcacugcccgc

SEQ ID NO: 791479 - RNA, 20 nt, Mycobacterium avium subsp. paratuberculosis
ggcacuuaacaccucgccuc

SEQ ID NO: 791480 - RNA, 20 nt, Mycobacterium avium subsp. paratuberculosis
ggcagcgcuaaccgcgggca

SEQ ID NO: 791481 - RNA, 20 nt, Mycobacterium avium subsp. paratuberculosis
ggcagcgcuccugcagcgcg

SEQ ID NO: 791482 - RNA, 23 nt, Mycobacterium avium subsp. paratuberculosis
ggcagcgcuccugcagcgcggcg

SEQ ID NO: 791483 - RNA, 20 nt, Mycobacterium avium subsp. paratuberculosis
ggcagcgcucgucgucggag

SEQ ID NO: 791484 - RNA, 21 nt, Mycobacterium avium subsp. paratuberculosis
ggcagcgcucgucgucggaga

SEQ ID NO: 791485 - RNA, 13 nt, Mycobacterium avium subsp. paratuberculosis
ggcagcgcggcgu

SEQ ID NO: 791486 - RNA, 16 nt, Mycobacterium avium subsp. paratuberculosis
ggcagcgcggcguuca

SEQ ID NO: 791487 - RNA, 16 nt, Mycobacterium avium subsp. paratuberculosis
ggcagcgcggccagca

SEQ ID NO: 791488 - RNA, 23 nt, Mycobacterium avium subsp. paratuberculosis
ggcagcgcggccagcacggucag

SEQ ID NO: 791489 - RNA, 13 nt, Mycobacterium avium subsp. paratuberculosis
ggcagcggccgca

SEQ ID NO: 791490 - RNA, 16 nt, Mycobacterium avium subsp. paratuberculosis
ggcagcgcgcccucga

SEQ ID NO: 791491 - RNA, 20 nt, Mycobacterium avium subsp. paratuberculosis
ggcagcgcgcccugaggccc

SEQ ID NO: 791492 - RNA, 21 nt, Mycobacterium avium subsp. paratuberculosis
ggcagcgcgaccagcccggcc

SEQ ID NO: 791493 - RNA, 22 nt, Mycobacterium avium subsp. paratuberculosis
ggcagcgcgaccagcccggccg

SEQ ID NO: 791494 - RNA, 23 nt, Mycobacterium avium subsp. paratuberculosis
ggcagcgcgaccagcccggccgc

SEQ ID NO: 791495 - RNA, 14 nt, Mycobacterium avium subsp. paratuberculosis
ggcagcgcgauccg

SEQ ID NO: 791496 - RNA, 18 nt, Mycobacterium avium subsp. paratuberculosis
ggcagcgcgauccgcgcg

SEQ ID NO: 791497 - RNA, 21 nt, Mycobacterium avium subsp. paratuberculosis
ggcagcgcgauccgcgcgucg

SEQ ID NO: 791498 - RNA, 16 nt, Mycobacterium avium subsp. paratuberculosis
ggcagcgcgauccggg

SEQ ID NO: 791499 - RNA, 12 nt, Mycobacterium avium subsp. paratuberculosis
ggcagaccagga

SEQ ID NO: 791500 - RNA, 13 nt, Mycobacterium avium subsp. paratuberculosis
ggcagacccagca

SEQ ID NO: 791501 - RNA, 17 nt, Mycobacterium avium subsp. paratuberculosis
ggcagacccagcagcgg

SEQ ID NO: 791502 - RNA, 22 nt, Mycobacterium avium subsp. paratuberculosis
ggcagacccagcagcggccggc

SEQ ID NO: 791503 - RNA, 14 nt, Mycobacterium avium subsp. paratuberculosis
ggcagacccccagc

SEQ ID NO: 791504 - RNA, 17 nt, Mycobacterium avium subsp. paratuberculosis
ggcagacccgcgucgau

SEQ ID NO: 791505 - RNA, 16 nt, Mycobacterium avium subsp. paratuberculosis
ggcagaccggugagca

SEQ ID NO: 791506 - RNA, 21 nt, Mycobacterium avium subsp. paratuberculosis
ggcagaccgugugccagcccg

SEQ ID NO: 791507 - RNA, 16 nt, Mycobacterium avium subsp. paratuberculosis
ggcaggccggcagccg

SEQ ID NO: 791508 - RNA, 18 nt, Mycobacterium avium subsp. paratuberculosis
ggcaggccggcagccggc

SEQ ID NO: 791509 - RNA, 13 nt, Mycobacterium avium subsp. paratuberculosis
ggcaggccggugc

SEQ ID NO: 791510 - RNA, 15 nt, Mycobacterium avium subsp. paratuberculosis
ggcaggccgcggccg

SEQ ID NO: 791511 - RNA, 22 nt, Mycobacterium avium subsp. paratuberculosis
ggcaggccgcggccgucgucgu

SEQ ID NO: 791512 - RNA, 21 nt, Mycobacterium avium subsp. paratuberculosis
ggcaggccgaagaacucagcc

SEQ ID NO: 791513 - RNA, 16 nt, Mycobacterium avium subsp. paratuberculosis
ggcagcgucccgucgg

SEQ ID NO: 791514 - RNA, 21 nt, Mycobacterium avium subsp. paratuberculosis
ggcagcgucccgucggccagu

SEQ ID NO: 791515 - RNA, 15 nt, Mycobacterium avium subsp. paratuberculosis
ggcagcgucgccagc

SEQ ID NO: 791516 - RNA, 17 nt, Mycobacterium avium subsp. paratuberculosis
ggcagcgucgccagccg

SEQ ID NO: 791517 - RNA, 18 nt, Mycobacterium avium subsp. paratuberculosis
ggcagcgucgccagccgc

SEQ ID NO: 791518 - RNA, 20 nt, Mycobacterium avium subsp. paratuberculosis
ggcagcgucgccagccgccg

SEQ ID NO: 791519 - RNA, 15 nt, Mycobacterium avium subsp. paratuberculosis
ggcagcggucggcgg

SEQ ID NO: 791520 - RNA, 22 nt, Mycobacterium avium subsp. paratuberculosis
ggcagcggcugcugcagcgccc

SEQ ID NO: 791521 - RNA, 23 nt, Mycobacterium avium subsp. paratuberculosis
ggcaggcgauguggguggucagc

SEQ ID NO: 791522 - RNA, 15 nt, Mycobacterium avium subsp. paratuberculosis
ggcagggugaccgag

SEQ ID NO: 791523 - RNA, 14 nt, Mycobacterium avium subsp. paratuberculosis
ggcagggccaccgu

SEQ ID NO: 791524 - RNA, 13 nt, Mycobacterium avium subsp. paratuberculosis
ggcagggccagca

SEQ ID NO: 791525 - RNA, 15 nt, Mycobacterium avium subsp. paratuberculosis
ggcagggccagcagc

SEQ ID NO: 791526 - RNA, 17 nt, Mycobacterium avium subsp. paratuberculosis
ggcagggccagcagccc

SEQ ID NO: 791527 - RNA, 16 nt, Mycobacterium avium subsp. paratuberculosis
ggcaggcucagcagca

SEQ ID NO: 791528 - RNA, 12 nt, Mycobacterium avium subsp. paratuberculosis
ggcaggcggccc

SEQ ID NO: 791529 - RNA, 14 nt, Mycobacterium avium subsp. paratuberculosis
ggcaggcggcccgc

SEQ ID NO: 791530 - RNA, 13 nt, Mycobacterium avium subsp. paratuberculosis
ggcaggcggcgcg

SEQ ID NO: 791531 - RNA, 14 nt, Mycobacterium avium subsp. paratuberculosis
ggcaggcggcgcgc

SEQ ID NO: 791532 - RNA, 16 nt, Mycobacterium avium subsp. paratuberculosis
ggcaggcggcgcgcca

SEQ ID NO: 791533 - RNA, 18 nt, Mycobacterium avium subsp. paratuberculosis
ggcaggguuuucacgucg

SEQ ID NO: 791534 - RNA, 19 nt, Mycobacterium avium subsp. paratuberculosis
ggcaggguuuucacgucga

SEQ ID NO: 791535 - RNA, 23 nt, Mycobacterium avium subsp. paratuberculosis
ggcaggguuuucacgucgagcgg

SEQ ID NO: 791536 - RNA, 22 nt, Mycobacterium avium subsp. paratuberculosis
ggcaguaucuuguucgccgaca

SEQ ID NO: 791537 - RNA, 15 nt, Mycobacterium avium subsp. paratuberculosis
ggcaguagcgacgcg

SEQ ID NO: 791538 - RNA, 17 nt, Mycobacterium avium subsp. paratuberculosis
ggcaguagcgcaccggu

SEQ ID NO: 791539 - RNA, 22 nt, Mycobacterium avium subsp. paratuberculosis
ggcaguagcgcaccggucagcg

SEQ ID NO: 791540 - RNA, 22 nt, Mycobacterium avium subsp. paratuberculosis
ggcagugagggaacgccgauca

SEQ ID NO: 791541 - RNA, 13 nt, Mycobacterium avium subsp. paratuberculosis
ggcagugaucggc

SEQ ID NO: 791542 - RNA, 15 nt, Mycobacterium avium subsp. paratuberculosis
ggcagugaucggcgg

SEQ ID NO: 791543 - RNA, 16 nt, Mycobacterium avium subsp. paratuberculosis
ggcagugaucggcgga

SEQ ID NO: 791544 - RNA, 15 nt, Mycobacterium avium subsp. paratuberculosis
ggcagugcacgacga

SEQ ID NO: 791545 - RNA, 20 nt, Mycobacterium avium subsp. paratuberculosis
ggcagugcacgacgaccgcg

SEQ ID NO: 791546 - RNA, 18 nt, Mycobacterium avium subsp. paratuberculosis
ggcaguccgcgccggucc

SEQ ID NO: 791547 - RNA, 14 nt, Mycobacterium avium subsp. paratuberculosis
ggcaucccacccgg

SEQ ID NO: 791548 - RNA, 12 nt, Mycobacterium avium subsp. paratuberculosis
ggcauccccagc

SEQ ID NO: 791549 - RNA, 22 nt, Mycobacterium avium subsp. paratuberculosis
ggcauccccagcugggccgcca

SEQ ID NO: 791550 - RNA, 13 nt, Mycobacterium avium subsp. paratuberculosis
ggcaucccgccga

SEQ ID NO: 791551 - RNA, 15 nt, Mycobacterium avium subsp. paratuberculosis
ggcaucccgccgaac

SEQ ID NO: 791552 - RNA, 13 nt, Mycobacterium avium subsp. paratuberculosis
ggcaucccgcgcc

SEQ ID NO: 791553 - RNA, 14 nt, Mycobacterium avium subsp. paratuberculosis
ggcaucccgcgccu

SEQ ID NO: 791554 - RNA, 16 nt, Mycobacterium avium subsp. paratuberculosis
ggcaucccgcgccugc

SEQ ID NO: 791555 - RNA, 23 nt, Mycobacterium avium subsp. paratuberculosis
ggcaucccgcgccugccuggcca

SEQ ID NO: 791556 - RNA, 21 nt, Mycobacterium avium subsp. paratuberculosis
ggcaucccugacacgaccgcc

SEQ ID NO: 791557 - RNA, 22 nt, Mycobacterium avium subsp. paratuberculosis
ggcaucccugacacgaccgccu

SEQ ID NO: 791558 - RNA, 20 nt, Mycobacterium avium subsp. paratuberculosis
ggcauccucggcgcgucggu

SEQ ID NO: 791559 - RNA, 14 nt, Mycobacterium avium subsp. paratuberculosis
ggcauccgcucgcc

SEQ ID NO: 791560 - RNA, 19 nt, Mycobacterium avium subsp. paratuberculosis
ggcauccggcucagaaggc

SEQ ID NO: 791561 - RNA, 22 nt, Mycobacterium avium subsp. paratuberculosis
ggcauccgggaggccagcaccu

SEQ ID NO: 791562 - RNA, 16 nt, Mycobacterium avium subsp. paratuberculosis
ggcauccgggccgccg

SEQ ID NO: 791563 - RNA, 19 nt, Mycobacterium avium subsp. paratuberculosis
ggcauccgggccgccgcgg

SEQ ID NO: 791564 - RNA, 16 nt, Mycobacterium avium subsp. paratuberculosis
ggcaucgcagcgcgcg

SEQ ID NO: 791565 - RNA, 20 nt, Mycobacterium avium subsp. paratuberculosis
ggcaucgcagcgcgcggcgc

SEQ ID NO: 791566 - RNA, 22 nt, Mycobacterium avium subsp. paratuberculosis
ggcaucgaggaccggcgccggc

SEQ ID NO: 791567 - RNA, 13 nt, Mycobacterium avium subsp. paratuberculosis
ggcaucgaccgcc

SEQ ID NO: 791568 - RNA, 23 nt, Mycobacterium avium subsp. paratuberculosis
ggcaucgacaugcccggcgacgg

SEQ ID NO: 791569 - RNA, 17 nt, Mycobacterium avium subsp. paratuberculosis
ggcaugaaccaggccgc

SEQ ID NO: 791570 - RNA, 18 nt, Mycobacterium avium subsp. paratuberculosis
ggcaugaaccaggccgcg

SEQ ID NO: 791571 - RNA, 13 nt, Mycobacterium avium subsp. paratuberculosis
ggcaugccggccg

SEQ ID NO: 791572 - RNA, 17 nt, Mycobacterium avium subsp. paratuberculosis
ggcaugccggccggcac

SEQ ID NO: 791573 - RNA, 18 nt, Mycobacterium avium subsp. paratuberculosis
ggcaucgucggcgccggc

SEQ ID NO: 791574 - RNA, 20 nt, Mycobacterium avium subsp. paratuberculosis
ggcaucgucggcgccggcgc

SEQ ID NO: 791575 - RNA, 13 nt, Mycobacterium avium subsp. paratuberculosis
ggcaucgggucgu

SEQ ID NO: 791576 - RNA, 15 nt, Mycobacterium avium subsp. paratuberculosis
ggcaucgguggcacc

SEQ ID NO: 791577 - RNA, 20 nt, Mycobacterium avium subsp. paratuberculosis
ggcaucgguggcaccccgcg

SEQ ID NO: 791578 - RNA, 14 nt, Mycobacterium avium subsp. paratuberculosis
ggcaucggcugguc

SEQ ID NO: 791579 - RNA, 16 nt, Mycobacterium avium subsp. paratuberculosis
ggcaucggcuggucgg

SEQ ID NO: 791580 - RNA, 14 nt, Mycobacterium avium subsp. paratuberculosis
ggcaucgcgugccg

SEQ ID NO: 791581 - RNA, 20 nt, Mycobacterium avium subsp. paratuberculosis
ggcaucgcgugccgaccagc

SEQ ID NO: 791582 - RNA, 23 nt, Mycobacterium avium subsp. paratuberculosis
ggcaucgcgugccgaccagccga

SEQ ID NO: 791583 - RNA, 16 nt, Mycobacterium avium subsp. paratuberculosis
ggcaucgcugguggcc

SEQ ID NO: 791584 - RNA, 22 nt, Mycobacterium avium subsp. paratuberculosis
ggcaucgcugguggccgacgug

SEQ ID NO: 791585 - RNA, 14 nt, Mycobacterium avium subsp. paratuberculosis
ggcaucgcgcgcgg

SEQ ID NO: 791586 - RNA, 23 nt, Mycobacterium avium subsp. paratuberculosis
ggcaucgcgcgcggcggccaccg

SEQ ID NO: 791587 - RNA, 21 nt, Mycobacterium avium subsp. paratuberculosis
ggcaucgauggcgggcgcgcc

SEQ ID NO: 791588 - RNA, 20 nt, Mycobacterium avium subsp. paratuberculosis
ggcaucggcgcccucgccga

SEQ ID NO: 791589 - RNA, 22 nt, Mycobacterium avium subsp. paratuberculosis
ggcaucggcgcccucgccgacc

SEQ ID NO: 791590 - RNA, 16 nt, Mycobacterium avium subsp. paratuberculosis
ggcaucggcgacggcg

SEQ ID NO: 791591 - RNA, 23 nt, Mycobacterium avium subsp. paratuberculosis
ggcauuuugggggacuuucgcgu

SEQ ID NO: 791592 - RNA, 17 nt, Mycobacterium avium subsp. paratuberculosis
ggccaacagcagcagaa

SEQ ID NO: 791593 - RNA, 19 nt, Mycobacterium avium subsp. paratuberculosis
ggccaacagcagcgccgcg

SEQ ID NO: 791594 - RNA, 20 nt, Mycobacterium avium subsp. paratuberculosis
ggccaccgaagccgacgucg

SEQ ID NO: 791595 - RNA, 11 nt, Mycobacterium avium subsp. paratuberculosis
ggccaccgacu

SEQ ID NO: 791596 - RNA, 14 nt, Mycobacterium avium subsp. paratuberculosis
ggccaccgacugcg

SEQ ID NO: 791597 - RNA, 17 nt, Mycobacterium avium subsp. paratuberculosis
ggccaccgacugcgacg

SEQ ID NO: 791598 - RNA, 18 nt, Mycobacterium avium subsp. paratuberculosis
ggccacccgggcgccggc

SEQ ID NO: 791599 - RNA, 19 nt, Mycobacterium avium subsp. paratuberculosis
ggccacccgggcgccggcg

SEQ ID NO: 791600 - RNA, 21 nt, Mycobacterium avium subsp. paratuberculosis
ggccacccgggcgccggcgau

SEQ ID NO: 791601 - RNA, 22 nt, Mycobacterium avium subsp. paratuberculosis
ggccaacagugcgcaggcggcg

SEQ ID NO: 791602 - RNA, 13 nt, Mycobacterium avium subsp. paratuberculosis
ggccaccugggcg

SEQ ID NO: 791603 - RNA, 15 nt, Mycobacterium avium subsp. paratuberculosis
ggccaccucgacggc

SEQ ID NO: 791604 - RNA, 16 nt, Mycobacterium avium subsp. paratuberculosis
ggccaccucgacggcg

SEQ ID NO: 791605 - RNA, 18 nt, Mycobacterium avium subsp. paratuberculosis
ggccaccucgacggcgug

SEQ ID NO: 791606 - RNA, 15 nt, Mycobacterium avium subsp. paratuberculosis
ggccaccucggcggc

SEQ ID NO: 791607 - RNA, 14 nt, Mycobacterium avium subsp. paratuberculosis
ggccaccgucaggg

SEQ ID NO: 791608 - RNA, 22 nt, Mycobacterium avium subsp. paratuberculosis
ggccaccgucccggugucgccg

SEQ ID NO: 791609 - RNA, 23 nt, Mycobacterium avium subsp. paratuberculosis
ggccaccgucccggugucgccgu

SEQ ID NO: 791610 - RNA, 14 nt, Mycobacterium avium subsp. paratuberculosis
ggccaccuccagcc

SEQ ID NO: 791611 - RNA, 14 nt, Mycobacterium avium subsp. paratuberculosis
ggccaccggcgcga

SEQ ID NO: 791612 - RNA, 20 nt, Mycobacterium avium subsp. paratuberculosis
ggccaccggcgcgacggcgg

SEQ ID NO: 791613 - RNA, 16 nt, Mycobacterium avium subsp. paratuberculosis
ggccaccgcggcguug

SEQ ID NO: 791614 - RNA, 16 nt, Mycobacterium avium subsp. paratuberculosis
ggccaccgcggucgac

SEQ ID NO: 791615 - RNA, 17 nt, Mycobacterium avium subsp. paratuberculosis
ggccaccgggaccgucg

SEQ ID NO: 791616 - RNA, 18 nt, Mycobacterium avium subsp. paratuberculosis
ggccaccgggaccgucgg

SEQ ID NO: 791617 - RNA, 19 nt, Mycobacterium avium subsp. paratuberculosis
ggccaccgggaccgucggg

SEQ ID NO: 791618 - RNA, 14 nt, Mycobacterium avium subsp. paratuberculosis
ggccaccgggccga

SEQ ID NO: 791619 - RNA, 13 nt, Mycobacterium avium subsp. paratuberculosis
ggccaccgggucg

SEQ ID NO: 791620 - RNA, 17 nt, Mycobacterium avium subsp. paratuberculosis
ggccaccgcgucgcugc

SEQ ID NO: 791621 - RNA, 18 nt, Mycobacterium avium subsp. paratuberculosis
ggccaccgaugcccgaca

SEQ ID NO: 791622 - RNA, 19 nt, Mycobacterium avium subsp. paratuberculosis
ggccaccgaugcccgacac

SEQ ID NO: 791623 - RNA, 21 nt, Mycobacterium avium subsp. paratuberculosis
ggccaccgcaucgccgagggc

SEQ ID NO: 791624 - RNA, 16 nt, Mycobacterium avium subsp. paratuberculosis
ggccaccgccgccagc

SEQ ID NO: 791625 - RNA, 13 nt, Mycobacterium avium subsp. paratuberculosis
ggccaccgccugc

SEQ ID NO: 791626 - RNA, 15 nt, Mycobacterium avium subsp. paratuberculosis
ggccaccgcgacgcc

SEQ ID NO: 791627 - RNA, 17 nt, Mycobacterium avium subsp. paratuberculosis
ggccaccgcgacgccca

SEQ ID NO: 791628 - RNA, 15 nt, Mycobacterium avium subsp. paratuberculosis
ggccaccgcgacgcu

SEQ ID NO: 791629 - RNA, 16 nt, Mycobacterium avium subsp. paratuberculosis
ggccaccgcgacgcug

SEQ ID NO: 791630 - RNA, 18 nt, Mycobacterium avium subsp. paratuberculosis
ggccaccgcgaucucgau

SEQ ID NO: 791631 - RNA, 20 nt, Mycobacterium avium subsp. paratuberculosis
ggccaccgcgccccggcgca

SEQ ID NO: 791632 - RNA, 13 nt, Mycobacterium avium subsp. paratuberculosis
ggccaccgcgcgc

SEQ ID NO: 791633 - RNA, 15 nt, Mycobacterium avium subsp. paratuberculosis
ggccaccgcgcgcug

SEQ ID NO: 791634 - RNA, 16 nt, Mycobacterium avium subsp. paratuberculosis
ggccaccgcgcgcugc

SEQ ID NO: 791635 - RNA, 20 nt, Mycobacterium avium subsp. paratuberculosis
ggccaccgcgcgcugccgcg

SEQ ID NO: 791636 - RNA, 14 nt, Mycobacterium avium subsp. paratuberculosis
ggccaccgcgcggc

SEQ ID NO: 791637 - RNA, 17 nt, Mycobacterium avium subsp. paratuberculosis
ggccaccgcgcggcggu

SEQ ID NO: 791638 - RNA, 20 nt, Mycobacterium avium subsp. paratuberculosis
ggccaccgcgcggcggucca

SEQ ID NO: 791639 - RNA, 14 nt, Mycobacterium avium subsp. paratuberculosis
ggccaccgcgcggu

SEQ ID NO: 791640 - RNA, 20 nt, Mycobacterium avium subsp. paratuberculosis
ggccaccgcgcggugcacca

SEQ ID NO: 791641 - RNA, 18 nt, Mycobacterium avium subsp. paratuberculosis
ggccaccgcggccagcug

SEQ ID NO: 791642 - RNA, 16 nt, Mycobacterium avium subsp. paratuberculosis
ggccagcacggcggcg

SEQ ID NO: 791643 - RNA, 19 nt, Mycobacterium avium subsp. paratuberculosis
ggccagcacggcggcgugc

SEQ ID NO: 791644 - RNA, 23 nt, Mycobacterium avium subsp. paratuberculosis
ggccagcacgcaggcguggccca

SEQ ID NO: 791645 - RNA, 16 nt, Mycobacterium avium subsp. paratuberculosis
ggccagcacgcccccg

SEQ ID NO: 791646 - RNA, 13 nt, Mycobacterium avium subsp. paratuberculosis
ggccagcacggcg

SEQ ID NO: 791647 - RNA, 15 nt, Mycobacterium avium subsp. paratuberculosis
ggccagcacgccggu

SEQ ID NO: 791648 - RNA, 16 nt, Mycobacterium avium subsp. paratuberculosis
ggccagcacgccgguc

SEQ ID NO: 791649 - RNA, 19 nt, Mycobacterium avium subsp. paratuberculosis
ggccagcacgccggucagc

SEQ ID NO: 791650 - RNA, 20 nt, Mycobacterium avium subsp. paratuberculosis
ggccagcacgccggucagca

SEQ ID NO: 791651 - RNA, 15 nt, Mycobacterium avium subsp. paratuberculosis
ggccagcacgccguc

SEQ ID NO: 791652 - RNA, 13 nt, Mycobacterium avium subsp. paratuberculosis
ggccagcacgccu

SEQ ID NO: 791653 - RNA, 22 nt, Mycobacterium avium subsp. paratuberculosis
ggccagcacgcugcggaugucg

SEQ ID NO: 791654 - RNA, 16 nt, Mycobacterium avium subsp. paratuberculosis
ggccagcaccuggcgc

SEQ ID NO: 791655 - RNA, 20 nt, Mycobacterium avium subsp. paratuberculosis
ggccagcaccuggcgcaccg

SEQ ID NO: 791656 - RNA, 18 nt, Mycobacterium avium subsp. paratuberculosis
ggccagcaccuucagcgg

SEQ ID NO: 791657 - RNA, 22 nt, Mycobacterium avium subsp. paratuberculosis
ggccagcaccaugaucaggccc

SEQ ID NO: 791658 - RNA, 23 nt, Mycobacterium avium subsp. paratuberculosis
ggccagcacccgcucgcgggccc

SEQ ID NO: 791659 - RNA, 15 nt, Mycobacterium avium subsp. paratuberculosis
ggccagcacccgcug

SEQ ID NO: 791660 - RNA, 15 nt, Mycobacterium avium subsp. paratuberculosis
ggccagcaccgccag

SEQ ID NO: 791661 - RNA, 13 nt, Mycobacterium avium subsp. paratuberculosis
ggccagcaccgcg

SEQ ID NO: 791662 - RNA, 15 nt, Mycobacterium avium subsp. paratuberculosis
ggccagcaccgcggc

SEQ ID NO: 791663 - RNA, 20 nt, Mycobacterium avium subsp. paratuberculosis
ggccagcaccgcggccgucg

SEQ ID NO: 791664 - RNA, 17 nt, Mycobacterium avium subsp. paratuberculosis
ggccagcaccgcggcga

SEQ ID NO: 791665 - RNA, 15 nt, Mycobacterium avium subsp. paratuberculosis
ggccagcaccgcggu

SEQ ID NO: 791666 - RNA, 14 nt, Mycobacterium avium subsp. paratuberculosis
ggccagcaccgcgu

SEQ ID NO: 791667 - RNA, 14 nt, Mycobacterium avium subsp. paratuberculosis
ggccagcaccacca

SEQ ID NO: 791668 - RNA, 14 nt, Mycobacterium avium subsp. paratuberculosis
ggccagcaccaccg

SEQ ID NO: 791669 - RNA, 17 nt, Mycobacterium avium subsp. paratuberculosis
ggccagcaccaccgcga

SEQ ID NO: 791670 - RNA, 19 nt, Mycobacterium avium subsp. paratuberculosis
ggccagcaccaccgcgagc

SEQ ID NO: 791671 - RNA, 19 nt, Mycobacterium avium subsp. paratuberculosis
ggccagcaccacggugauc

SEQ ID NO: 791672 - RNA, 19 nt, Mycobacterium avium subsp. paratuberculosis
ggccagcaccacguccgcg

SEQ ID NO: 791673 - RNA, 21 nt, Mycobacterium avium subsp. paratuberculosis
ggccagcaccacguccgcggu

SEQ ID NO: 791674 - RNA, 21 nt, Mycobacterium avium subsp. paratuberculosis
ggccagcaccagcagccgguc

SEQ ID NO: 791675 - RNA, 22 nt, Mycobacterium avium subsp. paratuberculosis
ggccagcaccagcagccggucg

SEQ ID NO: 791676 - RNA, 23 nt, Mycobacterium avium subsp. paratuberculosis
ggccagcaccagcagccggucga

SEQ ID NO: 791677 - RNA, 16 nt, Mycobacterium avium subsp. paratuberculosis
ggccagcaccagcccg

SEQ ID NO: 791678 - RNA, 22 nt, Mycobacterium avium subsp. paratuberculosis
ggccagcaccagcccgaugccg

SEQ ID NO: 791679 - RNA, 20 nt, Mycobacterium avium subsp. paratuberculosis
ggccagcaccagcgcgcggg

SEQ ID NO: 791680 - RNA, 14 nt, Mycobacterium avium subsp. paratuberculosis
ggccacucgccgcg

SEQ ID NO: 791681 - RNA, 22 nt, Mycobacterium avium subsp. paratuberculosis
ggccagcaacagcagcggcaug

SEQ ID NO: 791682 - RNA, 12 nt, Mycobacterium avium subsp. paratuberculosis
ggccagcaaccg

SEQ ID NO: 791683 - RNA, 21 nt, Mycobacterium avium subsp. paratuberculosis
ggccagcacacccucgacccg

SEQ ID NO: 791684 - RNA, 23 nt, Mycobacterium avium subsp. paratuberculosis
ggccagcacacccucgacccguu

SEQ ID NO: 791685 - RNA, 13 nt, Mycobacterium avium subsp. paratuberculosis
ggccacguggucg

SEQ ID NO: 791686 - RNA, 14 nt, Mycobacterium avium subsp. paratuberculosis
ggccacgucgaugc

SEQ ID NO: 791687 - RNA, 16 nt, Mycobacterium avium subsp. paratuberculosis
ggccacgucgaugccg

SEQ ID NO: 791688 - RNA, 13 nt, Mycobacterium avium subsp. paratuberculosis
ggccacggcgcga

SEQ ID NO: 791689 - RNA, 12 nt, Mycobacterium avium subsp. paratuberculosis
ggccacgcuggc

SEQ ID NO: 791690 - RNA, 18 nt, Mycobacterium avium subsp. paratuberculosis
ggccacgcuggcguccag

SEQ ID NO: 791691 - RNA, 20 nt, Mycobacterium avium subsp. paratuberculosis
ggccacgcuggcguccaggu

SEQ ID NO: 791692 - RNA, 18 nt, Mycobacterium avium subsp. paratuberculosis
ggccacgcucucgccggu

SEQ ID NO: 791693 - RNA, 23 nt, Mycobacterium avium subsp. paratuberculosis
ggccacgcucucgccggucagca

SEQ ID NO: 791694 - RNA, 11 nt, Mycobacterium avium subsp. paratuberculosis
ggccacggcgu

SEQ ID NO: 791695 - RNA, 14 nt, Mycobacterium avium subsp. paratuberculosis
ggccacgcucggcg

SEQ ID NO: 791696 - RNA, 21 nt, Mycobacterium avium subsp. paratuberculosis
ggccacgcucggcggcgcgca

SEQ ID NO: 791697 - RNA, 13 nt, Mycobacterium avium subsp. paratuberculosis
ggccacgcucggg

SEQ ID NO: 791698 - RNA, 19 nt, Mycobacterium avium subsp. paratuberculosis
ggccacgcucgggccggcg

SEQ ID NO: 791699 - RNA, 22 nt, Mycobacterium avium subsp. paratuberculosis
ggccacgcucgggccggcgccg

SEQ ID NO: 791700 - RNA, 15 nt, Mycobacterium avium subsp. paratuberculosis
ggccaccucguccca

SEQ ID NO: 791701 - RNA, 15 nt, Mycobacterium avium subsp. paratuberculosis
ggccaccucgucggc

SEQ ID NO: 791702 - RNA, 20 nt, Mycobacterium avium subsp. paratuberculosis
ggccaccucgucggcgguca

SEQ ID NO: 791703 - RNA, 21 nt, Mycobacterium avium subsp. paratuberculosis
ggccaccuugcgcgggucgcc

SEQ ID NO: 791704 - RNA, 21 nt, Mycobacterium avium subsp. paratuberculosis
ggccaccuuggacaggcccag

SEQ ID NO: 791705 - RNA, 17 nt, Mycobacterium avium subsp. paratuberculosis
ggccagcggccagcccg

SEQ ID NO: 791706 - RNA, 23 nt, Mycobacterium avium subsp. paratuberculosis
ggccagcgggucgugcaucggcg

SEQ ID NO: 791707 - RNA, 13 nt, Mycobacterium avium subsp. paratuberculosis
ggccagcggguga

SEQ ID NO: 791708 - RNA, 14 nt, Mycobacterium avium subsp. paratuberculosis
ggccagcgucgcgc

SEQ ID NO: 791709 - RNA, 19 nt, Mycobacterium avium subsp. paratuberculosis
ggccagcgucgcgccgcca

SEQ ID NO: 791710 - RNA, 17 nt, Mycobacterium avium subsp. paratuberculosis
ggccagcgucuccggcg

SEQ ID NO: 791711 - RNA, 19 nt, Mycobacterium avium subsp. paratuberculosis
ggccagcgucuccggcggg

SEQ ID NO: 791712 - RNA, 20 nt, Mycobacterium avium subsp. paratuberculosis
ggccagcgucuccggcgggc

SEQ ID NO: 791713 - RNA, 18 nt, Mycobacterium avium subsp. paratuberculosis
ggccagcgugaacaccgc

SEQ ID NO: 791714 - RNA, 16 nt, Mycobacterium avium subsp. paratuberculosis
ggccagcucaccggcc

SEQ ID NO: 791715 - RNA, 14 nt, Mycobacterium avium subsp. paratuberculosis
ggccagcguggcgc

SEQ ID NO: 791716 - RNA, 17 nt, Mycobacterium avium subsp. paratuberculosis
ggccagcguggcgcgcc

SEQ ID NO: 791717 - RNA, 17 nt, Mycobacterium avium subsp. paratuberculosis
ggccagcguuuccagcg

SEQ ID NO: 791718 - RNA, 20 nt, Mycobacterium avium subsp. paratuberculosis
ggccagcguuuccagcgccg

SEQ ID NO: 791719 - RNA, 22 nt, Mycobacterium avium subsp. paratuberculosis
ggccagcguuuccagcgccggc

SEQ ID NO: 791720 - RNA, 15 nt, Mycobacterium avium subsp. paratuberculosis
ggccagcucggcgug

SEQ ID NO: 791721 - RNA, 17 nt, Mycobacterium avium subsp. paratuberculosis
ggccagcucggcguggu

SEQ ID NO: 791722 - RNA, 19 nt, Mycobacterium avium subsp. paratuberculosis
ggccagcucggcguggucg

SEQ ID NO: 791723 - RNA, 19 nt, Mycobacterium avium subsp. paratuberculosis
ggccagcucggucgcgguc

SEQ ID NO: 791724 - RNA, 22 nt, Mycobacterium avium subsp. paratuberculosis
ggccagcucggucgcggucggc

SEQ ID NO: 791725 - RNA, 23 nt, Mycobacterium avium subsp. paratuberculosis
ggccagcucggucgcggucggcg

SEQ ID NO: 791726 - RNA, 18 nt, Mycobacterium avium subsp. paratuberculosis
ggccagcucgucgagccg

SEQ ID NO: 791727 - RNA, 19 nt, Mycobacterium avium subsp. paratuberculosis
ggccagcucgucgagccgg

SEQ ID NO: 791728 - RNA, 21 nt, Mycobacterium avium subsp. paratuberculosis
ggccagcucgucgagccggcc

SEQ ID NO: 791729 - RNA, 22 nt, Mycobacterium avium subsp. paratuberculosis
ggccagcucgucgagccggccg

SEQ ID NO: 791730 - RNA, 24 nt, Mycobacterium avium subsp. paratuberculosis
ggccagcucgucgagccggccgga

SEQ ID NO: 791731 - RNA, 15 nt, Mycobacterium avium subsp. paratuberculosis
ggccagcucgucgcg

SEQ ID NO: 791732 - RNA, 22 nt, Mycobacterium avium subsp. paratuberculosis
ggccagcugauagccgcccugc

SEQ ID NO: 791733 - RNA, 16 nt, Mycobacterium avium subsp. paratuberculosis
ggccagcugcaccggg

SEQ ID NO: 791734 - RNA, 17 nt, Mycobacterium avium subsp. paratuberculosis
ggccagcugcaccgggg

SEQ ID NO: 791735 - RNA, 18 nt, Mycobacterium avium subsp. paratuberculosis
ggccagcugcaccggggc

SEQ ID NO: 791736 - RNA, 19 nt, Mycobacterium avium subsp. paratuberculosis
ggccagcucccgggcggcg

SEQ ID NO: 791737 - RNA, 20 nt, Mycobacterium avium subsp. paratuberculosis
ggccagcucccgggcggcgc

SEQ ID NO: 791738 - RNA, 15 nt, Mycobacterium avium subsp. paratuberculosis
ggccagcuccgccac

SEQ ID NO: 791739 - RNA, 20 nt, Mycobacterium avium subsp. paratuberculosis
ggccagcuccgccacccugc

SEQ ID NO: 791740 - RNA, 22 nt, Mycobacterium avium subsp. paratuberculosis
ggccagcuccgggucgaccgcc

SEQ ID NO: 791741 - RNA, 18 nt, Mycobacterium avium subsp. paratuberculosis
ggccagcuccucggggau

SEQ ID NO: 791742 - RNA, 17 nt, Mycobacterium avium subsp. paratuberculosis
ggccagcucgaacaccg

SEQ ID NO: 791743 - RNA, 20 nt, Mycobacterium avium subsp. paratuberculosis
ggccagcucgaacaccgucg

SEQ ID NO: 791744 - RNA, 22 nt, Mycobacterium avium subsp. paratuberculosis
ggccagcucgaacaccgucgag

SEQ ID NO: 791745 - RNA, 15 nt, Mycobacterium avium subsp. paratuberculosis
ggccagcucgaccgc

SEQ ID NO: 791746 - RNA, 16 nt, Mycobacterium avium subsp. paratuberculosis
ggccaggaacggcgcc

SEQ ID NO: 791747 - RNA, 17 nt, Mycobacterium avium subsp. paratuberculosis
ggccaggaacggcgcca

SEQ ID NO: 791748 - RNA, 16 nt, Mycobacterium avium subsp. paratuberculosis
ggccaggaagccggcg

SEQ ID NO: 791749 - RNA, 17 nt, Mycobacterium avium subsp. paratuberculosis
ggccaggaagccggcga

SEQ ID NO: 791750 - RNA, 18 nt, Mycobacterium avium subsp. paratuberculosis
ggccaggaagccggcgac

SEQ ID NO: 791751 - RNA, 22 nt, Mycobacterium avium subsp. paratuberculosis
ggccaggaaguccuuguucgcc

SEQ ID NO: 791752 - RNA, 22 nt, Mycobacterium avium subsp. paratuberculosis
ggccagcugcggguugcgggcc

SEQ ID NO: 791753 - RNA, 12 nt, Mycobacterium avium subsp. paratuberculosis
ggccaggaccgg

SEQ ID NO: 791754 - RNA, 14 nt, Mycobacterium avium subsp. paratuberculosis
ggccaggaccggga

SEQ ID NO: 791755 - RNA, 21 nt, Mycobacterium avium subsp. paratuberculosis
ggccaggaccgggacgacggc

SEQ ID NO: 791756 - RNA, 22 nt, Mycobacterium avium subsp. paratuberculosis
ggccaggaccgggacgacggcg

SEQ ID NO: 791757 - RNA, 18 nt, Mycobacterium avium subsp. paratuberculosis
ggccaggaucucgucggg

SEQ ID NO: 791758 - RNA, 19 nt, Mycobacterium avium subsp. paratuberculosis
ggccaggaucucgucggga

SEQ ID NO: 791759 - RNA, 19 nt, Mycobacterium avium subsp. paratuberculosis
ggccaggaucuugucggcg

SEQ ID NO: 791760 - RNA, 17 nt, Mycobacterium avium subsp. paratuberculosis
ggccaggaugaaccggg

SEQ ID NO: 791761 - RNA, 18 nt, Mycobacterium avium subsp. paratuberculosis
ggccaggaugaaccggga

SEQ ID NO: 791762 - RNA, 18 nt, Mycobacterium avium subsp. paratuberculosis
ggccagcugcccgccgac

SEQ ID NO: 791763 - RNA, 22 nt, Mycobacterium avium subsp. paratuberculosis
ggccagcugcccgccgacgccc

SEQ ID NO: 791764 - RNA, 17 nt, Mycobacterium avium subsp. paratuberculosis
ggccagcugcgacagca

SEQ ID NO: 791765 - RNA, 15 nt, Mycobacterium avium subsp. paratuberculosis
ggccagcucggccau

SEQ ID NO: 791766 - RNA, 17 nt, Mycobacterium avium subsp. paratuberculosis
ggccagcucggcccgcu

SEQ ID NO: 791767 - RNA, 19 nt, Mycobacterium avium subsp. paratuberculosis
ggccagcucggcccgcugc

SEQ ID NO: 791768 - RNA, 14 nt, Mycobacterium avium subsp. paratuberculosis
ggccagcucggcgg

SEQ ID NO: 791769 - RNA, 19 nt, Mycobacterium avium subsp. paratuberculosis
ggccagcucgagcaucacg

SEQ ID NO: 791770 - RNA, 14 nt, Mycobacterium avium subsp. paratuberculosis
ggccagcucgccgc

SEQ ID NO: 791771 - RNA, 15 nt, Mycobacterium avium subsp. paratuberculosis
ggccagcucgccgcc

SEQ ID NO: 791772 - RNA, 16 nt, Mycobacterium avium subsp. paratuberculosis
ggccagccacgccgac

SEQ ID NO: 791773 - RNA, 19 nt, Mycobacterium avium subsp. paratuberculosis
ggccagccagccgcccagc

SEQ ID NO: 791774 - RNA, 14 nt, Mycobacterium avium subsp. paratuberculosis
ggccagccaggucu

SEQ ID NO: 791775 - RNA, 19 nt, Mycobacterium avium subsp. paratuberculosis
ggccagcgccuucggcgcc

SEQ ID NO: 791776 - RNA, 22 nt, Mycobacterium avium subsp. paratuberculosis
ggccagcgccuucggcgccagc

SEQ ID NO: 791777 - RNA, 17 nt, Mycobacterium avium subsp. paratuberculosis
ggccagcgcgacgcgca

SEQ ID NO: 791778 - RNA, 16 nt, Mycobacterium avium subsp. paratuberculosis
ggccagcgccucggcg

SEQ ID NO: 791779 - RNA, 19 nt, Mycobacterium avium subsp. paratuberculosis
ggccagcgccucggcguca

SEQ ID NO: 791780 - RNA, 17 nt, Mycobacterium avium subsp. paratuberculosis
ggccagccccaccaccg

SEQ ID NO: 791781 - RNA, 20 nt, Mycobacterium avium subsp. paratuberculosis
ggccagccccaccaccgcca

SEQ ID NO: 791782 - RNA, 23 nt, Mycobacterium avium subsp. paratuberculosis
ggccagccccaccaccgccacca

SEQ ID NO: 791783 - RNA, 14 nt, Mycobacterium avium subsp. paratuberculosis
ggccagcgccguca

SEQ ID NO: 791784 - RNA, 23 nt, Mycobacterium avium subsp. paratuberculosis
ggccagcgccgucaucaccgccg

SEQ ID NO: 791785 - RNA, 18 nt, Mycobacterium avium subsp. paratuberculosis
ggccagcgccuccagccg

SEQ ID NO: 791786 - RNA, 15 nt, Mycobacterium avium subsp. paratuberculosis
ggccagcgccucggc

SEQ ID NO: 791787 - RNA, 13 nt, Mycobacterium avium subsp. paratuberculosis
ggccagcaucucg

SEQ ID NO: 791788 - RNA, 19 nt, Mycobacterium avium subsp. paratuberculosis
ggccagcaucucggcgaag

SEQ ID NO: 791789 - RNA, 20 nt, Mycobacterium avium subsp. paratuberculosis
ggccagcaucucggcgaagg

SEQ ID NO: 791790 - RNA, 15 nt, Mycobacterium avium subsp. paratuberculosis
ggccagcaguucguc

SEQ ID NO: 791791 - RNA, 16 nt, Mycobacterium avium subsp. paratuberculosis
ggccagcagcaccgcg

SEQ ID NO: 791792 - RNA, 23 nt, Mycobacterium avium subsp. paratuberculosis
ggccagcagcagcaggucgucga

SEQ ID NO: 791793 - RNA, 12 nt, Mycobacterium avium subsp. paratuberculosis
ggccagcagcca

SEQ ID NO: 791794 - RNA, 23 nt, Mycobacterium avium subsp. paratuberculosis
ggccagcaggucgaaggcggccg

SEQ ID NO: 791795 - RNA, 20 nt, Mycobacterium avium subsp. paratuberculosis
ggccagcaggucgucgacgu

SEQ ID NO: 791796 - RNA, 21 nt, Mycobacterium avium subsp. paratuberculosis
ggccagcaggucgucgacguc

SEQ ID NO: 791797 - RNA, 23 nt, Mycobacterium avium subsp. paratuberculosis
ggccagcaggucgucgacguccu

SEQ ID NO: 791798 - RNA, 20 nt, Mycobacterium avium subsp. paratuberculosis
ggccagcagucgugacgcgg

SEQ ID NO: 791799 - RNA, 23 nt, Mycobacterium avium subsp. paratuberculosis
ggccagcagucgugacgcggcgu

SEQ ID NO: 791800 - RNA, 22 nt, Mycobacterium avium subsp. paratuberculosis
ggccagcagugccaacacggcg

SEQ ID NO: 791801 - RNA, 23 nt, Mycobacterium avium subsp. paratuberculosis
ggccagcagugccaacacggcgg

SEQ ID NO: 791802 - RNA, 15 nt, Mycobacterium avium subsp. paratuberculosis
ggccagcagugccac

SEQ ID NO: 791803 - RNA, 14 nt, Mycobacterium avium subsp. paratuberculosis
ggccagcggcgccg

SEQ ID NO: 791804 - RNA, 16 nt, Mycobacterium avium subsp. paratuberculosis
ggccagcggcgccgaa

SEQ ID NO: 791805 - RNA, 15 nt, Mycobacterium avium subsp. paratuberculosis
ggccagcggcgccgg

SEQ ID NO: 791806 - RNA, 23 nt, Mycobacterium avium subsp. paratuberculosis
ggccagcggcaacugggcggccu

SEQ ID NO: 791807 - RNA, 17 nt, Mycobacterium avium subsp. paratuberculosis
ggccagcggcagcgaca

SEQ ID NO: 791808 - RNA, 17 nt, Mycobacterium avium subsp. paratuberculosis
ggccagcggcagcggcg

SEQ ID NO: 791809 - RNA, 19 nt, Mycobacterium avium subsp. paratuberculosis
ggccagcggcagcggcguc

SEQ ID NO: 791810 - RNA, 17 nt, Mycobacterium avium subsp. paratuberculosis
ggccagcgcgucgcaca

SEQ ID NO: 791811 - RNA, 16 nt, Mycobacterium avium subsp. paratuberculosis
ggccagcgcggcguca

SEQ ID NO: 791812 - RNA, 23 nt, Mycobacterium avium subsp. paratuberculosis
ggccagcgcggcgucacccugga

SEQ ID NO: 791813 - RNA, 15 nt, Mycobacterium avium subsp. paratuberculosis
ggccagcgcgucggc

SEQ ID NO: 791814 - RNA, 16 nt, Mycobacterium avium subsp. paratuberculosis
ggccagcgcgucggcc

SEQ ID NO: 791815 - RNA, 16 nt, Mycobacterium avium subsp. paratuberculosis
ggccagcgcgugaucg

SEQ ID NO: 791816 - RNA, 23 nt, Mycobacterium avium subsp. paratuberculosis
ggccagcgcgugaugggugggca

SEQ ID NO: 791817 - RNA, 15 nt, Mycobacterium avium subsp. paratuberculosis
ggccagcgcggcggu

SEQ ID NO: 791818 - RNA, 17 nt, Mycobacterium avium subsp. paratuberculosis
ggccagcgcggcggucg

SEQ ID NO: 791819 - RNA, 22 nt, Mycobacterium avium subsp. paratuberculosis
ggccagcgcggcggucgcgcgc

SEQ ID NO: 791820 - RNA, 15 nt, Mycobacterium avium subsp. paratuberculosis
ggccagcgcggcguc

SEQ ID NO: 791821 - RNA, 13 nt, Mycobacterium avium subsp. paratuberculosis
ggccagcgcggug

SEQ ID NO: 791822 - RNA, 14 nt, Mycobacterium avium subsp. paratuberculosis
ggccagcgcggccg

SEQ ID NO: 791823 - RNA, 16 nt, Mycobacterium avium subsp. paratuberculosis
ggccagcgcggccggg

SEQ ID NO: 791824 - RNA, 19 nt, Mycobacterium avium subsp. paratuberculosis
ggccagcgcggccgggcgc

SEQ ID NO: 791825 - RNA, 13 nt, Mycobacterium avium subsp. paratuberculosis
ggccagcgcggcg

SEQ ID NO: 791826 - RNA, 21 nt, Mycobacterium avium subsp. paratuberculosis
ggccagcgcgcgggcgcgcgc

SEQ ID NO: 791827 - RNA, 16 nt, Mycobacterium avium subsp. paratuberculosis
ggccagcgcgcgcagc

SEQ ID NO: 791828 - RNA, 17 nt, Mycobacterium avium subsp. paratuberculosis
ggccagcgcgccgccga

SEQ ID NO: 791829 - RNA, 15 nt, Mycobacterium avium subsp. paratuberculosis
ggccagcgcgccgcc

SEQ ID NO: 791830 - RNA, 12 nt, Mycobacterium avium subsp. paratuberculosis
ggccagcgcgcc

SEQ ID NO: 791831 - RNA, 14 nt, Mycobacterium avium subsp. paratuberculosis
ggccagcgcgccgc

SEQ ID NO: 791832 - RNA, 20 nt, Mycobacterium avium subsp. paratuberculosis
ggccagcgcgccgcacagcc

SEQ ID NO: 791833 - RNA, 15 nt, Mycobacterium avium subsp. paratuberculosis
ggccagcgcgacggc

SEQ ID NO: 791834 - RNA, 17 nt, Mycobacterium avium subsp. paratuberculosis
ggccagcgcgacggccu

SEQ ID NO: 791835 - RNA, 19 nt, Mycobacterium avium subsp. paratuberculosis
ggccagcgcgacggccucg

SEQ ID NO: 791836 - RNA, 17 nt, Mycobacterium avium subsp. paratuberculosis
ggccagcgcgaucgccg

SEQ ID NO: 791837 - RNA, 15 nt, Mycobacterium avium subsp. paratuberculosis
ggcccaucgcgguca

SEQ ID NO: 791838 - RNA, 20 nt, Mycobacterium avium subsp. paratuberculosis
ggcccaucgcggucagcguc

SEQ ID NO: 791839 - RNA, 21 nt, Mycobacterium avium subsp. paratuberculosis
ggcccaucgcggucagcgucu

SEQ ID NO: 791840 - RNA, 21 nt, Mycobacterium avium subsp. paratuberculosis
ggcccaguucgcaccccaccg

SEQ ID NO: 791841 - RNA, 15 nt, Mycobacterium avium subsp. paratuberculosis
ggcccaucaccagcg

SEQ ID NO: 791842 - RNA, 23 nt, Mycobacterium avium subsp. paratuberculosis
ggcccaucaccggaccggccagc

SEQ ID NO: 791843 - RNA, 12 nt, Mycobacterium avium subsp. paratuberculosis
ggccccacccgc

SEQ ID NO: 791844 - RNA, 16 nt, Mycobacterium avium subsp. paratuberculosis
ggccccaacggcgugc

SEQ ID NO: 791845 - RNA, 12 nt, Mycobacterium avium subsp. paratuberculosis
ggccccgccagc

SEQ ID NO: 791846 - RNA, 15 nt, Mycobacterium avium subsp. paratuberculosis
ggcccauggcgaaca

SEQ ID NO: 791847 - RNA, 12 nt, Mycobacterium avium subsp. paratuberculosis
ggcccgcgcggc

SEQ ID NO: 791848 - RNA, 13 nt, Mycobacterium avium subsp. paratuberculosis
ggcccgcaccacc

SEQ ID NO: 791849 - RNA, 14 nt, Mycobacterium avium subsp. paratuberculosis
ggcccgcaccaccc

SEQ ID NO: 791850 - RNA, 18 nt, Mycobacterium avium subsp. paratuberculosis
ggcccgcaccacccagcc

SEQ ID NO: 791851 - RNA, 19 nt, Mycobacterium avium subsp. paratuberculosis
ggcccgcacccgccgcccg

SEQ ID NO: 791852 - RNA, 21 nt, Mycobacterium avium subsp. paratuberculosis
ggcccgauagcuugagccccg

SEQ ID NO: 791853 - RNA, 13 nt, Mycobacterium avium subsp. paratuberculosis
ggcccgaucacca

SEQ ID NO: 791854 - RNA, 14 nt, Mycobacterium avium subsp. paratuberculosis
ggcccgaucaccag

SEQ ID NO: 791855 - RNA, 16 nt, Mycobacterium avium subsp. paratuberculosis
ggcccgaucaccgccg

SEQ ID NO: 791856 - RNA, 23 nt, Mycobacterium avium subsp. paratuberculosis
ggcccgaucaggguccagggcgg

SEQ ID NO: 791857 - RNA, 18 nt, Mycobacterium avium subsp. paratuberculosis
ggcccgagguccucgcgc

SEQ ID NO: 791858 - RNA, 13 nt, Mycobacterium avium subsp. paratuberculosis
ggcccgaucgcgg

SEQ ID NO: 791859 - RNA, 19 nt, Mycobacterium avium subsp. paratuberculosis
ggcccgaucgcggcgagcu

SEQ ID NO: 791860 - RNA, 13 nt, Mycobacterium avium subsp. paratuberculosis
ggcccgaucgcgu

SEQ ID NO: 791861 - RNA, 15 nt, Mycobacterium avium subsp. paratuberculosis
ggcccgaucgcgucg

SEQ ID NO: 791862 - RNA, 15 nt, Mycobacterium avium subsp. paratuberculosis
ggcccgaucucgcgc

SEQ ID NO: 791863 - RNA, 18 nt, Mycobacterium avium subsp. paratuberculosis
ggcccgaugcggaccggg

SEQ ID NO: 791864 - RNA, 20 nt, Mycobacterium avium subsp. paratuberculosis
ggcccgauggcggccugcag

SEQ ID NO: 791865 - RNA, 16 nt, Mycobacterium avium subsp. paratuberculosis
ggccccggccgagccg

SEQ ID NO: 791866 - RNA, 20 nt, Mycobacterium avium subsp. paratuberculosis
ggccccggccgagcgcagcg

SEQ ID NO: 791867 - RNA, 13 nt, Mycobacterium avium subsp. paratuberculosis
ggccccggccggc

SEQ ID NO: 791868 - RNA, 17 nt, Mycobacterium avium subsp. paratuberculosis
ggcccgacgacgccguc

SEQ ID NO: 791869 - RNA, 17 nt, Mycobacterium avium subsp. paratuberculosis
ggcccgagcccgacggc

SEQ ID NO: 791870 - RNA, 21 nt, Mycobacterium avium subsp. paratuberculosis
ggcccgagcccgacggcagca

SEQ ID NO: 791871 - RNA, 20 nt, Mycobacterium avium subsp. paratuberculosis
ggcccgagcccugcgccagc

SEQ ID NO: 791872 - RNA, 16 nt, Mycobacterium avium subsp. paratuberculosis
ggcccgagcaccacca

SEQ ID NO: 791873 - RNA, 18 nt, Mycobacterium avium subsp. paratuberculosis
ggccccgcgugacggccg

SEQ ID NO: 791874 - RNA, 20 nt, Mycobacterium avium subsp. paratuberculosis
ggccccgcgugacggccgcg

SEQ ID NO: 791875 - RNA, 21 nt, Mycobacterium avium subsp. paratuberculosis
ggccccgcugccguccggcgg

SEQ ID NO: 791876 - RNA, 17 nt, Mycobacterium avium subsp. paratuberculosis
ggccccggauccgucgc

SEQ ID NO: 791877 - RNA, 16 nt, Mycobacterium avium subsp. paratuberculosis
ggccccggcaucgaca

SEQ ID NO: 791878 - RNA, 14 nt, Mycobacterium avium subsp. paratuberculosis
ggcccaggucguga

SEQ ID NO: 791879 - RNA, 13 nt, Mycobacterium avium subsp. paratuberculosis
ggccaggcgccca

SEQ ID NO: 791880 - RNA, 17 nt, Mycobacterium avium subsp. paratuberculosis
ggcccaguccagucgcg

SEQ ID NO: 791881 - RNA, 24 nt, Mycobacterium avium subsp. paratuberculosis
ggcccaguccagucgcgccgaggu

SEQ ID NO: 791882 - RNA, 23 nt, Mycobacterium avium subsp. paratuberculosis
ggcccaggcaguagccgaucucc

SEQ ID NO: 791883 - RNA, 22 nt, Mycobacterium avium subsp. paratuberculosis
ggcccaggccgacgccggccac

SEQ ID NO: 791884 - RNA, 12 nt, Mycobacterium avium subsp. paratuberculosis
ggcccaggccgg

SEQ ID NO: 791885 - RNA, 20 nt, Mycobacterium avium subsp. paratuberculosis
ggcccagcucggugcgcaug

SEQ ID NO: 791886 - RNA, 20 nt, Mycobacterium avium subsp. paratuberculosis
ggcccagcucguugccggcg

SEQ ID NO: 791887 - RNA, 14 nt, Mycobacterium avium subsp. paratuberculosis
ggcccagcugcugg

SEQ ID NO: 791888 - RNA, 23 nt, Mycobacterium avium subsp. paratuberculosis
ggcccagcgucaacucgucggcg

SEQ ID NO: 791889 - RNA, 22 nt, Mycobacterium avium subsp. paratuberculosis
ggcccagcggaucgagguagcg

SEQ ID NO: 791890 - RNA, 21 nt, Mycobacterium avium subsp. paratuberculosis
ggcccagcgcgguguacagcg

SEQ ID NO: 791891 - RNA, 14 nt, Mycobacterium avium subsp. paratuberculosis
ggcccagcgaggcg

SEQ ID NO: 791892 - RNA, 18 nt, Mycobacterium avium subsp. paratuberculosis
ggcccagcgaggcggcca

SEQ ID NO: 791893 - RNA, 21 nt, Mycobacterium avium subsp. paratuberculosis
ggccaggcgggugaucccgau

SEQ ID NO: 791894 - RNA, 16 nt, Mycobacterium avium subsp. paratuberculosis
ggcccagccggucgcc

SEQ ID NO: 791895 - RNA, 14 nt, Mycobacterium avium subsp. paratuberculosis
ggcccagccggugc

SEQ ID NO: 791896 - RNA, 11 nt, Mycobacterium avium subsp. paratuberculosis
ggccaggcggg

SEQ ID NO: 791897 - RNA, 14 nt, Mycobacterium avium subsp. paratuberculosis
ggccaggcgggacg

SEQ ID NO: 791898 - RNA, 17 nt, Mycobacterium avium subsp. paratuberculosis
ggccaggcgggacguug

SEQ ID NO: 791899 - RNA, 18 nt, Mycobacterium avium subsp. paratuberculosis
ggccaggcgggacguugu

SEQ ID NO: 791900 - RNA, 12 nt, Mycobacterium avium subsp. paratuberculosis
ggccaggcgggc

SEQ ID NO: 791901 - RNA, 14 nt, Mycobacterium avium subsp. paratuberculosis
ggccaggcgggcca

SEQ ID NO: 791902 - RNA, 15 nt, Mycobacterium avium subsp. paratuberculosis
ggccaggccggcgac

SEQ ID NO: 791903 - RNA, 16 nt, Mycobacterium avium subsp. paratuberculosis
ggccaggcccagcccg

SEQ ID NO: 791904 - RNA, 22 nt, Mycobacterium avium subsp. paratuberculosis
ggccaggcccagcccggcccca

SEQ ID NO: 791905 - RNA, 17 nt, Mycobacterium avium subsp. paratuberculosis
ggccaggcccaccgucg

SEQ ID NO: 791906 - RNA, 17 nt, Mycobacterium avium subsp. paratuberculosis
ggccaggcacggcccgu

SEQ ID NO: 791907 - RNA, 23 nt, Mycobacterium avium subsp. paratuberculosis
ggccaggauguucaccccggcgc

SEQ ID NO: 791908 - RNA, 15 nt, Mycobacterium avium subsp. paratuberculosis
ggccaggaugaccgc

SEQ ID NO: 791909 - RNA, 20 nt, Mycobacterium avium subsp. paratuberculosis
ggccaggaugaccgcccagg

SEQ ID NO: 791910 - RNA, 15 nt, Mycobacterium avium subsp. paratuberculosis
ggccaggaugccgaa

SEQ ID NO: 791911 - RNA, 19 nt, Mycobacterium avium subsp. paratuberculosis
ggccaggaugccgaacgcg

SEQ ID NO: 791912 - RNA, 24 nt, Mycobacterium avium subsp. paratuberculosis
ggccaggaugccgaacgcgaucca

SEQ ID NO: 791913 - RNA, 21 nt, Mycobacterium avium subsp. paratuberculosis
ggcccuguucgccgucgcggg

SEQ ID NO: 791914 - RNA, 19 nt, Mycobacterium avium subsp. paratuberculosis
ggcccuugccccaccaccg

SEQ ID NO: 791915 - RNA, 22 nt, Mycobacterium avium subsp. paratuberculosis
ggcccuugccccaccaccgccg

SEQ ID NO: 791916 - RNA, 18 nt, Mycobacterium avium subsp. paratuberculosis
ggccgaaacgcccggcuc

SEQ ID NO: 791917 - RNA, 18 nt, Mycobacterium avium subsp. paratuberculosis
ggccgaaaaaccugcggu

SEQ ID NO: 791918 - RNA, 20 nt, Mycobacterium avium subsp. paratuberculosis
ggccgaaaaaccugcggugc

SEQ ID NO: 791919 - RNA, 21 nt, Mycobacterium avium subsp. paratuberculosis
ggccgaaaaaccugcggugcc

SEQ ID NO: 791920 - RNA, 22 nt, Mycobacterium avium subsp. paratuberculosis
ggccgaaaaaccugcggugcca

SEQ ID NO: 791921 - RNA, 14 nt, Mycobacterium avium subsp. paratuberculosis
ggccgaacggcaug

SEQ ID NO: 791922 - RNA, 17 nt, Mycobacterium avium subsp. paratuberculosis
ggccgaaccgcucgucg

SEQ ID NO: 791923 - RNA, 20 nt, Mycobacterium avium subsp. paratuberculosis
ggccgaaccgcucgucggga

SEQ ID NO: 791924 - RNA, 14 nt, Mycobacterium avium subsp. paratuberculosis
ggccgaaccggaag

SEQ ID NO: 791925 - RNA, 15 nt, Mycobacterium avium subsp. paratuberculosis
ggccgaacaccguca

SEQ ID NO: 791926 - RNA, 20 nt, Mycobacterium avium subsp. paratuberculosis
ggccgaacaccgucaucgug

SEQ ID NO: 791927 - RNA, 14 nt, Mycobacterium avium subsp. paratuberculosis
ggcccuugaccgcc

SEQ ID NO: 791928 - RNA, 21 nt, Mycobacterium avium subsp. paratuberculosis
ggccgaaaucaacgcgccgaa

SEQ ID NO: 791929 - RNA, 22 nt, Mycobacterium avium subsp. paratuberculosis
ggccgaaaucaacgcgccgaac

SEQ ID NO: 791930 - RNA, 15 nt, Mycobacterium avium subsp. paratuberculosis
ggccgaacagcagcg

SEQ ID NO: 791931 - RNA, 22 nt, Mycobacterium avium subsp. paratuberculosis
ggccgacaacgacagcacccag

SEQ ID NO: 791932 - RNA, 18 nt, Mycobacterium avium subsp. paratuberculosis
ggccgaccccgaugcgcu

SEQ ID NO: 791933 - RNA, 14 nt, Mycobacterium avium subsp. paratuberculosis
ggccgacccggccg

SEQ ID NO: 791934 - RNA, 22 nt, Mycobacterium avium subsp. paratuberculosis
ggccgaccgacaguucggcgcg

SEQ ID NO: 791935 - RNA, 17 nt, Mycobacterium avium subsp. paratuberculosis
ggccgaccuggcggccg

SEQ ID NO: 791936 - RNA, 12 nt, Mycobacterium avium subsp. paratuberculosis
ggccgaccgccg

SEQ ID NO: 791937 - RNA, 13 nt, Mycobacterium avium subsp. paratuberculosis
ggccgaccgccgc

SEQ ID NO: 791938 - RNA, 14 nt, Mycobacterium avium subsp. paratuberculosis
ggccgaccgccgcc

SEQ ID NO: 791939 - RNA, 18 nt, Mycobacterium avium subsp. paratuberculosis
ggccgaccgccucgaugg

SEQ ID NO: 791940 - RNA, 16 nt, Mycobacterium avium subsp. paratuberculosis
ggccgaccggucucga

SEQ ID NO: 791941 - RNA, 22 nt, Mycobacterium avium subsp. paratuberculosis
ggccgaccggucucgaccgcgg

SEQ ID NO: 791942 - RNA, 18 nt, Mycobacterium avium subsp. paratuberculosis
ggccgaauccggccggag

SEQ ID NO: 791943 - RNA, 14 nt, Mycobacterium avium subsp. paratuberculosis
ggccgaaccgcagc

SEQ ID NO: 791944 - RNA, 15 nt, Mycobacterium avium subsp. paratuberculosis
ggccgaaggcggcgc

SEQ ID NO: 791945 - RNA, 19 nt, Mycobacterium avium subsp. paratuberculosis
ggccgaagcguuccgccgu

SEQ ID NO: 791946 - RNA, 20 nt, Mycobacterium avium subsp. paratuberculosis
ggccgaagaacgacuggcgg

SEQ ID NO: 791947 - RNA, 21 nt, Mycobacterium avium subsp. paratuberculosis
ggccgaagaacgacuggcggc

SEQ ID NO: 791948 - RNA, 18 nt, Mycobacterium avium subsp. paratuberculosis
ggccgaagaacucagccg

SEQ ID NO: 791949 - RNA, 13 nt, Mycobacterium avium subsp. paratuberculosis
ggccgaagacgau

SEQ ID NO: 791950 - RNA, 14 nt, Mycobacterium avium subsp. paratuberculosis
ggccgaagccgaca

SEQ ID NO: 791951 - RNA, 15 nt, Mycobacterium avium subsp. paratuberculosis
ggccgaagccgacac

SEQ ID NO: 791952 - RNA, 17 nt, Mycobacterium avium subsp. paratuberculosis
ggccgaagccgacaccg

SEQ ID NO: 791953 - RNA, 23 nt, Mycobacterium avium subsp. paratuberculosis
ggccgaagccgacaccggguccc

SEQ ID NO: 791954 - RNA, 21 nt, Mycobacterium avium subsp. paratuberculosis
ggcccuggcaggugagccggg

SEQ ID NO: 791955 - RNA, 14 nt, Mycobacterium avium subsp. paratuberculosis
ggcccugcucgucg

SEQ ID NO: 791956 - RNA, 17 nt, Mycobacterium avium subsp. paratuberculosis
ggcccugcucgucguug

SEQ ID NO: 791957 - RNA, 18 nt, Mycobacterium avium subsp. paratuberculosis
ggcccugccagcgcccgc

SEQ ID NO: 791958 - RNA, 16 nt, Mycobacterium avium subsp. paratuberculosis
ggcccugcagcgccuu

SEQ ID NO: 791959 - RNA, 23 nt, Mycobacterium avium subsp. paratuberculosis
ggcccugcagcgccuugaccgcg

SEQ ID NO: 791960 - RNA, 15 nt, Mycobacterium avium subsp. paratuberculosis
ggcccugcgcggccu

SEQ ID NO: 791961 - RNA, 14 nt, Mycobacterium avium subsp. paratuberculosis
ggcccggucgucga

SEQ ID NO: 791962 - RNA, 21 nt, Mycobacterium avium subsp. paratuberculosis
ggcccgguacagcgccgcggc

SEQ ID NO: 791963 - RNA, 18 nt, Mycobacterium avium subsp. paratuberculosis
ggcccgguacaucgacgc

SEQ ID NO: 791964 - RNA, 14 nt, Mycobacterium avium subsp. paratuberculosis
ggcccgggcugccc

SEQ ID NO: 791965 - RNA, 21 nt, Mycobacterium avium subsp. paratuberculosis
ggcccggggacacccucgggg

SEQ ID NO: 791966 - RNA, 22 nt, Mycobacterium avium subsp. paratuberculosis
ggcccggggacacccucggggu

SEQ ID NO: 791967 - RNA, 18 nt, Mycobacterium avium subsp. paratuberculosis
ggcccgggccggaggugc

SEQ ID NO: 791968 - RNA, 18 nt, Mycobacterium avium subsp. paratuberculosis
ggcccgggguggauccgu

SEQ ID NO: 791969 - RNA, 21 nt, Mycobacterium avium subsp. paratuberculosis
ggcccgggguggauccgucgc

SEQ ID NO: 791970 - RNA, 14 nt, Mycobacterium avium subsp. paratuberculosis
ggcccgggcgcuga

SEQ ID NO: 791971 - RNA, 21 nt, Mycobacterium avium subsp. paratuberculosis
ggcccgggcgauucgucgucg

SEQ ID NO: 791972 - RNA, 16 nt, Mycobacterium avium subsp. paratuberculosis
ggcccgggccacaccc

SEQ ID NO: 791973 - RNA, 20 nt, Mycobacterium avium subsp. paratuberculosis
ggcccggcgggucagcaccg

SEQ ID NO: 791974 - RNA, 18 nt, Mycobacterium avium subsp. paratuberculosis
ggcccggcgugggccgca

SEQ ID NO: 791975 - RNA, 11 nt, Mycobacterium avium subsp. paratuberculosis
ggcccggcguc

SEQ ID NO: 791976 - RNA, 12 nt, Mycobacterium avium subsp. paratuberculosis
ggcccggcgucg

SEQ ID NO: 791977 - RNA, 17 nt, Mycobacterium avium subsp. paratuberculosis
ggcccgcugcagcgccg

SEQ ID NO: 791978 - RNA, 15 nt, Mycobacterium avium subsp. paratuberculosis
ggcccgcugcgccga

SEQ ID NO: 791979 - RNA, 16 nt, Mycobacterium avium subsp. paratuberculosis
ggcccgcugcgccgac

SEQ ID NO: 791980 - RNA, 14 nt, Mycobacterium avium subsp. paratuberculosis
ggcccgcugcgcgg

SEQ ID NO: 791981 - RNA, 20 nt, Mycobacterium avium subsp. paratuberculosis
ggcccgcuucaggcagcgca

SEQ ID NO: 791982 - RNA, 22 nt, Mycobacterium avium subsp. paratuberculosis
ggcccgcuucaggcagcgcacg

SEQ ID NO: 791983 - RNA, 19 nt, Mycobacterium avium subsp. paratuberculosis
ggcccgcuugccgacguga

SEQ ID NO: 791984 - RNA, 23 nt, Mycobacterium avium subsp. paratuberculosis
ggcccgcggcggauccagcaccg

SEQ ID NO: 791985 - RNA, 21 nt, Mycobacterium avium subsp. paratuberculosis
ggcccgcucaccugcggcccg

SEQ ID NO: 791986 - RNA, 22 nt, Mycobacterium avium subsp. paratuberculosis
ggcccgcucaccugcggcccgu

SEQ ID NO: 791987 - RNA, 14 nt, Mycobacterium avium subsp. paratuberculosis
ggcccgcucgaugu

SEQ ID NO: 791988 - RNA, 16 nt, Mycobacterium avium subsp. paratuberculosis
ggcccgcucgaugucg

SEQ ID NO: 791989 - RNA, 19 nt, Mycobacterium avium subsp. paratuberculosis
ggcccgcucgaugucggug

SEQ ID NO: 791990 - RNA, 12 nt, Mycobacterium avium subsp. paratuberculosis
ggcccgcucggc

SEQ ID NO: 791991 - RNA, 13 nt, Mycobacterium avium subsp. paratuberculosis
ggcccgcucggcg

SEQ ID NO: 791992 - RNA, 14 nt, Mycobacterium avium subsp. paratuberculosis
ggcccgcucggcgg

SEQ ID NO: 791993 - RNA, 15 nt, Mycobacterium avium subsp. paratuberculosis
ggcccgcucggcggg
